United States Patent 9,920,329 (ISOLATED POLYNUCLEOTIDES AND POLYPEPTIDES, AND METHODS OF USING SAME FOR INCREASING PLANT YIELD AND/OR AGRICULTURAL CHARACTERISTICS) - sequence listing, part 3

SEQ ID NO: 3231 - DNA, 1530 bp, Zostera marina
ttaccagaggaactggaacacacatcgactgtcgcctcgggtgcaagatggaagatgctgatatggaggattacggattcgagtactccgaagaggagcaggaggagcaggacgttgacgttgagaatcagtattataattcaaagggtttgcttgaaactgatcctgaaggagctctttctgggttttctgaagtaattcagatggaacctgagaaagcggaatggggatttaaagctttgaagcagaccgtcaagctttattaccgccttggaaaatacaaggagatgatggaaacatatcgtgtgatgctgacatacatcaaatcggctgtaactagaaattacagtgaaaaatgtataaataacatcatggactttgtttctggatctgcaagtcagaattttgatcttttacaagaattctatcaaaccactctcaaggttcttgaagaagcgaagaatgagcggttgtggttcaagacaaacctaaagctttgtaaaatttggtttgacatgcgtgaatatggtagaatgaacaagatattgaaggagcttcacaaatcatgtcaaaaagatgatgggactgatgatcagaaaaaaggaacacagcttctggaggtgtatgctattgagattcaaatgcacactgaaacaaagaataacaaaaaactaaagtctttgtaccagaaggcacttacaattaagtcagctatacctcatccccgaattatgggaataattcatgaatgcggtggtaaaatgcatatggctgaaaggcattggaggcaggctgctactgatttctttgaagcttttaaaaactacgatgaagctggaaatcatcgccgtattcaatgtttgaaatacttggttcttgctaacatgctaatggggtctcaagtcaatccttttgacggtcaagaagctaaaccctataaaaatgatccagaaattttagcaatgacaaatttggtggctgcatatcaacggaatgagattatagagtttgagaagattttgaggagtaacagaaggacaataatggatgatctatttattcgcaactatatagaggatctcctaaagaatgtcaggacacaggttcttctgaaactcattaagccttacacaaggatcagaattccttttatagcaaaggaactaaatgtgcaagaggaagaagttatacagcttttggtctccttaatccttggtgcctctatagatgggcatatcgatcaagtgaacggaatcttagaatgtggtgacaagtccaagggatcaaagaaatacactgctgttgataagtggaaccgccaactgaattctctctacattgcaattgcaagtagagtatgctgattatatagatggcttttactatggttttttggttatctttctatttcaacattccagatcagtagagtagcatccaagagtgagtgaaatattatgtggtttgtacaattttaaaaacagagtgaaattctttttatacaataatgttcatatcttgagcctttct

SEQ ID NO: 3232 - DNA, 1412 bp, Brassica napus
agatgctgatatggaggactacggattcgagtactcagacgaggaaccggaggagcaagacgtcgacatcgagaaccagtactacaactccaaaggcaatattgagacggagcccgaggaggcgctttccgggttcgccgaggttgttaggatggagcctgacaaggctgagtggggattcaaagctctgaagcagacggtgaagatctactaccgtctaggcaaatacagagagatgatggatgcgtatagagagatgcttacgtacatcaagtcggctgtgactaggaactacagcgagaagtgtattaacagtattatggatttcgtctctggatctgctggccagaacactggcctgcttcaggagttttaccagaccaccttgactgctcttgaggaggctaagaatgagagactctggttcaagacgaatctcaagctctgtaacatctggtttgacattggtgaatacagacggatgactaagattttgaaggaactgcataagtcttgtcaaaaggaagatgggacggatgatcagaagaaaggaagtcagctgcttgaggtttatgcgattgagattcagatttacactgaaactaaggacaacaagaagcttaagcaactgtaccagaaagcacttgctatcaaatctgctattcctcatcctaggatcatgggtattatccgcgagtgtggtggcaaaatgcacatggcggaacgtcagtgggcagaagctgccactgacttctttgaggctttcaaaaactatgatgaagctggcaaccaaaggcgtattcagtgcttaaagtatcttgttcttgcgaatatgctgatggaatcagaagtgaatccattcgacggtcaagaggcaaaaccgtacaaaaacgaccctgagatcttggcaatgacgaatctggtagcagcgtatcaacggaacgaaatcatagagtttgagaaaatactcaagaataaccggaagacgataatggacgatccattcatcagaaactacatggaagatctgctgaagaaggtgaggacacaggtgttgctgaagctgataaagccgtacacgaagatcgggattcctttcatatcaaaggagctgaacgtgccagagaaggatgtaacggagttgctggtgtcgctgatactggacagccgaatcgatggacacattgatgagattaaccgttacttgctgagaggtgacagtgctaatggaaggaaacttcacaaggcggttgataaatggaacacacaactcaagtctctttcgatcagtatcaccaaccgagtctgttaatttacatccacctctcatcttttcgatagctttgacatttttcttgtttctacccatttgtggattacttttcttttctctgcgctgaattttctccttt

SEQ ID NO: 3233 - DNA, 1518 bp, Malus domestica
atgaggaaaacgaaccctctttctcctcgatctcctctctgctctgatttcagtagctgccgaatcctgaacgctttgaaaacccaaattccatctcggttctgatcagtcatgggctccgatgctgatatggaggattacggattcgagtattcggatgaggagcctgaggaacaagatgtcgacattgagaaccaatattacaactctaaagacgttaatatgagttaggattcagtgagaaatcagcataatcttgagtgtctgggcgagaaggagaagtgagctccttattgattgtatcaatccgctggttggtggtaatctacagtttgaaggtgaagagtttttttttttttcactgttaggagggttggagaggggatttaaagctttgaagcaaaccgtgaagctctattatcgtctggggaggtataaagaaatgatggatgcatacagggtgatgttgacttacatcaaatcagcagtaacaagaaattacagtgaaaagtgtataaacaatattatggattttgtttctggttcagctagtcagaactttagtctactgcaagagttctatcagaccactctaaaggcccttgaagaggcaaagaatgagagactctggtttaagactaatcttaagctttgcaaaatttggtttgatatgggcgaatatgggcgaatgagcaagattttgaaggaactccataaatcttgtcaaaaagaagatggtaccgatgaccaaaagaagggaagtcaacttctagaggtttatgctattgaaattcaaatgtacaccgagactaaaaataacaaaaagctcaagcaattataccaaaaagctcttgcaatcaagtcagccatacctcatcctaggatcatgggaataattcgagagtgtgggggtaagatgcatatggcagagcgtcagtgggcagatgcagccacagatttttttgaagcctttaagaactatgatgaagctgggaaccagaggcgtatacaatgcttaaagtacttggttctggcaaatatgctgatggagtcggaagttaatccatttgatggtcaagaagcaaagccgtataaaaatgatcccgagatcttggcaatgacaaatctgattgcagcatatcaacggaatgagatattggagtttgagaagattcttaagagtaataggaggacaattatggatgatccattcattcgaaactatattgaagatctgctgaagaatgttaggacacaagtgctgctcaaacttatgaagccgtacacgagaattcggttcccttcatatcaaaggaacttaatgtgccggagaaagatgtggagcaactcttggtttcacttatattggataacagaattgatggacatattgatcaggtgaatcggctcttagagcgtggcgacaagtcaaagggaatgaagaagtatgctgctgtagataaatggaacactcagctaaggtctctttaccagactatcagtaaccgagtatattga

SEQ ID NO: 3234 - DNA, 1654 bp, Pinus taeda
ggtccttccggctaacagcaaatgcggcagaggaaggggcggaattcgatcgaaatctcacatattacatagctaattgcttcgccaatcaaattctagcagacatccagatgggttccgatgaagatgaaatggattatggattcgaatactccgatgaagaacaagacgacgaagatgttgccattgaaaaccagtattacaactctaaaggtttggtggagtccaatcctcaagctgccctttctggttttgctgatgttgtcaggatggaacctgaaaaagatcagtggggatttaaggctctgaaacaaacggttaagctgcattatcgtttgggaaactataaagaaatgatggatgcttaccgggagatgttgacatacattaaatctgctgtgactcgaaactacagtgagaagtgtttaaataatatcatcgattttgtctctggttcggccggtcaaaacattgatctattacaagatttttatcaaactacactaaaggcccttgaagaggcaaaaaatgagaggctttggttcaagacaaatctcaagctttgcaagctctggtttaatagaggagagtacgggcgaatgaacaagacagtgaaggagcttcaccgatcttgtcagagagaggatggaacagatgaccataaaaagggcacccagctgttggaggtgtatgcaattgagatccagatgtacactgaaactaagaacaataagaaactaaagcaattgtacaacaaagcattgactgtcaaatctgcgatacctcatccccacatcatgggcattattcatgaatgtgggggtaaaatgcatacaacggaacgacaatggattgaagcagctacagacttttttgaagctttcagaaattatgatgaagctgggaatcaacgcagaattcaatgcctcaaatacctagttctagcatacatgctgatgcaatctgaagtgaatccctttgatgcccgggaggcaaagccctataaaaatgaccctgagatcttggctatgaccaatcttattgcagcataccaaagaaatgaaatattggagttcgaaagaatactcaagagcaatagaacaacaataatggatgattctttcattcgcaaccatattgaagatttgttgaagaacataaggacacaagtacttctaaagcttatcaagccatatacgagaattcggataccctttgtatcaaaggagctaaatattccagagaaagatgtggagcaacttcttgtgtctttaatcttagataaccgtattccagggcatattgatcaggttaatcagcttttagagctgggtgatgttagatccaagggtttgaaaaaataccaggccatagacaaatggaatactcaacttcatgctttgtatcaaacagttgcatgtaagattggataatctggacgcttctgtgatggcatatgacaattgccttgttttgccttctaataatggcttttgatccatggtttttatctctttgtttatatctgctgaggcattttgatttgtacatcttgagttgcctttttggattaaaatttctttctgaaaaactatatttgaatcctaagtggcttgttcttttgggctaattgtgttgaacatagcgggcatta

SEQ ID NO: 3235 - DNA, 1383 bp, Brassica juncea
caccgtcttgttccagaaaaacccttcttcaaccttttcccctacttctccgatcgaattctactctgcttagccttcgaatcggtgttggtttcttcttcatctggtcgtcgtcatggcttcagatgctgatatggaggactatgggttcgagtattcggacgacgaaccggaggaacaagacgttgacattgagaaccagtattacaactccaaaggtgtggttgagacagagcccgaagaggcgctctctgggtttgctgaggttgtacagatggaaccagacaagtctgagtggggtttcaaagctcttaagcagacggttaaaatttactatcgacttggtaagtacaaagagatgatggatgcgtacagagagatgcttacgtatatcaagtcagcagtgaccaggaactacagcgagaaatgtataaataatatcatggatttcgtctctggatctgctagccagaacactggcctgcttcaagagttttaccagaccaccttgacagcccttgaagaggctaagaacgagagactctggttcaagacgaatctaaagctctgcaacatctggtttgacattggtgaatacagacggatgactaagatactgaaggaactacataagtcttgtcaaaaggaagatgggacggatgatcagaagaaaggaagtcagctgcttgaggtttatgcgattgagattcagatttacactgaaactaaggacaacaaaaagcttaagcaactgtaccagaaagcacttgctatcaaatctgctattcctcaccctaggatcatgggtattatccgcgagtgtggtggcaaaatgcacatggctgaacgtcagtgggcagaagcagccactgacttctttgaggctttcaaaaactatgatgaagctggcaaccaaaggcgtattcagtgcttaaagtatcttgttcttgcgaatatgctcatggaatcagaagtgaatccattcgacggtcaagaggcaaaaccgtacaaaaacgaccctgagatcttggcaatgacgaatctggtagcagcatatcaacgaaacgaaatcatagagtttgagaaaatactcaagaataacaggaagacaatcatggatgatccattcatcagaaattacatggaagatctgctaaagaaggtgagaacacaggtgttgctgaagctgataaagccgtacacaaagatcgggattcctttcatatcaaaagagctgaacgtgccagagaaggatgtgacggagttgctggtgtcgctgatactggacagccgaatcgatggacacattgatgagattaaccgttacttgctgagaggtgacagtgctaatggaaggaaacttcacaaggcggttgataaatg

SEQ ID NO: 3236 - DNA, 1428 bp, Brassica napus
gggcccaataccaaaaatcctaaaccacaccgtcttgttccagaaaaacccttttgccctacttctccgatcgaaaattctactctgcttagccttcgatttctgtccgtgactagcttaatcttcgaatcccgtgttgatttcttcttcatctggtcgtcatggcttcagatgctgatatggaggactatggattcgagtattcggacgatgaaccggaggaacaagacgttgacattgagaaccagtattacaccgccaaaggtatggttgaggatgagcccgaagatgcactttctgagtttgctaaggttgttaagatggaaccagacaaggccgagtggggtttcaaagcgcttaagcagaccgtgaagatttactatcgactcggtaaatacaaagagatgatggatgcctacagagagatgcttacatatatcaagtcagcagtgaccaggaactacagcgagaagtgtataaacaatatcatggatttcgtctctggatctgctagccagaacactggcctgcttcaagagttttaccagaccaccttgaaagcccttgaagaggccaagaatgagcgactctggttcaagacgaatctaaagctctgcaacatctggtttgacattggtgaatacagacggatgactaagatcctgaaggaactacataaatcttgtcaaaaggaagatggaactgatgatcagaagaaaggaagtcagctgcttgaggtctatgcgattgaaattcagatctacactgaaacaaaggacaacaaaaagctcaagcaactataccagaaagcacttgctatcaaatctgctatacctcatcctaggatcatgggcataatccgtgagtgtggtggcaaaatgcacatggcagaacgtcagtgggcagaagccgccacagacttctttgaggctttcaaaaactatgatgaagctggcaaccaaaggcgcattcagtgcttaaagtatcttgttcttgcaaatatgctgatggaatcagaagtgaatccatttgacggtcaagaggcgaagccgtacaaaaacgaccctgagatcttggcaatgacgaatctgatagcagcatatcaacgaaacgaaattatagagtttgagaaaatacttaagaataaccggaggacgataatggatgatccattcatcagaaactacatggaagatctgctgaagaaggtgagaacacaggtgttgctgaagctgataaagccgtacacgaagatcaagattccgtttatatcaaaggagctgaacgtgccggagaaggacgtgacggagttgctggtgtcgctgatactggacagccgaatcgatggtcacattgatgaaatcaaccgttacttgctgagaggtgacagtgctaatggaaggaagcttcacaaggcggttgataaat

SEQ ID NO: 3237 - DNA, 1393 bp, Lippia dulcis
tgaaaaggctgagtggggatttaaagctttaaagcaaacagttaagctttactataagcttgggaagtacaaggaaatgatggatgcttacagagacatgttgacgtacattaaatctgctgtaacccggaattacagtgagaaatgcataaacaacattatggattttatttctggatcggccagtcaaaactttagcctattgcaagagttttatcagactaccttaaaggcacttgaagaggcaaagaatgagagactgtggtttaaaacaaatctaaagctgtgtaaaatatggtttgatatgggtgaatacgggcggatgagcaagattttgaaggagcttcacaagtcttgccaaaaagaagatggtactgatgatcagaagaaaggcacgcaacttttggaagtgtatgcaattgagatccaaatgtacacagaaactaagaacaataaaaagctgaaagaactatatcaaaaggcattatccatcaaatcagctattcctcatccaaggattatgggtataattcgtgaatgtggtggaaaaatgcatatggcagagcgacaatgggcagaagcagccactgatttctttgaagctttcaagaactatgatgaagctgggaaccagaggcgtatccaatgcctaaagtatttggttttggctaatatgctgatggagtcagaggtcaatccatttgacggtcaagaggcaaagccgtacaaaaacgatccagagatactagcaatgacgaacctaattgcagcatatcaacgaaatgaaattttggagtttgaaaaaattctgaagagtaatagaaggacaataatggatgaccccttcattcgaaattacattgaagatcttctaaagaatgtgagaacacaagtactgcttaagctcattaagccctacacaagaattcggattcccttcatatcaaaggagcttaatgtgccagagaaagacgtccaggatttgttggtgtctcttatattagataatcgtattaccggacacattgatcaagtgaaccggcttttggagcgtggcgacagatcaaagggaatgaagaagtacactgcaatagacaaatggaacacacaatttaaatccctataccaaactgtgggcaatagagtttgttgagatttgatggaatttgtacttgcttttagaaactccaaacattgttgttagtctaaaatatcgtcctaccaaaccaaccctgttgactaatgttgaaatatgtagtttcttttgtgtaacgcggtgcatgttgtctctttgaagcactgatttctttttctatttttgtttagagtgtggtaacaagagaatttaaagtttagtaccgtcctacatggagtaatgctaaccctaacgtgt

SEQ ID NO: 3238 - DNA, 3996 bp, Zea mays
atccgatctattatctatggatccccgccgtctccccatccttctctccctcctgcttgccttcttctccgccgttgtcgcctctgacgagatccacggatgcggcggcgtcgtcgaggcgagctctggcttggccaagtcgaggaaggcatcggattccaagctcgattactccgacatcacggttgagctctgcactgttgatggtttggttaaagaaagcacacagtgtgctcctaatggatactattttatccccgtctatgataagggttcgttcatggtcagagtgaaggggcccaagggatggtcatggaagcccgaaactgttcctgtcatcattgatcacaatgggtgcaatggaaatgcggatataaatttccagttcactgggtttatgatatccggtaaagtagtgggagctgttggtggtaagagctgctcaaaacggggaggacctgctggtgtgaaaattgaactgatgacagattctgatgagttgattgcatctgctttgacgtcatcatcaggagaatattcatttacaaacataattccagggcgttacatattacgtgcttctcatcctgattatgaaattgagttgagaggctcaccagagattgacctgcgatttggaaatgccgtggcagatgatgtcttctttgtatctggttatgacatttatggcactgtggttgcacagggaaatccaatagtgggagtccacctatatttgtattcaaatgatgtaacgaaggtcccttgcccacaaggtttcagtgatgcacccaaggaaggtgcactttgccatgcaatatctggtgctgatgggaagttcacatttagatcactaccttgtggtagctatgagttgttgccatactacaagggagagaacaccgtatttgatatttcaccatcttcactttctgtttctgttgagcatagtcatttgacgattccccaaaaattccaggtcactggattttctgttggagggcgtgttatcgatggttatggtgctggtgtggagagtgccaatgttatagttgatgggcagttgagagccataacagatagtcttggatactatagactcgatcaggttacatccaagaagtatactataactgccgagaaggatcattataagttcaaccgtttggaggattttatgattttaccaaatttggcaagtattgatgatatcagatcagttagatatgatgtatgtggtattgttcgaacagttactctgaattcaaaagcaatggttactttaacacatggaccagaaaatgtaaagccacagcggaaattagtgggtgaaaatggacatttttgctttgaggttcctgctggtgaataccagttatctgcattacctgtagattccgaacgctcttctagtcttatgttttcaccgggatctattagcgtcaatgtaaatagcccgttgcttgatctggaattctctcagtcacaagtcaatgttcatggtaaagtctcatgcaaacagcaatgcagccagaacattctggtctcacttgttagattggctggcggagttgaacaggaaaagaagacaactacattggaacaagataatgttaattttgtgtttaagaaagtatttcctggaaaatatcgtgtagaggtgaagaattctttacccgagggcttagctaaggatgattggtgctgggaccagagtatcttgaatatagatgttggtactgatgatgtgagagacattgtgtttgtacaaaaaggctattggattgagctagtttcaactcatgatactaatgcttatattcagcagccagattcttctagacttgatttgttgataaagaaaggatcacaaagaatttgtgttgaaacttcagggcaacatgagattcatttaactaatccttgtatttcctttgggacctcgtctgttttgtttgatacagctaatttaatgccgatccatatcaatgcaaagaagtatcttgtaaaaggtgaaatccatgtggacatgagctccattcaggaaaacattgattccaaggacatagtcgtggatatcttgaagagtgatggcagtttcatagaaaagatatccacatcacttgttcttggaaaggacaatcaaaatgacttcactgcctttgagtactctatttgggctgaccttggggaggacttcatctttgtcccccatgattctagcattggaaggaacaaggtcctattttatccagcaagacagcagtattcagtttctatgaatggatgccaagatactgttcctctaatcactgcaagaactggtctatatcttgaaggatcagtgttacctgcaacttctgatgttgacatcaagattctagcagctggaaagagcaactatgcccatctgaacaaaggggatgtagcaacagaggcaaagacagattctgaaggatcattttttgcaggtcctttgtatgatgacatagtatataaagttgaagcttcaaaggatggttaccatctcaaacaaactggcccatacaccttttcttgtcagaagcttggtcagatattagtgcggatttatggtgaaaattcagagcttttaccttcagtattattatcattgagtggcgagaaagggtacagaaataactcaattagtagttctggtggaaccttcacctttgacaacttatttcctggaagtttctatctccgaccacttctaaaggaatataaatttaatccgtcagcagtagctattgatcttaattctggagagtctagggaggctgaatttcgtgcaaccagagtggcttacagtgccatgggttctgtaacactattaactggccaaccaaaggagggtgtttttgttgaagcaagatctgaatccacaggtttttatgaggaagctaccacggattcttttggtagatttcgtcttagaggacttgtgcctggatcgacttactctataagagtggctgcaaaagataatcttcagtttgcagcagttgagcgtgcttcacctgaatatttgtcagttaatgttggtcatgaagacatgactggtattgattttgtggtttttgaacgccccgaagtaacaatcttgagtggccatgtggaaggagatggcattgatacgttacatccgcatctctctgttgaaatcagatcagcaacagactcttctagagtagaagctgtacttcctcttcctctttcatactactttgaagtccgagatttgcccaagggcaagcatcttgttcagcttcgatctggccttccatcacatacacataggtttgaatcggagttagtcgaagtagatctggaaaaggatccccaaatccatgttggtcccctcaaatataaaactgaggagcgtcatcaaaagcaggaactgaccccagcaccagtttttccgcttattgttggagtttctgtggttgcactggtgatcagtatgccaaggttaaatgacttataccagagcgctgtagggatgacttctctgggttcagggatggcaccgaccaaaaaggagccacgcaagaatatattaagaaagagagtgtaaatggcatattagcttagccttaggggtcgagaaatgagacatgacaaattgagcaatttcaacagtggaatagcttctggtttccccctcgggtaattttgccgacgaaaaggaatgccagttttgttgtacgatagcactatgcacagtttttgaagccttagattgtgccgttttggagttttagactataaagaaagagttgctgcatcatgaatgaactttctcaccagtcagcatgcacgttcgaataggttaatctgagcggtccaggactaagtagaatagacaagtttgttgtggcacgttgtttgcccctctttttgattgtacaacgaccaagtaaagcgtgtgcaatgacttctctatgacttacggatctggttcgccctttagca

SEQ ID NO: 3239 - DNA, 3984 bp, Setaria italica
atctcgtcgtcgtctccctcccccggtggcatgctccgctcccgctagatccgatcgatctatggatacccgccgcttccccgtcctcctctccctcctgctcgccttctgctccgtcgcggccgcctccgacgagatccacggatgcggcggcttcgtcgaggcgagctccggcttggccaagtcgaggaaggcgtcggactccaagctcgactactccgacatcacggttgagctgtgcactgttgaaggtttggttaaggaaagcacacagtgtgctcctaatggctactattttattccagtctatgacaagggtttgttcatggtcagagttaaggggcccaagggatggtcatggaagcctgatactgttcctgttgtcatcgatcacaatgggtgtaatggaaatgcagatataaatttccaattcactgggtttatgatatcgggtaaagtagtgggcgctgttggtggtaagagctgctcaaaggggggaggaccttctggtgtgaaagttgagctgatgacagactctgatgagttggttgcatctgcattaacatcatcatcaggagaatattcgtttacaaacataattccagggcgttacagattacgcgcttctcatcctgattatgatatcgagttgagaggctcaccagaggttgacttgcgatttggaaatgttgtggcagatgatgtcttctttgtatctggatacaacatctatggcactgtggttgcacagggaaatccgatattgggcgtccacctgtacttatattcaaatgatgtaacagaggttccttgcccacaaggtttcggtgatgcacccagggaaggtgctctttgccatgcgatatctggtgctgatgggaagttcatgtttagatcactaccttgtggtagctatgagctgttgccatactataagggggagaacactgtctttgatatttcaccatcttcacttcctgtttccgttgagcatggtcatttgactgttccccaaaaattccaggttactggattttctgttggagggcgtgttgttgatggttatggtgctggtgtggagggtgccaatgttatagtcgatggccagtcgagagctgttacagatagctttgggtactacagacttgatcaggttacatccaagaagtatactataacagctgagaaggatcactataagttcaaccgtttggagaattttatgattttaccaaatttggccagcattgatgatatcagatcagttagatatgatgtatgtggtattgttcggacagtaactccgaattcaaaagcaatggtgactataacacatggacctgaaaacgtaaagccgcagcggaaattggtgggagaaaatggacaattttgctttgaggttcctactggtgaataccagttatctgcattacctgtagattctgaacgttcttctagtcttatgttttcaccaggatctattactgtcaatgtaaatggcccattgcttgatctggcattttctcagtcacaagtcaatgttcatggtaaagtcttgtgcaaagaggaatgcaaccaaaatgttctggtctcacttgttagattagctgggggtgttgagcaggaaaagaagacaaccactttggagcaagataatgtcaattttgtgttcacaaaagtatttccgggaaaatatcgtatagaggtgaggcattcttcatctgagggctcggttaaggatgtttggtgctgggatcaaaatgccttgaatgtagatattggcattgatgatgtgaaggatattgtgtttgtgcaaaaaggctactggattgagctagtttcaactcatgatactgaagcatatattcagctgccagattcttccaaacgtgacttgtcgataaagaaaggatctcaaaggatttgtgtagaaacttcagggcaacatgagattcatttaacaaatccttgtatttccttcgggagttcgtctgttttgtttgatacagctaatcccatgccggttcatatcaacgcaaagaagtatcttgtaaaaggtgaaatccatgtggacatgggctcccttcaggaagacattgattcaaaggatatagtcgtggatgtcttaaagagtgatggcagctttgtagaaaagatatccaccaaacctgctcttggaaagagtaatcaaaatgactttactgcatttgagtactctatttgggctgacctaggggaggacttcatctttgtccctcatgattctagcactggaaggaaaaaggtcctattttatccagcaagacaacagtattcagtgtctgtgaatggatgccaagacactgttcctcaaatcactgcaaaagctggtctataccttgaaggatcagtgtcacctgcaacttctgatgttgatatcaggattctatcagctggaaagagcaactatgcccatctgaacaaaggggatgtagcaacagagacaaaaacagattctgatggatcattctttgcaggtcccttgtacaatgacatagaatataaagttgaagcttcaaaggatggttatcatctcaagcaaactggcctgtacacctttgcttgtcagaagcttggtcagatatcagtgcagatttatggtgaaaatttggagctgttaccatcagtattattatctttgagtggcgaggaaggatacagaaataactcaattagtggttctggcggaactttcatctttgacaacttatttcctggaagtttctatctccgacctcttcttaaggaatataaatttaacccctcagcagttgctattgatcttaattctggggagtctagagaggctgaattccgtgcaaccagagtggcttacagtgccatgggttctgtgacactgttaactggtcaaccaaaggaaggtgtttttgttgaagcaagatctgaatcaactggttattatgaggaagctactacagatgcttttggtaggtttcgtcttagaggacttgtgcctggatcaacttactctataagagtggttgcaaaagataatctccagtttgcagcagttgagcgcgcttcaccggattatgtgtcagttgatgttggtcatgaagacatcactggtattgattttgtggtttttgaacgcccggaagtaacaatcttgagtggtcacgtggaaggtgatggtattgatatgttgcagccacatctgtctgttgaaatcagatcagcagcagaaccttctagagtagaatctgtacttcctgttcctctttcatactactttgaagtgagagatttgcccaaaggcaagcatcttgttcagcttcgatctggccttccatcacatacccataggtttgaatcagagttggttgaagtagatctggaaaagcaaccccaaattcatgttggtccccttaaatataaaactgaagagcgccatcagaagcaggaactgaccccagcaccagtgtttccagttattgttggagtttctgtgattgcactggtgatcagtatgccaaggttaaaggacctgtaccagagtgctgtaggaattacctccctaggttcaggggctgcaccgatcaaaaaggagccacggaagaacataataagaaaaagagtgtaaacggcaaattagatttaatcctagtggtcgagaaatgagcactgacaaattgagcacgtcaggagtagaaactagctgttggtgccccctcgggtaattttgcagatgaaagaaatctgacagttgttgatgcttttcgacattactggcttcaagttttaaagctgaagcctggcgtgtactagtcattacagatgttgtatgatagcactatgtacagttttgcaggcgccagataatgccctcaatttcctttgtaataggagaaacgagaccactattcactgaacctgtttaagtcatttacaatcttatttactaagaattgtgtcgtaagctcc

SEQ ID NO: 3240 - DNA, 4086 bp, Panicum virgatum
cgcagctattgctatcctcgatctcgtcgtcgtctccccggtggcatgctccgctcccgctagatccgatctatctatggatccccgccgtctccccgtcctcgttgtcctcctgctcgtcttcttctccgccgcggccgcctccgacgagatccacggatgcggcggcttcgtcgaggcgagctccggcttggccaagtcgaggaaggcgtcggactccaagctcgactattccgacatcacggttgagctgtgcactgctgatggtttggttaaggaaagcacacagtgtgcacctaatggctactatttcattccagtctatgacaagggttcattcgtggtcagagttaagggacccaagggatggtcgtggaagcctgaaactgttcctgtcgtcatcgatcagaatggatgcaatggaaatgcagatataaatttccaattcactgggttcatgatatcgggtaaagtagtgggccctgttggtggtaagagctgctcgaaaaggggaggaccttctggtgtgaaagttgagctgttgacagattctgatgagttggttgcatctgcattaacatcatcatcgggagaatattcgtttacaaacataattccagggcgttacagattacacgcttctcatcctgattatgatatcgagttgagaggctcaccagaggttgacttgcgatttggaaatgttgtggcagatgatgtcttctttgtatctggatacaacatttatggcactgtggttgcacagggaaatccgatattgggagtccacctgtacttatattcaaatgatgtaacagaggtcccttgcccacaagatttcagtgatgcacccagggaaggtgctctttgccatgcaatatctggtgctgatgggaagttcatgtttagatcactaccttgtggtagctatgagctgttgccatactacaagggggagaacactgtatttgatatttcaccatcttcacttcctgtttctgttgagcatggtcacatgaccatttcccaaaaattccaggttactggattttctgttggagggcgtgttgttgatggttatggtgcgggtgtggagggtgccaatgttatagtcgatggccagttgagagccgtaacagatagtcttggttactacagacttgatcaggttacatccaagaagtatactataacagccgagaaggatcactataagttcaaccgtttagagaattttatgattttaccaaatttggccagcattcatgatatcagatcagttagatatgatgtatgtggtattattcgaactgtaactccgaattcaaaagcaatggtgactataacacatggacctgaaaacgtaaagccgcaacggaaattagtgggagaaaatggacgattttgctttgaggttcctgctggtgaataccagttatctgcattacctgtagattccgaacgttcttctagtcttatgttttcaccaggatctattagtgtcaatgtaaatagcccattgcttgatctggcattctctcagtcacaagtaaatgttcatggtaaagtgtcgtgcaaagaggaatgcaaccaaaatgttctggtctcacttgttagattagctggcggtgttgagcaggaaaaggagacaactactttggagcaagataatgtcaattttgtattcacaaaagtatttccggggaaatatcgtatagaggtgaagtattcttcatctgagggctcaactaaggatgattggtgctgggaccaaaataccttgaatgtagacattggcactgatgatgtgagggatattgtgtttgtacaaaaaggctactggattgagctagtttcaactcatgatactgaagcatatattcagctgccagattcttctaaacttgacttgtcgataaagaaaggatctcaaagaatttgtgtcgaaacttcagggcaacatgagattcatttaacaaatccttgtatttcctttgggagctcatctgttttgtttgatacagctaatcccatgctggttcatatcagcgcaaagaagtatcttgtaaaaggtgaaatccatgtggacgtgggctcccttcaggaaaacattgattccaaggatatagtcgtggatgtcttaaagagtgatggcagcttcgtagaaaagatatccatcaaacctgctcttggaaagagtaatcagaatggctttgcttcctttgagtactttatttgggctgaccttggggaggacttcatctttgttcctcatgattctagcactggaaggaaaaaggttctattttatccagcaagacaacagtattcagtgtctgtgaatggatgccaagacactgttcctcaaatcactgcaaaaactggtctgtaccttgaaggatcagtgtcacctgcaacttctgatgtcgatgtcaagattctatcagctggaaagagcagctatacccatctgaacaaaggggatgtagcaacagagacaaaaacagattctgatggatcattctttgcaggtcccttgtacgatgacatagaatataaagttgaagcttcaaaggatggttatcatctcaagcgaactggcccatacacatttgcttgtcagaagcttggtcagatatcagtccggatttatggtgaaaattcggagctgttaccatcagtattattatccttgagtggtgaggaagggtacagaaataactcaattagtagctctggcggaactttcatctttgacaatttatttcctggaagtttctatctccgacctcttcttaaggaatataaattcaatccatcagcagttgctattgatcttaattctggggaatctagagagactgaattccgtgcaaccagagtggcttatagtgccatgggttctgtaacactgttaactggtcaaccaaaggagggtgtttttgttgaagcaagatctgaatccacaggttattatgaggaagctactacagattcttttggtaggtttcgtcttagaggacttgttcctggatcaacttactctataagagtggctgcaaaagataatctccagtttgcagcagttgagcgtgcatcaccagattatttgtcagttgatgttggtcatgaagatatcactggtattgattttgtggtatttgaacgcccagaagtaacaatcttgagtggtcacgtggaaggtgatggtattgatatgttgcagccacatctgtctgttgaaatcagatcagcagcagaaccttctagagtagaatctgttcttcctgttcctctttcatactactttgaagtgagagatttgcccaaaggcaagcatcttgttcagcttcgatctggccttccatcacatacccataggtttgaatcagagttggtcgaagtagatctggaaaagcaaccccaaattcatgttggcccccttaaatataaaacggaagagcgccatcagaagcaggaactgaccccagcaccagtgtttccgctcatagttggagtttctgtgattgcactggttatcagtatgccaaggttaaaggacttgtaccagagtgctgtaggaatgacttccctcgggtcaggtgttgcaccgaccaaaaaggagccacggaagaatataataagaaagagggtgtaaacgccaaattagctttactcttaggggtcgagaaatgagcactgacaaaatgagcacgtcaggagtagatgctagctgttcggtttcccctcaagtaattttgcagatgaaaagaaatctgaaagttgatcgtccctttgtgacacttttggcttaaagttttgacgcggaagccaggtgtgtagtcattccaaattgttgtatgatagttaatttatactagagtctggggcgcaccattaatgcggtgttaaagaggaaattgcctttaaaaaaaaatgaaaaatgcttacgtcagtttagtgcaaatgttggtagtgtaattgtttttttatgttgttatgcctgttttgtcttacaatgttgtttgggtagtgacgcatggtaaggaattgttgtgttaatagtatattaagcaatcagaatta

SEQ ID NO: 3241 - DNA, 3839 bp, Pennisetum glaucum
ggcggcttcgtcgaggcgagctccggcttggccaagtccaggaaggcgtcggactccaagctcgactactccgacatcacggttgagctgtgcactgttgatggtttggttaaggaaagcacacagtgtgctcctaatggctactattttattccagtctatgacaagggttcgttcatggtcagagttaaggggcccaagggatggtcatggaagcctgaaactgttcctgttgtcatcgatcacagtggttgtaacggaaatgcagatataaatttccaattcactgggtttatgatatcgggtaaagtagtgggcgctgttggtggtaagagctgctcaaaaagaggaggaccttctggtgtgaaagttgagctgatgacagactccgatgagttggttgcatctgcattaactttatcatcaggagaatattcatttacgaacataattccagggcgttacagattacgcgcttctcattctgattatgatatcaagttgagaggctcaccagaggttgacttgcgatttggaaatgttgtggcagatgatgtcttctttgtatctggatacaacatctatggcactgtggttgcacagggaaatccgatattgggtgtccacctgtacttgtattccaatgatgtaacaggggtcccttgtccgcaaggtttcggtgatgcacccagggaaggtgctctttgccatgcaatatctggtgctgatgggaagttcgtgtttaaatcactaccttgtggtagctatgagctgttgccatactataagggggagaacactgtctttgatatttcaccatcttcacttcctgtttctattgagcatggtcatttgactgttcctcaaaaattccaggttactggattttctgttggaggacgtgttgttgatggttatggtgctggtgtggagggtgccaatgttatagtggatggccagtcgagagctgtaacagatagctctgggtactacagacttgatcaggttacatccaagaagtatactataacagctgataaggatcactataagttcgaccgtttggagaattttatgattttaccaaatctggccagcattgatgatatcagatcagttagatatgatgtatgtggtattgttcggacagtaaccccgaattcaaaagcaatggtgactgtaacacatggacctgaaaatgtaaagccgcagcggaaattggtgggagaaaatggacaattttgctttgaggttcctgctggtggataccagttatctgcattacctgtagattctgaacgttcttccagtcttatgttttcaccaggatctattactgtcaatgtaaatggcccattgctagatctggcattttctcagtcacaagtcaatgttcatggtaaagtcttgtgcaaagaggaatgcaaccaaaatgttctggtctcacttataagattagctggcggtgttgagcaagaaaagaagacagctactttggagcaggataatgtcaattttgtgttcacaaaagtatttccagggaaatatcgtatagaggtgaggcattcttcatccgagggctcggttaaggatgattggtgctgggatcaaaatgccatgaatatagatattggcattaatgatgtgaaggatattgtgtttgtgcaaaaaggctactggattgagctagtttcaactcatgatactgaagcatatattcagctgccagattcttccaaacgtgacttgtcgataaagaaaggatctcaaaagatttgtgtagaaacttcagggcaacatgagattcatttaacaaatccttgtatttcctttgggagttcgtctgttttgtttgatacagctaatcccatgccggtttatatcaacgcaaagaagtatcttgtaaaaggtgaaatccatgtggacatgggctcccttcaggaagacatcgattcaaaggatatagtcgtggatgtcttaaagagagagggaagctttttagaaaagatatccaccaaacctgctcttggaaagagtaatcaaaatgacttcactgcatttgagtactctatttgggctgaccttggggaggacttcatctttgtcccccatgattctggcattggaaggaaaaaggtcctattttatccagcaaaacaacagtattcagtgtctgtgaatggatgccaagacactgttcctcaaatcactgcaaaagctggtctataccttgaaggatcagtgtcacctgcaacttctgatgttgatatcaagattatatcagctggaaagagcaactatgcccatctgaacaaaggggatgtagcaacagagaccaaaacagattccgatggatcattctttgcaggtcccttgtacaatgacatagaatataaagttgaagcttcaaaggatggttatcacctcaagcaaactggcccgtacacatttgcttgtcagaagctaggtcagatatcagtgcggatttttggtgaaaattcggagctgttaccatcagtattgttatctttgagtggcgaggaaggatacagaaataactcaattagtggttctggcggaactttcatctttgacaacttatttcctggaagtttctatcttcgacctcttcttaaggaatataaattcaacccctcagcagttgctattgatcttaattctggggagtctagagaggctgaatttcgtgcaaccagagtggcttacagtgccatgggttctgtaacactgttaactggtcaaccaaaggaagatgtttttgttgaagcaagatctgaatcaactggttattatgaggaagctactacagatgcttttggtaggtttcgtcttaggggacttgtgcctggatcgacttactctataagagtggtagcaaaagataatctccagtttgcagctgttgagcgcgcttcaccggattatgtgtcaattgatgttggtcatgaagacatcactggtattgattttgtggtttttgaacgccctgaagtaacaatcttgagtggtcacgtggaaggtgatggtattgatatgttgctgccacatctgtctgttgaaatcagatcagcagcagaaccttctagagtagaatctgtacttcctattcctctttcatactactttgaagtgagagatttgcccaaagggaagcatcttgttcagcttcgatctggccttccatcacatacccataggttcgaatcagagttggtcgaagtagatctggaaaagcaaccccaaattcatgttggtccccttaaatataaaacagaagagcgccatcagaagcaggaactgaccccagcaccagtgttcccacttattgttggagtttctgtgattgcgctggtgatcagcatgccaaggttaaaggatttgtaccagagcgctgtaggaatgacctccctaggttcaggggctgcaccgatcaaaaaggagccacggaagactatgataagaaaaagagtgtaaacggcaaattagatttaatcctagtggttgaggaatgagcacaagacaaactgagcacgtcagaagtagaaactagctgttggtgcccgctctggtaattttgcagatgaaaagaaatctgacagctggtgatgcttttcgacattgctggcttcaagttttgacgctgaagcctggcgtgtagtcattacagatgttgtatgatattgatagcactatgtacagtcttgcaggcgccaaatggtgccctcagttttctttgtaatagaagtaacgacaccactattcactgaacctgtttaagtcatttattactaagactctaagagcgagtggttgtgtcg

SEQ ID NO: 3242 - DNA, 4130 bp, Oryza sativa
cagaatcaagtcatcagatcccagtgctattacttcatcgcagcctcgaactcgtcgtctctcccctctagcatgctcgccgcccactagatccgatctatggatccccgcctccttctcgccctcctctgcctcgccgccttctccgccgccgcgtatgcctccgacgagatccacggctgcggcggcttcgtcgaggcgagctcggggctagccaagtcgaggaaggcgtcggactccaagctcgactactccgacatcacggttgagctgtgtactattgatggtttggttaaggaaagcactcagtgtgcccctaatggatactattttatcccagtctatgacaagggttcattcatggtcagagttaaggggcccaaggggtggtcttggaagcctgaaactgttcctgttgtcatcgatcaaaatggatgtaatggcaatgcagatataaattttcagttcactgggtttatgatatctggtaaagtagtgggagctgttggtgggaagagctgctctaaacatggaggaccttctggtgtcaaagttgagctatcgacaaactctgatgagttagttgcttctgctttaacatcatctacaggagaatattcatttgcaaatataattccagggcgctataaattgcgtgcttctcatcctaactatgaaattgagacaaggggttcatcagaggtggacttgcgatttggaaatgctgttgcagatgatgtcttctttctatctggatataatatttatggctctgtagttgcacagggaaatccaatcttgggagttcacctttatttatattcaaatgacgtaacagaggtgccttgtccacaaagtattagtgatgcacccagagaaggtgctctttgccatgcagtatctggtgctgatggaaagttcacgtttagttcgttaccttgtggtagctatgagctgttgccgtactacaaaggggaaaatactgtttttgatgtctctcccccttcactgcttgtttctgttgagcacagtcatatgactatcccccaaaagttccaggttactgggttttctgttggagggcgtgttgttgatgggtatggtgctggtgtggaaggtgctaatgttatcgtggatggtcagttgagagctgtaacagacaatcttgggtattacagacttgatcaggttacctccaagaagtatactattgtggctgagaaggatcattacaaattcaaccgtttggagaatttcatgattttgccaaacatggctagtattgatgatatcacatcagttcggtatgatgtatgcggtattgttcgaacagtaaccccaaattccaaatcaatggtgactttaacacatgggcctgaaaatgtaaagccacagaggaaactggtgagcgaaaatggaagattttgctttgaggttcttgccggtgaataccgcttatctgccctacctgtagataccgaaggttcttccagtcttatgttttcaccaggatttattgatgtcaatgtcaacagtccattgcttgatatagagttctctcagtcacaagtcaaccttcatggtaaggtcctgtgcaaagagcaatgcaaccaaaatattctgctgtcacttgttagattagctgggggaatcgagcaggaaaagaagacagttactttggagcaagataatgttaattttgcattcaaaaaaatatttcctgggaagtatcgtctagaggtgaagcattcatcatctgaggccgctgcacaggatgattggtgctgggaccaaaatgcaatggatataaatgttggttctgatgatgtgacggacattgtgtttgtacagaagggctattgggtagagctagtctcaactcatgagaccaaagcatacattcaacatccagattcttctaaacttgatttgctgataaagaaaggatcacaaaggatctgcatagaaactcctgggcaacatgagcttcatttaattaattcctgcatttcctttgggagctcgccagtggtatttgatacaaagaatccaatgcctgttcatatcagtgcaaagaaatatcttgtaagaggtgaactccatgtggagatgggctcccttcaagaaattgatttatccaaaaatattggtgttgatgtcttcaagagtgatgggagtttcatcgaaaaaatctctgctacacctgttcttggaaagagttaccaaaatgacattagtgcctttgagtactccatttgggctgaatttggggaggacttcatttttgttccccgtgatgatagcactggaaggaaaaatatcctcttttatccatcaagtcagcagttttcggtggctgtgaatggatgccaatacactgttccttcaataaccgctaaaacaggtctataccttgaaggatcagtgtcgcctgcaatttctgatgttgacatcaagatcctagcagcagggaagagcaagtatgcatctctgaaggaaagggacatagcaatggagacaaagacaaattctgagggatcattctttgcaggtcccctgtatgatgatattggatatacggtggaagcttcaaaggctggctatcatctaaagcaaactggcccgtacaccttttcttgtcagaagcttggtcagatattggtacggatttatggtgaacaagatgccgagcttttaccttctgtattgctgtctttgagtggtgaagaaggctacagaaataattctattagtggttctggtggaactttcagctttggtaacttatttccaggaagtttctatctccgacctcttctcaaggaatataaattcactccatcagcagttgctattgatctcaattctggtgagtctagagaggttgaattccgtgcaactcgtgttgcctacagtgccatgggttctgtaaccctgctgactggccaaccaaaagagggagtatttgttgaagcaagatctgaatcaagaggttattatgaggaagctactactgattcttttggtaggtttcgccttagaggactcgtccctggctcaatttattctgtaagagtggttgcaaaagatgatcacaggtttgcagcagttgagcgtgcttcacctgaatatgtgtcaattgatgttggtcaggatgacatctctggtattgattttgttgtttttgaaagaccggaatcaacaattttgagtggccatgtggaaggagatgatcttgacatgttgcaaccacaactgtctgttgaaattagatcagctgcagacccttctagaatagaatctgtactccctgttcctctctcgtactacttcgaagtacagaatttgccaaaaggaaagcatcttgttcagcttcgttctggtcttccatcacatacccatagatttgagtcagagatagttgaagttgacttggacaagcaacctcagattcatgttggtcctcttaaatataaaaccgaagagcgacatcacaaacaggaattaactccagcccctgtatttcctcttattgtcggagtttccgtgattgcattggtcatcagcatgccaaggctaaaagacttgtaccaaagtgctgtgggaatgactaccctaggttctgcggctgcgccgataaaaaaggagccaagaaagacaatcatgagaaagagggcgtgaggcataaattagcttcagattaggtgttgaaaaaacgggtacttacagttgatcacgtcaggagtagaaaatagccgtttctttgcatttaaggggtaattttgcagataaaaattggcagtcgatatttattaacgactacaaattttgatgccaatgttgggcatgtagtcattcgaaatgttgtacgatagtactgtgtacagttttcaggtgccagatgaagttttgagagcctggtctatctttcctcagctcagtatatttgtttagttttagtgtctggtctcgtttatgctactatgttgtagataaacacgttggcatttgcttcgggcatagttactgccttgtactttggcattaatttttcatgttttaaactgtcatgttaaaatcttgtagtcttgttcccaaatactaccttcgttcacaaatattagtattcc

SEQ ID NO: 3243 - DNA, 4101 bp, Brachypodium distachyon
cactccaccactgctattactacaccccttgccctcgcacatctcctcgaactcgtcgtctccctgggcatgtccggcgccctctagatccgatctaatggatccccgcgtccctgtcctcctcgtcctcgtcctatcactcgccgccttctccgctgcctccgatgagatccacggatgcggtggcttcgtcgaagcgagctcgggtttggccaagtcgaggaaggcatcggactccaagctcgactactccgacatcacggttgagctgtgtactgtggatggattggtgaaggaaagcactcaatgtgctcctaatggctactattttattccagtctatgacaagggttcatttgttgtcagagttaaggggcccaagggttggtcatggaagcctgaaactgttcctgtagtcattgatcaaaatggatgcaatggaaatgcagatataaattttcagtttactgggtttacaatatctggtaaaatagtgggagctgttggtggtaagagctgttcgaaagatggagggccttccggtgtgaaagttgagctgttatcagattcagacgagttagttgcatctgcgctaacgtcatcaacaggaggatattcgtttgtgaacataattcctgggcgctacaaattgcgtgcttctcatcctgattatgacattgagatgagaggttcatcagaggtggacttgcgatttgggaatgttgtagcagatgatgttttctttgtatctggatacaatatccatggctctgtagttgcacagggaaatccaatcttgggagttcacctgtatttatattcaaatgacgtaaaggaggttcgttgctcacaaggtttgagtgatgcacccagggaaggtgctctttgccatgcagtatctggtgcagatgggaagttcacgtttagatcaataccctgtggtagctatgagctgttgccatactacaaaggtgaaagtactgtttttgatgtctccccttcttcattgcctgtttctgttgagcatagtcacatgacaatcccgcaaaagttccaggttactgggttttctgttggtgggcgtgttattgatggctatggtgctggtgtggaaggtgccaatcttataattgatggtcagttgagagctgtaacagataatcttgggtattacagacttgaccaggttacatccaagaagtatactatagttgccgagaagaatcattataagttcaacgttctggagaacttcatgattttaccaaatgtggcaagcattgatgatatcaaatcagttcagtacgatgtatgtggtgttgttcaaaccgtaactccaaattctaaagcaatggttacattaacacatgggcctgaaaatgtaaagccgcagaagaaaatggtgagcaaggatggaagattttgctttgaggttcccacaggcgaataccgtttatctgcgttacctgtagattctgaaggttcttccagtcttatgttttcaccaggatatattgatgtcaacgtcaagagcccattgcttgacgtagagttctctcagtcacaagtcaatgttcatggtaaggtcctctgcaaagagcaatgcaaccaaaatattttgctctcgcttgttagattagcagcgggtgtcgagcaggaaaagaagacaaccagtttggagcaagataatgttaattttgtgttcacgaaagtatttcccggaaaatatcgtctagaggtgaagcattcttcgtctgaggcctctgaaaacgatgattggtgctgggaccaaaatacctttgatatagatgttggtaatgatgatctggtagacattgtatttgtgcaaaagggctactggatagagctagtctcaactcatgacactgcagcatacattcatcaaccagactcttctagacttgactttcaaccagacacttcaaaatttgacttgttgataaagaaagggccgcaaagaatttgcatagaaactcctgggcatcatgagcttcatttagttaattcttgcatttcctttgggagcttgtctactatgtttgatacacaaaatccgatgccggttcatatcagtgcaaagaagtatcttgtaagaggcgagatccatgtggacataagctcccctcaggaagaaattgatttattagaagatattgttgttgatgcctttaagaacgatgggagttccattaaaaaattatctgccatacctgttcttgggaagagtcatcaaaatggcattactgcttttgagtactctacttggactgagcttggggatgacttcatttttgtccctcgtgattctagcactggaagaaaaaagatcctattttatccatcagagcagcagttttcagtgtcttcggacggatgccaagatgcggttccttcaatcactgctaaaacgggtctataccttgaaggatcagtggcacctgcaacttctgatgttgatatcaagattgtagccgcaggaaatagcaagtatgcaccgctgaagaaaggtgatgtagcagcagagacgaagacaaattccgatggatcattttttgcaggtcccttgtacgatgatataggatatgaagttgaagcttcaaaggctggttatcatctcaagcaaactggtccatacagctttgcttgtcagagacttggacagatattagctcgtgtttatggtgaaaaagatacagagatgttaccgtcggtattattatccttgagtggtgaaggaggctacagaaataactcagttagtggttctagtgggactttcagcttcggcaacttatttcctggaagtttctatctccgtcctcttcttaaggaatataaatttactccgtcaacagttgctattgatctcaattctggggagtctagagaggttgaattccatgcaacgcgtgttgcctacagcgccatgggttctataacactgctgactggtcaaccaaaggaaggtgttttcgttgaagctagatctgaatccagaggtcattatgaggaagccactacagattcttttggtaggtttcgtcttagaggacttgtccctggctcaacttactcaataagagtggttgcaaaagataatatcagatccgcagcagttgagcgtgcttcaccagaatatgtgtctattgacgtcggtcaggaggacatctctggtattgattttgtggtttttgaaaggccggaagcaacaattttgagtggtcacgtagaaggagatgacattgatatgttgcagccacatctttctattgaaatcagatcggttcttgacccttctagaattgtatctgtagttcctgttcctctttcatactactttgaattacgaaatttgcccaaaggcaagcatcttgttcagcttcggtctggccttccatcacatacccatatatttgaatcagagctggttgaagttgacctggaaaagcaacctcagattcatgttggtcctctcaaatataaaactgaagagcgccatctgaaacaggaactgactccggccccagtttttcctctcattgctggagtttctatcattgcactggtgatcagtatgccgaggttgaaggacctgtaccaaagcgctgttggaaggacttccctaagctcaggaatcacgccgagcagaaaggagccacggaagacaatattgagaaagagagcgtgaatcatattagcttcagattataggagttgaaaaatgagaacagacagattgagcacttcaggagtagaaagtagctgtttcttttcttctcggggggtaattttgcaaaaggaaaacaaatcccacagttaatattgtgtaccattacactagagattttggtcccattgtggggcatgtaatcatttggaatggtgtatgatgatagtgacatgtacagagccggattatgcttttgagaggctgccgtttagttttcaattgcaaaatggcggaactgcagtatcatcattggcatttttcgaaaatacattgatgacagcggtcatttgtttggaatcaggacgtcgacgacaaaaatctgtattattaacatgttagcaagcattgta

SEQ ID NO: 3244 - DNA, 1647 bp, Zea mays
caaaaatatccctccattaactctccaactcctcttcctcttcctcttcttctgcctcttcatttccaattccggcttcttcctcgcatcacaaaattccgattgcggcgcaatttcagattgcttgctccagggcgcaaatggtcatcatcagcggcagcaacttcccagcggattcgtgatccttccgcgatgggtcccgtcgccaacgatgcgtggcagaagcggttcttcagcgtcgcgccgccggccacgctggtcttcttcttcgtgctgatattcgtcgccggtgcaattgttacgcttgatcataaggagagcctggccatactgcagctgcagccaagaggagtgatcgcagcagagcagatgaggcctccagcgacgagcgagctgcgcgctgagccagcagcagaggaacccgacatctgtgagaataaatgtaggcctgcaggcagcgaggcgttgccgaggggcatcgtgcaggacaagtccaacttcgagatggagtcgctgggtggcaaccctgaacggaaggagaagaagggcaacggcaggcactcgaaaagcctcctcgccatccccgtcggcatcaagcagaaggcgatcgtcgacaagctcgtatccaagttcccggacaccaatttcatcgtgatgctgttccactacgacggcgaggtggacgggtggcgagacctggagtggtcgggccgcgcgatccacgtcggcgtacgcgaccagaccaagtggtggttcgccaagaggttcctgcacccggacctggtggcggagtacgactacgtcttcctctgggacgaggacatcgaggtggacagcttcgacccgctccggtacctgcgggtcgtgagggaggagcggctggagatctcgcagccggcgctcgaccggcggtcgcagatccaccaccggctcacggcgcgcgccgcgcggagcgggggcgtccaccggcggtactacaagacgagcgggcacggccggtgctacggcaacagcacgggaccgccgtgcgcggggtgggtggagatgatggtgcccgtgttctcgcgcgcggcgtggcggtgcgcgtggcacatgatccagaacgacctcatctacgcctggggcatggactacaagctcggctactgcgcgcagggcgaccggagccgcaacgtcggggtcgtcgacagccagtacgtgctccaccggggcatccctacgctcggcgacggcggcaaggcgacggcgacggctgccgcgtcggcattggggacggcagaccggttagcggtcaggcagcggtcctacaccgagctgcagctgttcaacaggaggtggaagaaggccgtggcggaggacgggtgctggaccgacccttacccgaacccggcgacgaccaccggctgaccgttggacggagcgaggcagcgcagggaagtacagtagttggtagctgtcagattgaccttgcctagaagatggtagtagatcatacactcgcattaatttacaggttcacagagagctatacatataatgtacagaactacagattgttttttttcctgtctcttgcctgtgatccatacaagggaataagcgtgcatgaataaaagaaattttgaaaatcataaatgaaattgccaa

SEQ ID NO: 3245 - DNA, 1591 bp, Zea mays
aaaattccctcaattaattgtcgaactcctcttccttttgcctcttcatttcaaattccagcttcttcctcgcggcgcactgcttgttcggtttgttcgaggcgacgaggccacaaatggtcatcgtgagtggcagcaacttccaaacggattcgtgacccttccgcgatggatcccgtctccaaaggtgcgtggcagaagcgattcttcagcgtcgcgccgccggcggcgctggtcttcttcttcgtgctgatattcgtcgccggtgcagccgtcacgctagatcataaggagagtcgtgtgtccgtattgcagttgcagccaaaactagtgactgcagcagcggagatgaggcctccagcgacgacgagcgagctgcgcgcagggccagcagaggaacccgacatctgtgagagtaaatgtagacctccaggcagcgaggcgttgccgcggggcatcgtgcaggacaagtccaacttggagatggagtcgatgggtggcaaccctgaacgtgaggagaacggcagcggcaggcggtcgaaaagcctcctcgccatccccgtcggcatcaagcagaaggcggtcgtcgacaagctcgtctccaagttcccggacaccaagttcaccgtgatgctgttccactacgacggcgaggtggacgggtggcgagacctcgagtggtcgggccgcgcggtccacgtcgccgcgcgcgaccagaccaagtggtggttcgccaagaggttcctgcacccggacctggtggcggagtacgactacgtcttcctctgggacgaggacgtcgaggtggacagcttcgacccgctcaggtacctgcgggtcgtgaggaaggaagggctcgaggtctcgcagccggcgctggaccgccggtcgcagatccaccacgggctcacggcccgcgcgcggcggggcggcggcgtccaccggcggtactacaagacgaaggggcacggcaggtgctacggcaacagcacgggcccgccgtgcacggggtgggtggagatgatggtgcccgtgttctcgcgcgcggcgtggcggtgcgcgtggcgcatggtccagaacgacctcgtctacgcgtggggaatggactacaagctcggctactgcgcgcagggcgaccggcgccgcaacgtcggcatcgtcgatagccagtacgtgctgcaccggggcatccccaccctcggcggcggcggcggcaacggcaacggcaagccttcgttctccgcttccgcgtcagcgttgggggcagaccggttagcggtcaggcagcggtcctacaccgagctgcaggtgttcaataggaggtggaagaaggccgtgtcggaggacgggtgctggactgacccttacccgaacacggcgaccaccggctgaccgttggacggaacgagacagctcagtagttggtagctgtcggattgacctcgtctagatgatggtagcagatcatacaccgcattactttacagattcagagagctcatatatgatgtacagattaaaaaaaaaatcctaactcttgactgttgtctatacaagggaaagagcaaattttgtactgtcaatcagttgt

SEQ ID NO: 3246 - DNA, 1741 bp, Setaria italica
atgtggcctggtgccatccatttgacttccacgagtggaattccggcatatttcgcaatcattcccttggctttcgcaaaatttgtaggagtactaaaatatccctccattactctcacggtgcctcgcatcccaaactcctcttcctcttcctcttcttcgtttccgattccagcttctgtttcgccgtcacggaaattccgattgcggcgccgttccggattgctcactccagcccgcaaatggtcatcatcatcggcagcagcttctcgaagaattcatgatccttcagcgatgggtccgatctccaatgatacgtcgcataagaggttcttcagcatcgcgccacgggcggcactgatctttttcgtgctaatattcgtcgcaggcgcaatattcacgcttgatcacaaggagaacttgtcgatattgcagttgcaacggaaagaagtgtttgcaactgaggagatcagacctccagcgacgagcgagttgcatgctgaaccaacagaggaacccaacatctgtgagaaccaatgcagaccttcaggcagcgaggccttgccaaggggcatcgtgcaggacatgtcaaacttcgagatggaatccctgggtggcaaccctgaccggaggaaagaccgcaggctgtcgaaaagcctcctcgccatccccgtcggcatcaagcagaagtccgtcgtcgacaagcttgtctccaagttcccagctgccaacttcattgtgatgctgttccactacgacggcatggtcgacggttggcgagacctcaagtggtccgaccgcgccatccacgtcgccgtgcgcgaccagaccaagtggtggttcgccaagaggttcctgcacccggacctggtggcagagtacgagtacatcttcctctgggacgaggacatcgaggtggacagcttcgacccgctcaagtacctgagcatcgtgaggagggaagggctcgagatctcgcagccggcgctcgaccgccggtcgctgatccaccaccggctcacggcgcgcgcccgcaagggcgacgtccaccggcggttctacaagacgaacgggcacggccggtgctacggcaacagcacggggccgccgtgcacggggtgggtggagatgatggtgcccgtgttctcgcgcgcggcgtggcggtgcgcgtggcagatgatccagaacgacctcatctacgcgtgggggatggactacaagctcgggtactgcgcgcagggcgaccggtggcgcaacgtcggcgtcgtcgacagccagtacgtgctccaccggggcatccccacgctcggcgacggcggcaaggcgacggtgaccgcgtccacgtcgacgtcgtcagcgacagaccggctggcggtgaggcagaggtcctacaccgagctgcaggtgttcaacaggaggtggaaggaggccgtggcggaggacgggtgctggaccgacccttacccgaatcccgcaaccaaaggctgagtggctgaccgtccgacgggaacgagatagcttaagcagggaggtacagtagtcagtagctgttacattgacgttgcctagatgatagattatacacaccatatttacaggttcagagagctcagagcagggctcgtatatgatgtacagattgttttttttccctctctgatctccaagggaataagcaagcgtgaataaaaaaaagattatgtgattttttccccttactttttcagtagtgagatgatga

SEQ ID NO: 3247 - DNA, 1689 bp, Panicum virgatum
gtctcaccatctcacgtgtctcagccggtcacccctcaaactcctctccctcctcttcttcatttccatcagcttttgtctcaccgtcacagaaattccgattgcggcgcagtcccggattgttcactccagcccgcaaatgatcatcaccgtcagcagcagcttctcgaagaattcatgatccttttgcgatgggtccgatctccaatgatgcgtcgcataagaggttcttcagcatcgcgccaccggcggcactgatatttttcttcgtactaatattcgtcgctggtgcaattgtcacgcttgatcacaaggagaacttgtcgatactgcagctgcatccaagagaagcgtttgcaaccgaggagatcaggcctccagcgacgagcgcgttgcgcgctgagccaacagaggaacccaacctctgtgagaaccaatgcagaccttcaggcagcgaggccttgccgaggggcatcgtgcaggataagtccaacttccagatggagtccctgggcggcaatccagggcggaagaaggctgttaggccgtcgaaaagcctcctagcgatccccgtcggcatcaagcagaaggcggtcgtcgacaagcttgtcgccaagttcccggcttccaacttcgtcgtgatgctgttccactacgacggcgtggttgacgggtggcgagacctcaagtggtcggaccgcgccatccacgtcgccgtgcgcgaccagaccaagtggtggttcgccaagaggttcctgcacccggacctggtggcggagtacgagtacatcttcctttgggacgaggacatcgaagtggacagcttcgacccgctcaagtacctgcggatcgtgaggagggaagggctcgagatctcacagccggcgctggaccgccggtcgcagatccaccaccggctcacggcccgcgcgcgcaacgtcgacgtccaccggcggttctacaagacgaacgggcatggccggtgctacggcaacagcacggggccgccgtgcacggggtgggtggagatgatggtgccggtgttctcgcgcgcggcgtggcgctgcgcatggcacatgatccagaacgacctcatctacgcgtgggggatggacttcaagctcgggtactgcgcgcagggcgaccggtggcgcaacgtcggcgtcgtcgacagccagtacgtgctccaccggggcatccccacgctcggcgatggcggcaaggcgcaggtgtctgcgttcacgtcggcgtcggcgtcggcgacggaccggctggcggtgaggcagcggtcgtacaccgagctaaaggtgttcaacaggaggtggaaggaggccgtggcagaggacggctgctggaccgacccttaccccgatccggcgaccaccaccggctgaccgtccgacggcctgagatagtgccaggatgggaggtacaatacagtagtcatcagtagctgttacattgactttgcctagatgatagattgtacaccatatttacagcttcagagagctcagagcaagctcatgtatgatgtacagattgtaatttttttccgtctctgatctccaagggaaaaaagcaggagcgcataaaaagatgatgcaattttttttgaactttttcagtaatgagatgattcagaacctgtaaagctaccttcaacaaatgctaaaatagctttagttc

SEQ ID NO: 3248 - DNA, 1309 bp, Saccharum officinarum
ctcgtctccgcacggaggccgtcctccccctctgcgtccggcgcccccgcgcgcgcgctccattataccccgggtcccgggcgggcgatgaccagcctatccaacgccggctccaccaatcaggcctaacacgagcagccctcgcctgggcggctggctgatccagcggccacagcccccggccgcctgatctcctcgtcgggcgggagtcgggtcgacaggagatggaggccagcgtgggcgtccgcgcgccgccgcgtggccgtgcctgggccggcctcgagaagccacagggcgctcactctgtcagagtcccgccggccaggctcacggcggagaggctgctgccgccgcggaagctggtgctgggcgccgatccgtggaggaccgcggatcctgccctccgtcccgcaaagctgagagcttcgtgctccgcgaaatcggcaggaacaggaaaggtccactactctgctgacgaggctctcatactacagcaaaaagcccaggatgttctttcttacttggatggccgatgcatttatcttgttggaatgatgggttcaggcaaaactacagttgggaagatattagccgaagtattaggttattcgttcttcgacagtgataagttggtagagaaggctgttggtatatcgtctgttgctgagatctttcagctccatagcgaagcattcttcagagataatgagagtgaggtcctgagggatctgtcatcaatgcatcggttggttgttgcaaccggaggtggtgcagtgatccgaccaatcaattggaattacatgaagaaagggctgactgtgtggttagatgttccactggatgcacttgcaagaagaattgctgctgtaggaaccgcatctcgaccactcttgcatcaggaatctggtgacccttatgcaaaggcttatgcgaaacttacatcactttttgagcaaagaatggactcgtatgctaatgctgatgccagagtttcacttgaacatattgcattaaaacaaggccataatgatgtcactatacttacacctagtgccatcgccattgaggcattgctaaatatggaaagttttcttaccgagaagaccatggtcagaaaatgattgcttgtatgtgagggaaaggatgctcacaaaatatggcccttgtttgtttatttgtacatatacctttgcataaactctttctgcagtgttgttcagcatgaaagaggaccgtttgagtttgtacttgtgcaaatgaataagtaaatagctttcagttaaaacaatgataatttgttatttatctc

SEQ ID NO: 3249 - DNA, 1328 bp, Panicum virgatum
gggtcgacccacgcgtccgctcgcgtctccgcacggagggccgccctcctcgtccgccgccgcctgccgccggcgagctcttcattaccccggcgatggccggcctatccaaaaccaccatcaccaatcacgtctagcacatctcgcccgagcggctgagccacacgtcacagcaacacatcaagccgcgcggatcgacaggaagatggaggcgagcgtgggcatccgggcgcggcccggtgcgtgggccgggctcgagaagccgcgcggcgcttgctctgcaagagtcccggcggcgaggctcacggcggagaagctgccggcgaggctggctctgggaaccgatccgcggaggagcacggatcctgtgctccgtgccgcaaagatgaaagcttcgtgttgcaagaaatcgacaggtactgaaaaggtccactactctgccgatgaagctctcatactacagcaaaaagcccaggatgttctcccttacttggatggccgatgcatttatctagtcggaatgatgggttcaggcaaaactacagttgggaagatattagctgaagtactaggttattctttcttcgacagtgataagttggtagagaaggctgtcggtatatcatctgttgctgagatttttcagctccacagtgaagcattcttcagagataatgagagtgaggtcctaagggatttgtcatcaatgcatcggttagttgttgcaactggaggtggtgccgtgatccgaccaatcaattggagttacatgaagaaagggctgactgtgtggttagatgttccactggatgcacttgcaagaaggattgctgccgtgggaactgcatctcggcccctcttgcatcaggaatctggtgacccatatgcaaaggcttatgcaaaacttacatcactttttgagaaaagaatggactcgtatgctaatgcggatgccagagtttcacttgaacatattgcattaaaacaagggcataatgatgtcactatacttacacctagtaccattgccattgaggcattattaaagatggaaagttttcttactgagaaggccatggtcagaaactgaccgcttgttgctggggaaaagggcaccaacagcatatggcccctgtttgtttaattgtgcttgtacatatgcctttgcatgagctctttacagtactgttagattgttgttcacgcaacatgaaagatgattatttgagtgtttgtacttgtgcgatgaataagagaatagttttaagtaaaataatcgcaacttgttctttatcttattaatgaatggttgaagagcacatcaggct

SEQ ID NO: 3250 - DNA, 1251 bp, Panicum virgatum
ctcgcgtctccgcacggagggccgccccctcctcgtccgccgcctgccgccggcgcgctctccattaccccggcgatggccggcctatccaaaaccagcctcaccaatcacgtctagcaagcacagagccacgcgtcacaacaacacatcctccgcgtcaggccggatcggcaggaagaagatggaggcgagcgtgggcatccgggcgcggcccggtgcctgggccgggctcgagaagccgcgcggcgcctactctgcaagagccccgccggtgaggctcacgccggagaagctgccggagaggctggctctgggaaccggtccgcggcggagcacggatcctgtgctccgtgccgcaaagctgaaagcttcgtgctgcaagaaatcggcaggtactgaaaaggtccactactctgctgatgaagctctcatactacagcaaaaagcccaggatgttctcccttacttggatggccgatgtgtttatctagtcggaatgatgggttcaggcaaaactacagttgggaagatattagctgaagtactaggttattctttctttgacagtgataagttggtagagaaggctgtcggtatatcatctgttgctgagatttttcagctccacagtgaagcattcttcagagataatgagagtgaggtcctaagggatttgtcatcaatgcatcggttagttgttgcaactggaggtggtgccgtgatccgaccaatcaattggagttacatgaagaaagggctgaccgtgtggttagatgttccactggatgcacttgcaagaaggattgctgccgtgggaactgcatctcggcccctcttgcatcaggaatatggtgacccatatgcaaaggcttatacaaaacttacatcactttttgagcaaagaatggactcatacgctaatgcggatgccagagtttcacttgaacatattgcattaaaacaagggcataatgatgtcactatacttacacctagtaccattgccattgaggcattgctaaggatggaaagttttcttaccgagaaggccacggtcagaaactgaccgcttgctgctggggaaaaggacaccaacagcatatggcccctgtttgtttaattgtgcttgtacatatgcctttgcatgagctcgattattgttcgcgcaacatgaaagatgattatttgagtgtttgtacttgtgcaaatgaataagagaatagttttaagtgaaataatcgcaacttgttc

SEQ ID NO: 3251 - DNA, 2121 bp, Panicum virgatum
acaattttctgctcttgtttgtcatcaggtcataatgacaggcgtatgatcaaactggagtcacgctagatgatcttgtatttcatattatgaaaaatatgaggatttcagatcctgaaaataatgaaaacatgccggacccacgcggcaagaaaccaaccacttcgaaaccaaactcacgaccgcctctcggaggagtcttgtataaaagccccgcgagcccacaattcccacctccttcaattccctctcatctcgcgtctccgcacggagggccgccctcctcgtccgccgccgcctgccgccggcgagctcttcattaccccggcgatggccggcctatccaaaaccaccatcaccaatcacgtctagcacatctcgcccgagcggctgagccacacgtcacagcaacacatcaagccgcgcggatcgacaggaagatggaggcgagcgtgggcatccgggcgcggcccggtgcgtgggccgggctcgagaagccgcgcggcgcttgctctgcaagagtcccggcggcgaggctcacggcggagaagctgccggcgaggctggctctgggaaccgatccgcggaggagcacggatcctgtgctccgtgccgcaaagatgaaagcttcgtgttgcaagaaatcgacaggtactgaaaaggtccactactctgccgatgaagctctcatactacagcaaaaagcccaggatgttctcccttacttggatggccgatgcatttatctagtcggaatgatgggttcaggcaaaactacagttgggaagatattagctgaagtactaggttattctttcttcgacagtgataagttggtagagaaggctgtcggtatatcatctgttgctgagatttttcagctccacagtgaagcattcttcagagataatgagagtgaggtcctaagggatttgtcatcaatgcatcggttagttgttgcaactggaggtggtgccgtgatccgaccaatcaattggagttacatgaagaaagggctgactgtgtggttagatgttccactggatgcacttgcaagaaggattgctgccgtgggaactgcatctcggcccctcttgcatcaggaatctggtgacccatatgcaaaggcttatgcaaaacttacatcactttttgagaaaagaatggactcgtatgctaatgcggatgccagagtttcacttgaacatattgcattaaaacaagggcataatgatgtcactatacttacacctagtaccattgccattgaggcattattaaagatggaaagttttcttactgagaaggccatggtcagaaactgaccgcttgttgctggggaaaagggcaccaacagcatatggcccctgtttgtttaattgtgcttgtacatatgcctttgcatgagctctttacagtactgttagattgttgttcatgcaacatgaaagatgattatttgagtgtttgtacttgtgcgatgaataagagaatagttttaagtaaaataatcgcaacttgttctttatcttattaatgaatggttgaagagcacatcaggttaacatgctattgccatttcgttatgtcatatagattgtgaaataaaatcaaataacatgaatccatgccattcagtgcattggtgcattttactctatttttatcacacataaatttaactcaaaacttcattagtataccatatggacataacagaaagggccttttacagggcctcgttttgtttgaaaaatatgtacatataataaagaagtgtcccaaaatcattcataacaaaaatcagtttgatcttggattctagattagatgctactgcaaggggggaaaaactcctagtcttctagtagtgattccaaaataatagttaaagaaacatttaaggaagcagggatggaaaacttgtaccttcagctttatatgaacattcttctaatggttctagcaacagcccgagataaaatacggcttgctaaatctgttggcagaagaagcaactgctgttgggactccagtggaagcttcaatagagaaggacataaacaaatgagccatgtgccatgtggattttgacatatattagtctcactgaacttgtat

SEQ ID NO: 3252 - DNA, 1319 bp, Zea mays
ctcctgaacacaccacccctcgtctccccacggaggccgtcctctcctctcctctgcgtccgccactgcccaccgctcgcccgcgcgcgctccattacctcggcgggcgatggccgacctatccaacaccggctccacctaacacgagcagcgcccccgcctaggcggcagctggctggtcggtcgtcgagcagctagcggcggcagcgcccggagggaggccgtctcactctcctcgtcggggcggcaggagatggaggccatcgtgggcgtccgcgcgccgccgcgtggccgtgcctgggccggcctcgagaagccgccgcgcgccgcttgccgcgccagagtcccgacggcgaggctcgcggtcgcggcggacaggccgcggaggctggtgctgctgggcgccgatacgcggagggccgcggatcctgccctccgttgcgccgcgcaatctgcaggtggaacaggaaaggtccactactctgctgatgacgctctcatactacagcaaaaagcccaggatgttctgccttacttggatggccgttgcgtttatcttgttggaatgatgggttcaggcaaaactacagttgggaagatactatccgaagtgttaggttattcgttcttcgacagtgataagttggtagagaaggctgttggtatttcatctgttgctgagatctttcagctccatagcgaaacattcttcagagataatgagagtgaggtcctgacggatctgtcatcaatgcatcggttggttgttgcaaccggaggtggtgcagtgatccgaccaatcaattggagttacatgaagaaagggctgaccgtatggttagatgtcccactggatgcacttgcaagaagaatcgctgctgtaggaaccgcgtctcgaccactcttgcatcaggaatccggtgatccttatgcaaaggcttatgcaaaacttacgtcactttttgagcaaagaatggactcgtatgctaatgctgatgccagagtttcacttgaacatattgcattaaaacaaggccataatgatgtcactatacttacacctagtaccatcgccattgaggcattgctaaagatggaaagttttcttaccgagaagaccatggtcagaaactgacctcttgaatgagagggaaaggatgctgacaacatgtggcccttgtttgtttaattgtacatatacctttgcattattgcctaaactctttctacagtgttgttggattattgtttgtgcagcatgaaagaggaccgtttgagtttgtatttatgcaaatgaataagtaaataactttcagtta

SEQ ID NO: 3253 - DNA, 1896 bp, Setaria italica
cgcccgctgccgccgccgccggcggccaccgcccgcgcgctctccgttaccccggcgatcgatggccggccaatctaacaccagctccaccaatcaggtctaacacgaataggcgccctcgcctgagtgcggctgctgaaccacaggcccggccgtctcctcgtcaggtcgggtcgagaggagatggaggcgagcgtgggcatcggggcgcggccccgtatctgggccgggctcgtcgagaagccgcatggcggcgcttactccgccagagccccggccttaaggttcacggcggagaagctgccgcagaggctggttctgggaaccgatccgtggaggggcacggatcctggactgattcgtgccgcaaagctgaaagcatcttgctgcaagaaatcggcaggtactgaaaaagtccactactctgctgatgaagctctcatactgcagcaaaaagcccaggatgttctcccttacttggatggccgatgtgtttatctagtcggaatgatgggttcaggcaaaactactgttgggaagatattagccgaagtattaggttattcgttcttcgacagtgataagttggtagagaaggctgtcggcatctcatctgttgctgagatctttcagctccatagtgaagcattcttcagagataatgagagtgaggtcctaagggatttgtcgtcaatgcatcggttagttgttgcaactggaggtggtgccgtgatccgaccaatcaattggagttacatgaagagagggttgactgtgtggttagatgttccactggatgcacttgcaagaaggattgctgccgtgggaaccgcatctcggcccctcttgcatcaggaatctggtgacccatatgcaaaggcttatgcaaaacttacatcactttttgagcaaagaatggacgcatatgctaatgctgatgccagagtttcacttgaacatattgcattaaaacaagggcataatgatgtcactatacttacacctagtaccatcgccgtcgaggcattgctaaagatggaaaattttcttagtgagaatgccatggtcagaaactgaccttttattgctgggaaaaggacactgacaacatacggcccttatttgttttattgtacatatacctctgcatgaactccttttacagtactattagattgttgttcacgcaacatgaaagaggatcatttgagtttgtacttgtgcaaatgaataagaaaatagttttagttaagttaaaataattgccatttgctctttatcttattataatgaatggttgatgggcacattaggtttacatgctattgcctttttgttatgtcatatacattgtgaaacaaaatcagataacatgaatccatgcttttcagtcaaactgcattactgcagtattattattttttatcacacaaagagctaactcaaaaattcataagttacactatatggatttaacaaaaagggccttttacagggcttccttttgtttgaaaaatatgtacatagtaaagaagtgtttccaaaatcattcataacaaagaaaaaaaatgtcagagtgattttggattctagattagatgctaccgcatggggaaaaaaaacttctcgtcttctagtagtgattcaaaaagaatagttaaacaaaaacatttaagtaagcagagatgaaaaatctgtacctttagctttacatgaacattcttctaatagttctcgcaacagcccgagataaaatacgattggctaaatccgttggcagaagaagcaactgctgttgggactccggtggaagcttcgatacagaagggtatacacaaatgagtaatgtgccatgtggaatttgacatatgttagtctcactgaacttatatatat

SEQ ID NO: 3254 - DNA, 2312 bp, Pennisetum glaucum
cggtgaggtgcacggcggagaagctgccgcggaggctggtcctcgggaccgatccgtggaggaggagcacggaccctggactgctgatccgtgccgcgaagctgaaagcatcgtgcagcaagaaatcggcaggtactgaaaaagttcactactccgctgatgaagctctcatactacagcaaaaagcccaggatgttctcccttacttggatggccgatgcgtttatctagtcggaatgatgggttcaggcaaaactaccgttgggaagatattggccgaagtattaggttactctttctttgacagtgataagttggtagagaaggctgttggtatctcttctgttgccgagatctttcagctccacagtgaagcattcttccgagacaatgagagtgaggtcctaagggatttgtcatcaatgcaacggttagttgttgcaactggaggtggtgctgtgatccgaccaatcaattggagttacatgaagaaagggctaactgtgtggttagatgttccactggatgcacttgcaagaaggattgctgccgttggaaccgcatctcggcccctcttgcatcaggaatctggtgacccatatgcaaaagcttatgcaaaacttacatcactttttgagcaaagaatggactcatatgctaatgctgatgccagagtttcacttgaacacattgcattaaaacaagggcataatgatgtcactatacttacacctagtgccatcgccatcgaggcattgctaaagatggaaagtgttcttagtgagaatgccatggtcagaaactgaccgcttgttgctggggaaaaggacactgacaacataaaacctttttttatttattgtacatatacctttgcatgaactccttttacagtactattaggttgttcgcgcaacatgaaagaggatcatttgagtttgtacttgtgcaaattgtaagaaaatagtttttgttaagttaaaataattggcatttgctattatcttattataatgaatggttgatgggcacattaggtttacatgctgttgcggtattgccatatgggcttaacaaaaagttccttagttacaccgtatgggcttaacaaaaagggccttttacaggcttccttttgtttgaaaaatatgtacatactaaagaagtgtttccaaaatcattcacaatgaaggaaaaaagtcagattgatcttgaattctatagattagatgctactgaataggaaaaaaccttctccccttccagtagtgattcaaaaagaatagttaaacaaaaacatttaaggaatcggagacgaaaacttgtacctttatctttatatgaacatttttctaatggttctcgcgacagcccgagataaaatacgattggctaaatccgttgcagaagaagcaactgctgttgggactccggtggaagctcaggaatgacggaaagaactggtaaaaattctggcagagatgccatttcgtacagagcaagagaaagttcatctgcgctaccaccattctctatggcattgttattttcaggaatcggagatgaattttccttctgagaaaccttagaaaaaagtaggagaaggcgatatagatttctcaagttattaacatcctcatcatctagtgaagttaatgtggatggaccactggcaaatggcaatctggaagctgctgcagatgttgctgagcttaatgtggctacaccaagtgcatctactcccttagcaatctcctgaagaagtaaatccttcacaaaggcaccctggtcagtgagtgtgaatgacaaacttgcttaattgcatatcttgtactatcaacatcttcttgttgatttctgaccaatgattgctctgttctggcacggagtgactcagttaacaaagactccagacgatcaatttggaaagtgccatccttataaagaagagtctgcaaagttgatcggagctttggtgaactgtcagtgagaacttttcttgcaatccatgggtatgaacttcccagcactttatagtttggattaaaacttattgcaataccttccaatacagcaaggcttcgaattacaagggaaaagtaagaaggtatctggaacttaaatttatacattgttcgtccaagatttcctgacagatctccaaagcttatattctcaactcctctgttaacagcattctcaaatacacctgtcagagcctttgtgacttcacccttctgggcagttggaggaagcaaaccaagagtgataaaatcttttgctaaagcatcaaaatcacggttaacaagatg

SEQ ID NO: 3255 - DNA, 799 bp, Saccharum officinarum
attagcaaggatcgcctaactaatcaagcaagcaaggaagggtagaggggaaaggaacagagagcggcccgtgatgtgctgctgtggcgatggcggcgagtgccggccgctgggctggctgctggggctgccgttcgcgctgctcgccgtcctcgtctccatcgtcggcgccatcatctggatcatcgggctgcccatctcgtgcatctgcccgtgctgcctctgcgtgacggtggtgctggaggcggcggtggagctcatcaaggcgccgctgcacgtcatgacctggttcacctccaagataccctgctagacaagtagtcggagtaccacatctaggcttcattgttcctagctccatatacgatggtcgatgggtcatgttaggcgaggatgattcatgcgaggcaaattgatcgagttgtgaacggattgtttatgtcgatcagtattaactattcagtatgcatcttcttgtgtgggtgtttttttaaacaatactccttgtgagcttgatttgaagttgagaacttgagagagactgatctcttatttacaacaatgaagatatcttatactaataattatgtgtattgatactacttttcttatatgtatgggggggcctcttttaggaaccaacttatagcaccgcggactccatagataatattttatttttaggacccctaatctaaatatcactggccttgattataaacaatctgacgctgggaaactctggggattccccatcatatgatgctgggagaaattaccccttatgaattatggagtt

SEQ ID NO: 3256 - DNA, 1103 bp, Panicum virgatum
cgggcgggtatggcaatcagtggatggaaaacgggcgaccgtcccgttcgttaacacagagggtcctcgctgaaagcgacttggaagcagctccccctccctcccactgacgcacgcagcaattgccaattggcacactcaagtctcagcccaccatatagaagaatattgcaaaagggaggatagtgccctggcagatttagattagcatccaagaattagtagaaggaatcgatcaccaaactaaccaatagcaagcaagcaagggagtcagggagtggggaaaggcagagcggccggcgatgtgctgctgcggcggcgacggcggcgagtgccggccgctggggtggctgctgggcctgcccttcgcgctgctcgccgtcctcgtctccatcgtcggcgccatcatctggatcatcgggctgcccatctcgtgcatctgcccgtgctgcctgtgcgtgacgctggtgctggaggcggcggtggagctcatcaaggcgccgctgcacgtcatgacctggttcacctccaagatcccctgctagccgttcatgtcatgtgttccttcattcatgtaaaaaaaaaagatgatggctcagggacagggagggcagaccaggatgatttgtttttgttattgtgcaaatcgggctgtgagcctgtgactgctgatcgatgatccatgtgcctgttcttctgtttcctcgtgggttgattagactatgagatgtggtttctcgtgcctgttcttcttactggtatttttcatggcggcgagaaagtttagaggcaggaacatagccgccaaggtagtcgatcagtcgcaggtcgctgtcgatggctcgtgccaacaattattcctgccgatccaagtgggaaacccggcgggcggtgggtagctaggtggagacgaatgaatttgggcaaccttcaacaaggggcaggggatctcaaacgcctaattcttatggactcccatgatattcctgggtgatggctcttttcagtgtaactaggcatatagcccgcgcatttgcgcagctatcattgaaaattcaaaaattcgcatgttgttgtatttttacttaaaaattatattattt

SEQ ID NO: 3257 - DNA, 679 bp, Zea mays
attagcaaggagcacggaacgaatcaagcaaaagccaaggaacagggggggcaaggctgctggctgctgcccgtgatgtgctgcggctgcggcggcgacggccgcgagtgccggccgctgggttggctgctggggctgccgttcgcgctgctcgccgtcctcgtctccgtcgtcggcgccatcatctggatcatcgggctgcccatatcgtgcatctgcccgtgctgcctctgcgtgacggtggtgctggaggcggcggtggagctcatcaaggcgccgctgcacgtcatcacctggttcacctccaagataccctgctagacaagcagtcggaggatggtttgtgagcgatagccacaggtgcagcgcatggacagtttatacaggacacggggtttcggtgcagaccagattagaatctgtcatgtttcttcgtgcttctggattgccgtttaacttttcaaaataggtcaaagtaaagagttgcagttgcacagcaattctaagaacagtatagagggatggtagatttcatataggtcatgtttgacagggctccggcttctcgagaaccctgccaaatggtcacttaaaattggctctttatatatgaagtctgaaggagccagagctgtttgtatatataggagttggtgatgctgaaatatggcttcagtct

SEQ ID NO: 3258 - DNA, 736 bp, Cynodon dactylon
attaaagcgatgagaccaccctggcaaaagttcaacattagggacgatcgcactaagaatttttttcaaacaaaacagagtccacacggcagctaactaatcaagcaagcaaggaacaaaggaaaggaaaagagatcggcggccatgtgctgcggcggcgacggcgagtgccggcctctggggtggctgctgggcctcccgttcgcgctgctcgccatcctcgtctcgatcgtcggtgccatcatctggatcatcgggctgccgatctcgtgcatctgcccgtgctgcctgtgcgtgacgctggtgctggaggcggcggtggagctcatcaaggcgccgatccatgtcatgacctggttcacctccaagataccctgttagcacagccggaatggtggcagatgaggatggttcttgcgatgccgatttgagttctgaactgattaatttagttggcatataagcgtattttttttttccttctgttaccttgagcgctggttcaactataagattgcttacgcgttcattcacgattcaaattgtatgctgagactggattatgattgttgtgtttgcttccttgatcacttgttacctgttttacttgagaaaggcttatctgcgtttattttccatggtaatgagcatagtacacctttaccatggatgtatcccgtctgcccgagctggatatagaattcaatatttttttttcatataagaaaaaataaaa

SEQ ID NO: 3259 - DNA, 506 bp, Saccharum officinarum
gagcagcaacgcgggcggaccggcaccgggttggttcatctgacatccacgccgcagcaggccggaggaggggaggcgatgtgctgctgcggcgacggggagtgccggccgctcgggtggctcctgggcctgcccttcgcactgctcgccgtcctcgtctccttggtcggcgccatcatctggatcatcgggctgcccatctcgtgcatctgcccctgctgcctctgcgtgacggtgctgctggaggtggccgtggagctcgtcaaggcgccgctccatgtcatgacctggttcacctccaagataccctgctgagtgccgatcttcagttcgtcccagtcccagtagctgtccccgatcatacgttcttgctttagccggagagattgctgtacattcaattcgtttcgtcgtcgggtgagtcatcgtagtacttcaagggttctgcaattgattttttccacagatttggtaattgtgtgaccttgtgataaagtaccagtagc

SEQ ID NO: 3260 - DNA, 758 bp, Panicum virgatum
acgggcaactgtcccgttcgttgacacggagggtcctcactgaaagcgacttggaagcagctcacttcctcccactaacgcacgcagcaattggcacactcaacaagccaagtctcaacccaccatagagaagaatattgcaaaagggaggagaggagggcgccctggcagattcagagtagcattagggaggccagatcgccatccaagaattagtagcaggaatcgatcaccaaactaaccaagcaagcaagcaagggagtcagggagtggggaaaggcagagcggccggcggcgatgtgctgctgcggcggcgacggcggcgacggcggcgagtgccggccgctggggtggctgctgggcctgcccttcgcgctgctcgccgtcctcgtctccatcgtcggcgccatcatctggatcatcgggctgcccatctcgtgcatctgcccgtgctgcctgtgcgtgacgctggtgctggaggcggcggtggagctcatcaaggcgccgctgcacgtcatgacctggttcacctccaaaatcccctgctagccgttcatgtcatgtgctccttcattcatgtaacaaaaaagatgatggggtcggggacagggagggcagaccaggatgatttgtttttgttattatgcaaattgggctgtgagcctgtgactactgatcgatgatcatgtgcctgttcttctgtttcctcgtgggttgattcgactatgagatggagtggtttctcgtgcctgttcttc

SEQ ID NO: 3261 - DNA, 688 bp, Panicum virgatum
acgggcaactgtcccgttcgttgacacggagggtcctcactgaaagcgacttggaagcagctcacttcctcccactaacgcacgcagcaattggcacactcaacaagccaagtctcaacccaccatagagaagaatattgcaaaagggaggagaggagggcgccctggcagattcagagtagcattagggaggccagatcgccatccaagaattagtagcaggaatcgatcaccaaactaaccaagcaagcaagcaagggagtcagggagtggggaaaggcagagcggccggcggcgatgtgctgctgcggcggcgacggcggcgacggcggcgagtgccggccgctggggtggctgctgggcctgcccttcgcgctgctcgccgtcctcgtctccatcgtcggcgccatcatctggatcatcgggctgcccatctcgtgcatctgcccgtgctgcctgtgcgtgacgctggtgctggaggcggcggtggagctcatcaaggcgccgctgcacgtcatgacctggttcacctccaagatcccctgctagccgttcatgtcatgtgttccttcattcatgtaaaaaaaaagatgatggggtcagggacagggagggcagaccaggatgatttgtttttgttattatgcaaatcgggctgtgagcctgtgactactactgatcgatgatc

SEQ ID NO: 3262 - DNA, 700 bp, Pennisetum glaucum
gctgctgcatccggacctccctccctcgcctccagtgcgcgcgcgcggcaagaaaaccaaccccggcgaggcggcgattgtttctgatctcggcgccggagatcgagccgccggagaggaggaggagaaggtcgtcgagggtcgagagagacaggatgtgctgctgcggcgacggcgagtgccggcccctggggtggctgctgggcctgcccttcgcgctcctcgccgtcctcgtctccttggtcggcgccatcatctggatcatcgggctgcccatctcgtgcatctgcccctgctgcctgtgcgtcacgctgctgctggaggtggccgtcgagctcgtcaaggcgccgctccatgtcatgacttggttcacctccaagataccctgctgagtgctgatcctcaccatccacccacaccatagctagctagctatctatctagctgcctcgtgctcgtccctgcgtagtgctagtcgccctccggggtattttttttgttcgtcgttcatacatttaatttcatgctgatttcattcggttcgtctggatgtacttttattctgcgattggattccagagatttcttgactgtgacctttgtgtatattatgcttgctgctgcctgttgtcagtttcaacagcgcctggtctttgcgtctgattacttttgcttgtgggggtgacgatgaccaggcgct

SEQ ID NO: 3263 - DNA, 1655 bp, Sorghum bicolor
gtttccctaggctgctgggcgtggtgtcgctaacttgccggttgcttccccgtgactccttgaccagcaggagagtagccctcctgctgtgtattatagttgccatcagtattagtgctgctgtcaagtagtagcaaccaggctttgcaagaatgctggatcacttgggaacttggaagatcaccactcatgtatcagccggatttccggaccggtcaaaggactgattgctcatcagcctgatgctgcttcctgcctgcctctgtctgccagctcagtaagatgacagaatgtgtcaattgtgtaaacgtctctgctgaatgagcatcacactctgctggccatgatggttactccttgatgggatttattagcatcattcgtgataaaacaaccattcttggttgcacgtatgcgccacggggattatttatatacactagttgagtattatataatattctgcgcctgaggaggctggttggaacgatctggcagttgcagcacctggtggacctgggtttgttaagaattcaacgagagcgtggcaggagagaagacggacggtggcggctggccagcgaaacgccgaaaccccccgcggccaaagccaaaccgccccaccagtcaaagtcgggccacgaatgaccgagtgcgttgggggaagctggccaaacatttccatcgctgccgcccgccatcccgacggaaaccgccctgccgctgccggcgcccggcggctgcctgattattgccacacggcacacttggaaagtcagacgagaaagcgtgttgggcttctctctcagcaccggaccggaaaccgaccgcgaaaccgcacgccttctgccttcatatattaccggaacaggcctccgcttgtctgccttggtgctcgcgagtcgcaaccagcccaaccccagccaagaagcaacgcggcggcggccggcaccgcatcgggttggttgttgggttcatccacgacgcagcaggccggaggaaggagcggaggcgatgtgctgctgcggcgacggggagtgccggccgctcgggtggctcctgggcctgcccttcgcggtgctcgccgtcctcgtctccttcgtcggcgccatcatctggatcatcgggctgcccatctcgtgcatctgcccctgctgcctctgcgtgacggtgctgctggaggtggccgtggagctcgtcaaggcgccgctccatgtcatgacctggttcacctccaagataccctgctgatgctgagtgccgacgatcttcacttcatcccagtcccagtagctgcccccgatcatacgtcttcttgctttagccggagagattgctgtacattcgttccgatccgtctcgtcgtcggttgagtcatcgtagtactctgggtcctgcaattgatttttccacggatttggcaactgtgtgaccttgtgataaaagtacgaccaatagcactactacttcttgttcttgaactgaatgcatggagtaccagtgccctgactgtgacgatcggcacactgactttggttacggctgcctgccttcatgcgctgccttgcgtagtaagcttttgcgtgtgtttcccagtcccagcccggggaatccgcaagaaaatccgtctgaaattgcgagggtaaaacacgagc

SEQ ID NO: 3264 - DNA, 535 bp, Triticum aestivum
ctgacatctgtcatccacgccgtagcaggccggaggaaggagccggaggcgatgtgctgctgcggcgacggggagtgccggccgctcgggtggctcctgggcctgcccttcgcggtgctcgccgtcctcgtctccttcgtcggcgccatcatctggatcatcgggctgcccatctcgtgcatctgcccctgctgcctctgcgtgacggtgctgctggaggtggccgtggagctcgtcaaggcgccgctccatgtcatgacctggttcacctccaagataccctgctgagtgccgacgatcttcacttcatcccagtcccagtagctgcctccgatcatacgtcttcttgctttagccggagagattgctgtacattcgttccgatccgtctcgtcgtcggatgagtcatcataatactctgggtcctgcaattgatttttccacggatttggcaactgtgtgaccttgtgataaaagtacgaccaatagcactactacttcttgttcttgaactgaatgcatggagtaccaaaaa

SEQ ID NO: 3265 - DNA, 805 bp, Zea mays
ctcactgtctgccagactgcccacccggccccgtctatcccttggaaagtcagacgagaaagcgtgctgggcaccgcaaggaaagcgaccacgaaaccgcgcgcctcctgcctctccatcttctccatatatactacctatcgaccgtgtccggcgggccggacctcttgtcgtcttggtgcgcgcgctcggtttcccttcctttttccctcgcgcgcggccaacctagaaagcgacggcggagccggagagggaaggggaggcgggccggctggtcaagggcggacgatgtgctgcggcggcgacggggagtgccggccgctcgggtggctcctgggcctgcccttcgcgctgctcgccgtcctcgtctccttcgtcggcgccgtcatctggatcatcgggctgcccatctcgtgcatctgcccctgctgcctctgcgtgacggtgctgctggaggtggccgtggagctcgtcaaggcgccgctccatgtcatgacctggtttacctccaagatcccctgctagctgtcccctgctttctgctgtgcggatcatacatacatcttgctttagccggagaggttgctgtactgtactgtactgttgtttcgtttcgtcgtcgcttggtccgttcgtcctagtgctactttgggtttctgcgattgatttttcagactagcttgttcttgaattgaatgcatggacttgtgctgccagcgccctggctagctacgacgatcagatcagccggcagcccggcacactgactttggtcacggctgccttcatggcgtaggtttttgcg

SEQ ID NO: 3266 - DNA, 711 bp, Setaria italica
cgcacttggttttctacgccagcgcagcaagcagcgcaacgcagcggccggcattgattattgcatctgatctccgcgccggagccggaggggaggagaggatcgagagaggatgtgctgcggcggcgacggcgagtgccggcccctggggtggctcctgggccttcccttcgcgctcctcgccgtcatcgtctccttcgtcggcgccatcatctggatcatcgggctgcccatctcgtgcatctgcccctgctgcctgtgcgtgacgctgctgctggaggtggccgtcgagctcgtcaaggcgccgctccatgtcatgacatggttcacctccaagataccctgctgatcatcatccacttcgccgctgttccaccgtagctagctacctgcctcgtgctacctccaagttactattagactccggttcggcactttgtgttcgtccacagatttcttgctgtatattcgtatcatcgtcggctgatttcattcttctgaatatatgttggtctgaaagaaatttgatagatttgtggataaaagaagatagcacctgaaaatagaaaaactgtagcgctccttttacaacaggtagggctcctcttttatagtgacccgtgagccactttacatttcgaaaatgttctttctcaaccactacattcctatgatatgccgtacataaaagtcactaagggtacgtacaaa

SEQ ID NO: 3267 - DNA, 639 bp, Saccharum officinarum
tgagaccaccctggcaaattagatagcaatcaagaattagcaaggatcgcctaactaatcaagcaggcaaggaaaggtagaggggaaaggaacagagagcggcccgtgaatgtgctgctgtggcgatggcggcgagtgccggccgctgggctggctgctggggctgccgttcgcgctgctcgccgtcctcgtctccatcgtcggcgccatcatctggatcatcgggctgcccatctcgtgcatctgcccgtgctgcctctgcgaaacggtggtcctgaacgcggcggtgagatcttataaaggcgccgttgcacgttaaaactgtgtcaactctcagataccctgctatacaaagagtcggagtaccacatctaagcgttattgttcctagctccatgtaccaaggtcgatgggtcatgttaggcgaggatgaatcatgcgaagcacattgatcgagttgtgaacggattgtttatgtccatcagtattcactatttagtatgcatcttcttgggtggaaatttttttaaaaaaaaaaaaaaaggcggggcggtttagaggaatcaagcttacgtacccttgcattccaagttataaattttttatttggggcccctaaattaaatttaatgggccggt

SEQ ID NO: 3268 - DNA, 593 bp, Panicum virgatum
gcgtgtccggcttctccgcgcccggccggcctccatatatactactctccctcttgtagtcttgcgcctctccttggttccacacgcctagctagctaagcacgacaggctccagcgcagcaagcgacgcgacgccatcgactgcgactggtcgaggatgtgctgcggcgacggcgagtgccggcccctggggtggctgctgggcctgcccttcgcgctcctcgccgtcatcgtctccttcgtcggcgccatcatctggatcatcgggctgcccatctcgtgcatctgcccgtgctgcctctgcgtgacgctgctgctggaggtggcggtggagctcgtcaaggcgccgctccatgtcatgacctggttcacctccaagataccctgctgatgataagtccacagctagcacaggacagtagagatcgatcatcctgctctgctttgcttttgtggattcatcggcactcgtgtggtgtgcgtcgtccacggatttctcgctcgctgtatattcgtatcaccggccggttgatttgtttgattcgtcttgatactttggtggattctgcgattcatttccagagatttgttga

SEQ ID NO: 3269 - DNA, 778 bp, Panicum virgatum
agacgagaaagcgtgtccggcttctccgcgcccggccgcctccatactactagtatatactactacccgggaatccctcttgttttcggtagtcttgcgccggcttgcattggttctccacgcctagctagccaaagcacgacaggctccagcgaccagcgcagcacacggcagcaagcgacgcgacgcggcggccggcgccatcgaatcgattgcggctgatcgaggatgtgctgcggcgacggcgagtgccggcccctggggtggctgctgggcctgcccttcgcgctcctcgccgtcatcgtctccttcgtcggcgccatcatctggatcatcgggctgcccatctcgtgcatctgcccgtgctgcctctgcgtgacgctgctgctggaggtggccgtggagctcgtcaaggcgccgctccatgtcatgacctggttcacctccaagataccctgctgatatctcgatcccttcgtccattattccattcttccaccacagctagctagcagccttcctagtacagtactagtcatcaccatcatccggctgtggtggtttcatcggctctcgtgtgcgtcgtccacagattgctcgcttttgtatattcgtatatcatcggttgatttgtttgattcgtcttgatactctggtggattctgcgattgatttccagagatttggtgactgactttgtgatccacaagtaatgctactgttcttgagtgctgtggaaatctgtgcctgctgtcgatttcggcagtgcctggtcttg

SEQ ID NO: 3270 - DNA, 572 bp, Panicum virgatum
gctccagcgaccagcgcagcacacggcagcaagcgactcgacgcggcggccggcgccatcgaatcgattgcggctgatcgaggatgtgctgcggcgacggcgagtgccggcccctggggtggctgctgggcctgcccttcgcgctcctcgccgtcatcgtctccttcgtcggcgccatcatctggatcatcgggctgcccatctcgtgcatctgcccgtgctgcctctgcgtgacgctgctgctggaggtggccgtggagctcgtcaaggcgccgctgcatgtcatgacctggttcacctccaagataccctgctgatatctcgatcccttcgtccattattccattcttccaccacagctagctagcagccttcctagtacagtactagtcatcaccattcgccagatccatcatccggctgtggtggattcatcggctctcgtgtgcgtcgtccacagattgctcgcttttgtatattcgtatatcatcggttgatttgtttgattcgtcttgatactctggtggattctgcgattgatttccagagatttggtgactgactttgtgatc

SEQ ID NO: 3271 - DNA, 978 bp, Panicum virgatum
tagaattgtatttattttgggacggagggagtagcatgctatcgtgaacgaattgagtcatcgcgaagctccttccttacctgtatggccgtatgcatggagtacacgcacgcggcacgcgtcacagaacggaaggttaccaactttttgatggtgaaatcgttgggttttggacgatctggtggctagcttgcacttgcaccggggcgtggaattcaacgggtccgtgggtggcgtcagcccagcgaaaccgccgcggccggagccggaccttggccacctcgccttccaaccaactccacatggcatgggcggccgctgcatcgcgcgccagcgccatggccatcacctcacctggatggattggtcagacgagaaagcgtgtccggcttctccgcgcccggccggcctccatatatactactctccctcttgtagtcttgcgcctcgccttggttccacacgcctagctagctaagcacgacaggctccagcgcagcaagcgacgcgacgccatcgactgcgactgatcgaggatgtgctgcggcgacggcgagtgccggcccctggggtggctgctgggcctgcccttcgcgctcctcgccgtcatcgtctccttcgtcggcgccatcatctggatcatcgggctgcccatctcgtgcatctgcccgtgctgcctctgcgtgacgctgctgctggaggtggcggtggagctcgtcaaggcgccgctccatgtcatgacctggttcacctccaagataccctgctgatgataagtccacagctagcacaggacagtagagatcgatcatcctgctctgctttgcttttgtggattcatcggcactcgtgtggtgtgcgtcgtccacggatttctcgctcgctgtatattcgtatcaccgccggttgatttgtttgattcgtcttgatactttggtggattctgcgattcatttccagagatttgttgactctgta

SEQ ID NO: 3272 - DNA, 597 bp, Panicum virgatum
gcgtgtccggcttctccgcgcccggccggcctccatatatactactctccctcttgtagtcttgcgcctctccttggttccacacgcctagctagctaagcacgacaggctccagcgcagcaagcgacgcgacgccatcgactgcgactggtcgaggatgtgctgcggcgacggcgagtgccggcccctggggtggctgctgggcctgcccttcgcgctcctcgccgtcatcgtctccttcgtcggcgccatcatctggatcatcgggctgcccatctcgtgcatctgcccgtgctgcctctgcgtgacgctgctgctggaggtggcggtggagctcgtcaaggcgccgctccatgtcatgacctggttcacctccaagataccctgctgatgataagtccacagctagcacaggacagtagagatcgatcatcctgctctgctttgcttttgtggattcatcggcactcgtgtggtgtgcgtcgtccacggatttctcgctcgctgtatattcgtatcaccggccggttgatttgtttgattcgtcttgatactttggtggattctgcgattcatttccagagatttgttgactct

SEQ ID NO: 3273 - DNA, 1579 bp, Oryza sativa
gtgtgggtgagtgcgagctaagcaagcacgcatgcagctaatggtccatctccctctctaccttatcctctcctactccaaccatccacacccttgcgcagccctttgccctttctaacctaactcgttgacacttgttttcctcgccggtaacaccatccactcttgactgcgattggaagcaccactactatcgcccgtctcactctcaccatcaccactactaagtgccacctactattggtcggcctattctctggcaatccctctaagcctagacctctttccccacatccctctccctcccaccatccctacccctaccttgaaaccttaatccacgagggcttagacaataatgacggtatcggagcgctactgcgtgccccgacaaaccgatttgttcgaacccatgcgcgggtaacgaacgctcgcgaattagcattcctacactgtgtaggaccctgttcagtaacctgcctcatctgccgctgatttctccatgtccatcaacgaagaaagcgatgggaaacgcctcccactcgcacgcgctggcacggcaccatgtgattgactacatatgtaggtcaataattaggccacaaccacaacaaccgccacaaaatacaatgcaaaacctggcattcataattcatacaaaaattattaaaacaagatcgatcgatcgatcgatcaagagttgcatcccaaaataaataatccaccgcaaaagctacaggcgccagcctccaggtagcttcgctatagcccatcaaacaagcaagaaagggggagagaagggaaggagaggtcgtcgtcgccgtcgacgacgattcaccggccatgtgctgctgctgcggcggcggcggcgacggcgacggcgacggctgcaagtgccggccgctggggtggctgctgggtctgcctttcgcgctgctcgccgtcctcgtctccatcgtcggcgccatcatctggatcatcgggctgccgatctcgtgcatctgcccgtgctgcctgtgcgtgacgctggtgctggaggcggcggtggagctcatcaaggcgccgctccatgtcatgacctggttcacctccaagataccatgctagctatagcttcttgatttgctctaccatttgatcagatataaacagaatgatcagtaactgatcagtaagtataccgattatttattatttatttatgcatatgtactctggcttggagatatgattaatttgtcattccaatcgagattcattcggtgaaaagatatactctgtggtgctggttcatctttgatcccctttttcgtgtgttcctgtcaacaactcctgctgctgatggaatttcagaaactaaaaaaaaaaagtcaggttgatggagttggtacaggtagagccactgattaaagcctgacgggtcaaaggctcatgtactagtaactttctttgacgaaatttcaaccaaacaagtctgatccaacttcgaatttgtgcgctttctgtggcacacaactcaaccttgaccattcatccttgcgagtccacctttccctacgtgtctctcaacgttcaagac

SEQ ID NO: 3274 - DNA, 255 bp, Setaria italica
tgctgcggcggcgacgacggccgcgagtgccggccgctggggtttctgctgggcctgccgttcgcggtgctcgccgtcctcgtctccatcgtcggcgccatcatctggatcatcgggctgcccatctcgtgcatctgcccgtgctgcctgtgcgtgacgctgctgctggaggcggcggtggagctcgtcaaggcgccgctgcacgtcatgacctggttcacctccaagatcccctgctagcgcctgatgcgctag

SEQ ID NO: 3275 - DNA, 1563 bp, Oryza sativa
aatgagtgcgcaaatacgcgacgaacactgagtacgtgtgggggggggggggggggggccggtggctcaaccgatccttcgcctccccattccaactcgttcggtgcggggccagcctaacgccaccgcgccgccacgcgtccgcgcagatatacatatacggccgttgcaccggtcaaacactggcggcgtcgcacggcaactcccacgaccgcccgtttggccctagcaacggctcggatctgcccctggcggattatctcaaccccggccccaagtctccaacaaccgttctacacttggcggcggcagaagggtgggtctgacgagacgagaggcgtcgacttctctctctctgccggaaagcgactccgcgagacgccgagacagcgtggtggttttcgtcgtcgtcgtcgtcgtcggcttcatatatcccctgggattccgcttcggtttccacgcgccaaagcaaacgggcaaagggaattgaagtagcagcagcagtgaattgaagtaagaagacaacgggatgtgctgctgcggtggcgactgccggccgatcgggtggctgctcggcctccccttcgcgctcctcgccgtcgtcgtctccttcattggcgccatcatctggatcgtcgggctgccgatctcgtgcatctgcccgtgctgcctgtgcgtgaccgtgctgctggaggtggcggtggagctcgtcaaggcgccgctccatgtcatgacctggttcacctccaagataccctgctgatctgatctcagatcatcatcagatcttgctgctgctacatatatacactactatctccgtttggttgatttagtgtcgtgacagaattccagttggtaggaaaatgtttttgtgcatgattccttatggatagatcgattatctctactcgttggttggttctgaatttgtggagagattgtcagcgattaattgcgtgcccatgcccatagacattgaagagttgttgcttcgtctgtttcggtgtctgtttcgctgtgtgtgtgacatgatgatttctggattagtgcttgtggaatgccgatgcctggtgtgtcttctgtgatgttgatgttgattgggacaacttaattggatcatcctggttggcagttgcctacaacattcggtgcagacgtcggaagttgtcgcttccgtgttataagttgctttgaaattttttcagttacaattaaagttttttttttttaaaaaatatagccacactttcaatacaaaacaaaatattatcaaaatatattcaacgttgcatttaataaaactaatttggtgttagagattgtgctaaatatttctatcaaacttaaagaagtttgattaggaaaaagaataaaaaataacttatgatacgaaacggagggagtacttcggaagaatttgatctgatctttccagttgctctgttgcattcaaatttgtgtttcagagttccaatgtaatagactcaacagatatagccaacatgggccaaatttataatatcacacatgggctcatgatgggcttaaccgggtccaatg

SEQ ID NO: 3276 - DNA, 1121 bp, Hordeum vulgare
gtcccgtctcctctcctccctggtgctatatagctactcctgctgtgtttcccacgcctaaccaccccgacgcgtgacagccgccggcgccgatctgaccagcctcccttcgcgtgcctcgcaccagtcgcacgcaccccgggaaggggaggaggatcggaggaagatgtgctgctgttgcggcggcggcgaccgcgaccacgaccacggctgccggccgctcgggttcctgctcggcctgcccttcgcgctcctcgccgtcctcgtctccatcgtcggcgccatcatctggatcatcgggctgcccatctcgtgcatctgcccctgctgcctgtgcgtgacgctgctgctggaggcggcggtggagctcgtcaaggcgccgctccacgtcatgacgtggttcacctccaagataccctgctgatccctcgtcaaggcgccgctccccgtcatgagggatcgctcgccccgtctctcgctcatgtcttagccggcgttgcacatgtcccgcggattcttgtttttattttctctctcggaacatatgttcggggattgatcggcgtatattcctacctggctgatgattcctgctcgttctccctttggctcgatcgtctgtgatccgttccgggatgtttgaggattgtgactttacttttcgtgactgttagcggctgccggggctctgtttccgtcggtttcttcgcatggtacagtatttgtgtgcgattgatgtggtggatgcgatgcctactgtctgctcttgtggatgttgatcactgggattctgacttaactgggcgttttgcgtgccagttgctcaaagtttccactgtacttccttgaaaaaaaaacaggtggttacactgaggaggtgtttggttaccgagattgtaaatgtaatttgattacagcgggaccagttgccgtcaaatcgtgtttgtttcaccgcggctgtaatcaggtcccatcattatacaaaattgattacgttccaaatgggctgtatcggtctgttacctgcttcccgcagccgcacaaagccgctcaaagggtgcgagagaaaaagaacatcgacaaccacaattcgccagcagtcggcatgcttcgccggcgtc

SEQ ID NO: 3277 - DNA, 1269 bp, Secale cereale
ccggccggattcctcgctgccgcttgccaccgcagcgcattattgccgaccttgccgcatgcggagtaaatcaactcgccgcgccggaaagcgaccgcagagccggcccgtctcctctcctcctcgatataactacggggtactgtgtttcccacgcctaaccaaccactccgacgcgtgacagccgccggcgccgatctgaccagcctcccttcgcctgccgcgttcgcacgccggggaaagggaaagggaaagtggaagggaagaggatcggaggaagatgtgctgctgttgcggcggcggcgaccgcgaccgcgagcacggctgccggccgctcgggttcctgctcggcctgcccttcgcgctcctcgccgtcctcgtctccatcgtcggcgccatcatctggatcatcgggctgcccatctcgtgcatctgcccgtgctgcctctgcgtgacgctgctgctggaggcggcggtggagctcgtcaaggcgccgctccacgtcatgacctggttcacctccaagataccctgctgattcctcgctgatcggggttcactcgctcgctcgccccctcgctcggcgttgcacatatccgcgtattcttgtttttctttcgtcgaaacatatgttcgcggattgattggcgtatattggtaccatggccgatgattcctgctcgtttccccctttgtggttcgatcgtcctgtgatcccttccgggatgcttgatgactgtgactttacttttcgtgactgttagcgactgcctgtagttctgtttcggtcggtgtcgtcggctgttactaattatcagcgattgctatgggcacgatgtctaccgtctgctcttgttgatgtcgatcaccgggcttctgccttcagagcatctactcgactttgctttacaaccgggcatcacaaatcaggcccccaatcctactctgttagtaccagttggcagcataggggagaaaagcaccacacctagaaataggaatcagaaagagaaaaacatggtgaccgatacaacttatattttccaaaatgttaagtgccacacatcagatgtgtgccactccagccatggcaattccagtcacgcaaatatgtcaattttcggttacacgtgataagtttctgtcaaaaaatagaccgaagcacgaaagttgtcatgcttgacaactaaaattgccattcgcacgtcactaaacttaccatcgaaaacattcggaggtgccatgtgcttgtatctgcgttcgatactt

SEQ ID NO: 3278 - DNA, 895 bp, Triticum aestivum
gccggatttcctcgctgccgcctgcccactgcggcgcattattgccgaccttgccgcacgcggataaatcaaaactcgccgcgccggaaagcgaccgcagagccggcccgtctcctctcctccctgacgctatatagctactcgtactgtgttccccacgcctaaccactccgacgcgtgacagccgccggcgccgatctgaccagcctcgcttcgcctgcctcgtacgcgcgccggggaaagggaaagtgaaaagggaagaggatcaggggaagatgtgctgctgttgcggcggcggcgaccgcgaccacgagcacggctgccggccgctcgggttcctgctcggcctgcccttcgcgctcctcgccgtcctcgtctccatcgtcggcgccatcatctggatcatcgggctgcccatctcgtgcatctgcccgtgctgcctgtgcgtgacgctgctgctggaggcggcggtggagctcgtcaaggcgccgctccacgtcatgacgtggttcacctccaagataccctgctgattcctcggtgaccagggaccgctcgctcgcccccctcgctcatggcttagtcggcgttgcacatgtccgcagattcttgttgtttttttcccctcgaaacatatatgttcgcagattgatcggcgtatatttcgcaccatggctgatgattcctgctcgttttcccctttggttcgatcgttcctgtgatcccttccggatgtttgatgattgtgactttacttttcgtgactgttagcgactgcctgtagttctgtttccgtcagattcttcggctgttatttgtcggcgattgctatggacacgatgtctaccatgtgctcttgttgatgttgatcactgggcttctgccttaagagtat

SEQ ID NO: 3279 - DNA, 380 bp, Avena sativa
aaggatcaaagatgtgctgctgttgcggcggcggcggcggcgacggcaaccacgaccgcgggtgccggccgctcgggttcctgctcggcctgcccttcgcgctcctcgccgtcctcgtctccatcgtcggcgccatcatctggatcatcgggctgcccatctcgtgcatctgcccgtgctgcctgtgcatcacgctgctgctggaggcgggcgggtggagctcgtcaaggcgccgctccatgtcatgacgtggttcacctccaagataccctgttgatttcatcacgagtcccgcgctcccctcgtactcttagttggtgttgcacaattttttgtttctttcgattggcttatatccgtaccatgttctgatgattcac

SEQ ID NO: 3280 - DNA, 1011 bp, Brachypodium distachyon
cacaggcttgaggaagcgcgtttgccttctcgccgcgcgccggaaagcgaccgcggaacggtccagtggcgcctccggcctcccttgattgatatacctgccggtacacgtagtactacttcgtcccgcacgcccaaccacagcgacgcgcaccagccagccagccagccagccgccgccgcatatccgatccgagtctctgaccagccttcgtcgtccgcgcgcatgcgtgcgagctcctccggggggaaaggggaggagaggagaagatgggctgctgctgctgcggaggcggaggcgatcgcgaccgcgaccgcgggtgccggccgctcgggtggctgctgggcctgcccttcgcgctcgtcgccgtcctcgtctccatcgtcggcgccatcatctggatcatcgggctgccgatctcgtgcatctgcccctgctgcctgtgcgtgacgctgctgctggaggtggcggtggagctcgtcaaggcgccgctccatgtcatgacgtggttcacctccaagataccctgctgattcactcctcgctcgccagaaatccctccctcccccttcggtcgtcgatcgtatctctcagttggtgttgcatgtgtccgcagatttattttgtttttcccacagatttgttggcgtatattcgtaccatctgccgatgattcctgcttttcacaccttttggttcgatctttacttcaggtcaggatattcggtggttatgacttcatttgtgggtgtgattgttagcgactgcccgtagttctgtacctgtcaattactctcttttttgcgggattgtaaatgtcaattgtctttacgtctgactgctgtgccgaccaacgtaccgtgtgctcttgttaaagttgattgaggtctgtcttgattgtttctcgtgccggtttctccgttccatgcgaataaatttccactgtcgtggttgacaatgctcaatgaagtccacgatccgcagaaaattggcagaggttacgtgtaacat

SEQ ID NO: 3281 - DNA, 676 bp, Saccharum officinarum
  misc_feature (601)..(601): n is a, c, g, or t
cgtccacactatgctggaggacgacgtcttcttcgccgagctcagcaagcggatatcgctgctcatcaccgacgacgacgaaggcggcgcggactcatccgtcggcgcgcagttcgtccccgcctcctccgccgccgcgcccctcccggggttcccatcgtcgcgcgcccatgtgccgtcgcatcagcaggattggggcgcgtcattgctggcgccaccggcctacgcgttgtaccaccacggcgccagctacggcggggcggcggcggcgtggcagcagtgcggcagcaagggcaccggcgtgttcatcccgcggtccacgcccgggtccgcgcaccccaagaagaagggcaagaacaggggcgccgccgccgccgccgccaaggccgcgcgggcggcgcagcaggcggtcggcgcaggcgtgccaaccaagaagcgcgtctgatttcgagctctcgatcgtgaatggatcaggaaaaaaaaaggaaaaaaggaggggaaaaaagcacaactactaactccagatgcagcagtgcaacgaggtgccgaacgaagaagtgatcgtcggaatcagccggattagcttaatctgtttaattanattaattaatcaatttcgagtattattactggtattcttatatagcaaataataaaaccattgcgactcccctgg

SEQ ID NO: 3282 - DNA, 2308 bp, Saccharum officinarum
ctctatttccgcgcagcattattaaacacatcggaggcgcgaccgcctcgtccgcttctgcttctggcagcaaagcgcactagtagagctgctaaacctcgggccatcccccgcggcgcgacacacccaaaggagaggcctcccgtcccgtgtgttgatcgctccgctccccacgatggcgtcgcacatcatcctgccgccggacgacgccgacgagaaccacaaccaccaggaggcggcggaggaggaggagcgggaggagctggggcgcgacgacgacgacgacgacgacgacgagcacgggccacccccggggctaccgcccaaggcggcgctgccgttctcggccacgtgggtgcggatctcccgcgactcgtacccgaacctccgcgcgctccgcaacgcctcctccgtcagcctcgccgacgccgcctacgtcaagatctccgagggcgacttcggctacgtcctcgacgacgtgccgcacttcaccgactacctccccgacatcccgacttatcctaatccactacaggatcatccggcctattcaactgtcaagcaatattttgtcaatgaagatgacactgtacctcaaaaggttgttgttcagaagaacagccggcgcggtgttcacttccgtcgtgctgggcctcgtcagagggtttattttggcaccgatgaagtgaaggcctgcattgtaacttgtggaggcctgtgccctgggcttaacactgttatcagggaactggtgtgtggcttgtcacacatgtacaatgtcagcagcatttttggaatacagaatggatacaagggcttctattctagcaactaccttcccttgacaccaaagagcgtcaatgacatccacaaaaggggtggtacagttctaggaacatcacgaggtggccatgatacaaaaaagattgttgataacattcaagatcgtggaatcaatcaggtgtatatcatcggaggagatggaactcagaaaggagcatatgagatcttcaaggaaatccggaaacgtggcctcaaagtttctgtcgctggagttccaaagacaatagataatgacattgcgatcatcgacaagtcttttggttttgatacggctgtggaagaggcccagcgtgccattgattcagctcacgtggaagcttgcagtgctgagaatggaataggtttagtaaaactgatgggtcgttatagtgggttcattgctatgtatgctactcttgctagtcgagatgtggactgctgtttgattccagagtctccattttatctggacggagagggcggattgcttgaatatatagaaaagaggctgaaagagaacaagcacatggttattgttgttgctgagggagcagggcaggatcttattgcaaaaagtatagccacatcagatcaacaagatgcatctggaaataagctgcttcttgatattggtctttggctgactcacaagataaaggattacttcaaaagcaaaaagatggagatgacgattaaatacatagatcctacatacatgatccgtgctattccaagcaatgcatcagacaatgtctactgcacacttctagctcacagtgctatccatggggcaatggcagggtataacttcactgtggggatggtcaatggaagacatacctatatacctttctatagggtgacatccacaaggaacaaggttaaagtcactgacaggatgtgggcaaggcttctgtcgtccaccaaccagccaagtttcctgagtcagaaggatatcgatgaagcgagtgaggcggataggctggcaaacaggccaccactgccaacgggtgccagccctcgcgtggcgaggtctttcgatcaatcttcgtcgtgttcttcgaatggagagatctagtgattgcaggtgcaccactactgtgtacagaaactactagtatcgttctgagctctggtgccagagcagcttggccacgcaatgagttttgctcttgtagtcgttatgcatatgcgttgtgtagagggacacgcggatatgaccctgttagcacgtgtaataaagaaacaccattgatgctgctacttcctggatctccagctatcatgtatttgctgcagaatataaggagttattattcaatctgcagatgatcaaaagaataaaaaagtattgaatttagaatctgacaaaagggcggcccgtttaaaagaaccaaacttacctacccctgcttgcaaatcataatttttttttatggcacctaaaatcaaattacttgcccgtgttttaaaaacgttctgaaat

SEQ ID NO: 3283 - DNA, 2126 bp, Zea mays
aacacaccggaggcgcgaccgcctcgtccgcgtctgcttctgcatctgcttctgcttgtgctgctgctgacatcgaatcaaagctgctaaacctcggtccatccatcacccgcggcgcgacacacccaaaggcctctccctcccgtcccgtgtcccgatcgcaccgctccccacgatggcgtcgcacatcatcctgccgccggacgacgccgacgagaaccacaaccaccaggcggcggcggcggcggaggaggaggaggaagagcgggacgagctggggcgcgacgacgacgacgacgagcacggggtgccaccggcgctgccgcccaaggcggcgctgccgttctcggccacgtgcgtgcggatctcccgcgactcgtaccccaacctccgcgcgctccgcaacgcctcctccgtcagcctcgctgacgccgcctacgtcaagatctccgaggccgactttggatacgtcctcgacgacgtgccgcacttcaccgactacctccccgacatcccgacttatcctaatccactacaagatcatccagcctattcaactgtcaagcagtattttgtcaatgaagatgacaccgttcctcaaaaggttgttgttcagaagaacagtcggcgtggtgttcacttccgtcgtgctgggcctcgtcagagggtttattttggcaccgatgaagtgaaagcctgcattgtaacttgtggaggcctgtgccctgggcttaacactgttatcagggaactggtgtgtggcttgtcacacatgtacaatgtcagcagcatttttggaatacagaatgggtacaagggtttctattctagcaactaccttcccctgacaccaaagagcgtcaatgacatccacaaaaggggtggtacagttcttggaacatcacgcggtggccatgataccaaaaagattgttgataacattcaagatcgtggaatcaaccaggtgtatatcattggaggagatggaactcagaagggagcatatgagatcttcaaggaaatccggaagcgtggcctcaaagtttctgttgctggagttccaaagacaatagataatgacattgcgatcatcgacaagtcttttggttttgatacggctgtggaagaggcccagcgtgccattgattcagctcatgtggaagcttgcagtgctgagaatggaataggtttagtaaaactgatgggccgttatagtgggttcattgcgatgtatgctactcttgctagtcgagatgtggactgctgtttgattccagagtctccattttatctggatggagagggtggattgcttcaatatgtagagaagaggctgaaagagaacaagcacatggttattgttgttgctgagggagcagggcaggatcttatcgcgaaaagtttagccacatcagatcaacaagatgcgtctggaaataagctgcttcttgatattggtctttggctgactcacaagataaaggactacttcaaaagcaaaaagatggagatgacgattaaatacatagatcctacatacatggtccgtgctattccaagcaatgcatcagacaatgtctactgtacacttctagcccacagtgctatccatggtgcaatggcggggtacagcttcactgttgggatggtcaacggaagacatacctatatacctttctacagggtgacatccacaaggaacaaggttaaagtcactgacaggatgtgggcaaggcttctgtcgtccaccaaccagccaagtttcctgagtcagaaggatatcgacgaagcgagtgaggcggataggctggcaaacaggccaccactgccaacgggtgccagctctcgcgtggtgaggtctttcgatcaatcttcgtcgtgttcttccaatggagagatctaagtgattgctggtgcaccgcaattgtgtacagaacctacttactatcgttctgagctctggtgcttgggcagcttcgccacgcaacgagttttgctcttgttgttagtcgttatgcatatgccttgagttgtgtaggaggacacgcggatgtgggccctgttagcacgcgtaataaagaaacaccattgatgaagctacttactagaggctctccatctatcat

SEQ ID NO: 3284 - DNA, 3696 bp, Setaria italica
gcctcgacggcaaccatgtatcgggctgcggggagccacctccgctccctcaagcatcacggtgctaccaggcttgctagtacaagtgttgtgaagcagtcccaaggtggcctgtttggctggcttcttgggggaaaatcaagccaacttcccccccttgatgttccgctcccaggcattactattcccccacctctaccggactttgtagagccatctaagacaaaaatcactactcttccaaatggtgtcaagattgcctcggagacgtcagcgagtccagcagtatcagtgggtctgtacattgactgtggctccatttatgaaacacctgcttcatctggagtgtcgcatctattggagagaatggccttcaagagcacagtgaatcggagtcacttgcggctagttcgtgaggtagaagccattggaggaaatgtctccgcttcggcttcccgtgaacaaatgagctatacctatgatgcattgaagagctatacaccagaaatggttgaagttctcattgacagtgtgaggaatccagcgtttttggattgggaggtcaaagagcagctccagaagataaaatctgaaatagctgaagtgtctgctaatcctcaaggcctactactggaggcgcttcattcagctggatattctggggcgctagcaaaacctttgatggcttctgaatccgctgtgaaccgattggatgttagcatcttggaggaatttgttgctgaacattacacggcacccaggatggttcttgcagcatcaggagttgagcatgatactttggtttcagttgtagaaccacttctatctgaccttcccagtgtgaaacgtcctgaagagccaaaatcagtgtacgtgggaggggactatcgttgccaagcagattctccaagcacacacattgcacttgcttttgaggtgccaggtggctggaatcaagagaaaactgcaatggttgtgacagtgcttcagatgctcatgggaggaggagggtccttctctgctggtgggcctggaaagggaatgcattctcgattgtatctccgtatcttgaccaactaccaacagatcgaatcattctctgctttcaacagtgtctacaacaattcgggtctttttggaatttatgcagtcactagcccagacttctcatcaaaggctgtggatttggcagccggggaactccttgagattgcaactcctggaaaagtttcacaagaacagcttgatcgtgctaaagaggcaaccaaatctgcagtactgatgaacttggaatcaaggtctatagcatctgaagatattggaagacaggttctgacttatggggaaaggaaacccattgaatatttcctgaaaactgttgaggagatcactttgaacgacatctcgtcaactgcaaagaagataatgtcctcaccgcttacaatggcatcatggggcgatgttattcatgttccaagctacgagtctgtcagccgaaagtttcactcaaagccgcgcccccgcaccatggcgtcgcacatcatcctgccgccggacgacgccgacgagaaccaccaccacccccaggaggatggggaggagcgggaggaggagctggggcgcgacgacggggacgaggagcgggagcacgcgtcccccgagcggccgcccaaggcggcgctgccgttctcggccacgtgcgtgcggatctcccgcgactcctaccccaacctccgcgcactgcgcaacgcttcctccgtcagcctcgccgacgccgcgtacgtcaagatctccgagggcgacttcgggtacgtgctcgacgacgtgccgcacctcaccgactacgtccccgacatcccgacctatcctaatccattacaagatcatcctgcctattcaactgtcaagcagtattttgtcaatgaagatgatactgtacctcaaaaggtggttgtacagaagaacagccggcgtggtgttcacttccgtcgtgccgggcctcgtcagagggtctattttggccccgatgaagtaaaagcctgcattgtaacttgtggaggcctctgccctgggcttaacactgttatcagagaactggtgtgtggcttgtcacacatgtacaatgtcaataacatctatggaatacagaatggatataaaggtttttattctagcaactaccttcccctgacaccaaagagtgtcaatgacatccacaaaaggggtggtacagttctagggacatcacgaggtggtcatgatacaaaaaagattgttgataacattcaagatcgtggtattaatcaggtgtatatcattggaggagatggaactcagaagggagcatatgagatattcaaggaaatccgaaaacgtggcttgaaagtttctgtggctggagtccccaagacaatagataatgacattgcgattatcgacaagtcctttggttttgatacggctgtggaagaggcccagcgagccattgattcagctcatgttgaagcttgcagtgctgagaatggaataggcttagtaaaactgatgggtcgttatagtgggttcattgcgatgtatgctactcttgctagtcgagatgtggactgctgtttgattccagagtctccattttatatggatggagaaggtggattgcttcaatatatagaaaggaggctgaaagagaacaggcacatggttatcgttgttgctgagggagcagggcaggatcttattgcacaaagtatagccaaatcagatcaacaagatgcatcaggaaataagctgcttcttgatattggtctttggttgactcacaagataaaggattacttcaagagcaaaaagatggagatgacgattaaatacatagatcctacatacatgatccgtgccattccaagcaatgcatcagacaatgtttactgcacacttctggctcatagtgctatccatggtgcaatggcagggtatagcttcaccgttggaatggtcaacggtagacatacctttatacctttctatagggtgacatctacaaggaacaaggttaggatcaccgacaggatgtgggcgaggctgctctcatcaaccaaccagccaagcttcttgagtcagaaggacatcgatgaagcgagcgaggccgataggcttgccaacaggccaccattgccaacgggcgccagccatcgcgtggcgagctcttttgagcagtctgcatctacttcttccaacggagagatctaagtgattgctggtgcaccctgaatgtgtacaggagctgttgagctttgccacgctaccaattttgcttttgataagcagatgcctgtggaggaggcactatcctgataacccgagcaataaaacgaaaaccggtgatgaagctgtacatgacctatcttgaatttgctgcagagtattcagtgtaatgccatcagtcgatgattatgtctgctcttgagtcttacctcctgcactgttgtgtgttgtccgctaaggcctctgtatttattcaccatgggccatcgtctactatggcccatttgatggtaagttcattacagcccattagacctacttggttaccagcagcagaactgagcaaaaggggtataggcatgtaatgtaagctacatgacgtgaccatgtcctctcgatatttcaaattttcatccgtaagatggtgcaaccgtg

SEQ ID NO: 3285 - DNA, 2039 bp, Panicum virgatum
aatcaggcgaactactagagctagctaaacctcggagccatcccccccgcgagcgagacaccctcgaggcctcctccgatcgcagcctcgcaatcccccccccccccccaccatggcgtcgcacatcatcctgccgccggaggacgccgacgagaaccaccaccgggaggaggaggaggaggagcgggaggagctggggcacgacggcggggagcgcgcgcccccggagcagccgcccaagggggcgctgccgttctcggccacgtgcgtgcggatctcgcgcgactcgtacccgaacctccgcgccctgcgcaacgcctcctccgtcagcctcgccgacgccgcctacgtcaagatctccgagggcgacttcgggtacgtgctcgacgacgtgccgcacctcaccgactacgtccccgacatcccgacttatcctaatccgttacaagaccatccagcctattcaactgtcaagcagtacttcgtcaatgaagatgatactgtaccgcaaaaggtggttgttcagaagaacagccggcgtggcgtccacttccgtcgtgctgggcctcgtcagaggatttattttggtcccgatgaagtaaaagcctgcattgtaacttgtggaggcctctgcccagggcttaacactgttatcagagaacttgtgtgtggcttgtcacacatgtacaacgtcaacagcatctttggaatacagaatggatacaaagggttttattctagcaactaccttcccctgacaccgaagagtgtcaacgacatccacaaaaggggtggtacaattcttgggacatcacgaggtggtcatgatacaaagaagattgttgataacattcaagatcgtgggattaatcaggtgtatatcattggaggagatggaactcagaagggagcatacgatatattcaaggaaatccgaaaacgtagcctgaaagtttctgtggctggagtccccaagacaattgataatgacattgcgattatcgacaagtcctttggttttgatacggctgtggaagaggcccagcgtgccattgattcagctcatgtcgaagcttgcagtgctgagaatggaataggcttagtaaaactgatggggcgctatagtgggttcattgcgatgtgtgctactcttgctagtcgagatgtggactgttgtttgattccggagtctccattttatatggatggagaaggtgggctgcttgaatatatagaaaggaggctgaaagagaacaagcacatggttatcgttgttgccgagggagcagggcaggatcttatcgcaaaaagtatagccaaatcagatcaacaagatgcatccggaaataagctgctgcttgatattggtctttggttgactcacaagataaaggattacttcaagactaaaaagatggagatgacgattaaatacatagatcctacatacatgatccgtgccattccaagcaatgcatcagacaacgtgtactgcacacttctggctcacagcgctatccatggtgcaatggcagggtacagcttcaccgttggaatggtcaacggtagacatacctatatacctttctatagggtgacatccacaaggaacaaggttaagatcaccgacaggatgtgggccaggctgctatcgtcgactaaccagccaagtttcttaagtcagaaggacatcgatgaagcgatggaggatgataggcttgccaacaggccaccactgccgatgggcgccaaccatcgtgtggcgagctccttcgagcagtcctcttctacttcttccaacggagagatctaagtgattgctggcgccccgggaatgtgtacatgagctgttaagctttgccacgcttatcaattttgctttttatgtgcatatgccttgcgtatgaggacgcatggatactatcctgatacccagagcaataaaatgaacaccggtgcggtgatcagtgaacctgtacaagcactatcttgtgctcgctgggtaatattcaatgcaatttcatcagttgatgatggcc

SEQ ID NO: 3286 - DNA, 2794 bp, Panicum virgatum
cgattacaaaattacagacggctggcaaaatcgaagctgtgcttccagctctccattccaatcccgctgcgccctttttccagcggcgcaaggaatgacgcggtcgcgacgcgacgccgggaattgacccgcgcgcaccgtggcggcggcgcggcatacggtttgcctgccggatctctcgtgtggctgggaccggccgccaccgcgtcgccgaacctgaaaccagcgacagcgaccgcgaccgcgcggcgttgggcgacacgacaggctccgcgggcatctggtcccgagtttccgacgagttgccttgccattcgccgccgcaccacaagcccaaactaaccggcagaaaacgcaggctccacgggcgtcgctacggcctccggatgcaggccgccgaccgcccagcccagccaaaggccatcgccgccgtctccccgaaaccgcgacgcagctccacgtatccgccgcgccaaacaggtggcgaaaccgcgcgcgcgcgcacacatcttttccgctcaaaaccagcgcctggaaccggagacgacccccgctgaccggaccccgcctccccctctccccagcggcgctcggctcgtttattattaaaaccaccggaagcgccgcctcgtccgcttctggcacagcagagcaatcaggcgaactactagagctagctaaacctcggagccatcccccccgcgagcgagacaccctcgaggcctcctccgatcgcagcctcgcaatccccccccccatggcgtcgcacatcatcctgccgccggaggacgccgacgagaaccaccaccgggaggaggatggggaggaggaggaggagcgggaggagctggggcacgacggcggggagcgcgcgcccccggagcagccgcccaaggcggcgctgccgttctcggccacgtgcgtgcggatctcgcgcgactcgtacccgaacctccgcgccctgcgcaacgcctcctccgtcagcctcgccgacgccgcctacgtcaagatctccgagggcgacttcgggtacgtgctcgacgacgtgccgcacctcaccgactacgtccccgatatcccgacttatcctaatccgttacaagaccatccagcctattcaactgtcaagcagtacttcgtcaatgaagatgatactgtaccgcaaaaggtggttgttcagaagaacagccggcgtggcgtccacttccgtcgtgctgggcctcgtcagaggatttattttggtcccgatgaagtaaaagcctgcattgtaacttgtggaggcctctgcccagggcttaacactgttatcagagaacttgtgtgtggcttgtcacacatgtacaacgtcaacagcatctttggaatacagaatggatacaaagggttttattctagcaactaccttcccctgacaccgaagagtgtcaacgacatccacaaaaggggtggtacaattcttgggacatcacgaggtggtcatgatacaaagaagattgttgataacattcaagatcgtgggattaatcaggtgtatatcattggaggagatggaactcagaagggagcatacgatatattcaaggaaatccgaaaacgtagcctgaaagtttctgtggctggagtccccaagacaattgataatgacattgcgattatcgacaagtcctttggttttgatacggctgtggaagaggcccagcgtgccattgattcagctcatgtcgaagcttgcagtgctgagaatggaataggcttagtaaaactgatggggcgctatagtgggttcattgcgatgtgtgctactcttgctagtcgagatgtggactgttgtttgattccggagtctccattttatatggatggagaaggtgggctgcttgaatatatagaaaggaggctgaaagagaacaagcacatggttatcgttgttgccgagggagcagggcaggatcttatcgcaaaaagtatagccaaatcagatcaacaagatgcatccggaaataagctgctgcttgatattggtctttggttgactcacaagataaaggattacttcaagactaaaaagatggagatgacgattaaatacatagatcctacatacatgatccgtgccattccaagcaatgcatcagacaacgtgtactgcacacttctggctcacagcgctatccatggtgcaatggcagggtacagcttcaccgttggaatggtcaacggtagacatacctatatacctttctatagggtgacatccacaaggaacaaggttaagatcaccgacaggatgtgggccaggctgctatcgtcgactaaccagccaagtttcttaagtcagaaggacatcgatgaagcgatggaggatgataggcttgccaacaggccaccactgccgatgggcgccaaccatcgtgtggcgagctccttcgagcagtcctcttctacttcttccaacggagagatctaagtgattgctggcgccccgggaatgtgtacatgagctgttaagctttgccacgcttataaattttgctttttatgtgcatatgccttgcgtatgaggacgcatggatactatcctgatacccagagcaataaaatgaacaccggtgcggtgatcagtgaacctgtacaagcactatcttgtgctcgctgggtaatattcaatgcaatttcatcagttgatgatggctactatggcccatccggctccggcttgctggcaagttcattgcagcccaacgatgttagacctgctgggttacatgaacaaatgggtatggcatagaagtta

SEQ ID NO: 3287 - DNA, 2012 bp, Pennisetum glaucum
cgcaaccgcgacaccgcccctcgcccgcttctggcagcagagcagagcgatcaagccaactttggagctacaaacctcggaacatccccaccgcgcgagcgcgacacgcccaacgcccgcttcctccgatcgcccgcgctagccatggcgtcgcacatcatcctgccgccggacgacgccgaagagaatcaccacgactaccaggaggaggatggggaggaggaggagctggggagcgacggcggggaggagcggcagcgcgacgcggcccaggccgagcagcagccgcccaaggcggcgctgccgttctcggccacgtgcgtgcggatctcccgcgactcctaccccaacctccgcgccctgcgcaacgcatcctccgtcagcctcgccgacgccgcgtacgtgaagatctctgagggcgactacgggtacgtgctcgacgacgtgccgcacctcaccgactacatccccgacatcccgacctatcctaatccattacaagatcatcctgcctattcaactgtcaagcagtattttgtcaatgaagatgatactgtacctcaaaaggtggttgttcagaagaacagccggcgcggtgttcacttccgtcgtgccgggcctcgtcagaggatctattttggtcccgatgaagttaaagcctgcattgtaacttgtggaggcctctgccctgggcttaacactgttatcagagaactggtgtgtggcttgtcacacatgtacaatgtcaacaacatctatggaatacagaatggatataaaggattttattctagcaactacctccccctgactcccaagggtgtcaatgacatccataaaaggggtggtacagttctagggacatcacgaggtggccatgattcaaaaaagattgttgataacattcaagatcgtggtattaatcaggtgtatatcattggaggagatggaactcagaagggagcgtatgagatattcaaggaaatccgaaaacgtggcctgaaagtttctgtggctggagtccccaagacaatagataatgacattgcgatcatcgacaagtccttcggttttgatacggctgtggaagaggcccagcgtgccattgattcagctcatgtggaagcttgcagtgctgagaatggaataggcttggtaaaactgatgggtcgttatagtgggttcattgcgatgtatgctactcttgctagtcgagatgtggactgctgtttgattccagaatctccattttatatggatggagaaggcggattgcttcaatatatagaaaggaggctgaaagagaacaagcacatggttatcgttgttgcggagggagcagggcaggatcttattgcaaaaagtatagctgcatcagatcaacaagatgcatccggaaataagctgctgcttgatattggtctttggttgactcacaagataaaggattacttcaagggcaaaaagatggagatgacgattaaatatatagatcctacatacatgatccgcgccattccaagcaatgcatcagacaatgtttactgcacacttctggctcacagcgcaatccatggtgcaatggcagggtatagcttcaccgttggaatggtcaacggcagacatacctatatacctttctatagggtgacatccacaaggaacaaggtgaggatcaccgacaggatgtgggcgaggctgctttcatcaaccaaccagccaagcttcttgagtcagaaggacatcgatgaagcgagggaggccgataggcttgccaacaggccaccactgccgacgggtgccagccaccgtgtggcgacctctttcgagcagtctgcgtcttctacttccaacggagagatctaagtgactgctggtgcacccagatgtgtacaggagctgttaagctttgccacgctatcagttttgcttttgatatgcagatgccttgtgtaggactctatcatgataccctgaacaataaaatgaacgccggtgatgtacatggacaa

SEQ ID NO: 3288 - DNA, 4626 bp, Panicum virgatum
attacttttcacccgcacgcccaaaaaacttgagtggcctagcagagcccaccgatccatcagcggcctaccaaagcccattactccataacggcctaacaagcccacatatccagcgtgcgaggcggagccctggccttttctctccgccgcactagttctccagcgcgccgcccctcaccgccggcttctgcccctcctccacccctgccgccgccccgcagttggagacgctcgcctcgccggaaatcatgtaccgcgccgcggggagccacctgcgctccctgaagcatctcggtgctaccaggcttgctagtacaagtgttgtgaagcagccccaaggtggtcttttcagctggcttcttgggggaaattcaagccaacttcctcccctagatgttccgctaccaggcattactattcccccacctctaccagactttgtagaaccatctaagacaaaaatcactactcttccaaatggcatcaagattgcctcggaaatgtcaccgagcccagcagtctcagtgggtctgtatattgactgtggttccatttatgaaacacccgtttcatctggagtctcccatctattggagagaatggccttcaagagcacagtaaatcgtagtcacttgcggctagttcgtgaggtagaagccattggaggaaatgtctccgcatcagcttcccgtgagcaaatgagctatacctacgatgcattaaagaactatacaccagaaatggttgaagttctcattgacagtgtgaggaatccagcatttcttgaatgggaggtcaaggagcagctccagaagatcaaatctgaaatagctgaagtgtctgttaatcctcaaggtctacttctggaggcgcttcattcagctggatattctggggcacttgcaaaacctttgatggcttcagaatctgctgtaaaccggttggatgttagcatcttggaggaatttgtagctgaacactatactgctcccaggatggttcttgcagcatcaggagttgagcatgatactttggtttcagttgtagaaccacttctatctgaccttcccagtgtgaaacgtcctgaagagccaaaatcggtgtacgttggaggcgactatcgttgccaagcagattctccaagcacacatattgcacttgcttttgaggtgcctggtggctggaatcaagagaaaactgcaatggttgtgacagtgcttcagatgctcatgggaggaggagggtccttctctgctggtgggcctggaaagggaatgcattctcgattatatctccgtgtcttgagcaattaccagcagatcgaatcattctctgctttcaacagtgtctataacaattcaggtctttttggaatttatgcagtcactagcccagacttctcgtcaaaggctgtggatttggcagcaggtgaactccttgagattgcaactcctggaaaagtttcacaagaacagcttgatcgtgctaaagaggcaaccaaatccgccattctgatgaacttggaatcaaggtccatagcatctgaagatattggaagacaggttctgacttatggggaaaggaaacccattgaatatttcctgaaaacagttgaggagatcaccttgaatgacatttcgtcaactgcaaagaagatcatgtcttcaccgcttacaatggcatcatggggcgatgttattcatgttcctagctatgagtctgtcagccgcaagtttcactcaaagccccacccccacccccatggcgtcgcacatcatcctgccgccggaggacgccgacgataaccaccaccgggaggaggatggggaggaggaggaggagcgggaggagctgggggcacgacgacggggagcgtgcgccgccggagcaggcgcccaaggcggcgctgccgttctcggccacgtgcgtgcggatctcgcgcgactcgtacccgaacctccgcgccctgcgcaacgcctcctccgtcagcctcgcggacgccgcctacgtcaagatctccgagggcgactctgggtacgtgcttgacgacgtgccgcacctcaccgactacgtccctgacatccagacttatcctaatccgttacaagaccatccagcctattcaactgtcaagcagtacttcgtcaatgaagatgatactgtaccgcaaaaggtggttgttcagaagaacagccggcgtggcgtccacttccgtcgtgccgggcctcgtcagaggatttattttggtcccgatgaagtaaaagcctgcattgtaacttgtggaggcctctgccctgggcttaacactgttatcagagaactggtgtgtggcttgtcacacatgtacaatgtcaacagcatctttggaatacagaatggatacaaagggttttattctagcaactaccttcccctgacaccgaagagtgtcaacgacatccacaaaaggggtggtacaattcttgggacgtcacgaggtggtcatgatacaaagaagattgttgataacattcaagatcgtgggattaatcaggtgtatatcattggaggagatggaactcagaagggagcatacgagatattcaaggaaatccgaaaacgtggcctgaaagtttctgtggctggaatccccaagacaattgataatgacattgcgattatcgacaagtcctttggttttgatacggctgtggaagaggcccagcgtgccattgattcagctcatgtggaagcttgcagcgctgagaatggaataggcttagtaaaactgacggggcgttatagtgggttcattgcaatgtatgctactcttgctagtcgagatgtggactgctgtttgattccagagtctccattttatatggatagagaaggcggactgcttgaatatatagaaaggaggctgaaagagaacaagcacatggttatcgttgttgctgagggagcagggcaggatcttatcgcaaaaagtatagccaaatcagatcaacaagatgcatccggaaataagctgctgcttgatattggtctttggttgactcacaagataaaggattacttcaagactaaaaagatggagatgacgattaagtacatagatcctacatacatgatccgtgccattccaagcaatgcatcagataacgtgtactgcacacttctggctcacagtgctatccatggtgcaatggcagggtacagcttcactgttggaatggtcaacggtagacatacctatatacctttctatagggtgacatccacaaggaacaaggttaagatcactgacaggatgtgggcgaggctgctatcgtcgactaaccagccaagtttcttgagtcagaaggacatcgatgaagcgagggaggctgataggcttgccaacaagccaccactgccgacgggcgccagccatcgtgtggcgagctccttcgagcagtctgcttcttcatcttccaactgagagatctaagtgattgctggcccaccgggaatgtgtacatgagctgttaagctttgccacgctttaccaattttgcttttgatgtgcatatgccttgggtagaaggacgcatggatacgaatacgatcctgagacccagagcaataaaatgtacacgcactaccttgaattcgctgcataatactcaatgcaataccatcagttgatggctgctcttgacttcctgcaatgttctacgccaaagcttatgtgttttgtcaccatgggctaccatggcccatccgatggcaccttcattgcagcccaacgggttagacctgctgggttacatggacaaatgggtaggcatacaagacatggtacaagtcacatggtgttaccatgccatctcgatatttcaattttcccaaagtgctagtgcaactcaaggacgcgttctgtcatgactcaattccgtgacgctttgcacgaaccgaagtcatgggctttcttgcgcaaaatcatatatatccctgcccacaaattcagcacttcctggctgtacccggtacgacaagtgcagctttgccagttacgtgatttgtttctattttttaaaatgaggaactgcccacagcaacctctgcccgagccccactccaaaattcccaccgcaatttccggcgccgcaaaaaagtcagcactccgctggcgctcacggacccaccgccaccccaaagtcctgcccccagcaaggcagttgaccagcacccagtcaagtcaaccctccaaccatggaagtacaaagagttctgggtattttacaatttttactattataccaaatagtactcatcaaattatcacctttaaaatggcacttacagctataccagttgaaagaaatttaagttacattttttaccatgtttactaatatggcacgccacgccagtccgacatgctggcgcccaatcagcaggactaggttaaatgtccttcctatcctaatgtggctcccggtcagggatgcaagcggggcgccgcgaacccgccatctcagcccgcgccgcaaaaccgcatagcccgcgccgcaaaaccgcgttgccgaagcggacgatgcagctctaatcgcggtgcccagcggcgccgcaaccccgcttccaaggcatgcttcaaga

SEQ ID NO: 3289 - DNA, 2271 bp, Oryza sativa
gacccctcgctgacgctccgaccccaccaccaccaccgccgctcactcacacatcgagcgccattattaaaccccaggaaaaacagacgacctcgttcgcttctcgcccgcaaaaggctaaacctcgattacgcctccccaaacccgccgcgaaacgaagcgaaagcgagttcctccgatcccgaccacttgctcttctcatggcgtcctcccacatcatccttccgccggacgacgacgacgaggagcagcgccggctggaggaggaggaggacgaggatccgtgggcgcggagcgggcctccccccgcggcgccggagcacgcgatgaaggcggcgctgccgttctccgcgacgtgcgtgcggatctcccgcgactcctaccccaacctccgcgccctccgcaacgcctcctccgtcagcctcgccgacgccgcctacgtgaagatctccgagggggacttcggctacgtcctcgacgacgtgccgcacctcgtcgaccacctccccgatgcccccacttatcccaatccactacaagatcatccagcctattcaactgtcaagcaatattttgttaatgaagatgacactgtaccccaaaaggtggtcgttcagaagaacagccggcggggggttcacttccgtcgtgctggacctcgtcagaaggtttattttgagtcagatgaagtgaaagcatgcattgtaacttgtggaggcctttgccctggtcttaacactgtcatcagagagctcgtctgtggtttggcgcacatgtataatgtcagcaaaatctatggtatacagaatggatacaagggcttctattctagcaattaccttactctgacgccaaagagtgtcgatgacatccacaagaggggtgggacagttcttggcacatcacgaggtggccatgatacaaaaaagattgttgacaacattcaggatcgtggaattaatcaggtctatatcattggaggagatggaacacagaagggtgcatatgagatcttcaaggaaatccgaaaacgtgggctaaaggtttctgttgctgggattcccaagacaatagataatgacatagcgatcattgacaagtcatttggttttgatacggccgtagaagaggcccagcgtgccattgattcagctcatgtggaagcttgcagtgctgagaatggaataggcttagtaaaactgatgggccgttatagtgggttcattgcaatgtatgctactcttgcaagtcgagatgtggactgctgcttaattccagagtccccattttatatggatggtgaaggtgggttgcttcaatatgtagagagaaggctgaaagagaacaagcacatggttattgttgttgctgagggagcagggcaggatcttatagccaaaagtttatctacttctgagcagcaagatgcatcaggaaataagctactgcttgatattggtctttggctgactcacaagataaaggaccacttcaagagcaaaaagatggagatgactattaaatatatagatcctacctacatgatccgagctattccaagcaatgcatcagacaatgtctactgcacgctgctggcccacagtgctattcatggtgcaatggccggctatagcttcactgttggaaatgtcaacggcagacatgcctacatacctttctatagggtgacatccacacggaacaaggtcaagatcactgataggatgtgggcgaggctgctatcatcaaccaaccagccaagcttcctaagccagaaggacatcgacgaagccaaagagaacgataggacggccaacaagccaccacttcccaccggcctcagccatcatgtggcaaactctttcgaccagtctgcatcatcttcgtcgaacagccagatatgaactccatcatgtggcaaaccctttcgaccagtctgcgtcatcgtcctcgaacagcgagatgaatccaatctgtagttctatatagaagctgttgctattcccgttgagaaacctgggccacgctacgcagttttgatttaatatgcataatatcacctgtatgaatccacggatactctcctggattgctggtaactacaagcgtaataagaaaagcgctattgatgaagctatttctcataagcaacactcgtgttgtgtcttgtatatgctgctgatctgaagatatgtttcgtcagctgatcgtatattgaccttttctgtctctgtcactgcagtgcaatgcgtttatgttgtggtacccaaa

SEQ ID NO: 3290 - DNA, 2395 bp, Brachypodium distachyon
tgccgacggccgaggaatgaatgccataccgcagctaaaaccgccagccgaaaccacccgcgccgcatcttggcctcactttccagtttctacccgcacctcaaattcggttctccggagcagccgacggcctctctgtccctcacatctcgcagcaccaccgagcaagcaagcaagcgagcatcaaaataacccccccggaaacgcagacatctcgtcggcttctgcctgcgcacagctaaacctccgattccaacactacccatggcgtcccacatcatcctgccgccggacgacgaggagcagcggcagagggatgaggaggaggacggcgggcaatcggcgtcggagcacgcgccgctgccgttctcggccatgtgcgtgcggatctcccgcgactcgtaccccaacctccgcgccctccgcaacgcctccgccgtcagcctcgccgacgccgcctacgccaagatctccgagggcgacttcggctacgtcctcgacgacgtgccgcacctcgccgactacctccccgacatccccacctaccctaacccattacaagaccacccagcctattcaactgtcaagcaatattttgtcaatgaagatgacactgtacctcagaaggttgttgttcagaagaatagccggcggggggttcacttccgtcgtgctggacctcgtcagagggtctattttgagtcagacgaagtgaaagcatgcattgtaacttgtggaggcctttgtcctggacttaacactgttatcagagagctggtgtgtggcttgtcacatatgtacaatgtcaacaaaatatatggaatacagaatggttacaagggcttctattctagcaattaccttgctgtgacaccaaagactgtcaacgacatccacaaaaggggtggtacagttcttgggacatcacgaggtggtcatgatacaaaaaagattgttgacaacattcaggatcgtggaattaatcaggtgtatatcattggtggagatggaactcagaagggagcatatgagatctacaaggaaatccggaaacgtggcctaaaagttgctgttgctggggttcccaagacaatagataatgacatagcgattatcgacaagtcctttggttttgattcggctgtagaagaggctcaacgtgccattgattcagctcatgtggaagcttgcagtgccgagaatggaataggcttggtaaaactgatgggacgttatagtggattcattgcaatgtatgctactcttgcaagtcgtgatgtggattgctgcttaattccagagtccccgttttatatggatggtgaaggtgggttgcttcaatacatagaaaagaggctgaaagaaaacaagcacatggttattgttgttgctgagggagcaggccaggatattattgcaaaaagtataccttcttcagatcagcaagatgcatctggaaataagctgcttcttgatattggtctttggttaactcataagattaaggatcatttcaagagcaaaaaggtggagatgacaattaaatacattgatcctacctacatgattcgagctattccaagcaatgcatccgacaatgtctactgcacacttctggctcacagcgccattcatggtgcaatggcaggatacagcttcacggttgggatggtcaatggcaggcatacctatatacctttctatagggtgacatccacacggaacaaggttaagatcactgaccggatgtgggcgaggctgctatcatcaaccaaccagccaagcttcctgagccagaaggacatcgatgaggccagggaggctgacaggctggccaataagccgccgctgccatctggcgctaaccagagtgtggcaaacgcctttgggcaatctgcatcatcgtcatcgaacggtgagatatagtgatgcagatggtcagtaatcgtgtgcagcagctacagctatcctgttgagaacctgtgccacgccacgcagttttgctaccatactgatacacggatagtgtcggggtgttccgtgaaataagcagtactattgtatgcaaactattgctgataagctgttttttgccctggcaaaatcccttgtatttatttctacgtagaatctgccgtgccgcagggtctattttctttgcctgtctcctgatccatttcttttctctccgcgcctagcattctgatttatactcctctgttccttgatataaaatcttctactccctccaattcatattaattgtcttaaatttattcaaatatggatatatctatgtttaaaaaacgtctagatacatgtaatatttcgacaactaatatgaatatggattaaagagagtactacttttatctcaagtcaaagttcttatttt

SEQ ID NO: 3291 - DNA, 2226 bp, Hordeum vulgare
cccgcatccgcaccgcatctcttccctcccctctcgcgcccgcaccaccgagcaagcaagaaagaagcattcggccagtcattattaaaccccccgcggcgcctctctctcgtcgccccgtgacagcgcagcgcagcagcagcagcagcagcaaaacctcgtacccgcccatggcgtcccacatcatcctgccgccggacgacgagcagcagcggagggaggacgaggagcaggacggcggcgccgccgggggcggggagcagcagcagccgcccttctccgccatgtgcgtgcggatctcccgcgactcctaccccaacctccgcgccctccgcaacgcctccaacgtcagcctcgccgacgccgcgcacgtcaagatctccgagggcgacttcggctacgtcctcgacgacgtgccccacctcgccgactacctccccgacgtccccacttaccccaacccattacaagaccacccagcatattcaactgtcaagcaatattttgtcaatgaagatgacaccgtaccacaaaaggttgttgttcaaaagaatagccggcggggggttcacttccgtcgtgctggaccccgtcagagggttaattttgagtcagatgaagtgaaagcatgcattgtaacttgtggaggcctttgccctgggctcaacactgttatcagggagctggtgtgtggtttgtcgcacatgtacaatgtcaacaaaatctacggaatacagaatggatacaaggggttctattctagcaattatgttgctattacaccaaagacagtcaatgacatccacaaaaggggtggtacagtccttggaacatcacgaggtggtcatgacacaaaaaagatcgttgacaacattcaggatcggggaattaatcaggtgtatatcattggaggagatggaactcagaagggagcatatgagatctacaaggaaatccggaagcgtggcctcaaagttgctgtggccggggttcccaagacaatagacaatgacatagcgattatcgacaagtcctttggttttgattcggccgttgaagaggctcaacgtgccattaattcagctcatgtggaagcttgcagtgctgagaatggaataggcctggtaaaactgatgggtcgttatagtgggttcattgcaatgtatgctacccttgcaagtcgggatgtggattgctgcttaattccggagtctccgttttatatggatggagaaggggggttgcttcaatatgtagaaaggaggctgaaagagaacaagcacatggttattgttgttgctgagggagcaggccaggatattattgccaaaagcattcccgcttcagatcagcaagatgcatctggaaataaattgcttcttgatattggtctctggttgactcacaagattaaggatcatttcaagagcaaaaagatggagatgacgattaaatatattgatcctacctacatgatccgagctattccaagtaatgcagcggacaatgtctactgcacattgctggctcacagtgccatccatggtgcaatggcgggatacagctctactgttgggatggtcaatggcagacatgcctatatacctttctatagggtgacatccacacggaacaaggtgaagatcactgaccggatgtgggcgaggctgctgtcgtcgaccaaccagccaagcttcctgagccagaaggacatcgatgaggccagggaggccgataggctggccaacaagccgccgctgccatctgtcgccaaccacaatgtggcgaacgcctttgaccaatctgcgtcggcgtcgtcgaactgtgagatatagtgaccgcagctggtctgtaatcgtgtacagtagctactgctatcctgctgagaaacctgcgccacgccacgccacgcagttttgtttcgatatggatgtccctttatgtaggaactagtactaatgtacacggatactgtcgaggtgtcctgtgaactgtgaaataagcggtactgtattgctgctactagtctactactagtgatattgtgctccctttttgccctggcaaattgttgcatttcctacagacgagtcttctttttttcttttttcttttgagcaaatattgaggagtctgttggaggggtaacgctttgcattttgttctctcgttagtgggccttttcggccttttctcgatagaccgtgatgcaagtcgtgttgattg

SEQ ID NO: 3292 - DNA, 1908 bp, Secale cereale
gccatggcgtcccacatcatcctgccgccggacggcgacgacgacgagcagcagcggagggaggacgaggagaacgacggcgggagcgggagcgggagcgggggcgacggggagcggcagcagcagcagcagcagcagcatccggcccaggccaaggcggcgctgcccttctccgccatgtgcgtgcggatctcccgcgactcctaccccaacctccgcgccctccgcaacgcctccaacgccagcctcaccgacgccgcctacgtcaagatctccgagggcgacttcggatacgtcctcgacgacgtgccccacctcgccgactacctccccgacgtcccaacttacccgaacccgttgcaagaccacccagcatattcaactgtcaagcaatattttgtcaatgaagatgacaccgtaccacaaaaggttgttgttcagaagaatagccgccggggggttcacttccgtcgtgctggaccccgtcagagggttaattttgagtcagatgaagtgagagcatgcattgtaagttgtggaggcctttgccctgggctcaacactgttatcagagagctggtgtgtggcttggcgcacatgtacaatgtcaacagcatctttggaatacagaatggatacaagggcttctattctagcaattatgttgctattacaccaaagacagtcaatgacatccacaagaggggtgggacagtccttggaacatcacgaggtggtcatgatacaaaaaagattgttgacaacattcaggatcggggaattaatcaggtgtatatcattggaggagatgggactcagaagggagcatatgagatttacaaggaaatccggaagcgtggcctaaaagttgccgtggcaggggttcccaagacaatagacaatgacatagcgattatcgacaagtcctttggttttgattcggccgtcgaagaggctcaacgtgccattaattcagctcatgtggaagcttgcagtgctgagaatggaataggcttggtaaaactgatgggtcgttatagtgggttcattgcaatgtatgctactcttgcaagccgggatgtggattgctgcttgattccagagtctccgttctatatggatggggaagggggtctgcttcaatatgttgagaggaggctgaaagagaacaagcacatggttattgttgttgctgagggagcaggccaggatattattgccaaaagcatacccgcttctgatcaacaagatgcatctggaaataagctgcttcttgatattggtctctggctgactcacaagattaaggatcatttcaagagcaaaaagatggagatgacgattaaatacattgatcctacctacatgatccgagctattccgagtaatgcagcagacaatgtctactgcacactgctggctcacagtgccatccatggcgcaatggcgggatacagcttcactgttgggatggtcaatggcagacatgcctacatacctttctacagggtgacgtccacacggaacaaggtgaagatcactgaccggatgtgggcgaggctgctgtcgtcgaccaaccagccgagcttcctgagccagaaggacatcgacgaggccagggaggccgataggctggccaacaagccgccgctgccatctgtcgccaaccagagtgtggcaaaagcatttgaccaatctgcagcggcttcgtcgaacggcaagatatagcgatgcgctggtctgtaaccgtgtacagtagctactgctatcctgctgaggaacatgtgccacgccatgaagttttgcttccttacgatatcccttgtatgagtagtgcacgtatggatactgttcaggtgttctgtgaaataagcagtatattattgggctgctactgctgataatgtt

SEQ ID NO: 3293 - DNA, 1888 bp, Secale cereale
tggcgtcccacatcatcctgccgccggacggcgacgacgacgagcagcagcggagggaggacgaggagaacgacggcgggagcgggagcgggagcgggggcgacggggagcggcagcagcagcagccgcatccggcccaggccaaggcggcgctgcccttctccgccatgtgcgtgcggatctcccgcgactcctaccccaacctccgcgccctccgcaacgcctccaacgccagcctcaccgacgccgcctacgtcaagatctccgagggcgacttcggatacgtcctcgacgacgtgccccacctcgccgactacctccccgacgtcccaacttacccgaacccattacaagaccacccagcatattcaactgtcaagcagtattttgtcaatgaagatgacaccgtaccgcaaaaggttgttgttcagaagaatagccgccggggggttcatttccgtcgtgctggaccccgtcagagggttaattttgagtcagacgaagtgaaagcatgcattgtaagttgtggaggcctttgccctgggctcaacactgttatcagggagctggtgtgtggcttggcgcacatgtacaatgtcaacagcatctttggaatacagaatggatacaagggattctattctagcaattatgttgctattacaccaaagacagtcaatgacatccacaaaaggggtggtacagtccttggaacatcacgaggtggtcatgatacaaaaaagattgttgacaatattcaggatcggggaattaatcaggtgtatatcattggaggagatggaactcagaagggagcatatgagatctacaaggaaatccggaagcgtggcctaaaagttgctgtggcaggggttcccaagacaatagacaatgacatagcgattattgacaagtcctttggttttgattcggctgtcgaagaggctcaacgtgccattaattcagctcatgtggaagcttgcagtgctgagaatggaataggcttggtaaaactgatgggtcgttatagtgggttcattgcaatgtatgctactcttgcaagccgggatgtggattgctgcttgattccagagtctccgttttatatggatgggaaggggggctgcttcaatatgtagagaggaggctgaaagagaacaagcacatggttattgttgttgctgagggagcaggccaggatattattgccaaaagcatacctgcttcagatcagcaagatgcatctggaaataagctgcttcttgatattggtctctggttgactcacaagattaaggatcacttcaagagcaaaaagatggagatgacgattaaatacattgatcctacctacatgatccgagctattccgagtaatgcagcagacaatgtctactgcacactgctggctcacagtgccatccatggcgcaatggcgggatacagcttcactgttgggatggtcaatggcagacatgcctacatacctttctatagggtgacgtcgacacggaacaaggtgaagatcactgaccggatgtgggcgaggctgctgtcgtcgaccaaccagccgagcttcctgagccagaaggacatcgacgaggccagggaggccgataggctggccaacaagccgccgctgccatctgtcgccaaccagagtgtggcaaaggcctttgaccaatctgcagcggcttcgtcgaacggcgagatatagcgatgcgctggtctgtaaccgtgtacagtagctactgctatcctgctgaggaacatgtgccacgccatgccatgaagttttgcttccttacgatatcccttgtatgagtagtgcacgtatggatactgttcaggtgttctgtgaaataagcagtatattattgtgctgcta

SEQ ID NO: 3294 - DNA, 1983 bp, Secale cereale
agcagcggagggaggacgaggagaacgacggcgggagcgggagcgggagcgggggcgacggggagcggcagcagcagcagccgcatccggcccaggccaaggcggcgctgcccttctccgccatgtgcgtgcggatctcccgcgactcctaccccaacctccgcgccctccgcaacgcctccaacgccagcctcaccgacgccgcctacgtcaagatctccgagggcgacttcggatacgtcctcgacgacgtgccccacctcgccgactacctccccgacgtcccaacttacccgaacccattacaagaccacccagcatattcaactgtcaagcagtattttgtcaatgaagatgacaccgtaccacaaaaggttgttgttcagaagaatagccgccggggggttcatttccgtcgtgctggaccccgtcagagggttaattttgagtcagacgaagtgaaagcatgcattgtaagttgtggaggcctttgccctgggctcaacactgttatcagggagctggtgtgtggcttggcgcacatgtacaatgtcaacagcatctttggaatacagaatggatacaagggcttctattctagcaattatgttgctattacaccaaagacggtcaatgacatccacaaaaggggtggtacagtccttggaacatcacgtggtggtcatgatacaaaaaagattgttgacaacattcaggatcggggaattaatcaggtgtatatcattggaggagatggaactcagaagggagcatatgagatctacaaggaaatccggaagcgtggcctaaaagttgccgtggcaggggttcccaagacaatagacaatgacatagcgattatcgacaagtcctttggttttgattcggccgtcgaagaggctcaacgtgccattaattcagctcatgtggaagcttgcagtgctgagaatggaataggcttggtaaaactgatgggtcgttatagtgggttcattgcgatgtatgctactcttgcaagccgggatgtggattgctgcttgattccagagtctccgttttatatggatggggaaggggggttgcttcaatatgtagagaggaggctgaaagaaaacaaacacatggttattgttgttgctgagggagcaggccaggatattattgccaaaagcatacccgcttcagatcagcaagatgcatctggaaataagctgctgcttgatattggtctctggctgactcacaagattaaggatcacttcaagagcaaaaagatggagatgacgattaaatacatcgatcctacctacatgatccgagctattccgagtaatgcagcagacaatgtctactgcacactgctggctcacagtgccatccatggcgcaatggcgggatacagcttcactgttgggatggtcaatggcagacatgcctacatacctttctatagggtgacgtccacacggaacaaggtgaagatcactgaccggatgtgggcgaggctgctgtcgtcgaccaaccagccaagcttcctgagccagaaggacatcgacgaggccagggaggccgataggctggccaacaagccgccgctgccatctgtcgccaaccagagtgtggcaaaggcatttgaccaatctgcagcggcttcgtcgaacggcgagatatagcgatgcgctggtctgtaaccgtgtacagtagctactgctatcctgctgaggaacatgtgccacgccatgccatgaagttttgcttccttacgatatcccttgtatgagtagtgcacgtatggatactgttcaggtgttctgtgaaataagcagtatattattgggctgctactgctgataatgttcttttattttttttgcctggcaatttgcttcgcatttcctgtgaaatctgcgacggccttctgctggatggtgtatatatatgtttgctattttgtctcttcctttgacgtaacctgtaaataag

SEQ ID NO: 3295 - DNA, 1930 bp, Secale cereale
gtcaggcgggagcgggggcgacgggagcggcagccgcagtcatccggcccaggccaagcggcgcctgcccttctccgccatgtagcgtgccggatctcccgcgactcctacccctaacctcccgcgccctccgcaacgcctccaacgccagcctcaccgacgccgcctacgtcaagatctccagggcgacttcggatacgtcctcgacgacgtgccccacctcgccgactacctccccgacgtcccaacttacccgaacccgttgcaagacacccagcatattcaactgtcaagcagatttgtcaatgaagatgacacgtaccacaaaaggttgtgttcagaagaatagccgccggggggttcacttccgtcgtgctggaccccgtcagagggttaattttgagtcagatgaagtgagagcatgcattgtaagttgtggaggcctttgccctgggctcaacactgttatcagagagctggtgtgtggcttggcgcacatgtacaatgtcaacagcatctttggaatacagaatggatacaagggattctattctagcaattatgttgctattacaccaaagacagtcaatgacatccacaaaaggggtggtacagtccttggaacatcacgaggtggtcatgatacaaaaaagattgttgacaatattcaggatcggggaattaatcaggtgtatatcattggaggagatggaactcagaagggagcatatgagatctacaaggaaatccggaagcgtggcctaaaagttgctgtggcaggggttcccaagacaatagacaatgacatagcgattatcgacaagtcctttggttttgattcggccgtcgaagaggctcaacgtgccattaattcagctcatgtggaagcttgcagtgctgagaatggaataggcttggtaaaactgatgggtcgttatagtgggttcattgcgatgtatgctactcttgcaagccgggatgtggattgctgcttgattccagagtctccgttttatatggacggggaaggggggttgcttcaatatgtagagaggaggctgaaagagaacaaacacatggttattgttgttgctgagggagcaggccaggatattattgccaaaagcatacccgcttcagatcagcaagatgcatctggaaataagctgctgcttgatattggtctctggctgactcacaagattaaggatcatttcaagagcaaaaagatggagatgacgattaaatacattgatcctacctacatgatccgagctattccgagtaatgcagcagacaatgtctactgcacactgctggctcacagtgccatccatggcgcaatggcgggatacagcttcactgttgggatggtcaatggcagacacgcctacatacccttctatagggtgacgtccacacggaacaaggtgaagatcactgaccgaatgtgggcgaggctgctgtcgtcgaccaaccagccaagcttcctgagccagaaggacatcgacgaggccagggaggccgataggctggccaacaagccgccgctgccatctgtcgccaaccagagtgtggcaaaggcctttgaccaatctgcagcggcttcgtcgaacggcgagatatagcgatgcgctggtctgtaaccgtgtacagtagctactgctatcctgctgaggaacatgtgccacgccatgaagttttgcttccttacgatatcccttgtatgagtagtgcacgtatggatactgttcaggtgttctgtgaaataagcagtatattattgggctgctactgctgataatgttctttttcttttttgcccttggcaatttgcttagcatttcctgtgaaatctgcgacggccttctgctggagggcgtatatatgtttgcattttgttctcttcgtttgtagaaaccttaaaagt

SEQ ID NO: 3296 - DNA, 2216 bp, Brachypodium distachyon
tctcctctctttctcgctctttcggtctttccccttctccacgcttcgcgtcgcccgtcagccgaatatttaaacctcgacctttctcgtcgtcttctgccttctggcgacaggaaaacggcatcctacacgcgagacccacacgacacgatcacccgggtcgaagagcatacagtatcagagtcctcttatggcctctcacatcattctgcccaaggaggaggaggaggaggaggggctaggcgtggcggtggaggcggaccacgactcgccggagccgccgcggtaccaggcggagcccgtcccgaaggcgctgccgttctcggccacgtgcgtgcggatctcccgcgactcgtaccccaacctgcgcgcactccgcaacgcctctgccgtgagcctccgtgacgacgacgccgacttcgtcaagctcgaggagggtgactacggctacgtcctcgacgacgtccagcaccttaccgattacctccccgagctccccacttttcctaacccattgcaagatcaccctgcctattcaaccgtcaagcagtattttgtcaatgctgatgacactgtaccagaaaaggtggttgttcaaaagaacagcccacggggagttcactttcgtcgtgctggaccacgtcagagggtctacttcgaaccagaagatgtgaaagcatgcattgtaacatgtggaggactttgccctgggcttaatactgtcataagagagttggtgtgtggcttgtcccacatgtacaatgtcaacgatgtgtttggaatacagaatggatacaagggcttctattcaagcaattatcttcccatgacaccaaaaagtgtcaacgatatccacaaaaggggtggtacagttcttggaacttcacgtggtggtcatgataccagaaagattgttgacaacattcaagatcgtggaattaatcaggtttacattattggaggagatggaactcagaagggagcatatgagatatttaaggaaattcgtagacgtggtctaaaagtcgccgttgctggtattcccaagacaattgataatgatatagcggttatagacaagtcctttggttttgacactgccgtagaagaggcccagcgtgccattgatgcagctcatgtggaagcttcaagtgctgagaacggaataggcttggtgaaactgatgggtcgttacagtgggtttattgcaatgtgtgctactctggcaagcagagatgtggattgctgcttaattcctgaatccccattctatttggaaggggagggtggactgttcgagtatatagaaaggaggctgaaggagaacaaccatatggttattgttgtggctgagggggcaggacaggatcttattgctaaaagtataccagcagcagatcaactagatgcatctggaaataaactgcttcttgatgttggtctgtggttgactcacaagattaaggattattgcaagagcaaaaagatggagatgactattaaatacatagatccaacctacatgatccgtgccattccaagcaatgcttcagacaatgtctactgcacactgctggcacacagtgccattcatggtgcaatggcaggatatagctccacagtaggaatggtccatggcaggcatgcatacataccatttcatagggtaacatcaactcggaacaaggttaagataactgacaggatgtgggcaaggctactgtcttcaacaaaccagccgagcttcctgacccagaaagacatcgatgaggccagagaggccgataggttggccaacaggccacctgtgccagcgggcacctctgagctccgggagcatacggagaagcacccagcgtcggagtcagcaaatggtgagaaatagtacgactttgattttgatcgttctgcagtcgtgtacaatagttactgcagttcggccgtgttctgggccgtttttcactagtttcgttcccctgtctgtcgccggtgtgattgcaataaattcacacgaaaactattttccaataaatacacttcaacactgttgatattgcccgcgtaacaagctcatgctgtaaaagatagtgcatttttctgaacatgtgtagcgcagccgcagggctcaagtcatctgctgcagatgactgcctgcttgctggcaattctacagcggatttgctgagtcaactgagatttgagatttgagtccaccc

SEQ ID NO: 3297 - DNA, 1978 bp, Secale cereale
cgcttctgtactggccgaatatttaaacctccatctgtccagctcgctcgtcgtgctctgcctttccggcgaggggaaacggttttcttaacgcgccagcgagaccacccgctcgactccgccagccgggtccgtgagctttccagcgccgggagctctccgatggcgtcccacatcattctccccaaggcggaggaggaggaggaggaggtggaggaggggctgggcgtggcggtggaggcggaccacgactcgccggagccgccgcgctaccggcacacgcagccggcccagaaggcgctcccgttctcggccacgtgcgtgcggatctcccgcgactcctaccccaacctccgcgccctccgcaacgcctccgccacgagcctccgcgacgacgacgccgccttcgccaagctcgacgagggcgactacggctacgtcctcgacgacgtccagcacctcacggactacctccccgaactccccatttttcctaacccattgcaagatcaccctgcctattcaactgtcaagcaatattttgtcaatgcagatgataccgtacctgaaaaggtggttgttcagaagaacagtccacgtggagttcacttccgtcgtgccgggcctcgccagagggtctacttcgagccagaagatgtgaaagcatgcattgtgacgtgtggtggcctttgccctgggctcaatactgtcattagagagttggtgtgtggcttatcccacatgtacaatgtcaacgatgtcttcggaatacagaatggatacaaaggcttctattcgagcaattatcttcccatgacaccaaaaagtgtcaatgatgtccacaaaaggggtggtacagttcttggaagttcacgtggtggtcatgatacccataagattgtcgacaacattcaagatcgtggaattaatcaggtttacattattggaggagatggaactcagaagggagcatacgagatattcaaggaaatccggagacgtggtctaaaagtcgccgttgctggtatccccaagactattgataatgatatagcggttatagacaagtcctttggttttgacactgctgtagaagaggcccaacgtgccattgatgccgctcatgtggaagcttcaagtgctgagaacggaataggcttggtgaaactgatgggtcgctatagtgggtttattgcaatgtatgctacgctggcaagcagagatgtggactgctgcttaattcctgaatctccgttttatttggagggggagggtggactctttgagtatatagaaaggaggctgaaggagaacaaccacatggtcattgtagtggctgagggagcaggacaggatcttattgccaaaagtatacctgtagcagatcagctagatgcatctggaaataagctgcttcttgatgttggtctctggttgactcacaagattaaggattattgcaagagcaaaaagatggagatgaccattaaatacatagatccaacctacatgatccgagccattccaagcaatgcttcggacaatgtgtactgtacactgctggcacacagtgccattcatggtgcaatggcaggatatagcttcacagtgggaatggtcaacggcaggcatgcatacataccatttcatagggtaacatcaacacggaacaaggtcaagatcaccgacaggatgtgggcaaggctgctgtcttcaacaaaccagccgagcttcctgagcaaggaggatatcatggaggcacgagaggccgaaaggttggccaacaggctacctgtgccggcgggcagcagcgagcatacgaagaaacactctgcgtcggtactgtcaaacggtgagaaatagtggcacgagttttttctttaaacttcgggcagttttcgatggttcttgttgtgcacagtagtaactgtagttgcggtctgagcccttgtttcacccggttttgctccgatgtgtt

SEQ ID NO: 3298 - DNA, 2181 bp, Oryza sativa
ctcatcgttaatctctcggcggccggctggcagcagaaaccaccataccagaaaccgctcttctttccccttctccacgcttcgcttcgcttctctcctctcttcgccgagaaatatttaaaccgctccccaccggccacctcgtcggtttcgtccggtaagagaaaaccgtttcttttttttggcgaatcgcattcgcgcactaccaaacaccaacgcgagctcggaaagctactgatggcgtctcacatcattctgccgaaggaggaggaggcggcgctgggcgtggcggtggaggaggaccacgactcgccggcggcgccagggtaccagcatcagcaggggccgccggtggcgaaggcgctgccattctcggccacgtgcgtgcggatctcccgcgactcgtacccaaacctccgcgccctccggaacgcctccgccatgagcctccccgacgacgacgccgcctacgccaagctcgaggagggcgactacggctacctcctcgatgacgtcccgcacttcacggactacctctccgatctccccacttttcctaatccactgcaagatcatccagcctattcgaccgtcaagcagtattttgtcaatgcagatgatactgtacctgaaaaggtggttgttcagaaggacagtcccagaggagttcacttccgtcgtgctgggcctcgtcagagggtgtacttcgagtcagaagatgtcaaagcatgcattgtaacctgcggaggcctttgccctgggctaaatacggtcattagagagttggtgtgcggcttgtcccacatgtacaatgtcaatgatatcttcggcatacagaatggatacaagggattctattcgagtaattatcttcctatgacacctaaaagtgtcaatgatatccacaaaagaggtggcacagttctgggaacatcacggggtggtcatgacaccaaaaaaattgttgacaacattcaagatcgtggtattaatcaggtatacatcattggaggggatggaactcagaagggagcatatgaaatatataaggaaattcgtagacgtggtctaaaagttgctgttgctggtgttcccaagacaattgataatgatatagcggttatagacaagtcctttggttttgatagtgctgtagaagaggcccagcgtgccattgatgcagctcatgttgaggcttcaagtgctgagaatggaataggcttagttaaactgatgggtcgctatagtgggtttattgcaatgtatgctactcttgcaagcagagacgtggactgctgcttaattcctgagtcaccattttatttggaaggggagggtggactgtttgagtacatagagaagaggttgaaagagaacaaccacatggttattgttgtagctgagggagcaggacaggatcttattgccaaaagtatagctgcagcagatcaaatagatgcatctggaaataagctacttcttgatgttggtctttggctgactcacaagattaaggattactgcaagaacaaaaagatggagatgactattaagtatatagatccaacctacatgatccgtgcaattccaagcaatgcatcagacaatgtctactgcacactgctggcgcacagtgccattcatggggcaatggctggatatagcttcacagttggaatggtcaatggcaggcatgcatacattccatttcacagggtaacatcaacaagaaacaaggttaagataaccgacaggatgtgggcaaggctgttgtcctcgaccaaccagcccagcttcctgagccagaaggacatcgatgccgcaagagaggctgataagctagccagcaaatcgcctgtgccagttaacaccaaggagcacggagagaatgtaaagaagccggcaaatggtgagaaatagcatgcctttgatgattctttacctgtacagtagctacgctattcggctgaggccatgaaccgatcctactcaatttttgttttcgcggttcatctccgatgcgttgcaatggatacacgcgaaaaggatcttgatcgtctacgtaataaaaaacaccacctcatatttttgtatcagagaacatgtgtgtagcactacgcactttgcaagagttctgcctattatttcggtaagagaacttcttgatttttgtgttctgca

SEQ ID NO: 3299 - DNA, 2175 bp, Zea mays
cccataaacaatcaccccgaagaagaaaatcacgggcagacatcatcagcaacgccggccggcgtcaccgccaccctcccctctcgcggacaccggaaaccatcacatcaaaccggaaaccacccttccctccagaactccagaccattcccttctccctttcctcttctccacgcttcgcccctcgccgactattttaaacccacgcttcttttagttctttcttccccgtcggcttccggagtggaaaccattttcctaccacccgcgggagatccacacgcccacgagcagtggagctcggcagcgaggcttcggagttctgccatggcgtcgtcccacatcatcctgcccaaggaggaggaggaggaggcggctgcggcagcggtggcggaggtcgggttgggagcggcggtggaggcggaccacgaccaccggccgtaccaggagcaggggcccgggaaggcggcgctgccgttctcggcaacgtgcgtccggatctcccgcgactcgtacccgaacctccgcgcgctgcggaacgcgtcgaccatgacactccacgatgatgacgccgccttcgtcaagctcgaggagggcgactacggatacgtgctcgacgacgtcccgcacctcaccgactacctcccggacctccccacttttcctaatcctctgcaagatcatcctgcgtattcaactgtcaagcaatattttgtcaatgcagatgatacagtccctgaaaaggtagttgttcagaagaacagtccacgaggagttcacttccgtcgtgctggacctcgtcagagggtgtattttgagtcagaagaagcgaaagcttgcattgtaacctgtggaggcctttgccctgggctcaatactgtcatcagagagttggtttgtggcttgtcccacatgtacaacgttagcaatgtcttcggaatacagaatgggtacaaggggttctattcgagcaattatcttcccatgacaccaaagagtgtgaatgatatccacaaacgaggtggtacagttcttggaacatcacgaggtggccatgataccaaaaagattgttgacaacattcaagatcgtggaattaatcaggtgttcattataggaggagatggaactcagaagggtgcatatgagatttacaaggaaatccggagacgtggtctacaagtagctgttgctggtattcccaagactattgataatgatatagcggttatagacaagtcatttggttttgatactgctgtagaagaagcccagcgtgccattaatgcagctcatgtggaagcttcaagtgctgaaaatggaataggtttagtgaagcttatgggtcgctatagtggatttattgccatgtatgctactcttgcaagcagagatgtggactgctgcttgattcctgagtcacccttttatttggaaggggagggtggactatttgagtatatagataggaggttgaaggagaacaatcacacggttattgttgtcgcggagggagcaggacaggatcttattgctcaaagtatacctgctgcagatcagcaagatgcatctggaaataagctgcttcttgatgttggtctctggttgactcacaagattaaggattattgcaagagcaagaagatggagatgactattaaatacatagatccaacttacatgatccgtgctattccaagcaatgcatcagacaatgtctattgcaccctgctcgcacatagtgccattcatggtgcaatggcgggatacagctttacagtcggaatggttaatggcaggcatgcatatataccatttcatagggtaacatctacaaggaacaaggtgaggataactgacaggatgtgggcgaggctgctgtcttcaaccaaccaaccgagtttcctgagccagaaggacatcgacgcggccagagaagccgacaaggcggccaaccgcatgaagagcagagaggacgcgaagaagcaatctacaccagtgttggcaaatggtgagaaatagtgtgcttttgacggttctttgttgtatgcagtagctgctgcaagctggctgagatcagtaggccaaaactgcgaggtcgatgagttttacttccatttgcatgcgaacagaattcacgtaataaaagcttcatagtgtgtatttgcgttagta

SEQ ID NO: 3300 - DNA, 1737 bp, Secale cereale
accgacggccaaggcggcgcctgccccttctccgcccatgtgcgtgcggatctcccgccgacctcctacccccaacctcccgcgccctccgcaacgcttcccacgccagcctcaccgacgccgcatacgtcaagatctccagggcgacttcggatacgtcctcgacgacgtcccccacctcgcagactacctccccgacgtcccccacttacccgaacccactcaagaccacccagcatattcaactgtcaagcagtattttgtcaatgaagatgacaccgtaccacaaaaggttgttgttcaaagatagccgccggggggttcacttccgtcgtgctggaccccgtcagagggttaattttgagtcagatgaagtgaaagcatgcattgtaagttgtggaggcctttgccctgggctcaacactgttatcagggagctcgtgtgtggcttggcgcacatgtacaatgtcaacaacatctttggaatacagaatggatacaagggcttctattctagcaattatgttgctattacaccaaagacagtcaatgacatccacaaaaggggtggtacagtccttggaacatcacgaggtggtcatgatacaaaaaagattgttgacaacattcaggatcggggaattaatcaggtgtatatcattggaggagatggaactcagaagggagcatatgagatctacaaggaaatccggaagcgtggcctaaaagttgctgtggcaggggttcccaagacaatagacaatgacatagcgattatcgacaagtcctttggtttgattcggccgtcgaagaggctcaacgtgccattaattcagctcatgtggaagcttgcagtgctgagaatggaataggcttggtaaaactgatgggtcgttatagtgggttcattgcgatgtatgctactcttgcaagccgggatgtggattgctgcttgattccagagtctccgttttatatggatggaagggggacgtgcttcaatatgtagagaggaggctgaaagagaacaagcacatggttattgttgttgctgagggagcaggccaggatattattgccaaaagcatacctgcttcagatcagcaagatgcatctggaaataagctgcttcttgatattggtctctggttgactcacaagattaaggatcacttcaagagcaaaaagatggagatgacgattaaatacatcgatcctacctacatgatccgagctattccgagtaatgcagcagacaatgtctactgcacactgctggctcacagtgccatccatggcgcaatggcgggatacagcttcactgttgggatggtcaatggcagacatgcctacatacctttctatagggtgacgtccacacggaacaaggtgaagatcactgaccggatgtgggcgaggctgctgtcgtcgaccaaccagccaagcttcctgagccagaaggacatcgacgaggccagggaggccgataggctggccaacaagccgccgctgccatctgtcgccaaccagagtgtggcaaaggcctttgaccaatctgcagcggcttcgtcgaacggcgagatatagcgatgcgctggtctgtaaccgtgtacagtagctactgctatcctgctgaggaacatgtgccacgccatgccatgaagttttgcttccttacgatatcccttgtatgagtagtgcacgtatggatactgttcaggtgttctgtgaaatagc

SEQ ID NO: 3301 - DNA, 2824 bp, Panicum virgatum
ttaaacccgcgcttctttcccgtcggctttccggtgagaggaaaccatttttttagcccccgctagacccacaggccagccgaccagggggagctcgatccagaagcgtctagggactggggggagtgctacaatggcgtcgtcccacatcatcctgcccaaggaggaggaggcggaggcggaggcggaggcggagacaaggctcggcacggtggtggaggcggaccacgactccccggcgcagctcccgctccaggaccacgcgcccgggaaggcggcgctgccgttctcggctacgtgcgtccggatctcccgcgactcatacccgaacctccgcgcgctccgcaacgcttcagccttgaacctccacgacgacgacgccgccttcgtcaagctcgaggagggcgactacggatacgtgctcgacgacgtcccgcacctcaccgactacatacccgacctccccacttatcctaatcctttgcaagatcatccggcgtattcaactgtcaagcagtattttgtcaatgcagatgatacagtacctgaaaaggtggttgttcagaagaacagtccacgaggagtccacttccgacgtgctggacctcgtcagagagtgtatttcgaatcagaagaagtgaaagcttgcattgtaacctgtggaggcctttgccctgggcttaatactgtcatcagagagttggtgtgtggcttgtcccacatgtacaacgttaacaatgtcttcggaatacagaatggatacaagggtttctattcaagcaattatcttcccatgacaccaaagagtgtgaatgatatccacaagcgaggtggtacagttcttggaacatcacgtggtggccatgataccaaaaagattgttgacaacattcaagatcgtggaattaatcaggtgtacattatcggaggagatggaactcagaagggtgcatatgagatatacaaggaaattcgaagacgtggtctacaagtagctgttgctggtattcccaagacaattgataatgatatagcggttatagacaagtcatttggtttcgatactgctgtagaggaggcccagcgtgccattaatgcagctcatgtggaagcttcaagtgctgaaaatgggataggtttagtaaagcttatgggtcgttatagtgggtttattgccatgtacgctactcttgcaagcagagatgtggactgctgcttgattccagagtctcccttctatttggaaggggagggtggactattcgagtatgtagataggaggttgaaggagaacaaccacatggttattgtggtggctgagggagcaggacaggatcttattgctcaaagtatacctattgcagatcagcaagatgcctctggaaataagctgcttcttgatgttggtctctggttgactcacaagatcaaggattattgcaagagcaagaagatggaaatgactattaaatacattgatccaacttacatgatccgtgctattccaagcaatgcatcagacaatgtctattgcacactgctcgcacatagtgccattcatggtgcaatggcaggatacagctttacagtcggaatggtcaatggcaggcatgcgtatataccattccatagggtaacatcaacgaggaacaaggtgaggataaccgataggatgtgggcgaggctgctgtcttcaaccaaccagccgagcttcctgagcaaggaggacatcgatgcggccagagaagccgataaggcggccaacaacaggaagaacggagagaacgcgaagaagcaacatgcatcagtgttggcaaagggtgagaaatagtatgattttgacggttcatagctgtgtacaatacccattgctatttggctgaggtccataggccaaaactgcaaattcagtgcgtgctaggccgtaggacttctattagtagtttcttgactagtaatgcaactttgtcccgccaacggcaaatccaataagtattggtttcgtttgcatcgttccggttccttggaacggagcacattcgaagccccgtaatacgttctcagtagttcacgtaataaaggagctatattttgtgaagttgcatcagaaaacatgcagacctctgcaatttgaaaagctacctgcttgatgaccgtgtgttcgtcgtttgtgccggactgccggtctccatccgctgcaactgtgagtgtgtcgtcggcctcccttcttctgctaaagcttcctgtgaccttgtcgtcggcgcagcgaccttcagctgctcaatattaacgtccagtgtaccaccaaactagcagtcggtcgcccacgggccatgaactgttaaacctcctgtgaccttgtcgtcggtgcagcgaccttcgtcttgcctgacccggggaggggggtaccgttgttccttattttcgtccaggtgctctgcacgttggcggttatgctcgatcagctggctcaattcttcctccctgatgcccctgcctacattcttgcatgggggaaggcaccgtgggcgtcgaggctccccctacggcgtctgcactatcgcacaagccggtgaccggagctgcgccgccatctgcatcaccagacgtcgacgccgcgaggacccaggagccggacaataatgcgaagaacgaggcaggtgcagctgcgggtgatcaggatcagcggccgagccaggaggctcacggcgcaggtggatccttaacgcaggtggaggaggagaagcctacgcccggaacaggcgcctcgtggcccgcgacaccaccggggacgcggacgccgccacagcgcgacgtcgcgccg

SEQ ID NO: 3302 - DNA, 2184 bp, Hordeum vulgare
gaaaaacatcacaccgagaagtcccgagccttctcctcctcctctttccccttctccacgcttcgccactggcggaatatttaaacctccgtctgaccagctcgctcgtcggcttccgcctctccggcaacagcgaacggttctcttaacgcgcgaccgagacctgaccagaccacccactcggctccgccagctttccagccccgggggttctccgatggcctcccacatcattctccccaaggaggaggaggaggaggggctggccgtggcggtggaggcggaccacgactcgccggagccgccgcggtaccggcacttgcagccggcccaaaaggcgctcccgttctcggccacctgcgtgcggatctcccgcgactcctaccccaacctccgcgccctccgcaacgcctccgccacgagcctccgcgacgacgacgccgccttcgccaagctcgacgcgggcgactacggctacgtcctcgacgacgtccagcacctcacggactacctccctgaactccccacttttcctaatccattgcaagatcaccctgcctattcaactgtcaagcaatattttgtcaacgcagatgatacagtacctgaaaaggtggttgttcagaagaacagcccacgtggagttcacttccgccgtgccgggcctcgtcagagggtctacttcgagccagaagatgtgaaagcatgcattgtgacgtgtggtggcctttgccctgggctcaatactgtcattagagagttggtgtgtggcttatcccacatgtacaatgtcaacaatgtcttcggaatacagaatggatacaagggcttctattcaagcaattatcttcccatgacacccaaaagtgtcaatgatatccacaaaaggggcggtacagttcttggaagttcgcgtggtggtcatgatacgcataagattgtcgacaacattcaagatcgtggaattaatcaggtttacattattggaggagacggaactcagaagggagcatacgagatattcaaggaaattcgaagacgtggtctaaaagtcgctgttgctggtatccccaagaccattgataatgatatagcggttatagacaagtcctttggttttgacactgccgtagaagaggcccaacgtgccattgatgccgctcatgtggaagcttcaagtgctgagaatggaataggcttggtgaaactgatgggtcgctatagtgggtttattgcaatgtatgctacgctggcaagcagagatgtggactgctgcttgattcctgaatctccattttatttggaggggaagggtggacttttcgagtatatagaaaggaggctgaaggagaacaaccatatggtcattgtagtggctgagggagcaggacaggatcttatcgccaaaagtatacctgtagcagatcagctagatgcatctggaaataagctgcttcttgatgttggtctctggttgactcacaagattaaggattattgcaagagcaaaaagatggagatgaccattaaatacatagatccaacctacatgatccgagccattccaagcaatgcttcggataatgtctactgcacgctgctggcacacagtgccatacatggtgcaatggcaggatatagcttcacagtgggaatggtccacggcaggcatgcatacataccatttcatagagtaacatcgacacggaacaaggtgaagatcacggacagaatgtgggcaaggctgctgtcttcaacaaaccagccgagcttcctgagcgaggaggatatcatcgaggcaagagaggccgaaaggttggccaataggctatctctatctgttcctgcgggcagcagcgagcacggggagcatgcgaagaagtactctgggtcggtattagcaaatggtgagaaatagtaccagtaaagttttcactttggcaaattttccatggttcctgcggttgtacagtagcaaccgttgcggtctgagcccttgtttcacacggttttgcgtgttgacacgaatcctgctgatgtagagtgactaataaacagacgctactgtggtgttttcatcataacatgtggagggctcgagttagctgtggcggacgccaaaatctgcccttgctagttttctctttcttaaagcaaattcatacccatattcttcggtcgttc

SEQ ID NO: 3303 - DNA, 3421 bp, Panicum virgatum
cggcggcgtcaccgtcagcccccgccatcgtggacagcagaaaccacttctccccttctcccctccaaagctccggacccttctcccctttccccttcacgcttcgctccgcttcgcccctcgccgacgactatttaaaacccgcgcttctttcccgtcggctttccggtgagaggaaaccatttttttaacccccgcgagagacccacagccgagcagggggagctcgatcgagaagcgtctggggactcgggggagcgctccaatggcgtcgtcccacatcatcctgcccaaggaggaggaggaggcggcggcggaggccgggctgggcgtggcggtggaggcggaccacgactccccggcgcagcgcccgttccaggagcaggcgcccgggaaggcggcgctgccgttctcggcgacgtgcgtccggatctcccgcgactcgtacccgaatctccgcgcgctccgcaacgcttcggccctggacctccacgacgacgacgccgccttcgtcaagctcgaggagggcgactacggatacgtgctcgacgacgtcccgcacctgaccgactacctacccgacctccccacttttcccaatcctttgcaagatcatccggcgtattcaactgtcaagcagtattttgtcaatgcagatgatacagtacctgaaaaggtggttgttcagaagaacagtccacgaggagtccacttccgacgtgctggacctcgtcagagagtgtattttgaatcagaagaagtgaaagcttgcattgtaacatgtggaggcctttgccctgggcttaataccgtcatcagagagttggtgtgtggcttgtcccacatgtacaatgttagcaatgtcttcggaatacagaacggatacaagggtttctattcaagcaattatcttcccatgacaccaaagagtgtgaatgatatccacaagcgaggtggtacagttcttggaacatcacgtggtggccatgataccaaaaagattgttgacaacattcaagatcgtggaattaatcaggtgtacattatcggaggagatggaactcagaagggtgcatatgagatatacaaggaaattcgaagacgtggtctacaagtagctgttgctggcattcccaagacaattgataatgatatagcggttatagacaagtcatttggtttcgatactgctgtagaggaggcccagcgtgccatcaatgcagctcatgtggaagcttcaagtgctgaaaatgggataggtttagtgaagcttatgggtcgttatagtgggtttattgccatgtatgctactcttgcaagcagagatgtggactgctgcttgattccagagtctcccttctatttggaaggggagggtggactattcgagtatatagataggaggttgaaggagaacaaccacatggttattgtggtggctgagggagcaggacagaatcttattgctcaaagtatacctgctgcagatcagcaagatgcctctggaaataagctgcttcttgatgttggtctctggttgactcacaagatcaaggattattgcaagggcaagaagatggaaatgactattaaatacattgatccaacttacatgatccgtgctattccaagcaatgcatcagacaatgtctattgcacactgctcgcacatagtgccattcatggtgcaatggcaggatacagctttacagtcggaatggtcaatggcaggcatgcgtatataccatttcatagggtaacatcaacgaggaacaaggtgaggataaccgataggatgtgggcaaggctgctgtcttcaaccaaccagccgagcttcctgagcaaggaggacatcgacgcggccagagaagctgataaggcggccaacaagaggatgaacggagagaacgcgaagaagcaacctgcatcagtgttggcaaatggtgagaaatagtatgattttgacggttcatagctgtgtacagtacccattgctatttggctgaggtccataggccaaaactgcaattcagtgagtattggtttcttttgcatcgttccgattccttggaacggagcacattcgaagtcccggaacacgttctcagtagttcacgtaataaatgagatacattttgtgaagttgcatcagaaaaaatgcagacatctgcaacttgaaaagctacctgctggatgaccgtgtgtgttcgtcgtatgtgcctggcctccatccgctgcaactatgagcttgtcgtcgcctcgtcaacctcccttatgctagaacttaaacttcctgtgaccgtgtcgtcggtgcagcgacattcagctgctcaatattaacgtccatggtccatgaactgttaccctcttcgtcttggctgacttgccatcaggggaggggcgcaccgttgttccttattttcgtccaggtgctctgcacgtcgacggttatgcttgatcatcagctggctcaattcttgctccctgatgtccctgcctacattcttgcatgagggaaggcaccatcggcgtcgaggctccctctacggcgtcggcactaccgcaccggccggcgaccggagctgtgccgccatctgcatcaccagacgtcgacgccgcgaggatccaggacccggacaataatgcgaagaacgaggcaggtgcagctgcgggtgatcaggatgagcagccgagccaggaggctcacggcgcaggtggaaccgtaacgcagctggaggaggagaagcctacgcccggaacagacgcctcgtggcccacgacaccacgggggacgcggccgccaccacagcgcgacgtcgcgccggcgccgcgaaccggagatcgcaacgcgcgggccgcgcccgagacggagccggacgtcgaggccgtaaagcccggatcaggctgcaccacgccaccgccggcgcacgactcggaggcgtccgacgacggccgcggaagcccactgcacgaggagaagccgggcgcgagcgtggctgctgcctccaggtcgaggctgctctcgttccggtccttctcgcgggacaagaaggcgaacaagtccgacacggcggagcacaaggagaaaggcaaggagaggcggaagaggttctggaagtgaccgtcatcgatcaaagtcgtggcggggcgctagttttcatcgggcacgtcgcgcgggcgcggcccgcgtgtcaaataagcggagcgcttcacccccccccccccaaaaaaaaagtattgtgaatttgtggtacagcaagagcttggatttgtcgattgacgacttcttcttcatgtaataatttgtcaaacagaaggttagcccataagcagccatttgaatcctagtgtaaaaatgagaaatagctgacatttcactgatcattacttgggatatttactaaaaaaaaattgagagtca

SEQ ID NO: 3304 - DNA, 2149 bp, Panicum virgatum
gtggacagcagaaaccacttctccccttctcccctccaaagctccggacccttctcccctttccccttctccacgattttttcccctatacccttctccgacaattatttaaacccgcgcttctttcccgtcggctttccggtgagaggaaaccattttttaacccccgcgagagacccacagccgagcagggggagctcgatcgagaagcgtctggggactcgggggagcgctccaatggcgtcgtcccacatcatcctgcccaaggaggaggaggaggcggcggcggaggccgggctgggcgtggcggtggaggcggaccacgactccccggcgcagcgcccgttccaggagcaggcgcccgggaaggcggcgctgccgttctcggcgacgtgcgtccggatctcccgcgactcgtacccgaatctccgcgcgctccgcaacgcttcggccctggacctccacgacgacgacgccgccttcgtcaagctcgaggagggcgactacggatacgtgctcgacgacgtcccgcacctgaccgactacctacccgacctccccacttttcccaatcctttgcaagatcatccggcgtattcaactgtcaagcagtattttgtcaatgcagatgatacagtacctgaaaaggtggttgttcagaagaacagtccacgaggagtccacttccgacgtgctggacctcgtcagagagtgtattttgaatcagaagaagtgaaagcttgcattgtaacatgtggaggcctttgccctgggcttaataccgtcatcagagagttggtgtgtggcttgtcccacatgtacaatgttagcaatgtcttcggaatacagaacggatacaagggtttctattcaagcaattatcttcccatgacaccaaagagtgtgaatgatatccacaagcgaggtggtacagttcttggaacatcacgtggtggccatgataccaaaaagattgttgacaacattcaagatcgtggaattaatcaggtgtacattatcggaggagatggaactcagaagggtgcatatgagatatacaaggaaattcgaagacgtggtctacaagtagctgttgctggtattcccaagacaattgataatgatatagcggttatagacaagtcatttggtttcgatactgctgtagaggaggcccagcgtgccattaatgcagctcatgtggaagcttcaagtgctgaaaatgggataggtttagtgaagcttatgggtcgttatagtgggtttattgccatgtatgctactcttgcaagcagagatgtggactgctgcttgattccagagtctcccttctatttggaaggggagggtggactattcgagtatatagataggaggttgaaggagaacaaccacatggttattgtggtggctgagggagcaggacagaatcttattgctcaaagtatacctgctgcagatcagcaagatgcctctggaaataagctgcttcttgatgttggtctctggttgactcacaagatcaaggattattgcaagggcaagaagatggaaatgactattaaatacattgatccaacttacatgatccgtgctattccaagcaatgcatcagacaatgtctattgcacactgctcgcacatagtgccattcatggtgcaatggcaggatacagctttacagtcggaatggtcaatggcaggcatgcgtatataccatttcatagggtaacatcaacgaggaacaaggtgaggataaccgataggatgtgggcaaggctgctgtcttcaaccaaccagccgagcttcctgagcaaggaggacatcgacgcggccagagaagctgataaggcggccaacaagaggatgaacggagagaacgcgaagaagcaacctgcatcagtgttggcaaatggtgagaaatagtatgattttgacggttcatagctgtgtacagtacccatggctatttggctgaggtccataggccaaaactgcaattcagtgagtattggtttcttttgcatcgttccgattccttggaacggagcacattcgatgccccggaacacgttctcagtagttcacgtaataaatgagatacattttgtgaagttgcatcagaaaaaatgcagacatctgcaacttg

SEQ ID NO: 3305 - DNA, 2145 bp, Triticum aestivum
ctcgtcggctcgcgacagcgcggcagcgaagcgaaaccccccggttccggttccggttccgattccgattcccccggcagccatggcgtcccacatcatcctgccgccggacggcgacgacgacgagcagcagcggagggaggacgaggagaacgacggcggcgggagcgggggcgacggggcagcagcagcaggccgggggcaacgacgccaaggcggcgctgcccttctccgccatgtgcgtgcggatctcccgcgactcctaccccaacctccgcgccctccgcaacgcctcccacgccagcctcaccgacgccgcatacgtcaagatctccgagggcgacttcggatacgtcctcgacgacgtgccccacctcgccgactacatccccgacgtccccacttacccgaacccattacaagaccacccagcatattcaactgtcaagcaatattttgtcgatgaagatgacaccgtaccacaaaaggttgttgttcaaaagaatagccgccggggggttcacttccgtcgtgctggaccccgtcagagggttaattttgagtcagacgaagtgaaagcatgcattgtaagttgtggaggcctttgccctgggctcaacactgttatcagggagctggtgtgtggcttggcgcacatgtacaatgtcaacaacatctttggaatacagaatggatacaagggcttctattctagcaattatgttgctattacaccaaagacagtcaatgacatccacaagaggggtggtacagtccttggaacatcacgaggtggtcatgatacaaaaaagattgttgacaacattcaggatcggggaattaatcaggtgtatatcattggaggagatgggactcagaagggagcatatgagatctacaaggaaatccggaagcgtggcctaaaagttgccgtggcaggggttcccaagacaatagataatgacatagcgattatcgacaagtcctttggttttgattcggccgtcgaagaggctcaacgtgccattaattcagctcatgtggaagcttgcagtgctgagaatggaataggcttggtaaaactgatgggtcgttatagtgggttcattgcgatgtatgctactcttgcaagccgggatgtggattgctgcttgattccagagtctccgttttatatggatggggaaggggggttgcttcagtatgtagagaggaggctgaaagagaacaagcacatggttattgttgttgctgagggagcaggccaggatattattgccaaaagcatacccgcttcagatcagctagatgcatctggaaataagctgcttcttgatattggtctctggctgactcacaagattaaggatcacttcaagagcaaaaagatggagatgacgattaaatacattgatcctacctacatgatccgagctattccgagtaatgcagcagacaatgtctactgcacactgctggctcacagtgccatccatggcgcaatggcgggatacagcttcactgttgggatggtcaatggcagacatgcctacatacctttctacagggtgacgtccacacggaacaaggtgaagatcactgaccggatgtgggcgaggctgctgtcgtcgaccaaccagccaagtttcctgaggcagaaggacatcgacgaggctagggaggccgataggctgaccaacaagcctccgctaccacctgtcgccaaccagaatgtggcaaaagcatttgaccaatctgcatcggcttcgtcgaacggcgagatatagcgatgcgctggtctgtaaccgtgtacagtagctactgctatcctgctgatgaacatgtgccacggcacgccacgccatgaagttttgcttccttacgatatcccttgtatgagtagtgcacgtatggatactgttcaggtgttctgtgaaataagcagtatattattgtgctgctactgctgataatgttctttttttttttgccctggcaatttgctttgcatttcctgtgaaatctgcagcggccttctgctggagggggatgggggtatatatgcttgcattttattctctcgtctgtacaacctgtaatgaaccatttgccacttttaggatctactctctccgttcctaaata

SEQ ID NO: 3306 - DNA, 1895 bp, Secale cereale
ccgcgccctccgcaacgcctccaacgccagcctcaccgacgccgcctacgtcaagatctccgagggcgacttcggatacgtcctcgacgacgtcccccacctcgccgactacctccccgacgtcccaacttacccgaacccattacaagaccacccagcatactcaactgtcaagcagtattttgtcaatgaagatgacaccgtaccgcaaaaggttgttgttcagaagaatagccgccggggggttcatttccgtcgtgctggaccccgtcagagggttaattttgagtcagatgaagtgaaagcatgcattgtaagttgtggaggcctttgccctggactcaacactgttatcagggagctggtgtgtggcttggcgcacatgtacaatgtcaacagcatctttggaatacagaatggatacaagggattctattctagcaattatgttgctattacaccaaagacagtcaatgacatccacaaaaggggtggtacagtccttggaacatcacgaggtggtcatgatacaaaaaagattgttgacaatattcaggatcggggaattaatcaggtgtatatcattggaggagatggaactcagaagggagcatatgagatctacaaggaaatccggaagcgtggcctaaaagttgctgtggcaggggttcccaagacaatagacaatgacatagcgattatcgacaagtcctttggttttgattcggccgtcgaagaggctcaacgtgccattaattcagctcatgtggaagcttgcagtgctgagaatggaataggcttggtaaaactgatgggtcgttatagtgggttcattgcgatgtatgctactcttgcaagccgggatgtggattgctgcttgattccagagtctccgttctatatggatggggaaggggggttgcttcaatatgtagagaggaggctgaaagagaacaagcacatggttattgttgttgctgagggagcaggccaggatattattgccaaaagcatacccgcttcagatcaacaagatgcatctggaaataagctgcttcttgatattggtctctggctgactcacaagattaaggatcacttcaagagcaaaaagatggagatgacgattaaatacattgatcctacctacatgatccgagctattccgagtaatgcagcagacaatgtctactgcacactgctggctcacagtgccatccatggcgcaatggcgggatacagcttcactgttgggatggtcaatggcagacatgcctacatacctttctacagggtgacgtccacacggaacaaggtgaagatcactgaccggatgtgggcgaggctgctgtcgtcgaccaaccagccgagcttcctgagccagaaggacatcgacgaggccagggaggccgataggctggccaacaagccgccgctgccatctgtcgccaaccagagtgtggcaaaggcatttgaccaatctgcagcggcttcgtctaacggcgagatatagcgatgcgctggtctgtaaccgtgtacagtagctactgctatcctgctgaggaacatgtgccacgccatgccatgaagttttgcttccttacgatatcccttgtatgagtagtgcacgtatggatactgttcaggtgttctgtgaaataagcagtatattattgtgctgctactgctgataatgttcttatttttttttttgtccctggcaatttgcttcgcatttcctgtgaaatctgcgacggccttctgctggatggtgtatatatatgtttgcattttgtttctctcctttgtagaacctgtaatgaaccatttgtccacttttaggatctactccttctgttcctaaatataagcttccaatagagactacaaatagg

SEQ ID NO: 3307 - DNA, 2605 bp, Sorghum bicolor
tatctgtacaaaatccaaaaatcagtcaaccttataaacaatcatccgaagaagaaaccacagaaagactcacctcctacgcggccgccactttcatcatcagcaacgccggcgtcgccgtcacccaccctctcgcggactgcggacagcagaaaccatcacatcaaaccggaaaccacccttccctccagaactcgagaccattctcccctttccccttctccacgcttcgcccctcgccgactattttaaacccacgcttgttcttccccgtcggattcttttgtacccccgcgggagatccacgcatccacagccgagcagtggagctcgatcgcgaggcttctagagagtcggggggagttcaggcttctccaatggcgtcgtcccacatcatcctgcccaaggaggaggaggaggaggagaaggaggcggcggcggtggcggaggccgggttgggcgtgggggtggaggcggaccacgactccccggcgcagcggccgtaccaggagcaggcgccagggaaggcggcgttgccgttctcggcaacgtgcgtccggatctcccgcgactcgtacccgaacctccgcgcgctgcggaacgcgtccaccatggcactccacgatgatgacgccgccttcgtcaaaatcgaggagggtgacttcggatacgtgctcgacgacgtcccgcacctcaccgactacctcccggacctccccacttttcctaatcctttgcaagatcatccggcgtattcaactgtcaagcaatattttgtcaatgcagatgatacagtccctgaaaaggtggttgttcagaagaacagtccgcgaggagttcacttccgtcgtgctggacctcgtcagagggtgtattttgagtcagaagaagtgaaagcttgcattgtaacctgtggaggcctttgccctgggctcaatactgtcatcagagagttggtgtgtggcttgtcccacatgtacaacgttagcaatgtctttggaatacagaatgggtacaaggggttctattcgagcaattatcttcccatgacaccaaagagtgtgaatgatatccacaaacgaggtggtacggttcttggaacatcacgaggtggccatgataccaaaaagatcgttgacaacattcaagatcgtggaattaatcaggtgtacattataggaggagatggaactcagaagggtgcatatgagatttacaaggaaattcggagacgtggtctacatgtagctgttgctggtattcccaagactattgataatgatatagcggttatagacaagtcatttggttttgatactgctgtagaagaagcccagcgtgccatcaatgcagctcatgtggaagcttcaagtgctgaaaatgggatagggttagtgaagcttatgggtcgctatagtgggtttattgccatgtatgctactcttgcaagcagagatgtggactgctgcttgattcctgagtcacccttttatttggaaggggagggtggactatttgagtatatagataggaggttgaaggagaacaaccacatggttattgttgtggcggagggagctggacaggatcttattgctcaaagtatacctgctgcagatcagcaagatgcatctggaaataagctgcttcttgatgttggtctctggttgactcacaagattaaggattattgcaagagcaagaagatggagatgactattaaatacatagatccaacctacatgatccgtgctattccaagcaatgcatcagacaatgtctattgcacactgctcgcacatagtgccattcatggtgcaatggcaggatacagctttacagtcggaatggttaatggcaggcatgcatatataccatttcatagggtgacatctacaaggaacaaggtgaggataactgacaggatgtgggcgaggctgctgtcttcaaccaaccagccgagtttcctgagccagaaggacatcgacgcggcaagagaagccgataaggcggccaatgcgaagaaccaatctgcaccagcgttggcaaatggtgagaaataagtatgcttttgacggctctttgttgtgtacagtagctgttgcaaactgactgaggtcagtaggccaaaactgcgaattcgatgagttttgcttccatttgcatcggaacagaatccacgtaataaaagtttcatagtgtgtgtatttgcgttagtaaacgtgtaccagtgctctgcaatttgcttgtgttggtcgaatgtgccggcctccatccgctgccgttgcgcttcatctgaagcaaggctgtggccacaacaggtactctggtgtgagtaaacggctcttctgctagaaagtttcctgtgaccgtgtctcaggcgtgacaatatcacgagaggttaccttccgctgctcaatgtatcgtcccgtgtcccaccaaactagccgtcgatcgtccatggaccatgatcctctttgttcatgttgtcctcaagttgtctcttattttcgtcccactgttctgcacgtcggtggtggttgcgcttggtcagcaggtttccatgctcagttcttccctgatgcctgatggccctacgtttttg

SEQ ID NO: 3308 - DNA, 2119 bp, Pennisetum glaucum
tcttcgcccaatcgcccctcgccgactatttaaatcaccgcttcttttcccgtcggctttccggagagaggaaaccattttttttaaccccacacgcattcacaggctcacagccaagcgggagcgggggagctcgaccggaaagcttctagggactcgcggggagcgcttcaatggcgtcgtcccacatcatcctgcccaaggaggaggaggaggcagcggcggcggaggccgggctgggcgtggcggttgaggcggaccacgactccccggcgcagcgcccgtaccaggagcccgcgcccgggaaggcggcgctgccgttctcggcgacgtgcgtccggatctcccgcgactcgtacccgaacctccgcgcgctccgcaacgcctcggccctggacctccacgacgacgacgccgccttcgtcaaggtcgaggagggcgactacggatacgtgctcgacgacgtcccgcacctcaccgactacctacctgacctccctacttttcctaatcctttgcaagatcatccggcgtactcaactgtcaagcagtactttgtcaatgcagatgatacagtacctgaaaaggtggttgttcataagaacagctcacgaggagtccacttccgtcgtgctggacctcgtcagagagtgtatttcgagtcagaagaagtgaaggcttgcattgtaacctgtggaggcctttgccctggtctcaatactgtcatcagagagttggtgtgtgggttgtcccacatgtacaatgttaacgatgtcttcggaatacagaatggatacaagggtttctattctagcaattatcttcccatgataccaaagagtgtgaatgatatccacaaaagaggtggtacagttcttggaacatcacgtggtggtcatgataccaaaaagattgttgacaacattcaagatcgtggaattaatcaggtgtacattattggaggggatggaacacagaagggtgcatatgagatatacaaggaaattcggaggcgtggtttacaagtagctgttgctggtattcccaagacaattgataatgatatagcggttatagacaagtcatttggttttgatactgctgtagaggaggcacagcgtgccattaatgcagctcatgtggaagcttcaagtgctgaaaatgggattgggttagtgaaactcatgggtcgctatagtgggtttattgccatgtatgctactcttgcaagcagagatgtggactgctgcttgattcctgagtcacctttttatttggaaggggagggtggactattcgagtatatagataggaggttgaaggagaacaaccacatggttattgtggtggctgagggagcaggacaggatcttattgctcaaagtatacctgctgcagatcagcaagatgcatctggaaataagctgcttcttgacgttggtctctggttgactcataagattaaggattattgcaagaacaagaagatggaaatgactattaaatacatagatccaacttacatgatccgtgctattccaagcaatgcatcagacaatgtctattgcacactgctagcacatagtgccattcatggtgcaatggcaggatacagctttacagtcggaatggtcaatggcaggcatgcgtacataccatttcatagggtgacatcgacgaggaacaaggtgaggataaccgacaggatgtgggcgaggctgctgtcttcaaccaaccagccgagcttcctgagccagaaggacgtcgacgcggccagagaagctgataaagcggcgaacagcaggaggaacggagagaacgtgaagaagcaacctgcattgttgttggcaaatggtgagaagtagtatgattttgacggtttcatagttgtgtacagtacctagtgcaatttggccgaggccaataggccaaaactgcgaattcagtgagttttgctttcaattgcatagttccggttccacggaatggggtgcactcagaagtcccgaacacgttctcggtagagttcattcacataataaaaagctctatgttttgtgtacttgcattgcattaggaaacatgtagagttctgcaatttgaaagctacctgttcgat

SEQ ID NO: 3309 - DNA, 3304 bp, Saccharum officinarum
acacgactcgccgcgaggagtttccccttcctccgcgcgcatccccgcgagagctcgaaaacctagccgccaaatccatggctcgacgcgaccacgacgacgacgacgagatcgaggaggaggaggacgaggaggaggcctacgacctggacgaggaggaagaggaggacgaggaagacgactacgaggaggaggcgaggcgcgggaaggcctcccgcggcggcggcagcggcggcgggcggaagcggtcgcgtgaagacaactttattgacgacttggccatcgaagacgacgacgaggaggatgacgacgacgacggtgggggccggccgaggaagaagggcggcggcggggtgcgagggttcttcgacgaggaggcccaggtcgacgaggatgaggaagaggaggacgaaggcgagggcgaggacgattttattaatgatgctggggccgaccttcctgatgaggatgttgttaggggctcaagacgtcattctattcctatgagggatgaggaagaggacattgatgagattgagagacaagtgcgggagagatacgcaagatccactcatattgagtacggtgaggaagcagcagaagtggaacagcaagctctgctgccctccgtgaaggatcctaaactatggatggtcaaatgtgcgattggacatgagagagagactgcgatttgtctgatgcaaaagtacatagataggtcagaccttcagataaagtcagtcgtggcattggatcatctaaaaaattatatttatgttgaagctgaaaaggaggcccatgtcaaagaggcttgcaaaggtctacgaaacatttatgcttcagcaaaaataacattagtgccgataaaagaaatggcagatgtcctctctgttgagagcaaatctgtcgatctttcaagggattcttgggtccgaatgaaattgggcatatataaaggtgaccttgctaaggttgttgatgttgacaatgtacgtcaaagagtagatgtgaagctgatccctagaatagatctacaagctttggctagtaaactggaagggagggaggctgtaaagaagaaagcatttgtcccaccaccacgattcttcaatatcgatgaggcgagggagatgcatattcgtgtggaacggaggcgagataaagaatctggggagtactttgagtgggttgataatttgaagttcaaagatggtttcttgtacaaatcagtctccactaaatcaatccacacaaataatattcaaccgactttcgatgagcttgagaagtttaagaagcctggtgaagacatgaatggcgacatggctagcttgtccactctgtttgcaaacaggaaaaaagggcactttatgaagggtgatgccgtcattgttgttaaaggtgatttgaaaaatctggaggggtgggttgagaaagtagaggatgaaaccgttcacatcagaccaaaaatatctgatcttccgaaaacattagccttcaatgaaaaggagctttgcaaatatttcaagcctggtgaccatgtcaaggtgatctcaggtgttcaagaaggtgctactggcatggttgttaaagtggaagggcatgtcttgataattttgtctgacacaactaaagaacatatccgtgtgtttgctgatcatgtcgtcgaaagctctgaaattaccacaggaatcaccagaattggtgattatgaactgcacgatcttgtccttttagacaacttgtcatttggagtaattataagggtggaagctgaagcatttcaggttctgaaaggagtgccagatagacctgaagttgtgctcgtgaaattaagagaaataaaaagcaaaattgataggcgctcatcagctaaagatcgttctaataatattatctctgcaaaggatgttgtaagggttattgaaggagcatgcaaggggaagcaaggacctgtggaacacatacacaaggggatactgtttatctatgacaggcatcaccttgaacacgcaggctttatttgtgcaaaagcgcaatcttgccttcttgttggtggatcaactggtggtcgtcgaggaaatggtatggacacagctgatgcacggcttggtgctttgagatcttcagcaagcattctgcaatctccaggaaggctgcccccaagaggacctaatatgaattatggtggaaggtttggaggcggccgtggtggtagaggacatgatgccttggtgggtaaatgtatcaaaattaaatctggcccttataagggataccgtggccgtgttaaagaggtgactggtgcactcgtacgtgtagagcttgattcattgatgaagattgtcacagttaaaagagatgatattgctgacacacctactgttgcgacaccattccgtgaacctcgttattcattgggcggtgaaactccaatgcacccgtctcgaacaccacatcatgcttatcagactccaatgcgtgaccctggagcgacaccaatacatgacgggatgcggactcccatgcgaagtcgagcctgggctcctatgagccctccaagggataattgggaagatggaaatcctgctacatggggtagcagtccagcttaccagccaggaaccccacaagctcggccatacgaagcccccacaccaggatcagggtgggcaaacactccaggagttagtttcaatgatgctcctactcccagggataactatgcaaatgccccaagtccatacgtgccttccacgcctgttggtcaaccaatgacaccaaactcagctgcatatcttccgggcacacctggtggtcaaccaatgaccccaggcaacgttggaatggatataatgtccccgataataggtggcgagggtgatggtacatggctgttgccggatgttttggtcaatgtgttgaggggaggtgatgacggtcctggtgtggttagggaagtactcggggatggatcttgccgagttgcacttgggtcgtcgggcaacggtgacatggtgacagtccttccaaacgaggtcgaggtcatcaggccaaagaagagtgacaggatcaagatattgaatggtaatttccgtggatacacaggaaaactcataggtatagatggttctgacggaatagtgaggcttgacgacacatacgaagttaagatattagatatggtgattttggccaaactggcgacctgaaatggatatatatattttgtaacgtgtccatcatagaacatattttgtaacaatgccctcgtctgcaataaagctttttgttgcttatttcc

SEQ ID NO: 3310 - DNA, 3592 bp, Panicum virgatum
ctcgccttccccgcacatcgtcacacgactcggcgagaggagtttcccctttcctctgtgtgcacctcgcccccgcgagagctcgaaaacctagccgccaaatccatggctcgccgcggccgcgacgacgacgacgacgaggtggaggaggacgaggacgaggaggaggcctacgacctggacgacgaggaggaggatgaggaggacgactacgaggaggaggccaggcgcgggaaggcctcccgcggcggcggcggcggcggcaagggcggcggcggcggcgggcggaagcggtcgcgcgaggacaacttcatcgacgactcggctatcgaggacgacgaggaggatgaggacgacgacggcggggcgcggccgaggaagaagggcggcggcggggtgcgggggttcttcgatgaggaggcccaggtcgacgaggacgaggaggaagaggacgacggcgagggcgaggacgattttatcaatgatgctggggccgatattcctgatgaggatgttgttaggggctcaagacgtcattcgatgcctatgagggatgaagaagaggacattgatgagattgagagacaagtacgggagagatatgcaagatccactcatattgagtatggtgaggaagctgcagaagtggaacaacaagctctgttgccttctgtgaaggatcctaaactatggatggtcaaatgtgcgattggacatgagagagagactgcgatttgtctgatgcaaaagtacatcgataggtcagatcttcagataaagtctgtcgtggcgttggatcatctaaaaaattatatttacgttgaagctgaaaaggaggcccatgtcaaagaggcttgcaaaggtctacgaaatatttatgcttcagcaaaaataaccttagttccaataaaagaaatggcagatgtcctctcggttgagagcaaatctgttgatctttcaagggattcttgggtccgaatgaagttgggcatatataaaggtgaccttgctaaggttgttgatgttgacaatgtacgccaaagagtggatgtaaagctgatccctagaatagatctacaagctttggctagtaagctggaagggagagatactgtaaagaagaaagcatttgttccaccaccacgattcttcaatatcgatgaggcgagggagatgcacattcgagtggaacggaggcgggataaagaatctggagagtactttgagtgggttgataatctgaagttcaaagatggtttcttgtacaaatcagtctccacaaaatcaatccacacaaataatattcagccgtcattcgatgaacttgagaaatttaggaagcctggtgacgacatgaatggcgacatggctagcttgtccactctgtttgcaaacaggaaaaaagggcacttcatgaagggtgatgccgtcattgttattaaaggcgatttgaaaaatctggaggggtgggttgagaaagtagaggatgaaacagttcacatcagaccgaaaatatctgatcttccgaaaacattagctttcaatgagaaggagctttgcaaatatttcaaacctggtgaccatgtcaaggtgatctcaggtgttcaagaaggtgctactggcatggttgttaaagtggaaggacatgtcttgatcattttgtctgacacaactaaagaacatatccgtgtgtttgccgatcatgttgttgaaagctctgaaattaccacagggattaccagaattggtgattatgaactgcatgatcttgtccttttggacaatttgtcatttggggtaattataagggtggaagctgaagcatttcaggttctgaaaggagtgccagatagacctgaagttgtactcgtgaaattaagagaaattaaaagcaaaattgatcggcgtgcatcggtgaaagataggtcaaataatattatctcagcaaaggatgttgtaagggttgttgaaggagcatgcaaggggaagcaaggacctgtggagcacatacacaaggggatactgtttatctatgacaggcatcaccttgaacatgcaggctttatttgtgcaaaagcacaatcttgccttcttgttggtggatcaactggtggccgacgaggaaatggcatggatacagcagatgctcggcttggtgctttgaggtctccagcaagcattttgcaatctccaggaaggctgcccccaagaggacctcacatgaattatggtggaagatttggaggtggtcgtggtggtagagggcatgatgccttggtgggaaaatgtatcaaaattaagtctggtccttacaagggctaccgtggccgtgtcaaagaggtgactggtgcacttgtccgtgtggagcttgattcattgatgaagattgtcacagttaaaagagatgatattgctgacactcctactgtcgcaacaccattccgtgaacctcgttattcattgggtggtgaaacaccaatgcacccatctcgaacaccacaccatgcttatcagactccaatacgggaccctggagcaacaccaatacatgacgggatgcggactcctatgcgtagtcgagcctgggctcctatgagtcctccgagggataattgggaagatggaaatcctgctacttggagtagcagtccagcctaccagccaggaactccaccagctcggccatacgaagcccccacacctggatcagggtgggcaaacactccaggagttagtttcaatgatgctccgactcctagggataattatgcaaatgctccgagtccatacgttccttccacacctgttggtcaaccgatgactccaaattctgccgcgtatcttccgggtacacctggtggtcaaccaatgactccaggcaatgttggaatggatataatgtcccccataataggtggtgagggtgaaggtacatggctgttgccagatgttttggtcaacgtcttgaggggaggtgatgacggtcctggtgtggtcagggaagtacttggggatggatcttgccgagtcgcactcgggtcttcgggcaacggagacatggtgacggttcttccgaacgaggttgaggtcatcaggccaaagaagagtgacaggatcaagatactgaatggcaatttccgtggatacacaggaaaactcattggcatagatggttctgacggaatagtgaagctggacgacacatacgaagttaagatattagatatggtgattttggccaaactggcgacttaaatggatgtatattttgtaacgtgtccatcaaagaacatatgttgtaagttgtaacgatgcccttgctcgcaataaatctttttggtgcttatttccttagtcttactccagaatttgttgcgccaaagtgcccatctatttgttccgtttttttgttgtttccggccctgatagatgagagatctatggttcttggcatcttcgcaatttacaattcttggcagttggcacgtcatctgtcgattagcattgtacatgccaaacgggtaacgtatggcaaagaataagtatcatggtttgcaaatactcgagatttctcatagttttcttctttact

SEQ ID NO: 3311 - DNA, 3484 bp, Panicum virgatum
ggcgagaggaggtttcccctttcctctgcgtgcacctcgcccccgcgagagctcgaaaacctagccgccaaatccatggctcgccgcggccgcgacgacgacgacgacgacgaggcggaggaggaggaggacgaggaggaggcctacgacctggacgacgaggaggaggatgaggaggacgactacgaggaggaggccaggcgcgggaaggcctcccgcggcggcggcggcggcggcaagggcggcggcgggcggaagcggtcgcgcgaggacaacttcatcgacgactcggccatcgaggacgaggacgaggaggaagaggacgacgacggcggggcgcggccgaggaagaagggcggcggcggggtgcgggggttcttcgacgaggaggcccaggtcgacgaggacgaggaggaagaggacgacggcgagggcgaggacgattttatcaatgatgctggggccaatattcctgatgaggatgttgttaggggctcaagacgccattcaatgcctatgagggatgaagaagaggacattgatgagattgagagacaagtacgggagagatatgcaagatccactcatattgagtatggtgaggaagctgcagaagtggaacagcaagctctgttgccttctgtgaaggatcctaaactatggatggtcaaatgtgcgattggacatgagagagagactgcgatttgtctgatgcaaaagtacatcgataggtcagatcttcagataaagtctgttgtggcgttggatcatctaaaaaattatatttacgttgaagctgaaaaggaggcccatgtcaaggaggcttgcaaaggtctacgaaatatttatgcttcagcaaaaataaccttagttccaataaaagaaatggcagatgtcctctcggttgagagcaaatctgttgacctttcaagggattcttgggtccgaatgaagttgggcatatataaaggtgaccttgctaaggttgttgatgttgacaatgtacgccaaagagtggatgtaaagctgattcctagaatagatctacaagctttggctagtaaactggaagggagagagactgtaaagaagaaggcatttgtcccaccaccacgattcttcaatatcgatgaggcgagggagatgcacattcgagtggaacggaggcgggataaagaatctggagagtactttgagtgggttgataatctgaagttcaaagatggtttcttgtacaaatcagtctccacaaaatcaatccacacaaataatattcagccatcattcgatgagcttgagaaatttaggaagcctggtgatgacatgaatggcgacatggctagcttgtccactctgttcgcaaacaggaaaaaaggccacttcatgaagggtgatgccgtcattgttattaaaggcgatttgaaaaatcttgaggggtgggttgagaaagtagaggatgaaacagttcacatcagaccaaaaatatctgatcttccgaaaacattagctttcaacgagaaggagctttgcaaatatttcaaacctggtgaccatgtcaaggtgatctcaggtgttcaagaaggtgcaactggcatggttgttaaagtggaaggacatgtcttgatcattttgtccgacacaactaaagaacatatccgcgtgtttgccgatcatgttgttgaaagctctgaaattaccacagggattaccagaattggtgattatgaactgcatgatcttgtccttttggacaatttgtcatttggggtaattataagggtggaagctgaagcatttcaggttctgaaaggagtgccagatagacctgaagttgtactcgtgaaattaagagaaattaaaagcaaaattgatcgtcgtgcatcagcaaaagataggtcaaataatattatctcagcgaaggatgttgtaagggttgttgaaggagcatgcaaggggaagcaaggacctgtggaacacatacacaaggggatactgtttatctacgacaggcatcaccttgaacatgcaggctttatttgtgcaaaagcacaatcttgccttcttgttggtggatcaactggtggccatcgaggaaatggcatggacacagcagatgctcggcttggtgcattgaggtctccagcaagcattttgcaatctccaggaaggctgcccccaagaggacctcacatgaattatggtggaagatttggaggtggtcgtggtggtagagggcatgatgccttggtgggaaaatgtatcaaaattaagtctggtccttacaaggggtaccgtggccgtgtcaaagaggtgactggtgcacttgtccgtgtggagcttgattcattgatgaagattgtcacagttaaaagagatgatattgctgacactcctactgtcgcaacaccattccgtgaacctcgttattcattgggtggtgaaacaccaatgcacccgtctcgaacaccacaccatgcttaccagactccaatacgggaccctggagcaacaccaatacatgacgggatgcggactcctatgcgtagtcgagcctgggctcctatgagtcctccgagggataattgggaagatggaaaccctgctacttggagtagcagtccagcctaccagccaggaactccaccagctcggccatacgaagcccccacacctggatcagggtgggcaaacactccaggagttagtttcaatgatgctccgactcctcgggacaattatgcaaatgctccgagtccatacgtgccttccacacctgttggtcaaccgatgactccaaattctgccgcgtatcttccgggtacacctggtggtcaaccaatgactccaggcaatgttggaatggatataatgtcccccataataggtggtgagggtgaaggtacatggctgttgccagatgttttggtcaacgtcttgaggggaggtgatgatggtcctggtgtggtcagggaagtacttggggatggatcttgccgagttgcactcgggtcttcgggcaatggtgacgtggtgacggtccttccaaacgaggtcgaggtcatcaggccaaagaagagtgacaggatcaagatactgaatggcaatttccgtggatacacaggaaaactcataggcatagatggttctgacggaatagtgaagctggacgacacatacgaagttaagatattagatatggtgattttggccaaactggcgacttaaatggatgtatattttgtaacgtgtccatcatagaacatatgttgtaagttgtaacgatgcccttgttcgcaataaaattttttgttgcttatttccttagtgcccatttattgtgccaaagtgccagaatttgttgtgccaaagtgcctatttatttgtttcgttgattttgggtttcaggttctgatagatgagagatataactatcatgaatcgtcactttcttattgctaattaaagggagttgcgtttaggatgt

SEQ ID NO: 3312 - DNA, 3488 bp, Setaria italica
atggtgaaagagccccactgcaagccaaagacccggccacccgagagcccctgcatcccgaaaccagcccactctgttcgcgcatctcggcgcttccgacaggatcgaacgtcgcgggggcggctctcgccttccctcacacacgtctcgccgcgaggcgtttcccctttcctccgcgtgcacctcgcccccctcgcgagagagctcgaaaacctagccgccaaatccatggctcgccgcggccgcgacgacgacgacgacgaggtggaggaggaggaggacgaggaggaggcctacgacctggacgacgaggaggaggatgaggaggaagactacgaggaggaggcgaggcgcgggaaggcctcccgcggcggcggcggcggcaaggccggcggcggcgggcggaagcggtcgcgcgaggacaacttcatcgacgactcggccatcgaggacgaggatgaggatgatgaggacgacgacggcggcgcgaggccgaggaagaagggaggcggcggggtgcgagggttcttcgatgaggaggcccaggttgacgaggacgaggaggaggaggaggagggcgagggcgaggacgattttatcaatgatgctggggccgatattcctgacgaggatgttgttagggtcgcaagacgtcattctatgcctatgagggatgaagatgaggacattgatgagattgagagacaagtacgggagagatatgcaagatccactcatattgagtatggtgaagaagctgcagaagtggaacagcaagctttattgccctccgtgaaggatcctaaactatggatggtcaaatgtgcgattggacatgagagagagaccgcgatttgtctgatgcaaaagtacattgataggtcagatcttcagataaagtctgtcgtggcgttggatcatctaaaaaattatatttatgttgaagcagaaaaggaagcccatgtcaaagaggcttgtaaaggtctacgaaatatttatgcttcagcaaaaataacattagttccaataaaagaaatggcagatgtcctctctgttgagagcaaatctgttgatctttcacgggattcttgggtccgaatgaagttgggcatatacaaaggtgaccttgctaaggttgttgatgttgacaatgtacgccaaagagtagatgtaaagctgatccctagagtagacctacaagctctggctagtaaactggaagggagagaggctgtaaagaagaaagcatttgtcccaccacctcgattcttcaatatcgatgaggcgagggagatgcacattcgagtggaacggaggcgggataaagaatctggggagtactttgagtgggttgataatctgaagttcaaagatggtttcttgtacaaatcagtctccactaaatcaatccacacaaataatattcagccgacattcgatgaacttgagaaatttaggaagcctggtgatgacatgaatggcgacgtggctagcttgtccactctttttgcaaacaggaaaaaaggacacttcatgaagggtgatgccgtcatagttattaaaggcgatttgaaaaatctggaggggtgggttgagaaagtagaggatgaaacagttcacatcaggccaaaaatatctgatcttccgaaaacattagccttcaacgagaaggagctttgcaaatatttcaaacctggtgaccatgtcaaggtgatctcaggtgttcaagaaggagctactggcatggttgttaaagtggaaggacatgtcttgatcattttgtctgacacaactaaagaacatatccgcgtgtttgccgatcatgttgtcgaaagctctgaaattaccacaggaattaccagaattggtgattatgaactgcatgatcttgtccttttggacaatttgtcatttggggtaattataagggtggaagctgaagcatttcaggttctgaaaggagtgccagatagacctgaagttgtacttgtgaaattaagagaaataaaaagcaaaattgatcggcgtgcttcagcgaaagataggtcaaataatattatctcagcaaaggatgttgtaagggttgttgaaggagcatgcaaggggaagcaaggacctgtggaacacatacacaaggggatactgtttatctatgacaggcatcaccttgaacatgcaggctttatttgtgcaaaagcacaatcttgccttcttgttggtggatcgactggtggccgtcgaggaaatggcatggacacagcagatgcacggcttggtgctttgaggtctccagcaagcattttgcaatctccaggaagactgcccccaagaggacctcacatgaattttggtggaaggtttggaggtggtcgtggtggtagagggcatgatgccttggtgggtaaatgtatcaaaattaagtctggtccttacaaggggtaccgcggccgtgtcaaagaggtgactggtgcacttgtacgtgtggaacttgattcgttgatgaagattgtcacagttaaaagagatgatattgctgacacacctactgttgcgacaccattccgtgaacctcgatattcattgggtggtgaaacaccgatgcacccgtctcgaacaccacaccatgcttatcagactccaatgcgggaccctggagcaacaccaatacacgatgggatgcggactcctatgcgtagtcgagcctgggctcctatgagtcctccgagggataattgggaagatggaaatcctgctacttggggcagcagtccagcctaccagccaggaactccaccagctcggccatacgaagcccctacaccaggatcagggtgggcaaacactccaggagttagtttcaatgatgctccaactcctagagagaactatgcaaatgctccgagtccatacgtgccttccacacctgttggtcaaccgatgactccaaattctgctgcgtatcttccgggtactcctggtggtcagccaatgactccaggcaatgtgggaatggatataatgtcccccataataggtggtgagggtgaaggtacatggctgttgccagatgttttggtcaatgtgttgaggggaggcgacgatggtcccggtgtcgtcagggaagtacttggggacggatcttgccgagttgcacttgggtcgtcaggcaacggcgacatggtgactgtccttccgaacgagctcgaggtcatcaggccaaagaagagcgacaggatcaagatactgaatggcaatttccgcgggtacacaggaaaactcataggcatagatggttctgacggaatagtgaagctggacgacacatacgaagttaagatattagatatggtgattttggccaaactggcgacttgaaatgtatgtatattttgtaacgtgtccatcatataacataatgttgtaacgatgcccttgttcgcaataaaactttttgtggcttatatttccgtagtattattccagactct

SEQ ID NO: 3313 - DNA, 3306 bp, Zea mays
acacgattcgccgcgaggagtttccccttccgctgcgtgcatcccgcgagagctcgaaaacctagccgcaaaatcgatggctcggcgcggccacgacgacgacgacgacgaggtcgatgaggaggaagaggaggatgcctatgacctggacgacgacgaggatgaggatgaggaggacgactacgaggaggagacgaggcgcgggaaggcctcccgcggcggcggcggcgccaagagcggcggcgggcggaagcggtcgcgggaagacaactttatcgacgactcggccatcgaggacgaggacgatgaggatgacgacggcggtggccgaccgaggaagaagggtggcggcggggtgcgaggattcttcgacgaggaggcccaggtcgacgaggatgaggaagaagaggacgaaggagagggcgaggacgattttattaatgatgctggggcggacctccctgatgaggatgttgttaggggttcaagacgtcattctattcctatgagggatgaagaagaggacattgatgaaatggagagacaagtgcgggagagatacgcaagatctactcatattgaatacggtgaggaagctgcagaagtagaacagcaagctctgctgccctcggtgaaggatcctaaactatggatggtcaaatgtgcgattgggcatgagagagagactgcgatttgtctgatgcaaaagttcattgataggtcagaccttcaaataaagtcagtcgtggcgttggatcatctaaaaaattatatttatgttgaagctgagaaggaggcccatgtcaaagaggcttgcaaaggtctacgaaacatttatgcttcggcaaaaataacattagtgcctataaaagaaatggcagatgtcctctctgttgagagcaaatctgtcgatctgtcaagggattcttgggtccgaatgaaattgggcatatataaaggtgaccttgctaaggttgttgatgttgacaatgtacgtcaaagagtagatgtgaagctgatccctagaatagatctacaagctttggctagtaaactggaagggagagacattgtaaagaagaaagcatttgtcccaccaccacgattcttcaatatcgatgaggcgagggagatgcatattcgtgtggaacggaggcgagataaagaatctggggagtactttgagtgggttgataatttgaagtttaaagatggtttcttgtacaaatcagtctcaactaaatcaatccacaaaagtaatattcaaccgactttcgatgagcttgagaagtttaagaagcctggtgatgacatgaatggcgacatggctagtttgtctactctatttgcaaacaggaaaaaagggcattttatgaagggtgatgctgtcattgttattaaaggcgacttgaaaaatctggagggatgggttgaaaaagtagaggatgaaaccgttcacatcagaccaaaaatatctgatcttccgaaaacattagccttcaatgaaaaggagctttgcaaatatttcaagcctggtgaccatgtcaaggtgatctcaggtgtccaagaaggtgctactggcatggtcgttaaagtggaagggcatgtcttgatcattttgtctgacacaactaaagaacatatccgtgtgtttgctgatcatgtcgtcgaaagctctgaaatcaccacaggaataaccagaattggtgattatgaactgcatgatcttgtccttttagacaacttgtcatttggagtaattataagggtggaagctgaagcatttcaggttctgaaaggagtgccagatagacctgaagttgtgctcgtgaaactaagagaaataaaaagcaaaattgaaaggcgctcatcagctaaagatcgttctaataatattatctctgcaaaggatgttgtaagggttgttgaaggagcatgcaaggggaaacaaggacctgtggaacacatacacaaggggatgctgtttatctatgacaggcatcaccttgaacatgcaggttttatttgtgcaaaagcgcaatcttgccttcttgttggtggatcaactggtggccgtcgaggaaatggtatggacacagctgatgcacggcttgatgctttgcgatcttcagcaagcattctgcaatctccaggaaggctgcccccaagaggacctaatatgaattatggtggaaggtttggaggcggccgtggtggtagaggatatgatgccttggtgggtaaatgtatcaaaattaaatctggcccttataagggataccgtggccgtgttaaagaggtgactggtgcactcgtacgtgtagagcttgattcattgatgaagattgtcacagttaaaagagatgatatcgctgacacacctacagtcgcgacgccattccgtgaacctcgttattcattgggtggtgaaacaccaatgcacccgtctcgaacaccgcatcatgcttatcagactccaatgcgggaccctggagcaacaccaatacatgatggaatgcggactcccatgcgaagtcgagcctgggctcctatgagtcctccaagggacaattgggaagatggaaatcctgctacttggggtagcagtccagcttaccagccaggaaccccacaagctcggccatatgaagcccccacacctggatcggggtgggcaaatactccaggagttagtttcaatgacgctcctactcccagggataactatgcaaatgccccaagtccatacgtgccttccacacctgttggtcaaccaatgacgccaaactcagcctcgtaccttccaggcacacctggtggtcaaccaatgaccccaggcaatgctgggatggatatgctgtccccaataataggtggtgatggtgaagttgcatggctgttgccggatgttttggtcaatgtgttgaggggaggtgatgacggccctggcgtggttagggaagtactcggggatggatcttgccgggttgcacttgggtcgtcgggcaacggtgacgtggtgacggtccttgcgaacgaggtcgaggtcatcaggccgaagaagagcgacaggatcaagatattgaacggcaatttccgtgggtacacaggaaagctcataggtatagatggttctgacggaatagtgaggcttgacgaaacatacgaagttaagatcttagatatggtgattttggccaaactggccacttaagatcttagatgtatatgttgtaacgtgtccgtcatagaacgtattctgtaacaatgccctcgtttgcaataaagctttgcttatttgcacca

SEQ ID NO: 3314 - DNA, 3225 bp, Panicum virgatum
gaggaggacgactacgaggaggaggccaggcgcgggaaggcctcccgcggcggcggcggcaagggcggcggcggcggcgggcggaagcggtcgcgcgaggacaacttcatcgacgactcggctatcgaggacgacgacgaggaggaagaggacgacgacggcggggcgcggccgaggaagaagggcggcggcggggtgcgggggttcttcgacgaggaggcccaggtcgacgaggacgaggaggaagaggacgacggcgagggcgaggacgattttatcaatgatgctggggccaatattcctgatgaggatgttgttaggggctcaagacgccattcaatgcctatgagggatgaagaagaggacattgatgagattgagagacaagtacgggagagatatgcaagatccactcatattgagtatggtgaggaagctgcagaagtggaacagcaagctctgttgccttctgtgaaggatcctaaactatggatggtcaaatgtgcgattggacatgagagagagactgcgatttgtctgatgcaaaagtacatcgataggtcagatcttcagataaagtctgttgtggcgttggatcatctaaaaaattatatttacgttgaagctgaaaaggaggcccatgtcaaggaggcttgcaaaggtctacgaaatatttatgcttcagcaaaaataaccttagttccaataaaagaaatggcagatgtcctctcggttgagagcaaatctgttgacctttcaagggattcttgggtccgaatgaagttgggcatatataaaggtgaccttgctaaggttgttgatgttgacaatgtacgccaaagagtggatgtaaagctgatccctagaatagatctacaagctttggctagtaaactggaagggagagatactgtaaagaagaaagcatttgttccaccaccacgattcttcaatatcgatgaggcgagggagatgcacattcgagtggaacggaggcgggataaagaatctggagagtactttgagtgggttgataatctgaagttcaaagatggtttcttgtacaaatcagtctccacaaaatcaatccacacaaataatattcagccgtcattcgatgaacttgagaaatttaggaagcctggtgacgacatgaatggcgacatggctagcttgtccactctgtttgcaaacaggaaaaaagggcacttcatgaagggtgatgccgtcattgttattaaaggcgatttgaaaaatctggaggggtgggttgagaaagtagaggatgaaacagttcacatcagaccgaaaatatctgatcttccgaaaacattagctttcaatgagaaggagctttgcaaatatttcaaacctggtgaccatgtcaaggtgatctcaggtgttcaagaaggtgctactggcatggttgttaaagtggaaggacatgtcttgatcattttgtctgacacaactaaagaacatatccgtgtgtttgccgatcatgttgttgaaagctctgaaattaccacagggattaccagaattggtgattatgaactgcatgatcttgtccttttggacaatttgtcatttggggtaattgtaagggtggaagctgaagcatttcaggttctgaaaggagtgccagatagacctgaagttgtactcgtgaaattaagagaaattaaaagcaaaattgatcggcgtgcatcggcgaaagataggtcaaataatattatctcagcaaaggatgttgtaagggttgttgaaggagcatgcaaggggaagcaaggacctgtggagcacatacacaaggggatactgtttatctatgacaggcatcaccttgaacatgcaggctttatttgtgcaaaagcacaatcttgccttcttgttggtggatcaactggtggccgacgaggaaatggcatggatacagcagatgctcggcttggtgctttgaggtctccagcaagcattttgcaatctccaggaaggctgcccccaagaggacctcacatgaattatggtggaagatttggaggtggtcgtggtggtagagggcatgatgccttggtgggaaaatgtatcaaaattaagtctggtccttacaagggctaccgtggccgtgtcaaagaggtgactggtgcacttgtccgtgtggagcttgattcattgatgaagattgtcacagttaaaagagatgatattgctgacactcctactgtcgcaacaccattccgtgaacctcgttattcattgggtggtgaaacaccaatgcacccatctcgaacaccacaccatgcttatcagactccaatacgggaccctggagcaacaccaatacatgacgggatgcggactcctatgcgtagtcgagcctgggctcctatgagtcctccgagggataattgggaagatggaaatcctgctacttggagtagcagtccagcctaccagccaggaactccaccagctcggccatacgaagcccccacacctggatcagggtgggcaaacactccaggagttagtttcaatgatgctccgactcctagggataattatgcaaatgctccgagtccatacgttccttccacacctgttggtcaaccgatgactccaaattctgccgcgtatcttccgggtacacctggtggtcaaccaatgactccaggcaatgttggaatggatataatgtcccccataataggtggtgagggtgaaggtacatggctgttgccagatgttttggtcaacgtcttgaggggaggtgatgacggtcctggtgtggtcagggaagtacttggggatggatcttgccgagtcgcactcgggtcttcgggcaacggagacatggtgacggttcttccgaacgaggttgaggtcatcaggccaaagaagagtgacaggatcaagatactgaatggcaatttccgtggatacacaggaaaactcattggcatagatggttctgacggaatagtgaagctggacgacacatacgaagttaagatattagatatggtgattttggccaaactggcgacttaaatggatgtatattttgtaacgtgtccatcaaagaacatatgttgtaagttgtaacgatgcccttgctcgcaataaatctttttggtgcttatttccttagtcttactccagaatttgttgcgccaaagtgcccatttatttgttccgttgatttggggtttccggccctga

SEQ ID NO: 3315 - DNA, 3078 bp, Pennisetum glaucum
gaggcgcgggaaggcctcccgcggcggcggcggcggcaaagccggcggcgggaggaagcggtcgcgcgaggacaacttcatcgacgactcggccatcgaggacgaggacgaggaggatgaggacgatgacggcggggcgcggccgaggaagaagggaggcggcggggtgcgagggttcttcgacgaggaggctcaggtcgacgaggacgaggaggaggaggacgatggcgagggcgaggacgattttatcaatgatgctggggccgatattcctgatgaggatgttgttaggggctcaagacgtcattctattcctatgagggatgaagaagaggacattgatgagattgagagacaagtacgggagagatatgcaagatccactcatattgagtatggtgaagaagctgcagaagtggaacagcaagctttattgccctccgtgaaggatcctaaactatggatggtaaaatgcgcgattggccacgagagagagaccgcgatttgcctgatgcaaaagtacattgataggtcagatcttcagataaaatctgtcgtggcgttggatcatctaaaaaattatatttatgttgaagcagaaaaggaagcccatgtcaaagaggcttgtaaaggtctacgaaacatttatgcttcagcaaaaataacattagttccaataaaagaaatggcagatgtcctctctgttgagagcaaatctgttgatctttcaagggattcttgggtccgaatgaagttgggcatatacaaaggtgaccttgctaaggttgtagatgttgacaatgtacgccaaagagtagatgtaaagctgattcctagaatagatctacaagctttggctagtaaattggaagggagagaggctgtaaaaaagaaagcatttgtcccagcacctcgattcttcaatatcgatgaggcgagggagatgcacattcgagtggaacggaggcgggataaggaatctggggagtactttgagtgggttgataatctgaagttcaaagatggtttcttgtacaaatcagtctccactaagtcaatccacacaaataatattcagccgacatttgatgaacttgagaaatttaagaagcccggtgatgacatgaatggcgacatggctagcttgtccactctgtttgcaaacaggaaaaaaggacacttcatgaagggtgatgctgtcatagttattaaaggtgatttgaaaaatcttgaggggtgggttgagaaagtagaggatgaaacagttcacatcaggccaaaaatatctgatcttccgaaaacgttagccttcaatgagaaggagctttgcaaatatttcaaacctggtgaccatgtcaaggtgatctcaggtgttcaagaaggagctactggcatggttgttaaagtggagggacatgtcctgataattttgtctgacacaactaaagaacatatccgtgtgtttgctgatcatgttgtcgaaagctcagaaattactacaggaattaccagaattggtgattatgaactgcatgatcttgttcttttggacaatttgtcatttggggtaattataagggtggaagctgaagcatttcaggttctgaaaggagtgccagatagacctgaagttgtccttgtgaaattgagagaaataaaaagcaaaattgatcggcgtgcatcagcaaaagataggtcaaataatattatctcagcaaaggatgttgtaagggttgttgaaggagcatgcaaggggaagcaaggacctgtggaacacatacacaaggggatactgtttatctatgacaggcatcaccttgaacacgcaggatttatttgtgcaaaagcacaatcttgccttcttgttggtggatcgactggtggccgtcgaggaaatggcatggacacagcagatgcacggcttggtgctttgaggtctccagcaagcattctgcaatctccaggaagattgcccccaagaggacctcacatgaattttggtggaaggtttggaggtggtcgtggtggtagagggcatgatgccttggtgggtaaatgtatcaaaattaagtctggtccttacaaggggtaccgtggccgtgtcaaagaggtgactggtgcacttgtacgtgtggaacttgattcattaatgaagattgtcacagttaaaagagatgatattgctgacacacctactgttgcaacaccattccgtgaacctcgatattcattgggtggtgaaacaccgatgcacccatctcgaacaccacaccacgcttatcagactccaatgcgggaccctggagcaacaccgatacacgacgggatgcggactcctatgcgtagtcgagcctgggctcctatgagtcctccaagggataattgggaagatggaaatcctgccacttggggcagcagtccagcctaccagccaggaactccaccagctcggccatacgaagcccctacaccaggatctgggtgggcaaacactccaggagttagtttcaatgatgctcctactcctagagagaactatgcaaatgctccgagtccatacgtgccttccacacctgttggtcaaccgatgactccaaattctgccgcgtatcttccgggtactcctggtggccaaccaatgactccaggcaatgtgggaatggatataatgtcccccataataggtggtgagggtgaaggtacatggttgttgccagatgttttggtcaatgtgctgaggggaggcgatgatggtcctggtgtggttagggaagtacttggggatggatcttgccgagttgcacttgggtcatcgggcagtggcgacatggtgacggtccttccgaacgagcttgaggtcatcaggccaaagaagagcgacaggatcaagatactgaatggcaatttccgcgggtacacaggaaaactaataggcatagatggttctgacggaatagtgaagctggacgacacattagaagttaagatattggatatggtgattttggccaaactggcgtcttgaaatgtatgtatattttgtaacgtgcccatcatatcatagaaacatatgttgta

SEQ ID NO: 3316 - DNA, 3381 bp, Oryza sativa
cccccccccacccctttcctcttcctcgcgacgaaaacctagccgccgaaaaatccgccatggctcgccgcgcccgcgacgacgacgacgacgacgaggtggaggaggaggacgaggaggaggcgtacgacctcgaggacgaggaggaggaggaggacgacgaggacgactacgaggcggaggcgaggggcgggggcaaggcctcccgctcctcctcctcccgcggcggcggtggcgggggaggcggggggaggaagcggtcgcgggaggacaacttcattgacgactccgccatcgaggacgacgaggaggatgacgacgacgacgacggcgggggccgcccgaagaagaagggcggcggcggcggggtgcgcgggttcttcgacgaggaggcgcaggtggatgaggacgaggaggaggaggacgacggcgagggcgaggacgatttcatcaatgatgctggggccgaccttccagacgaggatgtcgttaggggctcaaggcatcgttcaatacctatgagggatgaagaagaggatattgatgaaattgaaagacaagtaagggagagatatgcaagatctactcatattgagtatggagaagaagctgctgaagtagaacagcaagctctcttgccatcggtgaaggatccaaagctatggatggtgaaatgtgcgattgggcacgagagggagacagcaatttgtctaatgcaaaagttcattgatagatcagatctccagataaagtcagttgttgcgctagaccatctaaagaattatatttatgttgaagcggagaaggaggcccatgtcaaggaggcttgcaaaggtctacgaaacatttacgcttcagcaaaaataacattagttcctataaaagaaatggcagatgtcctctctgtggagagcaaatctgttgatctttctagggacgcttgggttcgaatgaagctgggtatatataaaggtgaccttgctaaggttgtcgatgttgacaatgtgcgccaaagggttactgtgaagctgatccctagaatagatttacaagctttggctagtaaactggaagggagggaggctgtgaagaagaaagcatttgtcccaccaccacgtttctttaatattgatgaggccagggagatgcacattcgtgtggaacggaggagggataaagactctggggagtactttgagatgattgatggcttaatgttcaaagatggcttcttatacaaaactgtctcaataaaatcaatcagcacacagaatattcagccatcattcgatgaactggagaagttcagaaaacctggtgatgacatgaatggggatatgtctagcttgtctacgctttttgctaataggaaaaaggggcactttatgaagggtgatgctgtcattgttatcaaaggtgatctgaaaaatttggagggttgggttgagaaagtagaggatgagactgttcacatcagaccaaaaatatctgatctaccgaaaacgttagccttcaatgagaaagagctttgcaagtattttaaacccggagatcatgttaaagtggtatcaggtgttcaagaaggtgcaacaggcatggttgttaaagtggaagggcatgtcttgataattttatctgacacgacaaaagaacatatacgtgtgtttgcggaccatgttgtggagagctctgagatcacaacgggaataaccagaattggtgattatgagctgcatgatcttgttcttttggacaacttgtcatttggggttattataagggtggaaactgaggcatttcaggttctgaaaggagtaccggatagaccagaagttgtcctagtaaaattaagagaaataaaaagcaagattgatcgccgaacatccgcaaaagatcggtccaacaatatgatttcatctaaggatgttgtccgagtagttgagggagcatgcaagggaaaacaaggaccagtggaacacatacataaggggatattatttatctatgatagacaccacctcgagcatgcaggctttatttgtgcaaaagcacagtcctgtcttcttgttggtggatcagctggtggacgtcgtggaaatggtatggatacgtcagatccaaggcttggtgctttgagatctccagcaagcattttgcaatcaccgggaaggctgcccccaagaggacctcatatgaactttggtggaaggtttggaggaggtggtcgtggtggcagagggcatgatgcattggtgggcaaatgtattaaaattaaatctggtccttacaaggggtaccgtggccgtgttaaagaggtgactggcgtgcttgtgcgtgtggagcttgattcgttaatgaagattgtgacagttaaaagagatgatattgctgatacacctactgttgcaacaccattccgtgaacctcgttatccgttgggtggtgaaactccaatgcacccatctcgaacaccgcttcatccttaccagacaccaatgcgggaccctggagcaaccccaatacacgatggcatgcggactcctatgcgtcgtggctgggctcctatgagtcctccgagggataactgggaagaaggaaatcctgctacttggggaagcagtccagcttaccagccaggaactccaccagctcggccatatgaagcacccacacctggatcagggtgggcaaatacgccaggagttagctataatgacgctccaactcccagggagagcaactacggaaatgctccaagcccatatgtgccttccactcctgtaggtcaaccaatgacaccgaattctgcctcgtaccttcctggtacacctggtggtcaaccgatgactccaggcaatgttggaatggacataatgtcgcctataataggtggtgaaggtgaaggtaactggctgttgccagatgttttggttaatgtgttgagggcaggcgatgatggtcctggtgtggtgagggaagttcttgcggatggatcttgtcgcgtcgcccttgggtcatcaggtaatggtgagatcgtgacggttcttccaaccgagctcgaggttattcggccaaagaagagcgacaagatcaagataatgaacggcaatttccgtggatactctggaaagctcataggtatagatggttccgacggcattgtgaagcttgatgacacatacgaagtcaagatcttagatatggtgattttggccaaactggcgagttgagatggatgtatattttgtacgagtccatcgtatagccaaatgtttgtaacagataccctttgtagtcaataaaacgttttgttatttattccattatttagttgtatccagattttgacatcgaaagaaaacttgccttaagaaaaccgtc

SEQ ID NO: 3317 - DNA, 3619 bp, Brachypodium distachyon
gcggccgcctccgtccacgactcgtccgaggaggagttcccctttcctctcgacgcctcgcgagcggtcgaaaacctagccgccaaatccatggctcgacgcggacgcgacgaagacgacgacgaggtcgaggaggaggaggacgaggaggaagcctatgacctggacgaggaggaggacgaagaggacgactacgaggaggaggcgaggggccggggtaaggcagccgcccgttcccgtggcagcggcggcggcggcggcagcggggggcggaagagatcgcgccaggacaacttcatcgacgactctgccatcgaggatgacgacgaggaggatgaggatgacgacggcgggggccggccgaggaagaagggcggcggcggtgtgcgcggcttcttcgacgaggaggcgcaggtcgacgaggacgaggaggaagaggacgagggagaaggcgaggatgactttatcaatgatgcgggggccgacattcctgatgatgatgctgccaggggctccagatcgcgtcattctatccctatgagggatgaagaagaggatattgaggagattgagagacaagtacgagagagatatgcaagatctactcatatcgagtatggagaggaggccgcagatgtagaacagcaagctctcttgccatcagtgaaggatccaaagctctggatggtgaaatgtgcgattgggcatgagagggagacagcgatttgtctaatgcaaaagttcattgataggacagatctccagataaagtctgtcgttgcattagatcatctaaaaaattatatttatgttgaggcggaaaaagaggcacatgtcaaagaggcttgcaaaggtctacgaaatatttacgcttccgccaaaattacattagttccgataaaagaaatggcagatgtcctctttgttgagagcaagactgttgatctttcaagggatacttgggtccggatgaagctgggagtatataaaggtgaccttgctaaggttgttgatgttgatactgtacgccaaagggtaactgtgaagctcatccctaggatggatctacaagctctggctagtaaactggaagggagggaggttgtaaagaagaaaacgtttgtcccacctccaagattctttaatattgacgaggccagggaattgcacattcgtgtagagaggaagcgagataaagattcgggagagtactttgagatggttgatggtttaatgttcaaagatggtttcttacataaaacagtctcgacaaaatcaatccacacacagggtattcagccaacatttgatgaactggagaagttcaggaaacctggcgatgacatgaatggggatatggcaagcttgtctactctgttttctaatcggaaaaaaggacacttcatgaagggtgatgctgtcattgttattaaaggcgatctaaaaaacttggaggggtgggtcgagaaagtagaggacactacagtccatatcaggccaaaattatctgatcttccgaaaacattagccttcaacgaaaaagagctttgcaaatatttcaagcctggagatcatgtaaaagtggtatcaggtgtccaagagggtgctacgggcatggttgttaaagttgatgggcatgtactcatcattttatcagacacaactaaagaacatatccgtgtgtttgctgatcatgttgtggagagctctgagataaccactggaatcaccagaattggcgattatgaactgcatgatcttgtgcttttggacaacttgtcatttggggttattataagagtggaaacggaagctttccaggttctgaaaggaatgccggatagacctgaagtggtgatggtaaaattaagagaaataaaaagcaaaattgataggcgtgcatcagcacaagataagtccaacaacatgatctctactaaggatgttgtcagggttgttgagggaccatgcaagggaaggcaaggacctgtggaacacatacataaggggatattgtttatatatgataggcaccaccttgaacatgcaggcttcatttgtgcaaaagcaaaacaatgccttcttataggtggatcaaatggcggacgtcgtggaaatggtatggatgctgcagatgctagactgggtgctctgagaactccggcgagcattttgcaatctccaggaaagctgcccccaagggggccttacatgaattctggtggaagatttgggggaggtggtcgtgggggaagaggatatgatgccttagtgggtaaatgtatcaaaattaaatctggtccctataaagggtaccgtggccgtgttaaagaggtgactggggtgcttgtgcgtgtggagcttgattcactgatgaagattgtcacagttaagcgagaggatatcgccgacacacctactgtggcaacaccattccgtgaacctcgatattcgatgggtggtgaaacaccaatgcacccgtctagaacgccacttcatccctttcagactccaatgcgggaccctggagcaacgccgatacatgatggaatgcgaactcctatgcgtagccgagcctgggctcctatgagccctccgagggataattgggaagatggaaatcctgatacttggggaagcagtccggcttaccatccaggaactccaccagctcgaccatatgaagcccccacacctggctcagggtgggcaaataccccaggagtcagttataatgatgttccaactcctagagagagcaactacggaaatgctccaagcccatacgtgccttccacccctgttggtcaaccaatgacaccaaattctgcctcgtacctccctggtacacctggtggtcaaccgatgactccaggcaatgtaggcatggatatgatgtcccccataataggtggggagggtgaagttaactggctgttgccagatgttttggttaatgtgttgagggcaggcgacgacggccctggtattgtcagggaagtcctcggagatggatcttgccgagttgcacttgggtcgtcgggcaatggagatatcgtgacggttcttccaaatgagcttgaggctgtcaggccaaagaagggcgacaggatcaagatcttgaatggcaacttccgcggattcgtgggaaaactcataggaatagatggttccgatggcatcgtgaagctcgatgacacatatgaagtcaagatcttagatatggtgattttggccaaactggcgacttgagatgtatgtatatttgtaacgagtccatcatacaagcctttgttacaggttcgttgtttctcaataaaacatgttatttatttcgttagctgtatcccagattgtcatcaaaaggaaaacatgtcatgaggtaacgttgtctacagttacagccatctgacgtgtcatatgttcggttaatctttgccaactattactccttgtatacaaattcatgtcagttaattcggaacggagggagtatcatcgtagagtgcaataacagcttgtgtggcacccctcatttcatttcatttggtccaaatgaaatgaaatctaatttttggtagaatttcatttggttaaatttgaattctggattcaaaaa

SEQ ID NO: 3318 - DNA, 3367 bp, Secale cereale
ggagacgagtttcccctttcctctcgacgcccttctcgagcgcccgaaaacctagccgccaaatccacccatggctcgccgcggccgcgacgacgacgacgacgaggtcgaggaggaggaggaggacgaggaggaggcctacgacctcgacgacgaggaggaggacgagggggacgactacgaggaggaggcgaggggccggggcaaggcggcctcccgctcccgcgcccccgccggcggggtgcggaagagatcgcgccaggacaacttcatcgacgactcggccatcgaggacgacgacgaggacgaggaggacgacggcgggagccgcccgaggaagaagggcggcggcggcggcgtgcgcgggttcttcgacgaggaggcgcaggtcgacgaggacgaggaggaggaggacgaaggcgaaggcgaggatgacttcatcaatgatgctggagccgacattcctgatgacgatgccggcaggggctccagatcacgtcactctatccctatgagggatgaagaagaggatattgatgagattgaacgacaagtacgagagagatatgcaagatctactcatattgagtatggagaggaagctgcagacgttgaacagcaagctctcttgccatctgtgaaagatccaaagctttggatggtgaaatgtgcgattgggcatgagagggagacagcaatctgtctaatgcaaaagttcattgataggacagatctccagataaagtctgttgttgcgttagatcatctaaaaaattatatttatgttgaagcggaaaaagaggcccatgtcaaggaggcttgcaaaggtctacgaaatatctattcttcggcaaaaataacgttagtcccaataaaagaaatggcagatgtcctctatgttgagagtaagaatgttgatcttgcaagggatacttgggtccgaatgaagctgggagtatataaaggtgaccttgctaaggttgttgatgttgacaacgtacgccaaagggtaactgtgaagctcattcctagaatagatttacaagttttggctagtaaactggaagggagggtggttgcaaagaagaaaacctttctcccaccaccaagattctttaatattgatgaagccagggaaatgcacatacgtgtggagcggaggcgggataaagactccggggaatactttgagatggttgatggtttgatgttcaaagatggtttcttgtataaaccggtctcgataaaatcaatccacacacagggtattcagccatcatttgatgaattggagaagttcaagaaacctggcgatgacatgaatggggatatgtctagcttgaatactctgttttctaataggaaaaagggacactttatgaagggtgacgctgtcattgttgttaaaggcgatctaaaaaacttagaggggtgggttgagaaagtagaggacacaactgtccacatcaggccgaaaatatccgatcttccgaaaacattagccttcaacgagaaagaactatgcaagtatttcaaacctggagatcatgtgaaagtggtatcgggtgtccaagagggtaccacaggcatggttgttaaagttgatgggcatgtcttaatcattttatcagacacaactaaagaacacatacgtgtgtttgccgaccatgttgtggagagctctgaaatcaccacaggaattacaagaattggtgattatgaactacatgatcttgttctgttggacaatttgtcatttggggtcattataagagtggaaactgaagcattccaggttctgaaaggagtgccagatagacctgaagtggtgcttgtaaaattaagagaaataaaaagcaagattgatcggcgtacatcagcgaaagatcggtttaataacatggttgcaactaaggatgttgtaagagttgttgatggagcatgtaagggaacgcaaggacctgtggaacacatacataaggggatattgttcatatatgataggcaccaccttgaacatgcaggcttcatttgtgcaaaagcacaagcgtgcattcttgtcggtggatcgactggtggccgtcgtggaaatggtatggatcctgcagatgctaggcttggtgctttgagatccccggcaagcattttgcagtctccaggaaggctgcccccaagaggaccacaaatgaactatggtggaagatttggaggaggtggtcgtggtggaagaggacatgatgccttggttggcaagtgtatcaaaattaaatctggtccttataaagggtaccgtggccgcgttaaagaggtgactggggtgcttgtgcgtgttgagcttgattcgttaatgaagattgtcacagttaagagagatgatattgccgacacgcctactgttgcaacaccattccgtgaaccccgattttcgttgggtagtgaaacaccgatgcacccgtccagaacaccacttcatccatttcagactccaatgcgggatcctggagcaacaccgatacatgatggaatgcgaaccccgatgcgtagtagggcctgggctcctatgagtcctccaagagataattgggaagatggaaatcctgatacttggggaagcagtccagcttaccagccaggaacaccaccagctcggccgtatgaagccccaacacctggatcagggtgggcaaatactccaggagttagttataatgatgttccaactcctagagagagcaactatgcaaatgctccaagcccatatgtgccttctacacctgttggtcagccaatgacaccaaattctgccgcgtaccttcctggtacacccggtggtcaaccgatgactccaggcaatgctggaatggatataatgtctcccgtaatgggtggcgagggcgaaggtaactgggcattgccagatgtgctagttaatgtcttggcggcaggtgatgaaggacctggtgtggtcagggaagtgcttggggatggaacttgccgtgtggcacttgggtcttcaggcaacggagatattgtgacggtccttccgactgagctcgaggtcatcagaccaaagaagagtgacaggatcaagatcatgaatggtaccttccgtggatttgttggaaaacttataggaatagacggttccgatggcattgtgaagctcgacgacacatatgaagtcaagatcttagatatggtgattttggccaaactggctgcttgagctggatgtatatttgtaacctctgcctcatatagcctttgttgtaacaagtgtctttgttttcaataaaacatatgttatttttgtttctattattattagttgtatcccagattttgacatcaatagaaaaaaaaaccc

SEQ ID NO: 3319 - DNA, 3510 bp, Secale cereale
gtttcccctttcctctcgacgcccttctcgagcgcccgaaaacctagccgccaaatccacccatggctcgccgcggccgcgacgacgacgacgacgaggtcgaggaggaggaggaggacgaggaggaggcctacgacctcgacgacgaggaggaggacgagggggacgactacgaggaggaggcgaggggccggggcaaggcggcctcccgctcccgcgcccccgccggcggggtgcggaagagatcgcgccaggacaacttcatcgacgactcggccatcgaggacgacgacgaggacgaggaggacgacggcgggagccgcccgaggaagaagggcggcggcggcggcgtgcgcgggttcttcgacgaggaggcgcaggtcgacgaggacgaggaggaggaggacgaaggcgaaggcgaggatgacttcatcaatgatgctggagccgacattcctgatgacgatgccggcaggggctccagatcacgtcactctatccctatgagggatgaagaagaggatattgatgagattgaacgacaagtacgagagagatatgcaagatctactcatattgagtatggagaggaagctgcagacgttgaacagcaagctctcttgccatctgtgaaagatccaaagctttggatggtgaaatgtgcgattgggcatgagagggagacagcaatctgtctaatgcaaaagttcattgataggacagatctccagataaagtctgttgttgcgttagatcatctaaaaaattatatttatgttgaagcggaaaaagaggcccatgtcaaggaggcttgcaaaggtctacgaaatatctattcttcggcaaaaataacgttagtcccaataaaagaaatggcagatgtcctctatgttgagagtaagaatgttgatcttgcaagggatacttgggtccgaatgaagctgggagtatataaaggtgaccttgctaaggttgttgatgttgacaacgtacgccaaagggtaactgtgaagctcattcctagaatagatttacaagttttggctagtaaactggaagggagggtggttgcaaagaagaaaacctttctcccaccaccaagattctttaatattgatgaagccagggaaatgcacatacgtgtggagcggaggcgggataaagactccggggaatactttgagatggttgatggtttgatgttcaaagatggtttcttgtataaaccggtctcgataaaatcaatccacacacagggtattcagccatcatttgatgaattggagaagttcaagaaacctggtgatgacatgaatggggatatgtctagcttgaatactctgttttctaataggaaaaagggacactttatgaagggtgacgctgtcattgttgttaaaggcgatctaaaaaacttagaggggtgggttgagaaagtagaggacacaactgtccacatcaggccgaaaatatccgatcttccgaaaacattagccttcaacgagaaagaactatgcaagtatttcaaacctggagatcatgtgaaagtggtatcgggtgtccaagagggtaccacaggcatggttgttaaagttgatgggcatgtcttaatcattttatcagacacaactaaagaacacatacgtgtgtttgccgaccatgttgtggagagctctgaaatcaccacaggaattacaagaattggtgattatgaactacatgatcttgttcttttggacaatttgtcttttggggtcattataagagtggaaactgaagcattccaggttctgaaaggagtgccagatagacctgaagtggtgcttgtaaaattaagagaaataaaaagcaagattgatcggcgtacatcagcgaaagatcggtttaataacatggttgcaactaaggatgttgtaagagttgttgatggagcatgtaagggaacgcaaggacctgtggaacacatacataaggggatattgttcatatatgataggcaccaccttgaacatgcaggcttcatttgtgcaaaagcacaagcgtgcattcttgtcggtggatcgactggtggccgtcgtggaaatggtatggatcctgcagatgctaggcttggtgctttgagatccccggcaagcattttgcagtctccaggaaggctgcccccaagaggaccacaaatgaactatggtggaagatttggaggaggtggtcgtggtggaagaggacatgatgccttggttggcaagtgtatcaaaattaaatctggtccttataaaggttaccgtggccgcgttaaagaggtgactggggtgcttgtgcgtgttgagcttgattcgttaatgaagattgtcacagttaagagagatgatattgccgacacgcctactgttgcaacaccattccgtgaaccccgattttcgttgggtagtgaaacaccgatgcacccgtccagaacaccacttcatccatttcagactccaatgcgggatcctggagcaacaccgatacatgatggaatgcgaaccccgatgcgtagtagggcctgggctcctatgagtcctccaagagataattgggaagatggaaatcctgatacttggggaagcagtccagcttaccagccaggaacaccaccagctcggccatatgaagccccaacacctggatcagggtgggcaaatactccaggagttagttataatgatgttccaactcctagagagagcaactatgcaaatgctccaagcccatatgtgccttctacacctgttggtcagccaatgacaccaaattctgccgcgtaccttcctggtacacccggtggtcaaccgatgactccaggcaatgctggaatggatataatgtctcccgtaatgggtggcgagggcgaaggtaactgggcattgccagatgtgctagttaatgtcttggcggcaggtgatgaaggacctggtgtggtcagggaagtgcttggggatggaacttgccgtgtggcacttgggtcttcaggcaacggagatattgtgacggtccttccgactgagctcgaggtcatcagaccaaagaagagtgacaggatcaagatcatgaatggtaccttccgtggatttgttggaaaacttataggaatagacggttccgatggcattgtgaagctcgacgacacatatgaagtcaagatcttagatatggtgattttggccaaactggctgcttgagctggatgtatatttgtaacctctgcctcatatagcctttgttgtaacaagtgtctttgttttcaataaaacatatgttatttttgtttcattattattagttgtatcccagattttgacatcaatagaaaaaaaaacccatgagggaaatgttgtctgcagttatatggatttggtggtgtccgttgtacttaaaacaaaaaaaaaaaaaaaaaaaaagaaaaaaaaaaaaaaaagaaaaaaaaaaaactaagaaagaactagaccaagacaacaacgaagggaagtaagg

SEQ ID NO: 3320 - DNA, 3256 bp, Triticum aestivum
gacgactacgaggaggaggcgaggggccggggcaaggcggcctcccgctcccgcgcccccgccggcggggtgcggaagagatcgcgccaggacaacttcatcgacgactcggccatcgaggacgacgacgaggacgaggaggacgacggcgggagccgcccgaggaagaagggcggcggcggcggtgtgcgcgggttcttcgacgaggaggcgcaggtcgacgaggacgaggaggaggaggacgaaggcgaaggcgaggatgactttatcaatgatgctggagccgacattcctgatgacgacgccggcaggggctccagatcacgtcactctatccctatgagggatgaagaagaggatatagatgagattgaacgacaagtacgagagagatatgcaagatctactcatattgaatacggagaggaagctgcagacgttgaacagcaagctctcttgccatctgtgaaagatccaaagctttggatggtgaaatgtgcgatcgggcatgagagggagacagcaatctgtctaatgcaaaagttcattgataggacagatctccagataaagtctgttgttgcgttagatcatctaaaaaattatatttatgttgaagcggaaaaagaggcccatgtcaaggaggcttgcaaaggtctacgaaatatctattcttcggcaaaaataacgttagtccccataaaagaaatggcagatgtcctctatgttgagagcaagaatgttgatcttgcaagggatacttgggtccgaatgaagctgggagtatataaaggtgaccttgctaaggttgttgatgttgacaatgtacgccaaagggtaactgtgaagctcatccctagaatagatttacaagttttggctagtaaactggaagggagggtggttgcaaagaagaaaacctttgtaccaccaccaagattctttaatattgatgaagccagggaaatgcacatacgcgtggagcggaggcgggataaagactctggggaatactttgagatggttgatggcttgatgttcaaagatggtttcctgtataaaccggtctcgataaaatcaatccacacacagggtattcagccatcatttgatgaattggagaagttcaagaaacctggcgatgacatgaatggggatatgtctagcttgaatactctgttttctaataggaaaaaggggcactttatgaagggtgacgctgtcattgttgttaaaggcgatctaaaaaacttagaggggtgggttgagaaagtagaggacacaactgtccacatcaggccgaaaatatccgatcttccgaaaacattagccttcaacgagaaagaactttgcaaatatttcaaacctggagatcatgtgaaagtggtatcgggtgtccaagagggcaccacaggcatggttgttaaagttgatgggcatgtcttaatcattttatcagacacaactaaagaacatatacgtgtgtttgccgaccatgttgtggagagctctgaaatcaccacaggaattacaagaattggtgattatgaactacatgaccttgttcttttggacaacttgtcttttggggtcattataagagtggaaactgaagcattccaggttctgaaaggagtgccagatagacctgaagtggtgcttgtaaaattgagagaaataaaaagcaagatcgatcggcgtacatcagcgaaagatcggtttaataacatggtcgcaactaaggatgttgtaagagttgttgatggagcatgtaagggaacgcaaggacctgtggaacacatacataaggggatattgttcatatatgataggcaccaccttgaacatgcaggcttcatttgtgcaaaagcacaatcgtgcattcttgtcggtggatcgactggtggccgtcgtggaaatggtatggatgctgcagatgccaggctcggtgctttgagatccccggcaagcattttgcagtctccaggaaggctgcccccaagaggacctcaaatgaattatggtggaagatttggaggaggtggtcgtggtggaagaggacatgatgccttggttggcaagtgtatcaaaattaaatctggtccttataaagggtaccgtggccgcgttaaagaggtgactggggtgcttgtgcgtgttgagcttgattcgttaatgaagattgtcacagttaagagagatgatattgccgacacacctactgttgcaacaccattccgtgaaccccgattttcgttgggtagtgaaacaccgatgcacccgtccaggaccccgcttcatccatttcagactccaatgcgtgatcctggagcaacaccgatacatgatggaatgcgaaccccgatgcgtagtagggcctgggctcctatgagtcctccaagagataattgggaagatggaaatcctgatacttggggaagcagtccagcttaccagccaggaacgccaccagctcggccatatgaagccccaacacctggttcagggtgggcaaatactccaggagttagttataatgatgttccaactcctagagagagcaactatgcaaatgctccaagcccatatgtgccttctacacctgttggtcagccaatgacaccaaattctgcggcgtaccttcctggtacacctggtggtcaaccgatgactccaggcaatgctggaatggatataatgtctcccgtaatgggtggcgagggtgaaggtaactgggcattgccagatgtgttagttaatgtcttggcggcaggtgatgaaggacctggtgtggtcagggaagtgcttggggatggaacttgccgtgtggcacttgggtcttcaggcaacggagatattgtgacggtacttccgactgagctcgaggtcatcagaccaaagaagagcgacaggatcaagatcatgaatggtaccttccgtggatttgttggaaaacttataggaatagacggttccgatggcattgtgaagctcgacgacacatatgaggtcaagatcttagatatggtgattttggcaaaactggcggcttgagctggatgtatatttgtaacctgtgcctcgtatagcctttgttgtaacaagtgtagttttcaataaaacatatgttatttttgtttcattattttagttgtatcccagattttgacatcaatagaaaaaaaaaccatgagggaaatgttctccattattctcttctatctatggatttggtggtgtccgtcgtcttcagtcg

SEQ ID NO: 3321 - DNA, 3414 bp, Secale cereale
tcctctcgacgcccttctcgagcgcccgaaaacctagccgccaaatccacccatggctcgccgcggccgcgacgacgacgacgacgaggtcgaggaggaggaggaggacgaggaggaggcctacgacctcgacgacgaggaggaggacgagggggacgactacgaggaggaggcgaggggccggggcaaggcggcctcccgctcccgcgccccgccggcggggtgcggaagagatcgcgccaggacaacttcatcgacgactcggccatcgaggacgacgacgaggacgaggaggacgacggcgggagccgcccgaggaagaagggcggcggcggcggcgtgcgcgggttcttcgacgaggaggcgcaggtcgacgaggacgaggaggaggaggacgaaggcgaaggcgaggatgacttcattaatgatgctggagccgacattcctgatgacgatgccggcaggggctccagatcacgtcactctatccctatgagggatgaagaagaggatattgatgagattgaacgacaagtacgagagagatatgcaagatctactcatattgagtatggagaggaagctgcagacgttgaacagcaagctctcttgccatctgtgaaagatccaaagctttggatggtgaaatgtgcgattgggcatgagagggagacagcaatctgtctaatgcaaaagttcattgataggacagatctccagataaagtctgttgttgcgttagatcatctaaaaaattatatttatgttgaagcggaaaaagaggcccatgtcaaggaggcttgcaaaggtctacgaaatatctattcttcggcaaaaataacgttagtgccaataaaagaaatggcagatgtcctctatgttgagagtaagaatgttgatcttgcaagggatacttgggtccgaatgaagctgggagtatataaaggtgaccttgctaaggttgttgatgttgacaacgtacgccaaagggtaacggtgaagctcattcctagaatagatttacaagttttggctagtaaactggaagggagggtggttgcaaagaagaaaacctttctcccaccaccaagattctttaatattgatgaagccagggaaatgcacatacgtgtggagcggaggcgggataaagactccggggaatactttgagatggttgatggtttgatgttcaaagatggtttcttgtataaaccggtctcgataaaatcaatacacacacagggtattcagccatcatttgatgaattggagaagttcaagaaacctggcgatgacatgaatggggatatgtctagcttgaatactctgttttctaataggaaaaagggacactttatgaagggtgacgctgtcattgttgttaaaggcgatctaaaaaacttagaggggtgggttgagaaagtagaggacacaactgtccacatcaggccgaaaatatccgatcttccgaaaacattagccttcaacgagaaagaactatgcaagtatttcaaacctggagatcatgtgaaagtggtatcgggtgtgcaagagggtaccacaggcatggttgttaaagttgatgggcatgtcttaatcattttatcagacacaactaaagaacacatacgtgtgtttgccgaccatgttgtggagagctctgaaatcaccacaggaattacaagaattggtgattatgaactacatgatcttgttcttttggacaatttgtcatttggggtcattataagagtggaaactgaagcattccaggttctgaaaggagtgccagatagacctgaagtggtgcttgtaaaattaagagaaataaaaagcaagattgatcggcgtacatcagcgaaagatcggtttaataacatggttgcaactaaggatgttgtaagagttgttgatggagcatgtaagggaacgcaaggacctgtggaacacatacataaggggatattgttcatatatgacaggcaccaccttgaacatgcaggcttcatttgtgcaaaagcacaagcgtgcattcttgttggtggatcgactggtggtcgtcgtggaaatggtatggatcctgcagatgctaggcttggtgctttgagatccccggcaagcattttgcagtctccaggaaggctgcccccaagaggaccacaaatgaactatggtggaagatttggaggaggtggtcgtggtggaagaggacatgatgccttggttggcaagtgtatcaaaattaaatctggtccttataaagggtaccgtggccgcgttaaagaggtgactggggtgcttgtgcgtgttgagcttgattcattaatgaagattgtcacagttaagagagatgatattgccgacacgcctactgttgcaacaccattccgtgaaccccgattttcgttgggtagtgaaacaccgatgcacccgtccagaacaccacttcatccatttcagactccaatgcgggatcctggagcaacaccgatacatgatggaatgcgaaccccgatgcgtagtagggcctgggctcctatgagtcctccaagagataattgggaagatggaaatcctgatacttggggaagcagtccagcttaccagccaggaacaccaccagctcggccatatgaagccccaacacctggatcagggtgggcaaatactccaggagttagttataatgatgttccaactcctagagagagcaactatgcaaatgctccaagcccatatgtgccttctacacctgttggtcagccaatgacaccaaattctgccgcgtaccttcctggtacacccggtggtcaaccgatgactccaggcaatgctggaatggatataatgtctcccgtaatgggcggcgagggcgaaggtaactgggcactgccagatgtgctagttaatgtcttggcggcaggtgatgaaggacctggtgtggtcagggaagtgcttggggatggaacttgccgtgtggcacttgggtcttcaggcaatggagatattgtgacggtccttccgactgagctcgaggtcatcagaccaaagaagagtgacaggatcaagatcatgaatggtaccttccgtggatttgttggaaaacttataggaatagacggttccgatggcattgtgaagctcgacgacacatatgaagtcaagatcttagatatggtgattttggccaaactggcggcttgagctggatgtatatttgtaacctctgcctcatatagcctttgttgtaacaagtgtctttgttttcaataaaacatatgttatttttgtttcattattattagttgtatcccagattttgacatcaatagaaaaaaaaaacccatgaggggaaatgttgtctgcagttatatggatttggtggtgtccggttgtcttcagccgagtgtg

SEQ ID NO: 3322 - DNA, 2973 bp, Triticum aestivum
acgaggaggaggaggacgaaggcgaaggcgaggatgactttatcaatgatgctggagccgacattcctgatgacgacgccggcaggggctccagatcacgtcactctatccctatgagggacgaagaagaggatattgatgagattgaacgacaagtacgggagagatatgcaagatctactcatattgagtatggagaggaagctgcagacgttgaacagcaagctctcttgccatctgtgaaagatccaaagctttggatggtgaaatgtgcgattgggcatgagagggagacagcaatctgtctaatgcaaaagttcattgataggacagatctccagataaagtctgttgttgcgttagatcatctaaaaaattatatttatgtcgaagcggaaaaagaggcccatgtcaaggaggcttgcaaaggtctacgaaatatctatgcttcggcaaaaataacgttagtcccaataaaagaaatggcagacgtcctctatgttgagagtaagaatgttgatcttgcaagggatacttgggtccgaatgaagctgggagtatataaaggtgaccttgctaaggttgttgatgttgacaatgtacgccaaagggtaactgtgaagctcatccctagaatagatttacaagttttggctagtaaactggaagggagggtggttgcaaagaagaaaacctttgtcccaccaccaagattctttaatattgatgaagccagggaaatgcacatacgcgtggagcggaggcgggataaagactctggggaatactttgagatggttgatggcttgatgttcaaagatggtttcctgtataaaccggtctcaataaaatcaatccacacacagggcattcagccatcattcgatgaattggagaagttcaagaaacctggcgatgacatgaatggggacatgtctagcttgaatactctgttttctaataggaaaaagggacactttatgaagggtgatgctgtcattgttgttaaaggcgatctaaaaaacttagagggttgggttgagaaagtagaggacacaactgtccacatcaggccaaaaatatccgatcttccgaaaacattagccttcaacgagaaagaactttgcaaatatttcaaacctggagatcatgtgaaagtggtatcgggtgtccaagagggtaccaccggcatggttgttaaagttgatgggcatgtcttaatcattttatcagacacaactaaagaacacatacgtgtgtttgccgaccatgttgtggagagttctgaaatcaccacaggaattacaagaatcggtgattatgaactacatgatcttgttcttttagacaacttgtcatttggggttattataagagtggaaactgaagcattccaggttctgaaaggagtgccagatagacctgaagtggtgcttgtaaaattaagagaaataaaaagcaagattgatcggcgtacatcagcgaaagataagtttaataatatggtcgcaaccaaggatgttgtcagagttgttgagggagcatgtaagggaacacaaggacctgtggaacacatacataaggggatattgttcatatatgataggcaccaccttgaacatgcaggcttcatttgtgcaaaagcacaatcgtgcattcttgtcggtggatcgactggtggccgtcgtggaaatggtatggatgctgcagatgctaggatgggtgctttgagatccccggcaagcattttgcagtctccaggaaggctgcccccaagaggaccacaaatgaactatggtggaagatttggaggaggtggtcgtggtggaagaggacatgatgccttggttggcaagtgtatcaaaattaaatctggtccttacaaagggtaccgtggccgcgttaaagaggtgactggggtgcttgtgcgtgtggagcttgattcgttaatgaagattgtcacagttaagagggatgatattgccgacacacctactgttgcaacaccattccgtgagccccgattttcgttgggcagtgaaacaccaatgcacccgtctaggacgccactacatccttttcagactccaatgcgggaccctggagcaacaccgatacatgatggaatgcgaaccccgatgcgtagtagggcctgggctcctatgagtcctccaagagataattgggaagatggaaatcctgatacttggggaagcagtccagcttaccagccaggaacaccaccagctcggccatatgaagccccaacacctggatcagggtgggcaaatactccaggagttagttataatgacgtcccaactcctagagagggcaattatgcgaatgctccaagcccatatgtgccttccacacctgttggtcagccaatgacaccaaattctgctgcgtaccttcctggtacacctggtggtcaaccgatgactccaggcaatgctggaatggatataatgtctcctgtaataggtggcgagggtgaagttaactgggcattgccagatgtgttagttaatgtcttggcggcaggtgatgaaggacctggtgtggtcagggaagtgcttggggatggaacttgccgtgtggcacttgggtcgtcaggcaatggagacattgtgacggtccttccgtctgagctcgaggtcatcagaccaaagaagagtgacaggatcaagatcatgaatggtaccttccgcggatttgttggaaaacttataggaatagacggttctgatggcattgtgaagctcgacgacacctatgaggtcaagatcttagatatggtgattttggccaaactggcggcttgagttggatgtatatttgtaacctgtccctcatatagcctttgttgtaacaagtgtcgttgctttctcaataaaacatgatttttgtttcatttagttgtatcccagattttgacatcaatagaaaagaaaaaacccatgagggaaa

SEQ ID NO: 3323 - DNA, 3108 bp, Setaria italica
aattcagacatggcagatgccctatttgtagtcctcagaaaagttgctctttccctgggggaacggacgctagagaggattggcgcggaggtggtcgaagcggcaccagttctgacagatttcgagcatagcttgaaacagatcgaggacgagcttttgattctgcaggctttcgttggtcaggttgggccgcacaaagttggtgacaaggcattcgatgcctggctggaccaagtgagagatgttgcccatgaggtagaagacatcattgatgagcatgcttaccttgctgctcaagctgtggatactggcagcttctttaagaggaagttccgtcagataaaaaacttcgtagcatggcagaagtttactagccagatcagtcaagtagaagctcgaattcagaggctaggagaaatgaggaatcggtatggcatctcggtaggtgaaattcacaggagtaacaagttgaggcaccccaatcagctctttatgtcagaatcttcttacttaaccgataattctgaaatagtggggcatgctgatgaaatcgaaagattgacacaatggctgcttgaggagaaacaagagcgaactctgattgccatctttggtatgggaggtttaggaaagtctactattgcaagcagtgcctacaagaaccaaaagatctcaagaacttttgactgtcatgcatgggttactgtatctcagacttatcaagttgaagaactactaagagaaataataaatcagctgatagaccagagagcaagcgtggcaggtggtttcatgaccatgagtcgcttgagactagttgaggtaatacaaagctatttgcgggacaaaaaatatttcattgtcttggatgatgtgtgggacagagatgcttggttatttcttaactatgcatttgtcagaaacaactctggaagcaaagtgctgataacaactaggagaatggatgtgtcttctttggcagtagataaatacgttattgaacttaaaactcttccgtatgctgaatcttgggaacttttctgtaaaagggcgttttatgcatcaaaagataacatatgccctgaaaatctgcggtctttggcagagaaaatcgttgctaagtgtcaaggattgccacttgctattgtaaccattggaagtactttgtcataccgtgaattcgaggagcaggagtgggcatttttctacaaccagcttagctggcagttagctaacaatccagagctcagttggatatctaatgttctgaatatgagcttgaatgatctccctagttatctgaggatctgctttctttactgcagcctctaccctgaagattacaggattagaagaaaactgatttccaagctatggatcgcagaaggtctcgtggaagatagagaagatggaacaacaatggaggaggttgcaaagtattaccttaccgagctcactcagcgttgtcttcttcgagtcacagaatgtaatgcatgtggaagacctagaacatttgttatgcatgatcttgtgcgagaggtaacctcagtcattgctaaaaaggagaagtttggtattgcatatcgcgatgctgggataaccaaagtttcccatgaagctcgccgcttaagcatccaaaaaggtgcccagtccctaaattctttaaccagttcacgactccgctcattcattttgtttgaccctgaagtaccatcttcttggatatatgatgttttatcacaattcagactactgagggtcctatgcctaagatttgccaacattgaacaagtgccaggcatggtaacggaattgtataatttgcgctatctagatttttctcacacaaaagtgaagcacataccagtatcattcaaaaaacttaggaacctacaagttttagatctcagattcagctatgtggaggagctgccattggaaataactacactaattaatttacgccatttatatgtgattgtaatccatgatttgcaacaaagatcattggattgctttagtgctgtaaaaattcttggtaatatttgccatctaaagaatttgcagactttacatattgtttcagccaataaagatttggtttcacaactggggaacttgacactgatgagaagtttggctataatgaaagtgcggcaaagctgcatagcagagttatggagctccctgacaaagatgcctaacttgagcaggttgctcatttctgcatgtgatatggatgaggttcttgacttgagaatgctcaagccattaccaaatctgaagttcctctggctttcaggaaagttggcagaaggtgttcttccattgatattttccaagtttgagaaattggcattgttaaagatggactggtctggtctgaagaaggatcctattatctccttctctcacatgttaaacctagttgatttgcggctatatgggacatatggtggggaacagctaactttttgtgcagagtggtttcctaagctcaattctctgcaattagctgacatggaacatctaaattggatagatatagaggacggaacgatgataggtctgtatcatctggaacttattggtttaaggaatctaaaggcagttccagtgggcatcaagtacattaggaaacttcaccagatgtttctgacagatatgccaaacgagttcatacaaagactgcaaggaagtgacgatgacattgttcagcatatacctaatgttcatatttttgactcttctgattctaaagcagtaaataccttccattttgtgccataccttgccaagaagtacggccctggcgcaaccaagtatgcccctacatactggggctcatccagcatttgacatttcggtcgcagctttcagtaagaaataaatatgtaactcctttgtagaccaatcatttgaagagtaaacaatatgcagtccctcatggtgctaaaactctatatgagatcgttttttgtgttgtgtatcatcccttgtttgtgttgtgcctcatatgtgagtttctcacttagctcctgatatggtttgctactgtcaataaagataaacacaagaaaaattcagcagttgctgcatggaggctgt

SEQ ID NO: 3324 - DNA, 2859 bp, Zea mays
aattcagacatggcagatgccctatttgtagttcttagtaaacttgctgattccttgggagaacagacactagagaggattagcacaaagctgattgaagtagcaccagttttgacagattttgagcatagcatgaagcaaatcgaggctgagctattgattcttcaggcttttattgcacaggttgggacaaaagtcggtgataaggcatttgatgcctggctggaccaagtgagagatgttgcccatgaggtagaagacatcattgatgagtatgcttaccttgaggttcaagccgtggatactggcagcttctttaagaggaagttccttcagataaaaaagttcgctgcatggcagaagtttcatagccagatcagtcatgtagaagctcgaattcagaggctaggtgaaattaggaatcgatatggcatcttgtcaggtgaaatagacaggagtaagaaattgaggagccccaatcggctctttatgtcagattcttcttacttaactgataactctgaaatagtggggcatgttgatgaaattggaagattgacacagtggttacttgagtacaaacaagagcgaactcttattgccgtttttggtatgggaggttcaggaaaaactactattgcaagcagtgcatacaagagtcaaaagatcacaaggactttcaattgtcatgcatgggttactgtatctcagacttaccaagttgaagaactactaagagaaatcataaatcagctaatagatcagagagcaagcatgtcaagtgggtttatgactatgagcggcttgaggctagttgaggtaatacaaagctatttgcaagataaaaaatatttcattgtcttggatgatgtatgggataaagatgcatggctatttctaaactatgcatttgtcagaaacaattgtggaagcaaagtgctgataactactcggagaaaggacgtatctagcttggcagttgatcagtatacaattgagcttaaaactcttcaatatgctgaatcctgggaacttttctgtaaaaaggcatttcgtgcatcaaaggataaccaatgtcctgagaaccttaggttttgtgcagagaaaattgttgctaggtgtcagggattgcccctggctattgtaaccattggaagtgttctatcataccatgaattcgaagagcagggatgggaatctttctacagccaacttagctggcagttagctaacaatccggagctgaattggatatctaatgttctgaatatgagcttgaatgatctcccgagttatctgaggaactgctttctgtactgcagtctttatcctgaagattacaagattaaaagaaaagtgatttccaagctatggatagcagaaggtttagtggaagatagagaagatggaacaacaatggaggaggttgccaattattaccttgtggagctcactcagcgttgtcttcttcgagtcacagaaagtaatgcatgtggaaggccgagagcttttgttatgcatgatcttgtgcgagagttaacctccaacattgctaaaaaggagaagtttggtattgcatatggcgatgctagtacaacccaagttccccctgaagttcgccgcttatcagtcaaaactgcaactgctgctgaccacatgacttattccatcacgcggctccgctcatttattttgtttgacactgaagtaccatgctcttggatagatgatgttttatcacgtttcagactactgagggtcctatgcctaagatttgcaaatattgcagaagtgcctggcgtggtcacagaattgtataacttgcgctatattgatttttcatacacaaaagtgaagacaataccagcatcattcagaaaacttgtcaacctacaagttttggatctcagattcacctacgtagaggagttgccactggaaataactacgctaactaacttgcgtcatctacatgtgtttgcagtccatgattttcaacaaagatcattgaattgtttaggcgcaacaaaaattcctgttaacatttgtcatctaaagaatctgcaagctatacagatcgttttggccaacaaagatttggtttcacaacttgggaacttgaaattaatgagaagtttggctatagcggaagtgcggcaaagctacattgcagaattatggaagtccctgacaaagatgcctaacctgaataggttggctatttcaacatgcaacatggaggagattcttgattttaaaatgctaaagcccttatcaaatctggttttcttcaagcttgcaggaaagttggagtcaggcgtgcttcctttgatgttgtattattttgagaagttaacatggttacaattagactggtccggtctaaagaaggaccctatgagctccttatctcacatgtcgaaccttgttcatctgttcatgtgcgggtcatattgtggggaacagctaactttttgttcaggatggttccccaagctcaattatctgcaattatctaaaatggagaatctgaattggattgagatagaggatggaacaatgatgtgtctaaataatttgtacttagttgatttagggaatctaaaggctgtgccctatggcatcaagtacatcaggacactgcaccagatgcatctgacagatatgtcaaaggagtttctaggaagtctgcaaggaagcgcgagtcccgttgttcaacatatatgcaacatccatatttttgaatcctctgattctgaagcagtaaataaattcttctttgagccataccttgccaccaagttcggccctggtgcaactaagcatgcccctacttacctgggatcatctggcatctga

SEQ ID NO: 3325 - DNA, 618 bp, Vigna unguiculata
cccatgctctctcttgtggtgagcttcaggtttggggattagattctcggaaattggcttctgcattcactctgaaaatggatatgtcaaatcctgcggcctttgtcaatgcagaactactgcacttttatgttggaaggagggtaaggaccctgatgcaggttgtgcgatctgatggtggagttgtcattggaaaatcaacagatgagaaacagctagtagtaaaaggacttccccctgctcctcttacaacttttgtagaagtttttggtattgttaacagtgataagtccattgctgctgagatatggaccaattttggtgattccattgatatgatcagctacaataagctttgtcagcttgcaaatggagaacttaaatacctgttcctgtgagctataacaagcttatctgattatatgaaggtctctctatcatgtggaacactaggagacataaccattgtattggtcagaatgtttttcattttttctttctgatatctaaagttgacaatgaggattcgtctcatgccaaaactacccactcttcagaactagctcaatgccagtggcttcacttgtagcaatttaaacatttattaattctcttggt

SEQ ID NO: 3326 - DNA, 297 bp, Glycine max
agtatggatatatcaaatccagcagccttagtcaatgcagaactgttgcacttctatgttggaagcagggtaagggttgtgatgcaggttgtgcgatctgatggtgttgtgattggaaaatcaacagatgagaaacaactagttgtaaaaggatcacccccacctgctcctcatacaacttatgtcgaagtttatggtgctgagatatggaccaattttggtgatgccattgatatggatagctacaataagctctgtcagcttgcaaatggagaatttaaacacttgttcctgtga

SEQ ID NO: 3327 - DNA, 307 bp, Glycine max
agtatggatatatcaaatccagcagccttagtcaatgcagaactgttgcacttctatgttggaagcagggtaagggttgtgatgcaggttgtgcgatctgatggtgttgtgattggaaaatcaacagatgagaaacaactagttgtaaaaggatcacccccacctgctcctcatacaacttatgtcgaagtttatggtgctgagatatggaccaattttggtgatgccattgatatggatagctacaataagctctgtcagcttgcaaatggagaatttaaacacttgttcctgtgagttataacaa

SEQ ID NO: 3328 - DNA, 530 bp, Phaseolus vulgaris
gcagaatatggatatgtcaaatcctgcagcctttgtcaatgcagaactactgcacttttatgttggaaggagggtaagggccctgatgcaggttgtgcgatctgatggtggagttgtcattggaaaatcaacagacgagaaacaggtagttgtaaaaggaacaccccctgctcctcttacaacttttgtagaagtttttggtattgttagcagtgataagtcgattgctgctgagatatggaccaattttggtgattccattgatatgttcagctacaataagctctgtcagcttgcaaatggagaacttagacacctgttcctgtgagttataacaagcttatatgattatatgaaggtctctctatcatatggaacactgcgagatttaaccattgttttggcaataatgtttttcatttttcttctgatataaaggtgaaaatgaggtttcatttcatgtaaaaactacccgatgctaatggcttaactagtagcaatttaaacatttattggattctcttggtaaa

SEQ ID NO: 3329 - DNA, 525 bp, Phaseolus vulgaris
gaatatggatatgtcaaatcctgcagcctttgtcaatgcagaactactgcacttttatgttggaaggagggtaagggccctgatgcaggttgtgcgatctgatggtggagttgtcattggaaaatcaacagacgagaaacaggtagttgtaaaaggaacaccccctgctcctcttacaacttttgtagaagtttttggtattgttagcagtgataagtcgattgctgctgagatatggaccaattttggtgattccattgatatgttcagctacaataagctctgtcagcttgcaaatggagaacttagacacctgttcctgtgagttataacaagcttatatgattatatgaaggtctctctatcatatggaacactgcgagatttaaccattgttttggcaataatgtttttcatttttcttctgatataaaggtgaaaatgaggtttcatttcatgtaaaaactacccgatgctaatggcttaactagtagcaatttaaacatttattggattctcttggta

SEQ ID NO: 3330 - DNA, 639 bp, Lotus japonicus
gaaaggagtagccgcgctcgctccctcgcttttctcgtgtgcttctcttcactgccgctctcagaaattgaaccggaagatggatacatcgaatcctgcagtctttgtcaatgcagaactgttgcagttccatgttggaagaagggttcgtgcagtaatgcaggttgtgagatctgatggtgcagttgttattggaaaatcaactgatgacaagcagcttgttgtgaaaggatcaccaccacctgctcctctcacaacttttgttgaagttattggtattgttgacagtgataagtccattcgcgccgagatgtggaccaattttggtgattcaattgatatggtcagctaccagaagctttgtcagcttgcaaatggtgaatttaagcacttgttcctgtgagttataacaagcttatcagatgatacaaagttcaatctactcatatggaaaactagaggagacatggtcattgttttagcaacaatgtatgaacattcatttgttttgttttctctttggtaaataacttttactgattataattgaagtctagagtgtttttgttttcttttgccacgcataatagatcatattctgattttcgcaacacttgtctatcatctttagtttttgag

SEQ ID NO: 3331 - DNA, 836 bp, Cajanus cajan
aacacaacaaatatttcaattataaaaatccaaatccgcactgaaaggagaactggcgcgcttgctctctcttatttcgtgcgcttcagagttgtcgcttcgtttctcagcaattagcttctgaattcaatcagaatatggatacatcaaatcctgcggcgtttgtcaatgcagaactgttgcatttttatgttgggagaagggttcgagcactgatgcaggttatacggtctgatggtggaattgtaattggaaaatcaactgatgagaagcaactagttgtaaaaggatcacccccacctgctcctcttacaacttttgtagaagtttttggtattgttaataatgataagtcaattagtcccgagatatggaccaattttggtgatgccgttgatatgttcacctacaataagctttgtcagcttgcatatggagaatataagcacttgttcctgtgagttataacaagcttatctgatgatacgaaggcctctttatcattatgagtagaaaatgattcttctagtttgtatatttttcttgcacatgtttcttcttcgtgattgctataattgtttcttgagaacaatattcttgagacttggctaagtcattttcgttaatcagagaactttttcagttcatataaggatatagcctgggacattatgaatctctttgagcattcttgattttagtttgttagcttttgagttcaattttttttttgtcaactgttgtaaattaccgatcctgtctgttcaaatatactgaagcaaacttattagtagatttttattcaaaaggcttatagtttttcttagcaagcttcg

SEQ ID NO: 3332 - DNA, 520 bp, Cicer arietinum
gggaatgaatagcataaaagattctccagaggaaaaggcgcgctcgcgggtctcgtctcgtgtgcttcttaactgccgcttcgtttatcagcaattcgcatctgcagttgaattaatcagaagatggatgcatcaaaaaccgcagtctttgtcaatgcagaactgttacccttttatgttggaaggagggttcgtacagtgatgcaggttgtgcgatctgatggtgtagctgtcatcggaaaatcaccagatgagaagcagatggttgtaaaaggatcagccccaccagctcctcttacaagttttgtagaagttatcggtatcgttaacagtgacaagtccatccgtgctgagacatggaccaactttggtgatgcaattgatatgttcagctactgtaagctttgtcagcttgcaaatggagaatttaaacacttattcctatgagtttatttacaacaagcttgtctgactatacaaaggcttctctatcatatggaaaaactagatgagacattac

SEQ ID NO: 3333 - DNA, 784 bp, Arachis hypogaea
gagggatgaacccgcgctccctattctattcttcttcttcttcttctcatttttgcgttccgctctgttttgcagcaaccaagccattcacgcaagaatatggacacatcaaatcctgcagtttttgtcaatgcagaactcttgcagttttatgttggaaggagggttcgggctgtgatgcaggttgtgcgatccgaggggggcttgtcattggaaaatcaacagatgagaagcagctagttgtgaaaggaccacccccacctgcacctcttacaaattttgttgaagttattggcattgttgacaatgatagatccattcgagctgagatatggaccaattttggcaatgtgattgatatgttcagctacaataagctttgtcagcttgcaaatggagaatttaagcacttgtttgtgtgaggtataacgagctctatctgatgatgatatgaagtcccctctgaaacatgtgcagaaccggagatattatcattttgtctgggtacttgttggaaactattttcactgattataattgaaatatcaatctgatttttatagagttgtctgtcgtgttttacatcctcggttgtcagcatatccttgtgctttaaatctgcaatcatcagcattgcacgagttttaggcattccatgcttaagcatacagtgtgtactttagtcatgttcatgtttcttttctgccctaaaagtgtgaaccattattaatagattcatattactgcacgttataatggaaggccaagtagccaacaacacttg

SEQ ID NO: 3334 - DNA, 973 bp, Glycine max
gcatataataaacttaacagtgtgacagaacataatagcagaagggaacaagatggacttactggagttatgggcaattttcggccccggcgtcgccggcgccgtcttcggcgccggatggtggatctggcttgacgccgtcgtctgcagtaccgtcaccgttcccttccttcattaccttcccggaattttcgcatctcttgcggctttgatgttcaattgcgttagaaaagaagacatcgattattctccctacgacgaaggcgagtggagactgaagctgtggctcttcattgcatatgttgtatcctttgtttctttagctggatcagcaggcctgctgatccaagattcacttgataaatccgccccttcagtttggactggagttgcaggtgttttgcagtgtgtttttgtcttgatctgtggactggtatattggacttctcatcctgaataaggtgcaccaagatatgacttggagcttcaaattataccaggttatgtccacccatgtattatcttgtttgttttatgtgacgggaaatagctggcttcatctaaatcagtaaatgtaaattgtgctaacaatcttgagcctctgggtagattcatatctcttgtttcatatagttgatcaggacctgttaccaatttcagtcttggtattggttctatgaagattccccccctcgttttctcagtattttgcactcacagcatacaggaaaggaaactcttaatggttattataactgagaataactctgttgactgcatctatgtttgacaagaaaaacttgctcgatgattcagattggttatatacgaaagtttgtgtaagtactgtgaacatctaaggtggttcttggcagtgatttcccgacacaattatgccgtccttcatttgtactctcaactgcaaagtcagtccaacggtaagaaagtttaagagaaaattttatactttaaa

SEQ ID NO: 3335 - DNA, 1063 bp, Glycine max
gatactcttcttttccctttatatcgaacgatagtgaaatgcccaatgcatataataaacttaacagtgtgacagaacataatagcagaagggaacaagatggacttactggagttatgggcaattttcggccccggcgtcgccggcgccgtcttcggcgccggatggtggatctggcttgacgccgtcgtctgcagtaccgtcaccgttcccttccttcattaccttcccggaattttcgcatctcttgcggctttgatgttcaattgcgttagaaaagaagacatcgattattctccctacgacgaaggcgagtggagactgaagctgtggctcttcattgcatatgttgtatcctttgtttctttagctggatcagcaggcctgctgatccaagattcacttgataaatccgccccttcagtttggactggagttgcaggtgttttgcagtgtgtttttgtcttgatctgtggactggtatattggacttctcatcctgaataaggtgcaccaagatatgacttggagcttcaaattataccaggttatgtccacccatgtattatcttgtttgttttatgtgacgggaaatagctggcttcatctaaatcagtaaatgtaaattgtgctaacaatcttgagcctctgggtagattcatatctcttgtttcatatagttgatcaggacctgttaccaatttcagtcttggtattggttctatgaagattccccccctcgttttctcagtattttgcactcacagcatacaggaaaggaaactcttaatggttattataactgagaataactctgttgactgcatctatgtttgacaagaaaaacttgctcgatgattcagattggttatatacgaaagtttgtgtaagtactgtgaacatctaaggtggttcttggcagtgatttcccgacacaattatgccgtccttcatttgtactctcaactgcaaagtcagtccaacggtaagaaagtttaagagaaaattttatactttaaaatgagagagctacatcttaggtttttttttttcctaacatgtg

SEQ ID NO: 3336 - DNA, 1019 bp, Cajanus cajan
tgttgtttggtaaggtgtgacacagaagggaagatggacttaatggagttatgggcaattttcggccccggcgtcgctggcgctgtcttcggcgccggatggtggatctggcttgacgccgttgtctgcagctccgttaccgttcccttccttcactaccttcctggaattttcgcatcttttgccgctttgatgttcaattgcgttagaaaagaagacatcgattattcgccctatgacgaaggcgagtggagattgaagctgtggctcttcattgcatatgttgtatccttcgtttctttagctggatcagcgggtttactgatccaagactcacttgataaatctgccccttcagtttgggctggagttgcaggtgttttgcagtgtgtttttgtcttgatcagtggactgatatattggacttctcatcctgaataaggtgcaccaagatatgacttggttggagcctcaaattctaccaggttatgtccacccatgtattatcttttttttttttttttttttctgacgggaaatagccagcttcgtgtaaatccgtaaatgtaaattgtgctaacaatctcgacgcttgagcctctgggtatattcatatttcttgtttcatatagttgatcaagatctgttacacaagataaattcagtcgcttggtgttatctataaagcccccccttgtttcttaatattttgaatacaagaaaggaatctctttatggttataactgagaataattctgttgactacatccaggttggactagaaaatgtggagggttcagatcggttgtgtataaatgtttgtgtaaatagcattattcactgtgaacaccaaaggtgtaagttggcaatgattcctaaactcaatttttgcatcccctcgtttaatatcttaaacagctttgaaaaaatactttaaagggccaaagcccgagctggaaaaatatattaaaattctagttaaacaagggtgtggaagccccctgcatactctgcttga

SEQ ID NO: 3337 - DNA, 649 bp, Cicer arietinum
cggaagttgcttgcgtttgtgttgtttgggtttaggtgcgacgtagaaaagaagatatggacttaattgaattatgggcaattttcggccccggcgtcgccggcgcagtctttggcgccggctggtggatctggctcgacgccgtcgtatgcagctcaaccaccgttcccttccttcactacctccctggaatttttgcatctcttgcgggtttgatgttcaattgcgttagaaaagaagacattgattattctccttatgacgaaggagagtggagactgaagctgtggctcttcatcgcatatgttgtgtcctttgtttctttagctggatcagcgggtctactgatccaagattcacttgacaaatctgccccatcagtatggactggagttgcaggcgttttgcagtgtgtttttgtcttaatcagtggactgatttattggacttctcatcctgaataaggtgaaccaagatatgacttggagcttcacattataccagtttatgacttcttacccatgtgccattttcgttatttaatgtggtgagatatagctggtttcatgtaaatcagtaaatgtaaattgtcctaacaaccttgagccactgagtagatttatattacatgtttctacattattaatac

SEQ ID NO: 3338 - DNA, 1202 bp, Cicer arietinum
attttgaaaacaccaatagttaaaattggggacggttaaaaaggggccgaggttgtaatcaaaattcaaaagtaacttagaaattagtatctcagtaatcatagtttttttattaaacaaaaagaaaatatcagggtaataacagaagggcacacggaagttgcttgcgtttgtgttgtttgggtttaggtgcgacgtagaaaagaagatatggacttaattgaattatgggcaattttcggccccggcgtcgccggcgcagtctttggcgccggctggtggatctggctcgacgccgtcgtatgcagctcaaccaccgttcccttccttcactacctccctggaatttttgcatctcttgcgggtttgatgttcaattgcgttagaaaagaagacattgattattctccttatgacgaaggagagtggagactgaagctgtggctcttcatcgcatatgttgtgtcctttgtttctttagctggatcagcgggtctactgatccaagattcacttgacaaatctgccccatcagtatggactggagttgcaggcgttttgcagtgtgtttttgtcttaatcagtggactgatttattggacttctcatcctgaataaggtgaaccaagatatgacttggagcttcacattataccagtttatgacttcttacccatgtgccattttcgttatttaatgtggtgagatatagctggtttcatgtaaatcagtaaatgtaaattgtcctaacaaccttgagccactgagtagatttatattacatgtttcacattattaatcaatttctgctatccaatgtaatttcagtcgcgtggtggtttttacacatgttttcttcttcattttcttaatattttgaactcacagcacacaaaacagaaacgtttggtttacaactgagtagagcaccaaaatacttgtattttaattgaaattttaaacaacttgaggtctctagtaaagtaaattatgtattatttcaataactccattgacatcttattcgaataaaaagtaaatataattcataattctaaagacccgtgcactatgatacaaatgtgccgctacagtagatgtaaaaaaaatgtaatattacctagactgtactttataatgcagatattaaggtactattcatgcaaaactttcaagtattaaccgaactaacaattcctcct

SEQ ID NO: 3339 - DNA, 871 bp, Vigna unguiculata
ggggtgacggaagagaagcgaagatggacttattggagttatgggcaatcttcggccccggcgtcgccggcaccgtcttcggcgtcggttggtggatctggctcgacgccgtcgtttgcagctccatcactgttcccttccttcactaccttcctggaattttcgcatctcttgcggctttgatgtttaattgcgttagaaaagaagacatcgattattctccctatgacgaaggcgagtggagattaaagttgtggctcttcattgcgtatgttgtatcctttgtttctttggctggatcagcaggtctactgatccaagattcacttgataaatctgctccttcagtttggactggagttgcaggtgttttgcagtgtgtttgtgtcttgatcagtggactggtatattggacttctcatcctgaataaggtgcaccaagatacgatttggatcatcaaactctaccaggttatgtccacccatgtattgtcttgtttattttatgtaacggaaaataggtggctttatgtaaatcggtaaatgtaaattgtgctaacaatcttgagcctctgggtatattggtgtttattgataaagatatgttaaccgaagtaatttcaatcgcatggtgttggtatttattgagatccctacccgcacggccccatccatgttctcattattttgaactcagagcatatatgaatgaaagctctttacggttataattgagaatatgttgattgcatctatgtttgggtagaaaaactttctcgaggatttcgatttttgtgtacgaaagctaatgtaaataacattattcactgtgaacaccttaggggtggtacttggcagtgattcccataaa

SEQ ID NO: 3340 - DNA, 975 bp, Lotus japonicus
aaaaaaacaatttaaatgttgaatgagtagacacaacagaataatagatgtgagtcacagaagggaagggttgttgtaaatttgtagttgccttttgtgttgtttgggtttagggtgtgacagaagacacgatggacttactagaactatgggcaattttcggccccggcgtcgccggcgctgtcttcggcgccggttggtggatctggcttgacgccgtcgtctgcagttcaaccaccgttcccttccttcactacctccctggaattttcgcatctcttgcggctttgatgttcaattgcgtcagaaaagaagacattgattactctccctacgatgaaggcgagtggagactgaagctgtggctcttcattgcatatgttgtatcctttgtttctttagctggatcagcgggtctactgatccaagattcacttgataaatctgccccatcagtgtggactggagttgcaggtgttttgcagggtgttttagtcttgatcagtggactgatttattggacttctcatcctgaataaggccaaccggtaaggcgagatctgagttgaagctttaaattacgcccggttatgtcttcccactgtatgtatcattttgtttgatgtgatgggaaatagttggcttcatgtaaatcagccaatgtaaattgtgcagaccaccttgagcctctgggtagattcatattacttgtttcataaatccagatctgtcaacggaagtaatttcacgtggtatctgttatgacttatgatccttctttttttctcccttcacataatattttgaaccccgcttatttatggggtatatcttcataactgagtagagcctgctgactcgtagatggctacatctaactcttacttgaaaagagtccagttatgtaaatactgattactactacctctgatcctatttataagaacccaatgagaggtttattttgactttttt

SEQ ID NO: 3341 - DNA, 989 bp, Phaseolus vulgaris
atcctcctgcagtcaatcaagatagtgcaatactcaaggcataattgcagtatacaaaactaacagtgtttttggttaggtgtgacggaagagaagggaagatggacgtattggagttatgggcaatcttcggccccggcgttgcgggcaccgtcttcggtgtcggttggtggatctggctcgacgccgtcgtttgcagctccatcactgttcccttccttcactaccttcctggaattttcgcatctcttgcggctttgatgttcaattgcgttagaaaagaagacatcgattattctccctatgacgaaggcgagtggagactgaagttgtggctcttcattgcatatgtggtatcctttgtttctttggctggatcagcaggtctactgatccaagattcacttgataaatctgccccttcagtttggactggggttgcaggtgttttggagtgcgtttgtgtcttgattagtggactggtatattggacttctcatcctgaataaggtgcaccaagatatgacttggagcttcaaactataccaggttatgtccacccatgtattgtcttgtttattttatgtaacggaaaatagctggctttatgtaaattggtaaatgtaaattgtgctaacaatcttgagcctttgggtatattggtgtttattgttttatgtagttgataaagatctgtttaccgaagtaatttgaatctcatggtgttggtatgcattaagatcccttccccccaccccctaattttctcagtattttgaattcagagcatatatgaaaggaagctctttgccgttataattgagaatatgttgaatgtatctgcgttcgactagaaaaactttctcaaggattcagattgctgtgtacgaaaatttgtgtaaataacattattcactgtgaacactctatgtggtacttggcagtgattcccataaacaattatgtcgtccttcgtctatactcttaac

SEQ ID NO: 3342 - DNA, 745 bp, Glycyrrhiza uralensis
gccagacacaagattatccctgagtaacagaaggttgcgtttgtttgggttttgagaagagaagatggacgtgatggaattatgggcaattttcggccccggcgtcgccggtgccgtcttcggcgccggctggtggatctggcttgatgccgtcgtctgcagttccaccaccgttcccttccttcactacctccctggaattttcgcatctcttgcggctttgatgttcaattgcgtcagaaaagaagacattgattattctccttacgacgaaggcgagtggagactgaagctgtggctcttcatcgcatatgttgtatcctttgtttctttagctggatcagcaggtctactaatccaagactcgattgataaatctgccccatcagtgtggactggagttgcaggtgttttgcagtgtgctttggtcttgatcagtggactggtttattggacttctcatcctgaataaggcgaaccaagatatgacttggagcttcaaattataccaggttatgcctacccatgtattttgtctttttaatatggtgagaagtagttggcctcttgtaaatcagtaaatgtaaatcatccttacaatcttgagcctctgggtagattcatattgcatctttcatatggttgatcaagatctgttacccaaagtaatttcagtcgcttggtgttggtatctaccgtgaattttttctttctttcacattcttaatatttttattttgaactc

SEQ ID NO: 3343 - DNA, 934 bp, Medicago truncatula
aaaactctaaaacataaaatgtgtgttccttaaccttgatctagttaggtaaaagaagtagagtagaatatctaggacacgcgagttacctcttctgttgcttgagtttacgtgtaacgtagaaccgaaaatggacttaatcgaactatgggcgattttcggtcctggcgtcgccggagcagttttcggtgccggctggtggatctggctcgacgccgtcgtatgtagctccaccaccgttcctttccttcactaccttcctggaatttttgcttctcttgctggtttgatgttcaattgcgttagaaaagaagatattgattattctccttatgacgaaggagagtggagactgaagctgtggctcttcattgcatatgttgtgtcctttgtttctttagctggatcagcggggctactgatccaagattcacttgacaaatcttctccatcagtgtggactggaattgcaggcgttttgcagtgtgtatttgtcttgatcagtggactgatttattggacttcacatcccgaataagatggaccaggctatgattttggagcttcaaattataccagactatgctgcccatgtgccattttctttatttaatgtggtgataaatatagctggcttgatgtaaatcagtaaatgtaaattgtcctaacagtctcgagccattgggtaggttcatattgcatgtttgacatgattgatcaagatctactatccattgtaatttcagtcgcatggtggtttttacaaagatggtcttcttttcattttcttaatatttgaactcagcaaaccagaacggaaacgttgtactccatcgaggttggcaatatctaagtaaagacatgtattttaattgaaaattttaaataacaatttgatgtctctagtaaagtgaattatttattatttcatcaa

SEQ ID NO: 3344 - DNA, 772 bp, Arachis hypogaea
tggtgttttcggctgcgaaatcgaaacagtaaccggcgacaatggacttgatggagttatgggcaatctttggccccggcgtcgccggcgctgtcttcggcgccggctggtggatctggctcgacgccgtcgtctgcagctccaccaccgtccccttccttcactaccttcctggaatttttgcatctcttgcggctctgatgttcaattgcgttagaaaagaagacattgattattctccctacgatgagggcgagtggagactaaagctatggctcttcgtcgcatatgttgtctcctttgtttctttagctggagcagccggtctactaatccaagattcaatagatcaatctgccccttcagtttggacaggagttgctggtgttttgcagtgtgtttttgtcttgatcagtggactggtttattggacttctcatcctgaataagaaaaccaaggtatggcttgcaacttcaaattataccaggttatgtccacccatgtaccttcttggcaatttaatgtgacgggaagtagttgaccacttgtaaatcagtgtatgtaaattgtgctaacaagcttgagcctgagtatatgcatatattgcttgctacatatggttgatcaaagatctgttgcccaatgtaattccagttgcttggtgttggaatctttaaaatattattttatctttttaataaaaatttggaactcagagcatactagaatagaaactctcttggtccaagttttcatagaaaaaatgcagta

SEQ ID NO: 3345 - DNA, 906 bp, Trigonella foenum-graecum
taaataaaagtaagtagcgagtagaacatctcagttaccttttctgttgcttgggtttagtttaggtgtaacgagaagaagagaagagaagagaagagaagatggacttaatcgaattatgggcgattttcggtcccggcgtcgccggagcagttttcggtgccggctggtggatctggctcgacgccgtcgtttgcagctccactaccgttcccttccttcactacctccctggaatttttgcttctcttgcgggtttgatgttcaactgtgttagaaaagaagatattgattattctccttatgatgaaggagagtggagattgaagctgtggctcttcattgcatatgttgtgtcctttgtttctttagctggatcagcgggtctattgatccaagattcacttgacaaatcttccccatcagtgtggactggaattgcaggcgttttgcagtgtgtatttgtcctgatcagtggactgatttattggacttcacatcccgaataagatgaaccagcatatgatttggcgcttcaagttataccaggtaatttaattcacttccaagatccttcaaagttaacgtcaatggtccctatctttcattttcggggagtactgtttgtggttgcctcatcagagatgaccatggtaatctagtcaaggggttctacttaaaatcaatcctattgtgctcaactgtaaatcctttcttataaacccttattttcttagaccgtaagattggaatccttcaatctagttgatcaggaatccaaagtgtacatatttgcaagcttccattgagtttgtcctcttctacatggtttgcttagtgatatgatgtctaggaagtttggattctgactggttcttgttaaatttttgggtaataaaatacagg

SEQ ID NO: 3346 - DNA, 576 bp, Pisum sativum
tgggcaattttcggccctggcgtcgccggtgctgttttcggtgccggctggtggatctggctcgacgccgtcgtatgcagctccacaaccgttcccttccttcactatctccctggaatttttgcatctctagcgggtttgatgttcaattgcgttagaaaagaagatattgattattctccttatgacgaaggagaatggagactgaagctgtggctcttcattgcatatgtcgtgtcctttgtttctttagctggatcagcgggtttactgatccaagattcacttgacaaatctgccccttcagtgtgggctggagttgcaggtgttttgcagtgtgtttttgtcttgatcagtggactgatttattggactgctcatcctgaataagatgaatatgactcggagctttaaattataccaggttatgctgcctatgtaccattttctttatttaatgcgatgataaatagttggcttcgtgtaaatcagtaaatgcaaattgtgctaacaatcttaagccgctgggtagattcatattatatgttttattcggttgatcaaaaaaaaaaaaaa

SEQ ID NO: 3347 - DNA, 978 bp, Theobroma cacao
aaaaaatgaaaaagaccaaacaaaataaaggaaaaaaaccagtagggaagaggccagcgaacgtagggaggattcgggaggaaggtagtaagggagagagaaagaaagggcggaaaataacaattcacaaataggctgtactaaaggaagtcttaaaatatacttcaaaaaaaaaaaaaaaaacaaagaagagagggcttaagataaagaaaagaatcgaattgttaattcatcttcaataattagttaattaattgaaaaataatctaatggatttaggggagctgtgggcgatcttcgggcccggcgtcgctggagccgtgttcggtgccggctggtggttttggatcgacgccgtcgtttgtagttccgttactgtctctttcgtccactatttacctggaatatttgcatctattgcggctttgatgttcaattgtgttagaaaagaggatatcgattactctccctatgaagaaggcgagtggaggttgaagctctggcttttctttgcttatgttgtatcctttgtctcactggctgcttcagtgggcctgttgatacaagattcgcttgtgaaatctggtccttcggtgtggactggaactgcaggtgtcttacagtgtgtgttcgtcttaatcagcgggctgatatattggacttctcactcagaataaatgaagacagatgccttgcatctggtgtttggactttggagcttggaaccacaagtgaggcagttatatgtgtatgtattatctgtgcttaaatcagtgggacagaaagttgttaacctttgtaaatcttatgatgtactaactgtctcgggaatgaaagtatgattcatcctgctcttttgaaatttgtgatggtggttaactctagtttcaaccacctgcgcttgacaacatttattctgtctttttttttttttttgttccagttctattcaggggcaaatcaaatttattttgtctt

SEQ ID NO: 3348 - DNA, 965 bp, Ricinus communis
ggagaaaaagttaaaaataaaaagaaaaatctaattcctatttcggtaagggaaaaagaacaaaagaaaacaaatttacagagacccgcatcgaagtccaaacaaaggaagctgctgaaggaggcaatcactaaactctctctcgtacagttgaagttagctgtaattctcaacattcaacaataacaccaatcaatctctaattatatatatttttaatcaactaacacaccagaaaaacaaatggatttaccggagttatgggcgattttcggtccgggcgtggcaggcgctgtattcggagccggttggtggttttgggttgatgccgttgtttgtagcgccgttaaagtctcgtttgttcactacttacctggcatttttgcatcgatcgcagctttaatgtttaattgtgttagaaaggaggacattgattactctccatacgaagaaggcgagtggagattgaagctttggcttttctttgcttatgtcgtatcctttgtttctctagcggcatcagtgggcttattgatacaagattcacttgttaagtcggggccttcagtatggacaggaactgcaggtgtcttgcagtgtgtatttgtgttgataagcgggctaatttattggacttcgcattcggaatgaattgtgaaattgcatgtatcatttacttattcaaccgacaggaggaaatatggtcaccctggtgtacatatttatgaccttcagctgcctgtgaaatcttgagcatcggtagtagcccatgtaactcttctggaatttgtgatggttgtcctagattttgttcataacggattctaatttcagcaatactggtttatctagatcggtcatgtaccattgtgctttgtttggggccataaattgataatatttccgagaaaggataatttgttgcacctatgtatcataccactactatatgaaactttttcagc

SEQ ID NO: 3349 - DNA, 673 bp, Castanea mollissima
agaaaacagaaataacagtagaaagaaagaatactgggaaggaactgcagcaaattctcagtattcatcacattaggcttggaagtggatcagctcagctcttaaaaagtaacaaacaaaatacaacaattcttatcgctctataaatcgcagaaatggatttgtcggagctgtgggcaatattcgggccaggagttgcgggcgccgtattcggcgccgggtggtggttctgggtcgacgccgtcgtttgcagctccgtcgctgtctccttcgtccactaccttcctggaatatttgcttcttttgcggctctgatgttcaattgcgttaggaaagaagacatcgattactctccctacgaagaaggcgagtggagattgaagctttggcttttcttcgcatatgttgtgtcctttgtatctctagctgcatcagtgggcctattaatacaagattcacttgtaacaactggcccttctgtgtggacaggaactgctggtgtcttgcaatgtgtgtttgtgttgatcagtgggctgatttattggacttctcatccagagtaaattaatctgaatcatatgctttccatttggtgcttgaaattacaagtggggtagccatttgtacatgtatcgttttacttattcaatcaatgagatgggaaatagttcac

SEQ ID NO: 3350 - DNA, 796 bp, Solanum phureja
agagctcacgaatctgaagaatccctcttctcaaagagaatttctgatcaatttacactttttctatcagttttcttgttaatttaatggatttttcagagctatgggctatatttggacctggggtcgccggcgctgtcttcggcgccggatggtggttctgggttgacgccgttgtttgtagctccgtcaaaatctctttccttcattatcttccaggtatatttgcatctttggctgctttgatgtttaattgcgtcagaaaagaggatattgattactcaccttatgatgaaggagagtggaggttgaagctgtggctatttattgcatatgttgtatcctttgtgtcattggcggcatcagttggtctattgatacaagatgcactgggaaaatctggtccttcagcttggacaggagttgcaggtgttctgcaatgtgtgtttgtcttaatcagcgggctgatctattggacatcacattcagaatcttgagaggacactcgatggggtcttacttggatccattctgtcaagaaagagttacagttacttgtataaatgtgtgttggttgtgcagtgaggctaagcaccaaatattgaacgctcatcacttctttctacattatgataattattaacttgatatttcattggaaagctcaaggaaatatgtcttgtgaagtggtttgtttcaaaagacttcgattagtatatcttttacttaaagcatgtcatgcactgtatcttccattcacgttcaaacgtctttcaagatatccaaatggtttttt

SEQ ID NO: 3351 - DNA, 825 bp, Nicotiana tabacum
ggccattacggccgggggtagaccaactgacgaagacagcacacaatcacaccccacaaatctgaagaaacttctctccttgcactgaaaagtctcatcaattttgaaggaatttcactttttcatcaggtttttgggtaaagaagaggtgatccaaatggattttccagagctatgggcaatatttggacctggggtgtccggcgctgtcttcggtgccggttggtggttctgggttgatgccgtcgtttgtagctccgtcaaagtctctttccttcattatctcccaggtatattcgcgtctttggctgctttgatgtttaattgcgtaaggaaagaggacattgactactctccttatgatgaaggcgagtggaggttgaagctgtggctttttattgcatatgtcgtatcctttgtgtctttggcagcatcagttgggctattgatacaagacgcactcggaaaatctggtccttcagcttggacaggagttgcaggtgttctgcaatgtgtgtttgttttaatcagtgggctgatctattggacatcacattcagaatcttgaagatataccatgggagaggaacataagtcatttgatggaatcatcccatactcaatccatcccctcgagtaagagatacaattgatgcttgtataaatgtgtgttggttgtacagtgatgctaagcaccaagtgttaaacgctcgtatcttctttctacatattgttataatgactaatttgaaatttcagtggaaagcttcaggaagtatatgtctttgtggttactgaactgatgatagcttttacgttaagcct

SEQ ID NO: 3352 - DNA, 1064 bp, Fagus grandifolia
tgaaatttaaagtaaaactagttatgaacttattattattgttatccaagtaaaactcaataaaaatgagtaaataataataattataaaaataaaaagaagtacacgaaattacgaataggaacgaaacaaataagaaaaaggttggcagagtaggaagaaactagagtattcaccagatcacaataggctggaagtagagcagctcaaggcttaaaataaacgaacgaaaaaatcaaacacatcattgatcggattcgttcgaccgaatagaaaatcgcaggaaatggatttgacggagctgtgggcaatcttcggaccaggcgtcgcgggcgcggtattcggcgccggctggtggttctgggtcgatgccgtcgtttgcagctccgccacggtctccttcgtccactaccttcccggcatatttgcgtcttttgctgctctgatgttcaattgcgttaggaaagaagacattgattactctccctatgaagaaggcgagtggagattgaagctttggcttttcttcgcttatgttgtgtccttcgtatctctagcggcatcagtgggcctattaatacaagattcacttgtaacaactggcccttcggtgtggactggaactgcaggtgtcttgcagtgtgtgttcgtgttggtcagtgggctgatttattggacttctcacccagagtaaactaatgtgaatcttatgctttccatttggtgcttgtaattacaagtggggtagccatttgtacatgtatcattttacttattcataccatgagatggaaaatagttctccttttgtaaatgtttgtgttgtggtaacaatcttgagcatcatgtaacccaaggcaacttgactttgtgaggactggtgtagattttttttactgaacaatttcacactgttctgttgaaactcttttaaaggcatgtcctaccgcataacaaaccgcagaattttcatatttgggttgggtttgttgcatgatgtatcctgcacttcgccgcatcaattggtatttgaataggacagagttggctacaaactgcttgta

SEQ ID NO: 3353 - DNA, 664 bp, Citrus clementina
aaaaaagggagagagagcgcaattgaatcgacagtttagttgaggctggaagtgtaacaaagcaaagcaactcaatggatttagcggagctttgggcaatattcggacccggcgtggctggagccgtatttggagccggctggtggttctggatcgacgccgtcgtttgcagctctgtcaaagtccccttcgtccactacctccctggtatttttgcgtctcttgcggctttgatgttcaattgcgtgcggaaagaagacatcgattattctccttacgaagaaggcgagtggagattgaagctctggcttttcttggcttatgttgtatcctttgtttctctagcggcatcagttggtctgttgatacaagattcactagtgaaaactggtccatcagcgtggactggaactgcaggtgtcttgcagtgtgtgtttgtgttgatcagtgggctgatttattggacttcacattcggaatgagaatggatatatcaataccattgcgacctagagcttgaattactgatgaatttgtacaagaatcgttttccttgtttaaacattggaacaatttgcctttgtaaatgaatgtgttgtacaaacaatcttgagcatccttgtaaatctcatgcagctctttctatggaatgtgatgatcgtta

SEQ ID NO: 3354 - DNA, 659 bp, Cleome spinosa
catcatctaatacgcagaggagcatagcaaatcgacaacgattcgaataattatctttcgttgattccgaggaaaacccagtagagaggattcatcgaaccatggatttggtcgagctatgggcgattttcggaccgggagtcgccggagcggtgttcggagctggatggtggttctgggtcgacgccgtcgtctgcagctccgtccaagttccgttcgtccactatctccctggcatatttgcgtctcttggggctttgatgttcaattgcgtgaggaaagaggacatcgattactctccttatgacgaaggagagtggagattgaagctatggctgttcatagcatatgttgtagcttttgtttcccttgcggcatccgtcggcttactgatacaagattcgcttgtgaagacgggtccgtccacgtggactggtgttgcgggaatctttcaatgtgtgtttgtattgataagcgggctaatgtattggacatcgcatccggagtaagtcaatgaccaaaaacaggcgccatgtccatgtccatgcccatgtacaactcacgaagcttgtggggtagaaaggacttgtgattctacttgcaaatgttcatatcctttgggagttcttgttcccgaaactttgtcgatgtctttgtga

SEQ ID NO: 3355 - DNA, 729 bp, Linum usitatissimum
tccgccgtcggccgccgaatcgggacactcttccgccgccaaagagctctatagccaccacttgacaacccaacgaccgcgacgatcggcttcagttactcttgtcgaatttctggataccgaaatggatttgttggagatgtgggcaatcttcgggccaggggtggcaggtgctgtctttggagctggctggtggttttgggttgatgctgtagtttgtagctcggttcaagtatcttttgttcattaccttcctggtatctttgcatcatttgcggccctgatgtttaactgtgttagaaaagaggatatcgattactctccctacgacgaaggtgaatggagactgaagctgtggttattctttgcatacgttgtttcctttgtttcgctagcagcgtcagtgggtttgttgatacaagattccattgtcaaggacgggccttcagtatggacaggaacagcaagtgttttgcagtgtgtctttgtcctgataagtgggttgatctactggacatcacattcggaatgaatgatgctgtagataaataccagttgaccaattgcaatttgtgctctggtgtgttttgagattaagaatccgaggcttgccccaatcagtgtgcttgtttttcgtctttgttctgattctgtgaatgtactgatgtcaacttgtgtaaatgtcaacattgtgcgaacaatattatggcgtatcagctgatagatcgt

SEQ ID NO: 3356 - DNA, 705 bp, Linum usitatissimum
tccgccgtcggccgccgaatcgggataaatttttcccacttgactacccaacgaccgcgacgatcgggttcagttactcttgtccaattactggataccgaaatggatttgttggagatgtgggcaatcttcgggccaggggtggcaggtgctgtctttggagctggctggtggttttgggtcgatgctgtggtttgtagctcagttcaagtatcttttgtccattaccttcctggtatctttgcatcatttgcggccctgatgtttaactgtgttagaaaagaggatatcgattactctccctacgatgaaggcgaatggagactgaagctgtggttattcttcgcatacgttgtgtcctttgtttcactagctgcgtcagtgggtttgttgatacaagattccatcgtcaaggacgggccttcagtatgggcaggaacagcaggtgttttgcagtgtgtctttgtcctgataagtgggttgatttactggacatcacattcggaatgaccgatgctgtagataaataccagatcagcaatggcaatgtgcttctggtggtttgagattaagagaatgtgaggcttgcccaaccagtgtgcttttttttgtctttgttcagattctgtgaatgtactgatcaacttgtgtaaatgtccacattgtgcaaacaatattatggcgtatcagctgatagatcgttgc

SEQ ID NO: 3357 - DNA, 902 bp, Quercus alba
aaaacagaaataacagtagaaaagaaaggatagaatactgggaaggaagtgcagcaaattctcagtattcatcacattaggcttggaagtggatcagctcagctcttaaaaagtaacaaacaaaatccaacaattcttatcgctccaaaagtcgcagaaatggatttgtcggagctgtgggcaatattcgggccaggagtggcgggcgccgtattcggcgccgggtggtggttctgggtggacgccgtcgtttgcagctccgtctcggtctccttcgtccactaccttcctggattttttgcttcttttgcggctctgatgttcaattgcgttaggaaagaagacatcgattactctccctacgaagaaggcgagtggagattgaagctttggcttttcttcgcatatgttgtgtcctttgtatctctagcggcatcagtgggcctattaatacaagattcacttgtaacaactggcccttctgtgtggacaggaactgcaggtgtcttgcaatgtgtgtttgtgttgatcagtgggctgatttattggacttctcacccagagtaaactaatgtgaatcatatgctttccatttggtgcttgaaattacaagtggggtagccatttgtacatgtatctttttacttattcaatcaatgagatggaaaatagttcaccttatgtaaatgtgtgttttggtaacaatcttgagcatcaaagtaaacccaaggcaactcttgaatttgtgatgactggtgtagattttactttccttaacattttcatgctgttctgttgaaaatctttggccgtatgtttgattgtataacatatttattgtggagtaacaaaactactctggaacgttattttataattgtaataaaactggatggagtacc

SEQ ID NO: 3358 - DNA, 886 bp, Solanum lycopersicum
ataattaataattaatacaacaactgtaaaagtgacattgaagagctcacgaatctgaagaaatccctcttctctaagagaatttctgatcaatttacactttctctatcagttttcttgttaatttaatggatttttcagagatatgggctatatttggacctggggtcgccggcgctgtcttcggcgccggatggtggttctgggttgacgccgttgtttgtagctccgtcaaaatctctttccttcattatcttccaggtatatttgcatctttggctgctttgatgtttaattgcgtcagaaaagaggatattgattactcaccttatgatgaaggagagtggaggttgaagctgtggctatttattgcatatgttgtatcgtttgtgtctttggctgcatcagttggtctattgattcaagatgcgctggaaaaatctggtccttcagcttggacaggagttgcaggtgttctgcaatgtgtgtgtgtcttaatcagcgggctggtctattggacatcacactcagaatcttgagaggacactggatgccgtcttactcgatccattctgtcaagaaagagttacagtttacttgtataaatgtgtgttggttgtgcagtgaggctaagcaccaaatataaaaacgctcatcgcttctttcttatgataattatttaacttgaaaatttcattggaaagctcaaggaaatatgtcttgaagtggtttgtttcaaaagacttcaattagtatgtcttctacttaaagcatgtcatgcattgtatcttccattcacgttcaaacgtctttcaagatatccaaatggttttttcgtcctctccagaagtaaaagatttagcttcaatggaatttcaatattcag

SEQ ID NO: 3359 - DNA, 988 bp, Cucurbita pepo
ggattctagtttatttctgttgaactttttggcaggaaaggggtctgagcggtgcgatcattcagttcacaatagcctctccaaatccacctgtctccaatcgcaatcgtaaggagaaggcaaaaggaagaatccaccaatggatttggcggagctgtggtcaatttttggccctggcgttgccggagctgtgttcggcgccgggtggtggttctgggttgacgccgttgtctgcagttctgttgccgtctccttcctccactatcttccaggtatttttgcttcgtttgcggctctgatgttcaattgcgttcggaaggaagacatcgattattcaccatatgaggaaggcgaatggagattaaagctttggctattcttcgcttatgtggtatccttcgtttcattagcagcatctgtggggctcttgattcaagattcagtagtaaaactggcctatcagcatggacgggagttgcaggagtattgcagtgtgtgtttgtgctggttagtgggttgatttactggacttctcacacggaataagttggaaagaattatgcacttagatctcagaggctgaagagttaccaactgcatagcgcgttgcttcgtcaagtcgattgtgtgtcatttgacttttccaactatggaactgaacagtaagagctttctacttgtaaatgtcatgttaatcttaatctgaaaccatgtctgtaaatctttatggatccaatataagtgagcaaagtgagccagcattcaatgtttcagccacttcagtttgtcgcagtgtttatattatatacttacaaagcataaaatgatgcagggtggtcagttttgctttggttttagtttctttccttcgaaaattgtggatgcaaatgaataatatatagatggacaatggtggtattgtcaatagacatatagatggacaatggtggtattcaatctattgacaataaaatggtgatatttgaga

SEQ ID NO: 3360 - DNA, 410 bp, Manihot esculenta
aaatggatttaatggagctgtgggcgatcttcggtcccggagtcgcaggcgccgttttcggggctggctggtggttctggattgacgccgtcgtttgcagttctgtcaaagtctcttttgttcattaccttcctggaatttttgcatctatagcagctctgatgtttaattgtgttaggaaagaggatattgattattctccatatgaagaaggcgagtggagattgaagctctggcttttctttgcatatgttgtatcctttgtttctctagcagcatcagtgggcttattaatacaggattcaattgttaaaactgggccttcagtgtggacaggaactgctggtgtcttacaatgtgtgtttgtgttgatcagtgggctgatgtattggacttcacactcggaataa

SEQ ID NO: 3361 - DNA, 791 bp, Gossypium hirsutum
ctttctcggatttcccgatcgggctggtggcctacaactcgataagagtggaaaataatgttcagaatattagctgtacagttttctctctttcctttttgttccttgtcaattattagtcaattaattagatcggagaacaatcaatcaaatggagttaggggaactgtgggcgatcttcggtcccggcgtcgctggcgcagtgttcggtgccggctggtggttttggatcgacgccgtcgtatgcagctccgtcaatgtctctttcatccactatttacctggaatatttgcttctatcgcggctttgatgttcaattgcgttaggaaagaggatattgattactctccttatgatgaaggcgagtggaggttgaagctctggctcttctttgcttatgttgtatcctttgtctcactagctgcttcagttggcctcttgatacaagactcactagtgaaatctggtccttcagtgtggactggtactgcaggcatcttacagtgtgtgtttgtcttaatcagtgggctgatatattggacttgtcactcagaataacacatatatatccaacctaatccggtgtttacagtttggagcctggaacaggcaacgtagaatgtatcctttgtaattaatcaatggtttaagatggttagaaaattgtttcactttcataaatattgtattctactgtcatgagtttgattatgaaagaaggattgatcctcttctacttttggattatttgtgtgatgatgtctttttcaagttcttaattttcaaccta

SEQ ID NO: 3362 - DNA, 928 bp, Cucumis sativus
ggaaggtatgggagttataacattgagctggaaaagggtgtgagcctgtgaggtgtgcgatcattcagttcacactaccctctccagatcgacccgcttccaacaacctgcgtaaggagaaagcaaaaacaaagagccccacaaatggatttggcggagctttggtcaattttcggcccaggcgttgccggagctgtgtttggcgccggatggtggttctgggttgacgccgttgtctgcagttctgttgccgtctcctttgtccactacctcccaggtatttttgcttcttttgcggctttgatgttcaattgcgttcgaaaagaagacatcgattattctccatacgaggagggggaatggaggttgaagctttggctcttcttcgcttatgtggtatcattcgtttcattagcagcatcggttggactcttgatacaagattcagtagtaaaagccgggccatcagtgtggacaggagttgcaggagtgttgcagtgtgtgtttgtgttggttagtgggttgatttactggacttctcactcggagtaagttggaaaaaattatgcaccaaggcaagatctcaaaagctgaagagtctaccaactgtatagagctccagtctgcactgcaatgtcgagtaatttgtttgtgtctattgacctgaacccgagagcctttttactttttgtaaatgtcatgtgttaaatcataagctgaaactatgtctatatgtctttatgaattcaatataagtgagccagatatttaatgtttagacttttgttcttttatttcttcaaaatcaaatgttttctctgcaaaagaaaaaaaaaagaaaatataactatggtcatgtagaagaacccatactcattaaatttagataaagttattgtcatttgaaaacaaaaattaccaatccatt

SEQ ID NO: 3363 - DNA, 604 bp, Euphorbia peplus
attcgtcgctaattattgtgcaaataaagtaaataattagtcggtaaagctatggatttgcaagagttatgggcgatcttcgggcccggcgtggcgggggctgttttcggtgccggttggtggttctggattgacgccgtcgtttgtagctccgtcgccgttccgtttgttcactacctacccggtatttttgcttcttttgctgctttgatgtttaattgtgttaggaaggaggatattgattactctccttatgaagaaggcgaatggagattgaagctttggcttttctttgcgtatgttgtatccttcgtgtctctagcggcttcggtgggcttattgatacaagattcaattgtcacaatggggccttcagtctgggcaggaactgcaggtgtcttgcagtgtgtgtttgttttgatcagtggactaatctattggacttcacatacggaatgaattctcgcaaatcagtacatatgccgttgagagcttgaatttgcatgtaaggttgtatttgttcaatccgtgggacgaaatagacacccttgtacatgtttttgttgtctaaatctaacatattgactattgagttgccgatcaa

SEQ ID NO: 3364 - DNA, 749 bp, Ipomoea nil
ttcgtcgagaaccggccctggcagctaacaaactccaattgagttcttcgattgagttctaacaatttgtttgaactatagaatatcgactgaactcaaattagaggagaattgtgaggaatggattttggggagttgtgggcaatcttcggaccgggagttgcaggcgccgtcttcggagccgggtggtggttttgggtggacgccgtcgtttgcagcgccgttaaaatctcgttcctccactacctcccagggatatttgcgtccctggctgccttgatgttcaattgcgttagaaaagaggacattgattattcaccttatgatgaaggcgaatggaggttgaagctctggcttttcattgcatatgtagtatcatttgtttctttggctgcctctgttggtctcttgatacaagatgcacttatgcaaactggcccttcagcttggacaggagttgcaggtgtcctgcaatgtgtttttgtgttgatcagcgggctgatatactggacatcgcactcagagtaaaccgagcagaagaagttgatgaacacgcatttgtaagaggaagactgggagttggagttactatcgatctgggcacaagctcaaatgtcagtgtttgggtaaagtatacgactgccatttgcctgtgtatatttgctttcttgtaagtgaatcatgtgacagagtgattggattagtctgataatgcttttcattccaatttccaaagattccacattatg

SEQ ID NO: 3365 - DNA, 887 bp, Cucumis melo
tgtgtgcctgtgaggtgtgcgatcattcagttcacactaccctctccaaatcgacccgcttccaaccacttccgtaaggagaaagcaaaaacaaagaaccccacaaatggatttggcggagctgtggtcaattttcggcccaggcgtcgccggagctgtgttcggcgccggatggtggttctgggttgacgccgttgtctgcagttctgttgccgtctcctttgtccactacctcccaggtatttttgcttcttttgcggctttaatgttcaattgcgttcgcaaagaagacatcgattattctccatacgaggagggggaatggaggttgaagctttggctcttcttcgcttatgtggtatcattcgtttcattagcagcatcagtgggtctcttgatacaagattcagtagtaaaaactgggccatcagtgtggacaggagttgcaggagtgttacagtgtgtgtttgtgttggttagtgggttgatttactggacatctcactcggagtaggttggaaagaattatgcaccaaggcaagacctcaaaagctgaagagtttaccaactgtatagagctccagtgtgcactgcaatgtcgagtcatttgttttagtctattgacctgaacccaagagcctttttactttttgtaaatgtcatgtgttcaattataagctgaaaccatgtctatatgtctttatgaattcaatataagtgagcgagatatttaatgtttagcttttgttcttttatttcttcaaaatcaaaatgttttctgtgcaaaagaatagaaaataaaatataactatggtcacaagaagaactatcaacattaaattgtgataaagttattgtcatctgaaaacaataattaccaatccatt

SEQ ID NO: 3366 - DNA, 664 bp, Citrus sinensis
aaaaaagggagagagagcgcaattgaattgacagtttagttgaggctggaagtgtaacaaagcaaagcaactcaatggatttagcggagctttgggcaatattcggacccggcgtggctggagccgtatttggagccggctggtggttctggatcgacgccgtcgtttgcagctctgtcaaagtctccttcgtccactacctccctggtatttttgcgtctcttgcggctttgatgttcaattgcgtgcggaaagaagacatcgattattctccttacgaagaaggcgagtggagattgaagctctggcttttcttggcttatgttgtatcctttgtttctctagcggcatcagttggtctgttgatacaagattcactagtgaaaactggtccatcagcgtggactggaactgcaggtgtcttgcagtgtgtgtttgtgttgatcagtgggctgatttattggacttcacattcggaatgagaatggatatatcaataccattgcgacctagagcttgaattactgatgaatttgtacaagaatcgttttccttgtttaaacattggaacaatttgcctttgtaaatgaatgtgttgtacaaacaatcttgagcatccttgtaaatctcatgcagctctttctatggaatgtgatgatcgtta

SEQ ID NO: 3367 - DNA, 775 bp, Citrullus lanatus
aataggagagcttgaagggaaggtagatgggagttttaacattcggcaggaaaagggtgtgagcctgtgaggtgtgcgatcattcagttcacatcgcactagcctctccaattcgacccgcttcaaaccacttgcacaaggagaaggcaatagaaagaacccacaaatggatttggcggagctgtggtcaattttcggcccaggtgtcgccggagctgtgttcggcgccggatggtggttttgggttgatgccgttgtctgcagttctgtcgccgtctccttcgtccactacctcccaggtatttttgcttcttttgcggctctgatgttcaattgcgttcgcaaagaagacatcgattattctccatacgaggagggcgaatggagattgaagctttggctcttcttcgcttatgtggtatcattcgtttcattagcagcatcagtgggactcttgatacaagattcagtagtaaaaactgggccgtcagtgtggacaggagttgcaggagtattacagtgtgtgtttgtgttggttagtgggttgatttactggacttctcactcggagtaattatgcaccaagacctcagaagctgaagagttaccaactgcctagacctccagtgcactgcaatatcgagttatttttccattgacctgaacccaaaaaggctgtttacttcttgtaaatgtcatgtttatctcaagctggaactatgtctatatgtttttataaattcaatataagtgagccagatatttaatgtttcag

SEQ ID NO: 3368 - DNA, 875 bp, Malus domestica
cctaattcccctcacgaatcagagtcggccgactcgaagcatcgccccgtgccctctctctctctctctctctctctctagggttcttcttccgtctctccctccctcgtcgtttaggataacaagggaaagtcgtattgttataaatggatttgtcggagctctgggggatcttcggtcctggcgttgccggagccgtgttcggggccggctggtggttctgggttgacgctgtcgtttgcagctctgtcaaggtctccttcctccactacctccctggcatatttgcgtcgttagcggcgctgatgttcaattgcgtcaaaaaggaggacattgattactccccttatgaagaaggcgagtggagattgaagctttggctgttcattgcttatgttgttgcatttgtatctctagcggcatcggtgggtttgttaatacaagattctttagtgaagactggcccttcagtgtggactggaactgctggtgtgttgcaagcagtttttgtgttgatcagtgggctaatttattggactgctcacccggagtaagtagtgatctaccagcggtaccattttccttggaacctggatttcgcaagtgaggaaattggctgtgcatgtatcatttaaacttcttcaagcatttggaccaaggagacaggaaaatgaatagtaaatacggttcaatttgcaactccataggtaatatggaagacttgttgacctttgtaaatgtttgtagtgtgataccagtcttggttaatttgttaaaactaaagtagtgtctattcaaaatacgatttttcttcccttatgtttattacgttgtttcgcaacacgacgatgtgaaggcttaacgttgattacatt

SEQ ID NO: 3369 - DNA, 775 bp, Cleome gynandra
cttcctcatacgcgaataagcaaatcaaatcgtcgtgacgacgatacgtaatcatcgattgtagaatccgagaaaagcccagcaaagaggattcatcgaaccatggatttggcggagttgtgggcgattttcggaccgggagtctccggagcggtgtttggcgccggatggtggttttgggtcgacgccgtcgtttgcagcgccgttcaagttccattcgtccactatctcccaggcatatttgcgtctcttgccgctttgatgttcaattgcgttaggaaagatgatatcgattactctccttacgacgaaggcgagtggagattgaagctatggttgttcatagcatatgttgtagcttttgtttccctagcggcgtctgtcggcttactgatacaggattcgctagagaagactggtccgtcggcgtggactggtgtggcgggtatctttcaatgtgtatttgtattgataagtgggctaatgtattggacatctcactcggagtaagtcaaaggaacaatcagcgatagccttttcgggtgagcgttatctcgggctcgtgtggctcgggcccttgtcaatatacaatacgtgaacctgtgtgaaagaaagaacttgtgattcaacttgtaaatgttcttatcctgttctcagctatgcctgtatcttgtgttattattgagtggggctcatatctcgtgtgtgttgttattcatccgagtcttttcgagttttacattgtgtgtttttttgtttattaggttcaatttgg

SEQ ID NO: 3370 - DNA, 770 bp, Gossypium hirsutum
cagttgagaataggctgcgcttgaaagggaggttaagggaagaaaaatggaaatgttattttattctcaataattggtttaatttcgaaaaaagaaatcaaatggatttaggcgagctgtgggcgatcttcggtcccggtgtcgcgggcgccgtattcggtgccggctggtggttttgggtcgacgccgtcgtttgtagctccgttaatatctctttcgtccactatttacctggaatatttgcatctatcgcggctttgatgtttaattgtgttagaaaagacgatattgattactctccgtatgatgaaggcgagtggaggttgaaactctggcttttccttgcttatgttgtctccttcgtttcactggctgcttcagtgggcctattgatacaggactcactagtgacatctggtccttcattgtggactggtactgcaggtgtcttacagtgtgtgttcgtattaattagtggacttatatattggacttctcactcggaataacagacagtgtagcttggaatcacaagcgagtcttcaatagtatgtgcaggtatcatctgtcattttaattaatcaatggtgcaattagaaaggatttttcaccttcttaaatcttgtaccctatagtaagtgtcttgagtgtgaaaactaagattcatcctgctcttttgaaatttatgatttttcaaccacgaaacgagcgcttgaagcccatttgttgttttctttattaccagttctatatagggtcgaatcatccat

SEQ ID NO: 3371 - DNA, 771 bp, Cucurbita pepo
tcagaatttcaactgaagatcgatgggagctgtgctgttattcagttcatattagcctctctaaatcgatccgtctcaaacctctatcgcaaggagaaggcaaagaaagaagccacaaatggatttggcggagctgtggtcaattttcggccctggcgtcgccggagctgtgtttggtgccggatggtggttctgggttgacgccgttgtctgcagttctgttgccgtttccttcgtccactacctcccaggtatttttgcttcttttgcggctttgatgttcaattgcgttcgcagagaagacattgattattctccatatgaggagggcgaatggagattgaagctttggctcttcttcgcttatgtggtatcattcgtttcattagcagcatcagtgggactcttgatacaagattcagtagtaaaaacagggccatcagtgtggacaggagtcgcaggagtattgcagtgtgtgtttgtgttggttagtgggttgatttactggacttctcactcggagtaagacgtcagaggctaaagaattaccaacttcatatagctccagtggactgcagactacagtgtgagtcatttgtgtgtatcatttgacttttccaactatggaaccaaagggcttttctacttgtaaatgtcatgttaatttcaagctgaaaccatgtctatatgtctttatgcattcaatataagtgagtcagatattcaatctttcagccatttcaaccttgcatgtgggagagtttagtttag

SEQ ID NO: 3372 - DNA, 828 bp, Euonymus alatus
gacacttcgtggtaaagcatggcgtgtaccatcgacgataggaaaaatatcgtatgcacgtgactgtgcagcgaaggaaggaaccggaagcaaataatagttggcgaacagactgaagctatcagacttaacgactcagccacaaaagaacggaaaagatccggcgaagtggagatatggattcagctgaagtgtgggcgattttcgggccagccgttgcaggagctgttttcggtgcaggatggtggttctggatcgacgccgtcgtttgcagctatgttaccgtttctttcgttcactaccttcctggcatatttgcatcgattgcggcgctgatgttcaattgtgttagaaaggaggacatcgattattctccatacgacgaaggggagtggaggttgaagctttggcttttctttgcatatgttgtatcatttgtctctctagcggcctcagttggcctattaatacaagattcactcgtgaaaactggtccttcagtctggacaggaactgctggtattttgcagtgtgtgtttgtgttgatcagtgggctgatttactggacttcgcactcggagtaaattgtgttgatagaattccaaaatagacttgccatttggagcttcagatgtggatgagggagcgagaatgaacgtcggttcaccttatctatcaaatgtgaccaaaagaaaagcaaaagaaaaacattcctgtaaatgtgtttgctgtggtgaaatatttgcaaatttgtgatagtagtgtatatgctttatttcctccatcttggcttggtttctgccattttagtttggggtattgagcact

SEQ ID NO: 3373 - DNA, 897 bp, Gossypium raimondii
gatgttccatcgggctggtgacccaacaactcgataagagtggaaaataatgttcagaatattagctgtacagttttctctctttcctttttgttccttgtcaattattagtcaattaattagatcggagaacaatcaatcaaatggagttaggggaactgtgggcgatcttcggtcccggcgtcgctggcgcagtgttcggtgccggctggtggttttgggtcgacgccgtcgtatgcagctccgtcaatgtctctttcgtccactatttacctggaatatttgcttctatcgcggctttgatgttcaattgcgttaggaaagaggatattgattactctccttatgatgaaggcgagtggaggttgaagctctggcttttctttgcttatgttgtatcctttgtctcactagctgcttcagttggcctcttgatacaagactcactagtgaaatctggtccttcaatgtggacgggtactgcaggcatcttacagtgtgtgtttgtcttaatcagtgggctgatatattggacttgtcactcagaataacacatatatatacaacctaatccgccagtttggagcctgggacttgagaagtgaggtatcctttgtaattaatcaatggtttaagatggttagaaaattgtttcactttcataaatattgtattctactgtcatgagtttgattatgaaagaaggattgatcctcttcccttttggatatttatgtgatgatgctttttcgagtctaattttcaaccacctgccttttgtcaatagactcggcttggttttcaatgagtttgaataggatagagtttcgtagttcagatttttaaaggtgaaatgctcaactcagattgcttgatgccaacaagtgcaaattgctt

SEQ ID NO: 3374 - DNA, 737 bp, Tropaeolum majus
gaaggaaaggaacacgtttgctggagtggagaacctttgagaaaagaaaagaatttcatcgcccaaatccaacgcgataccctcaagatggatttaccggagttgtgggcgatcttcgggccaggttttgctggctctgtgttcggagctggttggtggttctggatcgacgccgtcgtttgcagttccgtcaaagtctcattcctccactacctccctggtatatttgcgtcgattgcggctttgatgtttaattgtgtgaggaaagaggatattgactattccccttacgaagaaggcgagtggagattgaagctgtggcttttctttgcatatgttgtatcctttgtttctctagcagcatcagtgggcttattgatacaagattcactgttaaaaactggcccttcagtgtggactggaacagctggtgtcttgcaatgtgtgtttgtgttagtcagtggactaatttattggacctcgcactcggagtgattcgacacaaacacgaacttcaaccaaggaaattccatctgtgaatgtattcttttctttttcttttttcaaacgtaaaacattgttatttaaaatagctttggttttgttcgtgtcttgtgttgcggagcattaaacctataagctgttagtctccaggaatttgtgatgtaatttctagcagtgctttgtaccatgtaagtaacttcgtggacagcaatatttgtataggcaactttgta

SEQ ID NO: 3375 - DNA, 934 bp, Fragaria vesca
taagaggaaattacaaaagttgccgtaatacagctaaacacaagtctcgctcactctctctctcaaggggaaagttcgctgtgagtgagaagcaatcgaaaacagctgtcaaaaccggagatcgaatttgcacaactccggcgattggaaccctggtagttatcaaaaccgccgtagtagactacaccgagcaccagccatggatttcccggagctttgggcaatcttcgggccaggcgtcgccggcgctgtgttcggcgccggatggtggttctgggtcgacgccgtggtttgcagctccgtcaccgtctcgttccttcactaccttccagggatttttgcttctttggcggctttgatgttcaattgtgttaagaaggacgacattgactactctccttatgaagagggcgagtggaggttgaagctttggctgttcattgcttatgttgtgtcctttgtatcattggcggcatcagtgggtttgctaatacaagattcacttgtgacaaccggcccttcggtttggacaggaactgctggtgtattgcaagccgttttcgtgttggtcagtgggcttatatattggacttctcacccggagtaagtagggaccgtgataagtagttattcatgggaatctgaatttcacaagggagggaatagaatgacttaatgtatcattttactccttcaatcaattggaccaagaacaaatgtatcgtaaatagggttcaatttcaaattcaatagctgatacgaaatgtatttttcagtgattgtaaatttatattgtgctatcttcctaaatttgtgaaactgagtcgatacttttcaaaaatgcaagtttgtttatgtttaatccattgaatgactgttttgctgcttaagtttgatatctaaggttgccctttcaaggcagcctacttgcttc

SEQ ID NO: 3376 - DNA, 686 bp, Tripterygium wilfordii
gccgaaacgatccggcgaatacgacgaatagagatatggatttatctgaagtgtgggcgattttcgggccagctgttgcaggagctgttttcggtgcaggttggtggttctggatcgacgccgtcgtttgcagctctgttactgtttctttcgttcactaccttcccggcatatttgcatcgattgcggcggtgatgttcaattgtgttagaaaggaggacatcgattattctccatacgacgaaggggagtggaggttgaagctttggcttttctttgcttatgtggtatcattcgtctctctagcagcctcagttggcctattaatacaggattcacttgtgaaaactggtccttcatcctggacaggaactgctggtgtcttgcagtgtgtgtttgtgttgatcagtgggctgatttactggacgtcacactcggagtaaattgtgttgatagaattccaaaatatgcttgccatttggagcttcagattgcagatgagggagtgagaatgtatgttgtttcaccttacctactgaatgtgaccaaaaagacaagcaaaagaaaaaaataaatcctgtaaatgtgtattctgttgtgaaaatcattagcaaatttgtgatgctagtgtagatgctttatttcttccatcttggcttggttgtgtgctgttgtgtttgtcaact

SEQ ID NO: 3377 - DNA, 541 bp, Flaveria ramosissima
aatttcatgtcgttttccatcgtagaaacttcaaaatagcacgcaactccaagacccaacatcgctgatcatcccgaaggtcgaaagaaagcattcgaattgaccgatggatgtgtcggaattgtgggcaatttttggtcccggagtcgccggcgccgtgttcggtgccggatggtggttttgggtcgacgccgtcgtttgcagtgctgttaaagtctcgtttcttcactatcttcctgggatatttgcgtctttagctgctttgatgtttaattgtgttagaagagaggatattgattactctccgtatgatgaaggcgaatggaggttgaaactttggctttttctagcctatgttgtgtcgttcgtctccttggcagcatcggtagggttactgatacaagatgcacttgtgcctgaaggcccttcagcatggacaggaactgctggtgttttgcagtgtgtgcttgtgttaattagtgggtcttgtttactggacgtctcatggtgagtaagaggagtgaagtctcaaggtcagttg

SEQ ID NO: 3378 - DNA, 618 bp, Jatropha curcas
aaaacaaactagagaccgtcggcatacaaacagatagagagaaatggatttggcggagctctgggcgatattcggtcccggcgttgctggtgctgtgtttggtaccggttggtggttctggattgacgccgttgtttgtagctccgtcaaagcctcctttgttcactacctgcccggaattttcgcatcatttgcagctctgatgtttaattgcgttaggaaagaggatattgattattccccgtacgaagaaggcgaatgaagattgaagctgtggcttttctttgcatatgttgtatccttcgtttctctagcggcatcagtgggcttattaatacaagattcaattgtcaaaactgggccttcagtatggacaggaactgctggtgtcttgcagtgtgtgtttgtgctgatcagcgggctaatttattggacttcgcactcggaatgatttctgcatatcagcaaatgccatgttgagcgaccaacgatttgtatggtttacttttactcaatgggctgaaacataatcaccctgtgtatattttcatgctgtactaacgatatttgagctgcgtaacaatcttgagaattggtagtaaactactgttgctcttc

SEQ ID NO: 3379 - DNA, 734 bp, Artemisia annua
tactccgacggggaacacacatcatcgacaagaaacaaacaaaacataacccttaatcctgtcaaaccaaccaagaatcgattgatcgatggatttggcagagttatgggcgatattcggaccaggtgtagccggagcggtgtttggtgcagggtggtggttttgggttgacgccgttgtttgtagttcagttcaagtctcttttcttcattatcttcctgggatatttgcatctttggctgctttgatgtttaattgtgtcagaagagaagatatcgattattccccttacgaagaaggcgaatggaggttgaagctttggcttttcctagcatatgttgtgtcattcgtctcgttggccgcatcagtaggcttgttgatacaagatgcactcgtgcctgaaggcccttcagcttggacaggaacagctggtgttctgcagtgtgtgcttgtgttaattagtgggcttgtttattggacatctcattcggagtaacaggaagtgaagtcttcattcgaaggtttcatttgtggttttggatcatcgtgtttgttaaatcgtgcttgtacattatatgttcatgatccaagtaacggtatgtgatagtaaaaacagcttttgaagtttaaagtgattggccggattgttttttatattgatgtttactccgcatgttatttatgaccttttagttactgctatgtatcccaaacctagcatttgtatgatgatc

SEQ ID NO: 3380 - DNA, 853 bp, Artemisia annua
gaacacacagttgattctcataaattaaccaacccatcaatcataaataaaaacttattaaaacaacaacacacatcatcgacaagaaacaaacaaacaaaacataacccttaatcctgtcaaaccaaccaagaatcgattgatcgatggatttggcagagttatgggcgatattcggaccaggtgtggcaggagcggtgtttggtgcagggtggtggttttgggttgacgccgttgtttgtagttctgttcaagtctcttttcttcattatcttcctgggatatttgcatctttggctgctttgatgtttaattgtgtcagaagagaagatatcgattattccccttacgaagaaggcgaatggaggttgaagctttggcttttcctagcatatgttgtgtcatttgtctcgttggccgcatcagtaggcttgttgatacaagatgcactcgtgcctgaaggcccttcagcttggacaggaacggctggtgttctgcagtgtgtgcttgtgttaattagtgggcttgtttattggacatctcattcggagtaacaggaagtgaagtcttcactcgaaggtttcatttgtggttttggatcatctgtctttgttaaatcgtgcttgtacattatatgttcatgatccaagtaacggtatgggatagtaaaaacagcttttgaagtttaaagtgattggccggattgtttttatattgatgtttactccgcgtgttgtttatgaccttttagttactgttatatatcccaacttagcatttgtatgagaaaaaggtcaattaaaggaacatagcttacaatatatagaagtcgggaattttgtcacatttacag

SEQ ID NO: 3381 - DNA, 971 bp, Cannabis sativa
cacaagtaattagaatatttgaaaaggaagaaccttgtctgagaaatcacgccagctctatctatcaattcagtactactttacctattctcaaattaagaagaagattttctcccaaaccaagtgcccatagatggatctggtagagctctgggcaatttttggtccaggtgtgtctggggccatcttcggcgccggttggtggttttggatcgacgccgttgtttgcagctccgtcaaggtttcattcctccactatcttcctggcatttttgcatctttggctgctttgatgttcaattgtgttaggaaagaagacattgattactctccctacgaagaaggcgagtggaggttgaagctttggctgttctttgcatatgttgtgtcctttgtttctctcgcggcttcagtgggtcttctgatacaagattcactagtgaaaactggcccttcagtatggacaggaacagctggtgtcttgcagtgtgtgtttgtccttgtcagtgggctgatgtattggactgttcactcggagtaacaggggaattcaaattgctatcaactggttctttttgaatactcaacactaccataagtgagaaatcggttgttaatttgctttgtctcactttcacttattatttgtacaaacgattctataaaaggcagttcgccatgtaaatgttgtatttacaatattgttgttatcctaactgaaaatgatgttattgtggtcatttcaacaagtctatcccaccaaaacatttctttttaagattttttgcacttgatttcttggtcttggtctcgatttctaaatcgacagtctttctattattagtctttcgtgctaccaaatgtttgagggtgtcgatgcttgaagaggtaaataagcatgacgtaaaaagtgcgggaattgaatgagcttgataatttaaagaaaaatattatataaaatatggttttta

SEQ ID NO: 3382 - DNA, 857 bp, Chelidonium majus
ttcagtctctatggtttgatttgagctcagaattttcagattgaagatctcaattttgtctctggtttcttcgattttgagccagaagatcgaggttttgaaataaaaaggagtaaacttgatctctttcaactaaatttgtgatcttttctggaaaaaggtatataaaatagcagagaatccgtctgatttgtgattatttcagaaggcttaattgggaggctttgatttcatcgttcctcaattaaggtcattttgattaattcagggtttcagtagtgacaaaacgtaacgaactgttaatagagagacgatggatttattggagttgtgggcgatattcggtccaggcattgctggtgctatattcggtgctggttggtggttttgggttgacgccgttgtttgtagctatgtcaccgtctctttcgttcactacctacctggtatattcgcttctctagcggctttgatgttcaattgcgttaagaaagaagacattgattactctccctatgaagaaggagagtggaggttgaagctttggcttttcgttgcatatgtcgtttcatttgtgtctctagcagcatctgtaggcctattggtacaagatgcacttgtacaatctggtccttcagtgtggacaggcacagccggtgtcttgcagtgtgtatttgtcttgattagcggactggtctactggacgtcgtattcagagtaatttcgttggagtaaaaaagtcgagtacgtaaatttttcgcgaactggaaagtcgtcaattccaaaaagaaagtattaatttgtgtattgttaatacctctgtctacccatccagtcagtccaaaaggaaagatata

SEQ ID NO: 3383 - DNA, 662 bp, Cichorium intybus
aacgtaacgcaccgcagaaagctacatagcacgcacatccgacacctaacaagcccgacccaaggagagacagcgttcgaatcgatcaatggatttgtctgaattgtgggcaatatttggtccaggtgttgccggcgccgtttttggagccggctggtggttttgggtagacgccgtcgtttgcagttctgttcaagtctcgtttctccactacctccctgggatattcgcatctttggctgctttgatgtttaattgtgttagaagagaggacatcgactactcgccctatgaagaaggtgaatggaggttgaagctgtggctatttctagcatatgttgtgtcgtttgtgtcgttggcagcatctgtagggctgttgatacaagatgcacttgtccccgaaggcccttcagcttggacaggaaccgcaggtgttttgcagtgtgtgcttgtgttaattagtgggcttgtttattggacatctcattcggagtgaagggagtcggttgtggttatgcatgttatatcgctctcgtgtacatgtctgtgttgatgatctattggatatagtaaaacaatgtgttgaaagtttgaccgaattgttttccaactgttgtttatgattatttgcttacagtttatctttgcttcttaggctgaaa

SEQ ID NO: 3384 - DNA, 727 bp, Gossypium hirsutum
aatacttcgttgacaagagagagggtttaaattaaaataagtgagaggaaattgagtcgttatttcatccttactaatttgttagtttaactataatcaaatggatttaggggaactgtgggcgatctttggtcctggcgtcgcgggcgctgtgttcggtaccggctggtggttttgggttgacgccgtcgtttgtagctccgtcaatgtctctttcgtccactatctacctggaatatttgcatctttagcggctgtgatgttcaattgtgttaaaaaagacgacattgattactctccttatgacgatggcgaatggaggttgaagctctggcttttcgttgcttatgtggtatcctttgtttcattggctgcttcagtaggcttattgatacaagattctctggtgaaatctggtccttcagtgtggaccggtactgcaggtgtcttacagtgcgtgtttgtcttaataagtgggttgatatattggacttctcattctgaataatataaatccctcaaatctggcgcctagacttgggaacctggaagttggaaccacgagtaaggcaacaccccgtgcatgtatcaactcaactggtacttaaattggaaagaaagctattcacgtttgtaaatcttgtattgtattgtgttgtggtactgctcttttgaaatttgtgatgccgatttagtctaatttcagttacctgcccagtgcccattg

SEQ ID NO: 3385 - DNA, 716 bp, Gossypium hirsutum
ataagagtggaaataatgttcagaatattagctgtacagttttctctctttcttttttgttccttgtcaattattagtcaattaattagatcggagaacaatcaatcaaatggagttaggggaactgtgggcgatcttcggtcccggcgtcgctggcgcagtgttcggtgccggctggtggttttgggtcgacgccgtcatatgcagctccgtcaatgtctctttcgtccactatttacctggaatatttgcttctatcgcggctttgatgttcaattgcgttaggaaagaggatattgattactctccttatgatgaaggcgagtggaggttgaagctctggcttttctttgcttatgttgtatcctttgtctcactagctgcttcagttggcctcttgatacaagactcactagtgaaatctggtccttcaatgtggacgggtactgcaggcatcttacagtgtgtgtttgtcttaatcagtgggctgatatattggacttgtcactcagaataacacatatatatatacaacctaatccgccagtttggagcctgggacttgagaagtgaggtatcctttgtaattaatcaatggtttaagatggttagaaaattgcttcactttcataaatattgtattctactgtcatgagtttgattatgaaagaaggattgatcctcttcccttttggatatttatgtgatgatgcttt

SEQ ID NO: 3386 - DNA, 892 bp, Eucalyptus grandis
cattacggccgcagtgaagttgcagacaggaagtcgtacaccgctcgcgttttcgtctcttcgtcttcgtgtgctcgagacgaaaacgctttgccatctcgatccctctcttcccctctccctccctcgaaacctgaaaatcggagccccgaatccgatttcgccgtcgatctccgccatggatttgtccgaactgtgggcgatcttctcgccgggcttcgccggcgccgtgttcggcgccggctggtggttctgggtcgacgccgtcgtgtgcagctccgtcaccgtctccttcgtccactacctccccggtatcttcgcttctttggcggcgctgatgttcaattgcgtgaggagggaggacatcgattactctccttacgacgacggcgagtggaggttgaagctttggcttttctttgcctatgttgtttcctttgtctctctggcagcatctgtgggcctattaattcaagattcactcgtgaccactggaccttcagtttggactggagttgctggtgtcttgcaatgtgtgtttgtgttgatcagtggactaatttattggacggcgcactcggagtgaggctgtgatctgcgacgatgtactttgtaaacatatcaagatggaggactctgtagagcgactaaattgtgatgatcatttggatgcacggagcaagcttcgtcattgcagagaagatgactatgtatatctgaattctattgttctctgagtaaggaaaggaggggctgttttaactcaaagccatagcttttgtggggaaacccgttcgactcggtctatttgcggtgtgagtgttcaaatgagtttgatagtgtaaacgaaccttttccactctgctgccgttttctgctggcaaaatcatcg

SEQ ID NO: 3387 - DNA, 705 bp, Flaveria ramosissima
cgtagaaacttcaaactagcacgcaaccccagcacccaacatcatcactgatcatcccgaaggtcgaaagcattcaaattgaccgatggatgtgtcggaattgtgggcaattttcggtcccggagtcgccggagccgtcttcggtgccggatggtggttttgggtcgatgctgtcgtttgcagtgctgttaaagtctcctttcttcactatcttcctgggatatttgcgtctttggctgctttgatgtttaattgtgttagaagagaggatattgattactctccgtatgatgaaggcgaatggaggttgaaactttggctttttctagcttatgttgtgtccttcgtctccttggcagcatcagtagggttgctgatacaagatgcacttgtgcctgaaggcccttcagcatggacaggaactgctggtgttttgcaatgtgtgcttgtgttaattagtgggcttgtttactggacgtctcatggtgagtaagaggagtgaagtatcaaggtctgttgtggttttgcttcattgtatttgtcaaatcatgcttgtacatgtctatgttgatgttgatgaatccaatcaactatatgcgatattgaatagacctttgaggttaagagtgattgattcaactgatgttttctcctgtgtatcctctctctgctaatatgtgtgtatatgtgcataagattctctct

SEQ ID NO: 3388 - DNA, 886 bp, Gossypium raimondii
aaactaaaaaaaaaacagtaaaactcatataaaaattgaacagtatatgaaaaaatcgaaagcttcagcctttggcttgctgcgaatacttcgttgacaagagagagggtttaaattaaaataagtgagaggaaattgagtcgttatttcatccttactaatttgttagtttaactataatcaaatggatttaggggaactgtgggcgatctttggtcctggcgtcgcgggcgctgtgttcggtaccggctggtggttttgggttgacgccgtcgtttgtagctccgtcaatgtctctttcgtccactatctacctggaatatttgcatctttagcggctgtgatgttcaattgtgttaaaaaagacgacattgattactctccttatgacgatggcgaatggaggttgaagctctggcttttcgttgcttatgtggtatcctttgtttcattggctgcttcagtaggcttattgatacaagattctctggtgaaatctggtccttcagtgtggaccggtactgcaggtgtcttacagtgcgtgtttgtcttaataagtgggttgatatattggacttctcattctgagtaatattaatccctcaaatctggcgcctagacttgggaacctggaagttggaaccacgagtaaggcaacaccccgtgcatgtatcaactcaactggtacttaaattggaaagaaagttattcacgtttgtaaatcttgtattgtagtgtgttgtggtgagtatgaaggtacgattcatactgctcttttgaaatttgtgatggcgatttagtctaatttcagttacctgcccattgacagcacctactttcttatgttttcttttttcagtaattatatgcagggcctattcatcta

SEQ ID NO: 3389 - DNA, 1606 bp, Gossypium raimondii
gggagatctagcttatagaaacagagcagatggataaataattgaaaagaaaaaggtgcaatattgttgtgaaaatctctaatgtacactaatgtacgcattcggaggaaggagcgaaggaagaggcagagagagagagagagcggggaaaataacagttgagaataggctgcgcttgaaaagggagggttaagggaagaaaaatggaattgttattttattctcaataattggtttaatttcgaaaaaaaaaaatcaaatggatttaggcgagctgtgggcgatcttcagtcccggtgtcgcgggcgccgtattcggtgccggctggtggttttgggtcgacgccgtcgtttgtagctccgttaatatctctttcgtccactatttacctggaatatttgcatctatcgcggctttgatgtttaattgtgttagaaaagacgatattgattactctccgtatgatgaaggcgagtggaggttgaagctctggcttttccttgcttatgttgtctccttcgtttcactggctgcttcagtgggcctattgatacaggactcactagtgacatctggtccttcattgtggactggtactgcaggtgtcttacagtgtgtgttcgtattaattagtggacttatatattggacttctcactcggaataacagacagtgtagcttggaatcacaagcgagtcttcaatagtatgtgcaggtatcatctgtcattttaattaatcaatggtgcaattagaaaggatttttcaccttcttaaatcttgtaccctatagtaagtgtcttgagtgtgaaaactaagattcatcctgctcttttgaaatttatgatttttcaaccacgaaacgagcgcttgaagcccatttgttgttttctttatttccagttctatatagggtcgaatcatccatgcccccttttaacaaaacctttttcttttgttttggattggccataccaacctctttcccgatttgatttgccacctttaggctttatttgttttggtaggtggaaagataaaattttattggtatgcttggtataaaatatggaaaagttgaataaaaatgtaattttgttttcactcgttgttaagacagaactatggaaaagaagtaaaaattatattatgttactattatactagcataacaaagtaaaatgctgaattcgggtctacttcatttgatgtattcacaccttaatttctaggacttaggagactcaatttgctgcctaatgttaaatttgatccgaaaactcgtgtcttaatattggattcgtataattttagctatggtcatcatgtttaaaacattacatatttgtatatattttcataagttaataaattatgttatatttgtatatcggttccatctttatattatctgtagttaatgaataatgaattgattagtagatgtttatatgtaaatgatgataatagatgggttaaaagatgatgaaccagtgaaagcagcatctgagttagataggtattgcaaggaattgtaagatcattagtgtattttaatgttggataagattctcggatcaaacctgttaaagagcaacattttgga

SEQ ID NO: 3390 - DNA, 897 bp, Vitis vinifera
catgccatcgtggaattggaggtgaagagaggcgaaaaaaggaaaaagaaacggtgcggaaaaagagagaaaagaggaaagttagcttgggaatagagaggcatacggagagagaggggctggaaacagattagcagaggctgtagaaataaaagaaagtagtcgttggagtagatcagatccgtcgagaaaagaggacagatcgaagtgagtagaagagaagggggcaatggatttggcggagctgtgggcaatcttcgggccaggcatcgcgggcgcgatcttcggtgccggctggtggttctgggtcgacgccgtcgtttgcagttccgtcaaggtttccttcgtccactacctccctggaatatttgcgtctctggcggctgtgatgttcaactccgttagaaaagaggacattgactactctccatatgaagaaggcgagtggagattgaagctctggcttttctttgcttatgttgtatcctttgtctctctggctgcatcagtgggcctattgatacaagattcacttgagaaatctggcccttctgtgtggacaggaactgcgggtgtcttgcagtgtgtgtttgtgttgataagcgggctgatctattggacctctcattcagagtaggttgggagtaatcggaggccatttgggaagttgtccatgcatgtatcaatttactcatttaatgaatgggatacaaaagtagttgaactctgtaaatatttcttctgctaaacaattaccagcataaaagaaatagacctattggattgccactcttgtttatgtttgattggtccatctggtttttttatttgcgctcttgatcatcagatatagaccactggcttcacccttgctggaattatgacagttgataaaaa

SEQ ID NO: 3391 - DNA, 743 bp, Humulus lupulus
agagaagggaaggaagtcaggtcaggagtctgagaaatcacgtcaggtctatcacgacccttacagtctaattaagaagaagattttctgccaaacgaagcggccctagatggatttggtggagctctgggcaattttcggtccaggtgtatctggggctatcttcggggccggttggtggttttggatcgacgccgttgtttgcagctccgtcaaggtttccttcctccactatctccctggcattttcgcgtctttggctgctttgatgttcaattgtgttaggaaagaagacattgattactctccctacgaagaaggcgagtggaggttgaagctttggctgttctttgcatatgttgtgtcctttgtttctctcgctgcttcagtgggtcttctgatacaagattcacttgtgaaaactggcccttcggtatggacaggaacagctggtgtcttgcagtgtgtgtttgtgttggtcagcgggctgatgtattggactgttcactcggagtaactgggaaattgcttcaaacggtttctttttaaatactcaattccataagtgagaaatcagttgtgaatttgctttgtctcacttttacttattgtacaaacgattctataaaagacaggtcgccatgtaaatgttgtttgtattcacaatattgttatgttattccaactaaatgtgatgtcattgtggtaatttcaacaagtctactcctcaagcttaccaaaac

SEQ ID NO: 3392 - DNA, 854 bp, Populus trichocarpa
cttaccaaatattaaccgaacggcaaataaattccttcgtttcactgtgacgagtgtagctttcgggggttaagtccgataacgaagactcaccctcttgtagaatgcaaatttcacgcaattcataagagcctggaacttttgagcagtagcaacagtcaaagcactaaccaccgtatcaagtaaccaaaaaagcaatctcgagagagagatacgaatggatttaccggagctgtgggcaatcctcggtcctgcagtcgctggtgcggtatttgggactggatggtggttttggatcgacgccgtcgtttgtagctccgttacagtctctttcgttcattacctccctggcatatttgcatctattgcagctctgatgtttaattgtgttagaaaagaggatattgattactctccttacgaggaaggcgagtggagattgaagctttggcttttctttgcatatgtcgtctccttcgtctctttagcagcatcagtgggtttgttgattcaagattcaattgtcaaaacagggccttcagtgtggacaggaactgctggcgttttgcagtgtgtgttcgtgctgataagtgggctaatttattggacctcacattctgaatgagttgtggtgataagtacatttacatgtttggagcttggaatcatgacggagggagttggcagtgcatgtatccttacttaacccacgggacagaacatacttctacattgtgtaaatttttatcctgtgctaacaatattgagcataaaagctgacccgcggaacttttctggaatttgagatgtttggtacgtaataaattgaaatctcataaactctggtgtttctt

SEQ ID NO: 3393 - DNA, 1069 bp, Populus trichocarpa
gacgtagcgtaattgtgatgcaatgtacttttataaaatttccaaaaatatcattgagctacgcgagaatagatttcttaccaaatattaaccgaacggcaaataaattccttcgtttcactgtgacgagtgtagctttcgggggttaagtccgataacgaagactcaccctcttgtagaatgcaaatttcacgcaattcataagagcctggaacttttgagcagtagcaacagtcaaagcactaaccaccgtatcaagtaaccaaaaaagcaatctcgagagagagatacgaatggatttaccggagctgtgggcaatcctcggtcctgcagtcgctggtgcggtatttgggactggatggtggttttggatcgacgccgtcgtttgtagctccgttacagtctctttcgttcattacctccctggcatatttgcatctattgcagctctgatgtttaattgtgttagaaaagaggatattgattactctccttacgaggaaggcgagtggagattgaagctttggcttttctttgcatatgtcgtctccttcgtctctttagcagcatcagtgggtttgttgattcaagattcaattgtcaaaacagggccttcagtgtggacaggaactgctggcgttttgcagtgtgtgttcgtgctgataagtgggctaatttattggacctcacattctgaatgagttgtggtgataagtacatttacatgtttggagcttggaatcatgacggagggagttggcagtgcatgtatccttacttaacccacgggacagaacatgcttctacattgtgtaaatgtttatcctgtgctaacaatattttgagcataaaagctgacccgcggaacttttctggaatttgagatgtttggtacgtaataaattgaaatctcataaactctggtgtttcttcaatggccttgtgcagaagccaaattctattattttcaggttgttcacacaattagtctcagtttcgtcacagaatgctcaaaatactattacctctttcagtttgcctcggatcccatgctattgttcatgtctgg

SEQ ID NO: 3394 - DNA, 866 bp, Papaver somniferum
gacgtttgtccctaaaccatcgcgtcatgaccatcgatcatatctacctcccaaaccctaacaatttgatttaatgtttttctagagagagataaagaatggatccaggggagttgtgggcgatctttggtcctggtttcgctggtgctgtgtttggtgctggttggtggttttgggttgatgccgttgtttgcagcgctgttgctgtctctttcgttcattacctccctggtatctttgcttcctttgcagctttgatgttcaattgtgttaggaaagaagacattgattactctccctatgaagaaggagagtggagattgaagctttggctcttctttgcatacgttgtttccttcgtatccctggcagcatctgtaggcctattgatacaagatgcgcttgtggaaactggcccctctgcctggacaggcacggctggtgtcttgcagtgtgttttcgtcttgatcagtggcctcgtgtactggacgtcgcatacagagtaactgggacgaactgcagtaaattccgagtgtaaattatcattgtctatagttgtccaattcagcaagtccaaagcaaaaatagaaaatgcgaaaaggtttcatctatcttaaggtgtttttcgttctggatggtggtgcaatttatgtaaatgtgtgtgtggagttgattctatttcatgctaactgggagatctgggatgtattaattccactcttgatacatatggtggttgtgggggtaatggatgttcttcttcgtgcaagatataaaaagttttcgggctagtatcttaagagtaactttgcacgaagacaacttttaagagtaaatactataaaatatagaaaacttcattaaga

SEQ ID NO: 3395 - DNA, 986 bp, Papaver somniferum
aaaaaagaagagtagttagaagacaacacagagaagcaaaatacatagttttgacccctaaaaccatcggcgtcatcaccatcgatcatatctccctctccaaaaccctaacaatttgatttaattgtatttctagagagagataaagaatggatccaggggagttgtgggcgatctttggtcctggtttcgctggtgctgtatttggtgctggttggtggttttgggttgatgccgttgtttgcagcgctgttgctgtctctttcgttcattacctccctggtatctttgcttcctttgcagctttgatgttcaattgtgttaggaaagaagatattgattactctccctatgaagaaggagagtggagattgaagctttggctcttctttgcatacgttgtttccttcgtatccctggcagcatcggtaggtctattgatacaagatgcgcttgtggaaactggcccctctgcctggacaggcacggctggtgtcttgcagtgtgttttcgtcttgatcagtggcctcgtgtactggacgtcgcatacagagtaactgggacgaactgcagtaaattctgagagcaaattatcatcgtctatagttgtccaattcagcaagtccaaagcaaaaatagaaaatgcaaaaaggtttcatctatcttaagttgtttttcgttctggatgttggtgcaatttatgtaaatgtatgtgtggagttgattctatttcatgctaactgggaggtctgggatgtattaattccactcttgatacatatggtggttgtgggggtaatggatgttcttcttcgtgcaagctataaaaagttttcgggttagtatcttgagagtaattttgcacgcagacaacttttaagagtaaatataaaatatactgtagaaaattaagagtaagttggtatttaagttgaatatatgtgcattcgtaactcaggttttactattatagagattgttgtgcc

SEQ ID NO: 3396 - DNA, 669 bp, Papaver somniferum
tttgatttaattgtttttctagagagagataaagaatggatccaggggagttgtgggcgatctttggtcctggtttcgctggtgctgtatttggtgctggttggtggttttgggttgatgccgttgtttgcagcgctgttgctgtctctttcgttcattacctccctggtatctttgcttcctttgcagctttgatgttcaattgtgttaggaaagaagacattgattactctccctacgaagaaggagagtggagattgaagctttggctcttctttgcatacgttgtttccttcgtatccctggcagcatctgtaggcctattgatacaagatgcgcttgtggaaactggcccctctgcctggacaggcacggctggtgtcttgcagtgtgttttcgtcttgatcagtggcctcgtgtactggacgtcgcatacagagtaactgggacgaactgcagtgccaaaattctgagagtaaattatccttgtctatagttgtccaattcagcaagtccaaagcaaaaatagaaaatgcgaaaaggtttcatctatcttaagttgttttatgtaaatgtatgtgtggagttgattctatttcatgctaactgggagatctgggatgtattaattccactcttgatacataaggtggttgtgggggtaatgga

SEQ ID NO: 3397 - DNA, 758 bp, Thalictrum flavum
catcgaaaaagagaaatcgaaagtaagaaaggaattttaactagtaaaactgattgattgataatggatttgggagaattatgggcgatctttggaccaggtgtatcaggtgcagtgttcggtgctggttggtggttttgggttgatgctgttgtttgtagttctgttaaagtctcctttgttcactatctccctggtatatttgcatctttggctgctttgatgtttaattgcgttagaagagaagatattgattattcaccctatgaagaaggagaatggagattgaagctttggcttttctttgcatacgttgtttcctttgtgtctttagcagcatctgtgggcctattggtacaagactcattagtgaaatcaggaccttccgtgtggacaggcacagctggtgtgttgcagtgtgtgcttgtattaatcagtgggcttatgtattggacatctcattcagaatagtttggtgtatctgaggtcaggcaatcaaccatgtatttgtttttaatgttcagttggtggaatagaaaaatagaaaggtacccttttatcttgattggtggagtggttctcatttattgtaaatgtgtatgatcattagaatgaaacccatgaaacccttgtttgtagcttcctgttgattcatggaaacaaaatgaagtgtaccaccgtagttcaacataatcttacatgtaaatttggaattgctagttactctttgaggtttctaagatgcaagtgtgtagaaa

SEQ ID NO: 3398 - DNA, 790 bp, Nicotiana benthamiana
  misc_feature (191)..(191): n is a, c, g, or t
  misc_feature (275)..(275): n is a, c, g, or t
gcacgaggcaaatctgaagaaacatttctctttgctgaaaactctcatcaattttgaaggactttcactttttcagcaggtttttctgtaaagaagaggtgatccaaatggattttccagagctatgggcaatatttggacctggggtatccggctctgtcttcggcgccggttggtggttctgggttgangccgtcgtttgtagctccatcaaagtctctttccttcattatctcccaggtatattcgcgtctttggctgctttgatgtttaantgcgtcaggaaagaggacattgactactcaccttatgatgaaggcgagtggaggttgaagctgtggctttttattgcatatgtcgtatcctttgtgtctttggcagcatcagttgggctattgatacaagacgcactcggaaaatctggtccttcagcttggacaggagttgcaggtgtcctgcaatgtgtgttcgttttaatcagcgggctgatctattggacatcacattcagaatcttgaagatgtaccacaggagaggaacataagtcatttgatgggttcatcccacactcgatccatcccctcgagtaagagataaattgatgcttgtataaatgtgtgttggttgtgcggtgaggctaagggccaagtgttaaaaacattcgtatcttgtttctacatattggtataatgactaatttgatatttcagtggaaagcttcaggagaatatatgtctttgtgagtaccgaaatgatgatgaaatgttttgttcgaaagggttttaaaaaa

SEQ ID NO: 3399 - DNA, 726 bp, Amsonia hubrichtii
atcactatctattgtgcaatacataattcgattgaattcgatttgttctgcagaaaagttgaaaagagcgcggtataaagaagaatttttggtgaatttggaaggaaattgaaatggatttgggtgagctatgggctatattcggaccaggagtcgccggtgcagtgttcggcaccggctggtggttttgggtggatgccgttgtttgcagctccgtcaaggtctctttcctccattacctcccaggaatttttgcttcgttggctgctttgatgttcaattgcgtgaggagggaggatattgactactcaccatatgaagaaggcgagtggaggttaaagctgtggctttttattgcatatgttgtttccttcgtctcattggcggcttccgtaggcctactgatacaagatgctctagtgacaactggcccatctgcatggacaggagttgcaggtgttctgcaatgtgtgttcatattggtcagcgggctgatttattggacttctcacacggaataaaatgcgataaaccaccggtttcaatgctttgctactgagatttgtttgctggatcttctttgcatgtatcttcttgacttgattgggcatgtgaattcaagattacaacttcctcttgtaaatgtatttcagtgggctaactgccaagttaaatcatcatataatttttagagatgtgaatgtgatgtgaaccttcatttcccct

SEQ ID NO: 3400 - DNA, 857 bp, Brassica juncea
tacgcggggagcattggttgttacaaagattgtcaaaattttcaccgcacgggcgttagatctgatttgaaaccgatcatctagcgatggacttggctgaactgtgggcgattttcgggccgggtttctccggggctgttttcggcaccggctggtggttttgggtcgacgccgtcgtgtgcagctccatccaagttcccttcctccactaccttcctggcatattcgcatctctcggagcattgatgttcaattgcgtcagaaaagaagatatcgattactcaccttatgacgaaggcgaatggaggttgaagctatggcttttcatagcgtatgtcgtggcgtttgtttccctagctgcttctgttggtttgctgattcaagattcggtcgtcaaaactgggccttccacctggactggtgtcgccggtgtctttcaatgtgtatttgtattgataagtgggctaatgtattggacatcacactccgagtaagtaggctcgcaggcaaatacttactccaacgcagatacatgtggtgacaacttacgaatgcctctcgtttcttcttctctgtaaattcttgtgtcttctctcgtccaacttggtgttgtgtgctagtttcctcttccattgcattggtgtatgtgtgtttgttttaaactttggctttctaagcttgggttaagtcgtagcttcttatgcagaggatggatatagaaatatcttgaactttgtgtgaatgttattaaacgcctcgtcgagctctgctccctctcttaattgcattggcgtgaaagattggcaacatttaccttgtattgtgattaaaagtgtagctacagcttcaaggcaaat

SEQ ID NO: 3401 - DNA, 666 bp, Brassica juncea
attaataggggcgaccgtgagtattcgttgtaacaaagattgttaaaattttcactgcacgggtgtcagatccgatctgaaaccgatcatctagcgatggacttagctgaactttgggcgattttcgggccgggtttctccggcgctgttttcggcaccggctggtggttttgggtcgacgccgtcgtatgcagctccatccaagttcccttcctccactaccttcctggcatattcgcctctctcggagcattgatgttcaattgcgtcagaaaagaagatatcgattactcaccttatgacgaaggcgaatggaggttgaagctatggcttttcatagcgtatgtcgtggcgtttgtttccctagctgcttctgttggtttgctgattcaagattcggtcgtcaagactgggccttccacctggactggcgtcgccggtgtctttcaatgtgtatttgttctcataagtgggctaatgtattggacatcacactcagagtaagtagactcgcaggcacgtacttactccaacgcagatatatgttgtgactacttacaaatgcctctcgtttcttcttctctgtaaattcttgtgtcttctctcgtccaacttggtgttgtgtgctagtttcctcttccattgcattggtgtatgtgtgttttg

SEQ ID NO: 3402 - DNA, 932 bp, Brassica rapa
aggttttggagttaaacaaaaaaaaggttttcggaaaattaataggggcgaccgtgagtattcgttgtaacaaagattgttaaaattttcactgcacgggtgtcagatccgatctgaaaccgatcatctagcgatggacttagctgaactttgggcgattttcgggccgggtttctccggcgctgttttcggcaccggctggtggttttgggtcgacgccgtcgtatgcagctccatccaagttcccttcctccactaccttcccggcatattcgcctctctcggagcattgatgttcaattgcgtcagaaaagaagatatcgattactctccttatgacgaaggcgaatggaggttgaagctatggcttttcatagcgtatgtcgtggcgtttgtttccctagctgcttctgttggtttgctgattcaagattcggtcgtcaaaactgggccttccacctggactggtgtcgccggtgtctttcaatgtgtatttgtattgataagtgggctaatgtattggacatcacactccgagtaagtagtctcgcaggcaaatacttactccaaggcagatacatgtggtgacaacttacgaatgcctctcgtttcttcttctctgtaaattcttgtgtcttgtctggtcaagctttgtgttgtgtgctagattcctccattgcagtggtgtgtgtttgttttaaactttgtcgagctaagcttggtttaagtagtagcttcctatgcagaggatggatagaaaaaaaacttcaactttgtgtgaatgttattgaacgccttgtcgagctctgctccgtctcttaattgcattcgcgtgaaagattggcaacatttaccttgtattttgattaaaattgtcgcaacagcttcaaagccaaattctttggttggtttttctagatactgaaactcaa

SEQ ID NO: 3403 - DNA, 805 bp, Brassica napus
aaattttcactgcacgggtgttagatccgatctgaaaccgatcatctagcgatggacttagctgaactttgggcgattttcgggccgggtttctccggcgctgttttcggcaccggctggtggttttgggtcgacgccgtcgtatgcagctccatccaagttcccttcctccactaccttcccggcatattcgcctctctcggagcattgatgttcaattgcgtcagaaaagaagatatcgattactctccttatgacgaaggcgaatggaggttgaagctatggcttttcatagcgtatgtcgtggcgtttgtttccctagctgcttctgttggtttgctgattcaagattcggtcgtcaaaactgggccttccacctggactggtgtcgccggtgtctttcaatgtgtatttgtattgataagtgggctaatgtattggacatcacactccgagtaagtaggctcgcaggcaaatacttactccaacgcagatacatgtggtgacaacttacgaatgcctctcgtttcttcttctctgtaaattcttgtgtcttgtctggtcaagctttgtgttgtgtgctagattcctccattgcagtggtgtgtgtttgttttaaactttgtcgttctaagcttggtttaagtagtagcttcctatgcagaggatggatagaaaaaaatcttcaactttttgtgaatgttattgaacgccttgtcgagctctgctccgtctcttaattgcattcgcgtgaaagattggcaacatttaccttgtattttgattaaaataaaattgtcgcaac

SEQ ID NO: 3404 - DNA, 714 bp, Catharanthus roseus
aatcttgtatctatagaattgatcttcgtagttccaaaaaaagagattctttgcgatcactatctgctctgcaatacataattcggttgaattccatttttagagcaaaaaagtagagacgaagtcagtgtaacgagaattttggtgaatccaaatggatttgggtgaattgtgggctatattcggaccaggggtcgctggtgccgtgttcggaaccggctggtggttttgggtggacgccgttgtttgcagctctgttaaggttcccttcctccactacctcccaggaatttttgcttctttggccgcattgatgttcaattgcgtgaggagagaggatattgactactctccttatgaagaaggcgaatggaggttaaaactgtggctttttattgcatatgttatttcctttgtctcattggcagcttcagtaggcctattgatacaggatgctctagtgaaaactggaccctctgcatggacaggagttgcaggtgttctgcaatgtgtttccattttggtcagtggactgatttattggacttctcatacggaataaggtgtgacgaggcaatgctttcagtgtagtagtagattcatttgctggatcttctttgcgtgtgatgtgaatcaacaactgcttcttgtaaatgtgtgtttcgtttgggctatcatctcatatcatgctaaaggttttaaggcaacataact

SEQ ID NO: 3405 - DNA, 890 bp, Cirsium arvense
gcgggggatgaattaaatagtcgtgtgctagtaaagttacagcgtagcaccgttgattcagatattgatcgatccattgatgattgtcgtcagctgattcataaacctttccaaacactttctttgtgttgttttcaattgtggaaagtagtggtagcacgcatctccgatacccaacaagccggagccgaatcgatccatggatttattggaattgtggggaatattcgggccaggcgttgccggcgccgtttttggagccggctggtggttttgggtcgatgccgtcgtttgcagttctgttaaaatctcgtttctccactatcttcctgggatttttgcatctttggctgctttgatgtttaattgtgttagaagagaggacatcgactactccccctatgaagagggtgaatggaggttgaagctttggcttttcttggcttatgtggtatcattcgtgtcgttggcagcatcagtagggttgttgatacaggatgcactcgtgccagaaggtccttcagcttggaccggaactgctggtgttttgcagtgtgtgcttgtgttaattagtggccttgtttattggacgtctcactcggagtaagaggagcctcggtggtttgtggttttcatcatcattgcagcacctgtacatgtccatgttcatgatccatctattggattgggattgtaaaacacaacctttgaagctaaagagtgattcagtggattattttttaacttgtcgtttatgacctttttggttaccgtttatctttgtgaatgtgattgtgccctttcggatttggtgtatcatgactttgtatatgaaatttactcttaaactttagtgccaaaaatgatgcatgaatcatatcgattactac

SEQ ID NO: 3406 - DNA, 758 bp, Taraxacum officinale
ctcctactgcttttctgcagtaaaagtacagtgcagcaagaaactcgttgatcgattataatcgtcagctaatcataaatcgtttcaacagtttgaaccctttgtttttcatcgcacaaagctaacaagcacgcatctccggtacgcaacaaacccgatctacggggagatagcgttcggattgatcaatggatttgtctgaattgtgggcaatatttggtccaggcgttgccggcgccgtttttggagtgggttggtggttttgggtcgacgcagtcgtatgcagttctgttcaagtctcgtttcttcactacctccctggaatatttgcatctttggctgctttgatgtttaattgtgttagaagggaggacatcgactactctccctatgaagaaggagaatggaggttgaagctttggctattcctggcatatgtcgtgtcatttgtgtcgttggcagcatcagtggggctgttgatacaagatgcacttgtgcccgaaggcccttctgcttggacaggaaccgcgggtgttttgcaatgtgtgcttgtcttgattagtgggcttgtttattggacatctcattcagagtaacacgccaatcaaagggagacattccaagtcacagtattgtaaaaacaaagtgtctgaagtgaaaatcattgacccaattatttttgtttatcacctttgcgtctctgctgttttttaatgtgtgtgttcatctttggtatattaaataaaatctcaaaatgc

SEQ ID NO: 3407 - DNA, 836 bp, Eschscholzia californica
aaacggcatctgttcgtatcaaataagctactacctcgttggaattgccttgaaagacattagaaatctctccccccagaggaaaataccaagtactagtagtattttatcgaccatcttcttcctctatctatttctctcactaaaatcaatttgaattctagagcgagagagaaaaagaatggatctaggagaattgtgggcgatctttggtcctggattttctggtgctatttttggtgctggatggtggttttgggtcgacgctgttgtttgtagctccgttactgtctctttcgttcactacctccctggaatatttgcttccctagcggctctgatgtttaattgcgttagaaaagaagatattgattattctccttatgaagaaggagagtggagattgaagctttggctattctttgcatatgttgtttccttcgtgtctctggcggcatccgtaggtcttctggtgcaagattcagttgtgaaaaccggtccttcagtgtggacgggaacagctggtgttttgcagtgtgtatttgtcttgatcagtggattggcttactggacatcacattcagagtaattcgaagaattcgaaaatacatgattcgggaagaaggcatctttataatgttatataggtatgcatcaaagttggtcgaaattcaagatatagtttattgtaaatgtgttcatggggggattattcccactttttatttagtattggtggtgtgtgtgagtggggtgagtgttcctgatgtttcttcttgcaaatggtccaaagtttgttggatgtacaagtttatcagtctttattggtgtttgac

SEQ ID NO: 3408 - DNA, 920 bp, Euonymus alatus
aagaaacaattggggaagatattgtactccggaaggaaggaaggaagcagaagcaatttacagttggtgaacaggctgctgagactatcagactcagtgtctcagccataaaagaacctaaacgatccggcggagtagacatatggatttagctgaagcgtggccgattttcgggccaggtgttgcaggaattgtgtttggtgccggttggtggttctggatcgacgccgtcgtttgcagctctgttgctgtttctttcgttcactaccttcccggcatatttgcatcgattgcggctgtgatgttcaattgtgttagaaaggaggacatcgattattctccatacgacgaaggggagtggaggttgaagctttggcttttctttgcttatgttgtatcattcgtctctctagcagcctcagttggcctattaatacaagattcactcgtgaaatctggtccttcatcctggactggaactgctggtgtcttgcagtgcgtgtttgtgttgattagtggactgatttactggacttcacattcggactaaattgtgttgatagaattccaagtataccttccattcggagcttcagattgcagatgaggatcgagaatgtacgttgtttcaccttatctatcaaatgtgaccaaaaagagcaaaattaaaaaaaaaaatcctgtaaatgtgtatgctgcggtgaaaatcattagcaactttgtgatggtggtgtatatgctttatttactccaatttctgacattttagtttgttgtgtttcgacactctcggtttatttatacttggcactccatgtaggacgccttgtttaatggcttctatatcatgaggcagttaaatgtttgagcactccgaacagcagattttctatcgaaaatatactatagccttaaataaa

SEQ ID NO: 3409 - DNA, 845 bp, Euonymus alatus
ggaagaaacaattggggaagatattgtactccggaaggaaggaaggaagcagaagcaatttacagttggtgaacaggctgctgagactatcagactcagcgtctcagccataaaagaacctaaacgatccggcggagtagacatatggatttagctgaagcgtggccgattttcgggccaggtgttgcaggaattgtgtttggtgccggttggtggttctggatcgacgccgtcgtttgcagctctgttgctgtttctttcgttcactaccttcccggcatatttgcatcgattgcggcgctgatgttcaattgtgttagaaaggaggacatcgattattctccatacgacgaaggggagtggaggttgaagctttggcttttctttgcatatgttgtatcatttgtctctctagcggcctcagttggcctattaatacaagattcactcgtgaaaactggtccttcagtctggacaggaactgctggtatcatgcagtgtgtgtttgtgttgatcagtgggctgatttactggacttcgcactcggagtaaattgtgttgatagaattccaaaatagacttgccatttggagcttcagatgtggatgagggagcgagaatgaacgtcgtttcaccttatctatcaaatgtgaccaaaagaaaaacattcctgtaaatgtgtatgctgtggtgaaatatttgcaaatttgtgatggtagtgtatatgctttatttcctccatcttggcttggtttctgccattttagtttggggtattgagcactatatctttatttgtactcaagttattcagattcaataccaactattgcaaaccttattac

SEQ ID NO: 3410 - DNA, 758 bp, Unknown
  Sequence found in Organisms: Euphorbia peplus, Euphorbia esula
aagaggacgacgaacggaagcaactggagcctggagagggaaaatccctaatctcatcaacagtttaaagtcagctgcaacttcgatcgagaccttcaataattcgtcgctaattattgtgcaaataaagtaaataattattcggtaaagaggccgggatatggatttgcaagagttatgggcgatattcgggcccggcgtcgcgggaacaattttcggggccggttggtggttctggattgacgccgttgtttgtagttccgtcgcagttccatttgttcactaccttcccggcatttttgcttctattgctgctttgatgtttaattgtgttagaaaggaggatattgattactctccttatgaagaaggtgaatggagattgaagctttggcttttctttgcctatgttgtatccttcgtgtctctagcggcttcagtgggcttattgatacaagattctattgtcacaactgggccttcagtctgggcaggaactgcaggtgtcttgcagtgtgtgtttgttttgatcagtggacttatctattggacttcacattcggaatgaaattctcagcaaatcagtacatatgccgttgagagctcgaatttgcatgtaaggttttacatttttaatccgttgggacgaaatagacgccccttgtacatgtttatactgtctaagtcttaacatattgactatattgagttgccgatcaaatcttgagcatcaatactaaggcccatataacttttct

SEQ ID NO: 3411 - DNA, 758 bp, Fagopyrum esculentum
agagagagagaaatctataactcacaaaaggcagaagagaagaggggaggaaagggcagcgccgttgccactttttggaagctgattttgtggtgatcaatggatatttccgaattgtgggcgatcttcggtcctggcgtcgccggtgccgtctttggtgccggctggtggttttgggtcgacgccgtcgtttgtagttctgttgcaatttccttcgttcactatctcccaggcatatttgcttctctggcggctttgatgttcaattgcgtcaggaaagaggatatcgattactctccatacgacgaaggagaatggaggttgaagctttggcttttcctcgcatatgttgtatcttttgtgtctcttgcggcttcagtagggctactgattaaagatgcacttgagacatctggtccttcagcttggacgggcactgcaggtgtcttgcaatgtgtgtttgtgttaatcagcggccttgtctattggacatcacattcagatcaaggtggcaatgcatggtactgaagaatgaatgctgtgttatattttgccatttctcgtgtaatatgtggatcgagtttcagttggaacttggtgggggagtatgtcatatgtaatgcttgtaacatacgatttgatcaaagcaattggtattcaattgtggcctctgatgatcgttgcttgaataatttggctggactagatttcaattgtatttgtctgcctctcaattaaggcctctgatgttcttctac

SEQ ID NO: 3412 - DNA, 1555 bp, Actinidia deliciosa
  misc_feature (36)..(36): n is a, c, g, or t
  misc_feature (749)..(749): n is a, c, g, or t
  misc_feature (752)..(752): n is a, c, g, or t
  misc_feature (754)..(754): n is a, c, g, or t
  misc_feature (759)..(759): n is a, c, g, or t
  misc_feature (1263)..(1263): n is a, c, g, or t
aaaccaatatgccaacttattaaatgttgatccatntacaggcaacacatcaggttgcaataaaattatttcagaaatctgaggtgaataagctagaaaggcttcaatcttttagccaaagaaatgttaaaacaaaaaagagaggaattacgaaaaaggaaacaaatagaaatgtgctcctcaaaaccttaagaataattacttcacaatcaaatacaacacggttctgaataagtttactttgtggatatcattttggtccaacgagcaaactcgagcaaaacaattatcagcccccaaaaagatacccagctgcttggtcttcattaccatcaaagaattttagagcttgtatcactgcctctctttcaaaccctagctcgattagcctggagacctttgcttcaaattccactccctgtggcaagtttggcgcactaccagaagaattactcccagttcgtataccactattctcccttgttccaggtgtaccttgggctcctgagcttgagacttcctttaacttcctctcctcatccaggtaatgagatggaatgtctttttctggcaaaaagggtactgaaacctctcctccaccaactctcaagacgttctccttcaaatcaatcatgcactggtgcttacgaagcatatccagcccgaaaaggaaatccatattaggagaatccagtaccaagaaggaacaagggtaaaatatattcccaatcttgattggagcaacatgnatncncctantatctccaactgaccaactccatgagccattcccttataacgttgatccaagagcctcaacagcccacagcgctccctcgtgccgaattcggcacgaggctcttctagaaagatctctattctctctctctcattttctaatagtgcaatccttcaactggcatggatttgacggagctgtgggcgatctttggacccgccgttgcgggtgcggtcttcggcgccggttggtggttttgggtcgacgccgtcgtctgcagttccgttcaggtctccttcctccactatcttcccggtatatttgcgtctttggcggcgttgatgttcaattgtgttaggagggaggacattgactactctccctatgaagaaggcgagtggaggttaaagctttggcttttccttgcttatgttgtatcattcgtctctctagcggcttcggtggggctattgatacaagatgcacttgtgacaactggcccctcagcgtggacaggaactgcnggtgttttgcagtgtgtttttgtgttgataagtgggttgatttattggacttctcacatagagtaggtaggggagtgcgttggaatgttactgctgcagatgaaatcatcatttgggattcttcttccgtgcatgtatcactttagtcattagtcatggagtgaaggtagcgtcagctggtgtaaatttgtgtatcaatctgaaggattcaactgttggtccaaagaaaattaattgccccgtctcttttgagttaagataattcatcctcgttttgttattgtactacact

SEQ ID NO: 3413 - DNA, 944 bp, Lactuca sativa
aaaggcacaaggaaacttaggggcctttcggacaaatatgtgagagttgagggccaaatagtgtcattctaaatacccatatgtaactttccatgatagatgttactactgctgaagtgcttatctgctagtaaaattacagcgcagcaagaaaatcattgatcgattataatcgtcagctaatcataagccttttcaacaatttcatcccttgttttccatcgcagaaagctgacgtagcacgcatctcctgtacccaacgagcccgacccacggggagatagcgttcgaatcgatcaatggatttgtctgaattgtgggcaatatttggtccaggctttgccggcgccgtttttggagccggctggtggttttgggtcgacgccgtcgtttgcagttctgtgcaagtctcgtttctccactacctacctggaatatttgcatctttggctgcgttgatgtttaattgtgttagaagagaggacatcgactactctccctatgaagaaggtgaatggaggttgaagctttggcttttcctagcatatgttgtgtcatttgtgtccttggcagcgtcggtaggcttgttgatacaagatgcacttgtgcccgaaggtccttctgcttggacaggaactgcaggtgttttgcaatgtgtgcttgtcttaattagtgggcttgtttattggacatctcactccgagtaagaggaggaatgagtgaagggaaacatttgtggttttgcgtgttaaaatgttcttgctcttgtatatgtatgtggcactgttgatgatccaagcaacagatacatagtaaaacacagtgtttaaagtgagtgattgaccgaattattttacacttgtttatatgaccttccttacctttttggttatcgtttatctttgcttctcaggtactttttaatgtgtttgtgtttgtgatca

SEQ ID NO: 3414 - DNA, 955 bp, Raphanus sativus
  misc_feature (143)..(143): n is a, c, g, or t
atgggcttcggtctagttgacgtgtgtctaaactcgagtctcgatcaaaaaccaccaaacaataatatctctctaaacaggttttcgataaattaacaagggcggccgtgagtattggttgttacaaagatttgtcaaaaganttcactgccacgggggtgttagatccgatccgatctgaaaccgatcatctagagcgatggacttggctgaactctgggcgattttcgggccgggtttctccggagctgttttcggcacaggctggtggttttgggtggacgccgttgtgtgcagctccatccaagttcccttcctccactatctccctggcatattcgcatctctgggagctttgatgttcaattgcgtcagaaaagaagatatcgattactctccttacgacgaaggcgaatggaggttgaagctatggcttttcatagcgtatgtcgtggcgtttgtttccctagctgcttctgttggtctgctgattcaagattccgtcgtcaaaactggtccttccacctggactggtgtcgccggtgtctttcaatgtgttttcgtattgataagtgggctaatgtattggacatcacactcggagtaagtagacttgcaggcacatactccaacgcagatacttgtggttacaacttacagatgcctcgttttcttcttctctgtaaattcttgtgtcttgtttggtccagcttggtgttgtgtgctagattcctccattgccttggtgtgtttgttttaaactttgtcgttctatgcttgggttataagttgttgcttcttatgtagaggatggatagataataatcttcaactttatgtgaatgttatgggacgccttgcccgtgtctgcacagtctcttaattgcattggagtgaacgattggtaacatttaccttttattttgattaaaagtgtcgcaacagtttcaagcca

SEQ ID NO: 3415 - DNA, 753 bp, Raphanus sativus
gggcggccgtgagtattggtggttacaaagatcgtcaaaattttcactgccacgggcgttagatccaatccgatctgaaaccgatcatctagcgatggacttggctgaactctgggcgattttcgggccgggtttctccggagctgtattcggcacaggctggtggttttgggtcgacgccgttgtgtgcagctccatccaagttcccttcctccactatctccccggcatattcgcatctctcggagcgttgatgttcaattgcgtcagaaaagaagatatcgattactctccttacgacgaaggcgaatggaggttgaagctatggcttttcatagcgtatgtcgtggcgtttgtttccctagctgcttctgttggtctgctgattcaagattccgtcgtcaaaactagtccttccacctggactggtgtcgccggtgtctttcaatgtgtattcgtattgataagtgggctaatgtattggacgtcacactcggagtaagtagactcgcaggctcatacttactccaacgaagatacatgtggtgacaacttacatatgcctcgttttcttcttctctgtaaattcttgtgtcttgtttggtccagcttggtgttgtgtgctagattcctccattgcattggtgtgtttgttttaaactttgtcgttctatgcttgggttatataagttgttgcttcttattgtagaggatggatagaaaataatcttgaactttatgtgaatgttatgg

SEQ ID NO: 3416 - DNA, 920 bp, Raphanus sativus
gttatgggcttcggtctgattgacgtgtctaaactcgagtctcgatcaaaaaccaccaaacaataatatctctctaaacaggttttcgataaattaacaagggcggccgtgagtattggttgttacaaagatttgtcaaaaaatttcactgccacgggggtgttagatccgatctgaaaccgatcatctggcgatggacttggctgaactctgggcgattttcgggccgggtttctccggagctgttttcggcacaggctggtggttttgggtggacgccgttgtgtgcagctccatccaagttcccttcctccactaccttcccggcatattcgcatctctcggagctttgatgttcaattgcgtcagaaaagaagatatcgattactctccttacgacgaaggcgaatggaggttgaagctatggcttttcatagcgtatgtcgtggcgtttgtttccctagctgcttctgttggtctgctgattcaagattccgtcgtcaaaactggaccttccacctggaccggtgtcgccggtgtctttcaatgtgttttcgtattgataagtgggctaatgtattggacatcacactcggagtaagtagacttgcaggcacatactccaacgcagatacttgtggttacaacttacagatgcctcgttttcttcttctctgtaaattcttgtgtcttgtttggtccagcttggtgttgtgtgctagattcctccattgccttggtgtgtttgttttaaactttgtcgttctatgcttgggttgtaagttgttgcttcttatgtagaggatggatagataataatcttaaactttatgtgaatgttatgggacgccttgcccgtgtctgcacagtctcttaattgcattggagtgaacgattggtaacatttaccttttattttg

SEQ ID NO: 3417 - DNA, 794 bp, Raphanus sativus
gggcggccgtgagtattgcttgtcacaaagattgtcaaaattttcactgccacgggcgttagatccgatccgatctgaaaccgatcatctggagatggacttggctgaactctgggcgattttcgggccgggtttctccggagctgtattcggcaccggctggtggttttgggtcgacgccgttgtgtgcagctccatccaagttcccttcctccactacctccccggcatattcgcatctctcggagctttgatgttcaattgcgtcagaaaagaagatatcgattactctccttacgacgaaggcgaatggaggttgaagctatggcttttcatagcgtatgtcgtggcgtttgtttccctagctgcttctgttggtctgctgattcaagattctgtcgtcaaaactggtccttccacctggactggtgtcgccggtgtctttcaatgtgtattcgtattgataagtgggctaatgtattggacatcacactcggagtaagtagacttggaggcacatacagatacatgtggtgacaacttacgaatgcctcgttgcttcttctctgtaaattcttgtgtctttgtctggtccagtttggtgttgtgtgctagattcctccattgcattggtgtgtttgttttaaactttgtcgttctatgcttgggttaagttgttgcttcttatgtagaggatggatagaaaataatcttgaactttgtgtgaatgttatggaacgccttgtcgaggtctctgctccgtctcttaattgcattggcgtgaaagattggta

SEQ ID NO: 3418 - DNA, 610 bp, Raphanus sativus
gtcacaaagattgtcaaaattttcactgccacgggcgttagatccgatccgatctgaaatcgatcatccagcgatggacttggctgaactctgggcgattttcgggccgggtttctccggagctgtattcggtaccggctggtggttttgggtggacgccgttgtgtgcagctccatccaagtgcccttcctccactatctccccggcatattcgcatctctcggagctttgatgttcaattgcgtcagaaaagaagatatcgattactctccttacgacgaaggcgaatggaggttgaagttatggcttttcatagcgtatgtcgtggcgtttgtttccctagctgcttctgttggtctgctgattcaagattccgtcgtcaaaactggtccttccacctggactggtgtcgccggtgtctttcaatgtgtattcgtattgataagtgggctaatgtattggacatcacactcggagtaagtagacttgcagggcacatactccaacgcagatacttgtggttacaacttacagatgcctcgttttcttcttctctgtaaattcttgtgtctttgtctggtccagcttggtgttgtgtgctagattcct

SEQ ID NO: 3419 - DNA, 725 bp, Helianthus annuus
tgtgttgtatcatacaagagttgaaacaacacgcatcctcgaaacccaacaatactcgatcaatggatgtgtcggaattgtgggcgatattcggaccaggtgtcgccggcgccgtattcggtgctgggtggtggttttgggtggacgccgtcgtttgcagtgctgttaaagtctcctttcttcactaccttccggggatatttgcttctttggctgctttgatgtttaattgtgttagaagagatgatattgattattctccttatgaagaaggcgaatggaggttgaaactttggctttttcttgcgtatgttgtgtcattcgtctcattggcggcatcagtagggttgttgatacaagatgcacttttgcccgaaggcccttcagcgtggaccggaaccgccggtgttttgcagtgtgtatttgtgttaattagtgggcttgtttattggacatctcattcggagtgaagtgcggaggtcagttgtggttttgcttcatcgcatttgtgaaatcatgcgtgtaaatgtgttgatgaatccaagtaacggtatgggatagtgatatagaccttttgagaaagtgatttgactatgagttatctttcaactgttgttttatcctgtatgttgtttaaatcaaacaaaaattccgaattagggcatatgggttcatataccttcccacacgagtcgtttaaatcaaacatatggttcgtaatgtaa

SEQ ID NO: 3420 - DNA, 703 bp, Valeriana officinalis
agtagaacatatctgatgatctgatcggaagaaacgtattccgatcttccacttctgaatacatctacactcgatcatcgatcttttcccgtataacaaaaactatacatagtcttaaggatccagtaaagccatggatttggctgagctcttcgtaatcttcggacctggagtatccggtgcagtattcggtgctggttggtggttctggatcgacgccgtcgtttgcagcgctgttaaagtctcattcctccactatctgccaggaatatttgcatccttggcggctttgatgtttaattgtgttaaaagggaggatattgattactctccgtatgaagaaggcgaatggaggttgaagctttggctatttatagcatatgtggtatcatttgtatcattagcagcttcagtcggactcttgatacaagattctcttgtcacaaccggcccttctgcttggactggagttgctggtgttcttcagtgtgtctttgtgctcattagtggactgatttattggacttctcatgctgagtgagcttttagtgtgtcgaatgtaccgctagcgtttcttggaaataggcaaatatatagtgccctttgtgtaaatgtaattttatttcatatttataaaatgtactatacttttatgctgcgttttatcgtgttttgggcgtcacaaagatttgtgagttaattt

SEQ ID NO: 3421 - DNA, 691 bp, Valeriana officinalis
tgatcggaagaaacgtattccgatcttccacttctgaatacatctacactcgatcatcgatcttttcccgtataacaaatactatacatagtcttaaggatccagtaaagccatggatttggctgagctcttcgtaatcttcggacctggagtatccggtgcagtattcggtgctggttggtggttctggatcgacgccgtcgtttgtagcgctgttaaagtctcattcctccactatctgccaggaatatttgcatccttggcggctttgatgtttaattgtgttaaaagggaggatattgattactctccgtatgaagaaggcgaatggaggttgaagctttggctatttatagcatatgtggtatcatttgtatcattagcagcttcagtcggactcttgatacaagattctcttgtcacaaccggcccttctgcttggactggagttgctggtgttcttcagtgtgtctttgtgctcattagtggactgatttattggacttctcatgcagagtgagctttttgtgtgtcgagtgtaccgctagtgtttcttggaaataggcaaaaatatagtatcctcggtgtaaatgtaattttatttcatttttacaaaatgtatacttttatgctacgttttatcgtgttttgggcgttacaaagatttgtgagttaatttgtcgatatttgg

SEQ ID NO: 3422 - DNA, 635 bp, Vinca minor
ccgttgaaaagttgaaaaaacccgcaataatacatagaatttaggtgatcgggggaggaaattggaatggatttgggtgagctatggactatattcggaccaggattcgccggtgcggttttcggagccggctggtggttttgggtcgacgccgttgtttgcagttccgttaaagtctccttcctccattatctcccaggaatttttgcttctttggctgctttgatgttcaattgcgtaagaagagaggatattgactattcgccttatgaagaaggcgagtggaggctaaagctgtggctttttattgcatatgttgtttccttcgtgtcattggcggcttcagtaggtctactcatacaggatgctctagtgaaaactggcccctctgcatggacaggagttgcgggtgttctgcaatgtgttttcattttggtcagtggactgatttattggacttcgcatacggaataaaatgggaagaaccggtgcttttaatgcttcggtgtagatttatttgctggatctttgaatgtatcttcttgatgacctgatttggtatgtgaattcaagagtacaactgcctcttgtaaatgtatttcattggtgtagctgcaaagctaaaagcatgaata

SEQ ID NO: 3423 - DNA, 607 bp, Centaurea maculosa
gccgaatcgatccatggatttattggaattatgggggatattcggtccaggcgtcgccggcgccgttttcggagccggctggtggttttgggtcgacgccgtcgtttgcagttctgttaaaatctcctttcttcactatcttcctggaatatttgcatctttggctgctttgatgtttaattgtgttagaagagaggacatcgactactccccctatgaagagggcgaatggaggttgaagctttggcttttcttggcatatgtggtatccttcgtctccttggcagcatcagtggggttattgatacaggatgcactcgtgccagaaggcccttcagcttggactggaactgctggtgttttgcagtgtgtgcttgtgttaattagcgggcttgcttattggacatctcactcggagtaagaggagccaagagagttggagtgatttgtggtttttcatcgtcgtattgttaaatcgcatctgtacatgtccatgtttcatctatgggattgcttatggttcatctttgtgaatgtgatagtaccctttattacccatttgaatttggtgtatcatgagtttgtatatgaaatcaatcaaatttac

SEQ ID NO: 3424 - DNA, 818 bp, Centaurea maculosa
gccgaatcgatccatggatttattggaattgtgggggatattcgggccaggcgtcgccggcgccgtttttggagccggctggtggttttgggtcgacgccgtcgtttgcagttctgttaaaatctcctttctccactatctccctggaatatttgcatctttggctgctttgatgtttaattgtgttagaagagaggacatcgactactccccctatgaagagggcgaatggaggttgaagctttggcttttcttggcgtatgtggtatccttcgtctccttggcagcatcagtggggttgttgatacaggatgcacttgtgccagaaggcccttcagcttggaccggaactgctggtgttttgcagtgtgtgcttgtgttaattagcgggcttgcttattggacgtctcactcggagtaagaggagccaagagttggagtgatttgtggtttttcatcatcgtattgttaaatcgcatctgtacatgtccatgttccatctatggggattgcttatggttcatctttgtgaatgtgatagtaccctttattacccatttgatttggtgtatcatgagtgtgtatatgaaatcaatcaaatttactttcatttttagtgccaaaaaagaaaaaagtaccgactgctaacagatcaagcaatgagcaaaaattaaatctataaaccgagattctgaagtaaaatcagatctcgaacacaaatcattagcttcaaacacacacaataacatcgatttcaagttacgtaaaccaaattacatcaaatgaaaacactaatcgctagatccagcagatatcga

SEQ ID NO: 3425 - DNA, 921 bp, Prunus persica
aacggaagcttcaagcatcgactagaaacagagtggagagcaattcacagttgacgaaaagcaaaaaagaaagcagccatcgggtttttcgaacagtccggtagacggcacccgatccggtttgtcttcgcgaaccaataaccaccgaagcaagttcaagcggcgtcgtttcatatggatgtgtcggagctttgggcgatcttcgggccaggcgtagccggagccgtgttcggagccggttggtggttctgggtcgacgccgtcgtttgcagctccgtcaaggtctccttcgtccactacctccctggcatatttgcatctttggcggcgttgatgttcaattgcgttaaaaaggaagacattgattactctccgtacgaagagagcgagtggaggttgaagctttggctgttcattgcctatgttgtagcctttgtatctctagcggcatcggtgggtttgctaatacaggattcacttgtgacaactggtcctccagtgtggacaggagttgctggtgtcttgcaatcagtttttgtgttgatcagtgggctaatttattggactgctcacccggagtaagtagggatgtatgagcggtaccttttcctttggaacctggatttcacaactgagggaattggctgtgtatgtgtatcatttaacttcttcaaacagttggaccaaggagacagaaagatgaatggtagatagggttcgaattccatttccatagttaatatggaaggtatttttcaccgttgtaaatgtttatattgtcccaccagtcttgtttaaattgctaaaactaaggcaatgcctttttgccttatcaaaatctgagtttgtttgcctgtctttcttacgttaaagcacaaccccgcatgatgtgagggcttatgataatacatagggtatatc

SEQ ID NO: 3426 - DNA, 702 bp, Ambrosia trifida
aactttattttcatggttaaatacaagcttctgatcaatttcagctgttgtcttcaatcatagaaagctgaaacagcacgtatcctcgatacccaacaactcataatcgataaaccaatggatgtatctgaattgtgggcgatattcggaccaggtgtcgccggagcagtgtttggagctgggtggtggttttgggtggacgccgttgtttgcagtgctgttaaagtctccttccttcactaccttcctgggatatttgcatctttggctgctttgatgtttaattgtgttagaagagatgatattgattactctccctatgaagatggcgaatggaggttgaaactctggctttttctagcttatgtcgtatccttcgtctccttggcagcatcagtagggttgttgatacaagatacactcatgcctgaaggcccttcagcatggacaggaactgctggtgttttgcagtgtgtatttgtgttaattagcgggcttgtttattggacatctcattcagagtgaagtgccgaggtcagttgtggttttgcttcatcgcatttgttaaatcatgcgtgtacatgtctgtgttgataaatccaagtaacggtatgagatagtgaaatagaccttttgaggttaaaagtgatttgagttgagttatctttcaactgatgtttcaaccttgtagtgttgtttatg

SEQ ID NO: 3427 - DNA, 629 bp, Arabidopsis lyrata
atccaattggagacgacgatcatatcatcgagcgatggatttggcagaattgtgggcgattttcggacccggattctccggcgccgttttcggaaccgggtggtggttttgggtcgacgccgtcgtgtgcagttccatccaagttcctttcgtccattaccttcccggcatattcgcatctctcggagctttgatgttcaattgcgtcagaaaagaggatattgattactctccttatgacgaaggcgaatggagattgaagctatggcttttcatagcgtatgtcgtagcatttgtttccttagctgcttctgttggcttgctgattcaagattcggttgtgaagactgggccttcgacttggactggtgtggctggagtttttcaatgcgtgtttgtattgataagtgggcttatgtattggacatcgcactcagagtaagtaaacgcacagactcatacttcatctccgacccagatacgtgatgtgacaacttgcaagttcctctcttttctctactctgtaaattcatgtgtcttgtctcatcagctcggcgttgtgtgcgagatttctctgttgcatcagtgtgtgtttgtgttaaactttgtggtaatgttattgaaaatac

SEQ ID NO: 3428 - DNA, 689 bp, Arabidopsis thaliana
atcaacaataaagtttttatttatctatctatccaattggagacgaatcatatcgagcgatggatttggcagaactgtgggcgattttcggacccggattctccggcgccgttttcggaaccgggtggtggttttgggtcgacgccgtcgtttgcagttccatccaagttcccttcgtccattaccttcccggcatattcgcttctctcggagctttgatgttcaattgcgtcagaaaagaagacattgattactctccttacgacgaaggcgagtggagattgaagctgtggcttttcatagcgtatgtcgtagcatttgtttccttagctgcttctgttggcttgctgattcaagattcggttgtgaagactgggccttcaacttggactggtgtggctggtgtctttcaatgtgtatttgtattgataagtgggctaatgtattggacatcgcactcagagtagcgcacaggcacatacttcatctccgactcagattcatactgtgacaacttacaagttcctctcgtttctctactatgtaaattcctgtgtcttgtcttgtcaccttggcattgtgtgcgagattcctctgttgcatcagtgtgtgtttctgttaaaactttgtgtgaatgttattgaaaatactccaaatcaatcagttgtccaaagagaacgcaaataggc

SEQ ID NO: 3429 - DNA, 1348 bp, Aristolochia fimbriata
gggggggtcgtaaaagtatcagagtctagagccgggaggtggtagcctgctgtggagccttcgctaaagccttctcctcctgttaggagactgtagcttccatctggcttctcctccacttctgctcgtgtcccctcttctttcattaaaattagtaaattacgagttataatcattcaattattgtagttttttttttttttaacttcataacctgctttccggcgagccgcatctctcgggttctgctcctgagggcatggatttcgcagacctgtgggcgatcttcggtcccggcgttgcaggagccgttttcggggcgggatggtggttctgggtcgacgccgtcgtctgcagcgccgtcaaagtttccttcgtccattatttgccggggatttttgcctctcttgcggctttgatgttcaactgcgtcaggaaggaagacattgattactccccctacgaggaaggcgagtggagattaaagctctggttattccttgcatatgttgtttccttcgtttcacttgccgcatctgttggcctactgattcaagatgccctcacctcttctggtccttcagcgtggacaggaactgctggtgttttgcagtgtgtgcttgtattaatcagtggattgatgtattggacctctcattcagagtgatattttggaagaagggagcagaacttgtacaaaaaatgaatcaggaagatacctttgatgtgtgtaattctttctgctaatgtttcctgtgtgggttgctttagttaccatcctcggtctaacgaattgtggaaagaacagagaaatcttgtgtggatatacttgaaatcattttaatcaggagaatcatgaagtctattattgtccctgttgttctgaaatgtgctacactaggcactgatgggccattccaatccaggcaaaacccagttgtcaaacactctgcttgccactcaaatgtaaggtattccagatgctccatccggtaatgaagcaagaagtgaacggacagcgtactaatccttagtttcagaagatccaaggttttgagtaaggcatttgtgactctctaggtttattatgtttaactgctctcaaatgacccttacaactttctcagaacaaaatggtatcatttgttcgaaataaattgtaaacttgaaagtttaagcgtgtgttgcacatttacaacatcaaattcagcaatggacttagcaaatgtcattcatcaacaactcaacacaacaggggtgttttcagctgagttgggattacctggatataaatttagtattttggtgttgaatgtagcatttgaactctaattttggtattttaaaa

SEQ ID NO: 3430 - DNA, 912 bp, Brassica oleracea
cgtccgcccacgcgtccgcggacgcgtgggaaaattaataggggcgaccgtgagtattcgttgtaacaaagattgttaaaattttcactgcacgggtgttagatccgatctgaaaccgatcttctagcgatggacttagctgaactttgggcgattttcgggccgggtttctccggcgctgttttcggcaccggctggtggttttgggtcgatgccgtcgtgtgcagctccatccaagttccattcctccactaccttccgggcatattcgcctctctcggagcattgatgttcaattgcgtcagaaaagaagatatcgattactctccttatgacgaaggcgaatggaggttgaagctatggcttttcatagcgtatgtcgtggcgtttgtttccctagctgcttctgttggtttgctgattcaagattcggtcgtcaaaactgggccttccacctggactggtgtcgccggtatctttcaatgtgtatttgtattgataagtgggctaatgtattggacatcacactccgagtaagtagactcgcaggcaaatacttactccaacgcagatacatgtggtgacaacttaagaatgcctctcgtttcttcttctctgtaaattcttgtgtcttgtctggtcaagctttgtgttgtgtgctagattcctccattgcagtggtgtgtgtttgttttaaactttgtcgttccaagcttggtttaagtcgtagcttcctatgcagaggatggatagaaaaaaatcttcaactttgtgtgaaagttattgaacgccttgtcgagtgctccgtctcttaattgcattcgcgtgaaagattggcaacatttaccttgtattttgattaaaattgtcgcaacagcttcaggccaaattctttggttggtttttctagat

SEQ ID NO: 3431 - DNA, 794 bp, Vaccinium corymbosum
gggattacagagggtgctagaggagaggtcgcggggcagggggaaagcatcaataaaatgagttggatctctactaacatttgaggacgcacatgctggaatttcatacataaaccgaaactcctttctctccacagacacagtctctgatcgcagaagcagcatctgtgtttggaataagggaattaaaactacgagtggttgattaattgggatggattttggggagctgtgggcgatctttggaccagctgtcgcaggtgcggtcttcggcgctggatggtggttttggattgacgccgtcgtttgcagttccgtcgccgtctccttcctccactatctccctggcatttttgcgtctttggcggcattgatgttcaattgcgtgaggagggaggatattgactactccccctatgaagaaggcgagtggaggttgaagctttggcttttccttgcttatgttgtatcattcgtttctctagcggcttcagtggggctattgatacaagatgcactgactgacactggcccctcttcttggacaggaacagcaggtgttttgcagtgtgtgttcgtgttgatcagtgggttgatttattggacttctcattccgagtaattaagttggggagagggttactgttgcagaagcacaatgggtttctcgagttggcaaccagttacagaatgattgtattacatgtgatgtaaatgagtcctaacaatctgcaatatcaactgttgacaactttaaagttcatactgatttcctttgaaattaagatagttca

SEQ ID NO: 3432 - DNA, 843 bp, Centaurea maculosa
  misc_feature (64)..(65): n is a, c, g, or t
  misc_feature (68)..(68): n is a, c, g, or t
  misc_feature (74)..(74): n is a, c, g, or t
  misc_feature (88)..(88): n is a, c, g, or t
  misc_feature (140)..(140): n is a, c, g, or t
  misc_feature (471)..(471): n is a, c, g, or t
  misc_feature (825)..(825): n is a, c, g, or t
  misc_feature (827)..(827): n is a, c, g, or t
  misc_feature (830)..(830): n is a, c, g, or t
  misc_feature (833)..(834): n is a, c, g, or t
  misc_feature (836)..(836): n is a, c, g, or t
ggcgggggatttgcatttattaaataagttgtttttttttggagtgctagtaaagttacagcgnngcnccatcngagagatattcatngattgatgattgtcgtcagctgctgctgattgatttatagatacctttttcnaccaaaatttcttggctttttttttttcgatcgtattagtaagaaagtagtgtgatagatgattaatagccagccgaatcgatccatggatttattggaattatgggggatattcggtccaggcgtcgccggcgccgttttcggagccggctggtggttttgggtcgacgccgtcgtttgcagttctgttaaaatctcctttcttcactatcttcctggaatatttgcatctttggctgctttgatgtttaattgtgttagaagagaggacatcgactactccccctatgaagagggcgaatggaggttgaagctttggcttttcttggcntatgtggtatccttcgtctccttggcagcatcagtggggttgttgatacaggatgcactcgtgccagaaggcccttcagcttggactggaactgctggtgttttgcagtgtgtgcttgtgttaattagcgggcttgcttattggacatctcactcggagtaagaggagccaagagagttggagtgatttgtggtttttcatcgtcgtattgttaaatcgcatctgtacatgtccatgtttcatctatgggattgcttatggttcatctttgtgaatgtgatagtaccctttattacccatttgaatttggtgtatcatgagtttgtatatgaaatcaatcaaatttacttcatntnatncannanaaaaaaa

SEQ ID NO: 3433 - DNA, 554 bp, Cirsium arvense
agataccttttttccaacaaaaatttcttggcttgttttcgattcgatcgtagtaaagtaagccgaatcgatccatggatttattggaattgtgggggatattcgggccaggcgtcgccggcgccgtttttggagccggctggtggttttgggtcgacgccgtcgtttgcagttctgttaaaatctcctttctccactatctccctggaatatttgcatctttggctgctttgatgtttaattgtgttagaagagaggacatcgactactccccttatgaagagggcgaatggaggttgaagctttggcttttcttggcgtatgtggtatccttcgtctccttggcagcatcagtggggttgttgatacaggatgcacttgtgccagaaggcccttcagcttggaccggaactgctggtgttttgcagtgtgtgcttgtgttaattagcgggcttgcttattggacgtctcactcggagtaagaggagccaagagttggagtgatttgtggttttcgtcatcgtattgttaaatcgcatctgtacatgtccatg

SEQ ID NO: 3434 - DNA, 719 bp, Cleome spinosa
gtttcccattggggctttaacgagcgtttcgtagttttgacaataggcagagaagtaaaggcaaatcgaacggcgataagtcatcatcttcggttggatttgagaaaaacccagtggagaggattcatcgaaccatggatatgaccgagctatgggcgattttcggaccgggagtctccggagcggtgttcggagccggatggtggttctgggtcgacgccgtcgtctgcagctccgtccaagttccgtttgtccactatctcccaggcatatctgcgtctcttgcagctttgatgttcaattgcgtgaggaaagaggatatcgattactctccttacgacgatggcgagtggagattgaagctatggttgttcattacatacgttgtagcttttgtttccctagccgcatctgtcggattactgatacaagactcgcttgtgaaaactggcccgtcggcgtggactggtgtcgcgggtatctttcaatgtgtatttgtgttgataagtgggctaatgtattggacatcacactcggagtaagtcgtctttaccactggaacatgcggagaaaactgaatcaggaccatgtccatgtttactacatttgctgtaaacgttcgtttcttttcggcgtggtcctgttctcagctttgccgtctcccttccttcaattaaaaatttatcaagtcactaacgaacgctttttattcaaatata

SEQ ID NO: 3435 - DNA, 884 bp, Euonymus alatus
cggccgggggaagttcatggacgatgaagaaacaattggggaagatattgtactccggaaggaaggaaggaaccggaagcaatttacagttggtgaacaggctgctgagactatcagactcagcgtctcagccataaaagaacctaaacgatccggcggagtagacatatggatttagctgaagcgtggccgattttcgggccaggtgttgcaggaattgtgtttggtgccggttggtggttctggatcgacgccgtcgtttgcagctctgttgctgtttctttcgttcactaccttcccggcatatttgcatcgattgcggctgtgatgttcaattgtgttagaaaggaggacatcgattattctccatacgacgaaggggagtggaggttgaagctttggcttttctttgcttatgttgtatcattcgtctctctagcagcctcagttggcctattaatacaagattcactcgtgaaaactggtccttcatcctggactggaactgctggtgtcttgcagtgcgtgtttgtgttgattagtggactgatttactggacttcacattcggactaaattgtgtcgatagaattccaagtataccttccattcggagcttcagattgcagatgaggatcgagaatgtacgttgtttcaccttatctatcaaatgtgatcaaaaagagcaaaataatagtaaaaaaaattcctgtaaatgtgtatgctgcggtgaaaatcattagcaactttgtgatggtggtgtatatgctttatttactccaatttctgacattttagtttggagtgtttcgacactctcggtttatttatacttggcactgcatgtaggactccttgtttaatggcttctatatcatgaggca

SEQ ID NO: 3436 - DNA, 512 bp, Flaveria ramosissima
aacacgccggagcatcacaaagcattcaaatcagccaatggatttctctgaactgtgggcaatattcggacccggcgtcgccggcgctgttttcggagccggctggtggttttgggtcgacgccgtcgtttgcagctctgtcaaagtctcctttcttcactaccttcctggaatatttgcatctttggctgctttgatgtttaattgtgttaaaagagaagacatcgactactccccctatgaagaaggcgaatggaggttgaaactttggctttttctagcttatgttgtgtcgttcgtctcattggcagcatcagtagggttgttgatacaagatgcacttgtgcctgaaggcccttcagcttggacaggaactgctggtgtgttgcagtgtgtgcttgtgttaattagtgggcttgtttattggacatctcattcagagtaagagtgaaccttcatttcaaagcgccgtctgtgggtaattgtatttgttgaatcatgcgtgtacatgt

SEQ ID NO: 3437 - DNA, 745 bp, Guizotia abyssinica
  misc_feature (662)..(662): n is a, c, g, or t
agggatttggtcgattatcatcgtcggctaaccataaaccttttgatcaatttcgtctgttgtttctatcgtagaaagttgaaatcaaacgcacctctgataacctaagtagccggagcatctgaatcaatcaatggatttgtctgaattgtgggcaatcttcggaccaggcgtctccggcgcggttttcggagccggctggtggttttgggtggacgccgtcgtttgcagttccgttcaagtctcgtttcttcactaccttcctggaatatttgcatctttggccgctttgatgttcaattgtgttagaagagacgacatcgactactctccatatgaagaaggcgaatggaggttgaaactttggctttttctggcgtatgttgtgtctttcgtctcattagcagcctcagtagggttgttgatacaagatgcacttgtgcctgaaggcccttcagcttggacaggaactgctggtgtcttgcagtgtgttcttgtgttaattagcgggcttgtttactggacctctcattcggagtgaagccttcatttcaaggtgtcgtttgtggttttacgtaatcgcgtttgtttaatcatgcttgtacatgtatgtctggttttacgtaatcgcgttttcaagttaaaattgactgacaattatntttcagctgatgtttcttctgtggttcgttttgtattaaaaatgatgcaacataatattcaaattaaaagatttatgttttag

SEQ ID NO: 3438 - DNA, 564 bp, Platanus occidentalis
tcttcctcctgctgcttctgctggtgtcgagacccggtggtggtggtgttgtttgccttggctcgattgtagcattattcaagggatggatttgggggagctgttggcgatctttgggccgggcatcgcaggcgcagttttcggtgccggttggtggttttgggtcgatgccgtcgtttgcagttctgtcaaggtctccttcgtccattacctccccggaatcttcgcatcgctggccgctctaatgttcaattgcgttagaagagaagacattgattactctccctacgaagaaggagagtggagattgaagctttggcttttctttgcgtatgttgtatccttcgtgtctctagcagcatctgtgggcctactgatacaagattcacttgtgaaatctggtccttcagtctggacaggtgttgctggtgtcttgcagtgtgtgttggtgctgatcagtgggttgatctactgggcatgtcattcagactaaattcaggaattgagaaatctactatttggagcagaaaaaatacggtgaatcaactttcaatgcatgtatca

SEQ ID NO: 3439 - DNA, 1058 bp, Populus trichocarpa
gtaatcattctattatagacagcaaattaaacgcaattcataacagcctggaacttcaagcagcaacaacagtcaatccctaaccagcgtccagtgtttgtttgttttttcctttcttttcttaattttacatagtagccaaaaaaaaaaaggcaatcgagagagaggaaaatggatttaccggagctgtgggcaatcttcggtcctggagtcgctggcgcggtatttggcgcgggatggtggttttggatcgacgccgtcgtttgtggctctgttacagtctccgtcgttcactacctccctggcatatttgcatctattgcttctctgatgtttaattgcgttagaaaagaggatattgattactctccttacgaggaaggcgagtggagattgaagctctggcttttctttgcatatgttgtctccttcgtctctttagcagcatcagtgggcttattgatacaagattccattgtcaaaactggcccttcagtgtggacaggaactgctggcgtcttgcagtgcgtgtttgtcctgatcagtgggctaatttgttggacttcatactcggaatgagttatggtgatatgtgctgcctgttggagcttggaattatgacagagggagttggctgtgtatgtttcagtaattattcaatccacaggacagaacatagttccacctcgtgcaaatgtttatcctgtgctcccattctcgagcataaaaaaaaaaaacccgtgcaacttttctggaatttgagatgtttggtacataagaaagtgaaatctcataaactctggtgtttcttcaatgctgcctttgtgcagaagccaaattcaattgttttcaggttggtcacacgaatcattagtctcagttagaaccgagaatgctgaaaatagccatgtccactttcaatcctccttggatctcatgctcttattcttgtctgttccctgttttgtaatgtcgtttttgttcttgttatggccttttcatgtgaattctaattgctggtatctttttcaaagctgcaacttcatattcgacagcca

SEQ ID NO: 3440 - DNA, 1060 bp, Populus trichocarpa
gtaatcattctattatagacagcaaattaaacgcaattcataacagcctggaacttcaagcagcaacaacagtcaatccctaaccagcgtccagtgtttgtttgttttttcctttcttttcttaattttacatagtagccaaaaaaaaaaaggcaatcgagagagaggaaaatggatttaccggagctgtgggcaatcttcggtcctggagtcgctggcgcggtatttggcgcgggatggtggttttggatcgacgccgtcgtttgtagctctgttacagtctccgtcgttcactacctccctggcatatttgcatctattgcttctctgatgtttaattgcgttagaaaagaggatattgattactctccttacgaggaaggcgagtggagattgaagctttggcttttctttgcatatgttgtctccttcgtctctttagcagcatcagtgggcttattgatacaagattcaattgtcaaaactggcccttcagtgtggacaggaactgctggcatcttgcagtgcgtgtttgtgctgatcagtgggctaatttgttggacttcatactcggaatgagttatggtgatatgtgctgcctgttggagcttggaattatgacagagggagttggctgtctatgtatcagaaattattcaatccacaggacagaacatagttccacctcgtgtaaatgtttatcctgtgctcacattctcgagcataaaaaaaaaaaacccgtgcaacttttctggaatttgagatgtttggtacataagaaagtgaaatctcataaactctggtgtttcttcaatgctgcctttgtgcagaagccaaattcaattgttttcaggttggtcacacgaatcattagtctcagttagaaccgagaatgctgaaaatagccatgtccactttcaatcctccttggatctcatgctcttattcttgtctgttccctgttttgtaatgtcgtttttgttcttgttatggccttttcatgtgaattctaattgctggtatctttttcaaagctgcaacttcatattcgacagccaaa

SEQ ID NO: 3441 - DNA, 921 bp, Prunus persica
aacggaagcttcaagcatcgactagaaacagagtggagagcaattcacagttgacgaaaagcaaaaaagaaagcagccatcgggtttttcgaacagtccggtagacggcacccgatccggtttgtcttcgcgaaccaataaccaccgaagcaagttcaagcggcgtcgtttcatatggatgtgtcggagctttgggcgatcttcgggccaggcgtagccggagccgtgttcggagccggttggtggttctgggtcgacgccgtcgtttgcagctccgtcaaggtctccttcgtccactacctccctggcatatttgcatctttggcggcgttgatgttcaattgcgttaaaaaggaagacattgattactctccgtacgaagagagcgagtggaggttgaagctttggctgttcattgcctatgttgtagcctttgtatctctagcggcatcggtgggtttgctaatacaggattcacttgtgacaactggtcctccagtgtggacaggagttgctggtgtcttgcaatcagtttttgtgttgatcagtgggctaatttattggactgctcacccggagtaagtagggatgtatgagcggtaccttttcctttggaacctggatttcacaactgagggaattggctgtgtatgtgtatcatttaacttcttcaaacagttggaccaaggagacagaaagatgaatggtagatagggttcgaattccatttccatagttaatatggaaggtatttttcaccgttgtaaatgtttatattgtcccaccagtcttgtttaaattgctaaaactaaggcaatgcctttttgccttatcaaaatctgagtttgtttgcctgtctttcttacgttatttcacaaccccgcatgatgtgagggcttatgataatacattgattatatc

SEQ ID NO: 3442 - DNA, 768 bp, Scabiosa columbaria
agatatcacatgcctcgggaaattacagtgaaaataaaccttcaaagccacaacagctgacatcacctggcttccactctgcttttgagctcaacttcgtgatcatcgaacaaaaagtaaatagcataagaattttcctttccattattcatatacatctgtactcgacccaatcgtacaataagcctcgaggatcccgtaaacacatggatttgggggagctattcgcaattttcggcccaggggtatccggcgccgtatttggcgccggttggtggttttggatcgacgccgtcgtttgcagttccgtcaaggtctccttcctccactacctaccaggtatctttgcatccttggcggctttgatgtttaattgcgttaagagagaagacattgactactctccctacgaagaaggcgagtggaggttgaagctgtggctttttatagcatacgtagtgtcatttgtctctttagcagcttcagtgggactcttaatacaagatgctcttgtcactactggcccttcagcttggactggaactgctggtgttctacagtgcgtctttgtattgattagtggattgatttattggacatctcattcggaatgaaacgttgtgtgttaagtgaatctaaaggtggcagtgtttctctggtggctttgtatcattctactcatttgattaggcacatatatatcgtccgctctgtaaatgttctgtttatgcaacaaaagcacggtgtgatttcaagttataaattgta

SEQ ID NO: 3443 - DNA, 807 bp, Tabernaemontana elegans
tctacagttcttcgttcgtacccaacaacactgattgttagcatcactatcgactctgcagtacataattcgattgaattcgagttgtagtgcagaaaagtagaaagagcgcagtataaaaaaaaattggtgaattggaaggaatgaatgatttggtgagatgtgggctatattcggaccaggagtagccggtgcagtgttcggcgctggctggtggttttgggtggacgcagttgtttgcagctccgtcaaggtctccttcctccattacctcccaggaatttttgcttcgttggctgctttgatgttcaattgcgtgagaagagaggatattgactactcaccttatgaagaaggcgagtggagattaaaactgtggctttttatcgcatatgttgtctcctttgtctcattggcggcttcagtcggcctcctgatacaagatgctctagtgaaaactggcccatctgcatggacaggagttgcaggtgttctgcaatgtgtgttcgttttgataagtgggctgatttactggacttctcatgcggaatagaacacatgaaccaacgtttcaaatgcttggagctcagatttatttgctgaatcttcttcgcatgtatcatcctgacttgatttggcatgtgaattcaagattacaactgcctcttgtaaatatatgttcagtgggttagctgcaaaattacgaacattacaatgcgtagagaagtgaatgtcatctgaacttgtaactcagccttcattacccttgaagtcgtggcaagccactacacttccaaattggaatat

SEQ ID NO: 3444 - DNA, 748 bp, Eutrema halophilum
atcaacaacaagtttattctcaaaattttcactgtatcggaggtagatccaatttgagaacgatcatcgagcgatggatttggttgaattgtgggcgattttcgggcctggtttctccggcgccattttcggaaccggctggtggttctgggtcgacgccgtcgtgtgcagctccatccaagttcccttcctccactaccttcccggcatattcgcatctctcggagctttgatgttcaattgcgtcagaaaagaagacatcgattactctccttatgacgaaggcgaatggagattgaaactatggcttttcatagcgtatgtggtagcgtttgtttcgctagctgcttctgttggtttgctgattcaagattcggtcgcgaagactgggccttctacctggactggtgtggctggtgtctttcaatgtgtatttgtattgataagtgggctaatgtattggacatcgcactcagagtaagtagacgcacagggacatacttcatattcgactcagatacatgttatgacaacttaaaagtgcttctctttactttcactctgtaaattcttgcgtcttgtctggtccagcttggtgttgtgtgctagattcatccgttgcattggtgtgtatttgcgttgaattgaactttgtcgttctaagcttgggttatgtcgtaaattcatattcagaagatggaaagagaaaattcgcgaactttttgtgaatgctattaaaagcccttgt

SEQ ID NO: 3445 - DNA, 741 bp, Eutrema parvulum
acaaattattctcaaaattttcactgtatcggaggtagatccaattttgagacgatcatcgagcgatggatttggctgaattgtggggaatattcgggccgggtttctccggcgccgttttcggaaccggctggtggttctgggttgacgccgtcgtctgcagctccatccaagttcctttcctccactaccttcccggcatattcgcatctctcggagcattgatgttcaattgcgtcagaaaagaagacatcgattactctccttatgacgaaggcgaatggagattgaagctatggcttttcatagcgtatgtcgtagcgtttgtttccctagctgcgtctgttggtttgctgattcaagattctgtcgtgaagactggtccttcgacttggactggtgtggctggtgtctttcaatgtgtctttgtattgataagtgggctaatgtattggacatcccactcagagtaagtagacgtgcagccacatacttcaactccgactcggatacatgtggtgacaacttacaagtgcctctcttttcttatactctgtaaattcttctgtcttgtctggtccagcttggtgttgtgtgctagattgctctgttgcactggtgtgtatttgtgttaaactttgtcgttctaagctttggttaagtcgtaggttcatattcagaggatggatagagaaatatcttttaactttgtgtgaatgttattgaaaagccattgttata

SEQ ID NO: 3446 - DNA, 601 bp, Utricularia gibba
gaaaattcagggtttttgggtcgtccaactcgcgactgttgcagggaaagactgatagagatggagtttggagagctcatggcgatctttggacctggtgtggccggggcaattttcgggactgggtggtggttttgggtggacgccgtcgtttgcagcgccgttggtgtcccctttgtccactacctaccagggatttttgcgtcttttgccgctttgatgttcaattgcgtgaggaaaggggatcttgattactctccttacgatgatggcgactggaggttgaagctgtggcttttcattgcctatgtggtctcctttgtttcattagctgcgtcagtggggctactcatacaagacgctttggtgaaatccggtccctcggcatggacaggagttgctggtgttcttcaatgtgtatttgtcttgatcagtggccttatttactggatatctcaccctgaatgacgttaacagcacttttccaaccagagagcttgtgtgttctgatggatgggtcgatcgatcatgtaaaatttgtccatcgttgttttcttttcttccctacaggaaacttttgcgaacgtttcaagtaaacaat

SEQ ID NO: 3447 - DNA, 784 bp, Juglans hindsii x Juglans regia
  misc_feature (19)..(19): n is a, c, g, or t
gggggggggaaagcatttntgggaaggacgtaggatctgtcgcaattcgcaattctcatctctcattaggctggaactcgagtagcaagctcgagattcaaacaacagattgcaatcaagcacatcatcgagatccgattcgttcttccgacttagaatatcgctacatatggatttctccgagttgtgggcaatcttcgggccgggcgtcgcgggagcagtattcggtaccggctggtggttctgggtcgacgccgtcgtctgcagctccgtcaaggtttccttcgtccactaccttcctggcatatttgcaacttttgcggccctgatgttcaactgcgttaggaaagaagacattgactactctccctacgaggaaggcgagtggagattgaagctttggcttttcttcgcatatgttgtgtccttcgtatctctagcggcatcagttggcctattgatacaagattcaattgtaacgaccggcccttctgtttggacgggaactgcaggtgtcttgcaatgcgtgttcgtgttggtcagtgggctgatttattggactgctcatccagagtaaactaaatgaatccttatgctttccagtttgtgactgaataagtgaatccttatgctttccagtatgtgattgaaattacaagtgggctacccatttgtacgtgtatcattttacttattcaattggtgagatcgaaaatacttcactttctgtaaatgtttatgctgtaacaatcttaagcatcaaagtagcaactcttgaatttac

SEQ ID NO: 3448 - DNA, 790 bp, Fagopyrum esculentum
ttcgtgaagaatgagaaaatatcgtgaatgataggaagactagagagagaaatctacaactcacaaaaggcagaagagaagagggaggaaagggcagcgccgttgccactttttcgaagctgattttttggtgatcaatggatatttccgaattgtgggcgatcttcggtcctggcgtcgccggtgccgtctttggtgccggctggtggttttgggtagacgccgtcgtttgtagttctgttgcaatttccttcgttcactatctcccaggcatatttgcttctctagcggctttgatgttcaattgcgtcaggaaagaggatatcgattactctccatacgacgaaggagaatggaggttgaagctttggctttttcttgcatatgtcgtatcttttgtgtctcttgcggcttcagtagggctactgattaaagatgcacttgagacatctggtccttcagcttggacaggcactgcaggtgtcttgcaatgtgtgttcgtgttagtcagtggccttgtctattggacgtcgcattcagatcaaggtggcaatgcatggtactgaagaatgaatgctgtgttatattttgccatttctcgtgtagtatatggatcgagttcagttggaacttggtgggggagcatgtcatctgtaatgcttgtaacatacgtttgatcaaagcaattggtattcaattgtgacttctgatgatcttagcttcaataatttggctggactagtatttttatttgttgtttgtctgcctcttaattatagcctctgatgtt

SEQ ID NO: 3449 - DNA, 678 bp, Arnica chamissonis
tacaagaaggcaactttcccttcgtatttgctagtaaaattacagcacagcacagttgatcttgagaaattgatttgatcgaattattatcataaaccttttgatcaatttcatttgttgttttctatcgatcgttgaaagctgaaataggacgcgtctttgataacccaacaatccggagcatcgccaaggggaggaagcatccgaatcgatcaatggatttgtctgaattgtgggcaatattcggacccggcgtttccggcgctgtttttggagccggctggtggttttgggtcgacgccgtggtttgcagtgctgttcaagtctcgtttcttcactaccttcctggaatatttgcatctctcgctgctttgattgtttaattgtgttagaagagaggacatcgactactctcctatgagaaggcgaatggaggttgaaactttggctttttctagcttatgttgtgtcattcgtctcattggcagcctcagtggggttgttgatacaagatgcacttgtgcctgaaggcccttcagcttggacgggaactgctggtgttttgcagtgcgtgtttgtgttaataagcgggcttgtttattggacatctcattcggagtgaagtcgtcattccactgtgtcgtttgtggttttacataatcatatttgttaaatcgc

SEQ ID NO: 3450 - DNA, 813 bp, Helianthus annuus
ggtttatcatatacttcacaaatcaaatccagattccagaatgagctagtataaaaacacagttatcttcagaaattgatctgatctgatcgattatcatcaacctcttgaccaatttcacgtatcgtttgtatctataataatccgaagtttcccttggaagaaaacattcgaatcgatcaatggatttctcggaattgtgggcaatattcggccccggcgtcgccggcgccgtctttggagccggctggtggttttgggtggacgccgtcgtgtgcagctccgttcaagtctcgtttcttcactacctccctggaatatttgcatctttggctgctttgatgtttaattgtgttagaagagatgatattgattattctccttatgaagaaggcgaatggaggttgaaactttggctttttctagcgtatgttgtatcgttcgtctcattggccgcatcagtagggttgttgatacaagatgcacttgtgcctgaaggcccttcagcttggacaggaactgctggtgttttgcagtgtgtgcttgtgttaatcagtggacttgtttattggacatctcattcggaacaatagtcaagtcttcatttcatttcatttcaaggtgtgatcatttgtgggttgttatattatgtttgtacatgtctgttgatgatagcgagacaacctttgaccttgttaaggtaaaagtgattgaccgaattatatttgcaactcgtgttttcttctgtgtgctttatcacccttttgttttgtattgaaaggataaaacataatgtacaaaatcttaatatta

SEQ ID NO: 3451 - DNA, 756 bp, Ambrosia trifida
gcggggggcagcacagttgaagtcgatcttcagcaattgattcgatcgatttcacctactgttgatatctaccataaaagtcgtatcgatcaatggaattgtctgaattgtgggcaagtattcggacccggcgtcgccggcgccgtgtttggagccgggtggtggttttgggtggacgccgtcgtttgcagctccgttctaagtctcctttcttcactaccttcctggaatatttgcatctttggtctgctttgtatgtttaattgtgttagaagagaggatattgattactctccttatgaagaaggcgaatggaggttgaaactttggcttttctagcgtacgttgtatcgttcgtctcattggcagcatcagtagggctgttgatacaagacgcacttgtgcctgaaggcccttcgtcttggacaggaactgctggtgttttgcagtgtgtgcttgtgttaatcagtggacttgtttattggacgtctcattcggaataagagtcaagtcttcatttcaaggtgccatttgtgggtttacataaatcttattttgttaaagtatgcctgtacatgtctgttgatgatagtgtgacaacctttgaccttttcaaggtaaaagtgattgaccaaattatatttgcaactcatgttttcttctgttcgtgctttatcatgcttttgttttgtatttaaaacggtaaaacatagtgctttatcagcaaaaaagaaaaaagtaccgactgcgactcta

SEQ ID NO: 3452 - DNA, 663 bp, Helianthus annuus
gatcgattatcatcacctgtagatcaatttcacgtatcgtttgtatctataataatccgaagtttcccttggaagaaaacattcgaatcgatcaatggatttgtcggaattgtggacaatattcggccccggcgtcgccggcgccgtctttggagccggctggtggttttgggtggacgccgtcgtgtgcagctccgttcaagtctcgtttcttcactacctccctggaatatttgcatctttggctgctttgatgtttaattgtgttagaagagatgatattgattattctccttatgaagaaggcgaatggaggttgaaactttggctttttctagcgtatgttgtatcgttcgtctcattggccgcatcagtagggttgttgatacaagatgcacttgtgcctgaaggcccttcagcttggacaggaactgctggtgttttgcagtgtgtgcttgtgtaatcagtggacttgtttattggacatctcattcggaacaatagtcaagtcttcatttcaaggtgtgaccatctgtgggtttacataatcgtatttgttatattatgtttgtacatgtctgttgatgatagtgagacaacctttgaccttgttaaggtaaaactgattgaccgaattatatttgcaactcatgttttcttctg

SEQ ID NO: 3453 - DNA, 840 bp, Antirrhinum majus
atttgtttttggtgtaaaatcataagagacgcgatacaggtggatagtagattcgatcatccgacaattattggcgtgttggaatcgaattggattcaatcaaaataaaaaaaaaccctaatttgaatttgaaagcaatggatttgggagaattgcttgctatcttcggacccggtatctccggcgcggtgttcggcgccggctggtggttttgggtagacgccgtcgtatgcagctccgtccaaattcccttcctccactatcttccaggaatttttgcatcttttgctgctttgatgttcaactgtgtgaggaaagatgatctcgattactcgccttatgacgagggtgaatggaggttgaaactttggcttttcattgcatatgttgtgtcctttgtctcattggctgcatcagtcggactattgatacaagatgcaatgttggaatcaggtccctcagcttggacaggggttgccggcatatttcaatgtgtttttgtgctaattagtggtcttatttactgggtttctcattcagagtagcctggcgatcgcagaactctcgtgttgattaagcctaatatttattcgagtcatccgagaatgagcgtctttcatatttgttgtattggtagcaactggcaagatgtccaagttgactctgctggtgttatttcatgtcaaataatttgtttttagcagagtgaactgggtgtgaatctcttccgagaaaaagaggagaaggaattttaatgcattgtatattaattgattgtgatccaaggttctgctccaaccactgtctttttttactaaaatcgactattgctgtttgaac

SEQ ID NO: 3454 - DNA, 850 bp, Cynara scolymus
  misc_feature (42)..(42): n is a, c, g, or t
  misc_feature (89)..(89): n is a, c, g, or t
gcggggcatctatttaatgtcatgtgctagtaaagttacagngcgcaccgttattcgatattgatcgatccattgatgattgtcgtcanctgattcataaacctttcccacagtttcttgtgttgttttcaattgtagaaagttgtgatagcacgcatctgcgaaacccaacaaggcggagcggaatcaatccatggatttatctgaattgtggggaatattcgggccaggcgttgccggcgccgtttttggagccggctggtggttttgggtcgacgctgtcgtttgcagttctgttaaaatctcgtttctccactatcttcctggaatatttgcatctttggctgctttgatgtttaattgtgttagaagagaggacatcgactactccccctatgaagagggcgaatggaggttgaagctttggcttttcttggcctatgtggtatcctttgtctcgttggcagcatcagtagggttgttgatacaggatgcactcgtgccagaaggcccttcagcttgggccggaactgctggtgttttgcagtgtgtgcttgtgttaatcagcgggcttgtttattggacatctcactcggagtaagaggagccaagagttggaatgatttgtggttttcatcatcatattgttaaattgcacctgtatatgttccatgttcatgatccacctatggggatttggagtcggattggaatagaattcactgaatcattttttaactcatcgtgtatgatctttttgattaccgttttatctttgtgaatgtgatcgtaccctctcggatttggtgtatcatgattttgtatatgaaatcaatcgagatttactttt

SEQ ID NO: 3455 - DNA, 675 bp, Flaveria ramosissima
ccaaacaagcagcacacttgtatcttcatactctgaattaatagattcgatcaatacaccatcatcaccaccaccctattcataaacccttttacgtatcaatttactaatcaatacacccaaacgtttaaaattaaatactcatctccgataacctacaacacgccggagcatcacaaaatcattcaaatcagccaatggctttttctgaactgtgggcaatattcggccccggcgtcgccggcgctgttttcggagccggctggtggttttgggtcgacgccgtcgtttgcagctctgttaaagtctcatttcttcactacctccctggaatatttgcttctttggctgctttgatgtttaattgtgttaaaagagaggatatcgactactctccctatgaagaaggagaatggaggttgaaactttggctttttctagcttatgttgtgtcattcgtctcattggcagcatcagtaggtttgttgatacaagatgcacttgtgcctgaaggcccttcagcttggacaggaactgcaggtgtgttgcagtgtgtgctcgtgttaattagtgggcttgtttattggacatctcattcagagtaagagtgaaaccttcatttcaaggcgttgtctgtggtcataattgtatttgttgaatcatgcgcgtacatgt

SEQ ID NO: 3456 - DNA, 806 bp, Plantago ovata
gagacgagaactttgtagagagagaaacagcgagtcgaatcgaaagttcgatcaccttcaattttgattcgacgattatctgcaatctcatcttacagctcaattcaacaatcaggaaaaccctgattaattgatttactctgctcgtagtcttctcttctcttctggtctgcaaaacccttgccgtacaaaaaatggatttaagtgaattgctagccatcttcggcccagggatctccggcgcagttttcggtaccggctggtggttttgggttgacgccgtagtttgcagctccgttcaagtcccgttcgtccactatctccctggtatttttgcgtctttagctgccttgatgttcaattgtgtgaggaaggaggatattgattactcgccctatgaagaaggtgaatggaggttgaaactttggcttttcattgcatatgttgtgtcttttgtctcattggctgcgtcagttggtctactggtacaagatgcacttgtggattctggcccttcttcatggacaggagtcgcaggcattcttcaatgtgtgtttgtactcatcagtggcctgatttattggatttctcattcggaataacctggcatatgtggaaccctcttatccttaaaaccgatactatttggtgtttttcccatgctgctggctctctgctgatttcagtgagatgttttagggaagcagagaatgtagtgggtgtgaatttctgtgaagagaaacgaatttgtttgcactgtatattgtctcttgatattattaattatctgcacataccaagtcttt

SEQ ID NO: 3457 - DNA, 536 bp, Rhizophora mangle
ttcttaggagcggttcaccatatccgctcgcccccgattaaaatacacaccaacaatcaaccatttgcgcaccatcctcgatcgtctgatcggccagtttcctcctaacgctcaaactgttaatcaaaaacataaaaagccaaagcgatggatttatcggagctgtgggcgatcttcggtccgggattcgcaggcgcggtgttcggcgccggctggtggttttgggtcgacgcggtcgtttgtagctcggtcaaagtgtccttcgtacactacctccccggcatatttgcgtctatagcagctctgatgtttaattgcgttagaaaagaggatattgattactccccttatgaagaaggcgagtggaggttgaagctctggcttttctttgcttatgttgtgtcatttgtttctctagcagcatcagtggggttactgattcaagattcattagtcaaaagtgggccttcagtttggactggaactgcaggcgtcctacaatgtgtgtttgtattggtcagtgggctgatttattg

SEQ ID NO: 3458 - DNA, 636 bp, Silene vulgaris
gaattgttggcgatattcggaccgggtatttccggagcagtattcggagctggttggtggttttgggtcgacgccgtcgtatgtagcgccgtcgcaatttccttcctccactaccttcccgggatttttgcgtcgttagctgcgttgatgttcaattgtgttcgcaaagaagacattgattattcgccttacgatgaaggcgaatggagactgaagctgtggctatttattgcttatgttgtcgcctttgtttctcttgccgcatcagttgggttgttaatacaagatgcccttgtgccttctggtccttcaacttggaccggagttgccggtgtcctgcagtgcgtgtttgtactaatcagtggactgatctattggacctcacatttggagtaaatgcttgctttgattttcttgtgaagttcttgaatatgaaatttctttgacgtgaacgatgacacgaagtaattttagtttctgtaaatgtttgtaatataccattggttataaccaacaacgctgtctgaaacttaactgtgttttcggctttgttagtattgttgtactttttattcacttggaatattatggattgtgccatgttgtgcttcttcgagtgtgaatgaattaaggttt

SEQ ID NO: 3459 - DNA, 714 bp, Silene vulgaris
acaggacaacaacgacctcagaaaagagtaaagaaaaggaaacatcaaccacggtaaaatactatggaaatatcggaattgatggcgatattcgggccgggtatagccggagcagtattcggaaccggatggtggttttgggttgacgccgtcgtatgcagtgctgtcgctatctctttcctccattacttacctgggattttcgcgtcgttggctgcattgatgttcaattgcgttcgaaaggaggacattgattattctccttatgatgaaggcgaatggagattgaaactgtggctttttattgcttatgttgttgcctttgtgtctcttgcggcgtcagttgggctgcttatacaagatgctcttgtgccttcgggtccttcagcttggactggagtcgccggtgtcctgcagtgcgtgtttgtactaatcagcggactgatctactggagttcgcatacagagtaaatgctcacttttgtgaaacctcaaagccaaagcaggactatttccaatgaagatcttgaatatgatttcttcgacggtcttagagaagtcgttctatgtaaatgtttgtagtatgcgccgacgatgatcgacgaagatgactgaagatcaatatttcagttcatcttcataacgtgcttcattttatatttattccaatgctcagaggctaggccatcaaaaagcttgttggtataattatgt

SEQ ID NO: 3460 - DNA, 731 bp, Camellia sinensis
tatatataaaaaaattagtgtataattcgagttactgaactatggatttgatagagctgtgggcgatcttcggaccagccgtcgctggtgcggtcttcggcgccggctggtggttttgggtcgacgccgtagtttgcagctccgtcgccgtctctttcctccactacctccctggtatatttgcttctctggcggctttgatgttcaattgtgttagaagggaggacatcgactactctccttacgaagaaggcgagtggagattgaagctttggcttttccttgcttatgttatatcattcgtctccctagcagctgcagtaggtctattgatacaagatgcacttgtggaaactggcccctcagcatggacaggaactgcaggtgttttgcaatgtgtgttcgtgttgatcagtgggttgatttattggacttctcattcggagtaggggtgaattgggatgtaattgttacagctgaaatcatcattttggggctctccatgcaggtttcaatttttagttattagtcatggaacccaaggtagtgtgcctcctgatgtaaatgtgtgctaacaatttgaagtttcaactgtttatccaagtaaaagagtaaatgccattttattttaaaattatgataatacatcctgattttgttattgtatcttactgagtgtagtgccaattacatgttataatgacttaaattctcttttttttggctgttgg

SEQ ID NO: 3461 - DNA, 796 bp, Beta vulgaris
gagggaagaaaaaagaagaaaataaagaaaaagaaagaggatggatataccggaactattggcgatattcgggccgggttttgccggcgccgtattcggagctggttggtggttttgggtcgacgccgtagtctgtagtgctgtcgccgtctctttcgttcactatcttcctggtatatttgcgtctttgtcggcgttgatgttcaattgtgtgaggaaagaggacattgattactctccgtacgatgaaggcgagtggagattgaagctttggctttttcttgcttatgtcatatcgtttgtatctcttgcggcatcagttgggctgcttatacaagatgccctggtgcctactggcccatcagcttggacagggacggctggtgtcttgcagtgcgtatttgtgctaatcagtgggctgatctattggacttcacattccgagtagctgaacaccttgaaggtttttgagacttcaatgtattatttactttaagttgaatgtgcaggaaagtagatcatcttgtgtaaatgtttgctatatgctaatggctttgagctacaaatgaaaaaaaaaaaaagttcaactctttctgttggctttattttctggaatttgctcattcttataattctgtgaggctgtctcatcaagtaaatgttatatcattgttaatttgtaatgaagttcccaccatggacagataattacagacttcgattgtaactttctaatattgtcctttgaggcactacccatttgtttgcttgtgtatcaatttttggtaatagcttt

SEQ ID NO: 3462 - DNA, 827 bp, Raphanus sativus
  misc_feature (258)..(258): n is a, c, g, or t
  misc_feature (275)..(275): n is a, c, g, or t
  misc_feature (426)..(426): n is a, c, g, or t
gttacaaagatttgtcaaaaatttcactgccacggggtgttagatccgatctgaaatcgatcatctagcgatggacttggctgaactctgggcgattttcgggccgggtttctccggagctgttttcggcactggctggtggttttgggtcgacgccgttgtgtgcagctccatccaagttcccttcctccattacctccccgggatattcgcatctctcggagctttgatgttcaattgcgtcagaaaagaagatancgattactctccttacnacgaaggcgaatggaggttgaagttatggcttttcatagcgtatgtggtggcgtttgtttccctagctgcttctgttggtctgctgattcaagattccgtcgtcaaaactggaccttccacctggactggtgtcgccggtgtctttcaatntgtattcgtattgataagtgggctaatgtattggacatcacactcggagtaagtagacttgcagggcacatactccaacgcagatacttgtggttacaacttacagatgcctcgttttcttcttctctgtaaattcttgtgtctttgtctggtccagcttggtgttgtgtgctagattcctccattgcattggtgtgtttgttttaaactttgtcgttctatgcttgggttataagttgttgcttcttatgtagaggttggatagaaaataatcttcaactttatgtgaatgttatgggacgccttgcccgtgtctgcacggtctcttaattccattggagtgaacgattggtaacatttaccttttattttgattaaaagtgtcgcaacagtttcaagcc

SEQ ID NO: 3463 - DNA, 551 bp, Rosa hybrid cultivar
gagtggagagcaattacgcagttgacaaaaccatcgatcgggttttgcaaaactccggcgaccggagtcgatcgtgttcgtaatcgcagccacatatggatatgccggagctttgggcaatcttcgggccaggcttcgccggcgctgtgttcggcgccgggtggtggttctgggtcgacgccgtcgtttgcagctccgtcacggtctcattcgttcactacctcccaggtatttttgcttctttggcggccttgatgttcaattgtgtgaagaaggacgacattgattactctccttacgaagagggcgagtggaggttgaagctttggctgttcattgcttatgttgtttcctttgtatcgttggcggcatcagtgggtttgctaatacaagattcacttgagactactggcccttcagtgtggacaggaactgctggtgtattgcaagccgttttcgtgttggtcagtggacttatatattggactgctcactcgcagtaagtagggactctgacaagtatttttccatgggaatgtgaatttcacaag

SEQ ID NO: 3464 - DNA, 522 bp, Sesamum indicum
cacccaagttccggaaagacttaaatctgtcgatagtctcttccaagttgcttgtggtcgccgctaatcgataatcggacagatcagaattatctaaattcttgctgtcgggaagtaaaagttacataaaatgaatttggcggagctgttggcaatcttcggacccggcgtcgcaggcgcggtattcggtgccggctggtggttttgggtggacgccatcgtctgcagctccgtccaagtcccattcgttcactacctccctgggattttcgcgtctctgtctgctttgatgttcaattgcgtgaggaaagaggatattgactactcaccgtatgaagatggtgaatggaggttgaaactctggcttttcatagcatatgttgtgtcctttgtctcgttagctgcttccgtcggcttgttgatacaagatacactggtaaaatctggtccttcggcatggaccggagttgcaggtgtccttcaatgtgtgtttgtgctaatcagtggcctgatttattggat

SEQ ID NO: 3465 - DNA, 722 bp, Carthamus tinctorius
  misc_feature (29)..(29): n is a, c, g, or t
  misc_feature (244)..(244): n is a, c, g, or t
gcggggggcttgtttcgatcgtctcgtanaagaaagtagcacgcatctccgattcccaatggatttattggaattgtgggggatattcggcccaggcgttgccggcgccgtttttggagccggctggtggttttgggtcgacgccgtcgtttgcagttctgttaaaatctcctttctccactatcttcctggaaatttgcatctttggctgctttgatgtttaattgtgttagaagagaggacntcgactactccccctatgaagagggcgaatggaggttgaagctttggcttttcttggcgtatgtggtatccttcgtctccttggcagcatcagtggggttgttaatacaggatgcactcgtgccagaaggcccttcagcttggaccggaactgctggtgttttgcagtgtgtgcttgtgttaattagcgggcttgcttattggacatctcactcggagtaagacgagccaagagttggagtgatttgtggtttttcatcatcgtattgttaaatcgcatctgtacatgtccatgttccatctatgggattgcttatggttcatctttgtgaatgtgatagtaccctttattacccattgaatttggtgtatcatgagtttgtatatgaaaccaatcaaatttactttcactttttagtgccaaaaatgatgcatatatgatccatcatatacatgaaaatgctctgtttatggaaaaa

SEQ ID NO: 3466 - DNA, 784 bp, Lippia dulcis
ttcattaagtatggtttcattaaaaataatagtaatatttaattataatggtttgattaaaaattagtgtatttaacgagagagagatcacaagaaaggatttttctcaactccattattagttgaatcaaaagccctaactcaaaaatcctccaattctagaacccctcacacccaattcatcatagtttgccccaattcgaggttgtttcgatcccactctacaatcggcggatcgaaaacgatcaaaatcaacccactcggaatcagtagttgcgtataaatggagttgtctgagcttttggcaatattcggaccgggaatctccagcgcggtgttcggcgcggggtgtggtttgggtggatgccgtcgtgtgcagcgccgtacaagtccctttcctccactacctgccaggaattttcgcttcgctgtctgctttgatgttcaattgcgtgaggaaagaagatattgactactcgccgtacgatgagggtgaatggaggttgaagctctggcttttcattgcatatgttgtgtcatttgtctcgctagctgcttcagtcgggctcttgatacaagacgcgctggtggagactggtccttcagcgtggactggaatcgcaggtgttcttcaatgcgtctttgtgctaatcagtggcctgatatattggatatctcattcctctgaataaccacccgtgtgcaaagtgtttccatcgttacttaatctgtgcataaccgtgctggagttacccgactgggagagactggagctattcatgtc

SEQ ID NO: 3467 - DNA, 695 bp, Triphysaria pusilla
ctagatcctcttaaatcatatctaaaatctcgccaattcgagttttctccaaatcataatctagagatacaataccctgcgtgaaaatggatttgagagagctgttggccatcttcggacctggcgtggccggcgccgtattcgcaacagggtggtggttctgggtcgaagccgtcgtttgcagctccgtcaaaatctcgttcgtccactaccttcctgggattttcgcttccttggcagcgttgatgtttaattgcgtgaggaaagaggatattgattactcgccctatgaagagggtgaatggaggttgaactttggctttcattgcatatgttgtagcctttgtctcattagctgcttcagttggtctattgatacaagattccctctcaaatcgggcccttcgacatgggccggagttgcaggtgttctccaatgtgtatttgtattaatcagtgggctgatttattggatatcccattcagaataacgtggtttgtgcaaatagtctcatgttggtgaaatgtgattagttttttatcgaccaagcgtgtatctgtgtatttcttggctttccttcgcccgaacttcgaatgccgtatgcctatatttgtcatttcacgcgatcaaattaaagaagcaaaatcacatgtttgtgaatttattttcgagaactattatattgaatttatat

SEQ ID NO: 3468 - DNA, 935 bp, Olea europaea
gattgctggctggaactgccccaagtgctagtaccaaaaaagcatacattaattaataaaatccccaaattcttcaacaatctttattctgtaatcaaatcctatactttccaagactcagaattcgaaacccaattcagttgaaagattttcttatttccaaactcaaggagggcgataatatatcaatatcaatttaaggaaataatataaatggatttgggagaattgtgggcaatctttggacccggattcgccggcgcggtctttggtgctggctggtggttctgggtcgatgccgtagtatgcagctccgtcaaagtttctttcctccactatcttccaggcatatttgcgtctttggctgctttgatgttcaatactgttaataaagaagaccttgacgactcaccctacggagaaagcgagtggagggtcaaactttggcttttcattgcatatgttgtatccttcgtctgcttggctgcttccgtgggcctattgatacaagatgcgctggtggaatctggaccttcagcttggacaggagttgcaggtgtttttcaatgtgtctttgtactaatcagtgggctgatgtattggacttctcattcagaataaccaagttgcctcaaaggtagactaactggaaattgagatgtttgccggtcatccctgcctgtgtttctgaatctgttatgttagttcagatatgaaggtcggtctgttctattaaaaaatttgagtcccttgtacaaaacattaatgaatgtgcttgaaaatgccagggtttctcgtccacaaaaacaaacgagtaaacctaaatgtaacggtagagaaaactaatgctattattcttgaacaagttggagttgtttttgttctgtagaagattagattttgttgtgaattatcctcatgactgtgaatgttga

SEQ ID NO: 3469 - DNA, 785 bp, Amorphophallus konjac
ctcttgcggggatggactacggggagctgtgggcgatcttcgggcccggcatcgccggcgccgtcttcggcgtcgggtggtggctctgggtcgatgccgtcgtctgcagcgccgtcaaggtctccttcctccactacctccctgggatattcgcgtcgctggcggccctgatgttcaactgcgtcaagaaagaggatatcgactactcgccctacgaagagggagagtggagagttaagctctggttgttcctagcatacgtagtatcttttgtctctcttgctgcatcagttggcctcttagtgcaggacgccctcacggataagggcatttccgcttggacaggtgttgccggtgtcctgcaatgtgtatttgtgctgatcagtgggttgatctactggacgtctcattctgagtaggacagcgagggttgatcaacatatgctgccggaaaatttgtctgagtcgatctaccattggatctaaaagttagttgttacttcggaattttatgctttcggtcccgcctcctgccctgtaaatgaaacgaacattatggttctccctccccatgtagagtattgtaaatgaaatgttcttcagtgctgagacgttgctggtgcgcttcgaatttgaaatgtgccgcggtacattacttcgtgtggatctgctgttttgcttacccttttctcgccatgtgtgctgctggcgttaaagggttcattcgggattgacgtaaagatccgaatcgttctgcgcttgtcctgtttaaacagttttttttc

SEQ ID NO: 3470 - DNA, 988 bp, Mimulus guttatus
gaagacgagtcacagtcagagagagagagagagagagagagaggggagaaaagcagaaagattgtttgctgaagacagaaaccctaatatcaaaattctccaattgaagagccacgaacaatcaatccatcaaaatcatatccgatttcctactactctcctttaatctatcaatcaatcaacccgatcacaattctctgagttaagtaatagttgcatagaatggatttgagcgagctgttggcgattttcggacccggcgtctccggtgcagtattcgccactgggtggtggttttgggtggacgccgtcgtttgcagctctgtcaaggtcccgtttgttcactacctgccagggatttttgcgtctttgtctgctttgatgttcaattccgtgaacaaagaggatattgattactcgccgtatgcagagggtgaatggaggttgaagctctggcttttcatagcatatgttgtttcgtttgtctcgttagctgcatcagtcggcttattgatacaagatgcacttgtggaatctggtccttctgcatgggccggggttgcaggtgttcttcaatgtgtgtttgtcctaatcagtggcctaatttattggatatctcattcggaataaagctactatgtgcagagtgtcatccttcagtgtaaactgagattatttgtgtcatccatttgtgtaaaccgaggttattcgtctcacacagacacgtgaagttatagagagaataaaatgaagtaagtcatttgtgaatctaatggtgcctcctgtgttattttgctcgtacagttcagttcagatatcttctgtcctcgttcgattcaaataagttttaatagcaggatcagtatttcagaagccaaccttattttttgaaagttgttaacacatcccatcacagacagacttacgaatgctcattttgttcccactcaattccttcataccgatacttccaatgaaaaataagttg

SEQ ID NO: 3471 - DNA, 1563 bp, Mimulus guttatus
aatgtatgttggctgaagacgagtcacagtcagagagagagagagagagagagagaggggagaaaagcagaaagattgtttgctgaagacagaaaccctaatatcaaaattctccaattgaagagccacgaacaatcaatccatcaaaatcatatccgatttcctactactctcctttaatctatcaatcaatcaacccgatcacaattctctgagttaagtaatagttgcatagaatggatttgagcgagctgttggcgattttcggacccggcgtctccggtgcagtattcgccactgggtggtggttttgggtggacgccgtcgtttgcagctctgtcaaggtcccgtttgttcactacctgccagggatttttgcgtctttgtctgctttgatgttcaattccgtgaacaaagaggatattgattactcgccgtatgcagagggtgaatggaggttgaagctctggcttttcatagcatatgttgtttcgtttgtctcgttagctgcatcagtcggcttattgatacaagatgcacttgtggaatctggtccttctgcatgggccggggttgcaggtgttcttcaatgtgtgtttgtcctaatcagtggcctaatttattggatatctcattcggaataaagctactatgtgcagagtgtcatccttcagtgtaaactgagattatttgtgtcatccatttgtgtaaaccgaggttattcgtctcacacagacacgtgaagttatagagagaataaaatgaagtaagtcatttgtgaatctaatggtgcctcctgtgttattttgctcgtacagttcagttcagatatcttctgtcctcgttcgattcaaataagttttaatagcaggatcagtatttcagaagccaaccttattttttgaaagttgttaacacatcccatcacagacagacttacgaatgctcattttgttcccactcaattccttcataccgatacttccaatgaaaaataagttgggaaatcatcgatcttacggtgcattgcagatgcatgatatattcaaatgttcggctatacctctgtgatatagcacgacactattgatcagaatagaaaatgctacaagggaaagattaaaagacaatcggtataactataatcagctttcaacttttttttttttccttttcttcaaaatatagtaaacctttcttcccctatttaaatcaggagaaatgggagaaaatatgcccagaaaaaggatgagccactgaattaaatgttagccgaatgcattttatgtcctatctttcaagtatgattcagcaaactcccgttcatgccaagcatcaatctcagatgccagaaatttattatttcatccacatacaaaaaccaatcatcaccgtaactttccttcagaaacaaatagcctgccaacaaaattgaacttcccagataccttgagctgacattaagtctcaagcttcagattcggaggagcttgattcaatgccagaaataccagagtataattcagaccgtttctcgagaacttccacacacttccaaagatg

SEQ ID NO: 3472 - DNA, 809 bp, Orobanche aegyptiaca
ttggagaggggataaagcaaaaaggctttgattcgattattgctattagaaaacccttaatcgatcgaccaaaaccaaatccccaacttccatggcgatttgaagatcttcaatcaaagctaaaatccataatttcaatactgagattgtctcaatcaaaaattcctgcgtaatttcaaatggatttgggtgagatgttggcaatcttcggaccggccatatccggagccgtatttggagccggctggtggttttgggtcgacgccgtcgtttgcagctcaatcaaaatcccgttcctccactacctaccagggatttttgcgtctttggctgctttgatgtttaattgcgtgaggaaagacgatattgattattcgccctatgaagagagtgagtggaggttaaaactgtggctcttcattgcatatgttgtgtcatttgtgtcgttagctgcttcggttggtctattgatacaagacgccctcgttgaatctggtccgtctgcatggacaggtgttgcaggtgttcttcaatgtgtatttgtactaatcagtggtctgatttattggatttcccatacagaataacttggcttgtgcagattgtgatattcttaaacatcatgtaccttttgtgtatttaacttgggttgccatcttctcatgttttcctttttcatgtgaacaagttgcagaagcagaatcaagtagttgtgaatttatttggagttattatattcttttaatggtgcaaacttagttttttttactagtcaacattcaaaaatagtcctttttgtacgaacattc

SEQ ID NO: 3473 - DNA, 885 bp, Lippia dulcis
ttttatagtcgcagttgagagaggcaaaaggtgattgctttggaaggaaaaaagccctagaatcaagaatcctcaaattcttgaacatctgagatcaaacccaacataaatcataatcacatcaatttttcttgtgttgcttcgttgaatccaacattcgaaccgatcggagttacctcggtagctggaagtaatggatttgaaggagatgctggcaatttttgggcctgggatctccggcggagttttcggcgccggatggtggttttgggtggacgccgtcgtttgcagctcggtcaaaatccccttcgtacactaccttccagggatttttgcttctttgtctgctttgatgttcaattgcgtgaggaaagaggatattgactactcgccgtatgatgatggtgaatggaggttgaaactctggcttttcattgcatacgttgtgtcgtttgtctcgttggctgcttccgtcgggttattgatacaagatgcgcttgtggaatccggtccttcagcgtggactggagttgcaggtgttcttcagtgtgtgtttgtactaatcagtggccttatttattggatatctcattcagattaacctcggatgtggcgagactctcgtattggcaaaactgaagatattctgttcctgtctgcaagtgtgaattcatgtatttcttgttaacttttgcaggctttttttcttgttatggagttgcaaaactaagttgttgtatttgtatatctctttctcaagtaaatgaatcgatttgaattgttaaatacccattttcagaagcagagttgggagcttcctcaaattcctaactattcacagaatcgtcctattttcattatttacaactatttttacttcaattc

SEQ ID NO: 3474 - DNA, 885 bp, Platanus occidentalis
tttgagggagctgtcggcgatctttgggccgggcgtcgccggtgcagttttcggtgtcggttggtggttttgggttgacgccgttgtctgcagttctgtcaaggtctccttcgtccattaccttccaggaatcttcgcgtccatcgccgctctgatgtttaattgcgtcagaagagaagacattgattactctccctacgaagaaggagagtggagattgaagctttggctgttctttgcatatattgtatccttcgtgtctctagcggcttctgtgggcctactggtacaagattcacttgtgaaatctggtgcttccgtgtggactggcgttgctggtgtcttgcagtgtgtgtttgtgttgatcagtggactgatctactggacagctcattcagactaaattggggaatcgtaaagcttccacttggaatggaaattataggtgagcaatcttccatgcatgtatcatttaagatgtccaggcagtggcaaagaacagttcacttcctgtaattctttctgggttcgaggaatgtagttttctgtaaatgtctgtgttgaatcatcttgactcaaagtggacccggttaaatgcaactcttatggaagtgatgaggttgacaaggatcctattgggtcctcggaaattggaattcaatctagtttcttacaggatcttgactactcaggatatcttacactgccttttgactggtcaatacacttgggattactgaaaccgcacatttaactggtagaatggttgaagagtggaatgcttgattttgttggtaacttgggtttaacccctgatgatgttgaacttagctcataaactaagcttggctaataaccgtactcatgtggagcttgatttgatat

SEQ ID NO: 3475 - DNA, 574 bp, Fraxinus spp
atttagcggagttgtgggccatattcgggcctggagtcgccggcgcagtcttcggcgccggttggtggttctgggtcgatgctgtcgtttgtagctcggttaaagttcccttcgtccactaccttccaggaatatttgcgtctttggctgctttgatgttcaattgcgttaagaaagatgacattattgatcactactccccatatgacgagggcgaatggagggggaaactttggcttttcattgcgtacattgtatccttcatttcattggcagcttcggtgggcctattgatacaagacgctctagtgaaaactggcccttcagcatggacaggagttgctggtgttcttcaatgcgtgtttgtattaataagtggtctgatgtattggacttgtaattcagaataacttggtacatgcaaaactctccttcattgctgcgaaatgtttaaccatgtatcggtctctttggtattttaaacaggattacagtttgatcccccctctgtacgtgtcttttattacatgagaaagtggagggcgataaataatccacgtgaaataattgttca

SEQ ID NO: 3476 - DNA, 628 bp, Bruguiera gymnorhiza
gacggaaaaaataataataataaagtgtcagagagacagagaaggactgagcgatcgatggatttatcggagctgtgggcgatcctcgggccgggcttggcaggttcggtgttcgccgccggttggtggttctggatcgacgccgtcgtttgtagctccgtcaaagtctctttctggcactatctccccggcatatttgcgtctatagcagctctgatgtttaattgcgttaaaaaagaggacattgattattcgccttatgaagaaggcgagtggaggttgaagctctggcttttcttcgcttatgttgtgtcctttgtttctctagcagcatcagtggggttactgatccgagattcaatagtcaatagtgggacttcagtttggactggaactgcaggggtcctgcagtgtgtgtttgtattgaccagtgggctgctttactggacatcacactccgaatgaattgtaatatacctgtgcagtttcctttttgagctggagttagttgattgtgaggcagttaactacatgtatagtcaatacttgttcagtggatggaatgaatgtggtttaccctaatgtaaattattaggttgtttagcaatccaggccatggatttactgt

SEQ ID NO: 3477 - DNA, 816 bp, Primula obconica
aattaataagagtgctaatagtaaaaaagttagtttgataaaaggttccattttataggagtaacaactaacaaatactccgtagtggtataattatagtctgatagacgaaattagttaaaaaacgatcctcaaataaaaatggatttgggggagctgtgggcgatctttggaccagcgatctccggcgcggtcttcggcgccggctggtggttttgggttgacgccgtcgtctgcagcgccgtcgccgtctccttcctccactacctcccaggtatatttgcttcgctggcagcggtgatgtttaattgtgtgaggagagaggatattgattactccccctacgaagaaggcgagtggagattgaagctttggcttttcctcgcttatgttgtatcatttgtatctttggcggcttcagtggggctattgatacaagatgcacttgtgacaactggcccatcagcttggacaggaactgcaggtgttttacagtgtgtgctcgtgttgatcagtgggttgatttattggacttctcattcatcagaataagtcagctgtgagttgggctagctgcagatggaatgaatatgtggaatttctccttcatttgcgtatgtggttagtggtttgttgtggtatagaggtcatgccgtctgatgtaaatgtataccaaaccagctaaaatattgaattaaagtaaatcccacaattctgtttgtatttattttctttttgcgctgctcgactgtctgcatattgcccattcctaacgtgcatgatgcctcttttttacacctgtgggagaaattggtc

SEQ ID NO: 3478 - DNA, 519 bp, Sesamum indicum
cacccaagttccggaaagacttaaatctgtcgatagtctcttccaagttgcttgtggtcgccgctaatcgataatcggacagatcagaattatctaaattcttgctgtcgggaagtaaaagttacataaaatgaatttggcggagctgttggcaatcttcggacccggcgtcgcaggcgcggtattcggtgccggctggtggttttgggtggacgccatcgtctgcagctccgtccaagtcccattcgttcactacctccctgggattttcgcgtctctgtctgctttgatgttcaattgcgtgaggaaagaggatattgactactcaccgtatgaagatggtgaatggaggttgaaactctggcttttcattgcatatgttgtgtcctttgtctcattggctgcttcggtcggtctattgatacaagatgcattggtagaatctggtccttcagcatggacaggagttgcaggagttctgcaatgtgtatttgttctaatcagtggcctgatttattg

SEQ ID NO: 3479 - DNA, 995 bp, Glycine max
attgactacgtcgtctctgtatgactctttccttttttctttttgccacatggttttgttcaccattttctatatatatacaattcacacagcaaaagtcatccacgtaaatacaacacaagaaacagacagagagaaattcacacataaaaatcatcacttcaaattaagctagagctagaaagattcagaggtagctatagagagagaaacagaggtcatggatggtttgcaaagatctgaggtgtctttcaggagacagggttcatcagggcttgtttgggacgacaagttattgtcaggggaattgaacaaagtgaacaacaacgaagaccaaaagggtggtggttctggtggtgaccttaaccttaaagttagaactacaccacccaacaccaccatccagagaagccgctccaacggcggctaccgcaccggaaaagtctcgccggcgatcgagcctccctctcccaagctctctgcttgcggcttctgcagcgctttcgggaaaacaagggaaaagggccgtgctaagcatcgatcaaggtaggttttttctcgtcgccggagacggtggttcatgcagctcttcaacacgttctgtttatgtccacttaagatttagggtttgagtttgagttcgtatatgggaatagagaagggtgaattgtagccctccgtttcgtctctgtttacgagttttggtttgttttcatgtttcaattgtctctgtggaagaagagatgatgatagtttggggtgagttgggttgtaatcatgtgtatgtttgttgggtcaaccaggaattttgatctctgtacaaagtaaaatctccaataagatctatctttcacaaatttgggattggtgcaatatccgaacgtgatttagtaccgtgcttttgcttttgtttaataatcaacaccatatttatatattgtatttgtatgatatatttgataaatatgaggaacttgaatttctaccatgtgttt

SEQ ID NO: 3480 - DNA, 969 bp, Glycine max
ctttccttttttctttttgccacatggttttgttcaccattttctatatatatacaattcacacagcaaaagtcatccacgtaaatacaacacaagaaacagacagagagaaattcacacataaaaatcatcacttcaaattaagctagagctagaaagattcagaggtagctatagagagagaaacagaggtcatggatggtttgcaaagatctgaggtgtctttcaggagacagggttcatcagggcttgtttgggacgacaagttattgtcaggggaattgaacaaagtgaacaacaacgaagaccaaaagggtggtggttctggtggtgaccttaaccttaaagttagaactacaccacccaacaccaccatccagagaagccgctccaacggcggctaccgcaccggaaaagtctcgccggcgatcgagcctccctctcccaagctctctgcttgcggcttctgcagcgctttcgggaaaacaagggaaaagggccgtgctaagcatcgatcaaggtaggttttttctcgtcgccggagacggtggttcatgcagctcttcaacacgttctgtttatgtccacttaagatttagggtttgagtttgagttcgtatatgggaatagagaagggtgaattgtagccctccgtttcgtctctgtttacgagttttggtttgttttcatgtttcaattgtctctgtggaagaagagatgatgatagtttggggtgagttgggttgtaatcatgtgtatgtttgttgggtcaaccaggaattttgatctctgtacaaagtaaaatctccaataagatctatctttcacaaatttgggattggtgcaatatccgaacgtgatttagtaccgtgcttttgcttttgtttaataatcaacaccatatttatatattgtatttgtatgatatatttgataaatatgaggaacttgaatttctaccatgtgttt

SEQ ID NO: 3481 - DNA, 1306 bp, Glycine max
gcaaagggaaagagaggaagagtgaaaatgaaaatgagaagggggtcggggggaatattgaacacaacacccactgcacagcttcataactaaaccgccatcgcctccaagactttccgtgcccaaaagatgagaaaacgcagcatttacgcatggctagtagcacttgtttgcttcctcctactcatgatcgtcaccccagccattccccagtcacaagaataccatgatttcgccgaccaccgcaccttcctcggtattcccaatgcacttaacgtgatatccaatttcccttttctggttattggcctcgttggacttgtactctgtcatcatggaaattactttaggctcagcttgcaaggtgaactatggggctggacatgcttctatgttggcgtggctgcagttgcagttggatcttcatactatcatctcaagccagacgatgctcgccttgtgtgggatcgcttgcccatgaccgtcgcttttacatcaatcatggcaatattcatcattgagcggattgatgagaggaagggaacggtttctattatacctctagttttggcgggtataataagcattgtgtattggagattctttgatgacctgcgtccatatgctctagtccaatttgtgccatgcattgtcattcctctaatggctattttgttgcctccaatgtacacacattcaacatattggctctgggctgcagggtcttatcttctagctaaggtgctagaggctactgatgatgtgatctatgaatgggcgcaacatattgtcagtggtcacacacttaagcatctggttgcagcaatggttcctgtcttcttaacattcatgcttgctaagaggagtgttgaacctgagaggcaaagtttgcttaaaacgtggagggtttcctggacgaagttcagagagggcaactccaacattgagagctactcttactcttacacaaatgtgcaggctgtggagccccagtgatgtgttactttcccatagaacaaaaaataataaaggcttatcctggattacggaatattgttacacttgactgtggactaggtaaaacaagacatagcaagttaactttcacacaataatattatctgtaattaactttgtatagttcccgatctttatcacatagagaggaccatttagatctgtgattctgtatgtgttgtctaatgtctatttttcgttcagcatggttataatctgcacgccttcaaagttcaaacccttgtagtgcttgtcatgagaaatcatactaactgatattaattaggaa

SEQ ID NO: 3482 - DNA, 1376 bp, Glycine max
gcaaagggaaagagaggaagagtgaaaatgaaaatgagaagggggtcggggggaatattgaacacaacacccactgcacagcttcataactaaaccgccatcgcctccaagactttccgtgcccaaaagatgagaaaacgcagcatttacgcatggctagtagcacttgtttgcttcctcctactcatgatcgtcaccccagccattccccagtcacaagaataccatgatttcgccgaccaccgcaccttcctcggtattcccaatgcacttaacgtgatatccaatttcccttttctggttattggcctcgttggacttgtactctgtcatcatggaaattactttaggctcagcttgcaaggtgaactatggggctggacatgcttctatgttggcgtggctgcagttgcagttggatcttcatactatcatctcaagccagacgatgctcgccttgtgtgggatcgcttgcccatgaccgtcgcttttacatcaatcatggcaatattcatcattgagcggattgatgagaggaagggaacggtttctattatacctctagttttggcgggtataataagcattgtgtattggagattctttgatgacctgcgtccatatgctctagtccaatttgtgccatgcattgtcattcctctaatggctattttgttgcctccaatgtacacacattcaacatattggctctgggctgcagggtcttatcttctagctaaggtgctagaggctactgatgatgtgatctatgaatgggcgcaacatattgtcagtggtcacacacttaagcatctggttgcagcaatggttcctgtcttcttaacattcatgcttgctaagaggagtgttgaacctgagaggcaaagtttgcttaaaacgtggagggtttcctggacgaagttcagagagggcaactccaacattgagagctactcttactcttacacaaatgtgcaggctgtggagccccagtgatgtgttactttcccatagaacaaaaaataataaaggcttatcctggattacggaatattgttacacttgactgtggactaggtaaaacaagacatagcaagttaactttcacacaataatattatctgtaattaactttgtatagttcccgatctttatcacatagagaggaccatttagatctgtgattctgtatgtgttgtctaatgtctatttttcgttcagcatggttataatctgcacgccttcaaagttcaaacccttgtagtgcttgtcatgagaaatcatactaactgatattaattaggaatttaggatattcctggtatgttgcaatgctcatctcacgaaattgaagttgacctgaagtttatattaga

SEQ ID NO: 3483 - DNA, 1384 bp, Cajanus cajan
tatagaaatgtgttaaaaaagcttgttgtgttattagcactagtaagaggaaatttggaagagtaagaggaaagcaaaaggagagataggaacgtaaacaaactcctccctctgagtctctgactttcctcggcgcccaaaagatgagaaaccgaagcgtttatgcatgggcagtggcactcgtttgcttccttgtgctcatgatcgttaccccagccattccccagtcacaggagtatcataatttcgccgaccaccgcaccttcttcggcattcctaatgcactaaacgtgatctccaatttcccttttctggttattggcctcattggacttgtactatgtcatcatggaaattactttaggctcagcttgcaaggtgaactatggggttggacttgcttctatgttggtgtggctgcagttgcagttggatcttcatactatcatctcaagccagatgatgctcgccttgtgtgggataggttgcctatgactgttgcttttacatcaatcatagcaatattcatcattgaacggattgatgagaggaagggaatgatttcaattatacctctaattttggcgggtataataagcattgtgtattggaggttcttcgatgacctccgtccatatgctctgatacaatttgtaccatgcattgccattcctctgatggctattttgttgcctccgatgtacacacattcgacatattggctctgggctgcagggtcttatcttctagctaaggttctagaggctactgatgaggtgatctatgaatggacgcatcatattgtcagtggtcacacacttaagcatctgtgtgcagcaatggttcctgtcttcttaacattcatgcttgctaagaggactgttgaacctgagaggcaaagtttgcttaaaacgtggagggtttcctggacgaagttcagagagggcaactcaaaggttgagagctacacttactcttactcaaatgtgcagactgtggagccccagtaacgtgctacgttccttagaacaaaaataagggcttatactggattacagaatattgttatacttgatcgtggactaggaaaaacaagccataccaagttaactttcacacaataatattaaccgtaattaattcttagtctgtatagttcatgattttttatctcatagctaggatcgttttacctttgaatcactgaatgtgagtgttgtatattttttgttcagtatggtattgatttgcacacctccttcaaactctagtagtgcttgtcacgagaaatcatattggtattaggatattcctggtatgttgctttgcggcccgtgctgcatcacaagaaattgatgttgacctgaagtgaatatttgattat

SEQ ID NO: 3484 - DNA, 1177 bp, Vigna unguiculata
ggaactcatacgaaacttgtatcgctcagcatctgcgcccccaaaccatgagaaatcgcagcctctatgcgtggctggttgcacttttttgcttcctcgtacttatgatcgttaccccagccattcctcagtctcaggagtatcataatttcgccgaccaccgcaaattcttgggtattcctaatgcacttaatgtgatatcaaatttcccttttctggttattggtctcgttggacttgtactctgttatcgtggaaactactttagactcagcttggaaggtgaaatatggggttggacttgcttctatgttggtgtggctgctgttgcagttggatcttcgtactatcatctcaagccagatgatgctcgccttgtgtgggataggttgccaatgactattgctttcacatccatcattgcaatattcatcattgagcggattgatgagaggaagggaacggtttcaattatacctctacttttggctggtataataagcattgtgtattggaggttctttgatgaccttcgtccatatgctctggtccagtttgtgccttgcattgccattcctctaatggctattttgttacctccaatgtacacacattcaacatattggctctgggctgcagggttttatcttttagctaaagtgctagaagctactgatgaggtgatctatggatggacacaccatattgtcagtggtcacacacttaagcatctagctgcagcaatggttcctgtcttcttaacattcatgcttgctaagagggatgttgaacctgagaggcaaaatttgcttaaaacttggagggtttcttggatgaagttcagagagggcaactccaacgttgagagctactcttactcgtacagtacggtgccggttgtggagaaatagtatggtgttactttcccatacaacaaaataaaggggtatactggattacctaatactgttaagcttcaatgtggaccaggtaaagtgccatgactttcatacaataatattatctgtaattaactctgtacagtttcccataggtacaatgtagagagtatttattttagttatgaatgtgttatgtactttttatgtcacctccttcacactctggtggtgcttgtctcaaaattatactaaatgaaattagaatatatctgctc

SEQ ID NO: 3485 - DNA, 1130 bp, Phaseolus vulgaris
ggtgttctacacaactcatactaaacttgtgttgtatcaatcgctgagcctgagacagattttctccatccgcgcccaaaccatgagaaatcgcagcgtttatgcatcgctggttgcacttttttgcttcctcgtactcatgatcgttaccccagcaattcatcagtcccaagattatcataatttcgctgaccaccgcaaattcttcggtattcctaatgcacttaatgtgatatcaaatttcccttttctggtcattggcctcgttggacttgtactctgtcatcgtggaaactactttagcctcagcttgcaaggtgaaatatggggctggacttgcttctatgttggtgtggctgctgttgcagttggatcttcatactatcatctcaagccagatgatgcccgccttgtgtgggataggttaccaatgactgttgcttttacatcaatcattgcaatattcatcattgagcggattgatgagtggaaaggaacggtttcaattatacctctacttttggctggtataataagcattgtatattggaggttctttgatgaccttcgtccatatgctctggtccaatttgtgccttgcattgccattcctctaatggctattttgttacctccaatgtacacacattcaacatattggctctgggctgcagggtcttatcttctagctaaagtgctagaagctactgatgaggtggtctatgaatggacacaccatattgtcagtggtcacacactaaagcatctagccgcagcaatggtccctgtcttcttaacattcatgcttgctaagagaagtgttcaacctgagaggcaaaatttgctcaagacttggagggtttcctgggtgaagttcagacagggcaattccaacgttgagagctactcctattcatacacagatgtgccggttgtggagccacactgaggttttaatttcccatagaacaaaataaaggcttatactggattacataatactgttaaacttgaatgtggaccaatacaatgctatttgtctgtaattaactctgtacagtcccccatatgtacaacatagagcgtatcgattttagtgatgaatgtgtgatctactttttatttctcac

SEQ ID NO: 3486 - DNA, 1197 bp, Phaseolus vulgaris
ggtgttctacacaactcatactaaacttgtgttgtatcaatcgctgagcctgagacagattttctccatccgcgcccaaaccatgagaaatcgcagcgtttatgcatcgctggttgcactttttttgcttcctcgtactcatgatcgttaccccagcaattcatcagtcccaagattatcataatttcgctgaccaccgcaaattcttcggtattcctaatgcacttaatgtgatatcaaatttcccttttctggtcattggcctcgttggacttgtactctgtcatcgtggaaactactttagcctcagcttgcaaggtgaaatatggggctggacttgcttctatgttggtgtggctgctgttgcagttggatcttcatactatcatctcaagccagatgatgcccgccttgtgtgggataggttaccaatgactgttgcttttacatcaatcattgcaatattcatcattgagcggattgatgagtggaaaggaacggtttcaattatacctctacttttggctggtataataagcattgtatattggaggttctttgatgaccttcgtccatatgctctggtccaatttgtgccttgcattgccattcctctaatggctattttgttacctccaatgtacacacattcaacatattggctctgggctgcagggtcttatcttctagctaaagtgctagaagctactgatgaggtggtctatgaatggacacaccatattgtcagtggtcacacactaaagcatctagccgcagcaatggtccctgtcttcttaacattcatgcttgctaagagaagtgttcaacctgagaggcaaaatttgctcaagacttggagggtttcctgggtgaagttcagacagggcaattccaacgttgagagctactcctattcatacacagatgtgccggttgtggagccacactgaggttttaatttcccatagaacaaaataaaggcttatactggattacataatactgttaaacttgaatgtggaccaatacaatgctatttgtctgtaattaactctgtacagtcccccatatgtacaacatagagcgtatcgattttagtgatgaatgtgtgatctactttttatttctcaccttcttcagactctgctgatgcttgtgttgacaaattatactaatgaaattagaatatttctgcta

SEQ ID NO: 3487 - DNA, 1215 bp, Medicago truncatula
atcatctctgatccaatcttgtttggtctgtctgtgaatccaaaaatgagaaaacgcgtcgtttatgcttgggcagtagctcttatttgcttcatagtactcatgattgtaaccccagctattcctcagtcccaagattatcataattttgctgatcaacgcaccttctttggtattcccaatgcacttaacgtcatctccaatttcccttttctcattattggtctcattggacttgtactctgtcatcatggaaattattttaagctcagcttgcaaggtgaactatggggttggacatgcttctatgttggtgtggctgctgttggaattggatcttcatactaccatctcaagccagatgatgctagtcttgtctgggataggttacctatgactgttgcttttacgtcaatcattgcgatattcatcattgagcgaattgatgaaaggaaaggaatgatctcaattatacctcttgttttggctggtgtaataagtatcgtgtattggaggttctttgacgacctccgtccatatgctttgattcaatttgtaccatgcattgcaattccactcatggctattttgttgcctccaatgtacactcattcaacttattggctctgggctgcaggattttatcttctggctaaggtgttagaggccactgatgatgtcgtctacaaatggactcatcatattgtcagtggtcatacacttaagcacttgtttgcagcaatggttcctgtcttcttgacattcatgcttgcaaagaggagtgtggaacctgagaggcaaagtttgtttaaggtatggaggatttcctggacaaaggtcaaagaaggcgactccaatgttgagagctacacttactcaagggtggaggttgaagaaccacagtaatgtctgtctactttcctatcaaccacaaaaatgcttatactggattacagaatatatatcatacttgatcttggactgagtaaaaaaaccacagtaagctaactttcatacaacgttaactgtaattagcttacagtttgtatagttcctgatccttatcatatagcaaggacctttttagatttcaatgtgaagtgttgtctagtgcaatactggtatttttccacctgtatcatacacttgtagtgcttgttggcacgagaaatcgttccaactatttcaatgatatgttagaccgtgtttacagaa

SEQ ID NO: 3488 - DNA, 1245 bp, Arachis hypogaea
cagaatcatattgtcacagctcacacactacacaattcaattaaattccactgctgaagcaaccaattttgcaggtttaacagcgggaatcgaaaactggaacgaatatgaggaaacgcaccgttttggcatgggtagtagcagttgtttgcttcgtagtgctgatgatcgttaccccagccattcctcaatcacaagaataccatgatttcgcagaccagcgcaccttctttggcattcctaatgcacttaatgtgatatcaaatttcccatttatgattattggccttattggggttattctctgtcaccatggaaattatttcaagctcagcttgcaaggagaactatggggttggacatgcttctatgttggtgtggccgcagttgctgttggatcttcatactatcatctcaagccggatgatgctcgccttgtgtgggacaggttgcctatgactattgcttttacatcaatcgtggcgatattcatcatcgagaggatcgatgagaggaagggaatgatttcaattatacctctattattgattggtataataagcattgtgtattggaggttctttgatgacctccgtccatatgccgtagtccaatttgctccgtgcatcgccattcctctcatggctattttgttgcctccgatgtacacacattcaacttactggctctgggctgcagggttttatcttctagcgaaggtgctagaggctgctgataaggtgatctatgaatggactcatcatgttgtcagtggtcacacacttaaacatttgtctgcagctatggttcctgtctttttgacattaatgcttgcaaagaggagtgttgattcagagaggcaaagtttacttaaaacctggagagtttcatggaccaagtacagagagggtaactccaatgttgagagctacactatatcttactcaaatgtgcctgttgaggagccccaatagcatctcttttctttcttactgagaagaacagcttaattttgatgtatctaagtttttttttttcttttacttgcttccattagggtgtgaagtgtgaacaaatcattggatgcaagtataatttgttttacaaaacatcaaaattattcactaccaaataatgttccataggataacattacttgtaattaacaatttagcttatagtttgtaatatgtatagttcatgatatttgtcacataaaagaactattgaaaatctgtgatagtc

SEQ ID NO: 3489 - DNA, 1288 bp, Trigonella foenum-graecum
cgcaccgcatcatacacggctttccccagtcctcttctcttctcttctcttccttcatcgcttcaattatgatctgatcttcttcttctccctctctctcttcgttaattaatcaaaacccaaaaatgagaaaacgcatcgtttatgcgtgggcagtagctcttatttgcttcatagtactcatgattgtaaccccagctattcctcagtcccaagattaccataatttcgccgatcaacgaaccttctttggtattcccaatgcacttaatgtcatatccaatttcccttttctcattattggtctcattggacttatactttgtcatcatggaaattattttaagctcagcttgcaaggtgaactatggggttggacatgcttctatgttggtgtggctgctgtcggcattggatcttcatactatcatctcaaaccagatgatgctagtcttgtctgggataggttacctatgactattgcttttacgtcaatcattgcaatattcatcattgagaggattgatgagaggaaaggaatggtctcaattatacctctaattttggctggtataattagcattgtctattggaggttctttgacgaccttcgtccatatgctttggttcaatttgtaccatgcattgcaattccactcatggctattttgttgcctccaatgtacactcattcaacttattggctctgggctgcaggattttatcttctggctaaggtgttagaggccactgatgatgtcgtctacaaatggactcatcatattgtcagtggtcatacacttaagcatttgtttgcagcaatggttcctgtcttcttgacattcatgcttgcaaagaggagtgtggaacctgagaggcaaagtttgtataaaatatggaggatttcctggacgaaggtcaaagaaggcgactccaatgttgagtacacttactcaagggtggaggttgaagaaccacagtaatgtttgtctactttcccatcaaccatttaaatgcttatactggattacagaatatctgtaatacttgatcgtggactgagtaaaaaaaccacagtaagctaactttcatacaacattaactgtaattagcttacagtttgtacagttcctgatccttatcatatagcaaggacaattttagatctaaatgtgaagtgttgtcttgtgcaataatggtatttgtccacctgcttcacacacttgtagtgcttgttggcacaagaaatcgttccaactatttcaatgatatgttagactgtgtttac

SEQ ID NO: 3490 - DNA, 1368 bp, Cicer arietinum
ttgagttcaacgatagtaaacacgctgtttccgagctctttccccaaaattcatcgattccattatcgtctctttgatctgatattttttgtttgttctgtctgtattaaattacaaaaatgagaaaacgcatcgtttctgcatggggtgtagctctaatttgcttcatagtactcatgatcgtaaccccaactattcctcagtcccaagaataccataatttcgccgaccaacgcaccttctttggtattcccaatgcacttaatgtgatatccaatttcccttttcttgttgttggtctaattggacttatactttgttaccatggaaattattttaagctcagcctgcaaggtgaattgtggggttggacatgtttctatcttggtgtggctgctgttggagttggatcttcatactatcatcttaagccagatgatgctacccttgtttgggataggttacctatgactattgcttttacgtcgatcattgcaatattcatcattgagaggattgatgagaggaaaggaatgatctctattgtacctctaattttggctggaataataagcattgtgtattggaggttctttgatgaccttcgtccctatgctttagttcaatttgtaccgtgcatcgccatgccactcatggctattttgttgcctccgatgtacactcattcaacttattggctatgggccgcaggattttatcttctagctaaggtactagaggccaccgatgatgtggtatacaaatggactcatcatattgttagtggtcatacactaaagcacttgtttgcagcaatggttcccattttcttgacattcatgcttgcaaagaggagcctggaagaagataggcaaagtttgcttaaaacatggaggatttcatggacaaagattaaagagggtgactccagtgttgagagcttcacttactcaagggtgcaggttgaagagccccagtaatatctttctacttacccaatcaaacacaaaaaaatgcttatactggattacagaatatctgtgacaatggattgtggaccaagttaaacaaaccacagtaagctaactttcatagaacgttaactgtaattgttttatagcttgtatagttcttgatttatataatatagtaaggaccattttagatctgaatgtgaagtgttgtctagttcaataatggtatttgctcacctgcttcatatacttatagtgcttgttggcacaagaaatcgtcccaactatttcaatgagacattagaatgtgtttacagaacttatgagctttaattggtaaggtatagatgttaggacattcctgatatgttgctgggctttgattcccatcaaa

SEQ ID NO: 3491 - DNA, 1783 bp, Cicer arietinum
atttttgtctaactaataattaattaaataaaaagtgattgagttcaacgatagtaaacacgctgtttccgagctctttccccaaaattcatcgattccattatcgtctctttgatctgatattttttgtttgttctgtctgtattaaattacaaaaatgagaaaacgcatcgtttctgcatggggtgtagctctaatttgcttcatagtactcatgatcgtaaccccaactattcctcagtcccaagaataccataatttcgccgaccaacgcaccttctttggtattcccaatgcacttaatgtgatatccaatttcccttttcttgttgttggtctaattggacttatactttgttaccatggaaattattttaagctcagcctgcaaggtgaattgtggggttggacatgtttctatcttggtgtggctgctgttggagttggatcttcatactatcatcttaagccagatgatgctacccttgtttgggataggttacctatgactattgcttttacgtcgatcattgcaatattcatcattgagaggattgatgagaggaaaggaatgatctctattgtacctctaattttggctggaataataagcattgtgtattggaggttctttgatgaccttcgtccctatgctttagttcaatttgtaccgtgcatcgccatgccactcatggctattttgttgcctccgatgtacactcattcaacttattggctatgggccgcaggattttatcttctagctaaggtactagaggccaccgatgatgtggtatacaaatggactcatcatattgttagtggtcatacactaaagcacttgtttgcagcaatggttcccattttcttgacattcatgcttgcaaagaggagcctggaagaagataggcaaagtttgcttaaaacatggaggatttcatggacaaagattaaagagggtgactccagtgttgagagcttcacttactcaagggtgcaggttgaagagccccagtaatatctttctacttacccaatcaaacacaaaaaaatgcttatactggattacagaatatctgtgacaatggattgtggaccaagttaaacaaaccacagtaagctaactttcatagaacgttaactgtaattgttttatagcttgtatagttcttgatttatataatatagtaaggaccattttagatctgaatgtgaagtgttgtctagttcaataatggtattttgctcacctgcttcatatacttatagtgcttgttggcacaagaaatcgtcccaactatttcaatgagacattagaatgtgtttacagaacttatgagctttaattggtaaggtatagatgttaggacattcctgatatgttgctgggctttgattcccatcaaaagcactagtagcattgtatgagcaagtgggtcatttagagaatgaagtgccttgattctttcttgtaaaggttcaccatcataataagaagagatcatttattcctttggatatcactagtaatagattctgtatgtaaggtccaagttcacaagtggaacaaaataaaagcaccatggttcaaatcaagctactgacaattatagtggacatcacaccctttagtcagctcccaaatccaaatatttctgtatttgtcaaatgaattttcaattaactcttcttttcttttatattataatatttacattcatcttatatctctctctttctcgttcatatcacctcttaggatgtaaattgtgatatatcatca

SEQ ID NO: 3492 - DNA, 1561 bp, Theobroma cacao
ttattaaattaataatattagcatgcgagtttatattagatgcatttcattaaaataggcaaaagaacttaagcaagaacttttttgacatgtaacgtgaggctaagataagatgccaaagcatgcatgcatagggaattttaggaagtgaatttaaggagggcaaaagattgtgactattccttacttgtatgtcaaatggaatacgaattacttcacaaaaccttttctcttccagaattttattatccaataagacacgaacaccgctaccgctataagaaaataagccgacacactttccttatcttattatgctaaacgaaacaaaaacaaaatttccgttccacgttattccaaagggtatatattttcgccagcaaacaaacggagccgtaaccatagtacaaggttcaaattaaatctctcccttcgtctttactctatcggctccgtcggtgacagaagagagatgagaagacgcaccgtttacgcatggggagttgcgattctctccttcgtagttttgatgatcgtcacgcccgccatccctcaatctcaagagtaccacgatttcgccgatcaacgcgaatttttcggtatacccaatacgttaaatgtggtttcgaatttccccttcctagttatcggggtcgtaggtcttgtactttgttattataagaattatttcaagttatgtttgcaaggtgaactatggggttggacttgttttttcattggtgtggctgctgttggagttggttcctcgtactatcatctccagccaaatgatgctcgacttgtgtgggatagattgccgatgactattgcgttcacttcaatcatagcaatatttattattgaaagaattgatgagcagaagggaacagtttccatcataccactgctgctggcaggcgtaatcagtatcatgtactggaggttttttgatgacctccggccttatgccctggtccagtttgttccttgcattgccatcccactgatggctattttgttgcccccaatgtacacgcattccacattttggttatgggcagcaggattctatcttttagctaaggtagaagaagcaatggataaagtaatatataaatggacccatcatattgtcagtgggcacaccctcaagcacttgtgtgctgccatggttcctgtctttttaacacttatgctggccaagaggacaattgaaactgagaggataagcttactgaagacatggaaggtttcatggacaaagttcaagaaaaatggttccgaggtggaaagttgcacgtgtacctacaccagtgttcaagctgaggaatcacactgacttgcacttatggcatatacttttatgtaacaagaccgatccaaacagatcactctaactttcacttaaagaacactggttcaaaagagaaataggttcgaaatttgaacactttgtcatgtttgtaaatgttttatagcaaaatattctttctaatgcgctgatgggcaagggctcttactcacacttttagtcttttctttttactttcattttgtacga

SEQ ID NO: 3493 - DNA, 941 bp, Glycine max
gggccggttggttgaaaaggcgtgtgtgtgttgatccctatttatactttagggctaataagcttaaagggtagcgtgtgtgttcccattccctgtggtgaaaggctaaggaggaagatggtgctttcggaggaggaaatgggtcgtctgtaccgaataaggaagacggtgatgcaaatgcttcgggacaggggttttctggtgggtgacttcgagatcaacatgtcgaagcatgagttcaagtccaagtacggcgagcacatgaagcgcgaggacctggtcatcaacaagtccaagaaggacaactccggcgaccagatctacgtcttcttccccgacgagcccaaggtcggcgtcaagaccatgaagacctacaccaaccgcatgaactccgaaaacgtctatagagccatcctcgtcacccagaccaacctcacccccttcgcccgcacctgcatcagcgaaatctcctccaaattccacctcgaggtctttcaggaggccgaacttctcgttaacattaaagagcatgagcttgtccccgaacatcaggttctcactgacgccgagaagaaaaccttgcttgagagatacactgtcaaggaaactcagctacctaggattcaggtcacagatcctgttgcaagatattatggattgaagcgtggacaagttgtcaagattatccggccaagtgaaactgctggcagatatgtgacataccgatttgttgtataagaatttgctttaacatatttggttatactgtcatagtgatggatagggatataaagccttctttttgcaaggggggaactcttgatttacaaggaaatgaaatgtgtgtttgtttctgtttattatagactattaagttcttttggtaatttagtgacaaggagagcagagggaggttcatttcttatgtcatttctgtgcat

SEQ ID NO: 3494 - DNA, 1148 bp, Glycine max
gggccggttggttgaaaaggcgtgtgtgtgttgatccctatttatactttagggctaataagcttaaagggtagcgtgtgtgttcccattccctgtggtgaaaggctaaggaggaagatggtgctttcggaggaggaaatgggtcgtctgtaccgaataaggaagacggtgatgcaaatgcttcgggacaggggttttctggtgggtgacttcgagatcaacatgtcgaagcatgagttcaagtccaagtacggcgagcacatgaagcgcgaggacctggtcatcaacaagtccaagaaggacaactccggcgaccagatctacgtcttcttccccgacgagcccaaggtcggcgtcaagaccatgaagacctacaccaaccgcatgaactccgaaaacgtctatagagccatcctcgtcacccagaccaacctcacccccttcgcccgcacctgcatcagcgaaatctcctccaaattccacctcgaggtctttcaggaggccgaacttctcgttaacattaaagagcatgagcttgtccccgaacatcaggttctcactgacgccgagaagaaaaccttgcttgagagatacactgtcaaggaaactcagctacctaggattcaggtcacagatcctgttgcaagatattatggattgaagcgtggacaagttgtcaagattatccggccaagtgaaactgctggcagatatgtgacataccgatttgttgtataagaatttgctttaacatatttggttatactgtcatagtgatggatagggatataaagccttctttttgcaaggggggaactcttgatttacaaggaaatgaaatgtgtgtttgtttctgtttattatagactattaagttcttttggtaatttagtgacaaggagagcagagggaggttcatttcttatgtcatttctgtgcatgatgttgtcccgagtcttttataagttgctggcttcttcctgctccataattatctatttaaccatatgatttaggtgcaaaccttaccggaattatgataaagtcattctcatgtcaattgagatgaaattccttcatgaacgatctcgaattcgtttagttatacacacataggagcatattaaaagtgagagtaaaaggaattg

SEQ ID NO: 3495 - DNA, 903 bp, Vigna unguiculata
ggaagaagaacatttgggagagaaagcgaagtgaagaagatggtgcttcccgatgaagaaatttcaaggttgtaccgaatcaggaagacggtgatgcagatgctgagggacagagggtatcttgtgggagacttcgagatcaacatgtccaagcacgagttcaaatccaagtacggcgagcacatgaagcgtgaagacctcgtcatcaacaagtccaagaaggacaactccggcgaccagatctacgtcttcttcccggaggaggccaaggtcggcgtcaaaaccatgaagacttacactaaccgcatgaactccgaaaacgtcttcagagccattcttgtcactcagactaaccttacccccttcgccagaacctgcatcagcgaaatctcttccaaatttcacttggaggtttttcaggaggcggagctgctggttaatattaaagagcacgagcttgtccctgaacatcaggttctcactgatgctgagaagaaaaccttgattgagagatacactgtgaaagaaactcagctacctaggattcaggtgacagatcctgtggcaagatattatggattgaaacgtggtcaagttgtgaagattattcgacctagtgaaactgctggaagatatgttacatatagatttgttgtataagaatgttataacttattgaccacattactttttagaatatgttgcatagtaatggacagaagggatctgaagcttgtggaattaaagtcctctatttatatctaaattgattgatgctgttatgaacagtcttgttagtgtgttatggagctttgtttcctttcgtaatggaccaataattatggtgtgtattcaaacaattttggttctgcttttactttctagtacacaatggtgtaaacc

SEQ ID NO: 3496 - DNA, 1035 bp, Cajanus cajan
agagttgaaggagggtagagtgcgtttccaaattccaagtaggcatataaaaggacgctagggctaaaaagagtgggaagaaaggaatagtggtgtggcggtggcgaaagaatggtgcttctggaggaagaaatcgggaggctgtaccgcataaggaagacggtgatgcagatgctgagggacagagggtacctggtgggggacttcgagatcaacatgtccaagcacgacttcaagtcaaagtacggcgaaaacatgaagcgcgaggatctcgtcatcaacaagtccaagaaggacaactccggcgaccagatctacgtcttcttcccggaggaggtcaaggtcggcgtcaaaaccatgaagacctacaccaaccgcatgaactccgagaacgtctacagagccatcctcgttcttcagaccaacctcactcccttcgctagaacctgcatcagcgaaatctcttccagatttcacttggaggtttttcaggaggcggaactgctggtgaacattaaagagcacgtgcttgtccccgaacaccaggttctcaccgacgcggagaagaaaaccttgcttgagagatacactgttaaagaaactcagctacctaggattcaggtgacagatcctgttgcaaggtattatggactgaagcgtggacaagttgtcaagataatccggccaagtgaaactgctggcagatatgttacgtaccgatttgttgtataagaattttctttaacttgatttagaagaggtgaaatgtgtgatttgtcgaaatggtgtatagggagaaactcttgatttacaagaggtgacatgtgcgattgttgaaacttttggaatcaaaaatatatatttatatcgtaattgactggcttctgttgtttttgattggtggtgttggtgtcatatggaactctgtttttgtgctttatagatcaatgagttctttaaataattcagtgacagggagagcatgaggttcatttatttattcatttcttgagcatatgctaaggtcatttttat

SEQ ID NO: 3497 - DNA, 952 bp, Phaseolus vulgaris
agaattcaatttaagcccattgggtcgaaaacctaattacaccctgcgagtattcttcccctttatttaaaagaggaaactttagggcaaaggaagaaaggcgaagaagaagaagaggaagaagaaaatttgggagcgaaaggaaagagaagaagatggtgcttacggatgaagaaatatctcggctgtatagaataaggaagacggtgatgcatatgctgagagacagaggttaccttgtcggagacttcgagatcaacatgtcgaagcacgagtttaaatccagtcatggaggagagaacatgaagcgtgaagacctcgacctcaacaagtccaagaaggataactcctccgaccagatctacgtcttcttcccggacgaggccaaggtcggcgtcaaaaccatgaagacatacactaatcgcatgaacaacgacaacgtctacagagccattctcgtcactcagaccaatctcacccccttcgccagaacctgcgtcagcgaaatctcctccaaatttcacttggaggtttttcaggaggcagagctgcttgtgaatattaaggagcatgaacttgtccctgaacatcaggttctcactgatgctgagaaaaaaaccttgattgagagatacactgtcaaagaaactcagctacctaggattcaggtgacagatcctgttgcaagatattatggattgaaacgtggtcaagttgtgaagattattcggccgagtgaaactgctggaagatatgttacatatagatttgttgtataagaatgtttgaacttattgactatatcactttttaggatatcttccatagtaatggacataatggacagggatgtgaagcttttggaatcaaaatcgaatttatatcgaagttgattttgtgttgttatatcgaagttgatttataagttcatttgctttgtcttttctctgtc

SEQ ID NO: 3498 - DNA, 827 bp, Glycyrrhiza uralensis
ccccaatcaatccatatagaacgcaaaaaaccgctctcgccggccgcaccatcctttgtgagctgagaagagaagagaagatggtgttttcggaggaagagatatcgcggctgtacaggataaggaagacggtgatgcagatgctgagggacaggggataccttgtgggagacttcgaggttaacatgccgaagcacgagttcaagagcaagtacggtgaacacatgaagagggaagacctcgtcatcaacaagaccaagaaggataacccttccgaccagatctatgtcttcttccccgaggaacacaaggtcggtgttaagaccatgaagacctacaccaaccgcatgaactccgagaatgtctaccgtgccatcctcgtcctccagaccaacctcacccccttcgcccgtacctgtgtcgccgaagtctcttccaaattccacttggaagtcttccaggaggcggagctgctggtgaacataaaagagcatgtgcttgtgccggaacatcaggtgctcaatgacaccgagaagaaaaccttgctcgagagatataccgtcaaagaaactcagctacctagaatccaggtgacggatcctgttgcaagatattatggactgaagcgtgggcaagttgtcaagataatccggccaagtgagactgcaggcagatatgttacataccgatttgttgtttaagaatttcctagaacttactggctatactatttttgcaatatttacctactgatatttatgagaagtatggacaatgattatacaatctttttttgtaatgggtgaacatacaacatgacatatgtt

SEQ ID NO: 3499 - DNA, 998 bp, Cicer arietinum
atttgatgaaacaaattttgttcttagtggacgcaaaagtacgcttcccgcacgcagatagacaccggactaacacctctgtttctttccaatcatcaaaccctctctcagtctgatttgtggtcgttgacaagtaatttctttttctttttcttttttagttgtgatagtacctaccctattgtagaagagcgacgccacgatggtgtttccagaggaagagataacgaggctatataggattcgtaagacggtcatggtgatgcttagggacaggaattacctcgtcggagactttgaggttaacatgtccaaacacgagttcaaggaaaagtacggcgagaacatgaagagagaagaccttgttatcaacaagactaaaaaagataaaccctccgatcagatctacgttttcttcccggaggaagttaaagtcggcgtcaaaacaatgaagacttacactaaccgtatgaactccgagaatgtgtacagagcaatccttgtttgtcagaccagcctcactcccttcgcgcgaacttgcatcgctgaagtctcttctaaatttcacttggaagtctttcaggaggcggaacttttggttaacataaaggaacatgtgcttgtgcctgaacatcaggtgcttactgaaactgagaagaaaactttacttgagagatacactgtcaaagaaactcaactacctagaatccaggtgacagatcctgttgcaagatattatggtctgaagcgtggacaagttgttaagataatccggccaagtgagactgcaggaagatatgttacataccgatttgttgtataatgattttcctccttgcccattgatatttatgagaaacttgaacagtgattatacagccttttttttttaatggttgacaataactacgtttttgtagcttgtgtttacctactagttctaagcctcgtgaaatatggttaaaatgattttaatgtctactcagagtccgatgcta

SEQ ID NO: 3500 - DNA, 1604 bp, Medicago truncatula
atgacgaaagtcatggctgaagccaacatttttcacagggtagaatgttggggggtccaaagttgggctaatgttcgcactctgcatgctgttctggagctttttgaggcaatgtcgggtttgaaggttaatttttataagagcatgttggttggggtcaatatttcagactcttggttaaatgaagcagccactattttgaattgtaaagtgaataaaattcctttcatgtatctgttctttcctatttatgttttggaagttgaaaaggaggacaaatggctatataatttggaaaaatctaacgtttacgctgttaggagtgcttataattttcagtttgctcaacttgctgttggtcccctgttggatgtgacgatgctttgttccctgaaaaatgtgaatcacttatttttacatcgctctttctttggggcggtttggtctcatattactcggtgggttgggttttcaatggtcgccccttttgagatattagatcattgcactcagttcagttttgatggtggtgattctcaggttcagtatttgttgtcaatcaatcaccaagaatccaatttagccttctgcgacaccaccaccaagaagacgatggtgttttcagaggaagaaataacgcgactatacagaatccgcaaaacagtgatgcaaatgctcaaagaccggaactacctcgtcggtgatttcgaactcaacatgtccaaacacgatttcaaagacaaatacggcgagaatatgaaaagagaagatctcgttattaacaaaaccaaaaaagataaaccttctgatcagatctatgtcttcttccctgaagaagccaaagtcggtgtgaaaacaatgaagacctacaccaaccgaatgaattctgagaatgtttatagagctattcttgtttgtcaaaccagtcttactccctttgccaaaacttgtgtttctgaaattgcttccaaatttcacttggaagtttttcaggaggcagagttgctggttaatataaaagagcatgtgcttgtgcctgaacatcagattctcaatgacaccgagaagaaaaccttgcttgagagatacactgtcaaggaaactcagctacctagaatccaggtaacggatcctgttgcaagatattatggcctgaagcgtggacaagttgttaagataatccggccaagtgagactgctggaagatatgttacataccgatttgttgtataaggattttcttgcctaccgatatttatgataagctcgagcaataattatacagcctttttttgtaatgggtgacaataactacatttcagcaggggtttatttattttatgtcagccctcctgttcctagggaacgatgccctggtaatttggagttcgggatgaaatgtgtaagccgcatgaaatatgtttaaaattgtgttaatgtgtaccgagagtctgagacaattttttttctttttttgaacaattgtgaattcacacttctataagttccctgctcaacttgttaatctaaactcattttcatttccactggaactaaactcctgggacaatctttaattcgtttagttctttatgttacatggt

SEQ ID NO: 3501 - DNA, 908 bp, Cajanus cajan
cgaaaatgatatataaggaattttaccctatttaaaaattacggaagtaaaaaagcgtaactaaccggtgagtgggaaaagatggtggtgacggaggaggaaatggggaggctccaccgcataaggaggacggtgatgcagatgctgagggacaggggctacctggtgggcgatttcgagatcaacatgtcgaagcgggatttcgtgaacaagtacggcgagcacatgaagcgcgaggatctcgtcttcaacaaatcaaagaaggataactccggcgaccagatctacgtcttcttcccggaggaggttaaggtcggcgtgaagaccatgaagacctacaccaaccgcatgaactccgaaaacgtcttcagagccatcctcgtcctccagaccagcctcactcccttcgccagaacctgcatcagcgaaatcgcatccaaatttcacctggaggtttttcaggaggccgagcttctcgttaacataaaggaccattgccttgttcccgagcatcaagttctcaatcaagccgagaagaaaaccttgcttcagagatacactgtcaaagaaactcagttacctaggattcaggtgacagatcctgttgcaagatattatggattgaagcgtgggcaagtagtcaagataattcggccgagtgaaactgctggcagatatgttacctaccgatttgttgtttaacaattttctttaatttattggctaccctatactgctttttttttttgtgtgtggatattttgcatactaatggatagagtcatatacagctttcttttgcaaggctgtgatcgttgaaattttgcaataaaaaattatatgttacatattcatatactaagtgatacttgttacagttgataatgtcagtttgttatattggactt

SEQ ID NO: 3502 - DNA, 1134 bp, Trigonella foenum-graecum
ctaagcttaatctgattcacattcttccaccaccgtagcttccaccaccgccaccaacacgatggtgttttccgaggaagaaataacgcggctatacagaatccgcaaaacggtgatgcagatgctcaaagaccgaaactacctcgtcggtgatttcgaactcaacatggcgaaacacgaattcaaggacaaatacggcgagaatatgaagagagaagatcttgtgattaacaagaccaaaaaagataaaccttctgatcagatctatgtcttcttccctgaagaagcgaaggtcggtgttaagacgatgaagacttataccaatcggatgaactctgagaatgtttacagagctattcttgtttgtcagactagtcttactccgtttgcaaaaacttgtgtttctgaaattgcttccaaatttcacttggaagtttttcaggaggcggagttgctggttaatataaaagagcatgtgctagtgccggaacatcagattctcaatgacactgagaagaaaaccttactcgagcgatatactgttaaggaaactcagctacctagaatccaggtaacagatcctgttgcaagatattatggcctgaagcgtggacaagttgttaagataatccggccaagtgagactgcaggaagatatgttacataccgatttgttgtataaggatttccttgcctaccgatatttttgatgagcatggacaataatttatacagttttttttttgtaatgggtgacagtaactacattttagtaaggggtttatttattttattttgtgttagccctcctgttgttcctaagggacggggccctgataatccaaggttcgggatgaaatatgtttagaatcatgttaatgtgtaccgagagtatgagactattcatatttctttatgttccctggtcaaattgttaagctaaactcattttcatggctactgaaactaaacttctaaacaatggccactcaaaatcttttactaaaattaagtttattggcctattttaagaatggctgctcaggggcatacatttcttattttgtagtacttttttctgtttgtttcttctgtgcacagaacaattataatgcagcatctttggtagtttgc

SEQ ID NO: 3503 - DNA, 851 bp, Cicer arietinum
tccgtaccgccgcacgctatctcttcccacgccagccatcctttctccgtctctcgccgtacgccttcgcgttccgttaccgtcctccgtctgcgtcttcgtccgtttgctatttttagggacgagtgagagctcaggcgtggtgtgcctacccttgagtagaagaggacgccacaatggggtttccggaggaagagataacgaggctgtataggatccggaagactgtgatggagatgcttagggacaggaattacctcgtcggagacttcgagattaacatgtcgaaacaccagttcaaggagaagtacggtgagaacatgaagagagaagacctcgtcatcaacaagaccaaaaaagacaaaccctctgaccaaatttacgtcttcttcccagaggaagttaaggttggtgtcaagaccatgaagacttatatcaaccgtatgaactccgagaatgtttacagagccatcctcgtttgccagaccagcctcactccttttgcacgaacatccgtcgctgaaatctcctccaaatttcacttagaagtctttcaggaggcagaattgcttgttaacataaaagatcacgtgcttgtgccagaacatcaggtgctcactgacactgagaagaaaaccttactcgagagatacaccgttaaggaaactcagctacctagaatccaggtgacggatcctgttgcaagatattacggtctgaagcgaggacaagttgttaagataatccggccaagtgagactgcgggacgatatgttacataccgatttgttgtataagattttccttccccaccaatatatatgagaagcatagacactgattatacattt

SEQ ID NO: 3504 - DNA, 1121 bp, Cicer arietinum
ctaaatactacaacttgtaacattcaatccattgtattcacctaacctctcacctccgtaccgccgcacgctatctcttcccacgccagccatcctttctccgtctctcgccgtacgccttcgcgttccgttaccgtcctccgtctgcgtcttcgtccgtttgctatttttagggacgagtgagagctcaggcgtggtgtgcctacccttgagtagaagaggacgccacaatggggtttccggaggaagagataacgaggctgtataggatccggaagactgtgatggagatgcttagggacaggaattacctcgtcggagacttcgagattaacatgtcgaaacaccagttcaaggagaagtacggtgagaacatgaagagagaagacctcgtcatcaacaagaccaaaaaagacaaaccctctgaccaaatttacgtcttcttcccagaggaagttaaggttggtgtcaagaccatgaagacttatatcaaccgtatgaactccgagaatgtttacagagccatcctcgtttgccagaccagcctcactccttttgcacgaacatccgtcgctgaaatctcctccaaatttcacttagaagtctttcaggaggcagaattgcttgttaacataaaagatcacgtgcttgtgccagaacatcaggtgctcactgacactgagaagaaaaccttactcgagagatacaccgttaaggaaactcagctacctagaatccaggtgacggatcctgttgcaagatattacggtctgaagcgaggacaagttgttaagataatccggccaagtgagactgcgggacgatatgttacataccgatttgttgtataagattttccttccccaccaatatatatgagaagcatagacactgattatacattttttggtaatgggtgtcaatacaacatgacatgtgttgttatgttttgtagtgataatatttaaatggaactttatttctgtacaagtatagacctataaattttaccaagttgataacttttatcttgctgtagttttttttccttctttttggtaaattaaaattagggaggagaaatggagtatatgaatggacaaaaattaaaattaaaatta

SEQ ID NO: 3505 - DNA, 1055 bp, Lotus japonicus
actactagtttctttcttctctgcaagttacatcagaagaagaagatggcgttgacggaggaggacataacgaaactccaccgtatccgcaagacggtgatgcagatgctccgcgaccgcaactacctcgtcggcgacttcgagatcaacatgtcccgtcacgagttcaaaaccaagtacggcgacaacatgaagcgcgaagatctcaccatcaacaaaaccaagaaagacggtccctccgaccagatctacgtcttcttccccgacgaacccaaagtcggcgtcaagacaatgaaaacctacaccaaccgcatgaacagcgagaatgtcttcagggctattcttgtttgtcaatcgaacctaaccccgtttgcgaaaacatgtatctctgaaatgtcttctaagtttcaattggaagtgtttcaggaggcggagctgttggttaatatcaaggagcatgtgcttgtgccggagcatcagattcttaatgagactgagaagaaaactttgcttgagagatatacagtcaaggaaactcagctacctagaatccagataacggaccctgttgctagatattatggactgaagcggggacaggtcgtcaagataatccggccaagtgagactgcaggcagatatattacatacagatttgttgtataagaatttccttgaactgactggctgtacaactttttcaatatgttacctactcatttataagaagcatggacaagggatatttaggctattttgtaatggttgagcatacgacttgaaatatgttatcatggttggtaatgttagtctcttatgtgaaacttcattgccataaattattcaccaatgaactcttttggtaagttggtattcttttctttttggattttgttttgtttagtgattaaaagtctcgggagagggaatgggagggtcacttatttcttcattgctgggcattgggttgcttgctttactatacaaattagtggcttcttagtgcttcctagtggttaatttatgtactttagttaatttgtttagttgtaaag

SEQ ID NO: 3506 - DNA, 1466 bp, Prunus persica
ctatctctcactcactcacgaaaccctacactatttctctcccgatctgagactaaccctacctcatcggccgccatctctatcgcgcgctctctctgtctctctctcaactcatctctctctctctctctctctctctctctctctctctctctctctcttagtcacatctttaagtctcttagagacgcgagactcattctctttctccaaacctaaccaaacatcaatccaatatcattggtttttggagcgaatccttgtaaattttggagggctctggttcattctaagttgttgtgcttagtctctgtgggtttggattaataggcaaaattgaagaggctaggttttccactgtaaaagttttggcggcagcagaaggaagcagaaagaagaaagaagaaccctaactcaccttcttctcgactgcatctgctgcaccaggtctcggccaaaaagttgtatgtaaaagcagtttttcttccggagctaaacctgcaacctgctaaatagattaacgcttcaggagattttcttccgccttgctctgacgcccgctcagacacgcgcttagtgacaaagatggtttaccccgaagaagaaatcacgaggctttacagagttcgaaagacagtgatgcaaatgctgaaagatcggaattacttagttggagattttgagatcaacatgacaagagaacagttcaagagcaaatacggcgaaaacatgaaaagggaagaccttactatcaataaaactaagagaagtgatagctctgatcagatttatgtcttttttcctgaagaaccaaaggttggggtcaagacaatgaagacttatactaaccgcatgaaatcggagaatgtgctcagagctgtcttggttactcaacaaaatctgactccctttgcaaagacttgtatcagtgagatatcttcaaagttccacttggaggtttttcaggaggcagaattgttggtgaatattaaagagcatgtgctagttcctgagcatctggtgcttacaactgaggaaaagaagactttactggagaggtatactgtgaaagaaacacagcttcctcggattcaggtgaccgatccaattgcaaaatattatgggcttaagcgtggacaggttgtgaagataatccgaccaagtgagactgcaggacgatatatcacctaccgctacgttatttaattatttttattgttagtgcagcttgattctgaaaagaagctctaaaaggaagagactgcaattaggattttagtcaacttgatgttttgaactcaattctgcgcattcctcagtagtgcatgtgatgttagctcgtgtggagctgatttccagttgtctacatactgatattgttgtcacaccacctcccatctcaaagtacacttgctaatgttgtaaaaaatttaagaatatggatgaatgaagtagggttttggctt

SEQ ID NO: 3507 - DNA, 2623 bp, Malus domestica
tcaccaccaaaaaaaatggctgagaattttgcagttccaaaatactggactactctgagtttagtactagggtttatgatgttatccgcaacggggacaagtctactcctaccctcactcggggatatcgagagcttgctactaaacgataccggatccatcaattcaacctctactgattatggccatatagtttatgaattcgcagctgcagttcttaatccgacgtctccaaatgacatcgtgagtctaatcctatcagcaaacaacaattctgcgcctgttagtgtagctgctagaggccagggtcattctgttcgcggacaggccttgacctctggtggcgttgtcataaacatgacagctttgatccgtaatgggtctagaattgtggtctcagagagcccttctttgggctcttatgctgatgttggaggtgagcaacgttggatcgatgtgttgcgtgctacactcgagcgtggtcttacgccggtttcttggaccgactacctttacctgagcgttggtggcacgctcagtaacgctggaatcagtgggcaaacgtttctgtatggacctcaaatcaacaatgtatatgaactcgatgttgttacagggaagggggaattagttacttgctcctcaaaaaaggtaccagagctattttatgctgttctcggaggcttgggccaatttggtataataaccagagcaaggattccccttgcaccggctccgaagagggctaaatgggttcggatgatgtacagtaacttctctgcattttcaagagatcaagaacatttaatggcacccaatggattcgattatttagaaggttttcttctaatgaagcagggtcctctagatctttccttttacccattactcgatcaaccaagaatagcagctttaataaatcgatacggcatcatctactacatagaagcagccaaatattacgatgatagcactacaaaaaccgtggacaaggtagttgaaaaaacgatcaaggggttaagctttgttcctgaatttttattcgagcaagacgtttcgtacatagattttctggatagagtgcacactgaagaggaaaatcttcgatcacttggactatgggaaattgctcatccttggctgaatatctttgtaccaaaatcacgaatatcggacattgattcaggtgttttcaggaacattcttctcaaacaaaatgttcctacggcagtgagcctcatttaccccatgaaccgaaaaaggtgggatggtaggatgtctgcagttattccagatgaagatgttttctatgttgtagggctcttgcatgcaagcggattcaatgactggcaggcatttgatgaagtaaatagacaactactgcaattttgtacggatgctggcattagggttaagcagtaccttccccactacaaaacacgggaggattggaaaaaccatttcggaagaaaatggcaaagtttccaggacatgaaagttagagtatccccgcatgtaggcgaagaccaatccctcgagccaagtcggaccccattcgggaggcaagctctcccaacgatggttgctctattcacaacttcggttggaaaccctttgcctctctctcgcaacgcgatccttggcacaacacgcagacagcagctctcgttctcgcgccttttttctgtccaaatcgaaaaccctaatcacatcactaacaatctccaaagatcctgtcaattcagctgcggtgatatcctgtacgagcatccacttcaacttccgacaacaaacgctaattttttctgccgaacagaggcgaagatggttttaacagaagaagaaatcacaaggctttacagagtccgaaagactgtgatgcaaatgctgaaagatcggaattacttggttggagattttgagatcaacatgtcaaaagaacagttcaaggacaaatacggagagaacatgaaaagggaagatcttatcatcaataaaacaaagagaactgacacaaacgatcagatttatgtcttctttcctgacgaaccaaaggttggggtcaagacaatgaagacttataccaatcgcatgaaatcggagaatgtgttcagagcaatcttggttactcaacaaagtctgacgccctttgcaaagacctgtatcagtgagatatcgggaaagttccacttggaggtttttctggaggcagaattgttggtgaatattaaagaacacgttctagttcctgagcatcgggtgcttacaaatgaggaaaagaagactttgctggagaggtatactgtgaaagaaacacagctccctcggattcaggtgactgatccaattgcgaaatactacgggcttaagcgtgcacaagttgtgaagataattcgaccaagcgagactgcagggcgatatgtcacctaccgttatgttatataattactcttatgtcagctcgacttgataatctttcattcatagttatgtcggaattggagctctaaagcgagcggttgctgcaatccggatttcagggaccgtatgtgatacttttatgtgcgctcatatggacctgaattctagtttatatgattacgcattacgacttgctagtatt

SEQ ID NO: 3508 - DNA, 1624 bp, Prunus mume
gattgaatttgggttgtatttggcttgtaatttacttcgtttgccaccccgcacccacccggggtggcaaacgaagtatcattgactttccttatgtgttgttgaccacccgataccactccaatacgtcccacaatacatacacacgaagaataaggtctaaatacagtcaagatacggcgcgggcttattttgaaaatatctggaaacttttgtagtaattcgaaattttatacaaaagttgggggtcaaaatataaatttcaaacttgatttaatcacactgacctcttcttcaagacagaggctaggttttccactgtaatagttttggcggcagcagaaggaagcagaaagaagaaagaaccctaactcaccttcttctcgactgcatctgctgcaccaggtctcggcggtaacaggcccagcctcttcttctcgactgcctctgctacacgagtgacaaagatggtttaccctgaagaagaaatcacgaggctttacagagttcgaaagacggtgatgcaaatgctgaaagatcggaattacttagttggagattttgagatcaacatgacaagagaacagttcaagagcaaatatggcgaaaacatgaaaagggaagaccttactatcaataaaactaagcgaagtgatagctctgatcagatttatgtcttttttcctgaagaaccaaaggttggggtcaagacaatgaagacttatactaaccgcatgaaatcggagaatgtgctcagagctgtcttggttactcaacaaaatctgactccctttgcaaagacctgtatcagtgagatatcttcaaagttccacttggaggtttttcaggaggcagaattgttggtgaatattaaagagcatgtgctagttcctgagcatctggtgcttacaactgaggaaaagaagactttactggagaggtatactgtgaaagaaacacagcttcctcggattcaggtgaccgatccaattgcaaaatattatgggcttaagcgtggacaagttgtgaagatagtccgaccaagtgagactgcaggacgatatatcacctaccgctacgttatttaattgtttttattgttagtgcagcttgattctgaaaaggagctctaaagggaagagactgcaattaggattttagtcaacttgatgttttgaactcaattttgcgcattcctcagtagtgcatgtgatgttagctcgtgtggagctgatttccagttgtctacatactgatattgttgtcacaccacctcccatctcaaagtacacttgctaatgttgccctttgagaccttacattgatgtctcaggtataaatggacgtttatgtaaaaatttaagaatatggatgaatgaagtagggttttggcttatttttgttactcataggctaacatagggtttagggcttatttattcatttattttatttaaaatagttgttttcctgttaaaagggatgcctaaacggggaattctaacccttgttcctgagctttgacttgctcgatagacatatttccagcagggcacgcccatagagactgatcttggctgttgatggaagtggggagcacaatgcatcaacggtcatattaggc

SEQ ID NO: 3509 - DNA, 1480 bp, Citrus clementina
tccagttggatactgctccagttccacctgcaaccacgcaaaataatcgtcagccaagcgaatgattcaaattcaaattcaaattcaaattcaatttttgttttgttcaattgcaaacactgtaaatagcgagagaaaccttcggattggagaactgctcgaggtcacccaacacactttctagttgcttcagcttcatcttctagttccgtgctggagagaagaagattcaggtttataataagcaaaatgctcgatggatattaaaattcttggccttgggccttgacctcgccttgggggctttcgtgcaaaattagaaatttcgcagcccctttttcttgtaattctaatcctaggcaaactttaattccgtatgacgaaaataccccgctgttaaaaaaaaaaaacacacagaagtatcattcaataatgaaaacaaagagccctagttgcagttgaacaacttgaatccaatcacaccactccacggtctcgtgtagccgtttgttgccgctgccaacgacccgctgctgtcgccgccgctgaccgttttcttgaaacgtacaagtgggtattagttttactcaacagcttcgtgtcatcggaaatttaaaggataaaacatgactttatccgatgaagaaatcaaaaggctattcagaatccggaggacggtcatgcagatgctcagagataggggttattttgttggagactttgaaatcaatatgagcaaagaacagttcattgctaaatttggtgagaacatgaaaagggaggaccttgttatcaataaagcattacgaaatgatagctcagatcagatctatgttttcttccctgatgaacaaaaagttggggttaagacaatgaagacttatactaatcgtatgaaatcggaaaatgttttccgagcaatattggtggttcaacaaaatttgactccctttgctcgaacatgcatacaagagatatctgcaaaattccacttggaggtattccaggaggcagagcttttggtcaacatcaaagaacacgttctggttcctgagcatcaagtgcttacaaatgaagagaagaagactttgctgaagcggtatacagtgaaggaaacgcagttgccacgtattcaagtgactgatccaattgcaagatattatgggctgaagcgtggacaggttgtgaagattatccggccaagtgagactgctggtcgttatgtcacctatcgatatgttgtataagtatactcataaacaatggtagttttactttttatcattctgtacttatctggaattggaattatgttttatccttctgaagttgatgtagttactacttagatttatcacccattgttgttttacaattaggaccttgaaggcaacagtccatactcaaattggtttggaagcagtaccgggtttttctcgttattgtgccaagtgctatttcattcggtaccactttatat

SEQ ID NO: 3510 - DNA, 787 bp, Euphorbia peplus
tgaaaaatgacgctgtcagatgaagaaatcaagaggctgtttagaattcgaaagactgtgatgcaaatgctcaaggataggggttacttggttggggagtttgagatcaacatgtcaaaggaacagttcatttcaaaatatggcgacaacatgaaaagagaagatcttgttatccacaaatcaaaacgcaatgataactctgatcagatttatgttttctttcctgatgaaccgaaggttggtgtcaagacaatgaagacttataccaatcgcatgaagtcagagaatgttttccgagcaatcttagctgttcaacaaaatttgactccttttgctcgaacatgtatagctgagatagcatcgaaattccagttggaagttttccaggaagcggaactactggtcaacatcaaagagcatgttcttgtccctgagcatcaggtgctgacagctgaagagaagaagacattgttggagagatacaccgtgaaagaaacacagttgcctcgtattcagattactgatccagtggctagatattacgggctgaagcgcgggcaagttgtgaagattatcaggccaagtgaaactgctggacgatatattacgtaccgatatgttgtataaattcatagaattaactcggaaacagtgagttaaagatattcttgacctgcaacaagcagcttaagagatggtctttacgttaggttgtcataatatgttcttggaatagcttaaggattctgcaactgtgttgtgatcctaattttttgttatggtttta

SEQ ID NO: 3511 - DNA, 1124 bp, Quercus alba
attttgtagatgacacgtgtcatttatctgtttaaaaacaagcagaaaacaatgagacactaaaaagaccggccccaaattaaaaaacctactttggttttgttcgctgtcgtcaaaacccttttcttatttgtttcaaagagaaaagttgtggtgtgctttgcaatggtgctgtcggaggatgaaacaaacaggctatttaggatccgaaaaacggtgatgcaaatacttaaggatcggggttatttggttgcagactttgaggttgacatgaccaaagaccagttcagaaggaaatacggtgagagcatgaaaagggaagaccttgtcatcaacaaaaccaagcgaactgattcctctgatcagatctatgttttcttccctgaggaaccaaaggttggtgttaagacaatgaagacttacaccaatcgcatgaagtcggagaatgttttcagagcaatcttggttgttcaacaaaatttaaccccctttgcgaggacctgtataagtgagatatcttcaaagttccacttggaggttttccaggaggcagagctgatggtaaacattaaagagcatgttcttgttcccgagcatcaggtgcttacaactgaggagaagaaaactttgctggagaggtacaccgtaaaagaaacacagctgcctcgtattcaagtgactgatccaattgccagatattatgggctgaagcgtggacaagttgtgaagataatccggccaagtgaaactgctggccgatatgtcacctaccgatatgttgtataagtatttacattttagtgactgcttaggagattgtttgagctggacttgagttgaaagtgctgttgtgcttgtcaaaatcgtcaagaggccagttttaggggattttgtagtgggggtttcaagacaactatgttacgaaaatatttattgttattcttcagttgtgcatcatagtgtatgctgtctgtggtggtggtttgtaatcctgttcgcattttcttcatgcatcttaacgtaagcgttttgtgtacttgttaaagatgcaagctctgtcttctctgttgcggttctctcctcaaacaatagagtaattcctaataccacaaaccctctcatac

SEQ ID NO: 3512 - DNA, 996 bp, Citrullus lanatus
tgaattagccacaaacaagatggtgctatcagaggaggaaatcaccaggcttttcagaattcgaaaaactgtgtttcaaatgctaaaagaccgaggctattttgttggagactttgagattgatatgacaagggagcagtttaagcataaatatggtgaaagcatgaaaagagaagatattgttattaataaagccaagagaaatgatagctctgaccagatatacgtgttctttccagaagaaccaaaggtcggcgtcaagacaattaaaacatatacccaacgcatgaactcagagaatgtttatagagcaatattggtcgttcaacagaatttgacccctttcgctcgtacctgtataaatgaagtaatatctaccaaagtacacttggaagttttccaggaagcagaattgctagttaatatcaaagaacacgttcttgttcctgagcaccagttacttaccaatgaagagaagaagacactactggagagatataccgtgaaagaaacacagctaccacgcatacaggtgactgacccggttgcaagatattacgggctaaagcgtggacaagttgtgaagatcatcagaccaagtgagactgcaggaagatatgtaacttacagatatgttgtctgagtatacttatgattatgcaattgaagatgtgacatataaatacagcttgaagttattttttctagtcttaatcagtgttaatggttgtgatatgatatctctgaggtgaggtgagttgaagaagaatttaggaatttttgtatttgggatttagttgtggtggtgtacactagtagatttttataaacatgacgacattggaagattcaattatttccatttaaggactcctttagtttttgtaaattatccctatggagtgcaaatttagaaatagccatctttaaatcaaaataatttaaatatagctcgagtagtaaactcactatcgtttaaaatgttcatttaaaatc

SEQ ID NO: 3513 - DNA, 1035 bp, Vitis vinifera
gccgctttagggcttcttgcagcacaagacaagaagccccggtcattccttctccaaactcggcgttacggtcgttctccgagttcaaggtctgcttgcagtacaagaagcaccgatctctggattcagtcattctttctccaagcgttgtgtttcgtttggtcgttctccgagttcaagatgtctgcatcagaggaagaaatttcaaggctattcagaatcagaaaaacagtgatgcagatgctgaaggataggggttactttgttggagattttgagatcaatatgacaaagcatcaatttgtgagcaaatttggtgaaaacatgaagagagaggaccttgtaatcaataaagcaaagcgaactgatagctctgatcagatttatgttttcttccccgaagaacaaaaggttggtgttaagacaatgaagacctacaccaatcgcatgaaatcggagaatgtcttcagagcaattttggttgttcaacaaaatttgactccctttgctcgaacttgcattaacgaaatatcaacaaaattccacttggaagttttccaggaggcagaattgttggtcaacatcaaagaacatgttcttgttcctgagcatcaggtgctgaccagtgaggagaagaagactttgctggagaggtatactgtgaaagaaacacagctacctcgaattcaggtgagcgacccgattgcaagatatttcgggctgaagcgaggacaagttgtaaagataattcgtccaagtgagactgcaggtcgatacatcacctatcgatatgtggtatgacttgttattactcattaggaatgaagggactctttgttgaggctagtgtgagtgaaaagcttattccagatgtattgttaaggcgaattcatggctccttgactcatatatgatatataacaatcatccatgtaacatatacacaatggcgttatgtcagttgaaccaaaattaatttgatgagtatgtcatgtgaccagtggcatcatggtttatggcttggcttggcttgtt

SEQ ID NO: 3514 - DNA, 1478 bp, Humulus lupulus
cctgacgtcgaccctcactctgtcgcgcatctccccgaccctcactcaatctcagactcagtttcctttctcactagtcggcggcgcagcctcctcccttcgattgttagcggcgcgggcgaacgaagcttctcctcttcctctctcgtcggcgcgggcgcagagtcttctccccctcactatcgtaggcggcgcagcatctatttcctcttcctctctttcgtcggcgcctgactgcctccttcacccacggccacggccggtcacttagagaagaagaatatcgaagctgcaatttgtggattggacctcttgagggtattcaattttttgaggtgattttgagacgtttcagtggatacttttgagggttttgcatcaagtttgaagcgtgaggtacccgaacccgcacaaaaccgtttgtgccaaagttgtaatcatactccatcaaaaataagaattagctcttccctttcccttgccgccttcatcacaactaatcaacactacacagagagggaaagatggttttgccagaagatgaaattacaaggcttttcagggttagaaaaacagtgatgcaaatgctcaaggatcgtaattatttagttggagattttgagattaacatgaccagagaacaattcagaaacaagtatggtgagagcatgaaaagggaagacctaaccatcagtaaagctaagaggaacgatagctctgatcagatttatgtgtttttcccagaggaaccgaaggtgggtgtcaagacaatgaagagttacaccaaccggatgaagtcagaaaatgttgtcagagcaatgttggttgttcaacagaatttgactcccttcgctcgcacttgtataagtgagatatcttccaagttccacttggaggtttttcaggaagctgaattactaatcaacatcaaagagcatgttcttgttcctgagcatcaagtcctcacaaatgaggaaaagaagactttgttggagcggtatacagtgaaagaaactcagcttcctcgcattcaagttactgatcctgtggcaagatactatggactgaagcgtggacaagttgtgaagataatccggccgagtgagacagcagggcgatatattacctaccgatacgttgtgtagtaacaaggccgagagaactgaagggcaatgccactccttgtttgttgtactcagtgtttgagaacctaatttaaaaattggcatttgagcctaaattaaggttgagtgaagtgtcttgatcccatttttaggccaatttaaagaaacagagagtcttagctacaactcatttttggcctcatcatcgtccaactctaggcatggattaatagaagctagaaatactaaaaatttctcatgtgttgtaaacagaaataatcagtcatacttaacttactcaattgggatggaggcccctttcttcattttttcttcttctaataagtattgaag

SEQ ID NO: 3515 - DNA, 1096 bp, Tripterygium wilfordii
acaaaagcacttctctcttctagcttccttaaatttcccaaatccaatccagagctctcgatctttacgtcctgtgcgttcttctctatcccacacagtaagagtatgactctctctgaggaggaaattaagaggctacacagaattcggaaaacagtcatgcaaatgctactggaccggggctattttgttggagactttgagatcaacatgacaaaagagcagttcattacaaagtacggggagaacatgaaaagggaggaccttatgataagtaaagcgaagagaagtgatagttctgatcagatttatgttttcttccctgaggaagcgaaggttggtgttaagacgatgaagacttacaccaatcgcatgaaatcagagaatgtttttagggccatcctggttgttcaacagaatttgacttcatttgctcggaattgtataagtgagatatcttcaaaatttcatttggaggttttccaggaggccgagctgttagttaatatcaaagaacatgttcttgtccctgagcatcaagtacttaacaccgaggagaagaaaactttgttggagaggtataccgtgaaagaaacacagctgcctcgcattcaggtaactgatccaattgcaagatattatgggctgaaacgtggacaggtcgtgaagatcatccgcccgagcgagactgccggccgatatgtaacctaccgatatgttgtataagtattcttatctgctctgtatttagcagaaccggatctcataagccagctcagatgaacgatatgtaacctacctattactgtctgctctgtatttagcataaccagttctcataagccatctcagatgaaagtgcagttcattgcgtcccctcataatggcaagcagatctctgaaccagtggattctgcaattgggttgttgaacacagtcccttcagtgtgcattgtgctgtagtagttttgtgccctaacattgtaaaacatgtaagttttattgagccactttcttttttaagtcgacattagcatagttttgaattctctgatattctatgatgagcaatgccctctgatgagaagaaaaaata

SEQ ID NO: 3516 - DNA, 862 bp, Fagus grandifolia
agtgctgcgactagctccactctttttgtatcattgaaagctatggcagtgtcggaggacgaaagcaataggctttttaggatccgaaaaacagtgatgcaaatgctgagagaccggggttatttggttgccgactttgaagttgacatgaccaaagatcagttcagaaggaagtacggtgataccatgaaaagggaagaccttgttatcaataaagctaagcgaaacgatagctccgatcagatctatgttttcttccctgaggaaccaaaggttggtgttaagacaatgaagacttacaccaatcgtatgaagtcagagaatgttttcagagcagtcttggttgttcaacaaaatttaactccctttgccaggacctgtataagtgagatatctggaaagtttcacttggaggttttccaggaggcagagttgatggtaaacattaaggagcatgttcttgttcctgagcatcaggtccttacaaatgaggagaagaaaactttgctggagaggtacaccgtgaaagaaacacagctgcctcgtattcaagtgactgatccagttgcaagatattatgggctgaagcgtggacaagttgtgaagataatccgcccaagtgaaactgcaggccgatatgtcacctaccgatatgttgtataagtactgcttacatcttaggaattgcttaggatagtgtttaaagctggacttgagttgaaactgcttttgtgtttcctcaaaataggcagagggattttgtaatggggatttcaagacaactctcttatgaaattgtttattgttatttctcatcatggtgctctttgtggcggtggttcgtaattctgttagcatttct

SEQ ID NO: 3517 - DNA, 783 bp, Castanea mollissima
atcatccaaaaggtgggcagcgctcattgtttggtgaaggaaaggggtttgcaatggtggtgtcggaggatgaaacaaacaggctatttaggatccgaaaaacggtgatgcaaatgcttaaggatcggggttatttggttgcagactttgaggttgacatgaccaaagaccagttcagaaggaaatacggtgagagcatgaaaagggaagaccttgtcatcaacaaaaccaagcgtactgattcctctgatcagatctatgtattcttccctgaggaacaaaaggttggtgttaagacaatgaagacttacaccaatcgcatgaagtcggagaatgttttcagagcaatcttggttgttcaacaaaatttaaccccctttgctaggacttgtataagtgagatatctgcaaagttccacttggaggttttccaggaggcagagctgatggtaaacattaaagagcatgttcttgttcccgagcatcaggtgcttacaactgaggagaagaaaactttgctggagagatacaccgtaaaagaaacacagctgcctcgtattcaagtgactgatccaattgccagatattatgggctgaagcgtggacaagttgtgaagataatccggccaagtgaaactgctggccgatatgtcacctaccgatatgttgtataagtatttacattttagtgactgcttaggagattgtttgagctggacttgagtcgaaagtgctgttgtgctcgtcaaaatcgtcaagaggccagttttaagggattttgta

SEQ ID NO: 3518 - DNA, 1115 bp, Tropaeolum majus
cggccgggggtaactcccacaatactcccagccaccacactgtccaatcgtcctctccccatttctacgcacgcagctcttcgattccggggccttgtcgcaccctccaccacacgcagcactttaatcctcccaccttatttaacttcgacctccaaatcatacacttagctttatatatatcaggttaaaaatctcatcttgtgttaaccatccaccttaaagaaggccgcccttgactctccctacacaaagtttcactagctaaaagatttcatactttctctttcctcaagcatatctcagtagctcagttttcgcataaaaaggctagaagatgtctatgttggatgaagatatcaaaaggttgtgcagagttcgaaaaactttgatgcaaatgctgaaggatcgtaattactttgttggtgactctgagattaatatgaccaaacaacagttcatttcaaagtatggtgagaacatgaaaagagaggaccttgttatcaataaagcaaagcggaatgatagttctgatcagatctatgttttcttccccgaagaaccgaaggttggtgttaagacagtcaagacttataccaaccgcatgaaatcagagaatgtttatagagcaatactggttgttcaagttaacctgactccatttgctagggcatgtgttagtgagatatcttcgaaattccatttggaggttttccaggaggcagaactgctagtaaacatcaaagaacatgttcttgtgcctgaacatcaagtacttacaaatgaggagaagaaaactttgctggagcggtataccgtcaaagagactcagcttcctcgaattcaggtgactgatccagttgcaagatactacggattgaaacgtggacaagttgtgaagataatccggccaagtgagacagcaggtcgatatatcacataccgatatgttgtataatttatcggtttgaagactttgtgttgtgtagaatttaaactacagaatttaaactgaattgatattccttttgagggaaacaacacaggatatgcaacatatttatctattgaaagacaagatattggattttatattatttattcatgttagtgta

SEQ ID NO: 3519 - DNA, 996 bp, Fagus grandifolia
gtttggttgctcggaaactgtgggaaaatcaataagaaagctaccaagcttggatctttgagggaatcaatggcgctatcggaggatgaaacaaacaggctctttaggatccgaaaaacggttatgcaaatgctgagggaccgaggttatttggttgcggactttgaggttgacatgaccaaagatcagttcagaaggaagtacggtgatagcatgaaaagggaagaccttgttatcaataaatccaagcgaaatgttacctccgatcagatctatgttttcttccctgaggaaccaaaggttggtgttaagacaatgaagacttataccaatcgcatgaagtcagagaatgttttcagagcaatcttggtcgttcaacaaaatttaaccccctttgcgaggacctgtataagtgagatatctggaaagttccacttggaggttttccaggaggcagagttgatgataaacattaaagaacatgttcttgttcctgagcaccaggtgcttaataatgaggagaagaaaactttgctggagaggtacaccgtgaaagaaacacagctgcctcgtattcaagtgactgatccgattgcaagatattatgggctgaagcgtggacaggtcgtgaagataatccggccaagtgaaactgcaggtcgatatgtcacctatcgatatgttgtataagtacttgtagcatcttagtaactgcttaggactgagaagagtgtttgagctagacttgagttgaaggtaatgctgtgcttttgtcattcgtatccatatatatgtatatggattttattattgattgacacatgatctaagctttattaatatttgtgatgatgatagtatgtgtattgtataagtatggttgtttcaacttgtatgtaaacagttttcctatctaaaactttattaaacatatctgttaatgtgtaatagtcttattagaagacctccaacaagactattacacattaacagata

SEQ ID NO: 3520 - DNA, 1594 bp, Theobroma cacao
atccaaaaatgcagaaccttcaaataaattaaaataattgaataaataaaatcacagcgtgtgagaaggaaagaaaaaaccgctgagttaagaaatacgaccgagttagtaactcggtccgtgagggaacccctcatctcttaaccgccttttttaatcaaacgaaaaagagatagcgaaactggcttcctctttacattagcattcggagaagactcaaagagaattttcttcctagagtttctgctgttcgtcgttcttggtatcactcgccctctctagccggaaaaaggacaacaaaaatggttctatcggatgatgaaatcaagaggttgtttcgaatccgaaagacggtaatgcagatgttgaaagataggggttatttcgtgggagactttgagattaccatgaccaaagctcaatttatttccaaatatggcgaaaacatgaaaagggaagatctggttatcaacaaaactaagcgaaacgacaactctgatcagatctatgtttttttccctgatgaagccaaggttggtgtcaagacaatgaagacgtatactaaccgcatgaaatcagagaatgtattcagggctgtactggttgtgcaacagaatttaactccctttgcccggacatgtattaatgaaatttcttcaaaatttcacttggaagttttccaggaatcagagctcctggtcaatgtaaaagaacattctcttgttcctgagcatcaggtgcttactaatgaggagaaaaagactctgctgcaaagatatactgtaaaggaaacacagctgccccgtattcaggtgagcgatccaattgcaagatactatgggctgaagcgtggacaagttgtgaagataattcggcccagtgagactgctggtcgttatgtcacctaccgatatgttgtctaagcatggttcctgttacatgagttttttttttgatcagttgttgcatgagcatttacctactttagttagaactggatagcaggggtttaattgaaagcacaactgtataattctatcaaatcggctggtggtctcaaaacctaatggattgtagttagggcatggagataactaagatgctagtttgaatgcaattctgggttttgctcagtagcattacttgtaatgttagtgtaatctcttttagctaatttctttgtgttctaatttctgtgtattctattcttgtttcatctcaaaaccaaatgacaattctgttttgctaaatgtttatattccctgacattctgtaaaattgttttttgtagcacgaaagtattttcacctcttggcaattgccaaataggcggctttgatcctgtagttattgaaaggtgaaggaataattgattttgtgctcacattttagctctggtcttgaaagaggcttgcgcaacgccatggcccatggagtatttttgcgtcttgataattgccctttatgggcctgtaataaacggacaataattgatttagtagttgcaggtaagtaagtggattcagttcatgcatattccagagtcccattccttgatgttagacttagttgacaagaaatggagctggaactt

SEQ ID NO: 3521 - DNA, 984 bp, Gossypium hirsutum
ttagcattcgaaaggggacgcaaagagtaattttctcttagggtttttttctgctacacttgttgttctttgggggaaacacaaaatggtattgtcggatgatgaaatcaagaggctgtttcgaattcgaaagactgtaatgcagatgttgaaagataggggttatttcgttggagattttgagattaatttgtcaaaacaacaattcatttccaaatacggcgaaaatatgaaaagggaggatcttgttatcaataaaaccaagcggaatgataactctgatcagatctatgttttcttccctgaagaagccaaagttggtgttaagacaatgaagacgtataccaaccgcatgaaatcagagaatgtatttagggctatactagttgtgcaacagaatttaactccctttgctcgaacttgtataaatgaaatttcttcaaagttccatttggaggttttccaggaagccgagctcctggtcaatgtaaaagaacatgctctcgtgcctgaacatcaggtgcttactaatgaggagaaaaagactttgcttcatagatataccgtaaaggaaacacagctgcctcgtatccaggtgagtgatccaatcgcaagatacttcgggctgaaacgtggacaagtggtgaaaataatccggcctagtgaaactgccggtcgttatatcacttaccgatatgttgtgtaagcatgtaccctgttcgataacattatcctccgataaagcaattttttttttctctaaaacaaagccgaactaaccgcccgtatcctagtattcatgttgtattcgtgtattgtcaagtgtcaagtatcataattgtgctcaagaaattatatatttatataaattttgacacattaataatttgaattgatgcaataactttttatagtccaaaaaagaaaacttcttagattaaatagttacacaaatcagattaatgtgcaattgaaattttttaa

SEQ ID NO: 3522 - DNA, 962 bp, Gossypium hirsutum
acattattatatttgttaccttcaagctatagtgctataccaaaaaggaagcaagttcagctgttagcattcaaaaggggacgcaaagagtaattttctcttagggtttttttctgctacactttttgttctttgggggaaacacaaaatggtattgtcggatgatgaaatcaagaggctttttcgaattcgaaagactgtaatgcagatgttgaaagataggggttatttcgttggagattttgaaattaatttgtcaaaacaacaattcatttccaaatacggcgaaaatatgaaaagggaggatcttgttatcaataaaaccaagcggaatgataactctgatcagatctatgttttcttccctgaagaggccaaagttggtgttaagacaatgaagacgtataccaaccgaatgaaatcagagaatgtatttagggctatactagttgtgcaacagaatttaactccctttgctcgaacttgtataaatgaaatttcttcaaagttccatttggaggttttccaggaagcagagctcctggtcaatgtaaaagaacatgctctcgtgcctgaacatcaggtgcttactaatgaggagaaaaagactttgcttcatagatataccgtaaaggaaacacagctgcctcgtatccaggtgagcgatccaatcgcaagatacttcgggctgaaacgtggacaagtggtgaagataatccggcctagtgaaactgccggtcgttatatcacttaccgatatgttgtgtaagcatgttccctgttcgacaacattatcctccgataaagcaatttttttctaaaacaaaccccgaactaaccggcccgtatcctagtattcatgttgtattcgtgtattgtcaagtgtcaagtatcataattgtgctcaagaaattatatatttatataaattttgatacattaataattcgaattgatgcaat

SEQ ID NO: 3523 - DNA, 1025 bp, Gossypium raimondii
aaggcaatgctatattttattacattattatatttgttaccttcaagctatagtgctataccaaaagggaagcaacttcagctgttagcattcaaaaggggacgcaaagagtaattttctcttagggtttttttctgctacactttttgttctttgggggaaacacaaaatggtattgtcggatgatgaaatcaagaggctttttcgaattcgaaagactgtaatgcagatgttgaaagataggggttatttcgttggagattttgagattaatttgtcaaaacaacaattcatttccaaatacggcgaaaatatgaaaagggaggatcttgttatcaataaaaccaagcggaatgataactctgatcagatctatgttttcttccctgaagaagccaaagttggtgttaagacaatgaagacgtataccaaccgaatgaaatcagagaatgtatttagggctatactagttgtgcaacagaatttaactccctttgctcgaacttgtataaatgaaatttcttcaaagttccatttggaggttttccaggaagcagagctcctggtcaatgtaaaagaacatgctctcgtgcctgaacatcaggtgcttactaatgaggagaaaaagactttgcttcatagatataccgtaaaggaaacacagctgcctcgtatccaggtgagtgatccaatcgcaagatacttcgggctgaaacgtggacaagtggtgaagataatccggcctagtgaaactgccggtcgttatatcacttaccgatatgttgtgtaagcatgttcccctgttcgacaacattatcctccgataaagcaatttttttctaaaacaaagcccgaactaaccggcccgtatcctagtattcatgttgtattcgtgtattgtcaagtgtcaagtatcataattgtgctcaagaaattatatatttatataaattttgatacattaataattcgaattgatgcaataatttattatagtccttctactatagcttcatcattttaaa

SEQ ID NO: 3524 - DNA, 1133 bp, Heritiera littoralis
gaagggaacgaggcagcagccgcgttagaaactcgatcctggagcgaagccctttcctcttaaccaaccgcctttttaatcaaacaaaagagaaaaaaaaagaagcgaaactactctctttacgtttttctcgaaggagacgcaatcttaggtttttctgtcttttattgttcttggtatctctcttctctctttcgccgcaaggggaaaatggctctatcggatgatgaaatcaagaggttgtatcgaattcgaaagacggtattgcagatgttgaaagacaggggttatttcgtcggcgattttgagattaacatgtccaaagaacaattcatttccaaatacggcgaaaacatgaaaagggaggatataattatcaataaaaccaagcggaatgataactctgatcagatctatgttttctttcctgatgaagccaaggttggtgtcaagacaatgaagacgtataccaaccgcatgaaatcggagaatgtactcagggctatactggttgtgcagcagaatttgactccctttgctcggacttgtattaatgaaatttctacaaaattccacttggaggttttccaggaagcagagcttttggtcaatgtaaaagaacattctcttgttcctgagcatcaggtgcttactactgaggagaaaaagactttgctgcaaagatatactgtaaaggaaacacaactgcctcgcatccaggtgagtgatccaatcgcaagatactatgggctgaagcgtggacaagtggtgaagataattcggcctagtgagactgctggtcgttatgttacctatcgatatgttgtttgagcatgtttcctgttgaatatctttttattttctttatttcaaactggatagcagtgttctattcaaaagcagaactactcctattaaattggctgacggtcataaaacccaaaggattttgtagttggggcatgaagataaccatgatactactttaaatgcggttctgggcttgttaaatagaatcacttgtaatatcaatcagtgtaatctctcttagctatttccttgtgttctaattgctttgtattctgacagactgcatcttggattcattaacattataaatctaaatttgccac

SEQ ID NO: 3525 - DNA, 1193 bp, Sesamum indicum
tggattcctgttcaattttagagtaatatattaaataaatttcagctgaagtttctaaagaaatgaaaaaggagaagagattataacattactgatcatgtagctgggccacttcgccctactgtaattcaatgctggtcattatcaaattgaacgaattatggatatatgtcctgggatgctaactgaaagtaggaagtatttgtgttacgtccttgcattgtttttgcttagtgttttccaattgacagtgcaaagatggttatgtctgaggaggaaattacgcggcttcatcgaattcggaagacggtgatgcagatgctgaaggatagaggttacatggtgggtgcatttgagattgacatgccgaagcatcagttcattcagaagtatggtgagaatatgaagagagaggaccttgttattcagaaaggcatgggcggtaacagctctgatcagatatacgtattctttcctgaggaacagaaggttggtgttaagaccatgaagacttataccaatcgcatgaaagaagagggtgttcatcgggcaatcttagtggtccagcagaatttaactccatttgctcgaacctgcattagtgaaatatctactaaattccacttggaagttttccaggaggctgagttgttagtcaacataaaagagcatgttcttgttccccagcatcaggtgcttactcctgaagaaaagaagactttgctggaaagatacactgtgaaagaaacacagcttccccgtatccagataaccgacccgatcgcgagatactatggtctaaagcgcggacaagtagtaaaaattatccgaccaagtgagactgcgggacgctatgtcacataccgatacgtggtttaaacttttaaagctctgtattagttgtcagacaaaaagtttaaaggggtgaggaataggtaaaggtctcgaatgcctgaaaaactcggcaactctatcttgtgtattgattggatgccatacacttcttagtgattttctttgagtgctaatgtaatgccacattaatctgcttctgtacctgtttgtgcctttacagtttcacttgtatggtgatctttttatcgagtatttgagcactcttttccaatgaagcttcaatttgttcaccataacctgaatcactccattagatgcggaaaaccgactagcacggc

SEQ ID NO: 3526 - DNA, 815 bp, Flaveria ramosissima
ttgcaacttatcttcccttgggtcctcggctctccacccatcgctgttgctaacttacttgctgctgctgctgcttacttttgctctcattcttttctttcaagattaaagaagaaaggaaacgatgtcgacttcgttgtcggaggaagaaatcaagaggttggttagaataaggaaaacggtgatggagatgctgaaagatagaaactaatttggttggagatttcgagctggagatggataaaaggcagtttgttcacaagtatggagaacatatgaagcgtgaagatctagtcatctgtaaatccatgaagaacgatagctctgaacagatctatgtcttcttccctgatgaagcaaaagttggggtcaagacaataaagaattatataaaccgtatgaagtcagagaatgttactcgggggatcttggttgtgcagcaaaatctaactccctttgcccgaacttgcattagtgagatatcaacgaaatttcacttggaagttttccaggaagcggagttgttggtgaacgtaaagaatcatgtcctagtccctgaacatcaggttcttacagacgaagagaagaaaacattacttgagagatacacagtaaaagaaacacagctgcctcatattcaagtgagtgacccagttgctagatattacgggctaaaacgtggacaggtcgtgaaaatcattcggcccagtgagacagcgggtcgttatgtcacttacagatatgttgtttaaaccctaattgatgtatggagtgtgaacttggattgacctgtattatgttgcactcattgttat

SEQ ID NO: 3527 - DNA, 855 bp, Manihot esculenta
tctcgtcggcaaaaatgaccctatcggaggatgaaattaagaggcttttcagaattcgtaagacagtgatgacgatgctcaaggataggggttattttgttggagactttgagatcaacatgacaagggagcagttcatttcgaaatttggcgagaacatgaaaagggaagatcttgttatcaacaagacgaagcgcaatgatccttctgatcagatttatgttttctttcctgaggaacagaaggttggagtcaagacaatgaagacttataccaaccgcatgaagtctgagaatgttttcagagcaatactggttgttcaacaaaatttgactccttttgctcgaacatgtatatctgagatagctgctaaattccagttggaggtcttccaggaggcagaactgttggtcaacatcaaagaacacgttcttgtacctgagcatcaggtgcttacaagtgaagagaagaagacattgttagagagatacactgtgaaagaaacacaactacctcgaattcaagtatctgatccaattgccagatattatgggctgaagcgagggcaagttgtgaagatcatcaggccaagtgaaactgcaggacgatatattacctatcgatttgttgtttaaatacttttatattcacggcttttgtttaggcttttagtatttaagccatggatattgatgggaatttggtgcctggtatagtttaccagaaaaaaaaagtatttatatagttgacacaagctggtttgggattaaaactttgttgtttcatagcttttgtttgagaggacctcggtttctttcttttataaagtaaatttagtgaataaattattttggc

SEQ ID NO: 3528 - DNA, 1038 bp, Euonymus alatus
ggacatcgtttagttccctcttccgccttccttccgtttcccgtatccaatccaatccaatacggtgctctcggccgtttcgtcctctgcgttcttctctatccagacagtaggagtatgactctctctgaggatgaaattaagaggctacacagaattcgaagaacggtcatgcaaatgctggtggaccggggttactttgttggagactttgacatcaacatgacaaaagagcagttcattacaaagtatggggagaacatgaaaagggaggaccttatgattagtaaagcgaagagaaatgatagttctgatcagatttatgttttctttcctgaggagccaaaggttggtgttaagacgatgaagacttataccaatcgcatgaaatcggagaatgtttttagtggcatgctggttgttcaacagaatttgactccatttgctcggacctgtataaatgagatatcttcaaaatttcatttggaggttttccaggaggccgagctgttagttaatatcaaagaacatgttcttgtccctgagcatcaagtacttaccatggaggagaagaaaactttgctggagaggtataccgtgaaagaaacacagctgccacgtattcaagtgaccgatccaattgcaagatattatgggctgaaacgtggacaagtcgtgaagatcatccgcccgagtgagactgcaggccgatatgtaacctaccgatatgttgtataagaattcttatctgctcaccaatatgatgttgtacaagtattcttatctgctcgcggatatgtaacctactgatatgttatataagtattcttatctgctctgcatttagcagaaccagttctcataagccagctcagatgaaagtgctgagacacagttcattgcgtccctcataatggctcgcaagcagacctgaaccggtggattctgcagttgggttgttgaacacattcccttcagtgtgcattgtactatcgttaacttttattgtgttactttcttttaagacggcattaatat

SEQ ID NO: 3529 - DNA, 1057 bp, Populus trichocarpa
cctgcattagccccttatttccgaactctaaaagaaacagagaaagcgcgagaccgttcctccataaaccttcctagggttttgatcaccttacactctcccttatcgatctccaggtgaaagaggaacaaaagaaaaaatgactttaacagaagaagaaatcaagaggctgttaagaattagaaagacagtgatgcaaatgctcaaggatagaggttattttgttggagactttgaaattaaaatgacaagagagcaatttgaatccaaatatggtaataacatgaaaagggaagatcttgttattaacaagaccaagcgaaacgatagttctgatcagatttatgttttctttccggaggaagctaaagttggtgttaaaacaatgaagacatacactaatcgcatgaaatccgagaatgtttttagagcaatcttggttgttcaacagaatttgaccccatttgctcgaacttgtatcaatgagatctctacaaaattccacttggaggtctttcaggaggctgagctgttggttaacatcaaagagcatgttcttgtccctgaacatcaagttctttcaaatgaagagaagaagactttgttggagagatacacagtgaaagaaacacagctgcctcgcattcagataactgatccaatcgcaagatactacgggctgaagcgtggacaagttgttaagattatcaggccaagtgaaacagcaggacgatatgttacctaccgatatgttatataaatagttttatcagcttaagattaactcagattagtgtttgaaacctgtactctgcatttctgtcaaaattaattaactcggaccccaaaaggaggatttatggatattaagatgattgtggctatattgttttgatctcaccgggtcatcgtgagctcttcatacggtgctctatgaatttgggatttgtttgtatttcttatgctgctgtcattcagagactgagagccaatggcttattttctgagaccttttgtgattttgtttttaagaaatttattgcattccggtgtctca

SEQ ID NO: 3530 - DNA, 1267 bp, Populus trichocarpa
aaacagggctgcactaggtcagaaaaagcgaggagagaagtgaaaagcagcgaaataccaaaagggccctccaaaacccaagcttaagacaccctgcaaaataacgatcaaggctgcccctgcattagccccttatttccgaactccaaaagaaacagagaaagtgcgagaccgttcctccataaaccttcctagggttttgatcaccttacactctcccttatcgatctccaggtgaaagaggaacaaaagaaaaaatgactttaacagaagaagaaatcaagaggctgttaagaattagaaagacagtgatgcaaatgctcaaggatagaggttattttgttggagactttgaaattaaaatgacaagagagcaatttgaatccaaatatggtaataacatgaaaagggaagatcttgttattaacaagaccaagcgaaacgatagttctgatcagatttatgttttctttccggaggaagctaaagttggtgttaaaacaatgaagacatacactaatcgcatgaaatccgagaatgtttttagagcaatcttggttgttcaacagaatttgaccccatttgctcgaacttgtatcaatgagatctctacaaaattccacttggaggtctttcaggaggctgagctgttggttaacatcaaagagcatgttcttgtccctgaacatcaagttctttcaaatgaagagaagaagacattgttggagagatacacagtgaaagaaacacagctgcctcgcattcagataactgatccaatcgcaagatactacgggctgaagcgtggacaagttgttaagattatcaggccaagtgaaacagcaggacgatatgttacctaccgatatgttatataaatagttttatcagcttaagattaactcagattagtgtttgaaacctgtactctgcatttctgtcaaaattaattaactcggaccccaaaaggaggatttatggatattaagatgattgtggctatattgttttgatctcaccgtgtcatcgtgagctcttcatacggtgctctctgaatttgggatttgtttgtatttcttatgctgctgtcattcacagactgagagccaatggcttattttctgagaccttttgtgattttgtttttaagaaatttattgcattccggtgtctcataaagttgattcggctgctcgggtattcctgctcaattgtgggagtccaactgatagtattttaagctcacacctatggttgctaagcattc

SEQ ID NO: 3531 - DNA, 1251 bp, Ricinus communis
gatcagaaaaagatgagtgtcacattttctttttttgttttcttttgaaaaaaaaattgaaagagaaaaagataaagaaggatattttagtaattaacccttaccaaaccccgcctccgcacatacccttcgtataataagaattatgaaagaaccgtagcattttgattggccgctcttttttctttttatacaaccgaagcagaaaaatcgaccgaggtttcgctttccctcgatactttgtctaagctcgcaacagagagtgagggaaaaatgactctatctgaggatgaaatcaagaggcttttcagaatccgaagaacagtgatgcaaatgctcaaagataggacctatttagttacggattctgagatcaatatcacaaagcatcagtttacttcgaaatatggtgacaacatgaagagggaagatcttgtcatacataagtctaagcgcgatggctctgattcgatttatgttttctttcctgaggaacaaaaggttggtgttaagacaatgaagacttataccaatcgcatgaagtctgagaatgttttcagggcaatattggttgttcaacagagcttgacgccatttgctcgaacatgtatagctgagatagcttcaaaattccacttggaggtcttccaggagtccgaactattggttaacatcaaagagcatgttcttgtccctgagcaccaggtgcttacaaatgaagagaagaaaacattattggagagatacaccgtgaaagaaacacagttgcctcgtattcagatttctgacccaattgctagatattatgggctgaagcgtgggcaagttgtgaagattatcaggccaagtgagactgcaggacgatatgttacctatcgatatgttgtataaatacattcttttatctgtaggattttacttgtattagggtttggaacctgtgctctattcatggtttagtcaaaatggcaaaagcaacctcaagagataggaatttgccacttgggatgttgagaaattgacggtgctcgtgtagaatgctttttctggatccctgatccattgatgtttctgtactccttggtgcgtatactgccataaacttgtgctaattttgttgcctgatgtctcttaaaagatttataatgagagcgccttgagaaattatttgagtcacttgtttccacactttgtttattaagatttacatctttcttgttaagtcttatataaaaatgtcttggcttttat

SEQ ID NO: 3532 - DNA, 872 bp, Olea europaea
tctctttcttccgcctgctcagcattcgcctacttggggaatctataggctcgcagaaagaattagtgggaagatggttttgtcggatgaggaaatcacacggctcttcagaatcaggaagacggtgatgcagatgctgagggataggggttacatagtaagtgattttgagatcgatatgtccaagcatcagttccttagcaagtacggggagaacacgaagagagaggaccttgttattatcaaagacttgcgcagcaatccctctgaaaagatatatgtgttctttcctgaggaggcaaaagttggtgttaagacaatgaagacttacaccaatcgcatgaaagatgatgatgttcatcgagcaatcttagttgtccagcagaatttaactccttttgctcggacctgtataagtgaaatatcgacaaaatttcacttggaggttttccaggaggcagagttgttggtgaacataaaagagcatgttcttgttcctgagcaccagctacttactccagaagaaaagaagactttgctagaaagatacacggtgaaagaaacacagctcccccgcattcaggttactgatccaattgcaagatattatggtctgaagcgtggacatgtcgtgaaaattatccgaccaagtgagactgctggtcgttatgttacttatcgatatgtcgtttaaattttttaggcactgtggttagtttgtcattcccaagaacttaaggacatgtttggcacggtggattggaagtatcaaagaaagttaaaatctcatctattgtattattgttctatcctttatggtccaagactaagtatcaaacttggacggcaaaaaattagaagtcacttgtagt

SEQ ID NO: 3533 - DNA, 954 bp, Cannabis sativa
actgggaatttactattacaaggcttttcagggttagaaaaacggtgatgcaaatgcttaaggatcgtaattatttagttggagattttgagattaacatgaccagagaacaattcagaaacaagtatggtgagagcatgaaaagggaagaccttaccatcagtaaagctaagaggaacgatagttctgatcagatttatgtgtttttcccagaggaacctaaggtgggtgtcaagacaatgaagagttacaccaaccggatgaagtcagaaaatgttgtcagagcaatgctagttgttcagcagaatttgaccccttttgctcgcacttgtataagcgagatatcttccaagttccacttggaggtttttcaggaagctgaattgttaatcaatatcaaagaacatgttcttgttcctgagcatcaggtcctcacaaatgaggaaaagaagacattattggagcggtatactgtgaaagaaacccagcttccccgtattcaagtgactgatccagtggctagatattatggactgaagcgtggtcaagttgtgaagataatccgtccgagtgagacagcagggcgatatatcacctatcgatacgtagtgtagtattcagtgcaatgtcatatccaaagggtagaaaaactatgtgatagaaaaactgaaaggtttattggcatttttcccattatatattagaatgtatatcttttttttattttactatgactaatttgcggtataaatacttaagttttatgtcaagtagtagataagtacgcaagtcatatttttggcaataaaaatttgcgtcataaatacttaagttttacgtcaggtagtagataagtacgtaagttatatttttgacaataaaaatacctttcgttactagtgtagaactggaaatttactatgggttgatgcatttagattttgaggtatattt

SEQ ID NO: 3534 - DNA, 1438 bp, Ricinus communis
ctttctgaatggttctttttgtgctaaaagaatctttgcggtgttgaaggtaaaacttatggaccttccacgaatgagtactgcataacgatggcagaaaaacatttgccatgcttgaattagccgcacagtgtttcacaggatctatgtttcagtcccatttcagaaaacagaaattatatattgcgatcagaaaaagatgagtgtcacattttctttttttgttttcttttgaaaaaaaaattgaaagagaaaaagataaagaaggatattttagtaattaacccttaccaaaccccgcctccgcacatacccttcgtataataagaattatgaaagaaccgtagcattttgattggccgctcttttttctttttatacaaccgaagcagaaaaatcgaccgaggtttcgctttccctcgatactttgtctaagctcgcaacagagagtgagggaaaaatgactctatctgaggatgaaatcaagaggcttttcagaatccgaagaacagtgatgcaaatgctcaaagataggacctatttagttacggattctgagatcaatatcacaaagcatcagtttacttcgaaatatggtgacaacatgaagagggaagatcttgtcatacataagtctaagcgcgatggctctgattcgatttatgttttctttcctgaggaacaaaaggttggtgttaagacaatgaagacttataccaatcgcatgaagtctgagaatgttttcagggcaatattggttgttcaacagagcttgacgccatttgctcgaacatgtatagctgagatagcttcaaaattccacttggaggtcttccaggagtccgaactattggttaacatcaaagagcatgttcttgtccctgagcaccaggtgcttacaaatgaagagaagaaaacattattggagagatacaccgtgaaagaaacacagttgcctcgtattcagatttctgacccaattgctagatattatgggctgaagcgtgggcaagttgtgaagattatcaggccaagtgagactgcaggacgatatgttacctatcgatatgttgtataaatacattcttttatctgtaggattttacttgtattagggtttggaacctgtgctctattcatggtttagtcaaaatggcaaaagcaacctcaagagataggaatttgccacttgggatgttgagaaattgacggtgctcgtgtagaatgctttttctggatccctgatccattgatgtttctgtactccttggtgcgtatactgccataaacttgtgctaattttgttgcctgatgtctcttaaaagatttataatgagagcgccttgagaaattatttgagtcacttgtttccacactttgtttattaagatttacatctttcttgttaagtcttatataaaaatgtcttggcttttat

SEQ ID NO: 3535 - DNA, 995 bp, Gossypium hirsutum
aaattttcttcatcgaaaactctcacactttctcctcgcattggcacactcgaagaatttttctcctagggtttcagcaattctcgttattattgaaattgtgggacgaaaatggttctgtcggacgatgaaatcaggaggttgtttcgtatccgaaagacggtattgcagttgttgaaagacagagattacttcgtcggagatttcgagattaacatgtctagagaacaatttatttccaaattcggcgaaaacatgaaaagggaggatctcattattaataaagctaagcgaaacgatagctctgatcagatctatgttttctttcctgaagaacccaaggttggtgtgaaaacaatgaagacatataccaaccgcatgaaatcggagaatgtatttagggctatactggttgtgcaacaaaatttgactccctttgctcggacttgtatcaatgaaatttcttccaaattccacttggaggttttccaggaaacggagctccttgttaatgtaaaagaacattctcttgttccggagcatcaggtgcttactaccgaggagaaaaagactttgctgcagagatatactgtaaaggaaacacagctgccgcgtatccaggtgagtgatccgatcgcaagatactacgggctgaagcgtggacaagtggtgaagataattaggcctagcgagactgctggtcgttatattacctatcggtatgtggtgtgaacatgtttcatgttaaataggattttcctagtttagttagaactagacagcctaatagattttgtagtcggggtatgaagaagacagctatgatgatagtttgtttaaatgtagtttagggttttgttgaatagcctcagttgtagtattagtgcaatcactctttttagccattactgtgttccaaatcttgtctattctcctaggttttccggatcggtgggtgaaccaatcaggtcatgagcttacctgtcatattggtc

SEQ ID NO: 3536 - DNA, 1105 bp, Tabernaemontana elegans
tctgacccgtcctcgcgaagcatacaacgcggctactctaggctcgcgcagtaagttttccggcggaacaacgagaagatgacactgtccgacgaagaaatcacgaggctgttcaggatccgaaagactgtgcttcaaatgcttaaggacaggggctattttgtggcggataaggagattgatatgcagaaacgtgactttctgcagaagtatggagagaatatgaagcgagaagacctcgtcatcaacaaatccaaacgcagtgatagctctgatcagatctatgttttctttcctgaggagcagaaggttggtgtaaagacaatgaagacatatacaaacagaatgaagtcggagaatgttttcagggcaatcttagttgttcagcagaatttgactccctttgccagaacttgtgtcagtgagatatctacaaaattccacttagaggttttccaggaggctgagttattggtgaacataaaaaatcatgttcttgttcctgagcaccagctacttacttctgatgaaaagaagactttgctggaaagatatacagtgaaagaaacacagctacccaggattcaggtaacagatcccgttgctagatattatgggctaaaacgtgggcaagttgtcaggatctcccgaccaagcgagactgcagggcgttacataacctaccgatttgttgtttgaactctacttgacaacacaacacagccagcagctaaaggtagagataataggggctgggactgctgcaaggggagaatgctgtgaggagagaatggacaatgaagtaatgaggtcaagtatgtcatccatggtggtgaatatgtgctgcgtcagagacccctgttgttaagtgtattagactcctcgtgttagtgttgatctaaataggtaaagattagcaagtgaatatgttgttcaactaatagcttctcctgtttgttgctcttctcctagtgctttgctgccctaatgttgctgattttctctgagtgaatgttgatttgtaactggattgggactttggatgtgtaccattgccattgtatccgagtttgtactttggatgggcagaccttcaactaaaact

SEQ ID NO: 3537 - DNA, 1687 bp, Cannabis sativa
ccaaaaactccgcagagtgctctattaacgcgtataagagaaaaaagaaaagagaaaaaagaaaagaggaagaggaaggaaaccctaatatttagtcctgcttgtcccagcccagcctctctctctctcgtacgagtctcttcagacgctgcgtcaaagccgcatttctccctctctcttggcgattatttactcagacgacggtgagacctcagacctattttttggttctctcgtactcattccaagtattttctgttgatgcatcttagattcctcatgtggggcttttctttgtagttggttgctttgatttgtagatatgtgaatgtcataaacttatgtagtagatttcttgattcattgagatttcatattcggaagaacaagataaaaccaagatagatgctttacttatggtttaagtattttatacttactaattagaaaaaccctcttgtagaactgggaatttactattacaaggcttttcagggttagaaaaacggtgatgcaaatgcttaaggatcgtaattatttagttggagattttgagattaacatgaccagagaacaattcagaaacaagtatggtgagagcatgaaaagggaagaccttacgatcagtaaagctaagagaaacgatagttctgatcagatttatgtgtttttcccagaggaacctaaggtgggtgtcaagacaatgaagagttacaccaaccggatgaagtcagaaaatgttgtcagagcaatgctagttgttcagcagaatttgaccccttttgctcgcacttgtataagcgagatatcttccaagttccacttggaggtttttcaggaagctgaattgttaatcaatatcaaagaacatgttcttgttcctgagcatcaggtcctcacaaatgaggaaaagaagacattattggagcggtatactgtgaaagaaacccagcttccccgtattcaagtgactgatccagtggctagatattatggactgaagcgtggtcaagttgtgaagataatccgtccgagtgagacagcagggcgatatatcacctatcgatacgtagtgtagtattcagtgcaatgtcatatccaaagggtagaaaaactatgtgatagaaaaactgaaaggtttattggcatttttcccattatatattagaatgtatatcttttttttattttactatgactaatttgcggtataaatacttaagttttatgtcaagtagtagataagtacgcaagtcatatttttggcaataaaaatacctttcgttactagtgtagaactgggaatttactatgggttgatgcatttagattttgaggtgtatctagatctgggaattttgagtggaactttgtttgttgggtagatctaaattagattgaatctatatgtatttgtagacgaataggttcgaattaaaggagtagggacaggatgttaatttttgtgcaaggtttttgtgtggctttccttatatacgtttgattgatgttgtatttgtaaggttctttttgtcggttctgggaaatttgagtagagctttgtttgttggattagttagatcaatcttctcttgttgataatgtttttgagtttaagtgggtgagtggtttcgggtgaggaaattttttaggatatttggctgagaaaaatttctgggttggggat

SEQ ID NO: 3538 - DNA, 1168 bp, Eucalyptus grandis
ctgtcttctcgctttctccccctcttccatcctcgaagccgcgaccggggcgagagcagcagctcctccgccgccctccgccgccgctccaacgcgcgattagggttttcctccgccgccgatgccgccgcatccgccgcatccgccgccgccgatccgggacacggccctgtcggaggaggagatcacccgcctccaccgaatccagaggacggtgttgcagatgctccgggaccggggctacctcgtcaccgacggcgagctcaacatgacccggttccagttcatcgaaaagtacggcgagaacatgaagcgggaggacctcgtcatcaacaagcacaagcgcaacgaaagctccgatcagatttacgtgttctttccggaagaggcgaaggtcggggtgaagaccatgaagacgtacacgacccgcatgaattcggagaacgtgttccgggcgatattggctgttcagcagaatttgactccctttgctcggacttgtatcagcgagatatcgacgaagttccacttggaagtcttccaggaggcggagttgctagtcaatatcaaagagcatgtactcgttcctgagcatcaagtgcttgctaatgaggaaaagaagactttgctacagagatatacagtgaaagaaacacagctaccgcgaatccaagtcactgatccggttgcacgctactatggcctgaagcgtggacaggttgtgaagatcataaggccgagtgaaacagcagggcgatacgtcacttaccgatatgttgtctgagattcctattctccaagcccagtgttgaactcgagtcataaattatgtatagcaggtgctgaggaggcacaaatgttgagttctgtggagtttgctcttttgcctgtccgtccttgcaaaagctgaagatgccataatctcgaagcggatgatcttctttccaagcatctgattctgtgggaactcagaagtaacagtgtgtctgtataatgtcctatgatgcaagtgagacgttgctgggctcgttcctaactgcctagcagatccatgtatttgtctgtcagataatccattcgagtcgtggctgtttctgggagatttttcccctttgttgaaagaacagttatttcatggaaatagagacatattagggtaggcttctat

SEQ ID NO: 3539 - DNA, 1117 bp, Cucumis melo
ttttctcttatccgccgccatcgccaacaatgtctaataaaatcagactaagccctaatttctcgttccgccatcttcttcttcacgccggctcctaacagctcagtgctgccgccgtgttctactgagtgggtttcactgatttcttgttgttactgcctggaacaagatggtgctatcagaagaggaaatcaccaggcttttcagaattcgaaaaaccgtgtttcaaatgctaagagaccgaggctattttgttggagactttgagattgacatgacaagggagcaatttaagcaaaaatatggtgaaaacatgaaaagagaagacattgttattaataaatccaagagaaatgatagcagtgatcagatatatgttttttttccagaagaggcaaaggttggcatcaagccgttgaaaacatataccacccgaatgaaatcagagaatgtttttagagcaatattggtcgttcagcagaatttgaccccttttgcccgtgcctgtatgagtgaagcaacttccaaatcattccacttggaagttttccaggaagcagaattgctagttaatatcaaagatcacgtccttgttcctgagcaccagttacttaccaatgaagagaaaaagacactacttgagagatataccgtgaaagaaacacagctaccacgcatacaagtgacggacccagttgcacgatattatgggctaaagcgtggccaagttgtgaagatcatcagaccaagtgaaactgcaggaagatatgtaacttacagatatgttgtctgagtatgtttatgattttgtaattgaacatttgacatatgtatacaccttgaagttatgttttgaagtcttaattagtgttatactggttgtgatatctgaggtgagttgaagaactttggaacttaagtatttgggatttagatgggggaacttcatggtattagttggaagatcaattatttctatttaagggtacttcttttgtaaattgtccccatggaactggagtgttgaatttagaaatagccatctttaaatcaaagtgatttaaatatagttagtgaggaaatcacgatccagggcacaaattattcatataatatc

SEQ ID NO: 3540 - DNA, 905 bp, Primula obconica
ctccgttgtttgggtaggctgctaaggaaatctctctctctctctctgtgtgtctctctctctgtggcgatgtcggggggtccttcggaggaagagttaaataggctgttcagaataaggaaaacagtaatggtaatgctgagagacagagactatgttgtcggtgattacgagattgatatgaccaaacatcaattctctcaaaaatacggcgattacttgaagagagaggatctcgtcatcagtaaagccaagcgcaacgatagctccgatcaaatttatgttttcttccctgaggaaccgaaggttggtgttaagacaatgaagacttacacaaatcgaatgaagtcggagaatgtttttcgagcaatcttggtggttcagcagaatctcactccttttgcaagaacctgtattaatgaaatatcctcaaaattccatcttgaggttttccaggaggcagagcttttggtcaacattaaagagcatgttcttgttcctgaacaccaactcctcaccaatgaagaaaagaagactttgctggaaagatacaccgttaaagaaacacagttacctcgaattcagatgactgatcctgttgccaggtattatgggctgaagcgagggcaggtcgtgaaaatcattcgaccaagtgagaccgcaggccgttatgtcacataccgatatgttgtctgagtatttttttacttctttcaatcaactaaaaagctgcttgtaccttgttttggatagaaacattcagtacttgttcaaaagctcaagtgaaatgtaactcattctaaaagattgtttggattttatttcagacaaacaatattcagtgctatcttttttactctttcgtgtttgagcatataaactcgttttccgtgatgaagaaaaaa

SEQ ID NO: 3541 - DNA, 732 bp, Olea europaea
ccggctgcacgcctatacaagtatacggtatacgcgccctcaattgtttaagttaaactcaatttctgggaatcagcttcttcgttgttcaacgataggctttttgcaaagatggttctgtcagatgaggaaattgcacggctcttcagaatcaggaagacggtgatgcagatgctgagggataggggttacacagtaggtgattttgagattgatatgtcgaagcatcagttccttagcaagtacggcgagaacatgaagagggaggacctcattatcatcaaagaattgcgtagcaatccctctgaaaagatatacgtgttctttcctgaggaggcaaaggttggtgttaagacaatgaagacttataccaatcgcatgaaagatgatgatgttcatcgagcgatcttagttgtccagcataatttaactccttttgctcggacctgtataagtgaaatatctacaaaatttcacttggaggttttccaggaggcagagttgttggtcaacataaaagagcacgttcttgttcctgagcaccaattgcttacccctgaagaaaagaagtctttgctagaaagatacactgtgaaggaaacacagctaccccgcattcaggtaaccgatccaatttcaagatattatggcctgaagcgtggacacgtcgtgaaaattatccgaccaagtgagactgctggacgttatgtaacttaccgatacgtagtttaa

SEQ ID NO: 3542 - DNA, 815 bp, Antirrhinum majus
  misc_feature (60)..(60): n is a, c, g, or t
  misc_feature (357)..(357): n is a, c, g, or t
  misc_feature (791)..(791): n is a, c, g, or t
  misc_feature (799)..(799): n is a, c, g, or t
  misc_feature (802)..(802): n is a, c, g, or t
  misc_feature (807)..(807): n is a, c, g, or t
  misc_feature (814)..(814): n is a, c, g, or t
ccgctgtaaattctccgtcaattaatcttcaatttgtagttttttcctctcatcatttanataagtgcaaagatggttctttcggaggaggaagtcgcgcggctctgcagaatccggaagacggtgatggagatgttgagggacaggggttacttggttggtgattttgaaattgaaatgtcaaaacatcagttcctcacaaaatatggtgataacgccaagagagaggaccttgttattagtaaaggcttgcgcatcaatgactccgagaagatatacgtgttctttcccgaggaacctaaggttggtgtcaagacaatgaaaacttatacaaaccgcatgaaagaagatggtgtncatcgtgcaattttagtggtccagcaaaatttaactccatttgctcggacctgcataagtgaaatttcaacgaagtttcacttggaagttttccaggaggctgaattattaatcaacataaaagagcatgttcttgtccccgagcatcagctgcttactcctgaagaaaagaagactttgctggaaagatacactgtgaaagaaacacagctacctcgtgttcagataactgatccagttgccagatactatgggctaaagcgtggacaagtcgtgaaaatcatccgacccagtgagactgctggacgctacgtcacttaccgatatgttgtctgaactgttgaactttctagttatatgtaacttataaagagagggtaataaggcacgaagctcttaataaaccctcggcttatctatgcttgaacaatggncattaganctngcacnatgtgtnt

SEQ ID NO: 3543 - DNA, 941 bp, Vaccinium corymbosum
gaagcagaaccgcatcccaaaattgaacaaaatctcagcagtgatcggcgattccaccaaacgttaaacacagcgaagggacacagatgtctacttcagacgaagaaatcacaaagctatacagaattcggaaaacagtgatgcgaatgctgtgcgacaggggatatttggtgggagatttcgatttggagatgacgaaacagcagttcattcagaaatatggtgaaaacatgaaaagggaagaccttgttatcagtaaagccaagcgcagtgacagctctgaccagatttatgttttctttccagaggagccgaaggttggtgtcaaaacaatgaagaattacactaatcgcatgaaatcagagaatgttttccgagcaatcttggttgttcaacaaaacctaactccctttgccagggcatgcataagcgaaatatctaccaaattccatttggaggttttccaggagccagagttgttggtcaacatcaaagaacatgttcttgttcctgaacaccagctccttacaaatgaagaaaagaagactttgctggataggtatacagtcaaagaaacacagctacctcgaattcaggtgaccgatccagttgccagatattatgggctgaagcgtgggcaagttgtaaaaatcattcgaccaagtgagactgcaggccgttacgttacgtaccgttatgttgtttagatttcctcaatcaacctatactatgtggtgtagtgtacttctaaaaccttgttctcgttggaagcacgttcttcgtgttttttcgtctagaggccaagttgttgaaggaaacactttggaaaatcaaatttttgaaactcgcttagttgtgtatatttgtgaaaactttagttgcttttttaatttgacggtaacgctgtagttgtttctgaactcaaatatttatggtacctt

SEQ ID NO: 3544 - DNA, 1006 bp, Actinidia deliciosa
gctaacaattcccgactcagcgactctctcgctctagcatcttcgacgcttcatctctcgtggtaccacgagcaaggcggggtttgcggcggaaatcatctccgatcaccgtccatccactccacgtccaagaaagtcctggaaaggagatgtctacttcagaggaagaaatcacaaggctgcacagaatccggcatacagtgatgcaaatgctgaaggacagggggtatttggtgggggatttcgagttagatatgacaaagcaacagttcattcagaaattcggtgagaacatgaaaagggaggacctaattatcaataaaaccaagcgcaacgatagctctgaccagatttatgttttctttcctgaggagcagaaggttggtgtcaaaacaatgaagacatataccaatcgcatgaaatcagagaatgttttccgagcaatcttggtcgttcaacagagtctcactccctttgcaaaagcatgcataagcgaaatatctacaaaatttcatttggaagttttccaggaaccagagttgttagtcaacattaaagaacacgtacttgttcctgagcaccagcttctttcaagcgaagaaaagaagactttgctggaaagatacactgtcaaagaaacacagctacctcgaatccaggtgactgatccagttgctagatattacgggttgaagcgtgggcaagttgtgaaaatcattcgacccagcgagacggcaggccgttatgttacataccgctttgttgtttagatttctttccatagttgagtggagttctgaaaccttgtttggttgtaagcattttggttatgtttcgagatgtctagcaactaaaagccacattgtaggaggaagaaagttctctttttgtcaacgtatctacggaaaaatgatggtggttcgtggcgttctaatagaaactactgtttgcttatgggaattcattttccagttttgttaatacttaaaaagattctcaaaaaaaa

SEQ ID NO: 3545 - DNA, 782 bp, Flaveria ramosissima
gattaaagaagaaaggaaacgatgtcgacttcgttgtcggaggaagaaatcaagaggctgtttaggataaggaaaacggtcatggagatgttgaaagacagaaactatttggttggagacttcgagctggagatggataaaaggcagtttgttcagaagtatggagaacatatgaagcgtgaagatctagtcatctgtaaatccatgaagaacgatagctctgaacagatctatgtcttcttccctgatgaagcaaaagttggagtcaagacaataaagaattatataaaccgtatgaaatcagagaatgttacccgggggatcttggttgtgcagcaaaatctaactccctttgcccgaacttgcattagtgagatatcaacgaaatttcacttggaagttttccaggaagcagagttgttggtgaacgtaaagaatcatgtcctagtccccgaacatcaggttcttacaaacgaagagaagaaaacattacttgagagatacacagtaaaagaaacacagctacctcgtattcaagtgagtgacccagttgctagatattacgggctaaaacgtggacaggtcgtgaaaatcattcggtccagtgagacagcgggtcgttatgtcacttacagatatgttgtttaaaccctaatcgatgtatggagtgtagagacttggatcgacctttattatgttgcactcattgttatcaaaccattttatagaacattatcttctctaaattgttcgtaatgttgttataattgagtgaaatgtcg

SEQ ID NO: 3546 - DNA, 968 bp, Helianthus annuus
aagggtgcaaagtatcatccaggctttcctcaagcgatatttacctaatttgaccaaagagtcaacatttaaacccagcaatcacacaaccatctcacccccgtcgccgatttctctctccgccgctaataaaccctaattcacttcctgtaaaaggagaagaaacgaacgatgtcgacttcgttgtcggaagaagaagtcaagaggctgttcagaatacgcaaaacggttatggagatgttgaaggacaggaattatttggttggagatttcgagctggagatggatagaaggcagttcgtttccaagtatggggagcatatgaagcgtgaggatctggttattagtaaatctatgaagaatgatagctctgaacagatctacgtcttcttccctgatgaagcaaaagttggagtgaagacaataaagaattatataaaccgtatgaagtcagagaatgtcactcggggaatcttggttgtgcagcaaaatctgactccttttgccagaacttgcattagtgagatatcaaccaaatttcatttggaagttttccaggaagcagagctgttggtgaacgtaaaaaaccacgttctagtacccgaacatcaggttctaacaaacgaagagaagaaaacattactcgagagatacacagtaaaagaaacacagctacctcgtattcaagtgagtgacccggttgctagatattacgggctaaagcgtggacaggtcgtcaaaattattagacccagtgagacagcaggtcgttatgtcacttaccgatatgttgtttgaatcctttttattcatgtatggaatttggacttggattgtattggatgtcatttgtaacaaaccgttttactgagtgatgataccttcttttatttgtattgttgttgtacggataatataatagagtgaaaagttatttataatttgtacgtataatactaccatgtttt

SEQ ID NO: 3547 - DNA, 726 bp, Helianthus annuus
gtcgccgatttctctctccgccgcaaataaaccctaattcacttccagtaaaaggagaagaaacgaaggatgtcgacttcgttgtcggaagaagaagtcaagaggctgttcagaatacgcaaaacggttatggagatgttgaaggacaggaattatttggttggagatttcgagctggagatggatagaaggcagtttgtttccaagtatggggagcatatgaagcgtgaggatctggttattagtaaatctatgaagaacgatagctctgaacagatctatgtcttcttccctgatgaagcaaaagttggagtgaagacaataaagaattatataaaccgtatgaagtcagagaatgtaactcggggaatcttggttgtgcagcaaaatctgactccttttgccagaacttgcattagtgagatatcaaccaaatttcatttggaagttttccaggaagcagagctgttggtgaatgtaaaaaaccacgttctagtacccgaacatcaggttctaacaaatgaagagaagaaaacattactcgagagatacacagtaaaagaaacacagctacctcgtattcaagtgagtgacccggttgctagatattacggactaaaacgtggacaggtcgtcaaaattattagacccagtgaaacagcgggtcgttatgttacttaccgatatgttgtttgaatcctttttattcatgtatggaatttggac

SEQ ID NO: 3548 - DNA, 858 bp, Cucumis sativus
gtctaataaaatcagactaagccctaatttctcgttccaccttcttcttcctcctccttcttcttcccagctcagtgcctccgccgtcttctacttagtgggtttcactgatttcttgttgttactgccagcaacaagatggtgctatcagaagaggaaatcaccaggcttttcagaattcgaaaaactgtgtttcaaatgctaagagaccgaggctattttgttggagactttgagattgacatgacaagggagcaatttaagcaaaaatatggtgaaaacatgaaaagagaagacattgttattaataaatccaagagaaatgatagcagtgatcagatatatgttttttttccagaagaggcaaaggttggcatcaagccgttgaaaacatataccacccgaatgaaatcggagaacgtttttagagcaatattggtcgtccaacagaatttgacccctttcgcccgtgcctgtatgagtgaagcaacttccaaatcattccacttggaagttttccaggaagcagaattgctagttaatatcaaagatcacgtccttgttcctgagcaccagttacttaacaatgaagagaaaaagacactacttgagagatataccgtgaaagaaacacagctaccgcgcatacaagtgactgacccggttgcacgatattacgggctaaagcgtggccaagttgtgaagatcatcagaccaagtgaaactgcaggaagatatgtaacttacagatatgttgtctgagtctgtttatgattttgtaattgaagatgtgacatttgtatacaccttgaagttatgttttgaagtcttaattagtgttatagtgattgtgatatc

SEQ ID NO: 3549 - DNA, 1049 bp, Prunus mume
aagtgagaaagatggttttaccagaagaagagatcacaaggctttacagagttcgaagaactgtgatgcaaatgctgagagatcggaaatacttagttggcgattttgagatcaacatgacaagagaacagttcaaggccaaatatggagagaacatgaaaagggaagaccttactatcaataagacaaaacgaaatgacagcaccgatcagctttacgtcttctttcctgaagagccaaaggttggggtcaagaccataaaaacttacaccaaccgcatgaaatcggagaatgtttccagagcaatcttggttactcaacaaaatatgactcccatggcaaggacctgtataagcgaaatatcgtcaaaattccacatggaggtttttcaggagccagagttgatggtgaatgttacagaacatgttctagttcctgagcatcagctgcttacgaatgaggaaaagaagaccttactggagaggtatactgtgaaagagacacagcttcctcgtattcagttgactgatccagttgcaaaatattacgggcttaagcgtggacaagttatgaagataatccggccaagtgagactgcaggacgatacatcacctaccgttatgttgtgtaatgcacttactttcattgttggttgacacctgacctgctagtgctctgtttataaatacttgtggctggatgagaaagagctcacaagtgaagcagtctttgcaattagcatcttagacaactgttataagtatttttacaataaagtcaacactagctattatactggacttggtgttgactttatcttcagctagcattagtccaagccaatatcaagtccagtatttttacaataaagtcaacactagcattggaagaaaaaaaaaaaattctcaaatttttgtggagataatttggttttgaaaatataaacaacatcatgaccacacagtttgtcccttcaaaattaggttgagagaacagtctcgaccattccaaaagagtaatttcatggttcagctgcataaatggaaga

SEQ ID NO: 3550 - DNA, 1084 bp, Centaurea maculosa
atagtaatataggtaaaactatttgattactaattatttaatttattttatcatgtaagtcttttttttaataaatcatagcgtttgttttgttttgttggaataaaggataaattttgtgtggttctttttattttttaaaggttttgattgctgctaaaaccctaattcacttgccaattaaacagaagaagaagaagaagaagaaaggaaaaagatgtcggcggcgttgacggaggaggaaatcaagaggctgttcagaataaggaagacggtgatggagatgttgaaggatcggaattatttggttggagatttcgagctggagatggataaaaggcagttcattcacaagtatggagacaatatgaaacgtgaggatcttgttatcagtaaatccttaaagaatgatagctctgaacagatctatgtcttcttccctgatgaagcaaaagttggagtcaagacgataaaaaattatatcaaccgtatgaagtcggagaatgttacccgagcgatcttggttgtgcagcaaaatctaacaccttttgcccgaacttgcattagtgagatatcaacgaaatttcacttggaggtcttccaggaagcagagttgttggtgaatgtaaaaaatcatgttctagtccccgagcatcagattctttcgcacgaagaaaagaagactttactcgaaagatacacagtaaaggaaacacagctgccacgtattcaagtgaccgatcccgttgctagatattatggactgaagcgtgggcaggttgtgaaaattattcgaccgagtgagactgctggtcgttacgtcacttaccggtacgtcgtctgaattccgatcacccgccgtgaatttcgatccaattttcttgtgatgaaacaacccagcttactgaagattaccttctcgcaattagcctgtaaagttcacattcatcaatgctgtactaaattgacaaccctcatttaatccgtttgtaatgctgttacatgtaatgcacattgtaatcccaccggtatcctgttttctgagtaatactaactattgttctcagataaataaatttctaag

SEQ ID NO: 3551 - DNA, 859 bp, Cirsium arvense
agaagaagaagaagaagaagaaaggaaaaaagatgtcggcggcgttgacggaggaggaaatcaagaggctgttcagaataaggaagacggtgatggagatgttgaaggatcggaattatttggttggagatttcgagctggagatggataaaaggcagttcattcacaagtatggagacaatatgaaacgtgaggatctcgttatcagtaaatccttaaagaacgatagctctgaacagatctatgtcttcttccctgatgaagcaaaagttggagtcaagacgataaaaaattatatcaaccgtatgaagtcggagaatgttacccgagcgatcttggttgtgcagcaaaatctaacaccttttgcccgaacttgcattagtgagatatcaacgaaatttcacttggaggtcttccaggaagcagagctgttggtgaatgtaaaaaatcatgttctagtgcccgagcatcagattctttcgcacgaagaaaagaagactttactcgaaagatacacagtaaaagaaacacagctgccacgtattcaagtgaccgatcctgttgctagatattatggactgaagcgtgggcaggttgtgaaaattattcgaccgagtgagactgctggtcgttacgtcacttaccggtacgtcgtctgaattccgatcaccaaccgtgaatttcgatctacttttcttgtgttgtaacaacccagtttactgaagattaccttctctcaatttgtttgtaatgtttacattcatcaatgctgtactaaattgactaccctaccctcttttaatctgtttgtaatgttgttacatgtaatgcacattgtaatcaaaccggtttccggttt

SEQ ID NO: 3552 - DNA, 837 bp, Cirsium arvense
ttctcttgccgtaagttatcttcaccaaaagtaatacagaatgaactcgagaaacgatttttgtagtcaatttatgtatatatatatatacacctttgaattttgatgtttgattatgttgaatacataacttgttttgattaaatagaagaagaagaagaagaaagggaaaagatgtcgacgtcgttgacggaggaagaaatcaagaggttgtttagaataaggaaaacggtgatggagatgttgaaggacaggaattatttggttggagatttcgagctggagatggatagaaggcagtttataaacaagtatggagacaatatgaaacgtgaagatctcgttatcagtaaatccttaaagaacgatagctccgaacagatctatgtcttcttccctgatgaagcaaaagttggagtcaagacaataaagaattatatcaaccgtatgaagtcagagaatgttacccgagcgatcttggttgtgcagcaaaatctaacgccttttgctcgaacttgcattagtgagatatcaacaaaatttcacttggaggtcttccaggaagcggagttgttggtgaacgtcaaaaatcacgttctagtccctgagcatcaggttcttgcaaacgaagaaaagaagactttactcgagagatacacagtaaaagaaacacagctgcctcgtattcaagtgaccgatcccgttgctagatattatggtctgaagcgtgggcaggttgtcaaaattattcgacccagtgaaactgctggtcgttacgtcacttaccgctacgttgtctgaaatccagatcgctctttaccattgttgtgttgtaac

SEQ ID NO: 3553 - DNA, 933 bp, Fraxinus spp
ccgtcaacccgaaccaacgccgagcctagccaaaccctccgaacgtactgtccggcgccgtaaccagccgaagtccgaactccatccgctgatagcgcgacgcaaccgagtgcgaagatggttatgtccgatgaggaagctacacggctattcagaatcaggaagacggtggtgcagatgctaagggataggagttacatgtaagtgatttcgagatcgatatgtcaaagcatcagttccttagcaagtacggtgagaacatgaagagagaggaccttgttattcttaaagacttgcgcagcaatccctctgaaaagatatacgtgttctttcctgaggaggcgaaggttggtgttaagacaatgaagacttataccaatcgtatgaaagatgatgatgttcatcgagcaatcttagttgtccagcagaatttaactccttttgctcggacctgtataagtgaaatatctacaaaatttcacttggaggttttccaggaggcagagttgttggtcaacataaaagagcacgttcttgttcccgagcaccagctgcttactcctgaagaaaagaagactttgctagaaagatacactgtgaaagaaacacagctaccccgcattcaggtaactgacccaattgcaagatattacggtctgaagcgtggacacgttgtgaaaattatccgaccaagtgagactgctgggcgttatgtaacttatcgatatgtggtttaaatcttttagcattgtagtttgttagtcgttccaaagaattaagggcatgcttcatggtggagtgcaagtattaaacgaaggaaaaaaatgttaaaatctcatctcttgtaccatttagcatgatccaagactacgtacccccaaagaagtcacgttgttgaaaaaggtttaacctgatattttgagacgtttggtg

SEQ ID NO: 3554 - DNA, 763 bp, Ambrosia trifida
tgagtgttcgtcgcttcaaccacattctttacagataaaaaaaagcaagaaacgtaacgatgtcgacgtcgttgtccgaggatgaaataaagaggctgtttaggataaggaagacagtgatggagatgttgaaggacaggaattatttggttggagattttgaactggagatggatagaagacagtttgttcagaagtatggggagcatatgaagcgtgaggatttggttattagtaagtctatgaagaatgatagctctgaacagatctatgtcttctttccagatgaagcaaaagttggagttaagacaataaagaattatataaaccgtatgaagtcagagaatgttacccggggaatcttggttgtgcagcaaaatctcactccttttgccagaacatgcattagtgagatatcaacgaaatttcacttggaagttttccaggaagcagagttgttggtgaacgtaaaaaaccacgttctagtccccgaacatcaggtacttacaaacgaagagaagaaaacattacttgagagatacaccgtaaaagaaacacagctacctcgaattcaagtcagtgacccggttgctagatattacgggctaaaacgtggacaggtcgtgaaaattattaggccaagtgagacagcgggtcgttatgtcacttaccgatatgttgtttgaatccttttatgatgtatggaatgtggacagcgatttggacctttattgtgttggatgtcatttttaacaaaccgttt

SEQ ID NO: 3555 - DNA, 736 bp, Flaveria ramosissima
agataagagaagaaaggaaacgatgtcgacttcgttgtcggaggaagaaatcaagaggttgtttagaattaggaaaacggtgatggagatgctgaaagatagaaactatttggttggagatttcgagctggagatggataaaaggcagtttattcagaagtatggagaacatatgaagcgtgaagatctggtcatctgtaaatccatgaagaacgatagctctgaacagatctatgttttcttccctgatgaagcaaaagttggagtcaagacaataaagaattatataaaccgtatgaagtcggagaacgtttcccggggaatcttggttgtgcagcaaaatctaactccctttgcccgaacttgtattagtgagatatcaactaaatttcacttggaagttttccaggaagcagagttgttggtgaacgtaaagaatcatgtcctagtccccgaacatcaggttcttacaaacgaagagaagaaaacattacttgagagatacacagtaaaagaaactcagttacctcgtattcaagtgagtgacccagttgctagatattatgggctaaacggtggacaggtcgtgaaaatcattcgacccagtgagaccgcaggtcgttatgtcacttacagatatgttgtttgaatcctaattgatgtatggaataaggacttggattgaccttactatgttgcacacatgttatcaaccatttattgaacattatcttct

SEQ ID NO: 3556 - DNA, 839 bp, Centaurea maculosa
gtcgacggcgttgacggaggaggaaatcaagaggttgttcagaattaggaagacggtgatggagatgttgaaggatcggaattatttggttggagatttcgagctggagatggataaaaggcagttcattcagaagtatggagacaatatgaaacgtgaggatctcgttatcagtaaatccttaaagaatgatagctctgaacagatctatgtcttcttccctgatgaagcaaaagttggagtcaagacgataaagaattatatcaaccgtatgaagtcggagaatgttacccgagcaatcttggttgtgcagcaaaatctaacaccttttgcccgaacttgcattagtgagatatcaacgaaatttcacttggaggtcttccaggaagcagagttgttggtgaatgtaaaaaatcatgttctagtgcccgagcatcagattctttcgaacgaagagaagaggactttactcgaaagatacacagtaaaagaaacacagctgccacgtattcaagtgaccgatcctgttgctagatattatggactgaagcgtgggcaggttgtgaaaattattcgaccgagtgagactgctggtcgttacgtcacttaccggtacgttgtctgaattccgatcacccatcgtgaaatttggatctacttttcttgtgttgtaacaacccagtttactgaagattaccttctcttagtttgtttgtaatgtttacattcatcaatactgtatgaagttgactaccctcttccaatttgtttgtaatgttgttgcatgtaatgcacattgtatcaaactggtttccgtttttccgagtaaaagtaaaaat

SEQ ID NO: 3557 - DNA, 909 bp, Brassica juncea
aagggtttggagctctgaagtaaagctctttcaacgccgcctctgtcttcttcgtcgctctgtgccacatctcattctctctttgcctccaaacatttagcggagatgggtctaacggaagaagaaatcaaaagactttacagaatccagaagacgttgatgcagatgctcaaggaccgtggctacttcatcgccgactccgaaatcaccatgagcttatcccagttcgttaggaagtatggtgacaacatgaaaagagaggatcttgttactctcaaagccaagagaaacgacagcagtgatcagctttatatcttcttccctgatgaggcgaaagttggggttaagacgatgaaggtgtacacaaacaggatgaaatcagagaatgtttacagagcaatcttggtggtgcaacagaacttgactccttttgctcgaacttgcattagtgagatctcttctaagtttcatttggaagttttccaggaggcggaaatgcttgtgaacattaaagagcatgttcttgttccggagcaccaagttctcaccactgaagagaagaaaactcttctggagagatacactgtcaaggagacacagcttccaaggatccaagtgactgatccaatcgcaagatactttgggctaaaacgtggacaagtcgtgaagatcatacgtccgagtgaaaccgctggtcgttacgttacctaccgttatgttgtataagcaaaaagcttttgtttgtgcgagtggaaagtctcaagtattgtgtaccaaatggttgacaatgttatttgttatatgtacgaatttaaaaaaccttaatacaacattttagtatcagtgtataatggggcaaggtagccttgccaaggtctcgtgagcactgaaatgattacatgtcttggg

SEQ ID NO: 3558 - DNA, 1011 bp, Brassica juncea
gaggtaagggtttggagcgttaaaggaaagctctttgaccgccgcttcgtcttcttcgtcgcctctgctccatctcttctcttctcttctctctctgcctctaaacagtttatcgagagatgggtctaacggaagaagaaatcaaaagactttacagaatccagaagacgctgatgcagatgctcaaggaccgtggctacttcatcgccgactccgaaatcaccatgagcttatcccagttcgttaggaagtatggtgacaacatgaaaagagaggatcttgttactctcaaagccaagagaaacgacagcagtgatcagctttatatcttcttccctgatgaggcgaaagttggggttaagacgatgaaggtgtacacaaacaggatgaaatcagagaatgtttacagagctatcttggtggtgcaacagaacttgactccttttgctcgaacttgcatcagtgagatctcttcaaagtttcatttggaagtcttccaggaggcggaaatgcttgtgaacattaaagaacatgttcttgttccggagcaccaagttcttaccactgaggaaaagaaaactcttctggagagatacactgtcaaggagacacagcttccgaggatccaagtgactgatccaatcgcgagatactttggactaaaacgtggacaagtcgtgaagattattcgtccgagtgaaactgctggtcgttatgttacctaccgttatgttgtataagcaaaaaaaagcttttgttgatggaaacgctcagtgttgtgcgagtggaaatgctcagtgttgtgttgtgtacccaaattgttgacaatgttatttgttagatgtacgaattgaaaaaccttacaacaacagtttagtatcattgtataatggggcgaggtggccttgtcaaggtctcatgagcactgagatgatttcatgtgttggggttgattacccataagctatttcttaatcagttaatcaaacccaacacatgaaatcatctcag

SEQ ID NO: 3559 - DNA, 911 bp, Brassica oleracea
gatactagaaacctctttattctaatacaactgagaaagggtttggagctttgaaggaaagctctttcaacgccgcttctgtctgcttcttcgtcgctctgtgccacatctcttctctatttgcctctaaacatttatccgagatgggtctaacggaagaagaaatcaaaagactttacagaatccagaagacgttgatgcagatgctcaaggaccgtggctacttcatcgccgactctgaaatcaccatgagcttgtcacagttcgttagaaagtacggagacaacatgaaaagagaggatcttgttactctcaaagctaagagaaacgacagcagtgatcagctctatatcttcttccccgacgaggcgaaagttggagttaagacgatgaaggtgtacacaaacaggatgaaatcagagaatgtttacagagcaatcttggtggtgcaacagaacttgactccttttgctcgaacttgcatcagtgagatctcttcaaagtttcatttggaagttttccaggaggcggaaatgcttgtgaacataaaagaacatgttcttgttccggagcaccaagttctcaccactgaagagaagaaaactcttctggagagatacactgtcaaggagacacagcttccgaggatccaagtgactgatccaatcgcaagatactttggactaaaacgtggacaagtcgtgaagatcatacgtccgagtgaaaccgctggtcgctatgttacctaccgttatgttgtataagaagctaaaaaaagcttttattgatggaaacgctcagtgttgtgcgagtggaaacgctcagtgttgtgttgtgtacccaaattgttgacaatgttatttgttagatgtacgaattgaaaaaccttaaaacaacattttagtatcatt

SEQ ID NO: 3560 - DNA, 1038 bp, Brassica rapa
ataggttggggcttcttatactagaaacctctttattattctaatacaactgagaaagggtttggagctctgaagtaaagctctttcaacgccgcttctgtcttcttcgtcgctctgtgccacatctcattctctctttgcctccaaacatttagcggagatgggtctaacggaagaagaaatcaaaagactttacagaatccagaagacgttgatgcagatgctcaaggaccgtggctacttcatcgccgactctgaaatcaccatgagcttgtcacagttcgttagaaagtatggcgacaacatgaaaagggaggatcttgttactcttaaagctaagagaaacgacagcagtgatcagctctatatcttcttccctgacgaggcgaaagttggggttaagacgatgaaggtgtacacaaacaggatgaaatcagagaatgtgtacagagctatcttggtggtgcaacagaacctgactccttttgctcgtacttgcatcagtgagatctcttcaaagtttcatttggaagtcttccaggaggcggaaatgcttgtgaacattaaagaacatgttcttgttccggagcaccaagttctcaccactgaagagaagaaaactcttctggagagatacactgtcaaggagacgcagcttccgaggatccaagtgactgatccaatcgcaagatactttggactaaaacgtggacaagtcgtgaagattattcgtccgagtgaaaccgctggtcgttatgttacctaccgttatgttgtataagcaaaaaaagcttttgttgatggaaacgctcagtgttgtgcgagtggaaatgctcagtgttgtgttgtgtacccaaattgttgacaatgttatttgttagatgtacgaattgaaaaaccttacaacaacattttagtatcattgtataatggggcaaggtggccttgccaaggtctcatgagcactgagatgatttcatgtgttgggtttaattaactgattaagaaatagcttatgcctgatcaaccaagtaacca

SEQ ID NO: 3561 - DNA, 967 bp, Brassica napus
gaagtaaagctctttcaacgccgcttctgtcttcttcgtcgctctgtgccacatctcattctctctttgcctccaaacatttagcggagatgggtctaacggaagaagaaatcaaaagactttacagaatccagaagacgttgatgcagatgctcaaggaccgtggctacttcatcgccgactctgaaatcaccatgagcttgtcacagttcgttagaaagtatggcgacaacatgaaaagggaggatcttgttactcttaaagctaagagaaacgacagcagtgatcagctctatatcttcttccctgacgaggcgaaagttggggttaagacgatgaaggtgtacacaaacaggatgaaatcagagaatgtgtacagagctatcttggtggtgcaacagaacctgactccttttgctcgtacttgcatcagtgagatctcttcaaagtttcatttggaagtcttccaggaggcggaaatgcttgtgaacattaaagaacatgttcttgttccggagcaccaagttctcaccactgaagagaagaaaactcttctggagagatacactgtcaaggagacgcagcttccgaggatccaagtgactgatccaatcgcaagatactttggactaaaacgtggacaagtcgtgaagattattcgtccgagtgaaaccgctggtcgttatgttacctaccgttatgttgtataagcaaaaaaagcttttgttgatggaaacgctcagtgttgtgcgagtggaaatgctcagtgttgtgttgtgtacccaaattgttgacaatgttatttgttagatgtacgaattgaaaaaccttacaacaacattttagtatcattgtataatggggcaaggtggccttgccaaggtctcatgagcactgagatgatttcatgtgttgggtttaattaactgattaagaaatagcttatgacctaaaaaaaaaaaaaaaa

SEQ ID NO: 3562 - DNA, 945 bp, Brassica napus
cgccgcttctgtctgcttcttcgtcgctctgtgccacatctcttctctctttgcctctaaacatttagccgagatgggtctaacggaagaagaaatcaaaagactttacagaatccagaagacgttgatgcagatgctcaaggaccgtggctacttcatcgccgactctgaaatcaccatgagcttgtcacagttcgttagaaagtacggagacaacatgaaaagagaggatcttgttactctcaaagctaagagaaacgacagcagtgatcagctctatatcttcttccccgacgaggcgaaagttggagttaagacgatgaaggtgtacacaaacaggatgaaatcagagaatgtttacagagctatcttggtggtgcaacagaacttgactccttttgctcgaacttgcatcagtgagatctcttctaagtttcatttggaagttttccaggaggcggaaatgcttgtgaacataaaagaacatgttcttgttccggagcaccaagttctcaccactgaagagaagaaaactcttctggagagatacactgtcaaggagacacagcttccgaggatccaagtgactgatccaatcgcaagatactttggactaaaacgtggacaagtcgtgaagatcatacgcccgagtgaaaccgctggtcgttatgttacctaccgttatgttgtataagctaaaaaagcttttgttgatggaaacgctcagtgttgtgcgagtggaaacgctcagtgttgtgttgtgtacccaaattgttgacaatgttatttgttagatgtacgaattgaaaaaccttaaaacaacattttagtatcattgtataatggggcaaggtggccttgccaaggtctcatgagcactgagaagatttcatgttttgggtttaattaactgattaagaaatagcttatgggtaatcaacccaa

SEQ ID NO: 3563 - DNA, 981 bp, Centaurea maculosa
  misc_feature (56)..(56): n is a, c, g, or t
  misc_feature (306)..(306): n is a, c, g, or t
  misc_feature (767)..(767): n is a, c, g, or t
  misc_feature (792)..(792): n is a, c, g, or t
  misc_feature (821)..(821): n is a, c, g, or t
  misc_feature (878)..(878): n is a, c, g, or t
  misc_feature (882)..(883): n is a, c, g, or t
  misc_feature (891)..(891): n is a, c, g, or t
  misc_feature (894)..(894): n is a, c, g, or t
  misc_feature (899)..(899): n is a, c, g, or t
  misc_feature (901)..(901): n is a, c, g, or t
  misc_feature (920)..(921): n is a, c, g, or t
  misc_feature (924)..(924): n is a, c, g, or t
  misc_feature (928)..(928): n is a, c, g, or t
  misc_feature (932)..(933): n is a, c, g, or t
  misc_feature (939)..(939): n is a, c, g, or t
  misc_feature (946)..(946): n is a, c, g, or t
  misc_feature (948)..(948): n is a, c, g, or t
  misc_feature (952)..(953): n is a, c, g, or t
ggatttaattccactaacccccaattttgcgaaacacgctctctccttcgtcgccnattgctgctaaaaccctaattcacttgccaaagaagaagaagaagaagaaaggaaaagatgtcgacggcgttgacggaggaggaaatcaagaggttgttcagaattaggaagacggtgatggagatgttgaaggatcggaattatttggttggagatttcgagctggagatggataaaaggcagttcattcagaagtatggagacaatatgaaacgtgaggatctcgttatcagtaaatccttaaagaangatagctctgaacagatctatgtcttcttccctgatgaagcaaaagttggagtcaagacgataaagaattatatcaaccgtatgaagtcggagaatgttacccgagcgatcttggttgtgcagcaaaatctaacaccttttgcccgaacttgcattagtgagatatcaacgaaatttcacttggaggtcttccaggaagcagagttgttggtgaatgtaaaaaatcatgttctagtgcctgagcatcagattctttcgaacgaagagaagaggactttactcgaaagatacacagtaaaagaaacacagctgccacgtattcaagtgaccgatcctgttgctagatattatggactgaagcgtgggcaggttgtgaaaattattcgaccgagtgagactgctggtcgttacgtcacttaccggtacgttgtctgaattccgatcacccatcgtgaaatttngatccacttttcttgtgttgtaacnacccagtttactgaagattaccttctctnagtttgtttgtaatgtttacattcatcaatgctgtatgaagttgactaccctcttcnaatnngtttgtantgntgttncntgtaatgcacattgtatcnnacnggtntccnnttttcngagtaanantaannattgttctcagataaataaatttctaag

SEQ ID NO: 3564 - DNA, 928 bp, Lactuca sativa
taaaaattccgctacacaattttgcaagagcagctacaacaaaactttccctcgtcgccgacttcgtaatcggacgcgccgctgagaaaccctagttcacttgtttaaaaggagaagaaagcgaaagatgtcgacggcgttgacggaggaagatatcaagaggttgtacagaataaggaaaacagtgatggagatgttaaaggacaggaattacttggttggagatttcgagttggagatggatagaaggcagtttattcaaaagtatggagataacatgaaacgtgaagatctcgtcatcagcaaatccttgaagaacgatagctccgaacagatctatgtcttcttccctgatgaagcaaaagttggagtcaaaacaataaagaattacataaaccgaatgaaatcagagaatgtcacccgaggaatcctggttgtgcaacaaaatctcactccatttgccagaacttgcattagtgagatatctgctaaatttcatttggaggtttttcaggaagcagagttgctagtgaatgtaaaaaaccatgttctagtccctgagcatcaggttcttgcaaatgaagagaagaaaacattgcttgagagatacacagtaaaagaaacacagttgcctcgaattcaagtgacagatccagttgctagatattatgggctaaaacgtgggcaggttgtgaaaatcattagaccaagtgagactgctgggcgatatgttacttacagatatgttgtctgaatgagtgtctgaattgtgaacttggattattcagctttgttgtggtgtaataacgtttgttaaaatcgcattattaacattagcaactctcttaatgtgacattcatgatgatggaagtcaaattggttatatacattattagagtagatattagtttactagttgtgagacca

SEQ ID NO: 3565 - DNA, 931 bp, Mimulus guttatus
ccgctgtttgcaacttcaattgtaaattcccaaatcttgggttctcaattcgacgactcacctctcccccgagttaggccgagttagtgcaaagatggttttgtcggacgaggaaataacgcggcttgtcagagttaggaagaatgtgatgcagatgctcaaggatagaggatacatggtcggtgatttcgagattgatatgacaaagtatcaattccttcagaaatacggtgagaatatgaagagagaagatcttgttattaataaaggcttgcgcaacaacagctccgaccagatatatattttcttccccgaggaaccgaaggttggtgttaagacaatgaagacttatacgaatcgcatgaaagaagagggtgttcatcgtgcagttttaattgtccagcagaatttaaccccgtttgctcgaacatgcattagtgaaatatccactaaatttcacttggaagttttccaggaggcagagatgttaatcaacataaaagagcatgttcttgtacccgagcatcaagtgcttacccccgaagaaaagaagactttacttgaacgatacaccgtgaaagaaacgcagctacctcgtattcaaataacggacccgattgcaagatattacggactgaagcgtgggcacgttgttaaaattatccgaccaagtgagactgctggccgttacgtcacttaccgatatgtggtctgaaaaaaatgaagcaatcaagtgaaataagtatatcttgtggattgattgtgagtgctaaaattctatgtgatgtgtgaggattataacacttgggcgtatttgattttgtagcatgatgtaatttgaatagatttatagtgtatcagactatggacatattaactaaggacgaacctgaaaattcgttacgtgccttttaacatcgaaaatttcaag

SEQ ID NO: 3566 - DNA, 1036 bp, Mimulus guttatus
agaagccgctgtttgcaacttcaattgtaaattcccaaatcttgggttctcaattcgacgactcacctctcccccgagttaggccgagttagtgcaaagatggttttgtcggacgaggaaataacgcggcttgtcagagttaggaagaatgtgatgcagatgctcaaggatagaggatacatggtcggtgatttcgagattgatatgacaaagtatcaattccttcagaaatacggtgagaatatgaagagagaagatcttgttattaataaaggcttgcgcaacaacagctccgaccagatatatattttcttccccgaggaaccgaaggttggtgttaagacaatgaagacttatacgaatcgcatgaaagaagagggtgttcatcgtgcagttttaattgtccagcagaatttaaccccgtttgctcgaacatgcattagtgaaatatccactaaatttcacttggaagttttccaggaggcagagatgttaatcaacataaaagagcatgttcttgtacccgagcatcaagtgcttacccccgaagaaaagaagactttacttgaacgatacaccgtgaaagaaacgcagctacctcgtattcaaataacggacccgattgcaagatattacggactgaagcgtgggcacgttgttaaaattatccgaccaagtgagactgctggccgttacgtcacttaccgatatgtggtctgaaaaaaatgaagcaatcaagtgaaataagtatatcttgtggattgattgtgagtgctaaaattctatgtgatgtgtgaggattataacacttgggcgtatttgattttgtagcatgatgtaatttgaatagatttatagtgtatcagactatggacatattaactaaggacgaacctgaaaattcgttacgtgccttttaacatcgaaaatttcaagtaacaaattcgaattgaagtttgaacgaatatcctttacatatgatgtctacagattatacatcatataaaaataaacacaaaaataaaataaaattttt

SEQ ID NO: 3567 - DNA, 1122 bp, Orobanche aegyptiaca
atagtttcgtttttcctcaatcgggctttcctcttaatctctctgcaagtaattgatcccagctttcgaatttaaggttcaaaaaggtggtgcaaagatggttatgtccgaggaggaaattactcggcttcatagaattcgaaagactgtgatggagattctgagggatagaggttacatggtgggtgatttcgagattgaaatgccgaggcaccaattccttcagaaacatggtgagaatatgaagagagaggaccttatcataaataaaggcttgcgcagtaacaactctgatcagatatatgtgttctttcctgaggaaccgaaggttggtgttaagactgtgaagacatacacaaatcgcatgaaagaagagggtgtccatcgggcaattttagtggtccagcagaatttaactccgtttgctcgggcgtgcataagtgaaatatcgtctaaatttcatttggaagttttccaggaggcggagttgttaatcaacataaaagagcatgtccttattcccgagcatcagcttctcactcctgaagaaaagaaaactttgttagaaagatacactgtcaaagaaacgcagcttcctcgtatacagataactgacccgattgcaagatattatggactaaagcgcggacaagttgtgaaaatcatcaggccaagtgagactgctggacgttatgtcacttatcgctatgtcgtctgaactttttaaagatgtagagagtgtggagaagaagtatgaagcactcgggtttatttgtcgtatttccgcgtgtataactggatggtataatcttgtcgattggttgcgatgtcagactttcgatgatttttggtacactgctaaatgtattatttgtggcaacgtcataaaatcctgtatgtttttccccctcgccatccaacaaacaagaggcaaaaacttgtgcaaaattttgtctcatcagttcttagggttattctcttagttattttggagttttctattttcttgggtattttcttagtttttattttaagaatgacattgttcagtaacatcttaaagctagaaaatgaacaccttcgttatgtaattattttttatgtttgtcaagattattacaa

SEQ ID NO: 3568 - DNA, 875 bp, Raphanus sativus
  misc_feature (739)..(739): n is a, c, g, or t
  misc_feature (772)..(772): n is a, c, g, or t
  misc_feature (775)..(775): n is a, c, g, or t
ttttttacttgaaaggaaagctctttgaaacgccgctccgtcttcttcgtcgttctgtgcttcccatctcttcttctctctttaccctctataaacatttaatcgagatatgggtctaacggaagaagaaatcaaaagactttacaggatccagaagacgttgatgcagatgctcaaggaccgtggctacttcatcgccgactctgagatcaccatgagcttatcgcagttcgttaggaagtacggagacaacatgaaaagagaagatcttgttactctcaaagctaagcgaaacgacagcagtgaccagctctatatcttcttccctgatgaggcgaaagttggggttaagacgatgaaggtgtacacaaacaggatgaagtcagagaatgtttacagagctatcttggtggtgcagcagaacttgactccttttgctcgaacttgcatcagtgagatctcttctaagtttcatttggaagtcttccaggaggcggaaatgctagtgaacattaaagaacatgttcttgttccggagcaccaagttctaaccactgaggagaagaaaactcttcttgagagatacactgtcaaggagacacagcttccaaggatccaagtgactgatccaatcgcaagatactttgggctaaaacgtggacaagttgtgaagatcatacgtccgagtgaaactgctgggcgttatgttacctaccgttatgttgtataagcaaaaagnttttgttgtgcgactggaaacgcttagagttgntgngtaccaaaattgttgacaatattgtttgttaagtgtacgaattaaaaaaaccttacaacgacattttactatcactctataatgggcaagatggctttgc

SEQ ID NO: 3569 - DNA, 795 bp, Raphanus sativus
  misc_feature (112)..(112): n is a, c, g, or t
  misc_feature (115)..(115): n is a, c, g, or t
tttttacttgaaaggaaagctctttgaaacgccgctccgtcttcttcgtcgttctgtgcttcccatctcttcttctctctttaccctctaaacatttaatcgagatatgggnctnacggaagaagaaatcaaaagactttacaggatccagaagacgttgatgcagatgctcaaggaccgtggctacttcatcgccgactctgagatcaccatgagcttatcgcagttcgttagaaagtatggagacaacatgaaaagagaggatcttgttactctcaaagctaagagaaacgacagcagtgaccagctctatatcttcttccctgatgaggccaaagttggggttaagacgatgaaggtgtacacaaacaggatgaagtcagagaatgtttacagagcaatcttggtggtgcaacagaacttgactccttttgctcgaacttgcattagtgagatctcttctaagtttcatttggaagtcttccaggaggcggaaatgctagtgaacattaaagaacatgttcttgttccggagcaccaagttctcaccactgaggagaagaaaactcttctggagagatacactgtcaaggagacacagcttccaaggatccaagtgactgatccaatcgcaagatactttgggctaaaacgtggacaagtcgtgaagatcatacgtccgagtgaaactgctggtcgttatgttacctaccgctatgttgtataagcaaaaagcttttgttatgcgagtggaaacgcttagagttgttgtgtgccagattgttgacaatgttt

SEQ ID NO: 3570 - DNA, 3024 bp, Phaseolus vulgaris
atgaaaatgctgccaacttccgctgccggggagcccagccatggtggccggacggtggtcgtcggagtgaagatggactcacacagcaccgagttgctcacttgggctttgtttaaagtggctcagccctgtgatgttgtgcttgctcttcatgttcttgggaatgatgaaattgttaatcgagatgggaaatcttctttgttttcacttgtcaaagcgtttgactctgtgcttgctgtctacgaagggttctgcaatttgaaacaggtggatcttaagttcaaaatatgtcggggttcatcagtgaggaaaatcctggttcgagaagccaatgcttattctgcaacgcacatcattgttggaagtcctcaagggcttcataggattcggccatgtatatctgtggcaaggtactgtgctaggaagctaccaaaggattgttgggttcttgctgttcataatgggaaaattgtgttcaagagagatggttcacccgcaactctcgccgacatgaaaggagttgatcagaaccccacaactggggtgctttgttcgattcacaggacacttggcaagacttcaaaagtgttagatgatgatggtaccgggattcaggaaaagggttctggtcaattttcagatcacagtttggctaaggcttttctggattctaaagaattcattgagaagaagagttgctctatttgttcttcaaacccagcactgtttggtttatgttgtaaccatttagaagaagagtcttgtggtgatgcttgtcatgagaaccctttggcaatagtgtctgtgcagaccaatgattctgcttctaaaccaggttggccactgcttcataggacaattatatctgacagaaaatgctctgaaagatcgccgtttcgccagatctctgtagtacaatgggcaatgcagttaccttctagagatctttcatatgatgcgcatcttgtgcaaaaaacaaactattgtggcccaaataaggatgagtttttggctctagatagcaagagtggtgctcttgttccagtggatgctgaaatagggactgcccctttgcctgaccacaacacgagaagcattcctaaggaattggagggccttcatgagaaatactcatccagttgcagattgtttaagtaccaagaacttgtattggcaacatcaaatttcttgcctgaaaatttgattgggaaaggaggaagtagtcaggtatacagaggctgccttcctgatggcaaggaacttgctgttaagatcttaaagccatctgatgatgttctgaaggagtttgttctagaaatagaaattatcacaaccttgcatcacacaaacattatttccctccttggattctgctttgaggatggtaatcttctcttggtctatgatttcttatcaagaggaagccttgaagagaacatccatggtaataagaaaaatccacttgtgtttggttggaccgagagatacaaggtggcaatgggtgttgctgaggctttggattatctccataataatgaaggccaatctgtgatccatcgcgatgtaaaatcatcaaatgttttgttatctgaggattttgaaccccagctctctgactttggacttgctaaatgggcatcaacctcatcatcacatataatctgcacagatgttgctggaacctttggttacatggctcctgagtacttcatgtatggcaaagtaaacgacaagattgatgtctatgcatttggtgttgtgcttcttgagctcctttcaggaagaaagcccataagtagtgattatcccaaaggtcaagagagccttgtcatgtgggcaaatccaattctaaatagtgggaaggtattacaactgttagatcccagtttgggtgataactatgatcctgaagagatggaaaggatggtcttggcagctacactttgtatcaggcgtgctccaagagctagaccaccaatgacccttatctcaaagctccttggaggtgatagtgaagtggtgaatagggcaagagtagaagttcatgctatggaagcagcagaaatgcttgatgatgaagcttgctcaccttccaatctgcagtcacaccttaaccttgctctgcgtgatgtggaggatgattccctctccatatgcagtgttgagcaaaacgtgtcattggaggactacttgagagggaggtggagccgttcatcaagctttgattaagcaaagttctaggcaattactagaacaaggattgtgtttttgaatctaaatcctttgtagataattttggtgtgtggcatgttccattgtatctttggcatgtgctgtggaggtttatagatgggtttaggatgagaggttgtttgtgtgtgccctcctccttcccttcattgtctaggacactatgccttgtaattgtaaggctagttaccctttctccttcattgtctaggacacttggtgccattttcaacccttgatatcatctgtattctggtgccaaaataaaagttgtatcttcaatgttctcgtgtatttagtttaataaatttaatgatcatttctcttacgtggcgtttgcattgtttccttttttttttcttataatatggattatctaattctatcagcagaatcacttttaagttaaaacttttactttacagaatttaatatttgtgaattatcgcataacaatttaatgatagataatttaataaattcaacaataagccagaactaatattattttaaagtatggattttgaatttaactcttattgaataagttttgataccatcctgtaagaaggattttgcatcctacttttatattataattttatcatacttttagataaaaccttcttataagaaggattttgtatcctacttttatattataattttatcatacttttagataaaaccttcacatattctcttatgtcaatgtatattataattttatcatatttttagacaaatattggtgatatgatatggccaacctac

SEQ ID NO: 3571 - DNA, 2595 bp, Cajanus cajan
atgaaaatgcagcaatttgccaccgccggagaacccagccacggcggctccgatgcccgcacggtggtggtgggagtgaagatggactcccacagtagggagttgctcacttgggctttgttcaaacttgctcagcctggtgatgttgtgcttgctcttcatgttcttgggaatgatgaaatcgtgaatcgagaaggaaaatcctctttgttttcgcttgtcaaagcatttgagtctgttcttgccgtttatgaaggattctgcgatttgaaacaggtggatcttaagctcaaaatatgtcggggttcgtcagtgaagaaaattttggttcgagaagcggatgcttgttccgcaacacacatcctagttggaacacctcatggtcttagtagaattcggccatgtatatctgtggcaaagtactgtgctaagaagttaccaaaggattgttgggttcttgcggttaataatgggaaagttgttttcaagagagatgggtcacccgcaactcgtgctgacataaaagggcttaatcatcaggatcacaaaaatgggttgcttggtacactcagcaagagttcacaagtgctagatgttgatggtacagtgatgaatggaaagggtggtggccaattttcggatcacagtttagctaaggcttttctggactcaaaagagttcaaggggaagaaggggtgctttatttgtgcttcaactccagcattgtttgattcaacttgtaagaattcagaagaagagtcttgtggtgaagttgaggagaagaatcctttggcaatagtgcctgtgcagaccaatggtgctgcttctaaagctggttggccactgcttcataggaaaattgtatctgacgggaaatgccctgaaagatcagtgttgcgccagatctctgtggtacaatgggcaatgcagttaccctctagaaatatttcatatactgcacatcatgaccataaaacatatcattttgaccgggataaggatcggttttcgggtctagacagcaattgtggtgctcttgttcctgtgaatgctgaaatagggactgtttctttgcctgaacacaattcaagaagcattcctaaggaattggtgggccttcatgagaaatactcatccacttgcacattgtttaagtaccaagagcttgtatcggcaacatcaaatttcttgcctgaaaatttgattgggaaaggaggaagcagtgaggtttatagaggctgccttcctgatggcaagcaacttgccgttaagatcttaaagccatctgaggaagttttgaaggagtttgttctagaaatagaaattatcactaccttgcatcacaaaaacattatttccctccttgggttctgctttgaggatggcaatcttcttttggtctatgatttcttatcaagaggaagccttgaagagaacctctatggtaataagaaaattccacttgtgtttggttggactgagagatacaaggtggcaatgggtgttgctgaggctttggagtatctgcatgataatgaaggccaatctgtgatccatcgcgatgtaaaatcatcaaatgttctgttatctgaggattttgaaccccagctctctgactttggacttgctaaatgggcatcaacctcttcatcacacataatctgcacagatgttgctggaacctttggttacatggctccggagtacttcatgtatggtaaagtaactgagaagattgatgtctatgcatttggtgttgtgcttcttgagcttctttcagggagaaagcccataagtggtgattatcccaagggtcaagagagccttgtcatgtgggcaagtccaattctaaacagtgggaaggcgtcacaattgttagatcctagtttgggtgataactatgatcatgaagaaatggaaagggtggtcttggcagccacactttgtatcagacgtgctccaagagctaggcctcaaatcagccttatctctaagctccttggaggtgatgctgatgtaatcaagtgggcaagactagaagtcaatgctacggaagcaccagaaatgcttgatgatgaaacttgtccaccttcaattctgcagtcacatcttaaccttgcattgcttgatgtggaggatgacttgctctccatgtgcagtgttgaccaacatgtctcattggaggactacctgagaggcaggtggagccgttcttcaagctttgattaagcaaattgctagaacaaggattgtttttttaaatctaaaccctttgtagatagttttgatgtggttcatgttccaccatctatggcattggctgtggatatttatagatatgggtttaggatgagaggttgtttgtgtgtgccctcctccttcccttcactgtcaaggaaactatgccctgtaatttggaaggctagttaccctttctcgttctactttaactggtgccacttttaatccttaatctcaatttgatacagtttaatatgtaacggtacgaaaaataaaagatgcaaaaggtgtatcttaaaactacataatggtcactgttctcatgcattttaataaagttaatggaaatttctt

SEQ ID NO: 3572 - DNA, 6439 bp, Glycine max
tgtcactctctttctcttcccttcattcaaaatctgttttttttttcttcataaaaataaaataataataatagttttatgattattatttatttttttatttgttcactcactgtttgtaattattacactctgctgggtgtttctggagggggttgtggatctgatttcggttgtttgtggtttcagttcccccaaagtcgctgtctttacatgcatgctcagattttaacggttaattgctttgtgggtcggtgacaaagtggagaaattttgagaactagcttagggtgatgctgattctgtgctcgtttgcttgagtggttggtgtttttgcatttgggtcattgttttggattgaatttgcttctgggtatgctgggaattgaggcattgagctgagttgactaaaagatcatatgaactgagatgatggggtttcgctttccatggcggtggccaatgatggcctctgccttttggtccggaacttagatatggttctcaacagcatcatagatcagatggaatgttaacaaggctggtcaatgagggactcataatgagagggcttgggttgaatcacagtccatgggcaccccggacaagaaagtatctgactttgttgatgtagttaggtcttggatccctcgaagggcggaaccaccaaatgtgtcgagggacttctggatgcctgatcagagttgtagggtatgctatgagtgtgattcacagttcacaatattcaaccgcaggcaccactgtcgaatctgtggtcgagttttctgtgcaaaatgcactgccaattctgttcctgtgccatcggacgagccaaatactggccgcgaagatttggagaggataagggtctgtaactattgttttaaacaatgggagcaagtagctacagttgataataatggaagtgcagatctttcagccaccccttgtctcagcccttcaccatctacaacaagcttggtcagcactaagtccagttgcacctgtcatagtagcagcagcactgctggttcagttccttatacaactgggccttatcagcgtgtgccgtatagtccccatcaatcttcacaaatgaatcagataacagacgagcaagaaaatttgaattctgggaggagtgcaaatccctctgagtctgtagggaatgtgacttctaaccaatttggctattgcttcagcaggagtgatgatgaggatgatgattatggtgcttatcattctgatacagaatcaaggcattattctcatgcccatgactacgacgatccagttaacattcatggggttgaccatgtctatgggccacatcaaatgcatcctgatgaagataacattcaggaaaaaagctcgagttgcctaacccaatcacagaatcttgatctagaaggtgtagctggaattcaagcacctgggaaagaagacgatgagcctgatcatgctgatggatgtgaaacttctccttatcatgaggagagcaattatgcagagcctgtggattttgagaataatggacaactgtggatacctcctgagccagaagatgaagaggatgatagagaagctgttctttttgatgatgatgaagatgaaggtactactggaggtggggaatggggatatctacgatcctccactagttttggttctggagaatgtcgtagcagagataaaacaactgaagatcataggaaggccatgaagactgtagtggaagggcattttagagctctagtagctcagctcttacaagtggagaacctaactacttgtgatgaagatggaaaagagacttggttggatataattactgctttgtcttgggaagctgctacacttctgaagccagatacgagcagaggtggaggtatggatcctggtggctatgtaaaggttaaatgcatagcttgtggacatcgaaatgaaagcatggtggttaaaggagttgtatgtaaaaagaatgtggctcatcggcgaatgacagcaaaaattgataaaccacgttttctaatacttggcggtgctttggagtatcagcgtgtttctaaccagttgtcaagtgttgatactttgttacagcaggagatggaccatttgaaaatggcagtagcaaggattgatgctcatcaccccaatgttcttttggtggaaaagtcagtatctcgttatgctcaagaataccttcttgctaaagacatatcacttgttctgaatattaaaaagccacttttagagcgtattgcccgttgtactggtgcacagattgtcccttcaattgatcatctgacctctcagaagctgggatattgcgaaacattccatgtagacaaattttttgaggagcatggtagtgccgggcaaggtgggaaaaaatcaacaaagactttgatgttctttgagggttgcccaaaacctttaggttgcactatcttgctgaagggtgccaatggggatgagttgaagaaggtgaaacatgtgatccaatatggaatctttgcagcctatcatctggcgctggagacatcttttctggctgatgaaggtgcttcacctctagagtttcccttgaaatctcccataaccgttgcattacccgataaaccatctagtactgtgagatccatttccactatccctggattttctgttcttactgctagagagtctcagggagcaaaaccttttaaagaagtaccaaaatcaaatgatatctacaagactgaaagaaccccatctagctgcagtgagtccactgaaagattattggtgggtgactcaatccatatgcatgaagtgtctggaggtatcacccaattggctctggatatgccatcttccaactgcaatagtttcgtttcaaatacttcttctaaggagaatgataagaaatgtcccaaggaattttttcaatacagaccagatgagagaagggaaactatgttgaacaatggtcttatttcaaattctttcggtacctttgagtcttcacagcaagatggcaatagccacctcagagctgcagcattgtttgctaatcaaggagctaaccctgagccacctaatgtaaaacatgacactaataattttaataacaataatgatcatgatgatatgatacattcaaaagaagattttcctccctcaacttctgaccatcagagtattttggtctttttatcaacacgttgtgtgtggaaaggaactgtttgtgaaaggtcccatcttgtaagaattaaatactatggaagttctgataagcctttgggacggtttttgagagatcaactacttgatccgagttacacatgctgctcatgtgagttaccatcagaagctcatgttcattgttatactcatcggcaaggcagcctgacaatttgcgttaagaaattggagtttgctttaccaggagaacgagaaggtaaaatttggatgtggcacaggtgcctgaaatgccctcgcatacatggttttcctcctgctacacgaagaatagttatgtctgatgctgcctggggcttatcctttgggaaatttttggagctgagtttttcaaatcatgcagcagcaagcagggttgcaagttgtggtcattctctccacagagattgtttaagattctatggttttgggaagatggttgcctgctttcgttatgcttcaattcaccttcattctgtttatctccccccatctaaacttgaattcaactatgatagtcaggactggctacaaaaagaagcaaatgagctgcataacaaggctgaaatactgtttagtgaagtgtgcaacacactgcatcaaatttcagagaaggtttcaggtcctgtgttgcaggagggtggaaatagggtgtcagattttaggaatctaattgctgaacttaaagggatgctgcagtatgagaaagaagaatttgaggactcattacaaaagttgctgcataaagagggaaaagctggtcagcctgtgattgatattctagagctcaataagttgcgcaggcatatccttatccattcttatgtttgggaccagcgcttgatatatgcatccaatttaagtaaaattattcttcaagaaaacttgaagagcttaaatcatagggagaagttgcttggttctagggaaaaggttgtcgaggccgatgttgccactaggcctgcaagaggccatagcagttgtgattcctttcttttggaaacaaaacctgatggaaacctaaatttagaaaacactagccaccttagtcaccctgtggttaaaagtgaggacaagggtaaagacacaaatcatgataaggttgacctttctctttctggtggtgcaaatatcaatgataaatctgattctgtggagtttggaggggctgtacggaaggctttgtctgagggggaatctctccagttgtggctaatttatctgatacccttgatgctgcatggacaggtgaaggtcatcctacaaattcatcactcaaagaaaatggttgtctacctcccgatgcagcagctgtggctgttcattcacctgtggcaaatatagttacatcaaaatcaaattctaatatttatactgctaatataggtggggttgaggcaggatgcactaattactctaaattgctttccaagggacttgatactacatggaaaggaataccttttgcaaacgtctttggttcattcaacaaaacttcttccttcaatacagagaagcttgttgagtacaatccagtccacattttatcatttcgagagttggagcgccagactggtgctagactgcttcttccagctggcactaatgataccatagtgcctgtctacgatgatgaacccactagtgttatagcgtatgtgcttgtgtcaatggattatcatatgcagatgttagaatatgatagacctaaagacagtggagacagttcaatttcattgccactctttgattcaacaagtctactttctcttaactcttttgatgagacaattactaatacctacagaagtctgggctcttttgaggagaacgtgttatccacttctgggtctcggagtttgccggctggggatccattctcatacacaaaggatttgcatgcaagagtttcttttactgatgatagctcccttggaaaagtgaaatatactgtaacttgctactatgcaaagagatttgaggctttaagaagaacttgttgcccttctgagttagattttgtgcggtcccttagtcgttgtaaaaagtggggagctcagggaggaaagagcaatgttttctttgcaaaaaccctggacgatagatttattatcaagcaggttacaaaaacagagctcgagtcatttactaagtttgcacctgcttattttaagtatctatctgagtcaatcagtacagggagtccaacttgtcttgcaaagatcttgggcatttatcaggtaacatcaaagcacctcaaaggagggaaggaaacaaagatggatgttttggttatggaaaaccttctttacaggcgtaacattagacgactttatgacctcaaaggttcttcccgatcacggtacaatccagatacaagtgggagcaataaagtgctgctggatcagaatctcattgaagctatgccaacctctccaatatttgttgggaacaaggcaaagcggttgcttgagagggccgtgtggaatgacactgccttccttgcatcaatatatgtgatggactactcattgctggttggagtggatgaggaaaagcatgagctggttttaggtatcattgattttatgaggcagtatacatgggacaaacaccttgaaacttgggtgaagacctcaggcatccttggtggacccaagaacacttctccaactgttatatcaccacagcagtacaagaaacggtttaggaaagccatgagcttgtattttcttatggtgccagatcaatggtcccctccagagttacaccccagtgggtcccaatctgacatttgcgacgaaaatgcgtgaggcatgggacccatttcattgatgtggtcaaagtttgaatcttgtaaatgtcagtaccattccattggcacgggtctctccttccttccttatgtccattatatttgtctgctgcataatgcagctgctgttgatttgtgttaccacagattgttgaaagggtaactaagtgtacagtgattcccctctttatatatatatatatatatatatatatatatatatatatatatattatatcttgtattaaatctcttgatctgtcgtaattttgatctaaagttcacaacctatcgaatggtgtttgaattgtgcacactgcgtttctttttctacggatgtgaaaggcgttgataaattcttacaattcactgttatgtgacccgtgtggaagtatatatttg

SEQ ID NO: 3573 - DNA, 5690 bp, Glycine max
tccatgggcaccccggacaagaaagtatctgactttgttgatgtagttaggtcttggatccctcgaagggcggaaccaccaaatgtgtcgagggacttctggatgcctgatcagagttgtagggtatgctatgagtgtgattcacagttcacaatattcaaccgcaggcaccactgtcgaatctgtggtcgagttttctgtgcaaaatgcactgccaattctgttcctgtgccatcggacgagccaaatactggccgcgaagatttggagaggataagggtctgtaactattgttttaaacaatgggagcaagtagctacagttgataataatggaagtgcagatctttcagccaccccttgtctcagcccttcaccatctacaacaagcttggtcagcactaagtccagttgcacctgtcatagtagcagcagcactgctggttcagttccttatacaactgggccttatcagcacgagcaagaaaatttgaattctgggaggagtgcaaatccctctgagtctgtagggaatgtgacttctaaccaatttggctattgcttcagcaggtactctttcttttttgtttattttttcagattgctgaatgtaattgtctttccattccctttcttaatgatggtaaattctgctgttgtcgtcaaactttctgtttttctgttcttactgttattttatgtttattcttctgaaccaggagtgatgatgaggatgatgattatggtgcttatcattctgatacagaatcaaggcattattctcatgcccatgactacgacgatccagttaacattcatggggttgaccatctcgagttgcctaacccaatcacagaatcttgatctagaagaagacgatgagcctgatcatgctgatggatgtgaaacttctccttatcatgaggagagcaattatgcagagcctgtggattttgagaataatggacaactgtggatacctcctgagccagaagatgaagaggatgatagagaagctgttctttttgatgatgatgaagatgaaggtactactggaggtggggaatggggatatctacgatcctccactagttttggttctggagaatgtcgtagcagagataaaacaactgaagatcataggaaggccatgaagactgtagtggaagggcattttagagctctagtagctcagctcttacaagtggagaacctaactacttgtgatgaagatggaaaagagacttggttggatataattactgctttgtcttgggaagctgctacacttctgaagccagatacgagcagaggtggaggtatggatcctggtggctatgtaaaggttaaatgcatagcttgtggacatcgaaatgaaagcatggtggttaaaggagttgtatgtaaaaagaatgtggctcatcggcgaatgacagcaaaaattgataaaccacgttttctaatacttggcggtgctttggagtatcagcgtgtttctaaccagttgtcaagtgttgatactttgttacagcaggagatggaccatttgaaaatggcagtagcaaggattgatgctcatcaccccaatgttcttttggtggaaaagtcagtatctcgttatgctcaagaataccttcttgctaaagacatatcacttgttctgaatattaaaaagccacttttagagcgtattgcccgttgtactggtgcacagattgtcccttcaattgatcatctgacctctcagaagctgggatattgcgaaacattccatgtagacaaattttttgaggagcatggtagtgccgggcaaggtgggaaaaaatcaacaaagactttgatgttctttgagggttgcccaaaacctttaggttgcactatcttgctgaagggtgccaatggggatgagttgaagaaggtgaaacatgtgatccaatatggaatctttgcagcctatcatctggcgctggagacatcttttctggctgatgaaggtgcttcacctctagagtttcccttgaaatctcccataaccgttgcattacccgataaaccatctagtactgtgagatccatttccactatccctggattttctgttcttactgctagagagtctcagggagcaaaaccttttaaagaagtaccaaaatcaaatgatatctacaagactgaaagaaccccatctagctgcagtgagtccactgaaagattattggtgggtgactcaatccatatgcatgaagtgtctggaggtatcacccaattggctctggatatgccatcttccaactgcaatagtttcgtttcaaatacttcttctaaggagaatgataagaaatgtcccaaggaattttttcaatacagaccagatgagagaagggaaactatgttgaacaatggtcttatttcaaattctttcggtacctttgagtcttcacagcaagatggcaatagccacctcagagctgcagcattgtttgctaatcaaggagctaaccctgagccacctaatgtaaaacatgacactaataattttaataacaataatgatcatgatgatatgatacattcaaaagaagattttcctccctcaacttctgaccatcagagtattttggtctttttatcaacacgttgtgtgtggaaaggaactgtttgtgaaaggtcccatcttgtaagaattaaatactatggaagttctgataagcctttgggacggtttttgagagatcaactacttgatccgagttacacatgctgctcatgtgagttaccatcagaagctcatgttcattgttatactcatcggcaaggcagcctgacaatttgcgttaagaaattggagtttgctttaccaggagaacgagaaggtaaaatttggatgtggcacaggtgcctgaaatgccctcgcatacatggttttcctcctgctacacgaagaatagttatgtctgatgctgcctggggcttatcctttgggaaatttttggagctgagtttttcaaatcatgcagcagcaagcagggttgcaagttgtggtcattctctccacagagattgtttaagattctatggttttgggaagatggttgcctgctttcgttatgcttcaattcaccttcattctgtttatctccccccatctaaacttgaattcaactatgatagtcaggactggctacaaaaagaagcaaatgagctgcataacaaggctgaaatactgtttagtgaagtgtgcaacacactgcatcaaatttcagagaaggtttcaggtcctgtgttgcaggagggtggaaatagggtgtcagattttaggaatctaattgctgaacttaaagggatgctgcagtatgagaaagaagaatttgaggactcattacaaaagttgctgcataaagagggaaaagctggtcagcctgtgattgatattctagagctcaataagttgcgcaggcatatccttatccattcttatgtttgggaccagcgcttgatatatgcatccaatttaagtaaaattattcttcaagaaaacttgaagagcttaaatcatagggagaagttgcttggttctagggaaaaggttgtcgaggccgatgttgccactaggcctgcaagaggccatagcagttgtgattcctttcttttggaaacaaaacctgatggaaacctaaatttagaaaacactagccaccttagtcaccctgtggttaaaagtgaggacaaggggggaatctctccagttgtggctaatttatctgatacccttgatgctgcatggacaggtgaaggtcatcctacaaattcatcactcaaagaaaatggttgtctacctcccgatgcagcagctgtggctgttcattcacctgtggcaaatatagttacatcaaaatcaaattctaatatttatactgctaatataggtggggttgaggcaggatgcactaattactctaaattgctttccaagggacttgatactacatggaaaggaataccttttgcaaacgtctttggttcattcaacaaaacttcttccttcaatacagagaagcttgttgagtacaatccagtccacattttatcatttcgagagttggagcgccagactggtgctagactgcttcttccagctggcactaatgataccatagtgcctgtctacgatgatgaacccactagtgttatagcgtatgtgcttgtgtcaatggattatcatatgcagatgttagaatatgatagacctaaagacagtggagacagttcaatttcattgccactctttgattcaacaagtctactttctcttaactcttttgatgagacaattactaatacctacagaagtctgggctcttttgaggagaacgtgttatccacttctgggtctcggagtttgccggctggggatccattctcatacacaaaggatttgcatgcaagagtttcttttactgatgatagctcccttggaaaagtgaaatatactgtaacttgctactatgcaaagagatttgaggctttaagaagaacttgttgcccttctgagttagattttgtgcggtcccttagtcgttgtaaaaagtggggagctcagggaggaaagagcaatgttttctttgcaaaaaccctggacgatagatttattatcaagcaggttacaaaaacagagctcgagtcatttactaagtttgcacctgcttattttaagtatctatctgagtcaatcagtacagggagtccaacttgtcttgcaaagatcttgggcatttatcaggtaacatcaaagcacctcaaaggagggaaggaaacaaagatggatgttttggttatggaaaaccttctttacaggcgtaacattagacgactttatgacctcaaaggttcttcccgatcacggtacaatccagatacaagtgggagcaataaagtgctgctggatcagaatctcattgaagctatgccaacctctccaatatttgttgggaacaaggcaaagcggttgcttgagagggccgtgtggaatgacactgccttccttgcatcaatatatgtgatggactactcattgctggttggagtggatgaggaaaagcatgagctggttttaggtatcattgattttatgaggcagtatacatgggacaaacaccttgaaacttgggtgaagacctcaggcatccttggtggacccaagaacacttctccaactgttatatcaccacagcagtacaagaaacggtttaggaaagccatgagcttgtattttcttatggtgccagatcaatggtcccctccagagttacaccccagtgggtcccaatctgacatttgcgacgaaaatgcgtgaggcatgggacccatttcattgatgtggtcaaagtttgaatcttgtaaatgtcagtaccattccattggcacgggtctctccttccttccttatgtccattatatttgtctgctgcataatgcagctgctgttgatttgtgttaccacagattgttgaaagggtaactaagtgtacagtgattcccctctttatatatatatatatatatatatatatatatatatatatatatattatatcttgtattaaatctcttgatctgtcgtaattttgatctaaagttcacaacctatcgaatggtgtttgaattgtgcacactgcgtttctttttctacgg

SEQ ID NO: 3574 - DNA, 6280 bp, Phaseolus vulgaris
tattattttatttgctccagtcactgtttgtaattattactctgctgggtgtttctggaggccttgtgagatctgatttcggttgtttgaggttcagttccccaaaaagttactgtctttacatgcatgcccagagtttaacggctgattgctttgtgggccgctgacagagtggagaaattttgtgaagcagcttagggttgtactgattctgcgcttgtctgcttgaggggttggtgtttttgcatctgggtcgttgtttttgattgaattttcttgctgtgtatgcgcgaactgaggcatcgaactgagctgaataagatcctatgaactgagatgatggggttttgctttccatggcggtggccaatggttgtctctgccttttttctggaagatatgcttctttccggcatcatagattagatggaatgttaacaaggctggtcaatgagggactcataatgagagggcttgggtttaatcacagtccatggacacccccgataagaaaagatctgattttgttgatgtagttaggtcttggatccctcgaaggaccgagccaccaaatgtgtcgagggacttctggatgcccgatcagagttgtagggtctgctatgagtgtgattcgcagttcacgatattcaaccgcagacatcactgtcgaatctgtgggcgagttttctgtgcaaaatgcactgccaattctgttcccgcgccttcagatgagccaaatactgtccgtgaagagtgggagaggataagggtctgcaactattgttttaaacaatgggaagggttagcaacaattgataataatggaagagcagatccttcgtccaccccttgtcttagtccttcaccgtctacaacaagcttggtcagcactaagtccagttgtacctgtcatagtagcagcagcactgctggttcagttccttatacaactgggccttatcagcgtgtgccttatagtccccggcaatcttcgcaaatgaatcagatagctgatgaacaagataatttaaattctggtaggagttcaaatccctccgaggctgtagggaatttgacttctaaccaatttggctattgcttcaacaggagtgatgatgaggatgatgattatggtgtttatcattcggatacagaatcaagacattattctcatgtacatgactttgaagatccagttaacattcatggggttgaacatgtctacgggccacatcaaatgcatcctgacgaagctagcattcatgaaaaaagcttgagttgcctaacgccaccacagaatcttgatctagaaggtgtagatggaattcaagcacctggtaaagaagctgatgagcatgatcatgctgatggatgtgaaacttctccttatcatgaagagagcaataatacagatcctgtggattttgagagtaatggactactatggctacctcctgagccagaagatgaagaggatgatagagaagctgttcttttcgatgatgatgaggatgaaggtactactggaggtggggaatggggatatctacgatcctccactagttttggctctggagaatgtcgtagcagagataaaacaagtgaggatcataggaaggccatgaagactgtagtggaagggcattttagagctctggtcactcagctcttacaagtggaaaacctaactatttgtgatgaagatggaaaagagagttggttggatataattaccgctttgtcttgggaagctgctacaattctgaagcccgatatgagcagaggtggaggtatggatcctggtggatatgtaaaggttaaatgcatagcttgtggacatcggaatgaaagcatggtggttaaaggagttgtatgtaaaaagaatgtggctcatcggagaatgacatcaaaaattgataaaccacgttttctaatacttggaggtgctttggagtatcagcgtgtttctaaccagttatcaagtgttgatactttgttacagcaggagatggaccatttgaagatggcagttgcaaggattgatgctcatcaccccaatgtgcttttggtggagaagtcagtatctcgttatgctcaagattaccttctagctaaagacatatcacttgttttgaatatcaaaaagccacttttagagcgcattgcccgttgcaccggtgcacaaattgtcccttcaattgatcatctgacctctcaaaaattgggatattgtgaaacattccatgttgacaaattttttgaggagcatggtagtgcagggcaaggtgggaaaaaatcaacaaagactttgatgttctttgagggttgtccgagacctttaggttgcactatcttgctgaagggtgccaatggggacgagttgaagaaggtgaaacatgtgatccaatatggagtctttgcagcctatcacctggcattagagacatcttttctggctgatgaaggtgcttcaccactagagtttcctttgaaatctcccataactgttgcattaccagataaaccatctagtattgtgagatccatttccactatccctggattttctgttctctctgctagagagtctcagggagcaaaaccttttgaaataccaaaatctgacgacatccacaagacagaaagaaccccatctagctgcagtgagtccactgaaagatcattggttggtgactcaatcaatatgcatgaagtcccgggagttgccatccaatcagctcaggatatgccatcttccctctgcaaaagtttcctttcgaacactgcttctaaggaagatgattcttttggaacatttgactcttcacaacaagatggcaatagctacctcagagctgcagaattgtacgctaatcaaggccctagctttggggcaccatatgtaaaacatgatactaataatagtaataacaataatgatcatgaggacatggtacattcgaatgaagattttcctccctcaacttccgaccatcagagtattttagtctttttatcaacacgttgtgcatggaaaggaactgtttgtgaaaggtctcatctggtcagaattaaatactatggaagttctgataagcctttgggacggttcttgagagatcaactactcgatcagagttacacgtgctgctcatgtgagtcgccaccagaagcccatgttcattgttatactcatcggcaaggcagcctgacaatttctgttaagaaactatcggattttgatttaccaggggaacgagaaggtaaaatttggatgtggcacagatgcctgaaatgtcctcgtgtaaatggttttcctcctgctacacggagagtagttatgtctgatgctgcctggggcttatcctttgggaaatttttggagctgagtttttcaaatcatgcagcagcaagcagggttgcaagttgtggtcattcgcttcacagagattgtttaagattctatggttttgggaagatggttgcctgctttcgttatgcttcaattcaccttcattctgtttatcttcccccacctaaacttgaattcttcaactatgataggcaggactggctactaaaagaagcgtatgagctgcatgacaaggctgaattactgtttggtgaagtgtgcaccgttctgcatcaaaattcagagaaggtttcaggtcttgtgttacaggagggtggacaaagggtgtcagattttaggaatctaattgtggaacttaaagagatgctgcagtatgagaaagaagaatttgaggactcattacgaaaaatgctgcatagagaagccaaagctgaacaacctgtgattgatattctggagctcaataagttgcgcaggcatatccttatccattcttatgtttgggaccagcgcttgatatatgcattcaatctatgtaaaattattcttcaagaaaattcaaggatcttaaatcatagagaaaagttgcttggtcctagagaaaaacttgttgaagcagatattgccactaggccagcaagaggctatagcagttccgattcctttcttttggaaacaaaacctgatggaaacttaaatttagaaaacactagtcaccttagccaccctgatgaagtgattaaatgtgaggacaaggttaaagatacaaatcatgataaggttgacctttctctctctggttgtgcaaatatcaatgatagatctgattctgtagaattcggggggtctgtaaggagggctttgtctgagggggaatcttctgttgtggtcaacttatctgatacccttgatgcagcatggacaggtgaaagtcaccctacaatttcatcactcaaagaaaatggttgtcaatctcctgatatgtctgttcattcacctgtggcaaatacagtttcgtcaaaatcaaattctgctaactataatgctgatataggtgggattgaggcgggatgcactaattactctaaaatactttccaaaggacttgatgctaaatggaaagcagtgccttttgcaaacttctttggttcattcaacaaaacttcttccttcaatatacagaagcttgttgagtataacccagtccatattttatcatttcgagaggtggagcgccagactggtgccagactgcttctgcccgccggaactagtgataccatagtgcccgtttacgatgatgaacccaccagtgttatagcatatgtgcttgtgtcagtggattatcatatgcagatgtcagaatttgatagacctaaagacagtggagacagttcaatttcattgccgctctttgattcaagtatactttctcttaattcttttgatgagacaattactaatacgtacagaagtcttggctcttttgatgagagcatgttatccacttctgggtctcggagtttaccggctggggatccaccctcatacacaaaggattttcatgcaagggtttcttttactgatgatagctcccttgggaaagtgaaatatactgtaacttgctactacgcaaagagatttgaggctttaagaaggacttgttgcccttctgagttagattttgtgcggtcccttagccgttgtaagaagtggggagctcagggaggaaagagcaatgttttctttgcaaaaaccctggatgataggtttattatcaagcaggttacaaaaacagagcttgagtcatttaccaagtttgcaccagcatattttaagtatttatctgagtcaatcagtacaggaagcccaacttgtcttgcgaagatcttaggaatttatcaggtaacatcgaagcacctcaaaggagggagggaaacaaaaatggatgttttggttatggaaaatcttctttacagacgaaacattaggcggctttatgacctcaaaggttcttcccgatcacggtacaatccggatacaagtgggagcaataaagtgctgctggatcagaatctcattgaagctatgccaacctctccaatatttgttgggaacaaggcaaaacggttgctagagagggctgtgtggaatgatactgccttccttgcatcaatatatgttatggactactcattgctggttggcgtggatgaggaaaaacatgagctggtattaggtataattgatttcatgaggcagtatacatgggataaacaccttgaaacatgggtgaagacctcaggcatccttggtggagacaagaatacttctccaactgttatatcaccgcagcagtacaagaaacggtttaggaaagccatgagtttatattttctcatggtgccagatcaatggtctcctccagagttacaccccagtgggtcccaatctgacatttatgacgataatgcataggataagagggacccatttgagtgacgtgttcaaaattttatcttgtaaatgttacgattccagcattcgtttacacgggtttctcatatccatgttcattctctctccttaatgtccgtaatatttgcctgcggaataatgcagccgttggatttgtgtcgcttaaaacatcggaggtgcacctccagttaccgtacgatggagcatatccatcaagggtaactaactgtacagtgacttccccctctctttttcattttttatatcatgtattaatctcttgttttcgttatctgtcgtcttcaagttttgagtttttaagtcatagcctattaaagggtgctccaattgcacattgcgtttattttttctgactcactgttatgtgatccgtttagttgtattgtatgtatatatatatatagacaa

SEQ ID NO: 3575 - DNA, 6291 bp, Phaseolus vulgaris
tattattttatttgctccagtcactgtttgtaattattactctgctgggtgtttctggaggccttgtgagatctgatttcggttgtttgaggttcagttccccaaaaagttactgtctttacatgcatgcccagagtttaacggctgattgctttgtgggccgctgacagagtggagaaattttgtgaagcagcttagggttgtactgattctgcgcttgtctgcttgaggggttggtgtttttgcatctgggtcgttgtttttgattgaattttcttgctgtgtatgcgcgaactgaggcatcgaactgagctgaataagatcctatgaactgagatgatggggttttgctttccatggcggtggccaatggttgtctctgccttttttctggaagatatgcttctttccggcatcatagattagatggaatgttaacaaggctggtcaatgagggactcataatgagagggcttgggtttaatcacagtccatggacacccccgataagaaaagatctgattttgttgatgtagttaggtcttggatccctcgaaggaccgagccaccaaatgtgtcgagggacttctggatgcccgatcagagttgtagggtctgctatgagtgtgattcgcagttcacgatattcaaccgcagacatcactgtcgaatctgtgggcgagttttctgtgcaaaatgcactgccaattctgttcccgcgccttcagatgagccaaatactgtccgtgaagagtgggagaggataagggtctgcaactattgttttaaacaatgggaagggttagcaacaattgataataatggaagagcagatccttcgtccaccccttgtcttagtccttcaccgtctacaacaagcttggtcagcactaagtccagttgtacctgtcatagtagcagcagcactgctggttcagttccttatacaactgggccttatcagcgtgtgccttatagtccccggcaatcttcgcaaatgaatcagatagctgatgaacaagataatttaaattctggtaggagttcaaatccctccgaggctgtagggaatttgacttctaaccaatttggctattgcttcaacaggagtgatgatgaggatgatgattatggtgtttatcattcggatacagaatcaagacattattctcatgtacatgactttgaagatccagttaacattcatggggttgaacatgtctacgggccacatcaaatgcatcctgacgaagctagcattcatgaaaaaagcttgagttgcctaacgccaccacagaatcttgatctagaaggtgtagatggaattcaagcacctggtaaagaagctgatgagcatgatcatgctgatggatgtgaaacttctccttatcatgaagagagcaataatacagatcctgtggattttgagagtaatggactactatggctacctcctgagccagaagatgaagaggatgatagagaagctgttcttttcgatgatgatgaggatgaaggtactactggaggtggggaatggggatatctacgatcctccactagttttggctctggagaatgtcgtagcagagataaaacaagtgaggatcataggaaggccatgaagactgtagtggaagggcattttagagctctggtcactcagctcttacaagtggaaaacctaactatttgtgatgaagatggaaaagagagttggttggatataattaccgctttgtcttgggaagctgctacaattctgaagcccgatatgagcagaggtggaggtatggatcctggtggatatgtaaaggttaaatgcatagcttgtggacatcggaatgaaagcatggtggttaaaggagttgtatgtaaaaagaatgtggctcatcggagaatgacatcaaaaattgataaaccacgttttctaatacttggaggtgctttggagtatcagcgtgtttctaaccagttatcaagtgttgatactttgttacagcaggagatggaccatttgaagatggcagttgcaaggattgatgctcatcaccccaatgtgcttttggtggagaagtcagtatctcgttatgctcaagattaccttctagctaaagacatatcacttgttttgaatatcaaaaagccacttttagagcgcattgcccgttgcaccggtgcacaaattgtcccttcaattgatcatctgacctctcaaaaattgggatattgtgaaacattccatgttgacaaattttttgaggagcatggtagtgcagggcaaggtgggaaaaaatcaacaaagactttgatgttctttgagggttgtccgagacctttaggttgcactatcttgctgaagggtgccaatggggacgagttgaagaaggtgaaacatgtgatccaatatggagtctttgcagcctatcacctggcattagagacatcttttctggctgatgaaggtgcttcaccactagagtttcctttgaaatctcccataactgttgcattaccagataaaccatctagtattgtgagatccatttccactatccctggattttctgttctctctgctagagagtctcagggagcaaaaccttttgaaataccaaaatctgacgacatccacaagacagaaagaaccccatctagctgcagtgagtccactgaaagatcattggttggtgactcaatcaatatgcatgaagtcccgggagttgccatccaatcagctcaggatatgccatcttccctctgcaaaagtttcctttcgaacactgcttctaaggaagatgattcttttggaacatttgactcttcacaacaagatggcaatagctacctcagagctgcagaattgtacgctaatcaaggccctagctttggggcaccatatgtaaaacatgatactaataatagtaataacaataatgatcatgaggacatggtacattcgaatgaagattttcctccctcaacttccgaccatcagagtattttagtctttttatcaacacgttgtgcatggaaaggaactgtttgtgaaaggtctcatctggtcagaattaaatactatggaagttctgataagcctttgggacggttcttgagagatcaactactcgatcagagttacacgtgctgctcatgtgagtcgccaccagaagcccatgttcattgttatactcatcggcaaggcagcctgacaatttctgttaagaaactatcggattttgatttaccaggggaacgagaaggtaaaatttggatgtggcacagatgcctgaaatgtcctcgtgtaaatggttttcctcctgctacacggagagtagttatgtctgatgctgcctggggcttatcctttgggaaatttttggagctgagtttttcaaatcatgcagcagcaagcagggttgcaagttgtggtcattcgcttcacagagattgtttaagattctatggttttgggaagatggttgcctgctttcgttatgcttcaattcaccttcattctgtttatcttcccccacctaaacttgaattcttcaactatgataggcaggactggctactaaaagaagcgtatgagctgcatgacaaggctgaattactgtttggtgaagtgtgcaccgttctgcatcaaaattcagagaaggtttcaggtcttgtgttacaggagggtggacaaagggtgtcagattttaggaatctaattgtggaacttaaagagatgctgcagtatgagaaagaagaatttgaggactcattacgaaaaatgctgcatagagaagccaaagctgaacaacctgtgattgatattctggagctcaataagttgcgcaggcatatccttatccattcttatgtttgggaccagcgcttgatatatgcattcaatctatgtaaaattattcttcaagaaaattcaaggatcttaaatcatagagaaaagttgcttggtcctagagaaaaacttgttgaagcagatattgccactaggccagcaagaggctatagcagttccgattcctttcttttggaaacaaaacctgatggaaacttaaatttagaaaacactagtcaccttagccaccctgatgaagtgattaaatgtgaggacaaggttaaagatacaaatcatgataaggttgacctttctctctctggttgtgcaaatatcaatgatagatctgattctgtagaattcggggggtctgtaaggagggctttgtctgagggggaatcttctgttgtggtcaacttatctgatacccttgatgcagcatggacaggtgaaagtcaccctacaatttcatcactcaaagaaaatggttgtcaatctcctgatatgtctgttcattcacctgtggcaaatacagtttcgtcaaaatcaaattctgctaactataatgctgatataggtgggattgaggcgggatgcactaattactctaaaatactttccaaaggacttgatgctaaatggaaagcagtgccttttgcaaacttctttggttcattcaacaaaacttcttccttcaatatacagaagcttgttgagtataacccagtccatattttatcatttcgagaggtggagcgccagactggtgccagactgcttctgcccgccggaactagtgataccatagtgcccgtttacgatgatgaacccaccagtgttatagcatatgtgcttgtgtcagtggattatcatatgcagatgtcagaatttgatagacctaaagacagtggagacagttcaatttcattgccgctctttgattcaagtatactttctcttaattcttttgatgagacaattactaatacgtacagaagtcttggctcttttgatgagagcatgttatccacttctgggtctcggagtttaccggctggggatccaccctcatacacaaaggattttcatgcaagggtttcttttactgatgatagctcccttgggaaagtgaaatatactgtaacttgctactacgcaaagagatttgaggctttaagaaggacttgttgcccttctgagttagattttgtgcggtcccttagccgttgtaagaagtggggagctcagggaggaaagagcaatgttttctttgcaaaaaccctggatgataggtttattatcaagcaggttacaaaaacagagcttgagtcatttaccaagtttgcaccagcatattttaagtatttatctgagtcaatcagtacaggaagcccaacttgtcttgcgaagatcttaggaatttatcaggtaacatcgaagcacctcaaaggagggagggaaacaaaaatggatgttttggttatggaaaatcttctttacagacgaaacattaggcggctttatgacctcaaaggttcttcccgatcacggtacaatccggatacaagtgggagcaataaagtgctgctggatcagaatctcattgaagctatgccaacctctccaatatttgttgggaacaaggcaaaacggttgctagagagggctgtgtggaatgatactgccttccttgcatcaatatatgttatggactactcattgctggttggcgtggatgaggaaaaacatgagctggtattaggtataattgatttcatgaggcagtatacatgggataaacaccttgaaacatgggtgaagacctcaggcatccttggtggagacaagaatacttctccaactgttatatcaccgcagcagtacaagaaacggtttaggaaagccatgagtttatattttctcatggtgccagatcaatggtctcctccagagttacaccccagtgggtcccaatctgacatttatgacgataatgcataggataagagggacccatttgagtgacgtgttcaaaattttatcttgtaaatgttacgattccagcattcgtttacacgggtttctcatatccatgttcattctctctccttaatgtccgtaatatttgcctgcggaataatgcagccgttggatttgtgtcgcttaaaacatcggaggtgcacctccagttaccgtacgatggagcatatccatcaagggtaactaactgtacagtgacttccccctctctttttcattttttatatcatgtattaatctcttgttttcgttatctgtcgtcttcaagttttgagtttttaagtcatagcctattaaagggtgctccaattgcacattgcgtttattttttctgactcactgttatgtgatccgtttagttgtattgtatgtatatatatatatagacaatttttttgtct

SEQ ID NO: 3576 - DNA, 5714 bp, Lotus japonicus
tccatgggcacccctgaaaagaaagtatctgacttcattgatgtagttagatcctggatccccagacgggctgattcaccaaatgtgtccagagacttctggatgcccgatcagagttgtagggtatgctatgagtgtgattctcagttcacaatattcaaccgcaggcatcactgtcgaatctgtggtcgagttttctgtgcaaaatgcactgccaattctattcctgtgccattggatgggacaagtactggtcgtgaagattgggaaaggattagggtttgtaacttttgctttaatcaatggcagcaggcggtagcaactgttgataatggcactccttcagccaccccttgtctcagcccttcaccatctacaacaagcttggtcagcactaagtctagttgcacctgtcatagtagcagcactgctggttcagttccttactcaaccgggccttatcaacgtgtaccatatagtccacatcagtcttccgaaatgaatacagtaacagatgagcaagaaaatttaaattctgggagcacaaatccctctgcggatgtagagaatttgtcttctaaccaatttagttattgcttcaacaggagcgatgatgaggatgatgattatgatgttgatactgatacagaatcaaggcatttctctcatgccaatcactatgacggtccagttaacatccatgagatagaccgtgtctatggaccacatataaatcattctgatggtgataactttcaggaaacaagttcgagttgcctaacagcaacaccgaatcttgatcaagaaggcgtagatggagttcaagctcctggaaaagaagctgatgagcatgatcatgatggatgtgaaacatctccctatcatgaggagagtagtaatgcggagcctgtggactttgagaataatggacttctgtggctacctcctgaaccagaagatgaagaggatgatagagaagctgctccttttgacgatgaagatgaagatgaaggtagtactggagaatggggatatctacgatcctccaatagctttggctctggagaatcccgtaacagagataaatcaattgaggatagtaggaaggccatgaagaatgtagtggaagggcattttagagctctgatagctcagcttttacagtcggaggaactaagtatttgtgatgaagagaataaagagagatggttggatataattaccactttgtcttgggaagctgctacacttctgaagcctgatatgagcggggctggaggtatggaccctggtggatatgtaaaggttaaatgcatagcgtgtgggcatccaaaagaaagtgtggtggttaaaggaattgtttgtaagaagaatgtggctcatcggcggatgacatcaaaaattgataaaccacgttttctaatacttggaggtgctttggagtatcagcgtgtttctaaccagttatcgagtgttgacactttgttacagcaggagatggaccatttgaagatggcggttgcaaggattgctgctcaccaccccaatgttcttttggtagagaagtcagtatctcgttatgctcaagaatatcttctcgctaaagacatatcgcttgttctgaatattaaaaggccgcttttagagcgtattgctcgttgtactggggcacagattgtcccttcaattgatcatctgacctcccaaaagcagggttattgtgaaaccttccatgtggacaaattttttgaggagcatggtactgctgggcaaggtgggaaaaaatcaacgaagactttgatgttctttgagggttgtccaaaacctttaggttgcactatcttgctcaaaggtgccaatggggatgagttgaagaagctgaaacatgtggtccagtatggaatctttgcagcctatcatctggcgctggagacatcttttctggctgatgaaggtgcctcacctctagagtttcccttgaaatctcccataaccgttgcattacctgataatcgatctagtattgtgagatcaatttcaactatccctggatttactgttaccactcctcgagaacatcaaggatctgaaactattaaagaggtaccaaaatctaatgatcgccacaacacagaaagaaccccatctagatgcagtgggtccttcgaaagatcacaggttggtgactccatccacatgcatgaagtctttggagaagtcacccggccagttcaggatatgacatctacccactgcaatagtttcctcgcagatactgattctaaggaggatgttaagaaatgtcccaaggaattttttcaatacagacaagatgagagcggggaaatgatgttgaacaatgatcatatttcagattcttttggcacctttgaaccttcagtgcaagaaggcaataaccacatcaaagctgtagcattggcttcacatcaaggagctaaccctgagccacctattgtaaaaattgacaattataataatgatgatgatgacatgctacattcgaaagaagattttcctgcctcaacttctgaccatcagagtattttggtctttttatcaacacgttgtgtgtggaaaggaactgtttgtgaaaggtcccatcttgttagaattaaatactatgcaacttctgataagcctttgggacggtttttgagagatcgactatttgatcagagttacacttgctgctcatgcgagatgcctccagaagctcatgttcaatgttatactcaccgccaagggagcctgacaattgctgttaagaaactaccagagtttccattaccaggggaaagggatggtaaaatctggatgtggcacagatgcttgaaatgtcctcgtgtaaatggttttcctcctgctacacgaagaatagttatgtctgatgcagcttggggcttatcctttgggaaatttttggagctgagtttttcaaatcatgcagcagcaagcagggttgcaagttgcggtcattctctccacagagattgtttaagattctacggtttcgggaagatggttgcctgctttagctatgcttcaattcacctacattctgtttttcttcccccacctaaacttgaattcaaccatgatactcaagactggctacagaaagaagcgcttgaggtacatgacaaggctgaaatactttttagtgaagtgtgcaatggtctacatcaaatttcagagaagatttcaggtcctatgctgcaggagggtggaaatattgtggcaaaatttaagctcctagtagctgaacttaaaggaattctgcagaaagagaaagaagaatttgaggacttgttacaaaagttgctgcataaagagcccaaagctggccagtctatggttgatattctagagctcaataaattgcgcaggcatatccttactcattcttatgtttgggaccggcgccttatatatgcttccaatctaagtaaaactactctccaagaagattcaaggaattcctatctgaaagagaagtcaattagttctaaggaaaaggttgctgagaaagatgcggcttctaggttcacaagaggccatagcagttgtgactctcttcatttggaaacaaagcctgatggaaaccttaatttagaaaacactagccgccttaaccagtctggtgaagtgattaaaggcgaggacaaaggtaaagacaaaagtcatgataaggttgatctttctctctctggtggtgcaaatgtcaatgataaatctaactctctggagtttggaggagctggaaggagggcttcgccagaggggggatctcctactgttgctaatttatccgatacccttgatgctgcatggacgggtgaaagtcaccctacaagtttatcattcaaagaaaatggttgtcttcctcctgattcagcagttgtgacagttcattcacctgtggcaaatatagtttcaacaacatcaaattctgataattatactgctgatataggtgggactgagacagggcacattaagttgcttcccaaaggacttgatgctagatggagtgggatgccttttgcaaatttgtattcgttcaacaaaacatctaccgtcaatacacagaagcttgttgagtacaacccagtccacattccatcatttcgagagttggagcgccagattggtgctagactgcttctgcctgctggtattaatgacaccatagtacctgtctatgatgatgaacccactagtgttatagcacatgtactcgtgtcaatagattatcacatacaaatgtcagaatctgatagacctaaagacagtttagacagttcagtctcattgcctctctttgattcaacaagtctactttctcttggctcttttgatgagacacttactaatacttacagaagttttggctcttctgatgagagcatgctatccacttctgggtctcggagttcgctggctggggatccactcttatacacaaaggattttcatgcaagggtttcttttgctgatgatagctcccttggaaaggtgaaatatactgtaacttgctactatgcaaagagatttgaggctctaagaaaaatctgttgcccttctgagctagattttgtgcggtcccttagtcgttgtaagaagtggggggctcaaggaggaaagagcaatgttttctttgcgaaaaccctggacgatagatttattatcaaacaggttacaaagacggagcttgagtcatttataaagtttgctcaggcttattttaaatatttatctgagtcaatcagcacaggaagcccaacttgcctagcaaagattttgggaatttatcaggtaacatcaaaacatgtcaaaggagggaaggaaacaaaaatggatgttttggttatggagaatcttctttataggcgtaacattagacggctttatgaccttaaaggttcttctcgatcaaggtacaatccagatacaagtgggagcaataaagttctgctggatcagaatctcatcgaagctatgccaacctctccaatatttgtggggaacaaggcaaagcggttgctcgagagggccgtgtggaatgatacagcattccttgcatcaatatatgtgatggactactcattgctggttggagtggatgaggaaaaacatgagctggttttaggaattattgattttatgagacaatatacatgggacaagcatcttgaatcttgggtgaagaccacaggcatccttggaggacccaagaatgcttctccaactgttatatcaccacagcagtacaagaaacggttcaggaaagccatgagtttatattttctcatggtgccagatcaatggtctcctccaggtttaaaccccactggctcccaatctgatcactgtgatgaaaattcctgagggggtccattttgattgattttgcattatgtaaatgtcaaagattccagcttcatcccatttataccagcaatttttgtctgctgcattgtatttatgtgatgcatggtgcagctgttattttgtgtccatctagagaacatcgaaggtgcacctttgaaaagggtatgttggatcatgtctataaagggtaactgtacagtgaaatctcaaaattgtatatcgtgtattacatctcttgctttgcgagttgtctttagattttgatttttaaatattcataatttaagtttttcggaaaaaaa

SEQ ID NO: 3577 - DNA, 1292 bp, Cajanus cajan
atcccatccataagaaccatggaatacactgcaccaagatttaagattctcctagacacgtacatgaaccaaattctccaaaacacgaagcgagcaagtcgaactcgaagcacaccgaagcccacaaaatcgcaccgatgtcagagcccccaaaagccagggtagtaatctgcgtgggcgacatccacggcttcataacgaagctgcagaacctgtggtcgaacctcgaaagcagcatcgaccgatcccaattcgaaaccgccaccgtaatcttcctcggcgactactgcgacagaggccccgacacccgccgcgtcatcgatttcctggcggccctgccgtcgcggcacccgcggcagaggcacgtcttcctgtgcggcaaccacgacctggccttcgccgccttcctccgcctcctcccgcctccgtcggacgggtcggcgttctcggaggggtggagggagtacgaggggagcgaggcgcgcgaagggtggttcaagggcgaggggtatgaggacatgcacttgcagggtcgaaggtggagtggtaacatcacagtgaagtttaacactgctaagggcaccgagtatcaggggtccatttacgacgctggacccacctttgagtcctatggagttccccatggttcctctgatttggttaaggctgttcctgatgagcataagaaatttcttgctgatttggtttgggtccatgaagaggacgatgtctttgtgaacactggtgatggagttaaatgctgcaagttgattgctgttcatgctggtttggtgaaaggagcagatgtgaaagagcaactaaaacttttgaaagctcgggatactcgggtacctaaggttgaggctctaagtgggagaaagagtgtatgggatattccagaggaactaactgcaagtggaaccatcgttgttagtggtcaccatgcaaaactccatgtagaagacctaaggctgatcattgatgaaggtggaggatataaagataagccagtggctgcaattattcttccttcgatgaagattattcgtgacactgatgtattagcaaaatagtttcatatttgtgatatttttgcttgtatacagagtagtcaagctgttaagctttagatctaatgagcttagagatgaaataatgtgtgtgtgtgttgctgatctgaaacacgagatacatttaaaaggtttttcctctaattctgattgtcaataaagcattaaactattcttttaagcaatgctgtggatctgaatcttccacctttgaaatgacaa

SEQ ID NO: 3578 - DNA, 1487 bp, Vigna unguiculata
gtaagaactacgttatttctcaagcttttggaaaatagaatgcaaccgatccataagaaccataacaaccgtagaatgtgtgatgtataaagaatccgaatcccctcctctggcttaagacacgtgcataaataaaactcttcaaaactgaccaagtagaacacttggaaccaaaccgaaacccagaaaatagcaccaatgtcagagcccccaaacccaaaacccaggcttgtaatctgcgtaggcgacatccacggcttcataacgaagctgaataatctatggtcgaatctcgaacgcagcatcgaaagatcagaattcgaaacggccaccgtaatcttcctcggcgactactgcgaccgcggtcccgacacccgcctcgtcatcgatttcctcgtggcgttgccctcccgttacccgcggcagaagcacgtcttcctctccggcaaccacgacctggccttcgccgccttcctccacctcctgccgccacctccggacgggtcgccgttctcggatgggtggaaggagtactcggctagcgaggaacgtgaagggtggttcagtggtgaggggttcgagaatatgcacctgcaaggtcgaaggtggagtggtaagataaaggagaggtttaacactgtcaaggggacggaatatcaagggtcgatttacgacgctgggccaacctttgaatcctatggagttccccatggttccgctgatttggttaaggctgttcctgatgagcataagaaatttctgactgatttggtttgggtccatgaagaggacgatgtcttcattaacactgaagatggaagcaagtgctgcaagttgattgctgttcatgctggtttgcagaaaaaagtagatgtgaaagagcagttaaaacttttgaaagctcgagatactcgggtgcctaaggtggaggctctaagtgggagaaagactgtgtgggatattccagaggaactaactacaagtccaaccatcattgtgagtggtcaccatgccaaacttcatatagaaggcttaaggctgatcattgatgaaggtggcggatttaaagataaaccagtggctgcaattattcttccttcacagaagattattcgtgatacagatgtattagcagaatagtttgatacttctgatatttttgcttgcatatggcgtagtcaagttgttaagctttagatctcatgagcatttagagatgagatattttgtgttgatctgaaatttaggtggttaataaaacatggaactattcctttccccaatcctatggatcttaatctttcattttactgcttaacaacaatgattcttctctttctttctgagtgaactgattaggttggtgagatttttctgtgtgggattctatatctacccgtggatcatgtatggaagaggaaacaaaatatacatttcatcataccttaattatttttatatctcgtcttaatttttaggaaaaaaaa

SEQ ID NO: 3579 - DNA, 1251 bp, Phaseolus vulgaris
gacacgtacatcaatcaaactcttcaaaaccgaagtgaccaagtacaacacttggaaccaaaccgaaacccagaaaatcgtatcaatgtcagagctcccaaacccaaaacccagggtcgtaatctgcgtaggcgacatccacggcttcgtaacgaagctgaaaaacctatggtcgaacctcgaacgcagcatcgaccgatccgaattcgaaaccgccaccgtaatcttcctcggcgactactgcgatcgcggtcccgacacccgccacgtcatcgatttcctcgtggcgttgccctcccgttacccgcggcagaagcacgtcttcctttccggcaaccacgacctggccttcgcggccttcctccacctcctgccgccgcctccggacgggtcgccgttctcggatgggtggaaggagtacgcggcgagcgaggaacgtgaagggtggttcaatggtgaggggttcgagaatatgtacctgcaaggtcgaaggtggagtggtaagataaaggacaagattaacactgttaagaaaacggagtatcaaggatcgatttacgacgctgggccaacatttgaatcctatggagttccccatggttccgctgatttggttaaggctgttcctgatgagcataagaaatttctggctgatttggtttgggtccatgaggaggacgatgtcttcattaacactgaagatggaggtaaatgctgcaagttgattgctgttcatgctggtttggagaaaggagacgtgaacgagcagttaaaacttttgaaagctcgaaatactcgggtgcctaaggtggaggctctaagtgggagacggagtgtgtgggatattccagaggagctaactgcaagtccaaccatcattgttagtggtcaccatgggaaactccatacagaaggcttaaggctgatcattgatgaaggtggcggatttaaagatagaccaatggctgcaattgttcttccttcacagaaggttattcgtgatacagatgtattagcaaaatagtttcatacttgtgatatttttgcttgtatatggcgtagtcaagttgttaagctttagatctcatgagcatttagagatgagacattttgtgttgatctgaaatttaggtggtttaacctcttgctgtgattgtcaataaaacaaggaattattcctttcctcaacgccgtgaatcttaatctttcaccttttctgtgacaagtgctgtgaattatttaagtttggca

SEQ ID NO: 3580 - DNA, 1411 bp, Phaseolus vulgaris
aaatgtaatgtatttgtttaacaaaattgtgtagagaaaccataagaagcaccttatttctcaagcttttcaaaaatagaatgcaaccaatccataagaaccataaaacaaccgtagaatgtgtgatgtgtattaagaatccgaatcccctctagtttaagacacgtacatcaatcaaactcttcaaaaccgaagtgaccaagtacaacacttggaaccaaaccgaaacccagaaaatcgtatcaatgtcagagctcccaaacccaaaacccagggtcgtaatctgcgtaggcgacatccacggcttcgtaacgaagctgaaaaacctatggtcgaacctcgaacgcagcatcgaccgatccgaattcgaaaccgccaccgtaatcttcctcggcgactactgcgatcgcggtcccgacacccgccacgtcatcgatttcctcgtggcgttgccctcccgttacccgcggcagaagcacgtcttcctttccggcaaccacgacctggccttcgcggccttcctccacctcctgccgccgcctccggacgggtcgccgttctcggatgggtggaaggagtacgcggcgagcgaggaacgtgaagggtggttcaatggtgaggggttcgagaatatgtacctgcaaggtcgaaggtggagtggtaagataaaggacaagattaacactgttaagaaaacggagtatcaaggatcgatttacgacgctgggccaacatttgaatcctatggagttccccatggttccgctgatttggttaaggctgttcctgatgagcataagaaatttctggctgatttggtttgggtccatgaggaggacgatgtcttcattaacactgaagatggaggtaaatgctgcaagttgattgctgttcatgctggtttggagaaaggagacgtgaacgagcagttaaaacttttgaaagctcgaaatactcgggtgcctaaggtggaggctctaagtgggagacggagtgtgtgggatattccagaggagctaactgcaagtccaaccatcattgttagtggtcaccatgggaaactccatacagaaggcttaaggctgatcattgatgaaggtggcggatttaaagatagaccaatggctgcaattgttcttccttcacagaaggttattcgtgatacagatgtattagcaaaatagtttcatacttgtgatatttttgcttgtatatggcgtagtcaagttgttaagctttagatctcatgagcatttagagatgagacattttgtgttgatctgaaatttaggtggtttaacctcttgctgtgattgtcaataaaacaaggaattattcctttcctcaacgccgtgaatcttaatctttcaccttttctgtgacaagtgctgtgaattatttaagtttggca

SEQ ID NO: 3581 - DNA, 1453 bp, Cicer arietinum
gagtaatcaaatcctttaaaagtgagcctgacaaaaccgaaacaaaccgaccaaagaagtaacaacaatgtcagaatctcctcaaccaaaaacggtaatctgcatcggcgacatccacggcttcataaccaaacttcaaaacctctggtcaaatctcgaaaacaccctaaacccatcccaattccaaaccgccacaataatcttcttaggtgattactgcgacagaggcccacaaaccaaccaagtaatcgatttcctaatcaccttacccgcccgctaccctaatcaaaagcacgttttcctctccggtaatcacgacttcgcttttgctgccttcctccgcctccttccgccgccacttgacgggtccgaatttagtgaggggtggaaggagtttgaagatagtgaggagagagaagggtggtttaaaggtgatgggtatgaaaagatgcatttgcaaggtaggagatggagtggtgcaataaaggctaagtttaatgttgctaagggtactgagtatcagggttcgatttatgatgctagacctacttttcactcatatggagttccccatggttccgctgatttggttaaggcagttcctgatgagcataagaaatttcttgcggatttggtgtgggtccatgaagaggatgatgtcttaatgaacactgatgatggagttaaatgctgcaagttgattgctgttcatgctggtttggagaaaggggtagatgtcaaagagcagatgaaaattttgaaagctcgagatactcggatacctaagttgcagcctctaagtggtagaaagaatgtttgggatattccagaggaactaagtgcaagtcctaccatcattgttagtggtcaccatgcaaaactccatgttgaaggctataggttgataattgatgaaggtggtggataccaagataaaccagtagctgcaattgttcttccttccatgacgattattcgcgatacagatgtattggcaaaataggttcatatttgtgtagttttgctggtatactgagtcaagttattaagctttggatttcttaagtgtgtatttttagatgggcggtgagtttggcaaaatcacgtcgacactgattttgtagaactgattttgtagaaactacaaagtttagttttttactgtgatgttaccaatctcatcgtcaattcgaacatgcacacaaataagttattattcattgttgttgatctggcacactagagataaaaggaaataaggatggtttgtcctcttgttttagatgagttaaactatctgcagattatttgtgttggactctgtttttttagtacatattagtctcggttaaatgctagaccaacattgttcgcttataacattgtgtttctcttctcatgttaaagttttgtattgatatattgattaatgtggagattttgaattcatata

SEQ ID NO: 3582 - DNA, 1369 bp, Cicer arietinum
tcagaatctcctcaaccaaaaacggtaatctgcatcggcgacatccacggcttcataaccaaacttcaaaacctctggtcaaatctcgaaaacaccctaaacccatcccaattccaaaccgccacaataatcttcttaggtgattactgcgacagaggcccacaaaccaaccaagtaatcgatttcctaatcaccttacccgcccgctaccctaatcaaaagcacgttttcctctccggtaatcacgacttcgcttttgctgccttcctccgcctccttccgccgccacttgacgggtccgaatttagtgaggggtggaaggagtttgaagatagtgaggagagagaagggtggtttaaaggtgatgggtatgaaaagatgcatttgcaaggtaggagatggagtggtgcaataaaggctaagtttaatgttgctaagggtactgagtatcagggttcgatttatgatgctagacctacttttcactcatatggagttccccatggttccgctgatttggttaaggcagttcctgatgagcataagaaatttcttgcggatttggtgtgggtccatgaagaggatgatgtcttaatgaacactgatgatggagttaaatgctgcaagttgattgctgttcatgctggtttggagaaaggggtagatgtcaaagagcagatgaaaattttgaaagctcgagatactcggatacctaagttgcagcctctaagtggtagaaagaatgtttgggatattccagaggaactaagtgcaagtcctaccatcattgttagtggtcaccatgcaaaactccatgttgaaggctataggttgataattgatgaaggtggtggataccaagataaaccagtagctgcaattgttcttccttccatgacgattattcgcgatacagatgtattggcaaaataggttcatatttgtgtagttttgctggtatactgagtcaagttattaagctttggatttcttaagtgtgtatttttagatgggcggtgagtttggcaaaatcacgtcgacactgattttgtagaactgattttgtagaaactacaaagtttagttttttactgtgatgttaccaatctcatcgtcaattcgaacatgcacacaaataagttattattcattgttgttgatctggcacactagagataaaaggaaatgaggatggtttgtcctcttgttttagatgagttaaactatctgcagattatttgtgttggactctgtttttttagttacatattagtctcggttaaaatgctagaccaacattgttcgcttataacattgtgtttctcttctcatgttaaaagttttgtattgatatattgattaatgtgga

SEQ ID NO: 3583 - DNA, 2035 bp, Phaseolus vulgaris
agaggttattgtggattcgaaatccaattagaatgcagagatccgggtatggctccgacggaatattccggtcactgagaccttcaatcgctctccccaaacaacccaacctcacactcgtttcccatctattcaacagagtcgcaccatttccctccaaacacgcccttatcgatgccgattcttcccaaaccctttcattcgcgcagttgaagtcgctaaccgttaaagtctcacacggcctcctccgtctcggcgtcgccaaaaacgacgtcgtcctcttccttgcccccaacgatatccgctacatcgtctgcttcctcgctgtcacctccctcggcgccatcgtcactaccgtcaatcccgcctacaccgccgccgaggtcgccaaacaggccaaagactccaatcccaaatttgtcgtcactgtccccgaactctgggacaagctccaacacctcaacctccccgctgtgttccttcattcccgcgcgcactccaacgcgactagcttcgacgcgctcgtccatctcgcagggtcgcctaccgagtttccgaaagttgacgtcaagcagagtgacacggcggtgctgctgtactcctccgggaccactggcctgagcaagggcgtggttctaacgcacgggaacttcgtggcggcatcgttgatgataggattggacgatgatttggccggggagatgcatagcgtgttcctctgcgttctgccgatgtttcatgtgtttggtttgatggtgatttcgtactcgcagcttcagaggggcagtgctgtggtgtctctgaagaagtttgagtttgaactggttttgaagacgattgagaagtttagtgtgacgcatttgtgggttgtgcctccgattattcttgctttggccaaacatggtttggttgataagtatgatctttcttcgctgaagcatattggttctggcgctgctcctcttgggaaagagttgatggaggagtgtgctaaacgtttccctcgtgccactgttgctcagggatatggtatgactgaaacttgtgggattgtttctgtggagaatacaaggatggggattcggcatagtggctctgcaggaatgcttgttgcgggagtggaagctcaaatagttagcgtggatacactgaaggctctccctcctggacaattgggggagatatgggtgcggggtcctaatatgatgcaaggatatcacaacaatccccaagccacaagattgactatagataaaaaagggtgggtgcatacaggagatcttggatattttgacgaggatggtcaactttttgttgttgaccgtatcaaagaactgatcaagtataaaggttttcaggttgcaccagcagaacttgaagggcttcttgtttctcacccagaaatacttgatgctgttgtcatcccatatcccgatgcagaagctggtgaggttccagttgcctatgtcgttcgctcacccaatagttcattgactgaggaagatgttcaaaagtttattgctaagcaggtagcacctttcaaaagattgcgaagggtgacattcatcaatgctgttcctaagacagcatcgggaaaaattctccgaagagagcttattgagaaagtaagatccaaaatatgatgccatgatatgatttacaccttttcaaaaccttttcggggttcaaattctgaagtataatgcgagatagagcgaatccggaaaggtatgatggttgtggtagtggaaaatggaataaactgtacataatagttcttataatcttaaactaataaaattatattgcatatctatcaatttagttcataaactgctatattttccaattttaaaggatcaatttgatggattttttcaatatgaacaagttcgtgttatgatatctaatatttagagattatttatgtaatttttctcctttagaaaataggttaatactttcgggatgaactgtgtatctgtctcgaaccagtacttgaaaaaacttgcatattagcacattactcagaaaa

SEQ ID NO: 3584 - DNA, 1882 bp, Cajanus cajan
gtgaatcgcaaatcagaatgcagagatcaggatatggatcggagggaatattcaggtctctaaggcctccacttgttctaccaaaggacccaaacctctcactcctttcacacctcttcaccagagtctctgcctttccctccaaacccgcactcatcgattctcacaccgaccaaaccctctccttcgcgcaactaaggtcgctaaccgttaaactctcccacgcgctcctgcgcctcggcgtcaccaaaaacgacgtcgtcctcttcctcgcgcctaacgacatccgctacctcgtctccttcctcgccgtcaccgcactcggcgctgtcgtcaccaccgtcaaccccgcctacaccaccgcggaagtctccaagcaggccaaagactccaatcccaaactcctcgtcaccgtccccgaacaatgggacaagctcaaacacctccacctccccgccgtcttcctccgctcccacgcgccggcgccgcccgaggccggccacaccttcgacgcgctgctcgagctcgccgcgtcggcgaccgagtttccgagtgttagtgtggctcagagcgacgcggcggcgctgctgtactcttccgggaccaccggtgtcagcaagggcgtgattctcacgcacgggaacttcgtggcgtcgtcgttgatgattggaatggacgatgaattggcgggggagatgcacagcgtgttcctctgcgttttgccgatgtttcatgtgtttggtttggtggtgatttcgtacgcgcagcttcagagggggaatgcggtggtgtcgctgaagaagtttgagtttgagcttgttttgaagacgattgagaggtttagggtgacgcatttgtgggttgtgcctcctattgtccttgctctggccaaacacggtttggttgataagtatgatctttcgtcgttgaagcatattggttccggcgctgctcctcttgggaaagagttgatggaggagtgtgctaaacgttttcctcgtgtcagtgtttgtcagggatatggaatgactgaaacttgtgggattgtttctgtggagaatccgaggatggggattcggaatagtggctccgccgggccgctagttgcgagagtggaagctcaaataatcagtgtggatacgctgaagcccctgcctcctggacagttgggggagatatgggtacggggtcctaacataatgcaaggttatctcaacaatccacaggccacaagattgactatagatagaaaaggatggctacatacaggagatcttggatattttgatgaggatgggcaactttttgttgttgaccgtatcaaagagctgatcaagtataaaggttttcaggttgcacccgcagaactcgaagggcttcttgtttctcaccctgaaatacttgatgctgttgtcatcccatatcccgatgctgaagctggtgaggttccagttgcctatgtcgttcgttcccccaatagttcactgactgaggaagatgttcaaaagtttattgctgatcaggtagcacctttcaaaagattacgaagggtgaccttcaccaatgctgttcccaagacagcgtcgggaaaaattctccgaagagagcttattgagaaagtaagatctaaaatatgatgtcgtgatataatttattatttcttaaaactattttcggggtaaattgtggggtagaatgcaagttcagagcaaattccgatagatatgtatctggctgggactagtactggaacacttggataagggagtactcaatatttctcagaaaatatatcaactcatgtaaaataattgctttgctgttaaataaaataaacatttactttctgtcaaaaaaatcaacatttacttcactttcatac

SEQ ID NO: 3585 - DNA, 1815 bp, Lotus japonicus
ctgcgttcaccgtcgttccaatgcagagatctggctatggctccgatggaatctacaggtctctgcgaccctctctggtcacaccgaagaacccaaacctctctctcgtctcacacctcttcaccaaggtctcatcattccccacaaaacccgcactcatcgacgccgattccaaccaaacgctttcgttctccgagctgaaaacgctcaccgttaaactctcccacgccctcctccaccacttcaacctcgccaaaaacgacgtcgtcctcttcctcgcccccaacagcttcctctaccctgtttgcttcctcgctgtcacttccctcggcgccgtcgtctccaccgtcaaccccacgtatactctccccgaagtctccaaacaagctaacgactccgccccgaagctcgtcatcacggttgcggagttatgggataaggtcaaacacctcaacatccccgccgtgttcctggaacccaccacggtgccggattcgagtgttatcaatatcgatgagctgattgggcttgaacttgctgggtcggtgactgattttccggcgagggatatcaagcagggagatacggcggcgctgctgtattcatcggggacgacgggggtgagcaagggagtgattctcacgcacgggaatttcattgctgcttctttgatgattgggttggatgatgaattggcagggcagatgcacgatgtgtttctctgcgttttgccgatgtttcatgtgtttgggtttgcggttatcacgtactcgcagcttatgagagggaatgcggtggtgtcgttgaagaggtttgagtttgagctggttttgaagacggtggagaagtataaggtgacgcatttgtgggttgtgcctccgattgtgcttgctttggcgaagcatggtttggttgataagtatgatctttcttcgttgaagcatattggttctggtgctgcacctcttgggaaagagttgatggaggagtgtgccaagcgtttccctaatgtcattgtttgtcagggttatggtatgactgagacttgtgggattgtttcggtggagaatccgaggatgggggttcggcatactggctcaactggaatgcttgtcgcgggagtggaagctcaaattgtgagtgtggataccatgaagcccctacctcctggacagttgggggagatctgggtgcgtggtcctaatatgatgcaaggttatcacaacaatccacaggccactagattgactatagataaacaggggtgggtacatacaggagatcttggatattttgatgaggatggacaactttttgttgttgaccgtatcaaagaacttatcaagtataaagggttccaggttgcgccagcagaacttgaagggcttcttgtttctcatcctgaaatacttgacgctgttgttatcccataccctgatgctgaagctggtgaggttccagttgcctatgtcgttcgttcacccaatagttcactaaccgaggaagatgttcaaaagttcattgctaatcaggtagcacccttcaaaaaattgagaagggtgacattcatcaacactgttcctaagacagcatcaggaaaaattcttcgaagagagctcattgacaaagcacgatccaaaatataacaatattataaatattacttgattttcagccattttcaaggttcaattatgtgatagaacccaccaaaaaaatcatgtgatagaacccaagttctttgggaatctcatagggtacgatgcatagcagctcaaatgggaataaggagtaaaattatacaatagtgaaaat

SEQ ID NO: 3586 - DNA, 3881 bp, Glycine max
gaaaattgggaaagggtaagagaaagggggcagtgggcagtgacacattcttttgttcgagcgagagagaatacgcagccatccaacgtggaaggaagcgaagaaacctaaatcaattcaaagccttgaactctccaattttttccccataaaatagcaaaaaacactctccattctctctcactcgctttgcttcaacgccaccaggcctccttttttcctcattaccctatttttttctccattttcttcactccaatccttcccaattgaacggtttctctccctctactcgatcccatatgtgttgaggagatagtgaaaggcatcatcaccatcaatcatggcatggtttagagctggaactagcatagcaaagcatgcaattaggagaaccctttccaagggtggatccacataccttgtgtcaagggcaaggttccttccatcgataccatcatcatcgtcatcaccatatagcagaagcttccacagcacggttttcaaggaacaagctgcacctgttccacgtgcggttcctctttcaaagttaacagatagtttcttagatggcacaagcagtgtgtatttggaagagcttcagagggcttgggaggctgatcccaacagtgtggatgagtcatgggacaatttcttcaggaactttgtggggcaggcaacaacctcacctggaatttctggtcagacaattcaggaaagtatgaggttgttgttgctggtgagggcgtaccaggttaatggtcacatgaaggccaagttggatcccttgaatctggaaccaaggcaaatctctgaggatttggaccctgcactttatggcttcactgaggctgatcttgatagagagttcttcttaggggtgtggaggatggctggtttcttgtccgagaatcgccccgtgcaaacccttagatccattttgacaaggcttgagcaggcctattgtggaagcattggatatgagtatatgcacattgcagatcgtcataagtgtaattggcttagggacaagattgagacccccacccctacacagtttaatagggagaggcgtgaggctatatttgataggcttgcttggagttccttgtttgagaacttcttggccaccaagtggacctctgcaaagaggtttggtcttgagggtggagagactcttattcccggaatgaaggaaatgtttgatagggcatctgatcttggggttgagagcatagttataggaatggcacatcgagggaggctgaatgttttggggaatgtggtaaggaagcccctgcggcagattttctgcgagtttagcggtggtcttcagcctgagggggaagttggactctacactggaactggagatgttaagtatcatttggggacatcgtatgatcgccctactaggggtggcaagaggattcatttgtctttggtggcaaatcctagtcacttggaagctgtcaatccgcttgttattgggaaaactcgagccaagcagtattacgcaaatgacgtggatagaacgaagaacatgggtgtgttgattcatggagatggaagttttgctggacagggtgtggtctatgaaaccctgcatttaagtgctcttccaaattacactactggtgggacgattcacatcgtgtttaacaatcaggttgcatttacaactgatccgacttctggcaggtcttcacaatattgcactgatgttgccaaggctttggatgctcccatctttcacgtgaatggtgatgatgttgaagcagttgttcatgcctgtgaacttgctgcagagtggcgccagactttccactctgatgtggttgtcgacttggtgtgttaccgtcgatttggccacaatgagattgatgaaccatctttcactcagcctaaaatgtacaaggtaatccgaagccatccatcaactcttgagatctatgagaagaaccttttggaatcaggggagttgacacaagaagaaattgataggatccacaagaaggtcacatcaattctaaatgaagaatttttggctagcaaagaatacattccaaaaagaagagattggctttcagcatattggcttggtttcaagtcacctgaacagctttcacgtatccgaaacactggtgtgaaaccagagatcttgaaaactgttggaaaagcaatcacaaccatccctgaaaatttcacacctcatagagcagtgaagaggatttatgaacaacgggcccaaatgattgaaactggggaagatattgactggggatttgcagaggcgcttgcttatgctaccttgcttattgaaggtaaccatgttcgattaagtggtcaggatgttgaaagaggaacttttagtcaccgccatgctgtagttcacgatcagacaacaggggagaaatattgtcccctggaccatgttataatgaaccaagacgaagagatgtttactgttagcaatagttcactttctgagtttggtgttcttggatttgaattgggttactcaatggaaaatcccaattcattgataatttgggaggctcagtttggtgattttgctaatggtgctcatgtgatatttgacaattttttggcttctggtgaggctaagtggcttcgtcagactgggcttgttgtgttacttcctcatggttatgatggccagggcccagagcattcaagtgcaagattggaacgctttcttcagatggctgatgacaaccctcatgttatccctgagatggatccaaccctccggaagcagattcaggagtgtaatttgcagattgtgaatgtcacaactcctgctaattttttccatgttctaaggaggcaggtacatagagattttcgcaaacctctcattgtaatgtcccctaagaacctgcttcgtagcaaggcttgcagatcaaatttatctgagtttgatgatgtccaaggccacccaggctttgacaaacagggaaccagattcaagcgcctcataaaagaccaaaatgcccacaaagatgttgaggagggtattagacgtttagtactttgctctggaaaagtttactatgaacttgatgaacaacgaacaaaggttgatgcaaatgatgttgcaatatgtagggtggaacagctttgtcctttcccttatgaccttgtccaacgagagcttaaacgatatccaaatgctgaggttgtttggtgtcaagaagagccaatgaacatgggtggatacacttatgttttaccccgacttatatcttcaatgaaagctgtgaataggggaggttacgacgatgtcaaatatattggtcgtgctccatccgcggccacagccactggcttcctcaaggttcaccagaaggagcagactgagattgctgaaaaagccgttcaacaagaaccaatcgacttcccattttgaaaaatcctttgcacatgcatccatcttttttgagagtgataataatgcatttagtttaatttatccaccacgtaagtggctatagttggaaggaaggcgacctcatacatttgctttcaagttttgacctttttttatgttcttttggttccttacaaaaagtatgttaagctgaatttcaacatacgtatgctgaaatatttatatttccttgttgcgatagcaaaggcgtggttggcttactagttgaattgatgccttgggaattaccatttttttttttaatttatgctgtgtaatttggaaaagcatcttccgtaatttgtgactatgtaattccattttccagaggcatgccttggcaatatagcctcaggatcatggccaagagttccccataatttttttctctcaaatatgccttttaataccatcaattcaaaatcaa

SEQ ID NO: 3587 - DNA, 3967 bp, Glycine max
ctaaattcattgggtctcaaatagatttttaatacataatagatgggtggaagaaggacccgtgaaaattgggaaagggtaagagaaagggggcagtgggcagtgacacattcttttgttcgagcgagagagaatacgcagccatccaacgtggaaggaagcgaagaaacctaaatcaattcaaagccttgaactctccaattttttccccataaaatagcaaaaaacactctccattctctctcactcgctttgcttcaacgccaccaggcctccttttttcctcattaccctatttttttctccattttcttcactccaatccttcccaattgaacggtttctctccctctactcgatcccatatgtgttgaggagatagtgaaaggcatcatcaccatcaatcatggcatggtttagagctggaactagcatagcaaagcatgcaattaggagaaccctttccaagggtggatccacataccttgtgtcaagggcaaggttccttccatcgataccatcatcatcgtcatcaccatatagcagaagcttccacagcacggttttcaaggaacaagctgcacctgttccacgtgcggttcctctttcaaagttaacagatagtttcttagatggcacaagcagtgtgtatttggaagagcttcagagggcttgggaggctgatcccaacagtgtggatgagtcatgggacaatttcttcaggaactttgtggggcaggcaacaacctcacctggaatttctggtcagacaattcaggaaagtatgaggttgttgttgctggtgagggcgtaccaggttaatggtcacatgaaggccaagttggatcccttgaatctggaaccaaggcaaatctctgaggatttggaccctgcactttatggcttcactgaggctgatcttgatagagagttcttcttaggggtgtggaggatggctggtttcttgtccgagaatcgccccgtgcaaacccttagatccattttgacaaggcttgagcaggcctattgtggaagcattggatatgagtatatgcacattgcagatcgtcataagtgtaattggcttagggacaagattgagacccccacccctacacagtttaatagggagaggcgtgaggctatatttgataggcttgcttggagttccttgtttgagaacttcttggccaccaagtggacctctgcaaagaggtttggtcttgagggtggagagactcttattcccggaatgaaggaaatgtttgatagggcatctgatcttggggttgagagcatagttataggaatggcacatcgagggaggctgaatgttttggggaatgtggtaaggaagcccctgcggcagattttctgcgagtttagcggtggtcttcagcctgagggggaagttggactctacactggaactggagatgttaagtatcatttggggacatcgtatgatcgccctactaggggtggcaagaggattcatttgtctttggtggcaaatcctagtcacttggaagctgtcaatccgcttgttattgggaaaactcgagccaagcagtattacgcaaatgacgtggatagaacgaagaacatgggtgtgttgattcatggagatggaagttttgctggacagggtgtggtctatgaaaccctgcatttaagtgctcttccaaattacactactggtgggacgattcacatcgtgtttaacaatcaggttgcatttacaactgatccgacttctggcaggtcttcacaatattgcactgatgttgccaaggctttggatgctcccatctttcacgtgaatggtgatgatgttgaagcagttgttcatgcctgtgaacttgctgcagagtggcgccagactttccactctgatgtggttgtcgacttggtgtgttaccgtcgatttggccacaatgagattgatgaaccatctttcactcagcctaaaatgtacaaggtaatccgaagccatccatcaactcttgagatctatgagaagaaccttttggaatcaggggagttgacacaagaagaaattgataggatccacaagaaggtcacatcaattctaaatgaagaatttttggctagcaaagaatacattccaaaaagaagagattggctttcagcatattggcttggtttcaagtcacctgaacagctttcacgtatccgaaacactggtgtgaaaccagagatcttgaaaactgttggaaaagcaatcacaaccatccctgaaaatttcacacctcatagagcagtgaagaggatttatgaacaacgggcccaaatgattgaaactggggaagatattgactggggatttgcagaggcgcttgcttatgctaccttgcttattgaaggtaaccatgttcgattaagtggtcaggatgttgaaagaggaacttttagtcaccgccatgctgtagttcacgatcagacaacaggggagaaatattgtcccctggaccatgttataatgaaccaagacgaagagatgtttactgttagcaatagttcactttctgagtttggtgttcttggatttgaattgggttactcaatggaaaatcccaattcattgataatttgggaggctcagtttggtgattttgctaatggtgctcatgtgatatttgacaattttttggcttctggtgaggctaagtggcttcgtcagactgggcttgttgtgttacttcctcatggttatgatggccagggcccagagcattcaagtgcaagattggaacgctttcttcagatggctgatgacaaccctcatgttatccctgagatggatccaaccctccggaagcagattcaggagtgtaatttgcagattgtgaatgtcacaactcctgctaattttttccatgttctaaggaggcaggtacatagagattttcgcaaacctctcattgtaatgtcccctaagaacctgcttcgtagcaaggcttgcagatcaaatttatctgagtttgatgatgtccaaggccacccaggctttgacaaacagggaaccagattcaagcgcctcataaaagaccaaaatgcccacaaagatgttgaggagggtattagacgtttagtactttgctctggaaaagtttactatgaacttgatgaacaacgaacaaaggttgatgcaaatgatgttgcaatatgtagggtggaacagctttgtcctttcccttatgaccttgtccaacgagagcttaaacgatatccaaatgctgaggttgtttggtgtcaagaagagccaatgaacatgggtggatacacttatgttttaccccgacttatatcttcaatgaaagctgtgaataggggaggttacgacgatgtcaaatatattggtcgtgctccatccgcggccacagccactggcttcctcaaggttcaccagaaggagcagactgagattgctgaaaaagccgttcaacaagaaccaatcgacttcccattttgaaaaatcctttgcacatgcatccatcttttttgagagtgataataatgcatttagtttaatttatccaccacgtaagtggctatagttggaaggaaggcgacctcatacatttgctttcaagttttgacctttttttatgttcttttggttccttacaaaaagtatgttaagctgaatttcaacatacgtatgctgaaatatttatatttccttgttgcgatagcaaaggcgtggttggcttactagttgaattgatgccttgggaattaccatttttttttttaatttatgctgtgtaatttggaaaagcatcttccgtaatttgtgactatgtaattccattttccagaggcatgccttggcaatatagcctcaggatcatggccaagagttccccataatttttttctctcaaatatgccttttaataccatcaattcaaaatcaactttgatatggttcttgaatcaa

SEQ ID NO: 3588 - DNA, 3728 bp, Cajanus cajan
tttggctaactgttatctgggtatgtgtctgtggttgtctcagatgtgttgatagtgaaaggcatcatcattaagcatggcatggtttagagctggagctagtatagcaaaaaatgcaattaggagaagcctttccaagggtggatccacataccttgtgtcaagggcaagggtccttccatcgtcatcatcaacagcatcacataacagaagtttccacggcacggctttcaaatcaaaggcacaagcagcacctgttccacgtgcggttcctctgtcaaagctaactgatagtttcctagatgggacaagcagtgtgtatttggaggagcttcagagggcatgggaggctgaccccaacagtgttgatgagtcatgggacaatttctttagaaactttgtggggcaggccacaacctcacctgggatttcaggccagacaattcaggagagtatgaggttgttgttgtttgtgagggcataccaggtcaatggccacatgaaggccaagttggatcctttgaatctggaacccaggcaaatccctgaggatttggaccctgcactctatggcttcactgaggctgatcttgatagagagttcttcttgggggtgtggaggatggctggcttcttgtctgagaaccgccccgtgcaaacccttagatccattttgaccaggcttgaacaggcctattgtggaagtattggatatgagtatatgcacattgcggatcgcaacaaatgtaattggcttagggacaagattgaaacccccacccatacgcatttcaatagggagaggcgcgaggctatctttgataggcttgcttggagttctttgtttgagaacttcttggccaccaagtggacctctgcaaagaggtttggacttgagggtggagagactcttattcctggaatgaaggaaatgtttgatagggcatctgatcttggggtggagagcatagttattggaatggcacatagggggaggctgaatgttttggggaatgttgttaggaagccgttgcgccagattttctgtgagtttagcggtggtcttcagcctgaggatgatgttggactctacactggaactggtgatgttaagtatcacttggggacatcgtatgatcgccctactcggggtggcaagaggattcatttgtctttggttgcaaatcctagtcacttggaagctgtcaatccagttgttgttgggaaaactcgggccaagcagtattactcagatgatgtggatagaaccaagaacatgggtgtgttgattcacggagatggaagttttgctggacagggtgtagtctatgaaactctgcatttaagtgctctaccgaattacaccactggtgggactattcacattgtgtttaacaatcaggttgcatttacaactgatccaacatctggcaggtcttcgcagtattgcactgatgttgccaaggctttggatgctcccatctttcatgtgaatggtgatgatgtggaagcagttgttcatgcctgtgaactcgctgctgagtggcgccagactttccactcagatgtggttgtcgacttggtttgttaccggcgatttggccacaatgagatcgatgaaccatctttcactcagcctaaaatgtacaaggtaatccgaagccatccatcagctcttgagatctatcagaagaagcttttggaatcaggggagctagcacaagaagaaattgacaagatacacaagaaggtcacatcaattctaaatgaagaatttttggctagcaaagaatacattccaaaaagaagagattggctttcagcatattggcttggtttcaagtcacctgaacagctttcacgtatccgaaacactggcgtgaaaccagatatcttaaaaaatgttggaaaagcaatcacaaccatccctgaacatttcacacctcataaagcagtgaagaggatttatgaacaacgtgcccaaatgattgaaactggggaagatattgactggggatttgcagaggcacttgcttttgctaccttgcttattgaaggtaaccacgttcgattaagtggtcaagatgttgaaagaggaacttttagtcaccgccatgctgtagttcatgatcagacaacaggggagaagtattgcccccttgatcatgttataatgaaccaagatgaagaaatgtttactgttagcaatagctcactctctgagtttggtgttcttggatttgaattgggttactcaatggaaaatcccaattcattgataatttgggaggctcagtttggtgattttgctaatggggctcatgtgatatttgacaatttcttggcttctggtgaggctaaatggctccgtcagactgggcttgttgtgttacttcctcatggttatgatggccagggccctgagcattcaagtgcaagattagaacgctttcttcagatggctgatgacaatccccatgttatccctgagatggacccaactcttcggaaacagattcaggagtgtaatttgcagattgtgaatgtcacaactcctgctaattttttccatgttctaaggaggcaggttcatagagaattccgcaaacctctcattgtaatgtcccccaagaacctgcttcgtagcaaggcttgcagatcaaatttatctgagtttgatgatgtccaaggccacccaggttttgacaaacagggaaccagatttaagcgcctcataaaagaccaaaatctccactcagatgttgaggagggtattagacgtttagtactttgctctggaaagatttactatgaacttgatgatcaacgaacaaaggctgatgcaaaggacgttgcaatatgtagagtggaacaactttgtcctttcccttacgaccttgtccaacgagagcttaaacgatatccaaatgctgaggttgtttggtgtcaagaagagccgatgaacatgggtggatacacatacattttgccgagacttatttcttcaatgaaagctgtgaataggggaggttatgatgatgtcaaatatgttggtcgtgctccatctgcagccacagccactggtttcctcaaggttcaccagaaggagcagtctgaaattgctgagaaagccgttcaacaggatccaatcgacttcccatattgaaaaagcctttgcacatgcattttttgagaatcataataatgcattttagttatccacgcaaggagctatagttggaagcaattgatacatctgcatgagttttgatcttgtcttattattccttgctaatcttcagctaagctgaatttcaatacatgcatgctgagataatttttttccttgttgcgaataggtacgctaaggtatgttgccttagttgaatcgatgcttttgatatttactctttttaaaaaaaattataatgtgtaagttggaaacgcttcttcaataatttttgtgactatgtaattcccttttccaggggcatgccttggtagtatagcctcgggagttgggtcatggccaaagttcatcaaatatattattttttaatcaaatgttctttttatttcataattctaaatcaactttcttgtggttcttgaatgaatgagttcatcaccctatgtatgtgtctgagaatgtactcttgattttggaattggacatgattcccaattcaaccaccgaactcttgtatcattttggaattgaaaatgcg

SEQ ID NO: 3589 - DNA, 3773 bp, Phaseolus vulgaris
tttccctaatatttctccattttcttcactccaatcattcataccacaattgaaccctttctcgccctccactcgatcccatatgtgttgaggataggatcgtattggtgatagtgaaaggcatcatcatcaagcatggcatggtttagagctggaacaagcatagcaaaacaagcgatcagaagaaccctttcgaagggtggatccacatatcttgtatcaagggcaagggtctttccatcatcgtcaacatcatcacatggcagaagcttccacagtacggttttcaaatcaagggcacaagctgcacctattccacgagcggttcctctttccaagttgactgatagttttttggatggcacaagcagtgtgtatttggaagagcttcagagggcttgggaggctgaccccagcagtgttgatgagtcctgggataatttcttcaggaactttgtggggcagtcctcaacctcgcctgggatttctggtcagacaattcaagagagtatgaggttgttgttgctggtgagggcataccaggttaatggccacatgaaggccaacttggaccctttgaatctggaagcaagggaaatccctgaggatttggaccctgcactctatggcttctctgaggctgatcttgatagggaatttttcttgggggtgtggaggatggctggtttcttgtccgagaaccgccccgtgcaaacccttagatccattttgacaaggcttgagcaagcctattgtggaaacattggatatgagtatatgcacattgcagatcgtcataagtgtaattggcttagggacaagattgaaacccccaccattacacagtataatagggagaggcgcgaggctatctttgataggcttgcttggagttctttgtttgagaacttcttggccaccaagtggacctctgcaaagaggtttggacttgagggtggagagactcttattcctggaatgaaggaaatgtttgatagagcatctgatcttggtgttgagaacatagttataggtatggcacatagggggaggctgaatgttttgggaaatgtggttaggaagccgctgagacagattttctgcgagtttagcagtgggcttcagcctgaggatgaacttggactctacactggaactggtgatgttaagtatcacttgggaacgtcatacgatcggcctactcggggtggaaagaggattcatttgtctttggtggcaaatcctagtcacttggaagctgtcaatccagttgttgttgggaaaactcgtgccaaacagtattactcaaatgatgtggacagaaccaagaacatgggtgtgttgattcatggagatggaagttttgctggacagggtgtggtctatgaaactttgcatttaagtgctcttccaaattacaccactggtgggactattcacattgtgtttaacaaccaggttgcatttacaactgatccaacatctggcaggtcttcacagtattgcactgatgttgccaaggctttggatgctcccatctttcatgtgaatggtgatgatgtggaagcagttgttcatgcctgtgaacttgctgctgagtggcgccagactttccactctgatgtggttgtcgacttggtgtgttatcgtcgatttggccacaatgagattgatgaaccatcattcactcagcctaaaatgtacaaggtaatccgaaaccatccatcaactcttgagatctatgagaagaaacttctcgaatcaggggagctgtcacaagaagaaattgataagatacacaagaaggtcacatcaattctaaatgaagaatttttgtctagcaaagaatacattccaaaaagaagagattggctttcagcatattggcttggtttcaagtcccctgaacagctttcacgtatccgaaacactggtgtgaaaccagagatcttgaaaaatgttggaaaagcaatcacgaccatccctgaaaatttcacacctcataaagctgtgaagaggatttatgaacaacgagctcaaatgattgaaactggggaagatattgactggggatgtgcagaggcacttgcttttgccaccttgcttattgaaggcaaccatgttcgattaagtggtcaggatgttgaaagaggaacttttagtcataggcatgctgtggttcacgatcagacaacaggggataaatattgcccccttgaccatgttacaatgaaccaagatgaagagatgttcactgttagcaatagctcactttctgagtttggtgttcttgggtttgaattgggttactcgatggaaaatcccaattcattgataatttgggaggctcaatttggtgactttgctaatggtgcccatgtgatatttgataatttcttggcttctggtgaggctaagtggctccgtcagactggccttgttgtgttacttcctcatggccattacggccggggcccagagcattcaagtgcaagattggaacgctttcttcagatggctgatgacaaccctcatgttatccctgagatggatccaactcttcggaaacagattcaagagtgtaatttgcagattgtgaatgtcacaactcctgctaattttttccatgttctaaggaggcaggtacatagagaattccgtaaacctctcattgtaatgtcccccaagaacctgcttcgtagtaaggtttgtagatcaaatttatctgagtttgatgacgtccaaggccacccaggttttgacaaacagggaacaagatttaaacgtctcataaaagaccaaaacttcctctcagatgttgaggagggtgttaggagattagttctttgctctggaaaggtttactatgaacttgatgaacaccgaactaagggtgacacaaaggatgttgcaatatgtagggtggaacaactttgtcctttcccttacgaccttgtccaacgagagcttaaacgatatccaaatgctgaggttgtttggtgtcaagaagagccaatgaacatgggtggatactcttacattttgccccgacttgtatcttcaatgaaagctgtgaacagaggaggttatgatgatgtgaaatatgtcggccgtgctccatctgccgccacggccaccggtttcctcaaggttcaccagaaggagcagactgagattgctcagaaatcccttcaacaggaatcaatagatttcccttactgaaaaaatctttgcacatgatgatgcatccatcttttatcaagtgataataatgcatgtggtttactttatcccacataaggagctataaggtggaaggaaggtgacttcatacatttgcttgagtctttttgaccttttatgttttttggttccttacaaaatgtcagtaagctaaatttcaacataagcatgccgaaagatttttattttattgacgcaaaggtggttttgccttggtggttgtattgaggctttgatatttataccttttgttatactgtaatttggaaactgatcttcaataattttttgacaatgtaatttcattttccagaggcatgcatgccttagcagtatagcctcgggattttgattaacacttcttcaaataagttttccccttctctttataacttaaattcaaaatcaactttgatgtgatccttgaatcaatttgagttcaccttctatgtctctttgtgtgataatctactcttgatcaaagttttgtgtttattgtattttgctagaaagttggataacgttggttt

SEQ ID NO: 3590 - DNA, 3929 bp, Phaseolus vulgaris
cattcactcctaatacaacacgcagccattgttaccgaagaaacctaaatctattcaaagcgttgaattttccaatcttccaacaaagtagcaaaatctctctctctctctctcactcgctttgcatcaacgctactagggcttcttctctttcaatttccctaatatttctccattttcttcactccaatcattcataccacaattgaaccctttctcgccctccactcgatcccatatgtgttgaggataggatcgtattggtgatagtgaaaggcatcatcatcaagcatggcatggtttagagctggaacaagcatagcaaaacaagcgatcagaagaaccctttcgaagggtggatccacatatcttgtatcaagggcaagggtctttccatcatcgtcaacatcatcacatggcagaagcttccacagtacggttttcaaatcaagggcacaagctgcacctattccacgagcggttcctctttccaagttgactgatagttttttggatggcacaagcagtgtgtatttggaagagcttcagagggcttgggaggctgaccccagcagtgttgatgagtcctgggataatttcttcaggaactttgtggggcagtcctcaacctcgcctgggatttctggtcagacaattcaagagagtatgaggttgttgttgctggtgagggcataccaggttaatggccacatgaaggccaacttggaccctttgaatctggaagcaagggaaatccctgaggatttggaccctgcactctatggcttctctgaggctgatcttgatagggaatttttcttgggggtgtggaggatggctggtttcttgtccgagaaccgccccgtgcaaacccttagatccattttgacaaggcttgagcaagcctattgtggaaacattggatatgagtatatgcacattgcagatcgtcataagtgtaattggcttagggacaagattgaaacccccaccattacacagtataatagggagaggcgcgaggctatctttgataggcttgcttggagttctttgtttgagaacttcttggccaccaagtggacctctgcaaagaggtttggacttgagggtggagagactcttattcctggaatgaaggaaatgtttgatagagcatctgatcttggtgttgagaacatagttataggtatggcacatagggggaggctgaatgttttgggaaatgtggttaggaagccgctgagacagattttctgcgagtttagcagtgggcttcagcctgaggatgaacttggactctacactggaactggtgatgttaagtatcacttgggaacgtcatacgatcggcctactcggggtggaaagaggattcatttgtctttggtggcaaatcctagtcacttggaagctgtcaatccagttgttgttgggaaaactcgtgccaaacagtattactcaaatgatgtggacagaaccaagaacatgggtgtgttgattcatggagatggaagttttgctggacagggtgtggtctatgaaactttgcatttaagtgctcttccaaattacaccactggtgggactattcacattgtgtttaacaaccaggttgcatttacaactgatccaacatctggcaggtcttcacagtattgcactgatgttgccaaggctttggatgctcccatctttcatgtgaatggtgatgatgtggaagcagttgttcatgcctgtgaacttgctgctgagtggcgccagactttccactctgatgtggttgtcgacttggtgtgttatcgtcgatttggccacaatgagattgatgaaccatcattcactcagcctaaaatgtacaaggtaatccgaaaccatccatcaactcttgagatctatgagaagaaacttctcgaatcaggggagctgtcacaagaagaaattgataagatacacaagaaggtcacatcaattctaaatgaagaatttttgtctagcaaagaatacattccaaaaagaagagattggctttcagcatattggcttggtttcaagtcccctgaacagctttcacgtatccgaaacactggtgtgaaaccagagatcttgaaaaatgttggaaaagcaatcacgaccatccctgaaaatttcacacctcataaagctgtgaagaggatttatgaacaacgagctcaaatgattgaaactggggaagatattgactggggatgtgcagaggcacttgcttttgccaccttgcttattgaaggcaaccatgttcgattaagtggtcaggatgttgaaagaggaacttttagtcataggcatgctgtggttcacgatcagacaacaggggataaatattgcccccttgaccatgttacaatgaaccaagatgaagagatgttcactgttagcaatagctcactttctgagtttggtgttcttgggtttgaattgggttactcgatggaaaatcccaattcattgataatttgggaggctcaatttggtgactttgctaatggtgcccatgtgatatttgataatttcttggcttctggtgaggctaagtggctccgtcagactggccttgttgtgttacttcctcatggccattacggccggggcccagagcattcaagtgcaagattggaacgctttcttcagatggctgatgacaaccctcatgttatccctgagatggatccaactcttcggaaacagattcaagagtgtaatttgcagattgtgaatgtcacaactcctgctaattttttccatgttctaaggaggcaggtacatagagaattccgtaaacctctcattgtaatgtcccccaagaacctgcttcgtagtaaggtttgtagatcaaatttatctgagtttgatgacgtccaaggccacccaggttttgacaaacagggaacaagatttaaacgtctcataaaagaccaaaacttcctctcagatgttgaggagggtgttaggagattagttctttgctctggaaaggtttactatgaacttgatgaacaccgaactaagggtgacacaaaggatgttgcaatatgtagggtggaacaactttgtcctttcccttacgaccttgtccaacgagagcttaaacgatatccaaatgctgaggttgtttggtgtcaagaagagccaatgaacatgggtggatactcttacattttgccccgacttgtatcttcaatgaaagctgtgaacagaggaggttatgatgatgtgaaatatgtcggccgtgctccatctgccgccacggccaccggtttcctcaaggttcaccagaaggagcagactgagattgctcagaaatcccttcaacaggaatcaatagatttcccttactgaaaaaatctttgcacatgatgatgcatccatcttttatcaagtgataataatgcatgtggtttactttatcccacataaggagctataaggtggaaggaaggtgacttcatacatttgcttgagtctttttgaccttttatgttttttggttccttacaaaatgtcagtaagctaaatttcaacataagcatgccgaaagatttttattttattgacgcaaaggtggttttgccttggtggttgtattgaggctttgatatttataccttttgttatactgtaatttggaaactgatcttcaataattttttgacaatgtaatttcattttccagaggcatgcatgccttagcagtatagcctcgggattttgattaacacttcttcaaataagttttccccttctctttataacttaaattcaaaatcaactttgatgtgatccttgaatcaatttgagttcaccttctatgtctctttgtgtgataatctactcttgatcaaagttttgtgtttattgtattttgctagaaagttggataacgttggttt

SEQ ID NO: 3591 - DNA, 3769 bp, Cicer arietinum
gacacaaatgttaaaaaaaaaaacatgtaaaaagggtaagaaaagaacacgttttgttcgaaaaatgcaataatatatcaaatcatcaaagcgttgaatttccccttttgtttgtcacaaaataaaaactcattctctttctcttacaaactcaaacgcttcgcttccacgcgaatttctctctcatgttcttcccctcagatgctaaacaacattgaggatattggatcgctgaaaatttcttggtgatattgttggattgagactgtgagtggtatatcagtgatggcatggtttagagctggagctagtatagcaaaacatgctattaagaggaccctttctcaaagtggatcttcatatcttgtttctagggctagagtgcttccttcatcacatggtagaaagtttcagaccactgtttttaaggagcaagctgcacctgtacctcgtgctgttccgctttctaggttgactgatagtttcttggatgggacaagtagtgtgtatttggaggagcttcagagggcttgggaggctgacccgaatagcgttgatgagtcatgggacaatttctttaggaactttgttggtcaggcttctacatcccctgggatttcaggtcaaacaattcaggagagtatgaggttgttgttgatggtgagggcatatcaggttaatggtcacatgaaggccaagctggacccgttgaatctggaggcaaggcaaatacctgatgatttggaccctgcactttacgggtttaccgaggctgatcttgatagggagttctttttgggtgtttggaggatgtctggttttttgtctgagaatcgtcctgtccaaacacttagatccattttgacacggcttgagcaggcttattgcgggagcattgggtacgagtatatgcacatctcggatcgtgagaagtgtaattggcttagggacaaaatcgaaactcctacgccagtgcaatttaaccgtgagcgtcgtgaggctatatttgacaggcttgcttggagttcactgtttgaaaactttttggccaccaagtggacttcagctaagaggtttgggcttgaagggggagagactcttattcccggcatgaaagaaatgtttgatcgagcatctgatcttggggttgagagcatagttattggaatggcacataggggaagattgaatgtgttaggtaatgttgtccggaagccactacgtcagatcttttgtgagttcagtggcggtctcacacctgaggatgaagttgggctttacacgggaactggtgatgttaagtatcacttgggaacatcttatgatcgccctactaggggtggcaagaggatacatttgtctttggtggcaaatcctagtcacttggaagctgtcaacccggttgttgttgggaaaactcgagctaagcagtattactcaaatgatgtggacaggaaaaaaaacatgggtgttttgctccatggagatggtagttgtgctggacagggtgtggtctatgaaaccctacatttaagtgctcttcctaattacactacgggtgggactattcacattgtgttaaacaatcaagttgcatttacgactgatccaatgtctggcaggtcttcacagtattgcacagatgttgccaaagctttaaatgctcctatctttcatgttaatggtgatgatgtggaagcagttgttcatgcatgtgaacttgctgctgagtggcgccagactttccattcagatgtggttgtggacttggtgtgttatcgtcgatttggccacaatgaaattgacgaaccatctttcactcaaccaaaaatgtacaaggtcatcagaagtcatccttcaactcttgaaatctatcagaagaagcttttggaaacaggagagctgacaaaagacgacattgataagatacacacaaaggtcacatcaattctaaatgaagaatttcaagctagcaaagattacattccaaaaagaagagattggctttcagcatactggcttggtttcaagtcacctgaacagctttcccgtgtccgaaacactggtgtgaaaccagagatcttgaaaactgttgggaaagcaatcacaactatccctgaaaatttcacacctcataaagcagtgaagaggatttatgaacagcgcgcacaaatgattgaaactggggaagatattgactggggatttggagaggcacttgcttttgctacgttgcttgttgaaggtaaccatgttcgattgagtggtcaggatgttgaaagaggaacttttagtcatcgtcactctgtagttcatgatcagataactggggaaaaatattgcccccttgacaatgttataatgaaccaaaatgaagagttgttcactgttagcaacagctcgctttcagagtttgctgttcttggatttgaattgggttactcaatggaaaaccccaattccttgataatttgggaagcacaatttggagattttgctaatggggctcatgtgatatttgacaatttcttggcttctggtgaggctaagtggctccgtcagactgggttagttgtgttgcttcctcatggttatgatggccagggccctgagcattcaagtgcaagattggaacgctttcttcagatggctgatgacaatccttatattatccctgagatggatccaactcttcggaaacagattcaggagtgtaatttgcagattgtgaatgtcacgactcctgccaactttttccatgttttaaggagacagatacatagagaattccgtaaacctctcattgtaatgtcccctaagaacctgcttcgtagcaaggcttgcagatcaaatctatcagagtttgacgatgtccaaggacaccctggttttgacaaacagggaaccagatttaagcgcctcataaaagaccgtaacgaccactccaatgtcgaggagggtattagacgtttagtactctgctccggaaaggtttactatgaacttgatgagcatcgatctaaggttgatgcatcggatgttgcaatatgtagggtggaacagctttgtcctttcccttacgaccttgtccaacgagagcttaaacgatatccaaatgcagaggttgtttggtgtcaagaagaaccaatgaacatgggtggatacacttacatcttaccgcgacttgtctcttccatgaaagctgtaggtagaggtggttttgatgacgtcaaatatgtcggtcgtgctccatctgcagccacagccactggtttcctcaaggttcaccagaaggagcaagccgagattgccgagaaagcccttcaacgggaaccagtcaacttcccattctgaaaggttttgcatatgaatgctttttgaggattatagttcacttgatttatttatttacataaggtggcttaactatatttgcttttgagttatttggtctttatgtttctcatgcaaagcttataaagttcatacatatactaaatgctgagatagttttgtttctttgttgaagaggtaattgctatgtaatgtaacacggaaatgcgtgttgcgtttccaagtggaatcgttaccttgatggtttcacttttttgtttgttttgttttccatacactagtacaatgtaattttgaaatgcctcagtgtttaactgtttattcaataaatcattttttctctagattgaattattgtatactttaaatactgtctttataagctttttaaaaaattaagtaatattgcgcggtc

SEQ ID NO: 3592 - DNA, 3557 bp, Medicago truncatula
tccattttcgacaatcataaatctctctctctattttctctcactcattttctcacagaaaccgcttcgcttccacgcgattagggttcgttccatctttctctcattttcttcctttcagatgcattaacaacattgaagctgtaagatcgttgaaattttgttaagaatttagtgatggcatggtttagagctggtgctagtatagcaaaaaatgctataaaacgaaccatttcacaaaacagatcttcatcatatcttgtatctaggtcaagaatcttaccatcaacacatggtagaaagtttcatacaactgtttttaagcagcaagctgcaccggttccgcgtgcggttccgttgtcgaggttaacagacagttttttagatgggactagtagtgtgtatttggaggagttgcagagggcatgggaggctgacccgaatagtgtcgacgagtcgtgggataatttctttagaaattttgttgggcaagcgagtacgtctcctgggatatcggggcaaacgattcaggaaagtatgaggttgttgttgatggttagggcttatcaggttaatgggcatatgaaggcgaagttggatccgttgaatttggaagcgagacagataccggatgatttggatccggcgctttatgggtttagtgaggcggatcttgatcgggagttttttttgggtgtttggaggatggcgggttttttgtctgagaataggcctgttcagacgcttaggtcgattttgacaaggcttgagcaggcttattgtgggagtattgggtttgagtatatgcatatttcggatcgtgagaagtgtaattggcttagggataaaattgagacacctacaccggtgcagtttaacagggagcgtcgtgaggctatatttgatagacttgcttggagttcgttgtttgagaattttttggctactaaatggacttcggcgaagaggtttgggcttgaaggaggagagactcttattcctggtatgaaagaaatgtttgatcgagcatctgatctcggggttgagagcatagttattggaatggcacacaggggaagattgaatgttttgggtaatgtggtccggaagccgttgcgtcagatcttttgtgagttcagtggtggtctctcgcctgaggatgaagttgggctttacacgggaactggtgatgttaagtatcatttgggaacatcttatgatcgtcctactagaggtggcaagaggatacatttgtctttggtggcaaatcctagtcacttggaagctgttgaccccgttgttgttgggaaaactcgagctaagcagtattactcgaatgacgtggacaggacaaaaaacatgggtattttgcttcatggagatggtagttttgccggacagggtgtggtctatgaaaccctgcatttaagtgctcttcctaattacactacgggtgggactattcatattgtgttaaacaatcaagttgcgtttacaactgatccaatgtctggcaggtcttcacagtattgcacagacgttgctaaagctttagatgctcccatctttcatgttaacggtgatgatgtggaagcagttgtacatgcctgtgaacttgctgctgagtggcgccaaactttccattcagacgtggttgtggatttggtgtgttatcgtcgatttggccacaatgagattgacgaaccatctttcacgcagcctaaaatgtacaaggtcatcagaagccatccttcaactcttgaaatctatcagaagaagcttttggaaacaggggagctgacacaagatgacattgacaagatacacaagaaggtcacctcaattctaaatgaagaatttcaagctagcaaagattacattccaaaaagaagagattggctatcagcatactggcttgggttcaagtcacctgaacagctttcccgtgtccgaaacactggtgtgaagccagagatcttaaaaactgttgggaaagcaatcacaactatccctgaaaatttcacacctcataaagcagtgaagaggatttatgaacagcgtgcgcaaatgattgagactggggaagatattgactggggatttggagaggcacttgcttttgctaccttgcttgttgaaggtaaccatgttcgattgagtggtcaggacgttgaaagaggaacttttagtcaccgtcactcagtagttcatgatcagacaactggggagaaatattgcccccttgacaatgttatattgaaccaagatgaagagatgtttactgttagcaacagctcactttcagagttcgccgttcttggatttgaattgggttactcaatggaaaaccccaattcattgataatttgggaagcacaatttggagattttgctaatggggctcatgtgatatttgacaatttcttggcttctggtgaggccaagtggctccgtcagactgggctagttgtgttgcttcctcatggttatgatggccagggccctgagcattcaagtgcaagattggaacgctttcttcagatggctgatgacaatccgtatattatccctgagatggatccaactcttcggaaacagattcaggagtgtaatttgcagattgtgaatgtcacaactcctgccaactttttccatgttctaaggaggcagatacatagagaattccgaaaacctctcattgtaatgtcccctaagaacttgcttcgtagcaagtcttgcagatcaaacctatcagagtttgatgatgtccaagggcacccgggttttgacaaacagggaaccagatttaagcgcctcataaaagaccgaaatgaccacaacactgttgaggagggtattagacgtttagtactctgctctggaaaggtttactatgaacttgatgatcatcgatctaaggttgatgcatcagatgttgcaatatgtagggtggaacagctttgtcctttcccatatgaccttgtccaacgagaacttaaacgatatccaaatgcagaggttgtttggtgtcaagaagagccaatgaacatgggtggatacacttacattttacccagacttgtctcttccatgaaagctgtaggtaggggtggttttgatgatgtcaaatatgttggtcgtgctccatctgctgctacagccaccggtttcctcaaggttcaccagaaggagcaagctgagattgccgagaaggcccttcaacgcgagccagtcaacttcccattttgaaaagctttacaaattcatcccttttgaggagagtatagttcacttgatttgtttaaatttacataaggaaataatatagcttgagttttgacctttctcatgcaaatctgaagttcatacatacacttgctgagatagttttgtttcgttgctaaaaggtaacacggaaaggcgtgtgaactgattcgtttgatgttttcacttttttgtttaatctatactttgtaatcttgaaatgcattggtgtttatccaatgaataatttttcttttaagattgaattattctgttaccactttcaattctgt

SEQ ID NO: 3593 - DNA, 3484 bp, Glycine max
tgatggcatggtttagagttgcttccagcatagtaaagcatgatgcaattaggagaaatctctatcgaggtgcgaaaaggaccagcacagtccttccatcaacaagtagaattagaaaatttcacaccacggttgtcaaatccaaagagcaaaccgcaccggtgcctcgccccgtgcccctttccaagttgactgacaacttcttggatgggacgagcagtgtctatttagaggagcttcaaagggcttgggaagctgatccagacagtgtagatgagtcctgggacaatttcttcaggaactttgtgggtcaggcttccacatcccctggaatttctggacaaacaatccaggagagtatgcaattgctgttgctggtgagagcataccaggttaatggtcacatgaaagccaagctagatcctctgggtctggaggaacgaaaagtccctgatgagttagaccctgccttttatggcttcactgaggctgatcttgacagggaattctttttgggtgtgtggaagatgtctggctttttgtccgaaaatcgccctgtgcagactcttaggttcattttgtcacggcttcagcaagcctactgtgggagcattggatacgagtacatgcacataccggaccgtgaaaaatgtaactggcttagggacaggattgagactcctacacctacacagtataatcgggagcgtcgcgaagttatctttgataggcttgcctggagtacactttttgaaaatttcttggccaccaagtggacttcggcaaagaggtttgggcttgaagggggagagagtgttattcctggcatgaaagaaatgtttgatcgggcatctgatcttggggtcgagagcattgttatgggaatggcacataggggaagattgaatgttttgggtaatgtagtacggaagccacttcgtcagattttttgtgagtttagtggtggtcagcctgcagacgaagttgggctctacacaggaactggtgatgtcaaatatcatttgggaacatcttatgatcgcccaaccaggggtgggaggaggatacatttatctttggtggcaaatcctagtcacttggaagcagtcaacccacttgtggttggaaaaactcgagcaaagcaatattactccaatgatgtggacagaatgaaaaacatgggggttttgattcatggagatggtagttttgctggacaaggtgtggtctatgaaacccttcatcttagcgctcttccaaattacactactggtgggactatacacattgtgttcaacaatcaagttgcatttacaactgatcccaagtcaggaagatcttcacaatattgcactgatgttgccaaagcattaaatgctccaatctttcatgtgaatggtgatgatgtggaagctgttgttcatgtctgtgaacttgcagctgaatggcgccaaactttccattctgatgtggttgttgacttcgtgtgttaccgtcgatttggccacaatgagattgatgaaccatctttcacacagcctaaaatgtataaggtcatccgaaaccatccatcagctcttgagatctatcagaaaaaacttttggaatcaggggagctgacacaagaagacattgataagatacataagaaggtcacatcaattttaaatgatgaatttttggctagcaaagattatgttccaaaacgaagagattggctttcagcatattggtctggtttcaagtcacctgaacagatttcacgtatccggaacactggtgtgaaaccagagatcttgaaaagtgttgggaaagcaatcacaatcttacctaaatttttttctcctcataaagcagtgaagaggatttatgaacaacgtgcccagatggttgaaacaggggaagatattgactggggatttgcagaggcacttgcctttgccacattgatagttgagggtaaccatgttcggttaagtggtcaggatgttgaaagaggaacgtttagtcaccgtcatgctgtagttcatgatcagacaacgggagagatatattgcccccttgaccatgtgataatgaatcaaaatgaagagatgtttactgttagcaatagctcactctctgagtttggagttcttggatttgaattgggttactcaatggaaaatccaaattcattggtgatctgggaggctcaatttggtgattttgctaatggggctcaagttatatttgacaatttcttgagttctggtgagtctaagtggctccgtcagactgggcttgtagtgttacttcctcatggttatgatggccagggccctgagcattcaagtggaagattggaacgctttcttcagatggctgatgaccatccttatgttattcctgagatggatcctactcttcggaaacaaattcaggaatgtaactggcagattgtgaatgttacaactccagcaaattttttccatgttttacggcggcagatacatagagaattccgtaaacctctcattgtgatgtcacctaagaacctgcttcgtagtaaggcttgtagatcaaatttatcggagttcgatgatgttcaaggacacccaggttttgacaaacagggcactagatttaagcgcctcataaaagaccaaaataaccactcagatgttgaggagggtatcagacgtttagtactctgctctggaaaggtttactacgaactcgatgaacaacgaacaaaggaagatgcaaaggatgttgcaatatgtagggtggaacagctttgtcctttcccttatgatcttgtccaacgagagctcaaaagatatccaaatgcggaggttgtttggtgtcaagaagaaccaatgaacatgggtggatacacttatattttaccccgactcataagttccatgaaggctgtaggtaggggaggttatgaagatgtcaaatatgttggtcgtgctccctctgcagccacagctactggtttcctcaaggttcaccttaacgagcaggctgagctagttcagaaagccattcaacgtgagccaatcaatttcccttactgaggcatagcatatactttgtttctccagagtgatgaaggcaataattggagggtagcttacaaacacaattcttaatatttgcttttcacctttatgtgttctggttttgacaagatgtcaggtaagctgaaattcaaggtgtatactgtttacttcagctgaggtaatttttttctgttaccaagaggtgaaacttagtcaattgtcctccaataaataaaaattgtttttttttgtgtgattactgattattactgttattgcttagtagtgtttaatagtttcaatatagaacaacagtggcatacgttttaaatactgaattcctttcaagatagaacaacaattgtaattaatatgtctgaagctgtggattttaactagtctgtatgatgtcgtatgattcatgtaaccga

SEQ ID NO: 3594 - DNA, 3821 bp, Glycine max
tgcatgagcataataagcgtgttctggaaacaaacagaacaaagttgattcttgtcactgaattaaaaccttcaactcccattctattccttaccgtcaaaaattgttcatctcgatctctctccgcttttaactctgtttggtaattgataggaaagagtaatgtatggtgaattaagcaagaacttgaggaaatacaagcattggtgatagacattcttgattgattgttctgagcgagtgagtgatggcatggtttagagttgcttccagcatagtaaagcatgatgcaattaggagaaatctctatcgaggtgcgaaaaggaccagcacagtccttccatcaacaagtagaattagaaaatttcacaccacggttgtcaaatccaaagagcaaaccgcaccggtgcctcgccccgtgcccctttccaagttgactgacaacttcttggatgggacgagcagtgtctatttagaggagcttcaaagggcttgggaagctgatccagacagtgtagatgagtcctgggacaatttcttcaggaactttgtgggtcaggcttccacatcccctggaatttctggacaaacaatccaggagagtatgcaattgctgttgctggtgagagcataccaggttaatggtcacatgaaagccaagctagatcctctgggtctggaggaacgaaaagtccctgatgagttagaccctgccttttatggcttcactgaggctgatcttgacagggaattctttttgggtgtgtggaagatgtctggctttttgtccgaaaatcgccctgtgcagactcttaggttcattttgtcacggcttcagcaagcctactgtgggagcattggatacgagtacatgcacataccggaccgtgaaaaatgtaactggcttagggacaggattgagactcctacacctacacagtataatcgggagcgtcgcgaagttatctttgataggcttgcctggagtacactttttgaaaatttcttggccaccaagtggacttcggcaaagaggtttgggcttgaagggggagagagtgttattcctggcatgaaagaaatgtttgatcgggcatctgatcttggggtcgagagcattgttatgggaatggcacataggggaagattgaatgttttgggtaatgtagtacggaagccacttcgtcagattttttgtgagtttagtggtggtcagcctgcagacgaagttgggctctacacaggaactggtgatgtcaaatatcatttgggaacatcttatgatcgcccaaccaggggtgggaggaggatacatttatctttggtggcaaatcctagtcacttggaagcagtcaacccacttgtggttggaaaaactcgagcaaagcaatattactccaatgatgtggacagaatgaaaaacatgggggttttgattcatggagatggtagttttgctggacaaggtgtggtctatgaaacccttcatcttagcgctcttccaaattacactactggtgggactatacacattgtgttcaacaatcaagttgcatttacaactgatcccaagtcaggaagatcttcacaatattgcactgatgttgccaaagcattaaatgctccaatctttcatgtgaatggtgatgatgtggaagctgttgttcatgtctgtgaacttgcagctgaatggcgccaaactttccattctgatgtggttgttgacttcgtgtgttaccgtcgatttggccacaatgagattgatgaaccatctttcacacagcctaaaatgtataaggtcatccgaaaccatccatcagctcttgagatctatcagaaaaaacttttggaatcaggggagctgacacaagaagacattgataagatacataagaaggtcacatcaattttaaatgatgaatttttggctagcaaagattatgttccaaaacgaagagattggctttcagcatattggtctggtttcaagtcacctgaacagatttcacgtatccggaacactggtgtgaaaccagagatcttgaaaagtgttgggaaagcaatcacaatcttacctaaatttttttctcctcataaagcagtgaagaggatttatgaacaacgtgcccagatggttgaaacaggggaagatattgactggggatttgcagaggcacttgcctttgccacattgatagttgagggtaaccatgttcggttaagtggtcaggatgttgaaagaggaacgtttagtcaccgtcatgctgtagttcatgatcagacaacgggagagatatattgcccccttgaccatgtgataatgaatcaaaatgaagagatgtttactgttagcaatagctcactctctgagtttggagttcttggatttgaattgggttactcaatggaaaatccaaattcattggtgatctgggaggctcaatttggtgattttgctaatggggctcaagttatatttgacaatttcttgagttctggtgagtctaagtggctccgtcagactgggcttgtagtgttacttcctcatggttatgatggccagggccctgagcattcaagtggaagattggaacgctttcttcagatggctgatgaccatccttatgttattcctgagatggatcctactcttcggaaacaaattcaggaatgtaactggcagattgtgaatgttacaactccagcaaattttttccatgttttacggcggcagatacatagagaattccgtaaacctctcattgtgatgtcacctaagaacctgcttcgtagtaaggcttgtagatcaaatttatcggagttcgatgatgttcaaggacacccaggttttgacaaacagggcactagatttaagcgcctcataaaagaccaaaataaccactcagatgttgaggagggtatcagacgtttagtactctgctctggaaaggtttactacgaactcgatgaacaacgaacaaaggaagatgcaaaggatgttgcaatatgtagggtggaacagctttgtcctttcccttatgatcttgtccaacgagagctcaaaagatatccaaatgcggaggttgtttggtgtcaagaagaaccaatgaacatgggtggatacacttatattttaccccgactcataagttccatgaaggctgtaggtaggggaggttatgaagatgtcaaatatgttggtcgtgctccctctgcagccacagctactggtttcctcaaggttcaccttaacgagcaggctgagctagttcagaaagccattcaacgtgagccaatcaatttcccttactgaggcatagcatatactttgtttctccagagtgatgaaggcaataattggagggtagcttacaaacacaattcttaatatttgcttttcacctttatgtgttctggttttgacaagatgtcaggtaagctgaaattcaaggtgtatactgtttacttcagctgaggtaatttttttctgttaccaagaggtgaaacttagtcaattgtcctccaataaataaaaattgtttttttttgtgtgattactgattattactgttattgcttagtagtgtttaatagtttcaatatagaacaacagtggcatacgttttaaatactgaattcctttcaagatagaacaacaattgtaattaatatgtctgaagctgtggattttaactagtctgtatgatgtcgtatgattcatgtaaccgatcttacttagtaagataaggtttcatttttacctttttttttgtttagcttcagggggtgaagactttctctcctttatcagtgcacttttt

SEQ ID NO: 3595 - DNA, 3091 bp, Lotus japonicus
ccatggcatggtttagagctgctgctttaagcatagcaaagcatgcaattaggagaaatctctttagaggtggatcatcatattatgtgacaaggaccacaaaccttccatcaactagtagaaagcttcacacaacaattttcaaatcagaagctcatgctgccccggtgcctcgccctgtacccctttctaggttaactgacaatttcttagatgggactagtagtgcctatttagaggagcttcaaagagcttgggaagctgatccgagcagtgtcgacgagtcttgggacaatttcttcaggaactttgtgggtcaggcttccacctccccaggaatttctggtcagacaattcaggagagtatgagattgctgttactagtgagagcatatcaggttaatggccacatgaaagctaagcttgatcctttgggtctgaaagaacgaaatatccctgatgagttagatcctggcctttatggtttcactgaggctgatcttgacagggaattctttttaggggtgtggaatatgtctggatttttgtccgagaatcgtccagtgcagactcttaggtccattttgacacggcttgagcaagcttactgtggaagcattgggtacgagtatatgcatataccggatcgggacaaatgtaattggcttagggacaagattgaaacaccttcacctacacaatttagccgggagcgccgcgaggttatttttgataggcttgcttggagtacactctttgagaacttcttggccaccaagtggacatcagcaaagaggtttgggcttgaaggtggagagactcttattcctggaatgaaagaaatgtttgatcgagcatctgatcttggggttgagaacatagttatgggaatggcacataggggaagattgaatgttttaggcaatgtagttcgaaagccacttcgtcagattttttgtgagtttagtggtggtctacctcaggatgaagttgggctctatacaggaactggtgatgttaaatatcacttgggaacatcttatgatcgcccaacgaggggcgggaggaggatacatctatctttgatggcaaatcctagtcacttggaagcagtcaacccacttgttgttggaaaaactcgagcgaagcagtactactcgaatgatgcggaaaggatgaaaaacatgggtgttttgattcatggagatggtagttttgctggacaaggtgtggtctatgaaacccttcatcttagtgctcttccaaattatactactggtgggactatacacattgtgttcaacaatcaagttgcatttactactgatcctgagtcaggaagatcatcacaatattccactgatgttgctaaagccttaaatgctcctatctttcatgtcaatggtgatgatgtggaatcagttgttcatgtctgtgaacttgctgccgaatggcgccagactttccattcagatgtggttgttgacttagtgtgttaccgtcgatttgggcacaatgagattgatgaaccatctttcacacagcctaaaatgtataaggtcattcgaaaccatccatcagctcttgagatctatcagaagaaacttttggaattaggggagttgactcaagaagacattgataagatacacaagaaggtcacatcaattctgaatgatgaatttttggccagcaaagattacattccaaaaagaagagactggctttcagcatattggtcaggtttcaagtcacctgaacagctttcacgtatccggaacactggtgtgaaaccagatatcttgaaaaatgttgggaaagcaatcacggccttacctgaaagtttgaatcctcatagagcagtgaagaaggtttatgaacagcgtgcccaaatggttgaaactggggaagatattgactggggatttgcggaggcacttgcttttgccacattgatagtagaaggtaaccatgttcgattaagtggtcaggatgttgaaagaggaacgtttagtcaccgccacgctgtagttcatgatcaggcaaccggggagaaatattgcccccttgaccatgtcataatgaatcaaaatgaagagatgtttactgttagcaatagctcgctttctgagtttggtgttcttggatttgaattgggttactcaatggaaaatcctaattcgttggtgatatgggaggcacagtttggtgactttgctaatggggctcaagttatatttgacaatttcttgagttctggtgagtctaagtggctccgtcaaactgggcttgtagtgttacttcctcatggttatgatggtcagggtcctgagcattcaagtggaagattggaacgctatctacagatggctgatgatcatccttatattattcctgagatggatccaactcttcggaaacaaattcaggagtgtaatttgcagattgtgaatgttacaactcctgcaaatttcttccacgttttacggcggcagatacatagagaattccgtaaacctctcattgtaatgtccccgaagaacttgcttcgcagtaaggtttgcagatcaaatttatctgagtttgatgatgtccaaggacaccctggttttgacaaacaaggaaccagatttaagcgcctcataaaagaccaaaatgaccactcaaatgttgaggagggtataaggcgcttaatactctgctccggaaaggtttactatgaacttgatgagcaaagaacaaaggatgatgcaaaggatgttgcaatatgtagggtggaacagctctgtcctttcccttatgaccttgtccaacgagagcttaaaagatatccaaatgctgaggttgtttggtgtcaagaagagccaatgaacatgggtggatacagttacattttaccacggcttataacttcaatgaaggctctcggtcggggaggttatgaggatgtcaaatatgttggtcgtgctccatcggcggccacagcaactggtttcctcaaggttcaccagagggagcaggctgagctagttcacaaagccatgcaacataaaccaatcaacttcccttactgaggatttgcacacgcaca

SEQ ID NO: 3596 - DNA, 3377 bp, Cajanus cajan
atggcatggtttagagtagttgcttccagcatagctaagcatggcacaattaggagaagtctgtacggaggtggtgggggatcattgcattgtgtgagaagaaccacagcagcaggcacaaatagaattagaaactttcacagcacaattttcaaatccaaagcacaacccgcgcctgtgcccctttccaagttgactgacaacttcttggatgggacaagcagtgtgtatttggaggaacttcaaagggcatgggaagctgatccaagcagtgttgatgagtcttgggacaatttctttaggaactttgtgggccaggctcccacctcccccggaatttccggacaaacaatccaggagagtatgcggttgctcttgctggtgagggcatatcaggttaatggccacatgaaagcaaagcttgatcctttgggcttggaagagagaaaagtccctgatgagttagacctttccctttatggcttcagtgaggctgatcttgacagggaattcttccttggggtgtggaagatatccggatttttgtctgagaatcgccccgtgcaaactcttaggtccattttgacccgccttgagcaggcctactgtggaagcattgggtatgagtacatgcacataccggatcgtggcaaatgtaattggctcagggagaagattgagacccctgtgccaacacagtataatcgggagcgtcgcgaggttatcttcgataggcttgcctggagtactctttttgagaatttcttggccaccaagtggacctcagcaaagaggtttggacttgaagggggtgagagtgttattcctggcatgaaggagatgtttgatcgggcttctgatcttggagttgagagcatagttatgggaatggcacacaggggaaggttgaatgttttgggtaacgtagtccggaagccacttcgtcagattttctgtgagtttagtggtggtcagcctcaggatgaagtggggctctacacgggaaccggtgatgttaaatatcacttgggaacatcttatgatcgtccaaccaggggtgggaggaggatacatctgtctttggtggcaaatcctagtcatctggaagcagtcaacccacttgttgttggaaaaactcgagcaaagcagtattactcaaatgatgtggacagaaagaaaaacatgggggttttgattcacggagatggtagttttgctggacaaggtgtggtatatgaaacccttcatcttagcgctcttccaaattacactaccggtgggaccatacacattgtgttcaacaatcaagttgcatttacaactgatccaaagtcaggaagatcttcacaatattgcactgatgttgccaaagccttgaatgctcccatctttcatgtgaatggtgatgacgtggaagctgttgttcatgtctgtgaacttgcagctgaatggcgccaaactttccattctgatgtagttgttgacttggtgtgttaccgtcgatttggccacaatgagattgacgaaccatctttcacacagcctcaaatgtataaggtcatccgaaaccatccatcagctcttgagatctaccagaaaaaacttttggaatcaggggaactgacacaagaagacattgataagatacataaaaaggtcacatcaattctaaatgatgaatttttggctagcaaagactatattccaaaaagaagagattggctttcagcatattggtctggtttcaagtcacccgaacaactttcacgtatccggaacactggtgtgaaaccagagatcttgaaaaatgttgggaaagctatcacaatcttacctgagaattttactcctcataaagcagtgaagaggatttatgaacaacgtgctcagatggttgaaataggggaagatattgactggggatttgcagaggcacttgcttttgccacgctgatagttgaaggtaaccatgttcggctaagtggtcaggatgttgaaagaggaacatttagtcaccgccatgctgtagttcatgatcagacaactggagatatatattgcccccttgaccatgtgataatgaatcaaaatgaggagatgtttaccgttagcaacagctcactttctgagtttggtgttcttggatttgaattgggctactcaatggaaaatcctaattcattggtgatctgggaggctcaattcggtgattttgctaacggggctcaagttatatttgacaatttcttgagttctggtgagtctaagtggctccgtcagactgggcttgttgtgttacttcctcatggttatgatggccagggccctgagcattcgagtggaagattggaacgctttcttcagatggctgacgaccatccttatgttattcctgagatggatcctactcttcggaaacaaattcaggagtgtaattggcagattgtgaatgttacaactcctgcaaattttttccatgttttacggcggcagatacatagagaattccgtaaacctctcattgtaatgtcccctaagaacctacttcgtagtaaggcttgcagatcaaatttatcagagttcgatgatgtccaaggacacccaggttttgacaaacagggaaccagatttaagcgcctcataaaagaccaaaataaccactcagatgttgaggagggtatcagacgtttagtactctgctctggaaaggtttactatgaacttgatgaacaaaggacaaaggaagatgccaaggatgttgcaatatgtagggtggaacagctttgtcctttcccttatgatcttgtccaacgagagcttaagcgatatccaaatgcggaggttgtttggtgtcaagaagagccaatgaacatgggtggatacacttatgttttaccccggcttgtaacttccatgaagtctctaggtaggggaggttatgaagatgtcaaatatgttggtcgtggtccctctgcagccacagctactggtttcctcaaggttcacctcaaggagcagactgagttagttcagaaagccattcaacgtgaaccaatcaacttcccttactgaaacatagcatatacattattgtatctccagagtgatgaaggcaataattggagggtagcttgcataattcttaatatttgcttttcatctttatgtgttccgcatttcacaagatgtcatgtaagctgcaattcagtgtaaactgttttttgatgctgaggtaattttttcattgttaccaacaggtgaaacttggttaattgtcctctcaataaatttttttcgtgattattattgttattatttactagtttcaatatagaaaaactgatatatgttttagaaaacgaattcccttcaagata

SEQ ID NO: 3597 - DNA, 3527 bp, Phaseolus vulgaris
tatggcatggcttagagttgcttccagcatagcaaaacatgatgcagttaggagaaatctctatggaggtggagcacggtattgtgtgaaaaggaccaccacaatccttccatcaacaagtagaattagaaacttccacaccacagttttcaaattcaaagagcaaacagctagtgtgcctcgcccggtacccctttctaagttgacagacaacttcttggatgggacaagtagtgtctatttggaggagcttcaaagggcttgggaagctgatccaaacagtgttgatgagtcctgggacaatttcttcaggaactttgtgggtcaggcttccacctcccctggaatttctggacaaacaatccaggagagtatgcaattgctgttgctggtgagagcataccaggttaatggccacatgaaagccaagcttgatcctttgggtctggaagaacgaaaagtccctgatgagttagaccttgccttttatggattcactgaggctgatcttgacagggaattcttcttaggggtgtggaagatgtctgggtttttgtctgagaatcgtcctgtgcagactcttaggtccattctgacacggcttgagcaagcctactgtggaagcattgggtatgagtacatgcacataccagatcgtgagaaatgtaattggctcagggataggattgagacccttacacctacacagtataatcgggagcgtcgtgaggttatttttgataggcttgcttggagtacactttttgaaaatttcttggccaccaagtggacatctgcaaagaggtttggacttgaagggggagagagtattgttcctggtatgaaagaaatgtttgatcgggcttctgatcttggggttgagagtattgttatgggaatggcacataggggaagattgaatgttttggggaatgtagttaggaagccacttcgccagattttctgtgagtttagtggtggtcaacctgcagatgaagttggactctacacaggaactggtgatgttaaatatcacttgggaacatcttatgatcgaccaacaaggggtgggaagaggatacatttgtctttggtggcaaatcctagtcacttggaagcagtgaacccacttgttgttggaaaaactcgagcaaagcagtattactcaaatgataagaacagaatgaagaacatgggagttttgattcatggagatggtagttttgctggacaaggtgtggtgtatgaaacacttcatcttagtgctcttccaaattacactactggggggactatacatattgtgttcaacaaccaagttgcattcaccaccgatcccaagtcaggaagatcttcacaatactgcactgatgtagccaaatccttaaatgcccccatctttcatgtgaatggtgatgatgtggaagctgttgttcatgtctgtgaacttgcagctgaatggcgtcaaactttccattcggatgtggttgttgacttggtgtgttaccgtagatttggccacaacgagattgatgaaccatctttcacacagcctaaaatgtataaggtcatccgaaaccatccatcagcttttgagatctaccaaaaaaaacttttggaatctggggagctcacacgagaagatgttgataagatacatagaaaggtcacatcaattctaaatgatgaatttttggctagcaaagattatgttccgaaaagaagagattggctttcagcatattggtctggtttcaagtcacccgaacaaatttcacgcatccggaacactggtgtgaagccagagatcttgaaaaatgtagggaaagcaatcacactgttacctgaaaattttactcctcataaagcagtgaagagaatttatgaacagcgttcccaaatggttgaaacaggggaagatattgattggggctttgcagaggctctagcttttgcaacattgattgttgaaggaaaccatgttcggttaagtggtcaagacgttgaaaggggaacatttagtcatcgccatgctgtagttcatgatcagacaactggagagagatattgcccccttgaccatgtgataatgaatcaaaatgaagagatgtttactgttagtaacagctcactttctgagtttggtgttcttggatttgaattgggttactcaatggagaatcctaattcgctggtgatctgggaggctcaatttggcgattttgctaatggagctcaagttatatttgacaatttcttgagttctggtgagtctaagtggctccttacggccgggcttgttgtgttacttcctcatggttatgatgggcagggacctgagcattcaagtggaagactggaacgctttcttcagatggctgatgaccatccttatactattcctgagatggatcctactcttcggaaacaaattcaggagtgtaattggcagattgtgaatgttacaactcctgcaaattttttccatgttttaaggcggcagatacatagagaattccgtaaacctcttatagtaatgtcccctaagaacctgcttcgtagtaaggtttgcagatcaaatttaactgagtttgatgatgttcaaggacaccctggttttgacaaacagggaaccagatttaagcgcctcataaaagaccaaaataatcactcagatgttgaagggggtatcagacgtttagtactttgctctggaaaggtttactatgaacttgatgaacaacgaacaaaggaagatgcaaaggatgttgcaatatgtagggtggaacagctttgtcctttcccttatgatcttgtccaacgagagcttaaacgatatccaaatgccgaggttgtctggtgtcaagaagagccaatgaacatgggtggatacacatatattttaccccggcttataacttctatgaaggttctaggtaggggaggttatgaagatgttaaatatgttggtcgtgctccttctgcagcaacagctactggtttcctcaaggttcaccttaaggagcaggccgagctagttcagaaagccattcaacaagaaccaatcagtttcccttactgagacacagcagatgcatggtttctgcagagtgatgaaggcaataattggagggtagctggggaaattattaatatttggtattggtctttaggtaataataaaggttttttgtgccacaactgaagaacctggtcaattttgttattcaccttttataccatataatttgaagtgctttttgttgtttggtggccagtcaaaatggtgttcgggagatacattttacaagttcaattgtgttgcagtttcaggttctttcaagaacgtttatctaaaatcgattcaaactgttatatgatatgttatgcacataattttcttcatgagcaacatgcaactgctacaattaggcaaactacttatttgaggtgaggggcaagagacatcttttagtcttacaccagttttaagccactatccatttaatggcgtgtctatgatttag

SEQ ID NO: 3598 - DNA, 3987 bp, Cicer arietinum
atatatttaacctattttaaaatttattctttttaataaaaaattaatacttttatatctttaacaaatgtttttagagctcccgttgacttgccccttttaataaataggatacatggcaagctatatatataaatagaaatgattgatattaataaatgggatatcaataatttattcaaatagttatttacttattattttttaggcataatttagttatcatttaaactaaaaaataaaaaacgaataatattgatggccaacgtggcacgaatggaaaaagcgagttctagagaatttatgaaggacccaccaaaatagaagaaaaagaggtagggtgcatggagaaaagtatcagtgttctctggaaacaaataatatcgcattcaatttgaaatattatcattaccgttcctccttcaattcagccgccacatcgtatcttcttccattcgttctcatatcagaacagggaacgagggatgtgcagtgcataaagacactgctgagaaattggtgatattcttgattgtcctgattcgcaagtaagagccatgggatggtggtatagagctgcctccagcatagcaaagcgttcaattagaagaaacttctatcggggtgaattgtcatgttatgcgacaaggacctcaatccttccatcgacgagtagaaactttcagactacagtttttaaacccaaagcacaaactgcacctgtgcctcactctgtgcccctttctaggctagctgacaatttcttagatgggacgagtagtgtctatttggaggaacttcaaagagcttgggaagctgatccaaacagtgtagatgagtcttgggacaatttcttcaggaactttgtaggccaggctcccacctccccaggaatttccggtcaaacaattcaggagagtatgcgattgctgttattggtgagagcataccaagttaatggacacatgaaagccaagttagatcctttgggtctggaagtaagaaaaatccccgatgagttagacccatccctttatggtttcactgaggctgatctcgacagagaattctttttaggggtgtggaatatgtctgggtttttgtctgaaaatcgtccggtgcagacccttaggtctattttgacacgacttgagcaagcttattgtggaagcattgggtttgagtacatgcatataccggatcgtgacaaatgtaattggcttagggagaagattgaaacctctgcgcccacacaattcagtcggaagcgtcgggaggatatttttgataggcttgcctggagtacactttttgaaaacttcttggccaccaagtggacatcagcaaaaaggtttgggcttgaagggggagagactcttattccaggaatgaaagaaatgtttgaccatgcatctgatcttggggttgagagcatagttatgggaatggcacatagaggaagattgaatgttttgggtaacatagttcggaagccgattcgtcagatattttgtgagttcagtggtggtgttctaccggtggatgaagccgggctctacacaggaacaggtgatgttaagtatcatttgggaacttcttatgatcgcccaaccaggggcgggaagagaatacatttgtctttgttggcaaatcctagtcacttggaagcagtcaacccacttgttgttggaaaaactcgagcaaagcagtattactcagatgatgtggaaagagagaaacatatgggtgttttgattcatggagatggtagttttgccgggcaaggcgtagtctatgaaacccttcatctcagtgctcttccaaattatactacaggtgggactatacacattgtgctcaacaatcaagttgcgtttacaactgatcccaaagcaggaagatcttcacaatattccactgatgttgccaaagccataaatgctcctatctttcatgtgaatggtgatgacgtggaagcagttgttcacgtatgtgagcttgcagctgaatggcgtcagacgttccattcagatgtggttgttgacttagtatgttaccgacgatttggccacaatgagattgacgaaccttctttcacacagcctaaaatgtacaaggtcatccgaaaccatccatcagctcttgagatttatcagaagaaacttttagaattaggggagttaactaaaggagacgttgataagatacatcagaagatcacatcaatactaaatgaagaatttttggctagcaaagattatgttccaaaaagaagagattggctttcagcatattggtctggtttcaagtcacctgaacagatttcgcgtatacggaacactggggtgaaaccagagattttgaaaaatgttgggaaagcaattacagtcttacctggaaatttaactcctcataaagcagtgaagaggatttatgaacagcgtgcccaaatgattgaaacaggggaagacattgactggggttttgcagaggcacttgctttcgccacattggtagttgaaggtaaccatgttcgtttaagtggccaagacgttgaaagaggaacatttagtcaccgccatgctgtagttcatgatcagacaaatggcgagaaatattgtccccttgaccatgtgatcatcaaccaaaataaagagttgtttactgttagcaacagctcactttctgagtttggtgttcttggatttgaattgggttactcgatggaaaatcctaattcattggtgatctgggaggcacaatttggcgatttcgctaatggtgctcaagtcatatttgacaatttcttgagttctggtgagtctaagtggctccgtcaaactgggcttgttgtgttacttccgcatggttacgatggacagggtccagaacattcaagtgggaggttggaacgctttcttcagatggctgatggccatccttatattattcccgagatggaccctactcttggaaaacaaattcaggagtgtaattggcagattgtgaatgttacaactccagcaaattttttccatgttttacggcgacagatacatagagaattccgaaaacctctcattgtaatgtcccctaagaatctgcttcgcagtaaggtttgtagatcaaatttatctgagtttgatgatgtccaaggacacccaggttttgacaaacagggaaccagatttaagcgtctcatcaaagaccgaaatgaccactcaaatgttgaggagggtatcagacgtctgatactttgttctggaaaggtttactacgaacttgatgatcaacggtcaaaggtagatgcaaaggatgttgcaatatgtagggtggaacagctttgtcctttcccttatgaccttgtccagcgagagcttaatcgatatccaaatgcggaggttgtttggtgtcaagaagaaccaatgaacatgggtggatacacttatgttttaccgcggcttataacttcaatgaaatctataggtaggggaggttatgaggatgtcaaatatgttggtcgcgctccctctgcagccacagctactggttttctaaaggttcaccagaaggagcatgttgagctacttgggaaagcacttcaaagtgaacctatcaacttcccttactaaggctcttgcatctacattattctcatattttatactatataattctttattgcatttttaatagttttgtgacatgtgctagagggctttaaaatagcgtaccctcattgacagtgaagtttgaattcacctattcatccaatatgaaccgatccaatgcgtaagggtttgaccgaaacaagggtgtggctgtgacttatcttagtttagaaaagttattcggtcaccgatactgtatttgaatacagttttgagtttttattaattatttatttcttttcgagctgtttttctatgtcactgctttacgcatacacttatgtattatatggggtgtctgtctattttaatcttc

SEQ ID NO: 3599 - DNA, 3521 bp, Citrullus lanatus
aataaactaataagcaaactatgaggtggtttagagcaagctctgctgtagcaaaattggccattaagagaaacatattgcagggaggaccgtatgttgggagatcaaggatcagcacatctcaaagtcgatactttcatacgacactttttaaatcaaaagctcaaggtgctccagttccacgtgctgttcccctttctaggcttactgatagcttcttagatggaactagcagtgtctacttggaggaacttcaaagagcttgggaggctgaccctaccagtgttgatgagtcgtgggataatttcttcagaaactttgtgggtcaggctgcaacatctcctggcatttctggccaaacaatacaagagagtatgcgtttattgttgcttgtgagagcatatcaggttaatggtcacatgaaagccaagttggatccattgggattggaagaaaggaaaattcctgatgagttggaccttgcacatcatggtttcacagaagctgatcttgatcgggaattcttcttgggggtgtggaaaatgtccgggtttttgtctgagaaccgtcctgttcagaccctcagatacactttgactcgtcttgagcaagcatattgtggaagcatcggatatgagtacatgcatattgccgaccgtgaaaaatgtaactggttgagggacaagattgagaccccaacaccaacacaatacaatcgacaacgcaaagaggttattcttgatcgtcttttatggagcacacaatttgaaaactttttggcaactaagtggaccacagcaaagagatttgggcttgagggaggggagactttgattcctgggatgaaagaaatgtttgacagggctgcagatcttggagttgagagcatagtcattggaatgcctcatagagggagattaaatgtcttgggtaatgtggtcagaaagccacttcgtcaaatatttagtgagtttagtggtggtacaaagcctgtaaatgaggttgggctctatacaggaactggtgatgtgaagtatcacttgggaacctcgtatgaccgaccaactaggggtggcaagcgacttcacctttccttgcttgctaatcctagtcatttggaagctgttgatcctgtggttgttgggaaaacccgggcaaagcaatactactcaaatgatgtggagaggaaaaagaatatgggtattttgattcatggagatggtagttttgctggacaaggtgttgtgtatgagactttacatctcagcgctcttcctaactacaccactggcgggactattcacattgttgtaaacaatcaggtagcttttaccactgacccaaggtcaggaagatcctcacagtattgcactgatgttgccaaagccttgaatgcacccattttccatgtgaatggagatgatgtggaggcagttgttcatgtatgtgagctggctgcagaatggcgccagtctttccattcagatgttgttgtcgatttggtttgttaccgtcgtttcgggcacaatgagattgatgagccatctttcactcagcctaaaatgtatcaggttattaggaatcatccttcatctcttgagatttaccgaaagaaacttttagaattggagcaagtgtctcaagaagacatcgagaagatgcaatccaaggtcaattcaatacttaacgaagaatttgttgccagcaaagattatgttcctaaaaagagggattggctttcagcgtattgggctggattcaagtctcctgaacagctctcccgtattcggaatacagggcatgtggaataacattttcctttttaccgcctttcatcctcttatttgtactaatatctgtaagatactttgcagggtcaaaccagaaatcttgaagaatgtaggaaaagctattacatcccttccagataacttcaagcctcacagggcagtaaaaaaggtgtatgaacagcgtgctcaaatgattgaaactggggatggcattgactgggcccttggagaagcacttgcttttgccacattattagtggaaggtaaccatgtcagattaagtggacaggacgttgaaagaggcacttttagccatagacactcagttcttcatgatcaggaaacaggagagaagtattgccctcttgatcatgttattataaaccagaacgaggagatgtttactgtaagcaacagctctctttcagagtttggcgttcttggatttgagttgggttattcaatggaaaatcccaatgcattggtaatgtgggaagctcaatttggtgattttgccaatggggctcaagtaatatttgatcagttcttaagtagtggagaatcgaagtggctgcgacaaacaggacttgttgtgctacttccgcatggttatgatgggcagggacctgaacattcaagtgcaagattggagcgttttctccagatgagtgatgacaacccttttgttatacctgagatggatcctactcttaggaagcaaattcaagaatgcaattggcaagttgtgaacgttacaactcctgccaactacttccatgttctgaggcgtcagatacacagggacttccgtaagcctctcatcgtgatgtctcccaaaaacctgcttcgtcataaagactgtagatccaatctttctgagtttgatgatgtgaaaggccacccaggttttgataagcaggggaccagatttaagcgcctcatcaaggaccaaaatatgcactctgattgtgaagaaggtatcaggcgtttgattctttgctctggaaagatttattatgaactagatgaagagcggaagaaaaccgatggaaaggacattgctatatgccgggtggaacagctatgtccattcccatatgatctcatccagcgagagcttaaacgatatccaaatgctgagattgtttggtgccaagaggagccaatgaacatgggtgcatataactacattaatcctcgtcttggttctgccatgaagagtctatccagaggaacaattgaagacataaaatacgtcggtcgtgctccatctgcagctacagccactggtttctatcaagttcatgttaaagaacaaaccgagattatcgagaaagcaatgcaacgtgacccgatcccgtatcctcattgaagtccttccagattcctttagtaagcacattcataacatatctaacgatatgtaaatgtaaactttatagtgtcctaatatctatattttcaatgtatttattctgcatatgtttctattaaattatgacgggaggccatatgcagtctcaatgcagatttattctgctgattggaataaagttactgatcaacgcaaaatttgttgacaaaatcctccaaatttgtctcctaaaatgactggaaacttcttaaagcatgtgttgatatctctctctctctctctctctctctctctctccaaccaaactcccatagacttatcatagtttgagcaagagaataaattctatatatcta

SEQ ID NO: 3600 - DNA, 3360 bp, Cucumis sativus
aatgaactgacacgtgaactatgaggtggtttagagcaagcgctgctgtagcaaaattggccattaagagaaacatattgcagggaggatcatatgttgggagatcaaggatcagtacatctcaaagtcgatattttcattcgacactttttaaatcaagagctcaaagtgctccagttccacgtcctgttcctctttctaggcttactgatagcttcttagatggaactagcagtgtttacttagaggaacttcaaagagcttgggaggctgatcctaccagtgttgatgagtcatgggataatttcttcagaaacttcgtgggccaggctgccacatctcctggcatttctggccaaacaatacaagagagtatgcgtttattgttgcttgtgagagcatatcaggttaatggtcacatgaaggccaagttggatccattgggattggaagaaagaaaaattcccgaagagttggaccttgcacatcatggtttcacagaagctgatcttgatcgggagttcttcttgggggtgtggaaaatggccgggtttttgtctgagaaccgtcctgttcagaccctcagatatactgtgacccgtcttgagcaagcatattgtggaagcatcggatacgagtacatgcacattgccgaccgtgaaaaatgtaactggttgagggataagattgagaccccaacaccaacgcaatacaatcggcagcggaaagaggttattcttgatcgtcttttatggagcacacaatttgagaactttttggcaactaagtggaccacagcaaagagatttgggcttgagggaggggagactttgattcctgggatgaaggaaatgtttgacagggcttcagatcttggagttgaaagtatagttattggaatgcctcatagagggagattaaatgtcttgggcaatgttgtcagaaagccacttcgtcaaatatttagtgagtttagtggtggtacaaagcctgtaaatgaggttgggctctatacaggaaccggtgatgtgaagtatcacttgggaacttcttatgatcgaccaactaggggtgggaagcgacttcacctttccttgcttgctaatccaagtcatttggaagctgttgatcctgtggttgttgggaaaacacgggcaaagcagtactactcaaatgacgcggagaggaaaaagaacatgggtattttgattcatggagatggtagtttcgctggacaaggtgttgtgtacgagactttacatctcagcgctcttcctaactacacaactggtgggactattcacattgttgtaaacaatcaggtagctttcaccactgatccaaggtcaggaagatcctcacagtattgcactgatgttgccaaagccttgaatgcacccattttccatgtgaatggagatgatgtggaggcagttgttcatgtatgtgagctggctgcagaatggcgccagactttccattcagatgtcgtcgtggatttggtttgttaccgtcgtttcgggcacaatgagattgatgagccatctttcacccagcctaaaatgtataaggttattagaaaccatccttcatctcttgagatttaccgaaagaaacttttagaattggagcaggtgtctcaagaagacatccagaagatgcaatccaaggtcaattcaatacttaatgaagaatttgttgccagcaaagattatgttcctagaaagagggattggctttcagcgtattgggctggattcaagtcccctgaacagctctcacgtattcagaatacagggcatgtggaataatattttcctttttactgccttttgttctcttatttgtactaatatctgtaaaattcttttcagggttaaacccgaaatcttgaaaaatgtaggaaaaactattacatcccttccagatcacttcaagcctcacagggcagtcaaaaaggtgtatgaacaacgtgcccaaatgattgaaattggggatggcattgactgggcccttggagaagcacttgcttttgccacattgttagtggaaggtaaccatgttagattaagtggacaggacgttgaaagaggcacctttagccatagacattcagttcttcatgatcaggaaacaggagagaagtattgccctcttgatcatgttatcataaaccagaacgaagagatgtttactgtcagcaacagctctctttcagagtttggtgttcttggatttgagttgggttattcaatggaaaatcccaatgcattggtaatgtgggaggctcaatttggtgattttgctaatggggctcaagtaatatttgatcaattcgtaagtagtggagaatcaaagtggctgcgacaaacaggacttgttgtgctacttccgcatggctatgatgggcagggacctgaacattcaagtgcaagattggaacgatttcttcagatgagtgatgacaaccctttcgttatacctgagatggaccctactcttaggaaacaaattcaagaatgcaattggcaagttgtgaatgttacgactcctgctaactacttccatgttttgaggcgtcagattcacagggacttccgtaagcctctcattgtgatgtctcccaaaaatctacttcgtcataaagactgtagatccaatctatctgagttcgatgatgtgaaaggccacccaggttttgataaacagggcacgagatttaagcgcctaatcaaggaccaaaacatgcactctgatcgtgaagaaggtatcaggcgtttgattctttgctctggaaagatttattatgaactagatgaagagcgaaaaaaaaccaatggaaaggatattgctatatgccgggtcgaacaactatgtcctttcccatatgatctcatccagcgagaactgaagcggtatccaaatgctgagattgtttggtgccaagaggagccaatgaacatgggtgcatttacctacattaatcctcgtcttggttctgccatgaagagtctatccagaggaacaattgaagacataaaatatgtcggtcgtgctccatctgccgctacagccactggtttctatcaagttcatgttaaagaacaaaccgagattatcgggaaagctctgcaacgtgacccgatcccatatattcattgaagtccttccagattccttttgtaagcaattattcataacatatctaatgatatgtaaatgttaactctatgttgtcctaatatctgtactttcaatgtatttgttctgcatacgtatctattaacatataatgggaagccatatgcagtctcaatgcacagatgtattctgctcattccaataaagttactgataaac

SEQ ID NO: 3601 - DNA, 3422 bp, Eutrema halophilum
aacaataatggcgttttcattgtagaaagaaaaaagggcaaaactttaaaagcaaccctttctctcctccttcctccgttcttctcttcttcgcctccggtccagtggagaacgacgattgttgaatgcgttattgtcattgttaagtattgaagttaaagcattgtttttgaatctggtgaaatggtgtggtttcgagctggttcgagtgttacaaagctagctgttagaaggattctgaatcagggtggttcatatgcaacaaggacacggtctcttccatctcaaaatcgttcctttcactcaactatttacagaccaaaggctcagagtgctccagttcctagagctgtacctctttctaagctaactgatagcttcttagatgggacgagcagtgtctaccttgaggagctgcaaagggcttgggaatctgatcctaacagtgtagatgagtcttgggataatttctttaggaactttgttggtcaggctgccacgtctcctggcatctctgggcagacaattcaggagagtatgaggctgttgttacttgtgagggcttaccaggtgaatggtcacatgaaagcaaagttggatccattaggtctggaacagcgagagatcccggaggatcttgacctggctctctatggattcactgaggctgatcttgacagagagttcttcttgggagtgtggcagatgtcgggattcatgtctgagaaccggccagtgcagacccttcgttccatattgacaaggcttgaacaggcatactgtgggaacattgggttcgagtatatgcacattgcagatcgggataaatgtaactggttgagggaaaagattgagacaccaactccttggcggtataacagggaacgccgtgaggtgattctcgataggcttgcatggagtactcagtttgaaaatttcttagctaccaagtggaccacagctaagagattcgggcttgaaggtggagagtctttgattcctggcatgaaggagatgtttgacagggcagcagatcttggagtagagagcattgttattggaatgtctcacagaggaagattgaatgttctgggaaatgttgttcggaagccactccgtcagatatttagcgagttcagtggtggtattaggcctgtagatgaagttggctacactggaactggtgatgtcaaatatcacttgggaacctcttatgatcgacctacaagaggtgggaagaaaatccatctctcattggttgcaaatccaagtcacttggaagctgcggattctgtcgttgttggaaaaaccagagcaaaacaatactactccaaggatttagacaggaccaagaatttgggtattttgattcatggagatggtagctttgctggacaaggagtagtttacgaaactcttcatctcagtgctcttccaaactacaccaccggtggtaccatacatattgtggtgaataaccaagtggctttcacgacggatccaagggctgggagatcttcccagtattgtactgatgttgctaaggctttgagtgctcctatcttccatgttaatggggatgatgttgaggctgttgttcatgcctgcgagcttgctgctgagtggcgtcagacttttcattctgatgttgtcgttgacttggtttgctatcgtaggttcgggcataatgagatagatgaaccatcttttactcagcctaaaatgtacaaggttatcaaaaatcacccctcaacgcttcaaatctaccacaaaaagctcctggaatgcggtgaagtatcacaacaggatatcgaccggatacaagaaaaggttaacaccatcctcaatgaagaatttgttgctagtaaagactatctacctaagaaacgagattggctttcaaccaattgggctggatttaagtctcctgagcagatctcacgtgttcgaaacactggttcgtttcttttttctcttgaaaacttcaagcctcacagagcggtgaagaaagtttatgagcaacgtgctcaaatgattgagtcaggagaaggaattgactgggcactcgcagaagcccttgcttttgctaccttagttgtggaaggcaaccatgaaccctttagtcatcgtcattctgttcttcatgaccaggaaactggggaagagtattgtcctcttgatcatctcatcatgaaccaggatcctgagatgtttactgtcagcaacagttccctttcagaatttggtgtccttggattcgagttgggttactcaatggaaagcccaaactcgttggtactatgggaagctcagtttggagactttgccaacggagctcaggtgatatttgatcagttcatcagcagtggagaagccaagtggttgcgtcagacaggacttgttgtgctacttccccatggttatgatggtcaaggccctgaacattcaagtgcgaggctggaacgttaccttcagatgagtgatgataatccttatgtgataccagacatggaaccaacaatgcgaaagcaaatccaagaatgtaactggcagattgtcaacgccacaactcctgccaactatttccatgttctgcggcgacagatacacagagacttccgtaagcctctgattgtaatggcaccaaagaacttgctacgtcacaaggactgcaaatcaaatctttcggagtttgatgatgttcaaggccacccaggttttgacaagcaaggaactagatttaagcgattaatcaaggatcagaacgatcactctgatcttgaagaaggcatcagaagattggtactttgctctggaaaggtttattatgagcttgatgacgagaggaagaaggttggcgcgaaggatgttgctatctgtagagtggaacagctttgtcctttcccatatgatctcattcagcgtgagctcaaaagatacccaaatgcggagatagtgtggtgtcaagaagaggcgatgaacatgggagcattcagctacatatctccgaggctatggacagcaatgagaagcttaggcagaggagatatggaagacattaagtacgttggacgtggtccttctgctgctactgccaccggtttctacactttccatgtcaaagagcaagccgagctcgtccagaaagccatcggaaaggaacccatcaattaaaatactcttttccttttcttactgagttctcagacaaaaaaaagataaaggagaaaaactttacaataagaactttgggtgatgcaaagtgatagacaacaacactgacaaaatcctctgtttctttgtttttggtcccattgattttgagcctgtatcgtggtgcaggttaatacacattatactctcatttttatagagttttgctcttcctcttcatgtttcttctttgatacatcttttgcttt

SEQ ID NO: 3602 - DNA, 1461 bp, Glycine max
gtgtgttggacttgggttggtatattcagttttcaggagagtttggtatacacacaacacaacaccaacatgaagagcatggtgacgccattgacgagggtcttaccctttcgtcacccaaatggctataatacccttcccttctctcttacacgctacccttcctcaccgaacttctccttctccttctcccctctcactctcactctttccatggccgcttcaccacaatcctccgctccgactgtgtcgcctggtgatgctaacatcaacaaagatggtgtatttcaattgattcaagcacatcaggaaaaagctgctagacttccaccagttgaggaaattcgaactgtccttgatcgtagcgtgcgtgggatgctctctacattctcgaagaagttcgatggttatccatcagggtctatggttgactttgcttgtgattcaaatggatatcctatattagcagtgagcgacttggcagttcattcgaaggacctaactgccaatcctaaatgttcattgcttgtggctagagatcctgaagataggactgatttagtgattactgtacatggtgatgctatctctgtacctgaaaatgaaagagaagccgttcgagctgcatatttggcgaggcatcccaatgcattttgggttgactttggagacttccgattcttgcgcattgaaccaaaagttgtacgatttgtgtcaggtgttgccacggctttgttaggatcaggagagtttagtggagatgagtataaatctgcaaaagttgaccccatagctcagttttccaagccagtggcgtctcatatgaacaaagatcatgctgaagataacaaagtgattgtgcagcattggacctcagttccagtattggactttgccgacatactagatttggatagtcttggtttcaatgttaaggctggttaccagggtgatactttcaagcttcgtgtacctttccctcgacgtgctgaagatagaaaggatgtgaagactctcattgttgagatgcttcaagctgctaggcctaaagttgattgatcacgccattgatcaatgatgaacagcacctgccagtcatcctggggagaggacaaaatgtatacgtcaaaaaagtaaatgcagttataatttccaaagataaagatgacaaagcaaatggttgacttttgtcatttcttttatacacactatttagtattcttactagggaaagcacttgaaaattcagacatacaagtggtatggtattttatcaaagaaacaaaccctttatacataaatgattttgtgtatttcttcctggtgtactcttgtatagagttggaacaatgtatggataatccttaagaaacaacaacaattatttattttgtgcatgtttattttattgttgcaaatagacttttgagacaaaatgagatttgcgaaaatatcgagatc

SEQ ID NO: 3603 - DNA, 1252 bp, Glycine max
atgagtacttgtgttgtgtgttggacttgggttggtatattcagttttcaggagagtttggtatacacacaacacaacaccaacatgaagagcatggtgacgccattgacgagggtcttaccctttcgtcacccaaatggctataatacccttcccttctctcttacacgctacccttcctcaccgaacttctccttctccttctcccctctcactctcactctttccatggccgcttcaccacaatcctccgctccgactgtgtcgcctggtgatgctaacatcaacaaagatggtgtatttcaattgattcaagcacatcaggaaaaagctgctagacttccaccagttgaggaaattcgaactgtccttgatcgtagcgtgcgtgggatgctctctacattctcgaagaagttcgatggttatccatcagggtctatggttgactttgcttgtgattcaaatggatatcctatattagcagtgagcgacttggcagttcattcgaaggacctaactgccaatcctaaatgttcattgcttgtggctagagatcctgaagataggactgatttagtgattactgtacatggtgatgctatctctgtacctgaaaatgaaagagaagccgttcgagctgcatatttggcgaggcatcccaatgcattttgggttgactttggagacttccgattcttgcgcattgaaccaaaagttgtacgatttgtgtcaggtgttgccacggctttgttaggatcaggagagtttagtggagatgagtataaatctgcaaaagttgaccccatagctcagttttccaagccagtggcgtctcatatgaacaaagatcatgctgaagataacaaagtgattgtgcagcattggacctcagttccagtattggactttgccgacatactagatttggatagtcttggtttcaatgttaaggctggttaccagggtgatactttcaagcttcgtgtacctttccctcgacgtgctgaagatagaaaggatgtgaagactctcattgttgagatgcttcaagctgctaggcctaaagttgattgatcacgccattgatcaatgatgaacaggtgctcctccaaacttcatataatccctcaattcaattcatgtgcttcagtctccaagatttgtcatttttcttcgttcagagattagttggctatgtatgccttgcaactaaatattcacataccacataaattattaacaatatttgtgc

SEQ ID NO: 3604 - DNA, 1425 bp, Cajanus cajan
gtttagaagaaaggggtttcgtgttggtaccgttattgttggagtgagtgagtggtacacacgaacacaacatgaagagcatggtatcgccattgacgagggtctcacccttttgtcgccgaaatggccaaaatgcccttctattctctcccactttcacacgctacccttcttcacctaacacagacactttctcccctctcactctcactctttccatggctgcttcaccccaatcctcagctccgactgtgtcgcctggtgatgttaacatggataaagatggtgtctttcaattgattcaagcacatcaggaaaaagctgctagacttccaccagttgaggaaattcgaactgtccttgatcgtagcgtgcgtgggatgctctctacattctctaagaagttcgagagttatccatcagggtctatggttgactttgcatgtgatgcaaatggatatcctatattggcagtgagcgacctggcagttcattcaaaggacctaactgccaatcctaaatgttcattgcttgtggctagagatcctgaagataggactgatttagtgattactttacatggtgatgctatcgctgtacctgaaaatgataaagaagctgttcgagctgcatacttggcaagacatcccaatgcattttgggttgactttggagacttccgcttcttgcgcattgaaccaaaagttgtacgatttgtgtcaggtgttgccacagcattgttaggatcaggagagtttagtagagatgagtataaatctgcaaaagttgaccccatagctcagttttccaagccagtggcgtctcatatgaacaaagatcatgctgaagataacaaagtgattgtgcagcattggacctcagttccagtatgtggactttgcctatatactggatttggatagtcttggtttcaatgtcaaggctggttatcagggtgatactttcaagcttcgtgtacctttccctcgacgtgcagaaaatagaaaggatgtgaagactctcattgttgaaatgcttcaagctgctaggcctaaagctgattgattactccacagatcattgatgaacagcacctgctagacatccttcttggggagaggacaaaatatccacgtcaaaaaagtaaatgcagttatattttccgaagataaagatggcaaagcaaatggttgactttatttcttgtatatactgtttgagattttaatgagttttgaaaacacttgaaaattcagacatacaagtgtgtgatattactcaaaagaaacataccctttatacataaatgattttatgtgaaattcttccatatgcactcttttagagagttgaaacagtgtatgattaatctttttgagaaacaacaataatttatttatggttgcatacaacagtaagttgtga

SEQ ID NO: 3605 - DNA, 1663 bp, Phaseolus vulgaris
atttcattgtttgtttagtggtaagggagagtttggcacaaactaccaccatgaagagcatggtgacgccattgatgagggtctcaccctttcgtcaccagaatggccataatacccttcccttattctctctcgcacgctacccttcctcaccaaacttctctttctcccctctctctctcagtctttccatggccgcttcatcccaatcctcttctccggctgtgtcgcgtggtgatgctaacatggacaaagatggtgtatttcaattgattcaagcacatcaggaaaaagctgctagacttccaccggttgaggaaattcgaactgtccttgatcgtagcgttcgcggaatgctctctacattctctaagaagttcgatggctatccatcagggtctatggttgactttgcatgtgatgcaaatggatatcctatattagcagtgagcgacctggcagttcattccaaggacctaactgccaattctaaatgttcattacttgtggctagagatcctgaagataggactgatttagtgattactttacacggtgatgctatcactgtacctgaaaaggataaagaagctgttcgagctgcatatttggcgagacatcccaatgcattttgggttgactttggagacttccaattcttgcgcattgaaccgaaagttgtacgatttgtgtcaggtgttgccacagctttgttaggatcaggagagtttactggagatgagtataaatctgcaaaagttgaccccgtagctcaattttccaagccagtgacgtctcatatgaacaaagatcatgctgacgataacaaagtgattgtgcagcattggacctcagttccagtggactttgcataccttctagatttggatagtcttggtttcaatgttaaggctggttatcaggatgatactttcaagcttcgtgtacctttccctcgacgtgcagaagatagaaaggatgtgaagactctcattgttgagatgcttcaagctgccaggcctaaagctgaatgaagaatccacagatcaatgaagaggtgctcatccaaaattcatctaatatctgtgcttcagactcctggattcgtcatttttctttcagatattagttgaccatgccttgcaactagatatacctatgccaaataaatacttgcatacttattgctaatttttttgtctgctacttaccaacttacagttcatgtctttggtaatccctaattgaagttgcctggttttgtggtcaaaagaacgttttctgtcttaaattgaactgtaataaagcctgccaaaatgtaaaaaaaagtagtgaatgagactcttaaaagatggagtattatgacggtgctttctgttctcctccctttctgtttgaaatgctgcagcacctgccagacatccttcttggaaagaggaaaaatattcacatcgaagagaaggaaatggttgactttctttatttcttgtatataaactgtgttattttcatgaagaaaagcacttcaaaattcagattgtgatgtttctcaagcaaacaaacccttctatataggcaagtgattttatgtgaatttcttccagatgtactattgttatgaataaacccttttgagaaacaacaataatgattcagtttatgg

SEQ ID NO: 3606 - DNA, 1475 bp, Cicer arietinum
aatacatttataaaagaaaaatgaataaaacaaaacaaaaagtctcgcatgataaacaaaaaaagttaagaagggaaaatttggtgcattgttgtagtgttccgcaagatgaagtctatggtgacgccattgacaagggtcaccccaatttttcgcccaaatgcctataatgcccttcgtttctcccccaaaccactccactcttccttaccaaactccttcatcttcacctctcccactcccactctttcaatggccgcttcctcacaatccactgctccggctgtgtcctctggtgatgttaacatcaaaaaagacgacgtctttcaattaattaaagctcatcaggaaaaagctgcaagacttccaccagttgaagaaattcgaactgtccttgatcgtagtgtacgtgggatgctctccacattctcaaagaagttcgagggttatccatctgggtctatggttgactttgcatgtgatgcaaatggatgtcctatattagccgtgagcgacttggcagttcattcaaaggacttaactgctaatcctaaatgttcagtgcttttggctagagatcctgaagataggactgatttggtgatcactttacatggtgacgccatctttgtacctgaaaaagataaagaagccatacgagctgcatatttggcaagacatcccaatgcgttttgggttgactttggagacttccgatttgtacgcattgaaccaaaagttgtacgatttgtgtcaggtgttgccacagctttgttaggatcaggagagtttaatggagatgagtacaaatctgcaaaagttgatcccatagctcagttttccaagccagtagcgtcacatatgaacaaagatcacagtgatgatactaaagcgattgtgcagcattggacctcagttccggtggactttgcttacatactagatttggatcgtctaggtttcaatgtcaaggctggttatcagggagatactttcaagctccgcgtaccttttcctcgacctgcagaagatagaaaggatgttaaaactctcattgttgagatgctccaagcttctaagcctcaagtttgattgattactccacagatcaaagatggacacaagggtaacacacacaaaattcagtcattaaagtggtgtgagattcatactcttcaagacatacatatcctttatacagaatgatcataagactcttgttgaattgagagttgagacaatttataatcatacgtttagaaactacatatgcttttttatccttgtccatacagtgagagagcaatatcatatatgttttagtttttaatttcaaaatagaaataaaatacaattctatttatatattgttatagttgtgagttgaatgactatgtacataaaatgtgaaaaattatatagtaatctaatcatatgtcttcacttaaatattttttaagatattttgaaaaggg

SEQ ID NO: 3607 - DNA, 1270 bp, Lotus japonicus
tcagcagttgttggctgttggagtactccacaagatgaagaccatggtgacgccattgatgaggatctccccatcttttcgccaaaatgcccataaagcccttcccttctctccaacacgtcactcttcttcaccaaactccttcaccttcatctccgccattcccactctttccatttccatggccgcttcttcccaatccaccgctccggctgtgccctctggtgatgttggcatgaaaaaagatgaagtttttcaattaattcaagcgcatcaggaaaaagctgctagacttccaccggttgaacaagttcgaactgtccttgatcatagcctacgcggggtgctctcaacattctctaagaagtacgagggttatccatcagggtctatggttgacttcgcatgtgatgcaaatggatgcccaatattagcagtgagcgatttggcagttcataccaaggacttaactgctaatcctaaatgttcattgcttgtggctagagatcctgaagataggactgatttagtgataactttacatggtgatgctgtctctgtacctgaaaaagataaagaagccgttcgagctgcatatttagcaagacatcccaatgcattttgggttgactttggagacttccaatttgttcgcattaaaccaaagactgtacgatttgtgtcaggtgttgccacagctttattaggatcaggagagtttgatggagatgagtataaatctgcaaaagttgatccagtcgctcagttttccaagccagtggcgtctcatatgaacaaagaccatggtgaagatacaaaagtgattgtgcagcactggacctcagttccggtggactttgctgacatactagatttggattgtcttggtttcaatgttaaggctggttatcaaggagatactttcaagctccgtgtacctttccctcgacgtgcagaagatagaaaggatgttaagactctcattgttgagatgctccaagctgccaggcctcaaggtgattgattattccagtgatcaaagatgatagcgcgctccacaagtcatcctttggaagaggactaaatgtgtacctaaaaaagtaggaaagtaaatttagttatattttacaaagataaagatgacaagtcatatggttgactttgtatactttttttacattgggaattttcgtggggtgaaaacacttgaaaattcagacacatgtggtgtagtagcctctcaaaattacaagtggtgtagtagcctctc

SEQ ID NO: 3608 - DNA, 1420 bp, Trigonella foenum-graecum
aagactatggtgacgccattgacaagaatctccacatttttccgcccagttgcccataatgcccttcccttctcccctaaaccacgcatctcttccttaccaaactccttcaccttcacctctcccactcgcactctttcaatggcttcttcttcttctcaatccactgctccggttgtgtcctctggtgatgttaaattcaataaagacgatgtttttcaattaattcaagctcatcaggaaaagctgcaagactaccaccagttgaagaaattcgaactgtccttgatcgtagtttacgtgggacactctccacattttcaaagaagtatgacggttatccatcagcatctatggttgactttgcatgtgatgaaaatggatgtcctatattagcagtgagcgacttggcagttcattcaaaggacttaactgctaatcctaaatgttcagtgcttttggctagagatcctgaagataggactgatttggtgatcactttacatggtgacgccatctttgtacctgaaaaggataaagaggctgtacgagcggcatatttggcaagacatcccaatgcgttttgggttgactttggagacttccgatttgtacgcattgaaccaaaagttgtacgatttgtgtcaggtgttgccacagctttgttaggatcaggagagtttaacggagatgagtacaaatctgcaaaagttgaccccgttgctcagttttccaagccagtagcgtcgcacatgaacaaagatcacggtgaagatactaaagcgattgtgcagcactggacctcagttccggtggactttgctaacatactagatttggatcgtctaggtttcaatgttaaggctggttatcagggagatactttcaagctccgcgtacctttccctcgacctgcagaagatagaaaggatgttaaaactctcattgttgagatgctccaagctgctaggactcaagttgattgattcctccacagatcaaagatggagacgagctttctttcagtcatcctcctgctgaggaggacaatttgtgtgccttgagaagtagacacgtaaatacagtgatgttttcgatatatacgacgacaactcaagtagttgttctttgcgtactttccttattagcgattttcgtgggtaacgctcataaaatgcagacattaaaacggtgtaagatttattgtttctcaaaagacatatctttgtacagaatgatcctaagatcttcctccatgtttactcttgttgtattgagacaatttatagataatcctttaagaaacgacaataatgttgtacttcttggtatacaagaaatttattttttactcgtacccaagtccatcatgtatatatatactacaagtcttcaaaataatataacaaagtgacatcat

SEQ ID NO: 3609 - DNA, 1315 bp, Pisum sativum
gcaagatgaagactatggtgacgccattgacaagagtctccacattttttcgctcaaatgcccataatgcccttcccttctcccccaaatcacgcaacccttcgttaccaaacttcttcaccttcacctctccctctctttcaatggccgcttcttctcaatccactgctccggttgcgtcctctggtgatgttaacatagaaaaagatgacatctttcaattaattcaagctcatcaggaaaaagccgcgagacttcctccacttgaagaaattcgtactgttcttgatcttagtgtacgtgggacgctctccacattctcaaagaagtatgatggttatccatcagggtctatggttgactttgcatgtgatgcaaatggatgtcttatattagcagtgagcgacttggctgttcattcaaaggacttagctgctaatcctaaatgttcagtgctcgtggctagagatcctgaagataggactgatttggtgatcactttccatggtgacgctatttttgtacctgaaaaggataatgaggcgatacgagctgcatatttggcaagacatcccaacgcgttttgggttgacttcggagacttccgatttgtacgcattgaaccaaaagttgtacgattcgtgtcaggtgttgctacagctttgttaggatcaggagagtttagtggagatgagttcaaatctgcaaaagtggatcccatatctcagttttccaagccagtagcgtcgcatatgaacaaagatcatggtgaagatactaaaatgattgtgcagcactggacctcagttccggtggactttgcggacatactagatttggatcgtctaggtttcaatgttaaggctggtttcaagggagatactttcaagctccgtgtaccttttcctcgacctgcagaagatagaaaggatgtgaagactctcattgttgagatgctccaagccgctaagcctcaagtttgattgattactccacatatcaaaagatggagaggtactcatcagaaacccatcaagtactcgaattctgcaggttcttaccagtagtcacccttctgctggggggaacaaattgtgtgctttgagaagtagacaagtaaatatagctgtattttcaatatacacactaccacaactcaaattatttactttgtataattttgcttattgaagattttgtgtcactcgtaaaatgctgacattaaaatggtgtaaattaattctctctcatagacacttatctctgtatagaatgtacgcctgatcttccctgttccctcatgttgaattgagac

SEQ ID NO: 3610 - DNA, 1408 bp, Medicago truncatula
cggccgggggtgttcccgcaagatgaagactatggtgacgccattgacaagagtctccacattttttcgcccaattccctataatgcccttcccttctcccccaaaccacgcttctctttcttaccaaactccttcaccttcacctctctcactccttctctttcaatggcttcttcttcccaatccactgctcaggttgtttcctctggtgatgtcaacaataaaaaagatgatgtctttcaattaattcaagctcatcaggaaaaagctgcaagacttccaccagtcgaagaaattcgaactgtccttgatcgtagtctacgtgggacgctctccacattctcgaagaagtatgacggttatccatcaggatctatggttgactttgcatgtgatgcaaatggatgtcctatattagcagtgagcgacttggcagttcattcaaaggacttagcggctaatcctaaatgttcagtgcttttggctagagatcctgaagataggactgatttggtgatcactttacacggtgacgctatctttgtacctgaaaaggataaagaggccatacgagctgcatatttggcgagacatcccaatgcgttttgggttgactttggagacttccgatttgtacgcattgaaccaaaagttgtacgatttgtgtcaggtgttgccacagctttgttgggatcaggagagtttactggagatgagtacaaatcagcaaaagttgaccccattgctcagttttccaagccagtagcgtcgcacatgaacaaagatcacggtgaagatactaaagcgattgtgcagcactggacctcagttccggtggactttgctgacataatagatttggatcgtctaggtttcaatattaaggctggttataagggagataaattcaagctccgtgtgcctttccctcgacctgcagaagatagaaaggatgttaagactctcattgttgagatgctccaagctgctaagcctcaagttaattgattcctctacagatcaaaggtggacatgagattcctttccgtcatccaccttctgaggaggacaatttgtgtgccttgagaagtaggcaagtaaatatagtgatattttcaatacatacgatgacaactcaaatagcgatttccgtgggtaacactcataaatgtagacattgaaatggtgtaagattaattgtctctcgaagactcgtgccctttgtacagaatgatcataagatcttccccatgtttactttgttgaattgagacaatttacgaataatcctttaagaaacgacaacagtttttcgcttgtccagggccggatgttgcggccagttatgagttgaatgacatctaattatgcctcatcgtgtaaatacaaagtgatattttaacaaga

SEQ ID NO: 3611 - DNA, 1190 bp, Vigna unguiculata
cccactaactctctcactctttccatggccgcttcaccccaatcttccgctccggctgcgtcgcgtggtgatgctaaaatcgacaaagatggtgtatttcaattgattcaagcacatcaggaaaaagctgctagacttccaccattagaggaaattcgaactgtccttgatcgtagcgttcgcgggatgctctctacattctccaagaagttcgatggctatccatcagggtctatggttgactttgcatgtgatgcaaatggatatcctatattagcagtgagcgacctggcagttcattccaaggacctaactgccaatcctaaatgttcattacttgtggctagagatcctgaagataggactgatttagtgattactatacacggtgatgctatcactgtacctgaaaaggataaagaagctgttcgggctgcatatttggcaagacatcccaatgcattttgggttgactttggagacttcaaattcttgcgcattgaaccaaaagttgtacgatttgtgtcaggcgttgccacagctttgttaggatcaggagagtttactggagatgagtatcaatctgcaaaagttgaccccatagctcaattttccaagccagtggcgtctcatatgaacaaagatcatgctgacgataacaaagtgattgtgcagcattggacctcagttccagtggactttgcataccttttagatatggatagtcttggtttcaatgttaaggctggttatcagggtgatactttcaagcttcgtgttcctttccctcgacgcgcagaagatagaaaggatgtgaagactctcattgttgagatgcttcaagctgccgggccaaaagctgaatgatgactccacagatcaatgatgaagagcacttaccagatatccctcttggaaagaagaaaaatatacacatcgaaaaaggaaatgcatttatattttccataaaagaagacgacaaaggaaatggttgactttctttatttcttgtatatacactatttttttttttcacgaggaaaagcacttcaaaattcagattgtgtgatgtttctcaaagaaacaaaccctttaatatacataagtgattttatgtgaatttcttccagatgtactattgttatgaatgaacccttttgagaaacaagagtaattatttactttttggt

SEQ ID NO: 3612 - DNA, 1474 bp, Arachis hypogaea
gaaagaagaaagaaaggaaagtgaggttagtggttggttggttggtcggttgggacagcaaaaccaaaacaaaagatgaagactatggtgacgccattgatgaaaatttccccattttctcggccaaatggcatttatattaataaaccctcttctctcgtccctctttcccctctcacaccccaacgcaactcttcttcaccaaactccctcacctttcccactctcactcctactctttctgtttccatggccgcttcaccccaatccaccgctccgactgcatcccctggcggtgttaacatcaacaaagatgatgtttttcagttaattcaggcgcatcaggaaaaagctgctaggcttccaccggtagaagaaattcgaactttccttgatcgcagcgtgcgcgggatgctatctacctactcaaagaagtttgagggttatccatctgggtcgatggtggactttgcatgtgatgcaaatggatatccgatactagcagtgagcgacttggcagttcatacgaaggacttggctgcaaatcctaaatgttcactgctggtgcctagagatcctgaagataggactgatctagttgtcactttacacggtgatgctgtctctgtacctgaaaacgataaagaagccgtacgagctgcatatttggcaagacatcccaatgcattttgggttgactttggggacttccattttctgcgcattgaaccgaaagttgtacgatatgtgtcaggtgttgctacagctttgttaggatcaggagagttcagtccagatgaatataaagctgcaaaagttgatcccctagctcagttttccaagccggtggcgtctcatatgaacaaagatcatgctgaggatacaacagtgattgtgcagcactggacctcagttccggtggaatctgcatacatgctagatgttgatagtgttggcttcaatgtcaaggctggttataagggtgatactttcaagctcagagtaccttttcctcgacgtgcagcagacagaaaggatattaagactctaattgttgagatgcttcaagctgctagacctcatgttgattgattgctccacagataaacagaaaaaataaacagtacactacactatgcctatcatctttgggagaagagaaaaacaaaatgtgttccttcaaaacttggccatgtgagtcccccacacacaagatgacaaaaacaaaatggatgaccctttttaccctttttcactcactattcagtattattttcttggggtgggaaaaaaaagaaaagaaacccttgaaattccttacatagaaaagtggtgtgattgtgaatgaaagaaactttgtatataatatgatcgtgaatgtgatcttcctccaggtgtactcttgttggagaaattatatgaatccataaataaataaactccattaattttaggacaaaaaaagaaaaaaagc

SEQ ID NO: 3613 - DNA, 760 bp, Solanum phureja
aatttttctagtacaagatgtctggggaagaagaagaaaacgccgctgagctcaaaattggtgatgagtttttgaaggccaaatgtctaatgaactgtgaagtcgctttgattcttgaacacaagtatgagcagctccagcagatgtctgatgatccaaccaatcagatttcgcaggtatttgaaaagtcactgcaatatgtgaagcgtttcagtcggtacaagaaccctgatgctgttagacaagctcgagagatccttagtaggtatccacttgctgaattcgagctctgtgttcttgggaatctttgccccgaaaccgttgaggaaggtattgccatggtcccatccatcaagaatagaggacgtgcacttgacgaggaagcaattgagaaaatgctaacagacctttctctaataaagaaattcgagtagtcttatattgtgcttgtcttgctatgctgcagcagtctctgcttccgagcctgtaccaccatgtatttattagtaacagctctgcaatgcaaattgggctctggcattatgttgaaaactttatttgttgattgaggaagaaaacaaaactcgtttctctttggacatttttttccttttagtagctggttgtaaccacaatcctttggtagacggacttaaactattgtaatgatatacaaggtttgttgtttcgctttcgtgaaaggcaaataagagcatgcattgattggaatattagctatgggtcctgaggggtttttttt

SEQ ID NO: 3614 - DNA, 720 bp, Solanum melongena
tttctttctggttcacgaaaggtctgaaagatgtctggggaagaagaagaaaacgccgctgagctcaaaattggtgatgagtttttgaaggccaaatgtctaatgaattgtgaagtcgcattgattctggaacacaagtatgagcagctccagcagatgtctgatgatccaactaatcagatttcacaagtatttgaaaagtcactgcaatatgtgaagcgtttcagtcggtacaagaaccctgatgccgttagacaagctcgagagatcctcagtaggtatccacttgctgaatttgagctctgtgttcttgggaatctttgccctgaaacagtagaggaggctattgccatggtcccatccatcaagaatagaggacgtgctcttgacgaggaagcaattgagaaaatgctaacagacctttctctaataaagaaattcgagtagtttcatcagtgtgctcgtcttggcaagctgcagtagtctgcttccaagcctgtacctcttccatgtacttattagtagcagctctgtaatgcaaattgggctctggcattctgttagaaacttcagttgttgattgaggaagggaaaaaaggactcttttctatctaaattttttttcattcggtagctggttgtaaccataatcctttggtacacagaacaaaactattgttatttagatacaagatctgttgttgtgctttttctgtgagc

SEQ ID NO: 3615 - DNA, 720 bp, Nicotiana tabacum
  misc_feature (703)..(703): n is a, c, g, or t
  misc_feature (708)..(709): n is a, c, g, or t
ggctttttctagtaggttatcttgtctgaaagatgtcaggagaagaagaagaaaatgccgctgagctcaaaatcggtgatgagtttttgaaggccaaatgtctaatgaattgtgaagtcgcgttgattcttgaacacaagtacgagcagcttcaacagatgtctgaagatccaacgaatcagatttcacaggtatttgaaaagtcactgcaatatgtgaagcgtttcagtcggtacaagaaccctgatgctgttagacaagctcgagagatccttagtaggtatccacttgctgaattcgagctctgtgttctggggaatctttgcccagagactgttgaggaaggtattgccatggtcccatccatcaagaataggggacgcgcacttgacgaggaagcaatcgagaaaatgctgactgacctctctctaattaagaaattcgagtagtctcatttagcttctatgtctgtacttttggcgaccaggtgtgtattgcaaatggcgctctggcattctgttgaaattttatagctgatagatgaagagagaaaagaccaaacgactctgttctctctggacattttattcttttggaagctggttttagaacaatcctgtggtttcagagaccaacccgttgttatttacattaaactatacaaggttctctgtttttgtttttgtgtgagacaaattaaagngtgcnncggccgcatga

SEQ ID NO: 3616 - DNA, 691 bp, Capsicum annuum
aaaggatgtcgggggaagaagaagaaaacgccgctgaactcaaaattggtgatgagtttttgaaggccaaatgtctaatgaattgtgaagtcgctttgattcttgagcacaagtatgagcagctccagcagatgtctgatgatccaactactcagatttcgcaggtatttgaaaagtcactgcaatatgtgaagcgtttcagccggtacaagaaccctgatgctgttagacaagctcgagagatccttagtaggtatccacttgctgaattcgagctctgtgttcttgggaatctttgccccgaaaccgttgaagaagctattgccatggtcccatccatcaagaatagaggacgtgcacttgacgaggaagcaattgagaaaatgctaaacgacctttctctgataaagaagttcgagtagtgtcatcattgtgctcgtcttgctatgctgcagccgtctgtttccgagcctgtacctcgatgtagtttccatgtattttggtagtaggttgtaatgcaaattgagctctggcattatgttgaaaactttagttgttgatttgaggaagaaaaaaaaggctctgtagtcacaatcctatggggtactgaccaaaactattgttataagatgtacaaggtttgttgcttttgcttttgtgagataattaagagcatgccttgattgaacat

SEQ ID NO: 3617 - DNA, 655 bp, Petunia hybrida
gcataaacattttttttatatccacgaatttcagaagcttagaggacataaacctaacttgacatctctgtgtgtcaaaaaatcgatgtcaggcccctcaatggaagaagaagagaatgcggctgagctcaaaattggtgatgagtttttgaaggccaaatgtctgatgaattgtgaagttgcattgattcttgaacacaagtatgaacagattcagcagatgtctgatgatccaacaaatcaggtttcacaagtatttgaaaagtctctgcaatacgtgaagcgtttcagtcgatacaagaaccctgatgctgttagacaagctcgagagatccttagtaggtttccacttgctgaatttgagctctgtgttctggggaatctttgtccagaaaccgttgaggaaggtattgccatggtcccatccatcaagaatagaggccgcgcacttgacgaggaagcaattgagaaaatgctaaccgacctctctcttataaagaaattcgaatagtctatgtgatcgtctttactattttgtatgtctgcatatgcatttgtagcaatctttctaaagcaagggatcaacaactgtgtgaaaactgttgcttcttagagaaaatatccatcttcttgcttgttaaaaaacaaaaaaaca

SEQ ID NO: 3618 - DNA, 587 bp, Ipomoea nil
gaagtgcgaaacataagaggagaacgccgcggtttatataacgctttttctcgccacaatgtcagtagaagaggaggagaacgctgcggagcttaaaatcggagatgaatttctcaaggcgaagtgtctgatgaactgtgaggtttctttgattcttgaacacaagtatgagcagattcagcagatgtctgaggatccaacaaatcaagtttcccaagtgtttgagaagtcacttcaatacgtgaagcgtttcagccggtacaagaaccctgatgctgtgagacaagttcgagaaatcctgagtagatataagcttgctgaattcgagctttgtgttctgggaaacctttgcccagaaaccgttgaggaagcgattgccatggtcccatccattaagaacagagggcgtgcactggacgatgaggcaattgagaagatgctaaatgacctctcattgataaagaaatttgagtagagcaccttctccatttttttcagttggtttgccatattttagactgtacctctcattttaaatgttcattgtgtaaggtttcacagtattttattagaattagctttatgaa

SEQ ID NO: 3619 - DNA, 641 bp, Nicotiana benthamiana
tttcagccagctctatttaacacagtattcaaaagttctttttcccaaaacctctacctcttgccttcaaaggggttcacatttgctaccaggttttgtgtaatttcgtcgtcgtactctcaacatgtctttggaagaagaagaaaatgcagccgaactcaaaattggcgacgagtttttgaaggccaagtgtctaatgaactccgaagtttctttgattctggaacacaagtatgagcagattcagcagatgtctgatgatccgagcaatcaagtttcacaagtgtttgagaagtcactgcagtatgtgaagcgtttcagccggtacaagaatcctgatgccgttagacaagttcgagaaatccttagcagatatcaacttgctgaattcgagctgtgtgtcctggggaatctttgtccagaaactgttgaggaagctattgccatggtcccatctataaagaatagaggtcgcatgcttgatgaggaggcaatcgagaaaatgctgaatgatctctccctgataaagaagtttgagtagtgtcatttagatttatatctgcatttgttgtctgtaaatatttccgctactttgtacaagtactgctgccaagttttcaggactctgttgttggcggcag

SEQ ID NO: 3620 - DNA, 584 bp, Nicotiana benthamiana
ttcactatgccagctttatttaacacaatattcaaaaactctttttccctaaaacctctacctcttgcctttaaagggtttcacatttgctgcgaggttttgtataattgtgtcgtcgtactctcaacatgtctatggaagaagaagaaaatgcagccgaactcaaaattggcgacgagtttttgaaggccaagtgtctaatgaactccgaagtttctttgattctcgaacataagtatgagcagattcagcagatgtctgatgatccgagcaatcaagtttcacaagtgtttgagaagtcactgcagtatgtgaagcgtttcagccggtacaagaatcctgatgccgttagacaagttcgagaaatccttagcagatatcaacttgctgaattcgagctgtgtgtcctggggaatctttgtccagaaactgttgaggaagctattgccatggtcccatctataaagaatagaggtcgcatgcttgatgaggaggcaatcgagaaaatgctgaatgatctctccctgataaagaagtttgagtagtgtcatttagatttatatctgcatttgttgtctgtaaat

SEQ ID NO: 3621 - DNA, 836 bp, Eucalyptus grandis
attttaagcttgacgcccacttaaatggcgccccccctctagtccgctcttcaaactctctctctctctctctctctctctctctcgcgtattgctggtgtttaactcgagtgcgaagtatgtctggtgaagaggaagaaaatgctgccgagctcaaaattggtgatgaatttctgaaggcaaagtgtttaatgaactgtgaagtatccttgatacttgaacataagtatgaacagcttcaacagatgtctgatgatccaatgaatcaagtttctcaagtatttgagaaatcattgcaatatgttaaacgcttcagccgttataaaaatcccgatgctgtcagacaagttagagaaattctgagtagatatcaattggctgaattcgagctttgcgttcttggcaatctttgccctgagactgtagaggaagctattgctatggtaccatctattaagaaccgaggccgtgctctagatgatgaggcaattgagaagatgttgaacgacctgtcgctgattaagagattcgagtagcagccacttcgtagcagttgagagggagaacagatgagttgccatatttcgcagtgtatacagattgggaaacgatgatgtacaattttgtcatcgcgcattaagtattaaaccaatcagagttcaacttgatgatacatgtgttgcataccattgcaacctatcaaatgcgttctcctggatgcaaactgtgaattggtgaggttttttctgtgtcggtacggaagaattatctaacatgactgtctttatacgcattgattcctcattatcaatttgattacaaagatagacatccat

SEQ ID NO: 3622 - DNA, 717 bp, Carica papaya
atcttgccattggtctctccctgagcttgttaaaccctagctgaccgctctctcttcgtttctcagtttcaatatgtctggagaagaagaagaaaatgctgccgagcttaaaattggagatgaatttctgaaggcaaagtgtttaatgaactgtgaagttgctctaattcttgaacataagtatgagcagattcagcagatgtctgaagatcccatgaatcaagtttcccaagtatttgagaagtcactgcagtatgtgaagcgcttcagccgttataaaaatccagacgctgttaggcaagttcgagaaattcttagtaggtaccagttggctgaattcgagctttgtgttctcggcaatctatgtcctgaaactgtagaggaagctatagctatggtaccttctataaagaccaagggacgggcccatgacgatgaggctattgagaaaatgttgactgacttatcactgatcaagaaattcgagtaggagcccttgtatactgtgtcgatgctgtattcgtgttttttttttttgggggcgtagagccaactgttatttcctcgctcttgcatgatccatatctcagtatatgaagtgactgaatctcaaggagaacattcctttacttgtgtgtttttgctttgtaccataagaatgtttgggtgaacatttataagttgattatgatatatatccatgaaggctgttaattc

SEQ ID NO: 3623 - DNA, 873 bp, Nicotiana tabacum
ggattcgattcactatgccagctctatttaacacaatattcaaaaactctttttccctaaaacctctggctcttgcctttaaagggtttcacatttgctgcgaggtttttgtgtaattgtgtcgtcgtactctcaacatgtctttggaagaagaagaaaatgcagccgaactcaaaattggcgacgagtttttgaaggccaagtgtctaatgaactccgaagtttctttgattcttgaacacaagtatgagcagattcagcagatgtctgatgatccgagcaatcaagtttcacaagtgtttgagaagtcactgcagtatgtgaagcgtttcagccggtacaagaatcctgatgccgttagacaagttcgagaaatccttagcagatatcaacttgctgaattcgagctgtgtgtcctggggaatctttgtccagaaactgttgaggaagctattgccatggtcccatctataaagaatagaggtcgcatgcttgatgaggaggcaatcgagaaaatgctgaatgatctctccctgataaagaagtttgagtagtgtcatttagatttatatctgcgtttgatgtctgtaaatatttctgcgacttgtacaagtactgctgccaagttttcaggactcaatgttgttggtggcagaatataactactgaagaagagaagagtatgtggacctgcttctttctcaaccaaatttctacattggtaaaaaaattgctggagtatatcttgcgttatgaaattagtaagtcatagctttgttaattctatatttttgtatgcatgtttggatttcaaccgtgactgaacaacgctgtgtaatgcttttttgtaatgttgcggtctttgtttgtccg

SEQ ID NO: 3624 - DNA, 979 bp, Sarracenia psittacina
atttcgaaagtttgggtcaatttcttcctgagttcttctccaagagagtaaatctcgcgacttggctcttcggcggttcttcctcatccttggattctccggtgtcctctccccttcgtacctgctgccatttatcacggtatctctggcagaaaagctgtcaaagagcactaagagcatgggagtttgaagacaaagaagaatttctcctgttataaggttcttgggctgcctgcaagcaagagttggtacaaaaaattaataaagggatttacaaagctgcaggacttgggggttataatattgaacccgaggctttcaaggcagcattcctatctcaggtaacgtaagagcttttggcatgtctgcagaagagggagaaaatgctgctgaactgaaaattggagatgaatttttgaaggccaagtgtttaatgaattgtgaagttgccttaattcttgaacacaagtatgagcagctccagcaaatggctgatgatcccatgaaccaaatctctcaagtatttgaaaagtcattgcagtatgtgaagcgctttagccgctacaagaatccggattctgttagacaagctcgagaaatccttagtaggtatcagttggctgaatttgagctttgtgttcttggaaatctttgcccagaaactgttgaagaagctattgctatggtcccatctatcaagagtagaggacgtgctcttgacgacgaggcgattgagaaaatgttgaatgatctttctcttataaagaaatttgaatagtgctgttcttgctttctgccaaggccatattgtgttgactcaataaaaaggttactgcattgtatgacactgattctatattattgtctcctgttcatttctgaatatgttttaaagattcgattatcaattacaagaagacgatgtttattgagagatctctgttggaaactcaaagatcaaatcgatcgattttttgag

SEQ ID NO: 3625 - DNA, 1023 bp, Tabernaemontana elegans
ccaccgtcccccgcccctacccttcccgatggggctcaaaaccctgtactttcgtaatccattcaagtgttttggcagagtaagcagagctatataactcggaaccgacgaaccccaaattctctgagacgacaattatcaaactcgaaagattcacaaaagcgagggaggaaggagggagataagttttccttcagtaaaagtcccaggtacctgatctgcttcattccgttgattcgataggagctccggcgtgaacagaaagagcctcggaatcagctttgcctccggttactaggtctcggaatttgatacagcccaagaatgtctggagaagaggaagagaatgctgccgagctcaaaattggtgatgagtttttgaaggctaagtgtttgatgaactgtgaagttgccctgattcttgaacataagtatgagcagcttcagcagatgtccgaggatccaatgaatcaaatgtctcaagtatttgagaagtccttgcagtacgtgaagcgtttcagccgctacaagaatcctgattcggttcggcaagtgcgggagattctaagtagatatcagctagcggagtttgagctctgtgttcttggcaatctttgccctgagactgttgaggaagcaattgctatggttccatccatcaagaatcgtggccgtgcccttgatgatgaggcaattgagaaaatgctgaatgacttgtccctagttaagaaatttgagtagagtggggttcctggacaaaatattgtcgactatcatgcaatgctgtttggaaatcttgagatctattcatcaatgctgagaaatgtagtaattgtacccttaagagttagccctcatccacgtagtagatgaaattgaacttgttatctttcatatttgagatgatctgaaactattctttctagctttcacttggtcgcgagtatacttggttttgcattttagcccgtttccttttcttacctctgtagaacgactataatctgcattgcttgttagtca

SEQ ID NO: 3626 - DNA, 1061 bp, Tripterygium wilfordii
ttaacgaaaaacattgcgacgattctcttctagcactcttgttgctcttcactttctggtttgcttcggttctgtttcctctcacttttgggcgtttcagtatgtctggagaagaggaagaaaacgcagctgagctcaaaattggagacgagtttttgaaggccaagtgtttaatgaattgtgaagtggccttaattcttgagcataagtatgagcagcttcagcagatgtctgatgatcctacgaaccaaatctctcaggtgtttgaaaagtcactgcagtatgtgaagcgtttcagtcgatacaaaaatcctgatgctgtgagacaagttcgagaaatccttagcagatatcagttggctgaattcgagctttgtgttcttggcaacctttgccctgaaacagtggaagaagctattgcaatggtaccttctatcaagaccaaaggacggggtcatgacgacgaggcaattgagaaaatgttgaatgacctctcactggtcaagaaatttgaatagtcaattatccatttctacttgatcgatcttcaaaagcacactcagatcaaatgggtttattgtggtgttcctgtgatgtcaacttaaaacgtcataataccaaatgtttcagacattcatctgctgtaatttcttttaaatataggctgctgtaatatatgctgcgataggtatgcatcgcatcataccaaaagggttcggctgtaatgtcgcaatcatttgaaatagctagctgcgttaatccaacttgcacaagggctcatctgttggacttttcttcatcatgcggagttgaacaactctgcaaataaatagttcaagcgttctcaatgatgtatgttgaaatatcttaagaagtagatgggtgatgaggcactaagcagtatgttcaaacaggatgcaaaactgaggaatcaatcttacagaccattcatacaactgagtcaaagtcacggaagacatcaccatcagagcatcagaaatagcgtactgcgtttggccattgtaagttgtaacagcccaccgctcatactggcttgcata

SEQ ID NO: 3627 - DNA, 552 bp, Vinca minor
gtatcccttctattctagctgcagcttaagcaccagcaacctccagttccatccgacaacaatcatcaagtttgattcaacagaagaatgtctggagaagaggaagaaaatgctgctgagctcaaaattggtgatgagtttctgaaggctaagtgtctgatgaactgtgaagtttccctgattctcgaacacaagtatgagcagcttcagcagatgtccgaggatccaatgaatcaaatatctcaagtgtttgagaagtcattgcagtatgtgaagcgtttcagccgctacaagaatcctgattctgttcggcaagtgagggagattcttagtcgctataagttggctgagtttgagctctgtgtacttggtaatctctgtcctgagactgttgaggaagcaattgctatggttccatcgatcaagaatagaggccgtgctctagatgatgaggcaattgagaaaatgcttaatgatctatccctagtcaagaaattcgagtagataaattgaaatttgttatcagggaaaataatgtgttttaatcttttc

SEQ ID NO: 3628 - DNA, 975 bp, Amsonia hubrichtii
ttcctcccattctcattgcaataaggacacttccctctattttggtagtcatattaaaggcaattttcctctctcctttgcaaaataagcggctgcaactcgacagcgccggcgagtgcaaccttctctccgacgataatcgtgccaatttacatataattattattgtattccaccatttggttacctaagaccttcagttctagtgagcaagaaactgatttcatcacgtttcatactccgaatccttgccgaggcccattcagtccgactttcgtctcagattttgattcggcccaagaatgtctggagaagaggaagaaaatgccgctgagctcaagattggtgatgagtttttgaaggccaagtgtctgatgaattgtgaagtttccctgattcttgaacacaagtatgagcagcttcagcagatgtccgaggatccaatgaatcaaatgtctcaagtatttgagaagtcattgcagtatgtgaagcgattcagccgctacaaaaatcctgattctgttcggcaagtgagggaaattcttagtagatatcagctggctgagtttgagctctgcgttcttggtaatctctgtcctgagactgttgaggaagcaattgctatggttccatccatcaagaatagaggccgtgcccttgatgatgaggcaatcgagaaaatgctgaatgacctatccctagtgaagaaatttgagtagagtggtagcctgtacttgttaactattatttgaactttccaataagggaaaggatgcagtgctctttagaaatcgtgagttgaacttattatttcacggtcgatcttgagatggatttaaaaatgatttttctgcttcacttggtaatgctggtttttggtttaatattttatacataaatcattttgtttcagaagtctgtaagctgctttatcatattctcatacatgaaaaacatctcatcaaggagacattg

SEQ ID NO: 3629 - DNA, 705 bp, Fagus grandifolia
ctggaccttggctgtcactcagttgagaactcagaaccgaaccgaaccaaaccaaaccaccagataaaatttcggtttggttttctcaatatgtctggggaagaagaagagaatgctgctgagctcaaaatcggagacgagtttttgaaggccaagtgtttaatgaattgtgaagttgctttgattcttgaacataagtatgagcagcttcagcagatgtctgaggatccgatgaatcaagtttctcaagtgtttgaaaagtcactgcagtatgtgaagcgatttagccgatataagaatcctgatgctgttagacaagtgcgagaaatcctgagtagataccaattggctgagttcgagctttgtgttcttggcaacctttgccctgaaacagtggaggaagcaattgctatggtaccatctatcaagaccaaaggacgagctcatgatgatgaggcaatcgagaaaatgttgaatgacctgtcactcatcaagaaatttgaatagagggtgttctgcttgcccacatcagtattgattatgcacgagatgttttaaaagtgtgttatatttctagcaatcttaagatcttaatgttgtaacattgtgatcctatattgcattttgtaatgtctattctgaagattttgtgtagaccccacacgatgattatatccaagaaatgcttaaacagtacttaagttg

SEQ ID NO: 3630 - DNA, 642 bp, Vaccinium corymbosum
cccttcctctgcagccacccaaccaaacggtctctgtccttgctgattgttttcgagagctcagaatgtctggtgaagaggaagaaaatgctgctgaattgaaaatcggagatgaattcttaaaggccaagtgtctaatgaattgcgaagttgccttaattcttgagcataagtatgagcagcttcaacagatggctgatgatcccatgaaccaagtttcacaagtatttgaaaagtcacttcagtatgtgaagcgctttagccgctacaagaatccagatgccgtcagacaagctcgagaaatccttagtagataccagttggctgaatttgagctctgtgtccttggaaatctatgccctgacactgtggaggaagctattgctatggttccatcgatgaagagcagaggacgcgcgcttgatgaggaggctattgagaaaatgttgaatgacctttctatgataaagaagttcgattgatgccatttttgtttttcagtggatctacattgtgtgcaagaaatcgctgtgtctaaatttctagtaggctataaaagctatggcaacttcctttgaaatagcatgtctgaaaacatgtcccattgatgtagaggtgtcaaacgtgcgtgccgtgccgtgc

SEQ ID NO: 3631 - DNA, 628 bp, Manihot esculenta
ggttttggaagctcttttgatttgtgaataaaaatacagcatgtctggagaagaggaagaaaatgctgctgagctcaaaattggagatgaatttttgaaggcgaagtgcttaatgaattgtgaagtagcattaattcttgaacataaatatgagcagcttcagcagatgtctgatgatccaatgaatcaagtttctcaggtatttgagaaatcattacagtatgtgaagcgctttagccgttataaaaatcctgatgctgtcaaacaagttcgagaaattcttagtcgataccagttggctgaattcgagctgtgtgttcttggcaacctttgccctgaaactgtggaggaagctattgccatggttccttctatcaagacaaaaggaagagctcatgatgatgaggcaattgagaaaatgttgaacgacttgtcgttgatcaagaaatttgaatagtggaagccacctcttctgttgatacctgttttaaatgggatttcttgatctgatcataccaattaatagatttcacttgtgtgactttggaatcttcttattttgtagtgctgctttgacaaatgtcaacatgagaatattattacatgctagatttagactttttccaac

SEQ ID NO: 3632 - DNA, 724 bp, Castanea mollissima
agaaagttcagaaacccaaaccctccaaataaaataaaattacgcattggtttttatcaataatatgtctggggaagaagaagaaaatgccgctgagctcaaaatcggagacgagtttttgaaggccaagtgtttaatgaattgtgaagttgctttgattcttgaacataagtatgaacagcttcagcagatgtctgaggatccaatgaatcaagtttctcaagtgtttgaaaagtcactgcagtatgtgaagcgatttagccgctataagaatcctgatgctgttagacaagtgcgagaaatcctgagtagataccagttggctgagtttgagctttgtgttcttggtaacctttgccctgaaacagtggaggaagcaattgctatggtaccatctatcaagaccaaaggacgggctcatgatgatgaggcaatcgagaaaatgttgaatgacctgtcactcatcaagaaatttgaatagagggtgttatgctggaccagatcttcattgattatgcaaacgagatgtttttgaaatgttatatttatagcaatcttactatcctaatgttgtaatattgtgatcgactgatcgtatgttgccacttgcattttctgatgattttgcttggtccctgacacaatgattaggtacaagataatgctgcaagtcgttttaaagtacaagttatcttgtatgaaattatcaaacgaacaaaaaaaa

SEQ ID NO: 3633 - DNA, 853 bp, Euonymus alatus
cagcgattttcttcttgcactcttgctgttcttcacttttttttctggtgatcttctcatcttccttaatttgcttctctggtttgcttctgttctggttcctctcagttttgggtgtttcagtatgtctggagaagaggaagaaaacgcagctgagctcaaaattggagacgagtttttgaaggccaagtgtttaatgaattgtgaagtggccttaattcttgagcataagtatgagcagcttcagcagatgtctgatgatcctatgaaccaaatctctcaggtgttcgaaaagtcactgcagtatgtgaagcgtttcagccgatacaaaaatcctgatgctgtgagacaagttcgagaaatccttagcagatatcagttggctgaattcgagctttgtgttctcggcaacctttgccctgaaacagtggaggaagctattgcaatggtaccttctatcaagaccaaaggacggggccatgacgatgaggcgattgagaaaatgctaaatgacctctcactagtcaagaaattcgagtagtcaatgatccatttctactggatcaatccaaaagcataccagatcatatgggtttattgtgttgtaccgtacctgttgcttcaaatattcatttgttggctttagcctgttgtatatatagcctgctgtaatctatgtcacgattgcaccataccaaaaaggttcagctgtttgttgcagtggcttcaactgctcgagctcgtcattaacagtctcatcttcattgcgaagtggtaaaatatgattctttaactagacgactgtggactaaagtactttcatgggtcaatgatgcatggctatttgaattta

SEQ ID NO: 3634 - DNA, 821 bp, Vitis vinifera
ggtagtgatttaatcatcaagaagccgttttctgaagttgccctccagacgagagaatccctaaaaaaaagccctaactacctctgccactctccatcctcgcagattttgtatttggatctcaacatgtccggagaagaagaggaaaacgccgcggagctcaaaattggggatgaatttttgaaggccaaatgtttgatgaattgtgaagtagctgttattcttgaacataagtatgaacagcttcagcagatgtctgatgatccattaaatcaagtttctcaagtatttgaaaagtccctacagtatgtgaagcgcttcagccggtataagaatcctgatgctgttagacaagttcgagaaattctgagccgataccagttggctgaatttgagctttgcgtcctcggcaacctctgccccgaaactgtggaagaagctattgccatggttccatccatcaagacgaaaggccgggcccatgatgatgaagcaattgagaaaatgttgaatgacttgtctttgatcaagaaatttgaatagtagcctcttcatatttagaacctttttttatgtatcatgtacttgttgcagcagcctaagttttgaagaattttttgtttaatattgctggatcaccatttcaattttgcccacaatatgggtactatatgttagtcccaagtctgactgttagatatgttcctccaatatctggcttcgactaatactcttctagatgatttctggtttcttaaaaattattttatttggttagactttgaatggaaaattataatcctagtgggaaatttctaagt

SEQ ID NO: 3635 - DNA, 447 bp, Vitis vinifera
tatttggatctcaacatgtccggagaagaagaggaaaacgccgcggagctcaaaattggggatgaatttttgaaggccaaatgtttgatgaattgtgaagtagctgttattcttgaacataagtatgaacagcttcagcagatgtctgatgatccattaaatcaagtttctcaagtatttgaaaagtccctacagtatgtgaagcgcttcagccggtataagaatcctgatgctgttagacaagttcgagaaattctgagccgataccagttggctgaatttgagctttgcgtcctcggcaacctctgccccgaaactgtggaagaagctattgccatggttccatccatcaagacgaaaggccgggcccatgatgatgaagcaattgagaaaatgttgaatgacttgtctttgatcaagaaatttgaatagtagcctcttcatatt

SEQ ID NO: 3636 - DNA, 878 bp, Quercus alba
gagtgtgattcggactttttaactcaggaagactcctatatatatcgacaggcagtcttattgtcatgtctgattattcatagttccatcacagaaacccaaacccaaaccctccaaataaaattacgcattggtttttctcaataatatgtctggggaagaagaagaaaatgccgctgagctcaaaatcggagacgagtttttgaaggccaagtgtttaatgaattgtgaagttgctttgattcttgaacataagtatgagcagcttcagcagatgtctgaggatccaatgaatcaagtttctcaagtgtttgaaaagtcactgcagtatgtgaagcgatttagccgctataagaatcctgatgctgttagacaagtgcgagaaatcctgagtagataccagttggctgagtttgagctctgtgttcttggcaacctttgccctgaaacagtggaggaagcaattgctatggtaccatctatcaagaccaaaggacgggctcatgatgatgaggcaatcgagaaaatgttgaatgacctgtcactcatcaagaaatttgaatagagggtgttatgctggaccagatctttattgattatgcaaacgagatgtttttgaaatgttatatttatagcaatcttacgatcctaatgttgtaatattgtgatcgactgatcgtatattgccacttgcattttctgatgattttgcttgacccctgacacaatgattaggtacaagataatgctgcaagtcgttttaaagtacaagttatcttgtatgaaattatcaacagcaacaaaaaaaaaggaagttattttgtatgccacaagctagtcttcttatctccttgaaaactggccgaggagtcttataa

SEQ ID NO: 3637 - DNA, 713 bp, Cajanus cajan
aaacgaaagtattagacatctcagaaagctattattcagaaccaaaacgctgaagctctcgtcgttttattcctagcattctcttgtgcctgttctcgttctttaaacatgtctggggaagaggaagaaaacgccgcagagcttaaaattggagacgagtttttgaaggcaaagtgcttaatgaactgtgaagttgcattgattcttgagcacaagtatgagcagcttcaacagacatctgatgatcccacgagtcaaatttctcaggtatttgaaaaatcattgcagtatgtgaagcgtttcagccgttataaaaatcctgatgctgttagacaagttcgagaaattctggcaagatatcaattaactgagtttgagttgtgtgtccttggcaatctttgcccggaaactgtggaggaagccattgctatggttccatctatcaagacaagaggacgggctcaggatgatgaagcaatcgagaaaatgttaaatgacttatcattgatcaagaaatttgaataaatatttttcactgtcatcgggtgtgatatcacttgacagatagcaaacattcttgtgatttgtattacagaattcgttttcttatttctagtttatttaatgatttttatcttgaagaatttgacacatgcatatgaaattgtctttgatcagttaggataaattattactctttataaaatatttta

SEQ ID NO: 3638 - DNA, 846 bp, Populus trichocarpa
gaggggcaggttactcttggaagaggcaagaacgcgttcgcacttcaaagggaccaagaagccattgacgtgctcccccctgcccacaaatacagaaatatagattcacttttcaaccccaaatcgatcatcccaaactcagtcacacagtctctctaaaggaaaaacctgaaaagaatagtctaagtatgtctggagaagaggaagagaatgcggccgagctcaaaatcggagatgattttttgaaggccaagtgcttaatgaattgtgaggttgctttaattcttgagcataagtatgagcagcttcaacagatgtctgatgatcctatgaatcaagtatcccaagtatttgagaaatcactgcagtatgtgaagcgctttagccgctacaaaaatcccgatgctgtgagacaagttcgagaaattcttagccgataccagttggctgaattcgagctttgtgttcttggcaacctttgtcctgaaacagtggaggaagctattgccatggtaccttctatcaagaccaaaggccgagctcatgatgatgaagcaatcgaaaaaatgctgaatgacctgtccttgatcaagaaatttgaatagtggccagtatatcctcatccatttcaaatttggatgtctgtcatctgaatgttcaagatttttaattattattagaaagaggataatttaagctattgatggctatcaatattgttcaaaatattatcggcatcaaatccttatggctgcgtggtgttgctcaggatgtgatactgctctaacatgacagtacttgtattagatatcaacttcatgatgctcaaatattatagttttgttt

SEQ ID NO: 3639 - DNA, 957 bp, Populus trichocarpa
gagagaggggcaggttactcttggaagaggcaagaacgcgttcgcacttcaaagggaccaagaagccattgacgtgctcccccctgcccacaaatacagaaatatagattcacttttcaaccccaaatcgatcatcccaaactcagtcactcagtctctctaaaggaaaaacctgaaaagaatagtctaagtatgtctggagaagaggaagagaatgcggccgagctcaaaatcggagatgattttttgaaggccaagtgcttaatgaattgtgaggttgctttaattcttgagcataagtatgagcagcttcaacagatgtctgatgatcctatgaatcaagtatcccaagtatttgagaaatcactgcagtatgtgaagcgctttagccgctacaaaaatcccgatgctgtgagacaagttcgagaaattcttagccgataccagttggctgaattcgagctttgtgttcttggcaacctttgtcctgaaacagtggaggaagctattgccatggtaccttctatcaagaccaaaggccgagctcatgatgatgaagcaatcgaaaaaatgctgaatgacctgtcattgatcaagaaatttgaatagtggccagtatatcctcatccatttcaaatttggatgtctgtcatctgaatgttcaagatttttaattattattagaaagaggataatttaagctattgatggctatcaatattgttcaaaatattatctgcatcaaatccttatggctgtgtggtgttgctcaggatgtgatactgctctaacatgacagtacttgtattagatatcaacttcatgatgctcaaatattatagttttgttttgattctgcccgtttattaatggttatatgatgaaagacgaactgaacagtgaacatataattcacaaactgttgcgtattttaagttagctatttggttttgatgg

SEQ ID NO: 3640 - DNA, 826 bp, Populus trichocarpa
gttgccgtaataagaaaaattcattctcgaaccaaataaaaaattaaaaacccacccctctcaaacgaaaaaccttaaaaaggaaacgaaaagaaaaaataaattcttaaatattgaagtatgtcaggagaagaggaagagaatgcggccgagctcaaaatcggagatgattttttgaaagccaagtgcttaatgaattgtgaagttgctttaattcttgagcataagtatgagcagcttcaacagatgtctgatgatcctatgaatcaagtatcccaagtatttgagaaatcactgcagtatgtgaaacgctttagtcgctataaaaatcccgatgctgtcagacaagttcgagaaattcttagccgataccaattggctgaatttgagctttgtgttcttggcaacctttgcccggaaacagtcgaggaagctattgccatggtaccttctatcaagaccaaaggccgagctcacgatgatgaagcaattgagaaaatgttgaatgacctgtcattgatcaagaaattcgaataggggctactatatccccttccttttcaatctggatggttgtcatctgaatgttaaaggcttttttgcttttacaagaatgagagtggtttaagctgttgatggctatcagtatcgttctaaatttcatctgagccaaatggtttatacatcagtccttatggccatgtactgtgatactgctctcacgtgacatttggtaatacttgcacttgatatcaactgcctattcgaatgttacagttcagtctttgttttgacccgtttataaatagctatatgatttaagaca

SEQ ID NO: 3641 - DNA, 1155 bp, Populus trichocarpa
ggaagcgttgccgtaataagaaaaattcattctcgaaccaaataaaaaattaaaaacccacccctctcaaacgaaaaaccttaaaaaggaaacgaaaagaaaaaataaattcttaaatattgaaggtaatctttgaaagctagtttagttatctactctggttcgattccttaacatcaccaaactgcttttgttgtctgaaactttagaaatcaagttctactttaggttttgtcattagggttcttgatgaagttcgaaaaatattgagctttaataagaaatttgttcttcctcttcttcttcttcttcttcttcttgttaatttgaccttgtttgatttatttgtgagccacagtatgtcaggagaagaggaagagaatgcggccgagctcaaaatcggagatgattttttgaaagccaagtgcttaatgaattgtgaagttgctttaattcttgagcataagtatgagcagcttcaacagatgtctgatgatcctatgaatcaagtatcccaagtatttgagaaatcactgcagtatgtgaaacgctttagtcgctataaaaatcccgatgctgtcagacaagttcgagaaattcttagccgataccaattggctgaatttgagctttgtgttcttggcaacctttgcccggaaacagtcgaggaagctattgccatggtaccttctatcaagaccaaaggccgagctcacgatgatgaagcaattgagaaaatgttgaatgacctgtcattgatcaagaaattcgaataggggctacaatatccccttccttttcaatctggatggttgtcatctgaatgttcaaggctttttcgcttttacaagaatgagagtggtttaagctgttgatggctatcagtatcgttctaaatttcatctgagccaaatggtttatacatcagtccttatggccatgtactgtgatactgctctcacgtgacatttggtaatacttgcacttgatatcaactgcctattcgaatgttacagttcagtctttgttttgacccgtttataaatagctatatgatttaagacaaactgaacctagaatttactaactgctgcatattttaagttagctatttagtttgatggaagatattttaagttagccattttcgtttca

SEQ ID NO: 3642 - DNA, 914 bp, Sarracenia psittacina
gtaaatctcgcgacttggctcttctgcggttcttcctcatccttggtttctccggtgtcctctccccttcgtacctgctgccattaatcacggcatctctgacagcactaagagcatgggagtttgaagacaaagaagaatttctcccgttataaggttcttgggcagcctgcaagcaagagttggtacaaaaaaattaataaagggatttacgaagctgcaggacttgggggttataatattgaacccgaggctttcaaggcagcattcctatctcaggtaacgttagagctcttggcatgtctgcagaagagggagaaaatgctgctgaactgaaaatcggagatgaattttgaaggccaagtgtttaatgaattgtgaagttgccttaattcttgaacacaagtatgagcagctccagcaaatggctgatgatcccatgaaccaaatctctcaagtatttgaaaagtcattgcagtatgtgaagcgctttagccgctacaagaatccggattctgttagacaagctcgagaaatccttagtaggtatcagttggctgaatttgagctttgtgttcttggaaatctttgcccagaaactgttgaagaagctattgctatggtcccatctatcaagagtagaggacgtgcccttgacgacgaggcgattgagaaaatgttgaatgatctttctcttataaagaaatttgaatagtgctgttcttgctttctgccaaggccatattgtgtcgactcaataaaaaaggttactgtattgtatgacactgattctatattattgtctcctgttcattttctgaatatgttttaaagattcgattatcaattacaagaagacgatgtttattgagagatctctgttggaaactcaaagatcaaatcgatcgattttt

SEQ ID NO: 3643 - DNA, 736 bp, Glycine max
gcagatagataagcatacgcaacgcaagaatagagaactgcgtagcgacccatcagagaagatcgcgatcttctgaaacatgtctggggaagaggaagaaaacgccgcagagctcaaaattggagacgagtttttgaaggcaaagtgcttaatgaactgtgaagttgcattgattcttgagcacaagtatgagcagcttcaacagacatccgatgatcccatgaatcaagtttctcaggtatttgaaaagtcactgcagtatgtgaagcgcttcagccgctataaaaatcccgatgctgttagacaagttcgagaaattctcgccagatatgaattggctgagtttgagttgtgtgtccttggcaacctttgcccagaaactgtggaggaagctattgctatggttccatctatcaagtcaagaggacgggctcaggatgatgaagcaatcgagaaaatgttaaatgacctgtcgttgattaagaaatttgaataaatacgtcaaagtgtgtgatataactgacatatcacttaactgcaagcaaacattcttgtggtttgtattacaaaaacgcttggtaattatatttagttcattttgtgactgttatcgagtaggattttgacacatgcgaactggtgtatgaaagtgcttttgacctgttatgatgattatgcgaatgtgattattgtcttactataaccaactatttatagcaagaagatagattattat

SEQ ID NO: 3644 - DNA, 1744 bp, Glycine max
agtgcatgtttgaatgacggttgataaaattgatttggttaaaattgatttgaaattaatgtgatttatgtttgaatatttttattataaaataagttaagagtaaaatttagtataaatttttttatttaacaaaattactattgagcaccataaaaaatatgttttatttttataggaatcaaattaatacaaaaaaaattatgaggatcaaattaatattttttaaattttacaagaatcccatgcatattttatcctaaattttttatacaacttccagtccttcattaattttgtgttagaaattttagtccttctaaattttttgtctatttttagtctattgtttatttttattgttcaaaattagtcattgttttatcaaattttagtttagtcccttgtttattttatatttgagactacctttaaacaataaaaataaatgaaagactaaaaatgaaaaaaagttttaaaggagctaaaaattatgacaaaaaattaataaaaaaaactaaaaattgtcaaaattattttgaggaccaaaaattataatataaaaaatttgagaaacttaaaatttaattaaccccaaaaatataatcatattgacaatcaactgatcaatattaattgttaataagagattacatgaccattaaaaaaatatgtatatttatcttttgatattaaccacacaaattatctaatgtttaatgtttacgattttcatttcttacagtaaaaaatcatgtattttatatctttttaatgtatgaatttaatgcggcatctatctacaaaatggacattataaagaatataacatacgagaatctaaacttattctaaaacaggagattgaccaactaaaacaaaaaaaaaaaagtaaaaaaacgttgggcccgttggcccaattctccatggtcctatcaaagaagactgaattgcaaatttggagagcagatagataagcatacgcaacgcaagaatagagaactgcgtagcgacccatcagagaagatcgcgatcttctgaaacatgtctggggaagaggaagaaaacgccgcagagctcaaaattggagacgagtttttgaaggcaaagtgcttaatgaactgtgaagttgcattgattcttgagcacaagtatgagcagcttcaacagacatccgatgatcccatgaatcaagtttctcaggtatttgaaaagtcactgcagtatgtgaagcgcttcagccgctataaaaatcccgatgctgttagacaagttcgagaaattctcgccagatatgaattggctgagtttgagttgtgtgtccttggcaacctttgcccagaaactgtggaggaagctattgctatggttccatctatcaagtcaagaggacgggctcaggatgatgaagcaatcgagaaaatgttaaatgacctgtcgttgattaagaaatttgaataaatacgtcaaagtgtgtgatataactgacatatcacttaactgcaagcaaacattcttgtggtttgtattacaaaaacgcttggtaattatatttagttcattttgtgactgttatcgagtaggattttgacacatgcgaactggtgtatgaaagtgcttttgacctgttatgatgattatgcgaatgtgattattgtcttactataaccaactatttatagcaagaagatagattattatcctttaagcggtgacagggcaggggtaaatttacgtaagctct

SEQ ID NO: 3645 - DNA, 895 bp, Glycine max
aatcataaggactttgattcggagaacgcaatacactgtcctcctccaacgcagcattttaaaaccagacactaaacacacaaacgctgaatctctcgttcgattcttggcattccacttctcgccctcgttctttttttgcgttttcttcttcttcttcttcttcttcttcttcttcttctcactttttacctaagattttgtggaacatgtccggggaagaggaagaaaacgccgcagagctcaaaattggagacgagtttttgaaggcaaagtgcttaatgaactgtgaagtttcattgattcttgagcacaagtatgagcagcttcaacagacatctgatgatcccatgaatcaaatttctcaggtatttgaaaagtcactgcagtatgtgaaacgtttcagtcgctataaaaatcctgatgctgtcagacaagttcgagaaattctcgcaagatatcaattggctgagtttgagttgtgtgtccttggcaacctttgcccagaaactgtggaggaagctattgctatggttccatctatcaagtcaagaggacgagctcaggatgatgaagcaatcgagaaaatgttaaatgacctgtcgttgattaagaaatttgaataaatacgtcaaaatttgtgatgtaatgttggtaccgtataacaacatatcacgtgactgcaagcaaacattcttgtggtttgtattacagaaacccatggtaattatatttagtttattttgtgactgttattaagaaggattttgacacatggtgctggtgtatgaaagtgcctttaacctgttatgataattatgcgaatgttgtgattattgtcttgctacaaaggaaaaactttgctcacactcaagacaacacacaacgtcttttc

SEQ ID NO: 3646 - DNA, 930 bp, Glycine max
aattcaattcatggtaatcataaggactttgattcggagaacgcaatacactgtcctcctccaacgcagcattttaaaaccagacactaaacacacaaacgctgaatctctcgttcgattcttggcattccacttctcgccctcgttctttttttgcgttttcttcttcttcttcttcttcttcttcttcttcttctcactttttacctaagattttgtggaacatgtccggggaagaggaagaaaacgccgcagagctcaaaattggagacgagtttttgaaggcaaagtgcttaatgaactgtgaagtttcattgattcttgagcacaagtatgagcagcttcaacagacatctgatgatcccatgaatcaaatttctcaggtatttgaaaagtcactgcagtatgtgaaacgtttcagtcgctataaaaatcctgatgctgtcagacaagttcgagaaattctcgcaagatatcaattggctgagtttgagttgtgtgtccttggcaacctttgcccagaaactgtggaggaagctattgctatggttccatctatcaagtcaagaggacgagctcaggatgatgaagcaatcgagaaaatgttaaatgacctgtcgttgattaagaaatttgaataaatacgtcaaaatttgtgatgtaatgttggtaccgtataacaacatatcacgtgactgcaagcaaacattcttgtggtttgtattacagaaacccatggtaattatatttagtttattttgtgactgttattaagaaggattttgacacatggtgctggtgtatgaaagtgcctttaacctgttatgataattatgcgaatgttgtgattattgtcttgctacaaaggaaaaactttgctcacactcaagacaacacacaacgtcttttcaaaataatctttgaatttcg

SEQ ID NO: 3647 - DNA, 763 bp, Phaseolus vulgaris
agagtaattgaaacccagaagctgaatcttctaattctcgttcggttttcggcattcctcttcacgcgctccctctccctcgttcttctactcgctgtttctgcttctgtttcttctcacatacctgaaactctctgaaacatgtctggggaagaggaagaaaacgccgcagagctcaaaattggagatgagtttttgaaggcaaagtgcttaatgaactgtgaagtttcattgattcttgagcacaagtacgagcagcttcaacagacatctgatgatcccatgaatcaagtttctcaggtatttgaaaagtcgctgcagtatgtgaagcgattcagccgctataaaaatccagatgctgttagacaagttcgagaaatacttgcaagatatcaactggctgagttcgagttatgtgtccttggcaacctttgcccagaaactgtggaggaagctattgctatggttccatctatcaagacaagaggacgggcccaggatgatgaagcaattgagaaaatgttgaatgacttgtcattgattaagaaatttgaataaatatttcttacattacgagtgagatataacgttacttttaccatatcacgtcatctaactgcaagcaaaccattcttgtggattgtattacagaaaccctggataatatctagcattttgtgattctatacaagaaggatcttgacacatgcatgctggtgtatgaaagtgattttgacttgttatgataattacgtggatgtgg

SEQ ID NO: 3648 - DNA, 849 bp, Phaseolus vulgaris
agagtaattgaaacccagaagctgaatcttctaattctcgttcggttttcggcattcctcttcacgcgctccctctccctcgttcttctactcgctgtttctgcttctgtttcttctcacatacctgaaactctctgaaacatgtctggggaagaggaagaaaacgccgcagagctcaaaattggagatgagtttttgaaggcaaagtgcttaatgaactgtgaagtttcattgattcttgagcacaagtacgagcagcttcaacagacatctgatgatcccatgaatcaagtttctcaggtatttgaaaagtcgctgcagtatgtgaagcgattcagccgctataaaaatccagatgctgttagacaagttcgagaaatacttgcaagatatcaactggctgagttcgagttatgtgtccttggcaacctttgcccagaaactgtggaggaagctattgctatggttccatctatcaagacaagaggacgggcccaggatgatgaagcaattgagaaaatgttgaatgacttgtcattgattaagaaatttgaataaatatttcttacattacgagtgagatataacgttacttttaccatatcacgtcatctaactgcaagcaaaccattcttgtggattgtattacagaaaccctggataatatctagcattttgtgattctatacaagaaggatcttgacacatgcatgctggtgtatgaaagtgattttgacttgttatgataattacgtggatgtggttaaccatctatttatagcaagactgattattatgcattatgaggtcatagggtcatatgaaacttgatctatgtcttggttccta

SEQ ID NO: 3649 - DNA, 841 bp, Manihot esculenta
ggacccgtttctatttgtacccaaaaaaacgaaacaaacttaacggcaagtctccgtcttccttattgcaactctctctctctctcgaaaactgaaaagaaaaccctaatctgttcagtatgtctggagaagaagaagaaaatgcttctgagctcaaaattggagatgagtttttgaaggccaagtgcttaatgaactgtgaagtagcattaattcttgaacataagtatgagcagcttcagcagatgtctaatgatccaatgaaccaggtttctcaggtatttgagaaatcactgcagtatgtgaagcgatttagccgctataaaaatcctgatgctgtccgacaagttcgagaaattcttagccgataccagttggctgaattcgagctgtgtgtccttggcaatctttgccctgaaacggtggaggaagccattgccatggtgccttccatcaagacaaaaggacgggcccatgatgatgaggcaattgagaaaatgttgaacgacttatcattgatcaagaaattcgaatagccacctcaacgtcttctggccttctgaataggaactgttaatgccattctgagtgtagttttagtagctaccaaattctaaaatctgatcatgccgaatgaatgattcctacaatgattggcatggtcatggaatctagttctgtaattctgctgagtaactgtggcaacatgagaaattgtgctagaggtttgtttttcctttttcctttttgtcttgcatcctgaatttgcactccttcactattttgcaaatattattatctaaacctaaaccattctttcatcataacaagggttcctaac

SEQ ID NO: 3650 - DNA, 841 bp, Ricinus communis
ggacccgtttctatttgtacccaaaaaaacgaaacaaacttaacggcaagtctccgtcttccttattgcaactctctctctctctcgaaaactgaaaagaaaaccctaatctgttcagtatgtctggagaagaagaagaaaatgcttctgagctcaaaattggagatgagtttttgaaggccaagtgcttaatgaactgtgaagtagcattaattcttgaacataagtatgagcagcttcagcagatgtctaatgatccaatgaaccaggtttctcaggtatttgagaaatcactgcagtatgtgaagcgatttagccgctataaaaatcctgatgctgtccgacaagttcgagaaattcttagccgataccagttggctgaattcgagctgtgtgtccttggcaatctttgccctgaaacggtggaggaagccattgccatggtgccttccatcaagacaaaaggacgggctcatgatgatgaggcaattgagaaaatgttgactgacctgtcaatgatcaagaaattcgaatagccacctcaacgtcttctggccttctgaataggaactgttaatgccattctgagtgtagttttagtagctaccaaattctaaaatctgatcatgccgaatgaatgattcctacaatgattggcatggtcatggaatctagttctgtaattctgctgagtaactgtggcaacatgagaaattgtgctagaggtttgtttttcctttttcctttttgtcttgcatcctgaatttgcactccttcactattttgcaaatattattatctaaacctaaaccattctttcatcataacaagggttcctaac

SEQ ID NO: 3651 - DNA, 700 bp, Unknown
  Sequence found in Organisms: Citrus clementina, Citrus sinensis
acggacgatataaaaagcagcaactaaattctctctcatcctgaattttgaaaaacaaagccaagagctttcagaatgtctggagaagaagaagagaacgcggccgagcttaaaattggagacgagtttttgaaggccaagtgtttgatgaattgtgaagtagcaataattcttgatcacaagtatgagcagcttcagcagacttctgatgatcccatgaatcaagtttcccaagtgtttgagaaatcactgcagtatgtgaagcgctttagtcgctacaagaatcctgatgctgttagacaagtgcgagaaatccttagtagataccagttggctgaattcgagctgtgtgtacttggaaatctttgccctgagaccgtggaggaagccattgctatggtaccttctataaagaccaggggacgagctcacgatgacgaggcaattgagaaaatgttgaatgacttgtcactgataaagaaatttgagtaatcacagctggagctacctattgaagtttcttagggattaaaaaaaaaatgcattaggtattgtaatgtataaagtttgaatgcgagagagaatctatttactttattggtcagatattacgaggatcttgatgaaatcagatattacgaatatcttgttgaaatgagtttccaatcaaattgaagtgaaatgagttccaatcagatct

SEQ ID NO: 3652 - DNA, 763 bp, Coffea canephora
cggccggggggatctccaaaacgagctgattctcgccatcaaagttctgcatcaaaaccctttactccaaggttagtttaacttgggctaaatatgtcgggagaagaggaagagaacgccgctgagctcaagattggtgatgaatttttgaaggccaagtgtttgatgaattgtgaagtttccttaattcttgaacataagtatgagcagcttcagcagatgtcggaggatccaatgaatcaaatgtctcaagtatttgagaagtctctgcagtatgtgaagcgtttcagccgctacaagaatcctgattctgtcagacaagtccgagagattcttagcagataccagcttgctgaatttgagctttgtgtacttggtaatctttgcccagagactgttgaggaagctattgctatggtcccatcaatcaagaatagaggccgtgcccttgatgacgatgctattgagaagatgctgaatgacttatctctggtcaagaaatttgagtagaagaagtttgagcagcaacatctatctaggacagaaaggtcggtggtaaatgccagtggcatatcgtgctcatgtaaattctacattgatcttaaagtggagacagattttttgcttggctgcttaaattgggatgtagttgttgggattttcaaatcgattatgttttcatcttattttggacaattttcttgttcatttgaagaagaaatgtattctaatgtttaactacttcaaacctttgcaaaaaaaa

SEQ ID NO: 3653 - DNA, 838 bp, Vigna unguiculata
gtcattctttgatcgaccttcctcttcacacgttctttctgctcactgtttctgcgcatctgttccttctcacatacctgaaagtctctaaaacatgtctggggaagaggaagaaaacgccgcagagctcaaaattggagacgagtttttgaaggcaaagtgcttaatgaactgtgaagtttcattgattcttgagcacaagtacgagcagcttcaacagacatctgatgatcccatgaatcaagtttctcaggtatttgaaaagtcgttgcagtacgtgaagcgattcagccgctataaaaatccagatgctgttagacaagttcgagaaatacttgcaagatatcaattggctgagtttgagttgtgtgtccttggcaacctttgcccggaaactgtggaggaagctattgctatggttccatctatcaagacaagaggacgggctcaggatgatgaagcaattgagaaaatgttgaatgacttgtcattgattaagaaatttgaataaatatttcttacattgggagtatgatataacgttacttataccatatcacgtcacctgatgcaagcaacacattcttgtggtttgtattacagaaaccctggataatatctagttttttgtgactatctaagaaggattttgacacatgcatgctggtgtatgaatgtggctttaacttgttatgtggttagtgtgttgctgtagccctctgtttatagcaagactgattattatacattaagtggtcacagtggtaaatgaaacttgatgtaagtcttggttcctacaaatgtacatgtcctagaagttaacaaaaaaaaaaaaaaa

SEQ ID NO: 3654 - DNA, 831 bp, Cyamopsis tetragonoloba
cacgaggggcgctgaatcaatagaaggtaattgccgactgagaattcccttcttcaacctgcaacgcgggaagtttccgactaacgctcgtgctctctactctccgattcgattctgcggaaaacatgtctggggaagaggaagaaaacgctgcagagttgaaaatcggagatgagtttttgaaggcgaagtgcttgatgaactgtgaagttgcactgattcttgagcataagtatgagcagcttcagcagacatctgatgatgccgtgaatcaaatttcccaggtatttgagaagtcattgcagtatgtgaagcgtttcagccgctataagaatcctgatgctgttagacaagttagagaaattctagcaagataccagttgacagagtttgagctgtgtgtccttggcaatctttgcccggaaactgtggaggaagctattgctatggttccttctatcaagacaaggggccgggctcaggatgatgaagcaattgagaagatgttaaatgatttatcactgattaagaagtttgaatagaagtttcttccaactgccaccaattatggatgttccttgaatgcacaacatgctatattttcctatgttgagtctgatttaattggtgctctataaaaatcactgtactgcaggcaaacgtgttttgagtttctattactgaattcgtcagtagtaactatagccagattattttgacttctaactgggatttgacaaagatgcatgccagtctatgagattcctgtgacctgttaatgatgatgttgtaaaattacatgtgttgctgtatccttctatttaaaaaaaa

SEQ ID NO: 3655 - DNA, 688 bp, Glycyrrhiza uralensis
aggcccgaggtttggtttcccccagaaagcccaaaaaaagaacaaactgtatcgtcggaaagtggcagggagtaatcgttttcgtgagacatgtctggggaagaggaagaaaacgctgcagagctcaaaattggagacgagtttttgaaagcaaagtgcttgatgaactgtgaagtttcattaattcttgagcacaagtatgagcaacttcagcagacgtctgatgatcccatgaatcaagtttctcaggtatttgaaaagtcattgcagtatgtgaagcgtttcagccgttataaaaatcccgatgctgttagacaagtccgagaaattcttgctagatatcagttggctgagtttgagctgtgtgtcctaggcaatctttgcccggaaactgtggaggaagctattgctatggttccatctatcaagacaagaggacgggctcaggacgatgaagcaattgagaaaatgttaaatgacctctcactaattaagaaatttgaataagggtttcttccgattcccataaattatggttactcctgtgttgtgatgtaagttgtatactgtataacacatgcaaacaaacatgttttgtggtttctattacaaaatttgtcattggtaatatagtagcttattgtgacttttatcaagaaggagcatttgactgatgcgtgctggtgta

SEQ ID NO: 3656 - DNA, 668 bp, Lotus japonicus
gcttctctctttggattcaattcgattctgttctctgaaacatgtctggggaagaggaagaaaacgccgcagaactcaaaatcggagacgagtttttgaaggcaaagtgcttgatgaattgtgaagtttcattgattcttgagcacaagtatgagcagcttcaacagtcatctgatgatcccatgaatcaagtttctcaggtatttgaaaagtcattgcagtatgtgaaacggtttagccggtataaaaatcctgatgctgttagacaagtccgagaaattcttgccagataccaattggccgagtttgagctgtgtgtcctaggcaatctttgcccggaaactgtggaggaagctattgctatggttccatctatcaagacaagaggacgggctcaggatgatgaagcaattgagaaaatgttaaatgacctatcactcattaagaaatttgaataaatgtcttgcaattgtaattggtactgtgtaacaataacatctcacttgcttgtaagcaaacgtgtttttccttgattctattacggaagtcatcactggtaatttttgttttgtgacttatatcaagaatggtttgacagagatgtgtgttgatgtatgagattgtctccaacctgttatagtgtaatgaagtaattgtgattattgtct

SEQ ID NO: 3657 - DNA, 827 bp, Glycine max
gtgataccgactttcatccgggcggagagtgcaatacttatagtctccctgtcctgaaacgcagagcattcaacatctcgcaaaactattcaaaaccagacacacacacaaacaaacgctgaatctctcgtcgttctttttatttgcggtttcttcttcttctcacgttctacctaacattttctaaaacatgtctggggaagaggaagaaaacgccgcagagctcaaaattggagacgagtttttgaaggcaaagtgcttaatgaactgtgaagtttcattgattcttgagcacaagtatgagcagcttcaacagacatccgatgatcccatgaatcaagtttctcaggtatttgaaaagtcactgcagtatgtgaagcgtttcagccgctataaaaatcctgatgctgttagacaagttcgagaaattctcgcaagatatcaattggctgagtttgagttgtgtgtccttggaaacctttgcccggaaactgtggaggaagctattgccatggttccatctatcaagtcaagaggacgggctcaggatgatgaagccatcgagaaaatgttaaatgacctgtcattgattaagaaatttgaataaatacgcagagtgtgtgatatagtgttgttggtaccgtataacatatcacttgactgcaagcatacattcatgtggtttgtattacagaaaacccttggtaattatatttagtagtttattttgtgacagttatcaataaggattttgacacatggtgctggtgtatgttatgataattatgcgaatgtgatagcaatctggactcagatgctaatcgcag

SEQ ID NO: 3658 - DNA, 1091 bp, Glycine max
ggcgtgataccgactttcatccgggcggagagtgcaatacttatagtctccctgtcctgaaacgcagagcattcaacatctcgcaaaactattcaaaaccagacacacacacaaacaaacgctgaatctctcgtcgttctttttatttgcggtttcttcttcttctcacgttctacctaacattttctaaaacatgtctggggaagaggaagaaaacgccgcagagctcaaaattggagacgagtttttgaaggcaaagtgcttaatgaactgtgaagtttcattgattcttgagcacaagtatgagcagcttcaacagacatccgatgatcccatgaatcaagtttctcaggtatttgaaaagtcactgcagtatgtgaagcgtttcagccgctataaaaatcctgatgctgttagacaagttcgagaaattctcgcaagatatcaattggctgagtttgagttgtgtgtccttggaaacctttgcccggaaactgtggaggaagctattgccatggttccatctatcaagtcaagaggacgggctcaggatgatgaagccatcgagaaaatgttaaatgacctgtcattgattaagaaatttgaataaatacgcagagtgtgtgatatagtgttgttggtaccgtataacatatcacttgactgcaagcatacattcatgtggtttgtattacagaaaacccttggtaattatatttagtagtttattttgtgacagttatcaataaggattttgacacatggtgctggtgtatgttatgataattatgcgaatgtgatagcaatctggactcagatgctaatcgcaggcccaaaagaattattaaagggccacaagggtgggaagagtttgttcactaaagcatcagaccatcacctgaattctgttagtagtgggatcaatatttgttagtggtatctcttagtggctgtccccctagtgcttagccattctgttatgcttgtttcgttttttattattatgttattgttgtcctcatcctattagcaaatgtaagcctacaaatagtgagatatcaatgaaaggggagaattagcaagctaaaatc

SEQ ID NO: 3659 - DNA, 1014 bp, Trigonella foenum-graecum
cgagtgcagtgctgtctttaaaacgctgcgtttaacgttctccaaaatcccaactgaacaacacaaaactcctctcactgtttcgattctggttcgttcgttgcaccgtttctttcttcttcgcaatttcgaaaattactgattctgttctaacctaactcaattattcatctgaaggagtgaatcatgtctggcgaagaggaagaaaacgccgctgaactcaaaatcggagacgagtttttgaaagcaaagtgcttgatgaactgtgaagtttcattaattctggagcacaaatatgagcagcttcagcagtcgtccgatgatcccatgaatcaagtttctcaggtatttgaaaagtcattgcagtatgtgaagcgttttagccgctataaaaatcctgatgctgttagacaagttcgagaaattcttgctagatatcagttggctgaatttgagctgtgtgtcctaggcaatctttgcccggaaactgtagaggaagctattgctatggttccatctatcaagacaagaggacgggctcaggatgatgaagcaattgagaagatgttaaatgacttgtcattgatcaagaaatttgaataaaagtttctttcaattctcgtactgtaagcggtactgtataacatatcacttgacagcaagcaaatgtgttctgtagttatttcagaactcatattggtaatatacccgtgacttttatcgaggaggatttggtagagatgtttgacggtgcatagactgtctgtggtatgttatgaacttatgatgaaagaacactaattattgttttgcttgtattctcctatgtacaacaaaataggggtttttatacttttgctggtgacaggattagagaacactttgtacaagcgccggtttctatttcgtacaaattgtctagaaactatagagatacacttcatgcaaatgaatgaacctatctgctagatattagatgtagccacctaagagcacacattatcatttacatgt

SEQ ID NO: 3660 - DNA, 1409 bp, Cicer arietinum
gtttttatacaaatttatgtaaactgaaaattagaaatcctaatttttttaaaataattccaaaattgagaatccctaattaaaatatttctccccttctatcatcgtcgtatctcttccaaacgaggcttctgttcctcctcctccaacgccgagtttaacagttcacgaaatccaaactagggttctgttccccgtgctcaacgaaacaaaatcggagacggtaatcgcctgaaaccagcatagtaactgaatcgtaatcttctaaaaaatgtctggggaagaggaagaaaacgccgcagagctcaaaatcggagacgagtttttgaaagcaaagtgcttgatgaactgtgaagtttcgttaattctggaccacaaatatgagcagcttcagcagtcgtctgatgatcccatgaatcaagtttctcaggtatttgaaaagtcattgcagtatgtgaagcgtttcagtcgctataaaaatcctgatgctgttagacaagttcgagaaatccttgctagatatcagttggctgagtttgagctgtgcgtcctaggcaatctctgcccagaaactgtggaggaagctattgctatggttccatctatcaagacaagaggacgagctcaggatgatgaagcaattgagaagatgttaaatgacttatcattgattaagaaatttgaataatagttctgtctctcgtaaatcacgggtttttctgcgatgtaatgtaagtggtactatataacatatcacttgactgtaaacacgcatgtgtttggttattacaaaactcttcatggtaatatagatactttaccatgacttttatcgactaggatttgatagagatctgtgatagtgcatgagactgtctgcgacatgttacaaagatgaaaaaaacatgattattgtcttgctgtgtatcctcctatatataagggattattttgttatacttttcctagtgacagggttagagaatgttttgtacaaacactggttccatgtacaaataaaagtccaccttccgttttatcaaagatagagtttggaagtgtatcgatgcatggcgttgaaaatctctatggttcgatcttattcctccttttctgggtgattatattcaaaaaaagctaactcattttggccgagttctaaatctaaaggttctcacagaattaattggcactctcttggaatggtatgagcattagaaatatctatgcatgaaaaataaggtttggctttcacgggaaaactttattatacttttctagaattttcaagacaatgtattacactcttcaatggccagctttcccttgatctgaaacaatgctcattaaggaaatagccaatcacattaatcgatttcatgtttgaatccacttggttaggtgatgac

SEQ ID NO: 3661 - DNA, 1296 bp, Cicer arietinum
gcattttcaatggttctccttgaattcttgtcacgaaaaacacaatttattataaaagatagcattacatgatatatcttctgtgagctttttatatggaaatgagactaggatacaatttaaggatatggatggatttatttattagaaattaaatttatcaaacatttagaaaataaataaattaatttatcaaacattcagttataagtcatccgcttatcaatctaaaattggatctaacaggagtgccattttgcttctttgtttcgctcaacggatcagctgtcattggttgtgttagatactcgaacgcggtggcggcggaaggcgactgttcgagacggtaatcacctgaaatcaccagaggactgaatcgtaatcttctaaaaaaatgtctggtgaagaggaagaaaacgccgcagaactcaaaatcggagacgagtttttgaaagcaaagtgcttgatgaactgtgaagtttcgttaattctggatcacaaatatgagcagcttcagcagtcgtctgatgatcccatgaatcaagtttctcaggtatttgaaaagtcattgcagtatgtgaagcgtttcagccgctataaaaatcctgatgctgttagacaagttcgagaaatccttgctagatatcagttggctgagttcgagctgtgcgtcctaggcaatctctgcccagaaactgtggaggaagctattgctatggttccatctatcaagacaagaggacgagctcaggatgatgaagcaattgagaagatgttaaatgacttatcattgattaagaaatttgaataatagttttgtctcttgtaaatcacaggttttcctacaatgtaatgtaagtggtactatataacatatcacttgactgcaagcacacatgtttcgtggttattacaaaacttgtcatggtaatatagatactttaccatgacttttatcgactaggatttgatagagatccgtgatggtgtatgagactgtctgtgacatgttacaaagatgattaatgtgattggcgagttaatatggtggtatgagcattttaaaggtaatgtattacactcttcaatggtcagcttcccttgatatgcaacaatgcatattgaaagactgtaaggtaatagccaatcacattaatccatctcatgtttgaatccacttagtgagctgatgaccaccactttctttgattattaaaaaaatcccacaagttctttgctttttttttgttgtggttcaaaagttttttacttatatatatattaaaatttatagac

SEQ ID NO: 3662 - DNA, 545 bp, Bruguiera gymnorhiza
gaacaaggtgttttttatgtgtagtgtaggtatcgatatttctatactcaattctcacagtcctctggcttgaaaattagggttttgttcgatcaacgactgcccttgcagccaattagtggtgaacggaagagggtatgtcgggagaagaagaagaaaatgcggctgagctcaaaattggagacgagtttttgaaggctaagtgtttgatgaattgcgaagtagcactaattctcgagcacaagtatgagcagcttcagcagatgtctgatgatccaatgaatcaggtctcccaggtatttgagaagtcactccagtatgtaaagcgctttagccgctacaaaaaccctgacgctgtcagacaagttcgagaaattcttagccgatatcaattggctgaatttgagctctgtgttcttggtaacctttgtcccgaaactgtggaggaagctattgctatggtaccttctatcaagtcaaaaggacgggcccatgatgatgaggcggtcgaaaaaatgttgaacgacctgtcattgatcaagaag

SEQ ID NO: 3663 - DNA, 1021 bp, Cicer arietinum
aagaaaacgccgcagacatttttaaataatttctccccttcctatcatcgtcgtatctcttccaaacgaggcttctgttcctcctcctccaacgccgagtttaacagttcacgaaatccaaactagggttctgttccccgtgctcaacgaaacaaaatcggagacggtaatcgcctgaaaccagcatagtaactgaatcgtaatcttctaaaaaatgtctggggaagaggaagaaaacgccgcagagctcaaaatcggagacgagtttttgaaagcaaagtgcttgatgaactgtgaagtttcgttaattctggaccacaaatatgagcagcttcagcagtcgtctgatgatcccatgaatcaagtttctcaggtatttgaaaagtcattgcagtatgtgaagcgtttcagtcgctataaaaatcctgatgctgttagacaagttcgagaaatccttgctagatatcagttggctgagtttgagctgtgcgtcctaggcaatctctgcccagaaactgtggaggaagctattgctatggttccatctatcaagacaagaggacgagctcaggatgatgaagcaattgagaagatgttaaatgacttatcattgattaagaaatttgaataatagttttgtctcttgtaaatcacaggttttcctacaatgtaatgtaagtggtactatataacatatcacttgactgcaagcacacatgtttcgtggttattacaaaacttgtcatggtaatatagatactttaccatgacttttatcgactaggatttgatagagatccgtgatggtgtatgagactgtctgtgacatgttacaaagatgattaatgtgattggcgagttaatatggtggtatgagcattttaaaggtaatgtattacactcttcaatggtcagcttcccttgatatgcaacaatgcatattgaaagactgtaaggtaatagccaatcacattaatccatctcatgtttgaatccacttagtgagctgatgaccaccact

SEQ ID NO: 3664 - DNA, 858 bp, Gossypium hirsutum
aaaccccagacatcataaatctcaaacttcaaaaccttcatttctaaattggttattgaaaaccaaaaaaaaaaacagtttccttctgccttgggactgaaagagagcatttctaataatgtctggcgaagaggaagaaaacgcagctgagctcaaaattggagaagagtttttgaaggcgaagtgtttgatgaattgtgaagtggctctaattcttgagcataagtatgagcagcttcagcaaatgtctgacgatcccatgaatcaagtttcccaggtattcgagaagtcactgcagtatgtaaaacgcttcagccgttataaaaatccagatgctgttagacaagttcgagaaattttgagtagatatcagttagctgaattcgagctatgtgttcttggcaacctgtgtcctgaaactgtggaggaagcaatcgctatggtgccttccatcaagactaaaggacgggctcacgacgacgatgccatcgagagaatgctaaatgacttgtcccttatcaagaaatttgaatagtggccgctaaattactggctgtctatgacactgaagacattaatagaatgttgaatgccctttctcttacaaaatatacatttttatctattttacccatgtgacccaaaaatcttagtgtgttgaatggtttatgttctgtaaatttctcattaaggtgctgcaaatccgcatgtctgaaaacggcttttgctatttattccggtgatttttttggtttttaagttgtatactcatattttatgagtgattttgctgaggagtaccaattaccatgatctaaattttgtttccatcaaatataatcgttgcatttaatactc

SEQ ID NO: 3665 - DNA, 1023 bp, Gossypium hirsutum
ggcacgagcttataacaagtaaatcttacaaaagctttcactaattttcttgttagcctacggcggaaggtccttatattcacgttgttcactatttatttatttaaattttgaacttaactcctatttggacttgtttgatatatatatatatatatatagaatagatagtcttacgtaacctagaaactcaaaatcaaatttaggttttctccgacttcacgcatcgaaatcaagcagacgaaaaccatctttgtctaataatgtctggcgaagaggaagaaaacgctgctgagctcaaaattggagaagagtttttgaaggcgaagtgtttgatgaattgtgaagtggctttaattctcgagcataagtatgagcagcttcagcaaatgtctgacgatcccatgaatcaagtttcccaggtattcgagaagtcactgcagtatgtaaaacgctttagccgttataaaaatccagatgctgtgagacaagttcgagaaattctgagtagatatcagttagctgaattcgagctttgtgttcttggcaacctgtgtcctgaaactgtggaggaagcaatcgctatggtgccttccatcaagactaaagggcgggctcacgacgacgatgccatcgagagaatgctaaatgacctttcccttatcaagaaatttgaatagtggccgctaaattactggctgtctatgacactgaagacatgaatagaatgttgaatgccccgtctcatataaaatatacatttttatctattttacccatgtcagtttgagattgacctaaaaagttgtagtgtgtcgaatggtttacgttctgtaaatttctcattaaggtgttgcaaacccgcatgtctgaaaacggcttttgctgttcattctcgtgattttttgtaagtttatactcttatgattgatctaattttttttcttcaaatgtaataattgcatttaatactatattgttgtaatatgtatattaattagtgaggtgaaaatgtgagttgaa

SEQ ID NO: 3666 - DNA, 712 bp, Cucurbita pepo
ttgaaaacgaagaaccgccctctctgtttttgccgtcacgtcttgccgccggatctcgcccctaaccctctctgtgtttgtggtagtccaaaactccaacttcaggcatgtctggagaggaggaagaaaatgctgcagagcttaaaattggggatgagttcttaaaagctaagtgtttaatgaattgtgaagtttctttgattcttgaacacaagtatgagcagcttcaacaaatgtctgaggatccaaccaatcaagtttctcaagtgtttgaaaagtctctgcaatatgtgaaacggttcagccgctataagaaccccgatgctgttagacaagtccgagaaattctaagcaggtatcagttggctgagtttgagctctgtgttcttggcaacctttgccctgaaactgtggaggaagctatttccatggttccatctttgaagactaaaggaagagcacatgacgatgaagcaatcgagaagatgttgaacgatctttcattaatcaaaaagttcgagtagttagctctctaaatctggttaaatgtgttaatccattccttggcatttctcacctaaaacaatagagaattgtacccttctaatcagagtctaataataagtttttaggcatgtacctaaacgttcaattttattgcttatagatcgctaatactctgttcgatgactatgctattagacacttcttg

SEQ ID NO: 3667 - DNA, 681 bp, Cucurbita pepo
tgagttgaaaacgaagaaccgccctctctggttttgccgtcacgtcttgccgccggatctcgcccctaaccctctctgtgtttgtggtagtccaaaactccaacttcaggcatgtctggagaggaggaagaaaatgctgcagagcttaaaattggggatgagttcttaaaagcaaagtgtttaatgaattgtgaagtttctttgatccttgaacacaagtatgagcagcttcaacaaatgtctgaggatccaaccaatcaagtttctcaagtgtttgaaaagtctctgcaatatgtgaaacggttcagccgctataagaaccccgatgctgttagacaagtccgagaaattctaagcaggtatcagttggctgagtttgagctctgtgttcttggcaacctttgccctgaaactgtggaggaagctatttccatggttccatctttgaagactaaaggaagggcacatgacgatgaagcaatcgagaagatgttgaatgatctttcattaatcaaaaagttcgagtagttaatccattccttggcatttctcacctaaggcactagagaattgtacccttctaatcagagtctaataataagttttaggcatttacctaaacgtccaattttattgcttatagatcgctaatactctgttcgatgactatgctattagata

SEQ ID NO: 3668 - DNA, 661 bp, Fraxinus spp
gccgggggagagagtgagatttaagaacattcaaagaatgtctggagaagaagaagaaaacgccgccgaactcaaaatccccgatgagtttttgaaggcgaagtgtctcatgaactgtgaagttgctctaattcttgaacacaagtatgagcagcttcaacagatgtctgaggaccctatgaaccaaatatctcaggttttcgagaagtcactccaatatgtgaagcgcttcagccgttataagaaccctgatgctgtcagacaagttcgagaaattctcagtcgatatcagctggctgaatttgagctttctgtacttgggaacctttgcccagaaacagtagaggaagctcttgccatggtcccgtctatcaagactcgaggacgagctcatgatgacgacgcaatcgaaaaaatgctcaatgatctctcattgatcaagaaattcgaatgagtgtcattttcctctgtaatttggtctgaaatacctttctaatgacagttttatgtttagtctatttcaatggctaatgtgccattgaagataagataatacttgtctctttcttgacaatacttcccaaggaaaatattgaattaaattcggagatttccaaataggacgatcttttcatcatctataaaatgattatctataaga

SEQ ID NO: 3669 - DNA, 945 bp, Gossypium raimondii
agtaaattatatttttttaagtagaaaattaaaaatccattgaaaatctcaattcgattcgaaaccctaaatctcaatcccatttcaaaccccagacatcataaatctcaaacttcaaaaccttcatttctaaattggttattgaaacccaaaaaaaaaaaacagtttccttctgccttgggactgaaagagagcatttctaataatgtctggcgaagaggaagaaaacgcagctgagctcaaaattggagaagagtttttgaaggcgaagtgtttgatgaattgtgaagtggctctaattcttgagcataagtatgagcagcttcagcaaatgtctgacgatcccatgaatcaagtttcccaggtattcgagaagtcactgcagtatgtaaaacgcttcagccgttataaaaatccagatgctgttagacaagttcgagaaattttgagtagatatcagttagctgaattcgagctttgtgttcttggcaacctgtgtcctgaaactgtggaggaagcaatcgctatggtgccttccatcaagactaaaggacgggctcacgacgacgatgccatcgagagaatgctaaatgacttgtcccttatcaagaaatttgaatagtggccgctaaattactggctgtctatgacactgaagacattaatagaatgttgaatgccctttctcttataaaatatacatttttatctattttacccatgtgacccaaaaatcttaagtgtgtcgaatggtttatgttctgtaaatttctcattaaggtgctgcaaatccgcatgtctgaaaacggcttttgctatttattccggtgatttttttggtttttaagttgtatactcctattttatgagtgattttgctgaggagtaccaattaccatgatctaaattttgtttccatcaaatataatcattgcatttaacact

SEQ ID NO: 3670 - DNA, 1056 bp, Gossypium raimondii
ctcataacaagtaaattttacaaaagctttcactaattttcttgttagcctacggcggaaggtccttatattcacgttgttcactatttatttatttaaattttgaacttaactcctatttggacttgtttgatatatatatatatatatatagaatagatagtcttacgtaacctagaaactcaaaatcaaattttaggttttctccgacttcacgcatcgaaatcaagcagacgaaaaccatctttgtctaataatgtctggcgaagaggaagaaaacgctgctgagctcaaaattggagaagagtttttgaaggcgaagtgtttgatgaattgtgaagtggctttaattctcgagcataagtatgagcagcttcagcaaatgtctgacgatcccatgaatcaagtttcccaggtattcgagaagtcactgcagtatgtaaaacgctttagccgttataaaaatccagatgctgtgagacaagttcgagaaattctgagtagatatcagttagctgaattcgagctttgtgttcttggcaacctgtgtcctgaaactgtggaggaagcaatcgctatggtgccttccatcaagactaaagggcgggctcacgacgacgatgccatcgagagaatgctaaatgacctttcccttatcaagaaatttgaatagtggccgctaaattactggctgtctatgacactgaagacatgaatagaatgttgaatgccccgtctcatataaaatatacatttttatctattttacccatgtcagtttgagattgacctaaaaagttgtagtgtgtcgaatggtttacgttctgtaaatttctcattaaggtgttgcaaacccgcatgtctgaaaacggcttttgctgttcattctcgtgattttttgtaagtttatactcttatgattgatctaatttttttttcttcaaatgtaataattgcatttaatactatattgttgtaatatgtatattaattagtgaggtgaaaatatgagttgaaacatcgaatcatgatcaattgatctaatttttattgagg

SEQ ID NO: 3671 - DNA, 842 bp, Heritiera littoralis
gaaccgacaaacatattactcgctcctataaaagtttgatctatgttatctgcaagtttagatacaaattaaaactcaacaccagaatttaggtttgtgcctctttgctaactgctctcatcaaattcaagcaagtaagaggtaaaaattaagcagacaaaaccctcgtctaattatgtctggcgaagaggaagaaaacgctgcggagctcaaaattggagaagagtttttgaaggcaaaatgcttgatgaattgtgaagtggctttgattcttgagcataaatatgagcagcttcagcaaatgtctgatgatcccatgaatcaggtttcccaggtatttgagaagtcgctgcagtatgtaaagcgctttagccgttataaaaatccagatgctgttagacaagttcgagaaattctgagtagatatcagttagctgaatttgagctttgtgttcttggcaacctatgtcccgaaactgtggaggaagcaattgctatggttccttccatcaagactaaaggaagggctcatgatgatgatgccatcgagagaatgttaaatgacttgtctcttatcaagaaatttgaatagtgacaactaccttattgactgtattttagcaggctcatgcaaatgagactatcaagaggaagttcaacgcccgtctctaattaacaaatctctattgaggtcattatattttaattacccatatcaatagtgtttgaaattgtggtacaatcaatttggatttactgttgcgaaatggtctatgttttgtaatagtctcattaaggtacgacaatcatacgtctaggaaaaagctttagctttgccttag

SEQ ID NO: 3672 - DNA, 678 bp, Carpinus betulus
agaccgaagcctcggcaactgccaccaggtttcgttcatttttcatcaattggataaagtttcagtttggtcctcaaaatgtctgcggaagaggaagagaatgctacagagctgaaaatcggagacgagtttttgaaggccaagtgtttaatgaattgtgaagttgctttgattcttgaacacaaatatgagcagcttcaacaaatgtcagaggatccactgaatcaggtttcccaagtgtttgaaaagtcactgcagtatgtgaagcgctttagccgctataaaaatcctgatgctgttagacaagtgcgagaaatcctcagtagatatcaattggctgagttcgagctttgtgttcttggcaacctttgccctgaaacagtggaggaagctattgctatggtaccatctattaagaccaaaggacgggctcatgatgacgaggcaattgagaaaatgttgaatgacctgtcacttattaagaaatttgaatagagtataagtactcctgcactccagatgtttttctattatatttgaattcagttgtaatatctgccatccaataccgcaaattctcagaagggtcggtaggggggggacttcgatgatttgtgtggactcaccctcttaccatatctagtttgttcggctacgtacctttctggttttgtaggg

SEQ ID NO: 3673 - DNA, 1067 bp, Medicago truncatula
ggtagctttataaacgctgcgtttaacgttgtctaaaatccaaaacgagtgttactttcttcccaggtgaacgacacaaagccctcaacttctctcaccgttttgattctgcagaagaaggagtgaatcatgtctggtgaagaggaagaaaacgccgctgaactcaaaatcggagacgagtttttgaaagcaaagtgcttgatgaactgtgaggtttcattaattctggaacacaaatatgagcagcttcagcagtcgtctgatgatgccatgaatcaagtttctcaggtatttgaaaagtcattgcagtatgtgaagcgtttcagccgctacaaaaatcctgatgctgttagacaagttcgagaaattcttgcgagatatcagttggctgaatttgagctgtgtgtcctaggcaatctttgcccggaaactgtagaggaagctattgctatggttccatctatcaagacaagaggacgggctcaggatgatgaagcaattgagaagatgttaaatgacttatcactgattaagaaatttgaataagagtttcttacagttcttgtaaatcatggtcagttctgtgatgtacggtaagtggtactgtataacataccacttgacagcaaacaatgtgttttgtagttattgcagaactcatgctggtaatatagctaccttactgtgacttttattgaggaggatttgaaaaagatggtatgtggtgcattgagactgtgtgtggtaggttatgaacttatgatgaaagaacactgattattgtcttgcctgtattctcctatatgcaacaaaaggggagctattatttttttgcttgtgacatgattagagaacacattacacacaccggttcctatttcctacaaatgtgtgataattgtctagaaactaaagagatacacttaatgcaaattaccgaaccctatcttctaggatattagatgcagacacatgagctcacattattatttagatatgaaaattttcctaaaatgaaaatggattgtgttttttgatccttcttcaaactacaaacaacattttgt

SEQ ID NO: 3674 - DNA, 674 bp, Momordica charantia
ttttctgatctcgccggctctcttttcgccgtctcgtctcgccgccggatatcgtaccgtagtcatctctgtgttttgtgattctttagattgacgcgaaatccaaatttcaagtatgtctggagaggaggaagaaaatgcggcggagcttaaaattggggatgagttcttgaaagccaagtgtttaatgaattgtgaagtttctttgatccttgagcacaaatatgagcagcttcagcagatgtctgaggatccaatgaatcaagtttctcaagtgtttgaaaagtcattgcagtatgtgaaacgcttcagccgctataaaaatcctgatgctgttagacaagtacgagaaattctgagcaggtatcagttggctgagtttgagctctgtgttcttggcaatctttgccctgaaactgtggaggaagctattgccatggtaccatccttgaagactaaaggaagggcacatgatgatgaagcgatcgagaagatgttgaacgatctttcgttgatcaaaaagtttgagtagttattttctaaggcgaggccaaatatgtttaaaatccctgctctttttcctttttccgcttaaaacagtggagaattgtacctttcttctatgattctatcattgatattatgattttatgggtaggtttgtacttgtgaat

SEQ ID NO: 3675 - DNA, 552 bp, Olea europaea
cgctagattttaactatcaacaatgtctggagaagaagaagaaaacgccgccgaactcaaaattcctgatgagtttttgaaggctaagtgtctgatgaactgtgaagttgctctaattcttgaacacaagtatgagcagcttcagcagatgtctgaggatccgatgaaccaaatatctcaggtttttgagaagtcacttcaatatgtgaagcgcttcagccgttataagaatcctgatgctgtcagacaagttcgagaaattctcagtcgatatcagctggctgaattcgagctttctgtacttgggaacctttgcccagagacggtggaggaagctcttgccatggtcccatctatcaagactcgaggacgagcacacgatgacgacgcgattgagaaaatgctgaatgatctctctctaatcaagaaattcgaatagttctttgtaatgtaatttggtctgaaatatttggggcttccatttctagtattgctgtaaaacaggtttgtggatctttcattcaccttcctaatgtgcatgtttggtagcac

SEQ ID NO: 3676 - DNA, 577 bp, Olea europaea
aactatcaacaatgtctggagaagaagaagaaaacgccgccgaactcaaaattcctgatgagtttttgaaggctaagtgtctgatgaactgtgaagttgctctaattcttgaacacaagtatgagcagcttcagcagatgtctgaggatccgatgaaccaaatatctcaggtttttgagaagtcacttcaatatgtgaagcgcttcagccgttataagaatcctgatgctgtcagacaagttcgagaaattctcagtcgatatcagctggctgaattcgagctttctgtacttgggaacctttgcccagagacggtggaggaagctcttgccatggtcccatctatcaagactcgaggacgagcacacgatgacgacgcgattgagaaaatgctgaatgatctctctctaatcaagaaattcgaatagttctttgtaatgtaatttggtctgaactatttggggcttccatttctagtattgctgtaaaacaggtttgtggatctttcattcaccttcctaatgtgcatgtttggtagcacttaaaaaattacttttatagaaaataaatctagaaa

SEQ ID NO: 3677 - DNA, 969 bp, Arachis hypogaea
ccttattagatcctctctctctctctctctctctctctctctcacacaccacaccgaggcctctctccagtttcgccgccaacacccttctttcgccgccgctctgacctccccggcgccggtgtgttctctctcgtgccgctagggcatcctcttgcgctctctcaacttgctccttcaggggaatcagttttttgcctgaaacatgtctggggaagaggaagaaaatgctgccgaactgaaaattggagatgattttttgaaggcgaagtgtttgatgaattgtgaagtttcgttgattcttgagcataagtatgagcagcttcaacagacttctgatgatcccatgaatcaagtttctcaggtatttgaaaaatcattgcagtatgtgaagcgctttagccgctacaaaaatcctgatgctgttagacaagtccgagaaattcttgcacgatatcaattggctgaatttgagctgtgtgtccttggtaatctctgcccagaaactgtggaggaagctattgctatggttccatctataaagactagaggaagggcgcaggatgatgaagccattgagaaaatgttaaatgacctatcgttgattaagaaatttgaatgaaaatctgttccaattggcaatagatctcagttacccccttgtcaatgcacaatgttgatcatggcgtagttttgctgttactgcatatggtatcacttgacctatgtcgagcaaactttttgtaatttacattatgaaactcatcactagtaattataggctatagctattttgtttttaccgtggatcctaatcctatggtaagtggagtgattgaatgacccttttataatatatatagattgccctactttgtgtaattcgttcctgattctcgtcttatagaacttcgtttcgatgtcacgttactaaagttgacccttaatatttacagatttgtctcgcat

SEQ ID NO: 3678 - DNA, 674 bp, Petunia hybrida
atttatatatttcaaagaatactcaaaactctttttcttaaaacctgaatttgaagcgtaattacaccttggaaacttgctaacatgtctggagaagaagaagaaaacgcagcggagctcaaaatcggtgaagagtttttgaaggccaagtgtctaatgaactctgaagttgcgttgattcttgaacacaagtatgagcagattcagcagatgtctgatgatccaagcaatcaagtttcccaagtgtttgagaagtcactgcagtatgtgaagcttttcagccggtacaagaaccctgatgccgttcgacaagttcgagaaatccttagcagatatcaacttgctgaattcgagctgtgtgttctggggaacctttgtccatataccgttgaggaagctattgccagggtcccatctataaagaatagaggccgcacgcttgatggggaggcaatcaagaaaatgctgaatgatctctccctcataaagaagtttgaatagtgtcatttaggatggtcctatcttttatatctgcattttctctcttaagtaattctgcatctacttgtacaaatcagctatcaagttaattttcgtggttcatacctgcttttttaaccaaatttctcccagtcgtaaatagtaactacggtagatcatggatgtttaagtgt

SEQ ID NO: 3679 - DNA, 745 bp, Lippia dulcis
agaaaaaaaaagagcgaaatgaaaaattcgcgtccccgtcctatattcagaaggtcagctgcgaatttgatcccaaataatagaaccccctaacccagaccccactacaaaatttaagaattgaatcacttccatccctcttccgattagatttttgttaggaaaattgaagatgtcggcggaagaagaggagaacgccgctgagctcaaaatacccgatgaatttttgaaggccaaatgtcttatgaactgtgaagtttcccttatacttgaacataaatatgagcagcttcagcagatggccgatgatccaatgaatcagatgtctcaagtgtttgagaaatcgctccaatatgtgaagcggtttagccgatacaagaaccctgatgctgtcagacaagttcgagaaattcttagcagatatcagttggctgagttcgagctctgtgtacttgggaacctttgtcccgaaacagtggaggaagctatagccatggttccgtccatcaagaccagaggaagagcgcatgacgatgaggcaattgagaagatgttgaacgatctctccttgatcaaaaaatttgagtagtcttcattttattgtaagcatatgacattaagttgtggccataaaattacatattttagggaagccgatgattgcaatttcttattttgaatccggcttgaaatattatgttgtatgctttgataataggattctgactagagttcagttccatca

SEQ ID NO: 3680 - DNA, 662 bp, Helianthus annuus
gcggctcatatacagcgatcaaggctcaagttatcgatcagtatgtctggagaagaagaagagaatgctgcagagctgaagataggcgatgagtttttgaaggccaagtgtttaatgaattgtgaagtctccttgattcttgaacacaaatacgagcagcttcagcagatgtctgaagatccaacgaatcaagtttctcaagtgtttgagaagtccctgcaatatgtgaagcgtttcagtcgctacaaaaatccagatgccgttagacaagttcgagaattactgagtcgctaccagttagcagaattcgagctttgtgttcttggaaacctatgccctgaaactgtggaggaagccattgctatggttccgtctatcaagtcaaggggacggggacatgatgatgaagccattgagaaaatgctgaatgacatgtctttgattaagaagtttgagtagtttgtttctgtcctcatatttccaaaggttctgatgttggcatttttaagtgattgatttgtattaagtgcattggatcatatacttgttttttgatgactatatcagtttgagaggggaagttcattttataagaaagtatacacaattgtagtactaatgttattttcctaataataataggtaatgcaatacttattatt

SEQ ID NO: 3681 - DNA, 813 bp, Juglans hindsii x Juglans regia
  misc_feature (299)..(299): n is a, c, g, or t
  misc_feature (582)..(582): n is a, c, g, or t
  misc_feature (630)..(630): n is a, c, g, or t
ggggggacccaaggccaccgtttgcggttctgtaagggccaaaacctatttatcgactttgttccacctcgtagggccgaacgaaaccttcttcggcactgccttcagcctccagatttctttattttccatctataagataaaatttacctttggtcctcaaaatgtctggggaagaggaagaaaatgctgcagagctgaaaatcggtgacgagtttttaaaggccaagtgtttaatgaattgtgaagttgctttgattctcgaacacaaatatgagcagcttcaacaaatgtctgangatgcagcgaatcacgtttctcaagtatttgagaagtcacagcagtatgtgaagcgctttagccggtataagaatccagatgctgttagacaagtgcgagaaatcctcagtagatatcaattggctgagttcgagctttgtgttcttggcaacctttgccctgaaacagtggaggaagctattgccatggtaccatctattaagaccaaaggacgggctcacgacgatgaggcaattgagaaaatgttgaatgatctgtcgctcatcaagaaatttgagtagnggcttgtgcactttgatgttttgaagtgtctgtcaatttgtatttacngtatcacgatcctcctaatgtttcctaatgatgtggtgttgtaatataatcatcctatatacatggcaacatgcccaaatgatcagagtaggtaactgtcctcatgattttgcatatactctcggattgttttggtaaaagtattgatgagatttatactattaaaactcaaatgcattttag

SEQ ID NO: 3682 - DNA, 646 bp, Rhizophora mangle
ggatgtcaggagaagaagaagaaaatgcggctgagctacaaaattggagatgtagtttttgaaggccaagtgtttgatgaattgtgaagtatcattgattcttgagcacaagtatgaacagcttcagcagatgtctgatgatccaatgaaccaggtctcccaggtatttgagaagtcactgcagtatgtaaagcgctttagccgttataaaaaccctgatgctgtcagacaagttcgagaaattcttagcagatatcaattggctgaatttgagctctgtgttcttggtaatctttgtcctgaaactgtggaggaagctattgctatggtaccctctatcaagtcaaaaggacgagcccatgatgatgaggcaattgaaaaaatgttgaatgacttgtcgttgatcaagaggtttgaatagtggttccggcttttgccaataccagttttttattggcgatacaccaacatgttaaaggagcacgcttcatgtctagcaatacaattttcaatttttgcatgcttgtttttacattgatcggttggctggttaacgtggttttgtattgctgctgataagttataacctcatatgcaaaacttcataagatgttcccatttcctagtatccctatcttgagttgtg

SEQ ID NO: 3683 - DNA, 1395 bp, Theobroma cacao
attaatacattaatattataggttataggacataaatttttagttttaagaaacaaaactcgaaagcaaatttaggtttctgctgctctgatctcatttcatcgatatcaagcagggtaacaaatagagccctcgttttctaattatgtctggggaggaagaagaaaacgctgcggagctcaaaattggagaagagtttttgaaggctaaatgtctgatgaattgtgaagtggctctaattcttgagcataagtatgagcagcttcagcagatgtctgaggatcccatgaatcaagtttcccaggtatttgagaagtcactgcagtatgtaaagcgctttagccgttataagaatcccgatgctgttagacaagttcgagaaattctaagtagatatcagttagctgaattcgagctttgtgttcttggcaacctgtgtcctgaaacagtggaggaagctattgctatggtgccttccatcaagactaaaggacgggctcatgatgatgatgccattgagagaatgttaaatgacctgtccctgatcaagaaatttgagtagtggccaccatatgtctaatatctacccaccctagctgaccgtatttgaactggctcctgatgctaggcaattaagaatgaatgttagaacttgaatgtcctgcccctaacccagcaaattctgtcggaaccattacatttttacctacccatgtcaacagtatttaaaaatgtgtggtacaaccagttttgcattgaccttgaatcttggtatgccaaatgattttaagcagtagattgctatattttgtaattgtcccattaaggtatatgtcaatcatatgttaaaataaacggctttagctatgctttctggtgagacgatgacatttatacttgactggttttactctgagattctaacgggaggaagtctgactaataattacaataattcagccagtccaaagctttgatgactccttgttgtaaggctaggtaaaaggagagacatgagcagggtctcctcaccccttgaaagagtgaaggattgggaagaattttatttctttaatttttgttttctttgagcaataatcccaatctgtttaattcttcaaatcttacaaaacataaatttttaaactatttaactccatttcacagatttcaagcacagcaatatattaagttgaaataatttcctctttctaccaatgtcagaaatcttataatccggtgcccaagcaagtaaagtgggctatcttgtgctgtgactatgtagagacatccaaacaagaaaagatttttgccaatgcttttctctattttctgtaagcttgataccttctctcaaacaaactcgcaattggaaatttttgagcgaaatcaaac

SEQ ID NO: 3684 - DNA, 752 bp, Catharanthus roseus
tttccagactgcctgcagcttgagtgcaccagcaacctccaatcctccccaacagcaatcatctagattgattcgacccaagaatgtctgcagaagaggaagaaaatgctgcagagctcaaaattggtgatgagtttctcaaggcgaagtgtctgatgaattgtgaagttgcactcattcttgaacacaagtacgagcagcttcaacagacgtcggatgatccaatgaaccaaatgtctcaagtatttgagaagtcattgcactatgtaaagcgtttcagtcgctacaagaatcctgattctgttaggcaagtacgggagattctcagccgccatcagttagccgagtttgagctatgtgtacttggtaatctttgtccagaaactgttgaggaagcaattgctatggttccatctatcaagaacagaggccgtgcccttgatgatgaggcaattgagaaaatgcttaatgacttatccctagtgaagcaatttgagtagagagtagtactacctctatatcataacatattaactgtgtcttggaatttccattaatgaatctacctctgtttttatgtcctctggtacttgatggtgttttatgcccatttccttcccatcctttcttgtgagattttcatacatttatgggactcccttttttaggactatattttctttatatttctatatccaacttaaaaaagttgtgacgtttcgattttgcgtgacttagagtgagatagatcg

SEQ ID NO: 3685 - DNA, 789 bp, Cichorium intybus
cgcggggacggcgttgtttttaatctttcaggggttttctttgtccttcattcctcgttttcgttcgatctctccttgccgcatcaagcaacgtcaacatacgctggttagcttgtcggatcgatcttgacacaggcttaaactattcctcagtatgtctggagaagaagaagagaatgctgcagagctgaaaatcggcgatgagtttttgaaggccaagtgtctaatgaactgtgaagtctccttgattcttgaacacaaatacgaacagcttcaacagatgtccgaagatccattgaatcaagtttctcaagtgtttgagaagtcactgcaatatgtgaagcgattcagtcgctacaagaatccagatgctgttagacaagtcagagaattactgagtagataccagttagcggaatttgaactttgtgttcttggaaatctttgccctgaaactgtggaggaagccattgctatggtcccatctatcaagtcgaggggacgtggacatgatgacgaggctattgagaagatgttgaatgacatgtctttaattaagaagtttgagtgatttatgtgttgctgtttttgctctcattacctcaaattctgatgatggattttgtgtttctagtaaatgttgtttcgggagggatttttgaaaccggaacagtaatgttatagtaaacttgtatcaagtgtgttgaaggttacattagatgtattgttttattaaattttaatcggattatataatcattaatggaagtcgacacagtactagtgctg

SEQ ID NO: 3686 - DNA, 775 bp, Cucurbita pepo
cgggggggggttttcttgaaaatattagagaaatctgtgtgtcgcgccttctctgtttcccgccggctctcccttttcgccgtcacgtcgcaccgccgcttctggcctcctaatcctctcggtgttttgtgattcttttggttgtccagaactccaacttcaagcatgtctggagaggaggaagaaaatgctgctgagcttaaaattggggatgagtttttgaaggccaagtgtttaatgaattgtgaggtttctttgatccttgaacacaaatatgagcaacttcaacaaatgtctgaggatccaatgaatcaagtttctcaagtgttcgaaaagtcgctgcagtatgtgaaacgctttagtcgctataaaaatcctgatgccgttagacaagttcgagaaattctaagcaggtatcagttggctgagtttgagctctgtgttcttggcaacctttgtcctgaaaccgtggaggaagctattgctatggtaccatctttgaaggctaaagggagggtgcacgacgacgaagcaatcgagaagatgttaaacgacctgtcgttgatcaaaaagtttgagtagttactttctaagtttgggttaaacatgttcaaatccaatgtctatcattttctcccttagaacaatggggaattgtagccttctgtgtcgtagtattataacttgatgggtctgtttgtaattgatatccttgacaaatcttcaaactaaatttgagttgtatgttattctctttcaccattataatgaaaat

SEQ ID NO: 3687 - DNA, 905 bp, Euonymus alatus
cggccggggggtcggactcgtagagtgtctcagagatcgataaagcccgaaagacactgcctcccagtccaacgatcttctggttttttccctgctcttcactttctggtttgcttctgtgtttgtgtcctctaagttttgggtatttcagtatgtctggagaagaggaagaaaacgccgctgagctcaaaattggagacgagtttttgaaggccaagtgtttaatgaattgtgaagtggccttaattcttgagcataagtatgagcagcttcagcagatgtctggtgatcctttgaaccaaatttctcaggtttttgagaagtcactgcagtatgtgaagcgtttcagccgatacaaaaatcctgatgctgtaagacaagttcgagaaatccttagcagatatcagttggctgaattcgagctttgtgttcttggcaacctttgcccggaaacagtggaggaagctactgtaatggtaccttctatcaagaccaaaggacgggatcatgacgacgaggcgattgagaaaatgctgaatgacctatcgctcgtcaagaaatttgaatagtcaatgatccatttctactggatcaatcttcaaaggcatactcagatcagatgagtttcttgtgttgtacacgtgatataaacttaaaaagtcattacattgataagtgtccccatatgatttttttcaccagaactgtggagtagtgtactttcatctgcgagtttcaaaaggaaacaatgttccattgacagactttacctctctcagttaattaccattagagctcgtttggtttgaatctgaatctactactcatttggattggggtatgaccgtatgagcagcccctcctttttcttacttttttatatcaatatagagattatgaatgac

SEQ ID NO: 3688 - DNA, 654 bp, Euphorbia peplus
ctgagctgtgttctctccggaaatccctaaatcgttgtcgttattttcagcatgtcaggagaagaggaagaaaatgccgctgaactcaaaatcggagatgagtttttgaaggccaagtgcttgatgaattgtgaagtatcgttaattcttgaacacaaatatgagcagcttcaacagatgtctgaggatccaatgcaccaaatctcccaagtatttgagaagtccctgcagtatgtgaagcgctttagccgctataaaaatcctgatgctgtcagacaagttcgagaaattctaagccgctaccagttagctgaatttgagctatgtgttcttggaaacctttgccctgaaactgtggaagaagctattgccatggtgccctccatcaaggcgaaaggccgggttcatgatgatgaggcaattgagaagatgttgaatgatctgtcattgatcaagcgatttgagtagtagctcttcacatcatctagctgttctatttttctatccgactataaatctcgggttgtactctgtgattcaatttggttatgggtttattttgttgtaaattgtagttttgggaaacatgagactatactttttctgagaagagccttttttaatgaatggtcatacagaactctaatattaatg

SEQ ID NO: 3689 - DNA, 672 bp, Flaveria ramosissima
gtcttcttccgttgatcaaactacacgactctcatctctctatctgctcgatttcaggcttgagttatcttacagtatgtctggagaagaggaagaaaatgctgcagagctgaaaataggcgatgagtttttgaaggccaaatgtttaatgaattgtgaagtcgccttgattcttgaacacaaatatgagcagctccagcagatgtcagaagatccaatgaatcaaatgtctcaagtgtttgagaagtcactgcaatatgtgaagcgtttcagtcgatacaagaatccagatgctgtccgtcaagttcgagaactactgagtggataccagttagcagaatttgagttatgtgttcttggaaacctttgccctgaaactgtggaggaagccatagcaatggtcccatctatcaaatcaagggggcgtgggcacgacgacgaagctattgagaaaatgttaaatgatatgtcgttgattaagaagtttgagtagcttttatatgctgtgtctgcctcacaaccaaagctacaagtttcctaatggattttagtttttgattttgaacttgggtgaatcttcttgtggagtaatgcatagtgatttgtatcatgtggaacttaaaatcatatgcttgtttaactctactttctatttttctaatccaattatca

SEQ ID NO: 3690 - DNA, 590 bp, Flaveria ramosissima
acaggactcgagactttctcctctcatctctctatctgctcgatttcaggcttgagttatcttacaatatgtctggagaagaggaagaaaatgctgcagagttgaaaataggcgatgagtttttgaaggccaagtgtttaatgaattgtgaagtcgccttgattcttgaacacaaatatgagcagctccagcagatgtcagaagatccaatgaatcaaatgtctcaagtgtttgagaagtcactgcagtatgtgaagcgtttcagtcgatacaagaatccagatgctgtccgtcaagttcgagaactactgagtggataccagttagcagaatttgagttatgtgttcttggaaacctttgccctgaaactgtggaggaagccatagcaatggtcccatctatcaaatcaagggggcgtggacatgacgatgaagctattgagaaaatgttaaatgatatgtcgttgattaagaagtttgagtagcttttatatgctgtgtctgcctcacaaccaaagctacaagtttcctaatggattttagtttttgattttgaacttgggtgaatcttcttgtggagtaatgcatag

SEQ ID NO: 3691 - DNA, 802 bp, Flaveria ramosissima
ttggggaaagtatcaaacaacaggactcgaaactttctctctgccctcaaacggaaacaccatcggcttagggttccggcgaaggaagcgatttcaggcttgagttaacttacaatatgtctggagaagaggaagaaaatgctgcggagctgaaaataggcgatgagtttttgaaggccaagtgtttaatgaattgtgaagtcgccttgattcttgaacacaaatatgagcagctccagcagatgtcagaagatccaatgaatcaaatgtctcaagtgtttgagaagtcactgcagtatgtgaagcgtttcagtcgatacaagaatccagacgccgtccgacaagttcgagaactactgagtggataccagttagcagaatttgagttatgtgttcttggaaacctttgccccgaaactgttgaggaagccatagccatggtcccatctatcaagtcaagggggcgtggacatgacgatgaagctatcgagaaaatgctgaacgatatgtctttgattaagaagtttgagtagtttttatatgcagtttctgcctcacaaccaataatggatcttagtcttttgatttgaacttggctgaactttcttgtggagtaacgcgatagtgatttgtgtcttgtggatggagattgtacttaatgtcatatgcttgtttaactcaaccttctaacggaattgtcaaacaccaagatgaaggtctgaaatctggacagtaaccagaaagtttgtaaacaatatgatcattactaaactgaagaaattcaatatatttctataaatac

SEQ ID NO: 3692 - DNA, 658 bp, Guizotia abyssinica
gttcatcttcttccgttcttatgctctgcgatccataaacaccaatttttcattcgatcaaggctcaagcaatcggtaaatatgtctggagaagaggaagagaatgctgcagagctgaagataggcgatgagtttctgaaggccaagtgtttgatgaactgtgaagtcgccttaattcttgatcacaaatatgagcagcttcaacagatgtctgaagatccaatgaatcaagtttctcaagtgtttgagaagtcactgcaatatgtgaagcgtttcagtcgctacaagaatccagatgctgttagacaagttcgagaattactgagtagataccagttggcagaatttgagctttgtgttcttggaaacctttgccctgagactgtggaggaagccattgctatggtcccatctatcaagtcgagaggacgtggacatgatgatgaagctatcgagaaaatgctgaatgatatgtctttgattaagaagtttgaatagtatgtacggtttttgtcctcatttctaaaggttgcaagattctgatgatgggaatttgtgttatctgaagttgaaattttcaaacatgtaacagataatgttataatgatttctatcaagtgcattggaggttatatccaatcatgtacttgtttctgta

SEQ ID NO: 3693 - DNA, 758 bp, Tropaeolum majus
attttacccactaggaaaagagaaagaaaaacgtacatctcttcaatctcctcaacgtcataaaaccctagcacaactcgctccttcgtaatgtctggagaagaagaagaaaacgctgcagagctcaaaattggagatgagtttttaagagcaaagtgcttaatgaattgtgaagtgtctttaattctggaacacaagtatgagcaactgcagcagacgtctgatgatccgttgaatcaagtttcacaagtatttgagaagtcactgcagtatgtgaagcgtttcagccgctataaaaatccagatgctgttagacaagttcgagaaatcctgagtaggtaccagttagctgaatttgagctatgtgttcttggcaacctttgtcctgaaaccgtagaagaagctattgctatggtaccttcgataaagacgaagggacgagctcatgatgatgaggcaatcgagaaaatgctgaacgatttgtccctgatcaagagattcgagtaaagttatttcctagctgttggattcaagattaaagggcgtgttgtttactagtggttaaccgcaatatgaagatttggtaaatttaaaacataatcattagttatgattgtttttattgtgttgtattattatcagaggatcgtttttacataaatatttgtggtttgagtacgagaactggtgatgaatgtgtacatttaactgtgctagaatgtatcacttgttgtaatttagttgttggttatgttttc

SEQ ID NO: 3694 - DNA, 658 bp, Euphorbia esula
gtcggagctgtgttctctccggaaatccctaaatcgttgtcgttattttcagcatgtcaggagaagaggaagaaaatgccgctgaactcaaaatcggagatgagtttttgaaggccaagtgcttgatgaattgtgaagtatcgttaattcttgaacacaaatatgagcagcttcaacagatgtctgaggatccaatgcaccaaatctcccaagtatttgagaagtccctgcagtatgtgaagcgctttagccgctataaaaatcctgatgctgtcagacaagttcgagaaattctaagccgctaccagttagctgaatttgagctatgtgttcttggaaacctttgccctgaaactgtggaagaagctattgccatggtgccctccatcaaggcgaaaggccgggttcatgatgatgaggcaattgagaagatgttgaatgatctgtcattgatcaagcgatttgagtagtagctcttcacatcatctagctgttctatttttctatccgactataaatctcgggttgtactctgtgattcaatttggttatgggtttattttgttgtaaattgtagttttgggaaacatgagactatactttttctgagaagagccttttttaatgaatggtcatacagaactctaatattaatgaa

SEQ ID NO: 3695 - DNA, 667 bp, Helianthus annuus
atacagcgatcaaggctcaagttatcggtcagtatgtctggagaagaagaagagaatgctgcagagctgaagataggcgatgagtttttgaaggccaagtgtttaatgaattgtgaagtctccttgattcttgaacacaaatacgagcagcttcagcagatgtctgaagatccaatgaatcaagtttctcaagtgtttgagaagtccctgcaatatgtgaagcgtttcagtcgctacaaaaatccagatgccgttagacaagttcgagagttactgagtcgctaccagttagcagaattcgagctttgtgttcttggaaacctatgccctgaaaccgtggaggaagccattgctatggttccgtctatcaagtcaaggggacggggacatgatgatgaagccattgagaaaatgctgaatgacatgtctttgattaagaagtttgagtagtttctatgtcttgtttctgtcctcatttccaaagattgtaaggtaatgctatagtgatgatttgtattaagtgcattggagcttgtacctttatcatatacttgttttttgatgaccatcagtttgagaggggaagttcattttataagaaagtatagacaattgtagtactaatattatttccgtaataataataggtaaggcaatacttattatt

SEQ ID NO: 3696 - DNA, 710 bp, Helianthus annuus
aacggcgtcgtttatataacctgtacagcatattcgtcatccatctgcggcccgtattaatacagcgatcaaggctcaagttatcggtcagtatgtctggagaagaagaagagaatgctgcagagctgaagataggcgatgagtttttgaaggccaagtgtttaatgaattgtgaagtctccttgattcttgaacacaaatatgagcagcttcagcagatgtctgaagatccaatgaatcaagtttctcaagtgtttgagaagtccctacaatatgtgaagcgtttcagtcgctacaaaaatccagatgccgttagacaagttcgagaattactgagtcgctaccagctagcagaattcgagctttgtgttcttggaaacctatgtcctgaaactgtggaggaagccattgctatggttccgtctatcaagtcaaggggacggggacatgacgatgaagccattgagaaaatgctgaatgacatgtctttgattaagaagtttgagtagttttttctgtcctcatttccaaaggttgtaaggttctgatgttggcatttttaaacccataacaggtaatgctatagtgattgatttgtattaagtgcattggagcttgtacctttatcatatacttgttttttgatgactatatcagtatgagaggggaagttaattttataagaaagtatagacaattgtaggaaaaaa

SEQ ID NO: 3697 - DNA, 592 bp, Citrullus lanatus
taatctttgctgtactctgtttccaaattctgtaggttgatacaaaactccaacttcaagcatgtctggggaggaggaagaaaatgctgctgagcttaaaattggagatgagttcttaaaggccaaatgtttaatgaattgtgaagtttctctgattcttgaacataaatacgagcaacttcaacaaatgtctgaggatccaacgaatcaagtttcccaggtgtttgaaaagtcactacaatatgtgaaacgcttcagccgttataagaaccctgatgctgtaagacaagttcgagaaatcctaagcaggtatcagttggctgagtttgagctttgtgttcttggcaacctttgcccagaaactgtagaggaagccattgctatggtaccgtccttgaagactaagggaagggtgcatgacgatgaagctatcgagaagatgctgaacgatctttcattaatcaaaagatttgagtagttgtcttctatatcttggattaaatgtgaatctatttccgaggcaaaattgtaccttatatagtataggattatgattttatgggtaagtttgtaattgggatactccgcagtc

SEQ ID NO: 3698 - DNA, 447 bp, Aquilegia formosa
aaaatcaaatatgtctggacaagaggaagaagagaacgctgcagagctcaaaattggagatgagtttttgaaggctaagtgtttgatgaattgcgaagttgctttgattcttgatcgtaagtatgaacaacttcaacagatgtctgatgatcccatgaaccaagtttctcaagtttttgagaagtctctgcaatatgtgaagcgatttagccgttacacaaaccctgatgctgttcggcaagtgcgagaaatcctcagtagatatcagttggctgagttcgagctttgtgtacttggcaatctttgccccgaaactgtggaggaagcaatagccatggttccatctatcaagagtagaggacggactcatgaagatgaagcaattgagaagatgctgaatgatctatccttgattaagaaatttgaatgatgggccatcacatctct

SEQ ID NO: 3699 - DNA, 612 bp, Ambrosia trifida
cgaatataaatcataagtgctctaatatggtaatatataaccattttgcatccccgcgtaataagccagcatcctcgtatacagatatatcttgtatacgatcaaggctcaagttaacggttaatatgtctggagaagaggaagagaatgccgcagagctgaaaataggcgatgagtttctgaaggccaagtgtttaatgaattgtgaagtttcgttgattcttgagcacaaatatgagcagcttcagcagatgtctgaagatccaatgaatcaagtttctcaagtgtttgagaagtccctgcaatatgtgaagcgtttcagtcgctacaagaatccagatgccgttagacaagttcgagaattactgagtggataccagctagcagaattcgagctgtgtgttcttggaaacctttgtcctgagactgtggaggaagccattgcgatggtcccatctatcaagtcgaggggacgtggacatgatgatgaagctattgagaaaatgctgaatgacatgtctttgattaagaagtttgagtagttactatgtactgtttctgtcatttcaaaggttgctatagtgatttgtgttgagttctttggagcttgta

SEQ ID NO: 3700 - DNA, 550 bp, Ambrosia trifida
cgtaataagccagcatcctcgtatacagatatatcttgtataccatcaaggctcgagttaacggttaatatgtctggtgaagaggaagagaatgccgcagagctgaaaataggcgatgagtttctgaaggccaagtgtttaatgaattgtgaagtttcattgattcttgagcacaaatatgagcagcttcagcagatgtctgaagatcctatgaatcaagtttctcaagtgtttgagaagtccctgcaatatgtgaagcgtttcagtcgctacaagaatccagatgccgttagacaagttcgagaattactgagtggataccagctagcagaattcgagctgtgtgttcttggaaacctttgtcccgagactgtggaggaagccattgcgatggtcccatctatcaagtcgaggggacgtggacatgatgatgaagctattgagaaaatgctgaatgacatgtctttgattaagaagtttgagtagttactatgtactgtttccgtcatttcaaaggttgctatagtgatttgtgttaagttctttggag

SEQ ID NO: 3701 - DNA, 877 bp, Vaccinium corymbosum
acgaaaatctgcgaagcaagtagtctctcgatccaactttcaagcctctaatcagcagcatcttcagatatcatcatcgtcaatctaatcaccgtttcagtcccatcttcgatctagaaccatcggttcagattgatattgagagctttcagcatgtctggtgaagaggaagaaaatgctgctgaactgaaaatcggagatgaatttttgaaggccaagtgtctaatgaattgcgaagttgcgctaattcttgagcgtaagtatgagcagcttcaacatatggctgatgatcccatgaaccaagtctctcaagtatttgaaaagtcactgcagtatgtgaagcgctttagccgctacaagaatccagatgctgtcagacaagctcgagaaatccttagtagataccagttggctgaatttgagctctgtgtccttggaaatctttcccctgaaactgtggaggaagctattgctattgttccatcgatgaagagcagaggacgcacgcttgatgaggaggcgattgagaaaatgttgaatgacctttctatgataaagaagttcgattgatgccatttttttttactggatctatattgtgtgcaagaaatcgacaattgctaggaggctataaaagctatggcaactccttttttgagtagcatgtcgaaaatatgttccattgatgtacttctaaagtaaacgcatgattagattatgaatttcattttcggtaaaagctgcattgatatttatgtatgtttgtcttttaactcgtaccatattttttgaggaaacagaaacatattactccgtagtattgatcgccagaccgatcaaataatattgtatttgtaatgtcccgattttccgaagt

SEQ ID NO: 3702 - DNA, 873 bp, Vaccinium corymbosum
cgaacgaagatctgcgaagcaagtagtctctcgatccaactttcaagcctctaatcagcagcatcttcagatatcatcatcgtcaatctaatcaccgtttcagtcccatcttcgatctaaaaccatcggttcagattgatattgagagctttcagcatgtctggtgaagaggaagaaaatgctgctgaactgaaaatcggagatgaatttttgaaggccaagtgtctaatgaattgtgaagttgccttaattctcgagcgtaagtatgagcagcttcaacatatggctgatgatcccatgaaccaagtctctcaagtatttgaaaagtcactgcagtatgtgaagcgctttagccgctacaagaatccagatgctgtcagacaagctcgagaaatccttagtagataccagttggctgaatttgagctctgtgtccttggaaatctttcccctgaaactgtggaggaagctattgctattgttccatcgatgaagagtagaggacgcacgcttgatgaggaggcgattgagaaaatgttgaatgacctttctatgataaagaagttcgattgatgcctattttttactggatctatattgtgtgcaagaaatcgacaattgctaggaggctataaaagctatggcaactcctttttgagtagcatgtcgaaaatatgttccattgatgtacttgtaaaagtaaacgcatgattagattatgaatttcattttaccgtaaaagctgcattgattatttatgtatgttttctttttaactcgtaccatattttttgaggaaacagaaacatattagtattgatcgccagactgatcaaataatattgtatttgtaatgccccgattttccgaagc

SEQ ID NO: 3703 - DNA, 822 bp, Cucumis sativus
atctcttccctttgttcaataacagttcattcgtttcctttcttctccggcacttccgcggcagccaaacccgcctctcgccggacaccatcaccacctaacaaccatctttgagtcttctctttgctccctccttctccgctgcctccattatcggtcgccagtacgcctcagcattcgatttctctatttttccttcatcaccgccacgctgctaccaggacctgcagaactccatctcgaggttgacacagaactccaacttcaagcatgtccggggaggaggaagaaaatgctgctgagcttaaaattggagatgagttcttaaaagccaaatgtttaatgaattgtgaagtttctctaatccttgaacataaatatgagcaacttcaacagatgtccgaggatccaacaaatcaagtttcccaagtgtttgaaaagtcacttcaatatgtgaaacgcttcagccgttataagaatcccgatgctgttagacaagttcgagaagttctaagcaggtatcagttggcggagtttgagctttgtgttcttggcaacctttgccctgaaactgtggaagaagccattgccatggtaccatcattgaagaccaagggaagggtgcatgacgatgaagcaattgagaagatgttgaatgatctttcattaatcaaaagatttgagtagttagttaaatgtgtaaacagaattatactcttgcataatttagagttatgactttatgggttagtttgtaattgggatcctcaaccgacttgaggatcataaactctttgatatttacaaggatttattatgatt

SEQ ID NO: 3704 - DNA, 764 bp, Lactuca sativa
gttaaattgtataaatagggattaaccctttttctttggccttcattcttcgttttcgttgcgacctctccaggttagatatcggatccatcattgacacaggcttaagctatctctcagtatgtctggagaagaagaagagaatgctgcagagctgaaaataggcgatgagtttttgaaggccaagtgtctaatgaactgtgaagtctccttgattcttgaacacaaatatgaacagcttcaacagatgtctgaagatccattgaatcaagtttctcaagtgtttgagaagtcactgcaatatgtgaagcgattcagtcgttacaagaatcctgatgctgttagacaagttcgagaattgctaagtagacaacagttagcagaatttgagctttgtgttcttggaaatctttgccctgaaactgtggaggaagccattgctatggtcccatctatcaagtcgaggggacgtggacatgatgatgaggctattgagaagatgttgaatgatatgtctttaattaaaaagtttgagtagtttatgactatatatgtatttttctgcttctgatgatgatgatggttatcatgatcatgatgatggatgttgtgtttctagtaaaccttgtattgggtgtaatgttgacctaaatattggccagtaattgtaatgcaatattaggttgtttggtttacattgtacctttttttgtaataccgggtgtaatgtttatatttagcatcctactttgatggattttttt

SEQ ID NO: 3705 - DNA, 825 bp, Cucumis melo
atctcttccctttgtttaataacagttcattcgttttctttctctccggcactactgcggtagccaaaccccctctcgccagacacctatcaccacctaacaaccatctttgagttttctctttaccctttccttctccgctgcctccattatctgtcgtcagcacgcttcagcagtcaattttctctatttctcccttgtcgccggcacgctgctaccagaacctgcagaactccatctcgaggttgacacagaactccaacttcaaccatgtccggggaggaggaagaaaatgctgctgagcttaaaattggagatgagttcttaaaagccaaatgtttaatgaattgtgaagtttctctaatccttgaacataaatatgagcaacttcaacagatgtccgaagatccaacaaatcaagtttcccaagtgtttgaaaagtcacttcaatatgtgaaacgctttagccgttacaagaatcccgatgctgttagacaagttcgagaagttctaagcaggtatcagttggcggagtttgagctttgtgttcttggcaacctttgccctgaaactgtggaagaagccattgccatggtaccatcattgaagaccaagggaagggtgcatgacgatgaagcaattgagaagatgttgaatgatctttcattaatcaaaagatttgagtagttagttaattgtgtaaatccgtttctaatgcagaattgcacccttttataatttaaagttacgactttatggtgagtttgtgattgggatcctcaaccgtcttgaggatcataaactctttgatatttataaggactt

SEQ ID NO: 3706 - DNA, 682 bp, Nuphar advena
  misc_feature (258)..(258): n is a, c, g, or t
ccctttcgcacccgccgccagattcgccacgatgtcgggagaggaagaagagaatgctgcagagctgaagattggtgaagagtttctgaaggccaaatgtttgatgaactgtgaagttgcattgattttggatcataaatatgagcagctacaacaaatgtctgatgatcctacaactcaaatttctcaggtatttgagaagtcactgcagtatgttaaacgcttcagtcgttataagaatcctgatgctgtgaggcnagttagagaaatcctcagcaggtaccagttggctgagtttgagctttgtgtccttggcaacctttgtcctgagacggtggaggaagctatagcaatggtcccttccatcaagacaaagggtcgaactcacgatgatgatgctattgagaagatgttgaatgatcttgctttgatcaagaaatttgaatgatcgctggctgtgtgtgggcagtatgtggaaatccaagttatatggtctgagggcaggatatttctgttcatgttcttccaaatggtacccttttactataaatgaaaatgccggttctctgtctccttggacaaaggacattatatgttaccagataaggacagagccggctaatacagttattcgatgtgcagctgtcattgttcttggaatgctttgttttgttcactattg

SEQ ID NO: 3707 - DNA, 630 bp, Helianthus annuus
cagcgatcaaggctcaagttatcggtcagtatgtccggagaagaaaaagagaatgcggcagagctgaagataggtgatgagtttttgaaggccaagtgtttaatgaattgtgaagtctccttgattcttgaacacaaatacgagcagcttcagcagatgtctgaagatccaatgaatcaagtttctcaagtgtttgagaagtccctgcaatatgtgaagcgtttcagtcgctacaaaaatccagatgccgttagacaagttcgagaattactgagtcgctaccagttagcagaattcgagctttgtgttcttggaaacctatgccctgaaactgtggaggaagccattgctatggttccgtctatcaagtcaaggggacggggacatgacgatgaagccattgagaaaatgctgaatgacatgtctttgattaagaagtttgagtagtttctatgtcttgtttctgtcctcatttccaaaggttgtaaggttctgatgttggcatttttaagtgtttgatttgtgttaagtgcattggagcttgtacctttatcttatacttgttttttgatgaccatcagtttgagaggggaagttcattttataagaaagtatagacaattgtagtac

SEQ ID NO: 3708 - DNA, 646 bp, Helianthus annuus
attcgtcatccatctgcggcttcgtatacagcgatcaaggctcaagttatcggtcagtatgtctgaagaagaagaagagaatgctgcagagctgaagataggcgatgagtttctgaaggccaagtgtttaatgaattgtgaagtctccttgattcttgaacacaaatatgagcagcttcagcagatgtctgaagatccaatgaatcaagtttctcaagtgtttgagaagtccctgcaatatgtgaagcgtttcagtcgctacaaaaatccagatgccgttagacaagttcgagaattactgagtcgctaccagttagcagaattcgagctttgtgttcttggaaacctatgccctgaaactgtggaggaagccattgctatggttccgtctatcaagtcaaggggacggggacatgacgatgaagccattgagaaaatgctgaatgacatgtctttgattaagaagtttgagtagtttgtttctgtcctcatttccaaaggttgtaaggttctgatgttggcatttttaaacccataacaggtaatgctaaagtgattgatttgtattaagtgcattggagcttgtacctttatcatatacttgttttttgatgactatatcagtttgagaggggaagttaatttt

SEQ ID NO: 3709 - DNA, 661 bp, Tragopogon dubius
tatcggccttcattcgttcgctttcgtttcgaattttcctgatttcgtgtgaaagactcgtaaatccctgaatttccaggttagatcattggattgatcctcgacaggcttaagtaatctctcagtatgtctggagaagaggaagagaatgctgcagacctcaaaataggcgatgagtttctgaaggccaagtgtctaatgaattgtgaagtctcgttgattcttgaacacaaatatgaacagcttcaacagatgtccgaagatccgttgaatcaagtttcacaagtatttgagaagtcactgcaatatgtgaaacgttttagtcgctacaagaatccagatgctgttagacaagttcgagaattactgagtagatatcagttagcagaatttgagctttgtgttcttggaaatctttgccctgaaactgtggaggaagccattgctatggtcccatcgatcaagtcaaggggacgtggacatgatgatgaggctattgagaagatgctgaatgatatgtctttaattaagaagttcgagtagtttatttatacttttttgtgtattttaaggatgttggtaaacgtttttatgtagtagatagttttgaaccgaaaacaggaatgttatggtaacttgtatcaagtgcattgaaggttgt

SEQ ID NO: 3710 - DNA, 585 bp, Citrullus lanatus
ttgtagctggacaaatctctaacttcaagcatgtctggagaagaagaagaaaatgctgcagagcttaaaattggggatgagtttttaaaagctaagtgtttaatgaattgcgaagtttctttgatccttgaacacaagtatgagcagcttcaacaaatggccgaggatccaacaaatcaaatttctcaagtgtttgagaagtcattgcagtatgtgaaacgctttagtcgctataagaaccctgatgctgttagacaagtccgagaaattctaagcagataccaactagctgagtttgagctatgtgttcttggcaacctttgccctgaaactgtagaggaagctatctccatagttccatctttgaagactaaaggaagggttcatgatgatgaggcaatagagaagatgttgaatgatctttcgttaatcaaaaagtttgagtagttagctttctaaatctagattgattgtgtttccattccttgacatttttctcacctaaaacaatagaaaagtgtacccttctgatcacagttttataattggatgggtaactttgtaaatgggattattctcaccaaa

SEQ ID NO: 3711 - DNA, 633 bp, Valeriana officinalis
atctcggtctcttagtatgtctgcagctggagaagaagaagaaaatgcagctgagctcaaaatcggagatgagtttttgaaggccaaatgcttgatgaactgtgaagttgctctaattcttgaacacaagtacgaacagctccagcagacgtctgaagatccaatgaatcaagtatctcaagtattcgagaagtcattgcagtatgtgaagcgctttagtcgctacaaaaatccagatgctgttagacaagttcgagaaatcctgagccggtatcagttggccgaatttgagctttgtgttttgggaaatctttgccctgaaactgtcgaagaagctattgctatggttccatctattaagtcaagaggacgtggacacgatgacgaggcaattgagaaaatgttgaatgacctttcattgatcaagaagtttgaatagatctttgttttggattcaatattatgataaagacatgctcattttattagttgtttctaatatgtaagaatgttacgacgtgttcgattatgtgtttgaattatatagaactttgcattcgttctttgcaatagattgatccgattttggttcttttcaaccttgtacttttcaaccttgtactgtttatttct

SEQ ID NO: 3712 - DNA, 740 bp, Linum usitatissimum
agagaccttcttctttagctaagctaagctaatattccaatcgaagaagaaccagtatgtcaggagaagaggaagagaatgctgcggagctcaaaatcggagatgagttcttgaaggcgaaatgcttgatgaattgtgaggtttctttgattcttgagcacaagtatgagcagcttcaacaaatgtcggatgatgcgacgaatcagatgtcccaggtgtttgagaaatcgctgcagtatgtgaagcgctttagccgatacaaaaaccctgatgctgtcagacaagtgcgagaaatcctaagccgataccagctggcagagtttgagctctgtgtgcttggtaatctctgccctgaaactgtggaggaagcaacaacgatggttccttctctaaagacaaaggatcggtcccttgacgatgatgcgattgagaaaatgctgaatgatctatcgttgatcaagaagttcgagtagagatctgagagttgcagaccaatgccatcttgacaaacacgattcgttcgttctggtcttggtgttatcaaatcttcgaaaccgaaaccatttgctcgtggaattcttccatgtctttgtctatgtcatgtacgaaatatgaattgattcaatttgaagagtgaacaatggataagctcatactaacccgtcaatttgggatcaaattcgaaattagctcctactgagttactgaatgcatgagccactgaatgcatgaaatatggc

SEQ ID NO: 3713 - DNA, 526 bp, Antirrhinum majus
  misc_feature (1)..(1): n is a, c, g, or t
  misc_feature (28)..(28): n is a, c, g, or t
  misc_feature (46)..(46): n is a, c, g, or t
  misc_feature (50)..(50): n is a, c, g, or t
ntttttttttgttaccgtctatcacatntgtccggtgaagaagaantttnacgccgctgagcttaaaatcccagatgagtttttgaaggccaagtgtttgatgaattgtgaagtttccctaattcttgaacacaagtatgagcagcttcagcagatggctgatgatccaatgaatcaaatgtctcaggtttttgagaaatctctccaatatgtgaagcgcttcagccgatataaaaatcctgatgctgttagacaagttcgagaaattctaagtagatataagctggctgaatttgagctctgtgtacttggaaacctctgtccagaaacagtggaagaagctatagccatggttccgtccatcaagactagaggacggtcgcacgatgatgaagcaattgaaaaaatgttgaatgatctctccttgatcaagaaatttgagtaattccatttcctctttctatgttggaggggatatttgcatgaaccaagttgtagggaagctggtgggtatggttcttgggaa

SEQ ID NO: 3714 - DNA, 978 bp, Amborella trichopoda
tatcaaagtgcccccaaataatcaccctaatcccctctctctctataaatgaacaccctaatctcaaatcctcccccaatagtcacgctctctctctttttctcaatcaaatcttcattcttcccaaaactctctcgctgtctaaaacgctataccccaaatcgtccccgaagctctctctctcagattctcattcttaggtcctaggtatcgaacgttctgaactgacaagggtataagatgtctggagaagaggaagaaaatgccgcagagctcaagattggagaagagtttcttaaggccaagtgtttgatgaattgtgaagttgcccttattctggaccacaagtatgaacaacttcagcagatgtctgatgacccctcgaatcagatatcccaagtgtttgagaagtctctgcaatatgtgaagcgcttcagtcgctacaaaaaccctgatgcagtcaggcaggttcgagaagtcctgagcagaaaccagttggcagaatttgagctgtgtgtgctcggcaatctctgccctgaaactgtagaggaagcgatagcgatggttccgtctatcaaggcaaaggggcgctctaataacgatgacgatgcgattgagaagatgttaaatgatctagcacttatcaagaaattcgaatagaaagtgggatctgcttagtgtgtagccttcttctgctgcccctatgcttctgtctcattttttctgtggcttcggttccctgagctaccaacaaactaaaggagctgagtgaagacaccttgttgatgcaactgtgtagacttggttttatatgtgcttaatctgagaatatgtgatattgttttttgctctctttcaactgtctaatcaattagatcgatatgatctctatatgcatatgaattaggccttgtgtaaattatgtgtattgaaatattgaaagctcattcaagaaatcgatgatcctttcacttccac

SEQ ID NO: 3715 - DNA, 689 bp, Taraxacum officinale
gttttcttttaccttcgttcattgttttccttgcgatctggttccttgccgcatagtagcaacaagcaacgtcaccgctggttcgattatccggtcgatcctcgacagtcgacaggcttaaaaccatccctcaatatgtctggagctgcagaagaggaagagaatgctgcagacctgaaaataggagatgagtttttgaaggcgaaatgtctaatgaactgtgaagtctcgttgattcttgaacacaaatatgaacaacttcaacagatgtccgaagatccattgaatcaagtttcacaggtgtttgagaagtcactgcaatatgtgaagcgtttcagtcgctacaagaatccggatgctgttagacaagtcagagaattactgagtagataccagttggcggaattcgagctttgtgttcttggaaatctttgccctgaaactgtggaagaagctattgctatggtcccatctatcaagtcgaggggacgtggacatgatgatgaggctattgagaagatgctcaatgatatgtcattaatcaagaagtttgagtagtttttgcttagaagcttctaatgatgttttttgtatttctagtaaaccttgtttcaaatgatgaagtatattaaaagttttgtattatgttgggttaaaacataattgctttgaaaaaaaaaaaaaaaaaa

SEQ ID NO: 3716 - DNA, 806 bp, Malus domestica
ataaattctgctttgcttaagccccgtcgaaatctctctctctctctctctctctctctgttttctctctagatactccgcaaacatgtctggggaagaggaagaaaacgccgccgagcttaaaatcggagacgagtttttgaaggcaaagtgcttaatgaactgcgaagtttctttgattctcgaacacaagttcgagcagcttcaacagatgtctgatgatcccaggaaccaaatttctcaagtatttgagaagtcactgcagtatgtgaagcgcttcagccgttacaaaaatcccgacgctgttaaacaagttcgagaaatccttagtagatatcagctgactgagttcgagctctgtgttcttggcaatctctgccctgaaactgttgaggaagctattgctatggtgccatctataaaggcaaaaggacgggttcacgacgatgatgcaattgataaaatgttgaatgacctggcgctaatcaagaaatttgagtagtctgtcgctacttctgttccatatgactatgaaaggtgctgtatttatggcaatgcaactccgaacgtctttttgtagcatattttttaatattcagaacttgactgccaagcaagctgtctttggacagccaccaacttcaaaccttgtgtgtggatcttacatggatgtagttgaatgaatattatgactagtattcgtgggtgatgatgcccttgagtgatttgttctaaagtattctgagttttgtcacaaaggcttaatgccatcccaatgtggtttgaatgcaatgtagttttaaaat

SEQ ID NO: 3717 - DNA, 721 bp, Artemisia annua
acaattttcaatctgcaggtttaagtaattgttgagtatgtctggagaagaggaagagaatgccgcagagttgaaaataggcgatgagtttctgaaagcaaagtgtttgatgaactgtgaagtctcgttgattcttgatcacaaattagaacagcttcaggcaatgtctgatgatccaagtaatcaagtttctcaagtctttgagaagtcactgcaatatgtgaagcgtttcagtcgctacaagaacccagatgctgtcagacaagttcgagaacttctgagtaggcaccagttagcggaatttgagctttgtgttcttggaaacctttgccctgaaactgttgaggaagccattgctatggttccatctatcaagtcgaggggacgtggacacgacgatgaggcgatcgagaaaatgctgaatgatatgtctctaattaagaagtttgaatagtttctgtatgctttgtcattccgcctcccaagtttccgacaatgtactttgttaaaagcagcgttaatcaaaccaaaattacattggaggggaagtgttaaatgtcaagtacttctatggttgatgttaaaacattttcgggagtaaatttcaaatcccatatggacttgtagtgacgtatatcaactggattaaagtttaatattaatcgtatactatcaattctgttattttagtatcaaacttaagatcattgatgaaagtaaa

SEQ ID NO: 3718 - DNA, 708 bp, Cleome gynandra
atagattgaaccctaggcctgattttatctcccttgtcgttgctatgtctggagaagaagaagaaaacgccgccgagctcaagatcggagatgagtttctaaaggcaaagtgcttgatgaactgcgaagtcgctctgattctagagcacaaatatgaacagcttcagcaggtttctgaagatcccatgaaccaagtttctcaagtatttgagaagtccctgcagtacgtgaagcgctttagtcgctacaagaatcctgatgctgttcgacaagttcgagaaattctgagcagataccagttaacggaatttgagctttgtgttcttggcaacctctgtcctgaaactgttgaggaagctgttgccatggttccttctctaaagacaaagggacgagttcatgacgatgaagctatcgagaagatgctgaacgatctctccctcataaagagatttgaatgatcacaaatgatgcattagaatctgaatatcatctttcaacttaattttgctgtcttataaacaatctgaaacatactaacttatgcactgggggttgatcttcaagatttacaacccttgacaaagaggaacaaaggaatgttataagatgagattttgtaaggtctccattatagtgtttgcctttcgactgtgtcatctagtgatttgggtgcttgatattatgatataaagggtaatgtcataa

SEQ ID NO: 3719 - DNA, 586 bp, Cleome spinosa
ttgtcttcacttcctttcctcggtcgaaacctaagcctgattctccctccattgtcgtcgccatgtccggtgaagaagaagaaaacgccgccgagctcaagatcggagatgagtttctcaaggcaaagtgcttgatgaactgcgaagtcgctctgattctggagcacaagtatgagcagcttcagcagatttctgaagatcccatgaatcaagtttctcaagtgtttgagaagtccctacagtatgtgaagcgctttagccgctacaagaatccggatgctgtacgacaagttcgggaaatcctgagcagataccagttaacggaatttgagctctgtgttcttggaaacctctgtcctgaaactgttgaggaagctgttgccatggttccttctcttaagacgaagggacgagttcacgacgatgaagctatcgagaagatgctaaacgatctctccctcatcaagagatttgaatgatgatagattggacatgatattgttgtcttatgtacacagtagactgaagcatattgggcttctgcaaatggtggttgatcttcaaagtttcaccttcactataacaa

SEQ ID NO: 3720 - DNA, 573 bp, Euphorbia peplus
agcaagcatgtctgaactagaggaagaaaacgccgctgatctcaaaattggagatgagtttttgaaggctaagtgcttgatgaattgtgaagtatccttaattcttgaacacaaatatgagcagcttcagcaaatgtctgacgacccaatgctccaaatctcccaagtatttgagaagtccctgcagtatgtgaagcgctttagccgctataaaaatcctgatgctgtcagacaagttcgagaaattctaagccgctaccaattagctgagtttgagttatgtgttcttggaaacctttgccctgaaactctggaagaagctattgccatggtgccctccatcaaggcaaaaggccggattcatgacgatgaggcaattgagaagatgttgaatgatctgtcattgatcaagagatttgagtagttgctcttaatctagctgttctacttttctatccgactatgattcatctagttgcactgtgattcagtttggttatgcctttttttgttgtaaattgtagttttgacaagcatgagactatatagatctgatgtactttttgtgagaag

SEQ ID NO: 3721 - DNA, 784 bp, Linum usitatissimum
gaagaagaatccactgaaccagagagcttcttctttagctaagctaagctaagctaagcttccaattgaagaagaaccagtatgtcgggagaagaggaagagaatgctgccgagctcaagatcggagatgagttcttgaaggcgaaatgcttgatgaattgtgaggtttctttgattcttgagcacaagtatgagcagcttcaacagatgtcggatgatgcctcgaatcagatgtcccaggtgtttgagaaatcgctgcagtatgtgaagcgctttagccgatacaaaaaccctgatgctgtcagacaagtgcgagaaatcctaagccgataccagctggcagagtttgagctctgtgttcttggtaatctctgccctgaaactgtggaggaagcaacaactatggttccttctctaaagacaaaggaccggtcccttgacgatgatgcgattgagaaaatgctgaacgatctatcgttgatcaagaagttcgagtagagatcgagggttgcagaccaataccagctcgacaaagacgattcgtttgatctggtctcggtgttatcgaatcttcgaaactgaaaccatttgctcgtggaatgcttcgatgtcttttttctgtctgtattattaaactgaatcgtattgactagtaagccaaccaaatgcacgaaatatgaatcgatttcaatctgaagagtcaataacggatgatctcatgctaacccgtcaatttggggatcaaattcgaaattagctcctatgaatgcacgaaatatggcat

SEQ ID NO: 3722 - DNA, 992 bp, Elaeis guineensis
caaaaaaaaagaagttataattagtaacgaagaaaaggctttcggaggtagctagggttcggtcccgttcctcaccgtttccctcttcccaagcggcgaccggcgatcggcaacaagcgaccttcccgaccggcgagaggagcatctcaaccggcgatacaagaatccaagcgcgataccagatgtctggagaagaggaagagaatgctgcggagctaaaaattggtgaagagtttttgaaggcgaagtgcctgatgaattgtgaagttgcacttattcttgatcgtaaatatgagcagcttcagcagctatctgatgatcctacaaaccaaatatctcaggtgtttgagaagtcaatgcagtacgtgaaacgctttagtcgctacaaaaaccaagatgctgtgagacaagttagagaaatcctaagtaggtaccgattggctgaatttgagctttgtgtgcttggcaatctttgcccagaaactgttgaggaagctattgctatggtcccatcaattaagagcaaaggacggatccatgaagatgatgcaatcgagaaaatgctaaatgatctctctctgataaagaaatttgagtagtgtagtcttgtcatgggcaacttgaactcctacaaaatgtcttgtattgtcgcatgtttcaagggtcatggagtgatcagtctatgtatctactactggtctgtagattgaatgaatcctttggacgattttgcacaggcatgcagaatgaatattagcatttaggacatagatatctggtagatatgtgttgtggccaatgttaaatccgtatcagtgaaattctgctctcaatcaactgttataggaggcgtataagcataaagttggtagttttggatatttatttgattttattctgtatacctggattcatgtttaagctggcataggaaaaggtatgaacataaaaactaaagtagaacgtacgtacgaacgacgacacaacgggta

SEQ ID NO: 3723 - DNA, 814 bp, Prunus persica
cttttgtttttttccgaaacccgcaccgaagttcgactttcccaatccctttctagaatatttataaatcggcaagtctgattccgaattgaattcctgcttacccgaaaagtgggtttcaaatacttcaatttctccctctctcactctctctagatttttggtaccttctgcttgctctgcaacatgtctggagaagaagaagaaaatgccgccgagctcaaaatcggagacgagtttttgaaagccaagtgcttaatgaactgcgaagttgcgttgattcttgaacataagtacgaccagcttcagcagatgtctgatgaccccagaaaccaagtttctcaagtatttgagaagtcgctgcagtatgtgaagcgctttagccgttataaaaatcctgatgctgtcaaacaagttagagaaattctgagcagatatcaactgactgagtttgagctttgtgttcttggaaatctctgccctgaaactgttgaggaagctattgctatggtaccatctataaaggccaaaggacgtgttcatgatgatgatgcaatcgacaaaatgttgaatgacctggcgctaatcaagaaatttgagtagtgtctgttgcttctgctccctatcagtacgaataatgctttatgttgtaatatttagatcgtaaacgtagcaaagagtttggaatgcaggcatcccaatgtagttgaatattatgacttgtatttacggatgatgtggtgcccatgagtgatttgttccattgtatttgatcttaaagccagcccaatgccatggctcgagtgtgatgtga

SEQ ID NO: 3724 - DNA, 632 bp, Rosa hybrid cultivar
agactagatcgttctctcgtctaggtttccgtcaccgtctgctagttcgtcaaacatgtccggcgaagaggaagagaacgccgccgagctcaaaatcggggacgagtttctcaaggccaagtgtttgatgaactgcgaagtttctctgattcttgagcacaagttcgagcagcttcagcagatgtctgatgatcccaggaaccaagtctctcaagtgtttgagaagtcgctgcagtatgtgaagcgctttagccgctataagaatcctgatgccgtgaagcaagtgagagaaatccttagtagatatcagttgactgagtttgagctttgtgtgcttggcaatctctgccctgaaactgtcgaggaggctattgctatggtaccgtctataaaggcaaaaggaagggtgcatgatgatgaggcaattgataaaatgttgaatgacctggcactaatcaagaaatttgagtagtggctgatacttctgtcatttgtttcatagcaatgtagctttggatatttgagtataaactgctgtaatctgccagtgtagcaaaacatttgaacactcttattcgacccattatgtggatcttacctcactaaacttgaatatcaatacctattgtaga

SEQ ID NO: 3725 - DNA, 687 bp, Rosa hybrid cultivar
aaaagagactcgatcgttctctcgtctaggtttccgtcaccgtctgctagttcgtcaaacatgtccggcgaagaggaagagaacgccgccgagctcaaaatcggagacgagtttctcaaggccaagtgtttgatgaactgcgaagtttctctgattcttgagcacaagttcgagcagcttcagcagatgtctgatgatcccaggaaccaagtctctcaagtgtttgagaagtcgctgcagtatgtgaagcgctttagccgctataagaatcctgatgccgtgaagcaagtgagagaaatcctcagcagatatcagttgactgagtttgagctttgtgtgcttggcaatctctgccctgaaactgtcgaggaagctattgctatggttccatctataaaggcaaaaggacgggtgcatgatgatgaggcaattgataaaatgttgaatgacctggcactaatcaagaaatttgagtagtggctgatacttctgtcatttgtttcatagcaatgtagctttggatatttgagtattgcctgctgtaatctgccagtatagcaaaacgtttgaacacttgtattcgacccactatgtggatcttacctcactaaaattgaatatcaatgcctattgtagaacatgtccagtggtatgttattggtacttgaattgtgaaaatttttaacc

SEQ ID NO: 3726 - DNA, 781 bp, Chelidonium majus
aaagcttccacaagcccaagaaaccagaaatagttgaagattgtgatttgattgtactacttgaaaaaagatgtcaggagaagaagaagagaatgctgctgagctgaaatcggagatgaatttttgaaggccaagtgtttaattgaactgtgaagttgctctcattcttgatcggaagtatgagcagcttcagcaaatgtctaacgatccaatgaatcaagtttctcaagtatttgagaagtcactgcaatatgtgaagcgttttagccgctacaaaaaccctgatgctgttaggcaagttcgagaaatcctcagcagataccagttagctgaatttgagctctgtgtacttggcaacttgtgccctgaaactgtcgaggaagccatagctatggtcccatctattaagaccaagggacgggcacacgaggatgaagccattgagaagatgttgaatgaccttccttgattaagaaatttgaatgaaagccctgtatgttttatttctatatctagccttctgaacctacaggctagtgtacaaatggtcagaaattactgaagtgaacatccttgaagaccatcaatatgatgagtgctcatctcattagttgttaagttgttaaatcattgatatctggtgattgatttaacagttgtttagactttgtaatttatcagttgtttagactttgtgcacgagtttccctgagtacatggatcatctgatggggttgtgtacacattgcgctagttcaatttgtgttcaacataaaggaaa

SEQ ID NO: 3727 - DNA, 1410 bp, Primula obconica
ttgcaatcgcaaatcatacataattatcgcgtttgacgttactacgacaagactgcatctcatctctctctctctctctagaaagaagaaaagaagaagaagaagaaataggcggatcagctcaccgatgatcagatctctgtagtttaaggaggtctttcagcctattcgacaaggacggcgatggttgcatcacaaccaaggagcgtgggaaccgtgatgaggtcacgtgggtcagaacccgactgaagctgagctccaagatatgatcaacgaggtggatgctgatggcaacgggaccattgatttcccagagtttctcaatctgatggctcgcaagatgaaagatacggactctgaggaggagctgaaagaggctttccgtgtctttgacaaggaccagaacggcttcatctcggcagctgagctccgccacgtcatgaccaatctcggcgagaagctgacagacgaggaagtcgatgagatgatccgcgaggctgatgtggatggtgatggccagatcaactacgacgagtttgtcaaggtcatgatggccaagtgaggatctgtcaacaacccaaaactgaaatttcgaaatattgcttttggtcattacggccgaaagttctctcctctctctatatatacaatcacaaaagcgtacagcttcctccatccatctccgtttcgctctactaatcaattaatcaatcaaagaatatttgcaagtcttagaatgtctggagaagaggaggaaaatgctgctgaactcaaaattggagacgaatttttaaaggccaagtgcctgatgaactgtgaagttgctttaattcttgaacacaagtacgagcagcttcagcagatggctgatgattcagcaaaccaagtttctcaagtatttgagaagtcgctgcagtatgtgaagcgttttagccgctacaaaaatccggattcagtgagacaagctcgagaaattcttagcagataccagttggcggagtttgagctctgtgtgcttgggaatgtttgccctggtggtgtagatgaagctattgccatggttccctctctcaagagtaaagggcgcggtcttgatgaggaggcaattgagaagatgctgagcgatttggctctcattaaaaagtttgagtagctcactttccccccctctgtttcagctgaagctagcattgacgtttgtatcttgacattaaaaatgcacttcatgtgacaatatatgatgaatagtgtgtccttcgcgtgacaggtgacaaccttcatattctgatcaggttgtcccgaatattgtgatatggcaatggcattagaaaacaaatttgttttagctgtggcttttgacccttacgttttgttggttttttttggtatcagctatatagtggttctaca

SEQ ID NO: 3728 - DNA, 887 bp, Musa acuminata
atggaagttgctgatgaagcctttgtagatcaaccagtttccgagtgtttagtttcatctcgtgctttttgttatcttgataagacgaccattatacttctaactatcaagttacaattattttctgtttctgttcctcttatggtttcacttgcgcgcagagaagtcgatccactccgtcgacgcccacctttcgttccctcgtctccgcctcctgaatctttcaagtttctttgccgggcgaacatgtctggggaggaggaagagaacgccgccgaactaaagatcggcgaagaatttttgaaggcaaagtgtttgatgaactgtgaagttgcacgtattctggaccataaatatgaccagcttcagcagacgtcagatgatcctacaaaccagatatcccaggtgtttgaaaagtcaatgcagtatgtgaagcgctttagccgctacaagaaccctgatgcagtgagacaagtccgagaagtgttaagcagatataagttggctgaatttgagctttgtgtgctcggaaatctctgtcctgaaactgttgaagaagctattgcaattgtcccatctatcaagagcaaagggaggatgcttgaagatgatgcgatcgagaaaatgctgcatgatctctcactgattaagaaatttgaatagttccattcgtgcagtgaacggattgaacactttcggggtgcagcttatttagattgatgttagtgacttgtctatcctatgggtaataattagaacttaaaaccttttgagactgtgtaggatctgttggacagaatctatcaatacagttatctcctaataccttgtaagagttggataattgaatctgatgttcataagcaaattaccaaatcagatgatta

SEQ ID NO: 3729 - DNA, 617 bp, Eschscholzia californica
ttctctctcaaggatttggttggtttatttctaaccagaacaaggatccgagcagacgagcaactagggttttatcctaaatcttcgctttttctctcttgattgatctttcacaatcagatttctgaaatttttgaagaggaggatataagtgactgcaattataaagatgtcaggagaagaggaagagaatgctgcagagcttaaaattggagaggaatttttgaaggccaagtgcttgatgaattgtgaagttgctctaattcttgatcggaagtatgagcagcttcaagaaatgtctagtgatcccatgaatcaagtttctcaagtctttgagaagtcgctacaatatgtgaagcgttttagccggtacaagaaccctgatactgttaggcaagttcgagaaatactgagcagacatcagttggccgaatttgagctttgtgtgcttggcaacttgtgtcctgaaactgtagaggaagctatagctatggttccatctatcaagaccaagggacgagctcatgacgatgatgctattgagaagatgttgaatgatctctccctgattaagaaatttgagtgaaggcgtctcagcagtatcttcagatttctag

SEQ ID NO: 3730 - DNA, 874 bp, Mimulus guttatus
atttcgtgtccaaccaaagtccagaatagagagagagagagagagagagagagagagagagagagattgaacccgattttacgatttatccagttctgaagtattctcatagatcagtgaaagcagatccaataaattttttcttattttgagaaataaatcatgtcgggtgaagaagaggaaaacgccgctgagcttaaaatccccgatgaatttctgaaagccaagtgtctaatgaattccgaagtcgccataattctcgaacacaaatacgagcagcttcaacagagggctgaagatccgatgaatcaaatgtctcaggtttttgagaagtctctccagtacgtgaagcggttcagccgatataagaataatgatgctgtcagacaagtgcgagaaattctgagtagacatcagctcgctgaatttgagctctgtgtacttgggaacctttgtccagaaacagttgaagaagccatagccatggttccatccatcaagactaggggacgagcgcatgatgatgaagcaatagagagaatgttgaatgacctttctctcatcaagaaattcgaatagtcgtatctatcgtttttacgcttttgtgttgtatcgaatacgaatatgaatccgtaacgctgtcgatggctaatattttactatgcctggtgctgaattggaatttaatggctcaagcttaagccaaacaagacattaatattttgatatatatatattttggtaatcacggataggtggcggtggcggtgttttcgtagtttagcctaagtttagctttatttttaatttttttcaataatttaaagtgttgacctttgtagtaatagatattggtgatcaatcaattcaatta

SEQ ID NO: 3731 - DNA, 902 bp, Mimulus guttatus
atttcgtgtccaaccaaagtccagaatagagagagagagagagagagagagagagagagagagagattgaacccgattttacgatttatccagttctgaagtattctcatagatcagtgaaagcagatccaataaattttttcttattttgagaaataaatcatgtcgggtgaagaagaggaaaacgccgctgagcttaaaatccccgatgaatttctgaaagccaagtgtctaatgaattccgaagtcgccataattctcgaacacaaatacgagcagcttcaacagagggctgaagatccgatgaatcaaatgtctcaggtttttgagaagtctctccagtacgtgaagcggttcagccgatataagaataatgatgctgtcagacaagtgcgagaaattctgagtagacatcagctcgctgaatttgagctctgtgtacttgggaacctttgtccagaaacagttgaagaagccatagccatggttccatccatcaagactagaggacgagcgcatgatgatgaagcaatagagagaatgttgaatgacctttctctcatcaagaaattcgaatagtcgtatctatcgtttttacgcttttgtgttgtatcgaatacgaatatgaatccgtaacgctgtcgatggctaatattttactatgcctggtgctgaattggaatttaatggctcaagcttaagccaaacaagacattaatattttgatatatatatattttggtaatcacggataggtggcggtggcggtgttttcgtagtttagcctaagtttagctttatttttaatttttttcaataatttaaagtgttgacctttgtagtaatagatattggtgatcaatcaattcaattatttttataactatagtttaaaacaaaat

SEQ ID NO: 3732 - DNA, 644 bp, Centaurea maculosa
tgttcaatatgtctgctccgggagaagaggaagagaatgctgcagagcttaaaataggagacgagtttctgaaggccaagtgtttaatgaattgcgaagtctcgttgattcttgaacacaaatatgagcagcttcagcagatgtcagaagatccaacgaatcaagtttctcaggtgtttgagaaatcgctgcaatatgtgaagcgtttcagtcgctacaagaacccagatgctgttaaacaagttcgagagctactgagcagataccagttagcagaatttgagctttgtgttcttggaaacctttgccctgaaactgcagaggaagccattgccatggttccgtctatcaagtcgaggggacgtgtacatgatgatgaggctattgataaaatgctgaatgacatgacattgataaagaagttcgagtagtctccatcccccgtttctgccctggtgaccaagattgcaagtttccgatgatggacttttgtgttttgccaagtggcatcgaatgaattatgttcatgggaagtgttaattcgaccatcgattgtaaaccttgttcggagtagaaatattcaaaacccaaatgaataacgctataggtgagttgtattaattgacaatttaaagggttagtta

SEQ ID NO: 3733 - DNA, 674 bp, Centaurea maculosa
ggtctcagtgtgattcgtaagtaggttgctttaatctcattctcttaacgtttcttaaagccaggcttaagttattgttcaatatgtctgctccgggagaagaggaagagaatgctgcagagcttaaaataggcgacgagtttttaaaggccaagtgtttaatgaattgcgaagtctcgttgattcttgaacacaaatacgagcagcttcagcagatgtctgaagatccaacaaatcaagtttctcaagtgtttgagaaatcgctgcaatatgtgaagcgtttcagtcgctacaagaacccagatgctgttaaacaagttcgagagctattgagcagataccagctagcagaatttgagctttgtgttcttggaaacctttgccctgaaactgcagaggaagccattgctatggtcccgtctatcaagtcaaggggacgtgtacatgatgatgaggctatcgataaaatgctgaatgacatgacgttgataaagaagtttgagtagtctccatcttctgtttctgccctcgtgaccaagattgcaagtttctgatgatggacttttgtgtttgctaagtggcatcgaatgaattatgttcacgggaactgttaattcgcccatcgattgtaaaccttgttcggagtagaaatgttcaaacccaaaacgataatg

SEQ ID NO: 3734 - DNA, 758 bp, Centaurea maculosa
  misc_feature (8)..(8): n is a, c, g, or t
  misc_feature (545)..(545): n is a, c, g, or t
  misc_feature (558)..(558): n is a, c, g, or t
  misc_feature (582)..(582): n is a, c, g, or t
  misc_feature (739)..(740): n is a, c, g, or t
ggcttcgncgggggtctcgcacgtttcttaagccaggcttaagttattgttcaatatgtctgctccgggagaagaggaagagaatgctgcagagcttaaaataggcgacgagtttttaaaggccaagtgtttaatgaattgcgaagtctcgttgattcttgaacacaaatacgagcagcttcagcagatgtctgaagatccaacaaatcaagtttctcaagtgtttgagaaatcgctgcaatatgtgaagcgtttcagtcgctacaagaacccagatgctgttaaacaagttcgagagctattgagcagataccagttagcagaatttgagctttgtgttcttggaaacctttgccctgaaactgcagaggaagccattgctatggtcccgtctatcaagtcaaggggacgtgtacatgatgatgaggctatcgataaaatgctgaatgacatgacgttgataaagaagtttgagtagtctccatctcctgtttctgccctcgtgaccaagattgcaagtttccgatgatggacttttgtgtttnctaagtggcatcnaatgaattatgttcacgggaactnttagttcgcccatcgattgtaaaccttgttcggagtagaaatgttcaaacccaaaacgataatgctatagtgagttgtattaagtgcattaaaggttgtattttagtaagtatatttatgttcttatgtagagatgcacaatacctccctgcctttnnaggatgttttcagtaaac

SEQ ID NO: 3735 - DNA, 627 bp, Cirsium arvense
acgtttcttaaagccaggcttaagttattgttcaatatgtctgctccgggagaagaggaagagaatgctgcagagcttaaaataggcgacgagtttttaaaggccaagtgtttaatgaattgcgaagtctcgttgattcttgaacacaaatacgagcagcttcagcagatgtctgaagatccaacgaatcaagtttctcaagtgtttgagaaatcgctgcaatatgtgaagcgtttcagtcgctacaagaacccagatgctgttaaacaagttcgagagctattgagcagataccagttagcagaatttgagctttgtgttcttggaaacctttgccctgaaactgcagaggaagccattgctatggtcccgtctatcaagtcaaggggacgtgtacatgatgatgaggctatcgataaaatgctgaatgacatgacgttgataaagaagtttgagtagtctccatctcctgtttctgccctcgtgaccaagattgcaagtttctgatgattgacttttgtgtttgctaagtggcatcggatgaattatgttcacgggaacttttaattcgcccatcgattgtaaaccttgttcggagtagaactgttcaaacccaaaacgataatg

SEQ ID NO: 3736 - DNA, 558 bp, Olea europaea
cgctagattttaactatcaacaatgtctggagaagaagaagaaaacgccgccgaactcaaaattcctgatgagtttttgaaggctaagtgtctgatgaactgtgaagttgctctaattcttgaacacaagtatgagcagcttcagcagatgtctgaggatccgatgaaccaaatatctcaggtttttgagaagtcacttcaatatgtgaagcgcttcagccgttataagaatcctgatgctgtcagacaagttcgagaaattctcagtcgatatcagctggctgaattcgagtctttctgtacttgggaacctttgcccagagacggtggaggaagctcttgccatggtcccatctatcaagactcgaggacgagcacacgatgacgacgcgattgagaaaatgctgaatgatctctctactaatacaagtaattacgaattagttactttagtaattagttaatttggtacttagtaacttagtttcgggtcttcctatttctagttattgtacttagtaaaacgttggtttagtggtattctttctattcctacct

SEQ ID NO: 3737 - DNA, 953 bp, Aristolochia fimbriata
ccgattccagatccttccttcttgttgtggtatccgtcgtcgactcgtcggaagtacaacccttatcgtcggctcgtcggaagtacaacccttatcgtcggctcgggcttcttccgctgcctggtagagcctgaagcagctgctgcagctccttccggtgccatcagctccttttgtttcactgctaagatgtccggtgaagaggaagaaaacgcggcggagctgaagattggcgaagaatttttaaaggcgaaatgtttgatgaattgtgaagttgcactaattctcgatcggaaatacgagcagcttcaacagatgtctgaagatcctatgaaccaaatttctcaagttttcgagaagtccttgcaatatgtgaagcgctttagccgctacaaaaatccagatgctgttagacaagttagagaaattcttagtcggcaccagttagctgaattcgagctctgtgttctgggcaaccttagtcccgaaactgtggaggaagcaatagcaatggttccatctcttaagagccgtgaaaggtttcacaacgatgaggcgatagagacaatgttgaacgacctttctctgataaagaagtttgaatagcttcggatgtcaccgtgtggcaaatggcttgtaaattgtgttccagaggtcacttgctttttctttgaggaatgtggtgtaaatattcaagctaatggtcaatcatcgaggggtgggaagtatgttcaaccttggcttcataggtttccttcgagctcgaactccagctcgagctagacctcaattctacacctgacttcgagttcgagctccagaaaatattgagtatttgagttgaactcgagcttaggtctggcacccaccacctttaaagtgaaagaaaacaatagtagtgtgtatttaaatggaaatacttgaaacttgctgttttctcatttaaaaacaaa

SEQ ID NO: 3738 - DNA, 541 bp, Bupleurum chinense
tctcagttctctagttttgagctatcaatatgtctgcagaagaggaagagaatgcgtctgaattgaaaattggagaggagtttttgaaggcaaagtgtttgatgaattgtgaggtggccataattcttgatcacagatatgagaatcttcaacaaacgtcagaagatccgatgaatcaaatgtctcaggtgtttgagaaatcactgcagtatgtgaaacgctttagccgctacaaaaatcctgatgctgttcgacaagttcgagaaatcctcagtcgctatcaattggcagaattcgagctgtgtgttcttggcaacctttgccctgaaactgtggaggaagccattgctatggtgccatctatcaggtcccggggacgagggcttgatgacgaagcaattgagaagatgttgaatgatctctccctgattaagaagtttgagtaatggactgatatgttgtgtcccttctgatctgtatcacaaacgtaacttagtttcaacaactagcacttatatagatttctctagtatttgtagac

SEQ ID NO: 3739 - DNA, 507 bp, Cucumis sativus
catgtctggagaagaggaagaaaatgctgcagagcttaaaattggggatgagttcttaaaagctaagtgtttaatgaattgtgaagtttctttgatcctggaacacaagtatgagcagcttcaacaaagggctgaggatccaacaaatcaagtttctcaagtgtttgagaagtcactgcagtatgtgaaacgtttcagtcgctataagaaccccgatgctgttagacaagtccgagaaattctaagcagatatcaactagctgagttcgagttatgtgttcttggcaacctttgccctgaaactgtggaggaagctacttccatagttccatctttgaagactaagggaagagtgcacgaggacgaagcaatagagaagatgttgaatgatctttcattaataaaaaagttcgagtagttagctttctaaatcttaattaaatgtgttgtttatccattcttttatgacattttctcaaccggaaacaaactcaaaattttaccctt

SEQ ID NO: 3740 - DNA, 763 bp, Fagopyrum esculentum
cgcgttctattctctctcaatatttctattcgatttttaccgaacctaacccccaaattgagagcttcgtcttctctgattccttcaacatctcccttatccattcttcatctttcccggagcatagtagcagcccagcgcggtcccggagttgtgagatcaaaaaatggctgaagaggaggagaacgctgcggagcttaaaataggagacgagtttctcaaggcaaagtgtctgatgaactgtgaggttgctttgatattggaacgcaagtatgaacaactgcagcaaatgtctgaggatccggctaatcaggtttctcaggtgtttgagaagtcaatgcagtatgtgaagcgctttagccgataccagaaccctgatgctgtcagacaagttcgagagatcctcagcaggtatcagttggcggaattcgagctctgtgttcttggcaatctgtgtccagagactgttgaggaagccatagccatggtcccctccattaagactagaggaagagctcttgatgacaatgcaatccaaaagatggtggatgatcttgctttaatcaagaaatttgagtagagatttggttgttgctctcacagtgacaaaaacattcagtgttatgtaataactttggatgaaaactttttcttgtttctcttgttctttcaatgaatctatgacatatgggcctggatatttactgtcataattttgtagctgttatgttaatagggatagtcaatgagacgggttaaatac

SEQ ID NO: 3741 - DNA, 841 bp, Fagopyrum esculentum
acgcgttctattctctctcaatatttctattcgatttttaccgaacctaaccccaaattgagagcttcgtcttctctgattccttcaacatctcccttatccattcttcatctttcccggagcatagtagcagcccagcgcggtcccggagttgtgagatcaaaaaatggctgaagaggaggagaacgctgcggagcttaaaataggagacgagtttctcaaggcaaagtgtctgatgaactgtgaggttgctttgatattggaacggaagtatgaacaactgcagcaaatgtctgaggatccggctaaccaggtttctcaggtgtttgagaagtcaatgcagtatgtgaagcgctttagccgataccagaaccctgatgctgtcagacaagttcgagagatcctcagcaggtatcagttggcggaattcgagctctgtgttcttgggaatctgtgtccagagactgttgaggaagccatagctatggtcccctctattaagactagaggaagagctcttgatgacaatgcaatccaaaagatggtggatgatcttgctttgatcaagaaatttgagtagagatttggttgttgctctcacagtgacaaaaacattcagtgttatgtaataactttggatgaatacttttccttgtttctcttgttcttttaatgaatctgtggcatatgggcctggatagttactgtcataattttgtagctgttatgttaatagggacctcaatgagacgggttaaatcaatttcggtccctgtcctccttgtgatctaaaattgccgttaccatcagattccgttctttgtatgagatttccggtcgt

SEQ ID NO: 3742 - DNA, 646 bp, Utricularia gibba
aagatatgtcggctgaggaagacgaaaacgcggcggagctcaaaatccccgacgaatttttgaaggcgaaatgtctcatgaattgtgaagttgccctaattcttgaacgcaagaatgaccagcttcaacagatggctgatgattatatgaaccaaaattcgcaggtttttgagaaatctcttcagtatgtgaaacgcttcagccgatataagaaccctgatgctgtcagacaagttcgggaaatcctgagtagatataaattggctgaattcgagctatgcgtgcttgggaacctttgtcctgaaacagtggaagaagccatagccatggtgccgtccatcaaggctaaagggcgagcacatgatgatgatgcaattgagaaaatgctgaacgatctttccctcattaagaagtttgagtagtctgtgccctccacctgatggttggaaaggaattcaccagcactagtcgcagaggcgtaccccctattttcacttctagaatcttgcctgtatgtatcaagaggagaaatgtgattgtgaaaattaatgttggattaacttttcatcttccaaatttgaacaaggaggtttcttcttattacatgaacctatgtattactttggtaagaaaaaaaaaaaaacac

SEQ ID NO: 3743 - DNA, 709 bp, Senecio madagascariensis
aagcagtggtatcaacgcagagtacgcagggacagcatttgcattctccatcgatcaaaggattaagtaatttctagatatgtctggagctgctggagaagaggaggagaatgccgcagagcttaaaataggcgatgagtttctcaaggctaagtgtttaatgaactgtgaagtcgctttgatacttgaacacaaatatgatcagcttcagcagatgtctgaagatccaatgaatcaagtttctcaggtgtttgagaagtcactgcagtatgtgaagcgtttcagtcgctacaagaatccagatgctgttagacaagttcgagaactattgagtagataccagttagcagaatttgagctttgtgttcttggaaacctttgccctgaaactgttgaggaagccattgctatggtcccatctatcaagtctaggggacgaggacatgatgatgaagctatcgacaaaatgttgaacgatatgtctttaattaagaagttcgagtagtttccataatgccttgtgtcattatcaccagggttggacgtttctggagatgttctttgtgctctctagtgttgatgtagaaaaaatatgttaaacaacatttttgggatttttgaacccaaaaccgtaatgctatagtgacttgtattaagatcattggagctttatttttaatcatattaacttcctgttcttttttaaaaa

SEQ ID NO: 3744 - DNA, 676 bp, Centaurea maculosa
caggcttaagttattgttcaatatgtctgctccgggagaagaggaagagaatgctgcagagcttaaaataggcgacgagtttttaaaggccaagtgtttaatgaattgcgaagtctcgttgattcttgaacacaaatacgagcagcttcagcagatgtctgaagatccaacaaatcaagtttctcaagtgtttgagaaatcgctgcaatatgtaaagcgtttcagtcgctacaagaacccagatgctgttaaacaagttcgagagctattgagcagataccagttagcagaatttgagctttgtgttcttggaaacctttgccctgaaactgcagaggaagccattgctatggtcccgtctatcaagtcacggggacgtgtacatgatgatgaggttatcgataaaatgctgaatgacatgacattgataaagaagtttgagtagtctccatctcctgtttcttccctcgtgaccaagattgcaagtttccgatgatggacttttgtgtttcctaagtggcatcgaatgaattacgttcacggcaactgttggttcgaccatcgattgtaaaccttgttcggagtagcagtgttcttaccccacacgatgatgatagtgagttgtattaagtgcattgaaggttgtattttaataagtatatttatgttcttatgt

SEQ ID NO: 3745 - DNA, 723 bp, Arabidopsis lyrata
tcactttcgttgttagtcggaaaaaaaaaactagaggcggaacaaaaaaacttttaggtttcgatttccctccttggtaatcgccatgtccggagaagaagaagagaacgccgccgaactcaagatcggagatgagtttttgaaggcaaagtgcttaatgaattgtgaagtctctttgattcttgagcacaagtttgaacagcttcaacaagtctcagaggatcctatgaatcaagtttctcaagtgtttgagaagtccttgcaatatgtgaagcgattcagccggtacaagaatccagacgctgttagacaagttcgagaaatactgagcagacatcaacttactgagtttgagctatgtgttcttggcaatctctgtcctgaaactgttgaagaagcagtggcaatggttccttctcttaagacaaaaggaagagctcatgatgatgaagcaattgagaagatgcttaatgatctctctcttgtcaagagattcgagtagtgcagaagattctcaagatcatagactaagaacatttggcaggatgctttacttgccttctagctgatctggagttaattttccatgtctgaaattataaagctttatatgcccagaatctcttgaatggataccttatgttaaatgaatgtaattttcaatggatgacaatggatgatccaagctttcaatgaaatataccatttctttttcactaaatc

SEQ ID NO: 3746 - DNA, 715 bp, Arabidopsis thaliana
atattcatcactttcgttgttaagacggaaaaaaaaaaaaaagaggcagaaccaaaaaactttagggttcgatttcgctccttggtaatcaccatgtccggagaagaagaagagaacgccgccgaactcaagatcggagatgagtttttgaaggcaaagtgcttaatgaactgtgaagtctctttgattcttgagcacaagtttgaacagcttcagcaaatctcagaggatcctatgaatcaagtttctcaagtgtttgagaagtccttgcaatatgtgaagcgattcagccgctacaagaatccagatgctgttagacaagttcgagaaatactaagcagacatcaactcactgagtttgagctatgtgttcttggcaatctctgtcctgaaactgttgaagaagcagtggcaatggttccttctcttaagacaaaaggaagagctcatgatgatgaagctattgagaagatgctcaatgatctctcacttgtcaagagattcgagtagtgcagaagattctcaagatctaagattctgaacatttagcaggatgctttacttgccttctagctgatctggagttaattcgccacgtctgaaattataaagctttaatgcctagaatttctggaatgataccttcatgttaaatgaatgtaatttacaacggatgatccaagcttttaatgaaatataccatctctttttcact

SEQ ID NO: 3747 - DNA, 801 bp, Fagopyrum esculentum
cgcgttatattctctcaatacctctattcgatttttacagaaccctaacccccaatttgagagcttcgtcttctctgattccttcaccatctcccttcttcaatcttcgtctccccggagcatagtagcaatccggcgcggtcccggagttgtgagatcaaaaaatggctgaagaggaggagaacgctgccgagctcaaaataggagaagagtttctcaaggcaaagtgtctgatgaactgtgaggttgctttgatattagagcgcaagtacgagcaactacaacaaatgtccgaggatccatcaaaccaggtttctcaggtgtttgagaagtcaatgcagtatgtgaagcgctttagcagataccagaaccctgatgctgtcagacaagttcgagagatcctgagcaggtatcagttggcggaattcgagctctgtgttcttggcaatctgtgtccagagactgttgaggaagccatagccatggtcccctctattaagactagaggaagagctcttgatgacaatgcaatccaaaagatggtggatgatcttgctttgatcaagaaatttgagtagagatttggttgttgctctcacagtgacaaacattcagtgttatgtaataactttggattattactttgccttgtttctcttgttctatgaatctatggcatatgggcctggatagttactgttataattttattgcagttatgttaataggatgtcaatgagacaggttaaagccatttcagtccctgtcctcacttgtgatctaatattgccgttaccatac

SEQ ID NO: 3748 - DNA, 438 bp, Sesamum indicum
gcagagcgactgtttatctgttcagttttgctttcggctgtcaaatatgtcggtggaagaagaggaaaacgcggccgagctcaaaatcccagatgaatttttgaaggccaagtgtctaatgaactgtgaagttgctcttattcttgaacataagtatgagcagcttcaacagatggcggatgacccaatgaatcaaatgtcacaggtttttgaaaaatcactccaatatgtgaagcgctttagccgatataagaatccggatgctgtcagacaagttcgagaaattctgagtagatatcagctggctgaatttgagctctgtgtacttgggaatctttgtccagaaacggtggaggaagccatagccatggttccgtcaatcaagacgagaggacgagctcatgatgacgaggcaattgagaaaatgttgaatgacct

SEQ ID NO: 3749 - DNA, 601 bp, Euphorbia peplus
atcagaatgtctggagagaggaagaaaacgccgctgaactcaaaatcggagatgagtttctgaaggctaagtgcttgatgaattgcgaagtatcattaattcttgaacacaaatatgagcagcttcaacagacgtctgaggatccaatgcaccaaatctctcaagtatttgagaagtccctgcagtatgtgaggcgttttagccgctataaaaatcctgatgctgtcagacaagttcgagaaattctgagccgataccagttagctgaatttgagctatgtgttcttggaaacctttgccctgaaactgtagaagaagctattgccatggtaccgtccatcaaggcaaaagggcgggttcatgatgatgaggcgattgagaagatgttgcatgacctgtcactgatcaagagatttgagtagcagctgcaacataatgtgtacaagcatagctattttcatttccatatatctctaaaatcacattgtaccatttgattcagtttatcagtctctggattcttgtgatgtacggtcagaggccattaaccctgaatcggtgccaatacagaggatcgtggtcctgtaaacactttaaaaaa

SEQ ID NO: 3750 - DNA, 767 bp, Brassica rapa
ctttcttctttttatattactgagattgtttcttttggccttataattctctttcactcgttcgacgagaaaaatcaaaatcaagagaagaaaaaagataatctctaaagggttcgatttgcctcgcaatgtctggagaagaagaagagaacgccgccgagctcaagatcggagacgagtttttgaaggcgaagtgcttaatgaactgtgaagtgtctttgatccttgagcacaagtacgagcagctgcagcaagtctccgaggatcctatgaatcaagtttctcaagtgtttgagaagtcgttgcagtatgtgaaacgttttagccgctacaagaatccagatgctgttagacaagttcgagaaatcctgagtagacatcagctcactgagtttgagctttgtgttcttggcaatctctgtcctgaaactgctgaagaagctgtggctatggttccctctctcaagacaaaaggaagagctcatagtgatgaagcaattgagaagatgctcaatgatctctcccttgtcaagagatttgagtagttcataaaaattctcaagatctaagattatgaaccgattagtagtatttcagggtgtcgtattcgcctttaagctgatgatgtcttgagttaattttccaatgtctgaaattatgacactctcatggccataatctctggaacgatacccttcatgtttaatgaatgtagtttacaatggatgatccaagcttgcaatgaaatatacatctttttacttgat

SEQ ID NO: 3751 - DNA, 781 bp, Brassica rapa
gttctacttctctgcgttggcttaataaatttctcttcacttcggctccgttgttagaaaaggagagaagagaagagaaagagaagctcaggattcgatttccttctgccatgtctggagaagaagaagagaacgccgccgaactcaagatcggagacgagtttttgaaggcaaagtgcttaatgaactgtgaagtgtctttgatccttgagcacaagtatgaacagcttcagcaagtctccgaggatcctatgaatcaagtttctcaagtgtttgagaagtccttgcagtatgtgaagcggtttagccgctacaagaatcctgatgctgttagacaagttcgagaaatcttgagcagacatcaactcactgagtttgagctttgtgttcttggcaatctatgtcctgaaactgctgaagaagcagtggcaatggttccttctctcaagacaaaaggaagagctcatagtgatgaagcaattgagaagatgcttaatgatctctcccttgtcaagagattcgagtagttacagaaagctctcaagatctaagtttataaacatgtttcagggtgctacattcaccttctagctgatgatgatgtctgagggttggtttttcgtgtctaaaattataaagctttcatgctcagaaatctgaatctctggaatgacatcatcatgttaaatgaatgtggtttacaattggcttatctatgttttcgatgtaattaattcgtaaatttaatcagtaaaaataactacagattagtgaagagaaa

SEQ ID NO: 3752 - DNA, 771 bp, Brassica napus
tataattctctttcactcgttcgacgagaaaaatcaaaatcaagagaaggaaaaagataatctaaaagggttcgatttgcctcgcaatgtctggagaagaagaagagaacgccgccgagctcaagatcggagacgagtttttgaaggcgaagtgcttaatgaactgtgaagtgtctttgatccttgagcacaagtacgagcagctgcagcaagtctctgaggatcctatgaatcaagtttctcaagtgtttgagaagtccttgcagtatgtgaagcgatttagccgctacaagaatccagatgctgttagacaagttcgagaaatcttgagtagacatcaactcactgagtttgagctttgcgttcttggcaatctatgtcccgaaactgctgaagaagctgtggctatggttccttctctcaagacaaaaggaagagctcacagtgatgaagcaattgagaagatgctcaatgatctctcccttgtcaagagatttgagtagttcataaaaattctcaagatctaagattatgaaccgattagtagtatttcagggtgtcgtattcgcctttaagctgatgatgtcttgagttaattttccaatgtctgaaattatgacactctcatggccataatctctggaacgatacccttcatgtttaatgaatgtagtttacaatggatgatccaagcttgcaatgaaatatacatactttttaaaaaaaaaaacaacgtagactacgcgacgagacacaggaggtagagccccg

SEQ ID NO: 3753 - DNA, 610 bp, Brassica napus
tctgccatgtctggagaagaagaagagaacgccgccgaactcaagatcggagacgagtttttgaaggcaaagtgcttaatgaactgtgaagtgtctttgatccttgagcacaagtatgaacagcttcagcaagtctccgaggatcccatgaatcaagtttctcaggtgtttgagaagtccttgcagtatgtgaagcggtttagccgctacaagaatcctgatgctgttagacaagttcgagaaatcttgagcagacatcaactcactgagtttgagctttgtgttcttggcaatctatgtcctgaaactgctgaagaagcagtggcaatggttccttctctcaagacaaaaggaagagctcatagtgatgaagcaattgagaagatgctcaatgatctctcccttgtcaagagattcgagtagtgcagaaagctctcaagatctaagtttataaacatgtctagctgatgctgtctgagagttagttttcatgtctaaaattacaaagcttttatgctcagaatctctgcaatgacatcatcgtgttaaatgaatgtggtttacaattggcttatctaagttttcgatgtaattaattcgtaaatttaac

SEQ ID NO: 3754 - DNA, 778 bp, Brassica napus
tacttagttgttagtattttccgttcgtttaaagtttaaccgtttagttaacgtaacttagtagtagtcgtaattacgtactagttggtcgtacgtgaccgtcgttagttactataaattaagtattatgtttaaattaaaaacaaaaaaagtaaataaatctaaaagggttcgatttgccacgcaatgtctggagaagaagaagagaacgccgccgagctcaagatcggagacgagtttttgaaggcgaagtgcttaatgaactgtgaagtgtctttgatcctcgagcacaagtacgaacagcttcagcaagtctccgaggatcctatgaatcaagtttctcaagtgtttgagaagtccttgcagtatgtgaagcgatttagccgctacaagaatccagatgctgttagacaagttcgagaaatcctgagtagacatcagctcactgagtttgagctttgtgttcttggcaatctctgtcctgaaactgctgaagaagcagtggctatggttccctccctcaagacaaaaggaagagctcatagtgatgaagcaattgagaagatgctcaatgatctctctcttgtcaagagatttgagtagttcataaaaattctcaagatctaagatcatgaaccgattagtatttcagggtgttgtattcgcctttaagctgatgtcttgagttaatttttcatgtctgaaattataacgctctcatggccagaatctctggaacgataccttcatgagttcatgtttaatgaatgtagtttac

SEQ ID NO: 3755 - DNA, 721 bp, Brassica napus
gcgttggcttaataaatttctcttcacttcggctccgttgttagaaaaggagagaagagaagagaaagagaagctcaattcgatttccttctgctatgtctggagaagaagaagaaaacgccgccgaactcaagatcggagacgagtttttgaaggcaaagtgcttaatgaactgtgaagtgtctttgatccttgagcacaagtatgaacagcttcagcaagtctccgaggatcccatgaatcaagtttctcaggtgtttgagaagtcgttgcagtatgtgaagcggtttagccgctacaagaatcctgatgctgttagacaagttcgagaaatcctgagcagacatcaactcactgagtttgagctttgtgttcttggcaatctatgtcctgaaactgctgaagaagcagtggcaatggttccttctctcaagacaaaaggaagagctcatagtgatgaagcaattgagaagatgctcaatgatctctcccttgtcaagagattcgagtagtgcagaaagctctcaagatctaagtttataaacatgtctagctgatgctgtctgagagttagtttttcatgtctaaaattacaaagcttttatgctcagaatctctggaatgacatcatcgtgttaaatgaatgtggtttacaattggcttatctaagttttcgatgtaattaattcgtaaatttaatcagtaaaaatatgaagaaaaa

SEQ ID NO: 3756 - DNA, 751 bp, Humulus lupulus
ctgctgagctcaaaattggagacgagtttttgaaggccaaatgtctaatgaactgtgaagttgcgctcattcttgaacgtaaatatgatcaacttcaacagatgtctgatgatccactaaatcaagtttctcaggtgtttgagaagtcactgcagtatgtaaagcggtttagccgctacaaaaatcctgatgccgttagacaagtgcgagaaattctaagcagatatcaattggctgaattcgagctttgtgtgcttggcaatctctgtcctgaaactgtggaagaagctattgctatggtaccatctataaagaccaaaggaagggcacacgatgatgaagctattgagaaaatgttgaatgatttatcattaatcaagaaatttgagtagcggtttgatctgccccaggttatttgtctttcaaagtagaagttttctatgcttgtattactaatatcatttaagaaatttagaattggaagagctttgcatgagcggactggatgctttgttaatgagaccatcctctctttgtttgaatgtatattggttctcatcttattcattcgagggcaatttagaaacagggacaaagaacaaaggctcttctattctaaacttggcaaaatgcttaagaaaatttgttactataaattgagattcgaggtcaaatgttagtatcgcatataatgagcttctgggatgcttctattttactccccccccttctttctaataaagaaaacgta

SEQ ID NO: 3757 - DNA, 694 bp, Raphanus sativus
cttttcactcgttcgacgagaaaaaacaaagttgaaggaaaaaaaaatctaaaagggatcgatttgccacgccatgtctggagaagaagaagagaacgccgccgagcttaagatcggagacgagtttttgaaggcgaagtgcttaatgaactgtgaggtctctttgatccttgagcacaagtatgaacagcttcagcaagtctccgaggatcctatgaatcaagtttctcaagtgtttgagaagtccttgcagtatgtgaagcgttttagccggtacaagaatccagatgctgttagacaagttcgagaaatcctgagtagacaccaactcactgagtttgagctctgtgttcttggcaatctctgtcctgaaactgctgaagaagcagtggctatggttccttctctcaagacaaaaggaagagctcatagtgatgaagcgattgagaagatgctcaatgatctctcccttgtcaagagatttgagtagtgcagaaagttctcgagatctaagattataaacagtttaatttgagggtgttatattcaccttttagatgatgtcttgagttaatttttcatgtctgaaatttaaagctttccagaatctctagaataataacttcatgtttaatgaaatgtagtttacaatactttaatatgaagctgcaattctatcttcccttgggaaaaa

SEQ ID NO: 3758 - DNA, 764 bp, Eutrema parvulum
tataattctcttcacatccgtcctgtcgttgctagacgaaaaaaacaagagaagaaaacgaaaacctaagggttcgattttcctcctcagtactcccaatgtccggagaagaagaagaaaacgccgccgagctgaagatcggagacgagtttttgaaggcaaagtgcttaatgaactgtgaagtctctttgatcctcgagcacaagtatgaacaacttcagcaggtctccgaggatcctatgaatcaagtttctcaagtgtttgagaagtccttgcaatatgtgaagcgatttagccgatataagaatccagatgctgttagacaagttcgagaaatactgagcagacatcaactcactgagtttgagctctgtgttcttggcaatctctgtcctgaaactgctgaagaagcagtggcaatggttccttctcttaagacaaaaggaagagctcataatgatgaagcaatcgagaagatgctcaatgatctctcccttgtcaagagattcgagtagtgcagaaaattctcaagatctaaaattacaagcatatttatattcgccttttacctgatgtctggagttaatttttcatgtctgatattataaagcttccatggccagaatctctggaatgataccttcgtgttaaatgaatgtaatttacaatggatgatccaagtttgcaatgaaatccatatctttttactaaatggagttattagtaacatcatctgaatatgatataccgaaagctacgtgtga

SEQ ID NO: 3759 - DNA, 901 bp, Cynara scolymus
  misc_feature (807)..(807): n is a, c, g, or t
ctcggcgggatcctaatcgctggactcgtcgtctcgctgtggcctgtgacgctctcggcctctctcgtctgtaactcgtactcgaggtgatttaagattttgatccaggcttaatctatctttcattatgtctgctgctggagaagaggaagagaatgctgcagatctgaaaataggcgatgagtttctgaaggccaaatgtttaatgaattgcgaagtctccttgattcttgaacgcaaatacgatcagcttcagcagatgtcagaagatccaatgaatcaagtttctcaagtgtttgagaaatccctgcaatatgtgaagcgtttcagtcgctacaagaacccagatgctgttagacaagttcgagagctactgagtggataccagttagcagaatttgagctttgtgttcttggaaatctttgccctgaaactgtggaggaagccattgctatggtcccgtctatcaagtcgaggggacgtgtacatgatgatgaggctattgagaaaatgctgaatgacatgtcgttaataaagaagttcgagtagtctctattctctcgtttctgccctcgttaccaaggttgcaagttatggactttgtgttttgtatgtgacgttgcacgaatcatattaagcggaactgttggatataatgcattcggacgttgatagtaaaacttgttcagagcagaaattttcgaacccaaaactataatgctacaatgaattgtatcaagtgtattgaaggttgtattttagtgcttttatctatattttatgtagagatgcacatgcccatgccnttcagtccgttttctataaacaaaaaaaggcctgggctttttcatccggggggctgaaaaggggcagactgggcttttagggtgtgcttggttt

SEQ ID NO: 3760 - DNA, 694 bp, Raphanus sativus
ggggaggttttgcttgtttcgctgtcagaaggagaaaataaaagcttagggttcaatctccctcactcgccatgtccggagaagaagaagaagagaacgccgccgagctcaagatcggagatgagtttttgaaggcaaagtgtttaatgaactgtgaggtctcattgatccttgagcacaagtatgaacagcttcagcaggtctccgaggatcctatgaatcaagtttctcaagtgtttgagaagtccttgcagtatgtgaagcggtttagccggtacaagaatccagatgctgttagacaagttcgagagattctgagtagacatcaactcactgagtttgagctctgtgttcttggtaatctatgtcctgaaactgctgaagaagcagtggctatggttccttctctcaagacaaaaggaagagctcatagtgatgaagcaattgagaagatgctcaatgatctctcccttgtcaagagattcgagtagtgcagaacattctcaagatctaaacattataaacataaaatctttttagctgatgtgtctgaagttgatttttcatgtctgaaattataaaagctttcatgtatttccggaactatatcttcaatgttaaatgaatgtaacttgcaatggatgatcgcaagcttgcaatgatatatgaattatgaataatatgacgtacccga

SEQ ID NO: 3761 - DNA, 694 bp, Raphanus sativus
  misc_feature (52)..(52): n is a, c, g, or t
ggagctttgcttgtttcgctgtcagaaggagaaaataaaagcttagggttcnatctccctcactcgccatgtccggagaagaagaagaagagaacgccgccgagctcaagatcggagacgagtttttgaaggcaaagtgtttaatgaactgtgaggtctcattgatccttgagcacaagtatgaacagcttcagcaggtctccgaggatcctatgaatcaagtttctcaagtgtttgagaagtccttgcagtatgtgaagcggtttagccggtacaagaatccagatgctgttagacaagttcgagaaatactgagtagacatcaactcactgagtttgagctctgtgttcttggcaatctctgtcctgaaactgctgaagaagcagtggctatggttccttctctcaagacaaaaggaagagctcatagtgatgaagcaattgagaagatgctcaatgatctctcccttgtcaagagattcgagtagtgcaaaacattctcaagatctaacatattataaacataaatcttttttagctgatgatgtctggagttaatttttcatgtctgaaactataaaagctttcatatcagtatttccggaattataacttcaatgttaaatgaatgtaatttgcaatggatgatcccaagcttgcaatgatatatgaattatgaataatatgacgtacc

SEQ ID NO: 3762 - DNA, 755 bp, Curcuma longa
gcacgcagtggcatctctttccggcgtccctttcgcctcctgtggggagtctctaccgttatctcgttctctctctcgcccgcgttcatcgtctcagtctccgtctccgctggttctcgtcatgtcgggagaggaggaagagaacgctgctgaattaaagatcggggatgagtttctgaaggccaaatgtctgatgaattgtgaagttgctcgaattctcgatcacaaatacgatcaactccagcagatgtctactgatcctacaaaccagatctcccaagtatctgagaaatcaatgcaatatgtcaaacgctttagtaactacaaacacagatgcagtgaggcaagcacgagaagttataagcagatacaaattagcggagtttgagctttgtgtactgggaaatctctgtcctgatactgttgaagaagctattgcaattgtcccatctatcaagagcaaaggtcggaagctggaagacgatgcgattgagaaaatgctgcacgatctctcgttgatcaagaaatttgaatagcacgctaacacgatggatggagtaattgctggaaccaacactgatagtcgaggcattgctcttagaatcgatatgttgtgcacactgtttaattctatcgcaggtaactggcgctttggatactaatcgcttgaggaagcgttgtagtagtaggaattgtccgttggtagtgttgcactttcgttttaagatcaacatgacactttataaaattataat

SEQ ID NO: 3763 - DNA, 992 bp, Aristolochia fimbriata
aagcagtggtaacaacgcatccgattttatttttttcttagactgattttgctctgaactataaggagatccgattgtggagctcgtagaacaggcatgggctaccttcgacaagttttggtgatcaaggatgtctggggaagaggaagagaatgcagcggagttgaagattggtgatgagtttttgaaggcaaagtgtttaatgaactgtgaagtctcgttgatacttgagaggaggtacgagcagctacaacagatgtctgatgaacatttgaaccaagtttctcaagtgtttgagaaatcacagcagtatgttaagcgctttagtcgctataaaaatcctgacgctgtgagacaagttagagaaattcttagtcgacacaagctggctgagttcgagctttgtgtgttgggcaacttaagccctgaaacggtggaggaagccatagcaatggttccttctctcaagaccaaaggaaggtttcagaatgatgaagctatcgagacaatgttgaacgacctttccctgatcaagaaatttgaataagtctcagtgtttattggcctactgaaccacatccaactgctgttgttattggacaaaattcttcgtagtttcatcagtgttacttgaaagttgaaatgttgtcattctgtatttcagttaatgacaataaaagagggaagctcgaggaattcttcgtgagaaagaactgacccccttaataatctctttcagagttgacatgaaacgtttcttcaaattctcacaaaacctctgatgttgggccggagttataacaagctttacttggattccaacggaaactaaagcagcattagtagcatcgcttgggttttccaattaagctaagcggaacgcttcaggtacgatttcaaacgattcggtgctcacaggaaaaagtgggaaagaggcaagcaatagaattttgcgcacgctagtgtttaaaagtggaattagaataacatcg

SEQ ID NO: 3764 - DNA, 533 bp, Brassica juncea
ctcgccatgtctggagaagaagaagagaacgccgccgagctcaagatcggagacgagtttttgaaggcgaagtgcttaatgaactgcgaagtctcgttgatccttgagcacaagttcgaacagcttcagcaggtctctgaggatcctatgaatcaagtttctcaagtgtttgagaagtccttgcagtatgtgaagcgttttagccggtacaagaatccagatgctgttcgacaagttcgagaaatcctgagtagacatcagctcactgagtttgagctctgtgttcttggcaatctctgtcctgaaactgctgaagaagcagtggcaatggttccttctctcaagacaaaaggaagagctcatagtgatgaagcaattgagaagatgctcaatgatctctcccttgtcaagagatttgagtagtgcagaaattttctcaagatctaagattataaacagatttatatttcagggtgttacactcaccttttagctgatgtcttgagttaattttcatgtctgaaattataaag

SEQ ID NO: 3765 - DNA, 736 bp, Brassica juncea
agctttgcttgtttcgctgtttcgatatccccatcactcgccatgtccggagaagaagaagagaacgccgccgagctcaaaatcggagacgagtttttgaaggcgaaatgtttaatgaactgtgaggtctcattgatccttgagcacaagtatgaacagcttcagctggtctccgaggatcccatgaaccaagtctcgcaagtgtttgagaagtcgttgcagtatgtgaaacgttttagccgctacaagaatccagatgctgttagacaagttcgagaaatactgagtagacatcaactcactgagtttgagctctgtgttcttggcaatctctgtcctgaaactgctgaagaagcagtggcaatggttccttctctcaagacaaaaggaagagctcatagtgatgaagcaattgagaagatgctcaatgatctctccctggtcaagagattcgagtagtgcaaaacattctcaagattaaagattataagcatacatcagggggtgtcttttagctgatgatgtctggatttaatttttcatgtctgaaattataaagctctaagtgtctccggaattataccttcatgttaaatgaatgtaatttacaatggatgattatgaatgtaatttgcaatggatgatccaagcttgcattatgatatacataaagctacttgtgaagcttcaactccaaatttccagaaattatcactgaagtatataattgttaata

SEQ ID NO: 3766 - DNA, 716 bp, Brassica oleracea
  misc_feature (605)..(605): n is a, c, g, or t
ggttgcttgtttcgctgtcagaacgagagaaagaaaagcttagggttcgatctcgctcactcgccatgtccggagaagaagaagagaacgccgccgagctcaagatcggagacgagtttttgaaggcgaagtgtttaatgaactgtgaagtgtctttgatccttgagcacaagtatgaacagcttcagctggtctccgaggatcctatgaaccaagtctctcaagtgtttgagaagtcgttgcagtatgtgaagcgttttagccgctacaagaatccagatgctgttagacaagttcgagagatactgagtagacatcaactcactgagtttgagctctgtgttcttggcaatctctgtcctgaaactgctgaagaagcagtggcaatggttccttctctcaagacgaaaggaagagctcatagtgatgaagcaattgagaagatgctcaatgatctctcccttgtcaagagattcgagtagtagtgcaaaacattctcaagattgaagattagaaacatacatcagggtgccttttagctgatgatgtctggagtttatttttcatgtctgaaattataaagctttcatatcagtatctccggnattataccttcgtgttaaatgaatgtaatttacaatggatgattatgaatgtaatttgcaatgggatgatgatccaagcttgtcatgatatatgaatatgatgtgcctaaa

SEQ ID NO: 3767 - DNA, 691 bp, Brassica napus
aaatcaagagaagaaaaaagataatctaaaagggttcgatttgccacgcaatgtctggagaagaagaagagaacgccgccgagctcaagatcggcgacgagtttttgaaggcgaagtgcttaatgaactgtgaagtgtcgttgatcctcgagcacaagtacgaacagcttcagcacgtctccgaggatcctatgaatcaagtttctcaagtgtttgagaagtcgttgcagtatgtgaagcgatttagccgctacaagaatccagatgctgttcgacaagttcgagaaatcctgagtagacatcagctcactgagtttgagctttgtgttcttggcaatctctgtcctgaaactgctgaagaagcagtggctatggttccctccctcaagacaaaaggaagagctcatagtgatgaagcaattgagaagatgctcaatgatctctcacttgtcaagagatttgagtagttcataaaaattctcaagatctaagattataaaccgaagaaccgattagtatttctgggtgttgtattcccctttaagttgatgtcttgagttaatttttcatgtctgaaattatgacgctcgcattgtatacatctttttacttgatatacctaaagttacaagtgtgaagttctcactcctagaataagagatggcatatacaaagggcggcccctccagag

SEQ ID NO: 3768 - DNA, 891 bp, Phalaenopsis aphrodite
ttgtatactaaaccctcgcccaaaagtatcgatttcatgatggaacctttgcgatacacttgccatcatagatagctgggaaaggcagcgaggggatcgtggcttacagagactaccgaaactcccatcggtctgctctgctccgctgctgccagaactcattgagaaaggattggatttagcttaaatcctgcgtaaaaccggctgccgaacagcctcctggtcgagctacgtgcaacccagtaggcccagtgggttccaggcttggatttgggtgtcactatgtcggccgaggaggaagaaaatgccgccgaactcaaaattggcgaagagtttttgaaggcaaaatgtttaatgaattgtgaagttgcacttattcttgatcgaagattagagcaacttcagcagatgtctgatgatcctacaaatcaaatgtctcaggtatttgaaaagtcacatcaatatgttaagcgctttagtcgctacaagaatcaggatgcagtaaaacaagttagagaaatcctaagtaggaataaactggctgaattcgagctctgtgtgcttggaaatctctgccctgaaactgttgaggaagcaattgccatggtgccatctcttaagaccaaaggccggtcccttgaagatgatgcaattgagaaaatgctgaacgatctctctttgataaagaaatttgaatagaaccaaagaggaaatttacattgtatgtcattgatggacgtattcttccttgctgagaatggctgtaatgtatgaaacataaaatagaagaaatattaagtgtctctacacctaaatgtgaacttccttttaatcttttgttgttcagcaacatccgatacaagatatttcatataatggtgtgattttaat

SEQ ID NO: 3769 - DNA, 508 bp, Salvia sclarea
gcacgaggcttcaaaaatcgctaccgcgatcggtctttccggttagatttttgcttggaaaatcgaagatgtcgacggaagaagaggagaatgccgctgagctcaaaattcccgatgaatttttgaaggccaaatgtcttatgaattgtgaagtttctcttatacttgaacataaatatgagcagcttcagcagatggccgatgatccattgaatcaaatgtctcaggtgtttgagaaatcactccaatatgtgaagcgctttagccgatacaagaaccctgatgctgtcagacaagttcgagaaattcttagcagatatcagctggctgagttcgagctctgtgtacttgggaacctttgtccggaaacagtggaggaagctatagccatggttccgtccatcaagaccagaggaagagcgcatgatgatgaggcaattgagaagatgttgaacgatctctccttggatcaaaaagttcgagtagtcttctttccgttataagcatg

SEQ ID NO: 3770 - DNA, 666 bp, Fragaria vesca
attgaaattcccttggacctgaaaaagagggttccaaattccagtctaggtatccgtcaccgtctctgctcgctcgttaaacatgtccggcgaagaggaagagaacgccgccgagctcaaaatcggagacgagtttctcaaggccaagtgtttgatgaactgcgaggtttctctgattcttgagcacaagttcgagcagcttcagcagatgtctgatgatcccaggaaccaagtctcccaggtgtttgagaagtctctacagtatgtgaagcgatttagccggtataagaatgctgatgctgtgaagcaagtgagagaaatcctcagtagatatcagttgactgagtttgagctttgtgtgcttgggaatctctgccctgaaactgttgaggaggccattgctatggtaccatctataaaggcaaaaggacgggtgcatgatgatgaggtgattgacaaaatgttgaatgacattgcaatgatcaagaaatttgattagaggcttatacttctgtcctatgttttatagcaatgtagctgaatatttgggtatttggctattgtaatctgccagtgaagcaaaacgtttgaactcttgtttgaccctttatatggatcttaccttactaatcttgaatatcactacctattgttgaatatgtccag

SEQ ID NO: 3771 - DNA, 736 bp, Carthamus tinctorius
ggcgggggtcttgtgtctcgcacgtttcttaagccaggcttaagttattgttcaacatgtctgctgcgggagaagaggaagagaatgctgcagagcttaaaataggcgacgagtttctgaaggccaagtgtttaatgaattgcgaagtctcgttgattcttgaacacaaatatgagcagcttcagcagatgtctgaagatccaatgaatcaagtttctcaggtgtttgagaaatcgctgcaatatgtgaagcgtttcagtcgctacaagaacccagatgctgttaaacaagttcgagagctactgagcggataccagttagcagaatttgagctttgtgttcttggaaacctttgccctgaaactgcagaggaagccattgccatggttccgtctatcaagtcgaggggacgtgtacatgatgatgaggctattgataaaatgctgaatgacatgacgctgataaagaagttcgagtagtctccatctcctgtttctgctcatgtgaccgagattgcaagtttccggtgatggactttgtgtttgctaagtggcatcgaatgaattatgttcatgggaactcttagttcgaccatcgattgtaaaccttgttcggagtagaaatgttcaaacccaaaacgataatgttattgtgagttgtatcaagtgcattaaaggttgtattttagtaagtatatttatattcttatgtagagatgcacattacctccaaaaaa

SEQ ID NO: 3772 - DNA, 777 bp, Brassica napus
cctcagtcacgttcataggtgatatcaattctatcggccatacggccggggagagttcttgtttcgctgtcagaacgagagaaaaaaagcttagggttcgatctcggttcactcgccatgtccggagaagaagaagaagagaacgccgccgagctcaagatcggagacgagtttttgaaggcgaagtgtttaatgaactgtgaagtgtctttgatccttgagcacaagtatgaacagcttcagctggtctccgaggatcctatgaaccaagtctctcaagtgtttgagaagtcgttgcagtatgtgaagcgttttagccgctacaagaatccagatgctgtacgacaagttcgagaaatactgagtagacatcaactcactgagtttgagctctgtgttcttggcaatctctgtcctgaaactgctgaagaagcagtggcaatggttccttctctcaagacgaaaggaagagctcatagtgatgaagcaattgagaagatgctcaatgatctctcccttgtcaagagattcgagtagtagtgcaaaacattctcaagattgaagattagaaacatacatccgcgtgccttttagctgatgatgtctggagtttatttttcatgtctgaaattataaagcttttaagtgtctccggaattatgccttcatgttaaatgaatgtaatttacaatggatgattatgaatgtaatttgcaatgggatgatgatccaagcttgccatgatatatgaatatgacgtgcctaaagcttacttgt

SEQ ID NO: 3773 - DNA, 776 bp, Brassica rapa
ataaatagttttgctacctaaaagaaaaagtagctttgcttgtttcgctgtcagaacgagagaaaaaaagcttagggttcaatatccttcactcgccatgtccggagtcggagaagaagaagagaacgccgccgagcttaagatcggagacgagtttttgaaggcgaagtgtttaatgaactgtgaagtctctttgatccttgagcacaagtatgaacagcttcagctggtctccgaggatcccatgaaccaagtctcgcaagtgtttgagaagtcgttgcagtatgtgaaacgttttagccgctacaagaatccagatgctgttagacaagttcgagaaatactgagtagacatcaactcactgagtttgagctctgtgtccttggcaatctctgtcctgaaaccgctgaagaagcagtggctatggttccttctctcaagacgaaaggaagagctcatagtgatgaagcaattgagaagatgctcaatgatctctcccttgtcaagagatttgagtagtgcaaaacattcccaagattaaagattataaacatacatcatggtgccttttagctgatgatgtctggagttaatttttcatgtctgaaattataaagctctaagtgtctccggaattataccttcatgttaaatgaatgtaatttacaatgaatgattatgaatgtaatttgcaaaggatgatccgagcttgcattatgatatacataaagctacttgtgaagcttcaactccatttctttggaactttgattgg

SEQ ID NO: 3774 - DNA, 667 bp, Brassica napus
agggttcaatatccttcactcgccatgtccggagtcggagaagaagaagagaacgccgccgagcttaagatcggagacgagtttttgaaggcgaagtgtttaatgaactgtgaagtgtctttgatcctggagcacaagtatgaacagcttcagctggtctccgaggatcccatgaaccaagtctcgcaagtgtttgagaagtcgttgcagtatgtgaaacgttttagccgctacaagaatccagatgctgttagacaagttcgagaaatactgagtagacatcaactcactgagtttgagctctgtgttcttggcaatctctgtcctgaaaccgctgaagaagcagtggcaatggttccttctctcaagacaaaaggaagagctcatagtgatgaagcaattgagaagatgctcaatgatctctccctggtcaagagattcgagtagtgcaaaacattctcaagattaaagattataagcatacatcagggggtgtcttttagctgatgatgtctggatttaatttttcatgtctgaaattataaagctctaagtgtctccggaattataccttcatgttaaatgaatgtaatttacaatggatgattatgaatgtaatttgcaatggatgatccaagcttgcattatgatatacataaagctactt

SEQ ID NO: 3775 - DNA, 591 bp, Brassica napus
ggagaagaagaagagaacgccgccgagctcaagatcggagacgagtttttgaaggcaaagtgtttaatgaactgtgaagtgtctttgatccttgagcacaagtatgaacagcttcagctggtctccgaggatcccatgaaccaagtctcgcaagtgtttgagaagtcgttgcagtatgtgaagcgttttagccgctacaagaatccagatgctgttcgacaagttcgagaaatactgagtagacatcaactcactgagtttgagctctgtgtccttggcaatctctgtcctgaaaccgctgaagaagcagtggctatggttccttctcttaagacaaaaggaagagctcatagtgatgaagcaattgagaagatgctcaatgatctctccctggtcaagagattcgagtagtgcaaaacattctcaagattaaagattataagcatacatcagggggtgtcttttagctgatgatgtctggatttaatttttcatgtctgaaattataaagcttttaagtatctccggatattataccttcatgttaaatgaatgtaatttacaatggatgattatgaatgtaatttgcaa

SEQ ID NO: 3776 - DNA, 430 bp, Fraxinus spp
ggggcacggagctagatttgaactttcaacaatgtctggagaagaagaagaaaacgccgccgaactcaaaattcccgatgagtttttgaaggctaagtgtctgatgaactgtgaagttgctctaattcttgaacacaagtatgagcagcttcagcagatgtctgaggatccaatgaaccaaatatctcaggtttttgagaaatcactccaatatgtgaagcgtttcagccgttataagaatcctgatgctgtcagacaagttcgagaaattctcagtcgatatcagctggctgaattcgagctttctgtacttggaaacctttgcccagagacagtggaagaagctcttgccatggtcccatcgatcaagactcgaggacgagcacacgatgacgatgcgatcgagaaatgctgaatgaatctctctcta

SEQ ID NO: 3777 - DNA, 589 bp, Eutrema halophilum
tcttcgcttccattgttagacggagaaaaagaaaacagtagagagaaaaaaatccctagggctaaattttccgcattcgtactcccatgtctggagaagaagaagagaacgccgccgaactcaagatcggagatgagtttttgaaggctaagtgcttgatgaactgtgaagtctctttgatccttgagcacaagtacgaacagcttcagcaggtctctgaggatcctatgaatcaagtttctcaagtgtttgagaagtccttgcaatatgtgaaacgattcagccgctacaaaaatccagatgctgttcgacaagttcgagaaatactgagcagacatcaactcaccgagtttgagctctgtgttcttggcaatctctgtcctgaatctgctgaagaagcagtggcaatggttccttctcttaggacaaaaggaagaactcatgatgatgatgcaattggcaagatgcttgttgatctctcccttgtcaagaaattcgagtagtgcataattctcaagatctaagatgaggaacatgttttcagggtcttatttctagctgatgtgtgatcaaatatcactggagttaa

SEQ ID NO: 3778 - DNA, 544 bp, Lippia dulcis
ctccaacagtagactcttgtatctctgtagacgcgccaaaaatcgacgaagaatcttggagaatgttgggctattttcagagttcggcctaactctaaaagctgtttactttgcttgtttgattttggttttggcaagccaatatgtcggcggaagaagaggagaacgcggcggagcttaaaattcccgatgaatttctcaaagccaagtgtctaatgaatagtgaggttgccttgattctcgaccacaagtatgaacagctccagcagatgggtgaagatccgatgaatcaaatgtcgcaggtttttgagaaatcactccagtatgtgaagcgcttcagcagatataagaatcctgatgctgtcagacaagttcgagaaattcttagcaggtatcagctggctgaattcgagctctgtgtgcttgggaacctttgtccagaaactgtggaggaagccatagccacggttccatccatcaagactagaggacgagcacacgatgatgatgcgattgagaaatgttagaatgacctctctctcat

SEQ ID NO: 3779 - DNA, 780 bp, Fagopyrum esculentum
cgcgttctattctctctcaatatttctattcgatttttaccgaaccctaccccaaattgagagcttcgtcttctctgattccttcaacatctcccttactccattcttctatctttcccggtacgcatagtagcagcccacgcgcggtcccggacgttgtgagatcaaaaataggctgaagaggaggagaacgctgcggagcttaaaataggagacgagtttctcaaggcaagtagtctgatgaactgtgaggttgctttgatattggaacggaagtatgaacaactgcagcaaatgtctgaggatccggctaaccaggtttctcaggtgtttgagaagtcaatgcagtatgtgaagcgcttagccgataccagaacctgatgctgtcagacaagttcgagagatcctcagcagtatcagttggcggaattcgagctctgtgttcttggcaatctgtgtccagagactgttgaggaagccatagccatggtcccctctattaagactagaggaagagctcttgatgacaatgcaatccaaaagatggtggatgatcttgctttgatcaagaaatttgagtagagatttggttgttgctctcacagtgacaaacattcagtgttatgtaataactttggattattactttgccttgtttctcttgttctatgaatctatggcatatgggcctggatagttactgttataattttattgcagttatgttaataggatgtcaatgagacaggttaaagccatttcagtccctgtcctcacttg

SEQ ID NO: 3780 - DNA, 773 bp, Cirsium arvense
cctaaatcgccgtactcgtcgtctctctcgcctgtaactcgtgccctcgctgtgtctactcaaggtttttaagggtgatttaagatttcgagccaggcttaagtatctttcaatatgtctgctgctggagaagaggaagagaatgccgcagaattgaaaataggcgaagagtttctaaaggccaagtgtttaatgaattgcgaagtctccttgattcttgaacataaatatgagcagcttcagcagatgtcagaagatccaatgaatcaagtttctcaagtgtttgagaaatcgctgcaatatgtgaagcgtttcagtcgctacaaaaacccagatgctgttagacaagttcgagacctactgaccggataccagttagcagaatttgaggtttgtgttcttggaaatctttgccctgaaactgcggaggaagccgttgctatggtcccgtctatcaagtcaaggggacgtgtacatgataatgaggctatcgagaaaatgctgaatgacatgtctttaataaagaagttcgagtagtttttatctcctgtttctgccctcgttacaaatggttgcaagtttccgataatggactgcgtgttttctaagtgacatcaaacgaatcgtgttaggtataatgtgttctgattgttgatagtaaacccagatgataatgctatagtgagttgtatcaagtgcatttaaggttgtaatttactagtatatctatattcttatgtagagatgaacaatgtcattgcctttcaggcccg

SEQ ID NO: 3781 - DNA, 597 bp, Catharanthus roseus
gtgatgagtttctgaaggcgaagtgtctaatgaatgtgaagttgccctcattctcgaacacaagtatgagcagcttcagcagatgtccgaggatccaatgaatcaaatgtctcaagtgtttgagaagtcattgcagtatgtgaagcgtttcagccggtacaaaaatcctgattctgttagacaagtgcgagagattctcagtcgctatcagctggccgagtttgagctctgcgtacttggtaatctctgtcccgagactgttgaggaagcaattgctatggttccatcgatcaaaaatagaggccgtgccctagatgacgaggcaattgagaagatgcttaatgacctatccctggtgaagaaatttgagtagagagtgcctcgacaacatatggtacaatgtcttggggctttgcataagctaatatagttatgtttttatgtcctatgctactttgctggtgtttaacattttttttcttttttgatcagtaaagcttaagcatgtgtattagagaaattggcaaacaattctcctccatgatttatgttttgtcacgtgaggacattatttattttattggccacttctgttca

SEQ ID NO: 3782 - DNA, 711 bp, Cycas rumphii
gccggagccctttgaattgaaattggtggggcttcagagctgcttcctattgccaatggcgtccacatcagaagaggaagaaaatgctgcagagctgaagattggagaagaattcttgaaggcaaaatgtttgatgaattctgaggttgcactgattctggaaagaaaatatgaacagcttcagcaaatgtctgatgatccttcaactcaaatttcacaagtgtttgagaaatctttgcagtatgtgaagcgtttcagccgttacaaaaatccagatgctgtgaaacaagttcgagaggtgttgagcagaaataatttggctgagtttgagctgtgtgtgattggtaatctttgtcctgaaactgtggaggaagccaaagctatggtcccatccattaaggcaaagggacgcatgaatgatgatgaaaagattgagaaaatgcttgatgatcttgcacggatcaagagattcgaatagagcatctttttatattttagtcatgctacattttcatagcattgtgttcttgtacaggcttctctctctcactctcactctcactctcagaccccctcttcccgctcccacattcatgctacattttcatagcattgtgttcttgtacaggcttctctctctcactctcactctcactctcagaccccctcttcccgctcccacatcccacccctgaggtgttttgtttgctg

SEQ ID NO: 3783 - DNA, 684 bp, Nicotiana benthamiana
taggtgatcttgtctgaaagatgtcaggggaagaagaagaaaatgccgctgagctcaaaatcggtgatgagtttttgaaggcctaatgtctaatgaattgtgaagttgcgctgattcttgaacacaagtacgagcagcttcaacagatgtctgaagatccaacaaatcagatttcgcaggtatttgaaaagtcattgcaatatgtgaagcgtttcagtcggtacaagaaccctgatgctgttagacaagctcgagagatccttagtaggtatccacttgctgaattcgagctctgtgttctggggaatctttgcccggagactgttgaggaaggtattgccatggtcccatccatcaagaataggggacacgcacttgacgaggaagcaatcgagaaaatgctaactgacctttctctaattaagaaattcgagtagtcttatgtagcttctctgtctcagtacttttggtgacccgctgtgtaatgcaaaatggtgttctggcattctgttgattgctggctgacgaaaagagaaaagaccaaacgactctcctctctggacattttattgttttggaagctggttttagaataatcctttggtttcagagaccaacccgttgttattctatacaagtttcgctgattttgcttttgtgtgacacatattaaagtgtgtttct

SEQ ID NO: 3784 - DNA, 897 bp, Solanum tuberosum
tttctccgtattacacaaattgaaaagagagctttgacgccgacgcaacaatggcggacgatgattatgatatggacggaggatacgtggacgagccaatggatcctgaacctgatgaaggagcagagattgaagaagataatggcaacaatgaggacgtaccagatcccctgatgggtgaaggtgaggaaaaaccagagcagcaagagcctgtggaacgacctcgtaagacatcaaagtttatgacaaaatatgaacgtgcaagaatcctgggcactcgtgcactccagatcagcatgaatgcacctgtgatggttgagttggaaggagaaactgacccacttgagattgcaatgaaagagctccgagagaggaagataccattcacaattcgccgttacttgcctgatggaagttatgaagattggggagtcgatgaattgattgttgaggattcatggaagagacaagtcggaggaacttgacagctgaagtgcctctttgcttgttgctgcagacttattaggaatgttatctgtcgtttctggttgtcgtactctgctgaattgttgctgacttaatattaccaatgctatgaatatattttggaaaactcaagtgattagtcgtatgggctgtttcttttagtacaaattctaatgtgtatgtatttgtcgtgagtgtcaacctcttgatgaagctagggctctcaacttggcatatctcgcaaacacaacggagataattgccagttgggtcctgagacttcagaagttgttaagggaaaactgtagtatattctcaagatctcaaaaaaaggaagtgggcatgctcattcttcttttatgattttcttaatgtttacccaatatttctgctttaaacttataaagatta

SEQ ID NO: 3785 - DNA, 640 bp, Solanum phureja
agttctatttggtttcaaagctgcgttttctccgtattacacaaattgaaaagagagctttgacgccgacgcaacaatggcggacgatgattatgatatggacggaggatacgtggacgagccaatggatcctgaacctgatgaaggagcagagattgaagaagataatggcaacaatgaggacgtaccagatcccctgatgggtgaaggtgaggaaaaaccagagcagcaagagcctgtggaacgacctcgtaagacatcaaagtttatgacaaaatatgaacgtgcaagaatcctgggcactcgtgcactccagatcagcatgaatgcacctgtgatggttgagttggaaggagaaactgacccacttgagattgcaatgaaagagctccgagagaggaagataccattcacaattcgccgttacttgcctgatggaagttatgaagattggggagtcgatgaactgattgttgaggattcatggaagagacaagtcggaggaacttgacagctgaagtgcctctttgcttgttgctgcagacttgttaggaatgttatctgtcgtttctggttgtcgtactctgctgaattgtttctgacttaatattaccaatgctatgaatatattttggaaaac

SEQ ID NO: 3786 - DNA, 825 bp, Nicotiana benthamiana
gggttcaattctggagtacgcctccctttcctctcgctaatatacacaagtaagacaacaattgacagtgagctgtgaggcggacataacaatggcggacgatgattatgatatggacggaggatacgtggacgagccaatagaacctgagcctgatgaaggagcagagattgaagaagataatggcaacaatgaggacataccagaccctctattgggtgaaggtgaggagaaaacagagcaagagccggtggagcgacctcggaagacgtcaaagtatatgacaaaatatgaacgtgctagaatcctgggcactcgtgcactccagatcagcatgaatgctcctgtgatggttgagttggagggggaaactgatccactcgagattgcaatgaaggagctccgagagagaaagataccattcacaattcgccgttacctgcctgatggaagttatgaagattggggagttgatgaattgattgttgaggattcatggaagagacaagtcggaggaacttaatgcttgatgtgcctcctttgcatgcagggttgtgaggagtctaatctgttgtttttggttctcatgctccaccaaattattgcgaagttaacattaacaatgttatcaatgtattaaggaaaactcaaagtgcttattcatatcagttgtgtgatattgcaagttctaatggttatgtactagtagggctctaaaactgggcaggcattgcttagtttttgtatgaaatgtttgttagtaaatggaaaaatgtggtgactctcaacgctttgtagaaggaaattggcttgcaactttgcatg

SEQ ID NO: 3787 - DNA, 789 bp, Nicotiana benthamiana
caaatttacgaaggtagtacgcctccctttcctctcgctaatatacacaagtgagacaacaattgatagagagctgtgaggcggacataacaatggcggacgatgattatgatatggacggaggatacgtggacgagccaatagaacctgagcctgatgaaggagcagagattgaagaagataatggcaacaatgaggacataccagaccccctgttgggtgaaggtgaggagaaaacagaacaagagcccgtggagcgacctcggaagacatcgaagtatatgacaaaatatgaacgtgctagaatcctaggcacccgtgcactccagatcagcatgaatgctcctgtgatggttgagttggaaggggaaactgatccacttgagattgcaatgaaggagctccgagagagaaagataccattcacaattcgccgttacctgcctgatggaagttatgaagattggggagttgatgaattgattgttgaggattcatggaagagacaagtcggaggaacttaatgcttgaagtgcctcctttgcatgcagggttgtgaggagtctaatctgttgtttttggttgttcatactccaccaaattattgcgaagttaagattaacaatattatcaatgtattaaggagaactgaagtgcttattcgtatcggctgtgtgatattgcaagttctaatgggtatgtactttgtcaaccattgatggagctagggctctaaaactgggcaggcagtgctgagtttttgtatgagatggaagtaatttactgcta

SEQ ID NO: 3788 - DNA, 834 bp, Nicotiana tabacum
ctcacagatttacagaaggagtacgcctccctttcctctcgctaatatacacaagtgagacaacaattgacacagagctgtgaggcggacacaacaatggcggacgatgactatgatatggacggaggatacgtggacgagccaatagaacctgagcctgatgaaggagcagagattgaagaagataatggcaacaatgaggacataccagaccccctattgggtgaaggtgaggagaaaacagagcaagagcctgtggagcgacctcggaagacgtcgaagtatatgacaaaatatgaacgtgctagaatcctgggcactcgtgcactccagatcagcatgaatgctcctgtgatggttgagttggagggggaaactgatccactcgagattgcaatgaaggagctccgagagaggaagataccattcacaattcgccgttacctgcctgatggaagttatgaagattggggagttgatgaattgattgttgaggattcatggaagagacaagtcggaggaacttgatgcttgaagtgcctcctttgcatgcagggttgtgaggagtctaatctgctgtttttggttgtcatactccaccaagttattgcgaagttaacattaacaatgttatcaatgtattaaggaaaactcaagtgcttattcatatctgttgtgtgatattgcaagttctaatgggtatgtactagtagggctctaaaactgggcaggcattgcttagtttttgtatgagatgtttgttagtaaatggaaaaatggagtaatcactctcaacactttgtagaaggaaattggcttgcaactttacatggc

SEQ ID NO: 3789 - DNA, 685 bp, Capsicum annuum
ctattatacacacaagcagcaacaaacaatggccgacgatgactatgagatggacggaggatacatggacgagccaatggatcctgagcctgaggaaggagcagagattgaagaagataatgccaacaatgacgacattccagaccccctgttgggtgaaggtgcggaaaaaacagagcaagagcctgtggaacgacctaggaagacatcaaagtttatgacgaaatatgagcgtgcaagaatcctgggcacccgtgctctccagatcagcatgaatgctcctgtgatggttgagttggagggggaaaccgacccacttgagattgcaatgaaagagcttcgggagaggaagataccattcacaattcgtcgctacttgcctgatggaagttacgaagattggggagttgatgaattgattgttgaggattcatggaagagacaagtcggaggaacttgatagctcaagtgctgcttagtgattatttgttgtttttggttgtcgtactctgctgaatttttgctaacatagtatcaccaatgctatgaatgtattaaagtaaaatcaagtgcttattcgtacatgctgtttggtagtacaagttctagtggatatgtaattgtcgtaacttgttagtgtcaactgcttgatcgatccaggctctgaacttggcatgcctgctga

SEQ ID NO: 3790 - DNA, 728 bp, Solanum melongena
acattttcagttcccttttggtttcgagctgcgtttctctcctctccgaataagcaacaatggcggacgacgactatgagatggacggaggatacctggacgagccaatggagcctgagcctgaagaaggagctgagattgaagaagataatgtcaacaatgacgacataccagatccactgttgggtgaaggtgaggataaaacagagctgcaagagcctgttgaacgacctcggaagacatcaaagtttatgacgaaatatgaacgtgcaagaatcctgggcactcgtgcacttcagatcagcatgaatgcacctgtgatggttgagttggaaggagaaactgacccacttgagattgcaatgaaagagctccgagagaggaagataccattcacaattcgccgttacttgcctgatggaagttttgaagattggggagtcgacgaattgattgttgaggattcatggaagagacaagttggaggaacttgacagctgaagtgcctcttttgcttgctgctgcacttattagttatctgtcgtttctggttgtgctgtactctgctgaattgttgccaactataaccaacgctatgaatgtattttggacgggctgtttttttctttttgtcttagggcaagttagaatgtgtttgtatattgccagttgggttcggagactccagtgtaagttctaagaagcaagtggtctactcatttttgccc

SEQ ID NO: 3791 - DNA, 783 bp, Nicotiana tabacum
  misc_feature (154)..(154): n is a, c, g, or t
  misc_feature (335)..(335): n is a, c, g, or t
  misc_feature (377)..(377): n is a, c, g, or t
  misc_feature (401)..(401): n is a, c, g, or t
  misc_feature (520)..(520): n is a, c, g, or t
  misc_feature (567)..(567): n is a, c, g, or t
ccacttcaactttgaaggtaagttatagctctcaatcggaagcaaaaatggctgacgaggattatgatatggacggaggatatgaggatgagcccatagagcccgagcctgatgaaggagcagaggtcgaagaagataatgtcaacaatgaggnagtgccagacccccttttgggtgaaggtgaggaaaaaccagagcaggagcctgtggaacgacctcggaaaacatccaagtatatgacaaaatatgaacgtgcaagaatcctgggtactcgagcgctccagatcagcatgaatgctcctgttatggttgagttggagggtgaaactgatccncttgagattgcaatgaaagagctccgagaaaagaagataccnttcacaattcgtcgatatctgccngatggaagttatgaggattggggagttgatgaattgatcgttgaggatacatggaagagacaagtcggaggagcttgaaacatgtttacatgctgtctgaactgccctcgtgaagaacnattcggtcgatcaacttattctctatgaaatcccaaactagctagtngtgctctgtgaagaactattgatgtagataaatgcttggtgctccctgaagatcttactactggtcttggttttcacatcatagtgtttaatagactctggcttttagttggtatcttaaaatggtattctgccattgattttctaaggaaagcacatgtgcttactcctgctggctgttcttgcttgttactgttttatctttactgcttaaatt

SEQ ID NO: 3792 - DNA, 942 bp, Mimulus guttatus
acatttcgcagcaacagagaagcggaaaaaccgaagagagagaagagaagaaaaaaccctcttaccgccatggccgacgaggattatgaaatggacggagggtacgaagatgagccgatggagccggagcttgatgaaggggtagaagtggaagaagataatgaaaaccctgatgatgttccagacccgattgaaggggatggtgaggagaagcaggagcaagagcccgtcgaacggcctcgtaaaacgtctaagtatatgaccaagtatgagcgggccaggattttgggcacacgggccctgcagattagcatgaatgctcctgtgatggtggagctcgagggtgaaacggaccctttggagattgcaatgaaagagcttcgtgagcgaaaaatacccttcacaattcgtcgttacctacctgatggaagctacgaagattggggagtcgatgaattgattgtggaagattcgtggaaaaggcaggttgggggtaactgaaaatggctgttccttgttgctcaagacattttcgatctatttagtgagcgccgatttgtgtacaaaaatttgttaatcagaacctagtaccttaaaaaaaaaaacaagttaatgtttgccgtcttgctctttcctacgttgttgttactaggtttttgcttatggtccaagaaatcagtctcgtctttgtgttcgaactcgtgagagtaaaaacaccactcgtattatcttgaaccgttctatttgcgattttataacgttgttggattttagcattggcgcagtgacgcggtctattttcattaaaccagtgcctgattttttttttcttttttaaagattttagcaactatcaatcgacttaactatgtatgggtttgttgaaattatcgatctaactttaattgacattggattgaatacggatgaagaacaccctgt

SEQ ID NO: 3793 - DNA, 1060 bp, Mimulus guttatus
acatttcgcagcaacagagaagcggaaaaaccgaagagagagaagagaagaaaaaaccctcttaccgccatggccgacgaggattatgaaatggacggagggtacgaagatgagccgatggagccggagcttgatgaaggggtagaagtggaagaagataatgaaaaccctgatgatgttccagacccgattgaaggggatggtgaggagaagcaggagcaagagcccgtcgaacggcctcgtaaaacgtctaagtatatgaccaagtatgagcgggccaggattttgggcacacgggccctgcagattagcatgaatgctcctgtgatggtggagctcgagggtgaaacggaccctttggagattgcaatgaaagagcttcgtgagcgaaaaatacccttcacaattcgtcgttacctacctgatggaagctacgaagattggggagtcgatgaattgattgtggaagattcgtggaaaaggcaggttgggggtaactgaaaatggctgttccttgttgctcaagacattttcgatctatttagtgagcgccgatttgtgtacaaaaatttgttaatcagaacctagtaccttaaaaaaaaaaacaagttaatgtttgccgtcttgctctttcctacgttgttgttactaggtttttgcttatggtccaagaaatcagtctcgtctttgtgttcgaactcgtgagagtaaaaacaccactcgtattatcttgaaccgttctatttgcgattttataacgttgttggattttagcattggcgcagtgacgcggtctattttcattaaaccagtgcctgattttttttttcttttttaaagattttagcaactatcaatcgacttaactatgtatgggtttgttgaaattatcgatctaactttaattgacattggattgaatacggatgaagaacaccctgtaagtttttgttcgtttttgttaggatgtggtttgcatggcaaaaaacgtttttgttcgtaaaaacgtttttgttatgaattaccgtattagtaatcgtttttacgtgtaaacttcata

SEQ ID NO: 3794 - DNA, 781 bp, Orobanche aegyptiaca
ggactatgaaatggacggagggtacgaggatgaaccaatggatccggatcttgacgaagaagcaccaccagtccatttcccccctctgtaagagagagagagcaaagacgagatagagcgagagaaaaaataaaaaagaaccgcaatggcagacgaggactatgaaatggacggagggtacgaggatgaaccaatggatccggatcttgacgaagaagcagagttagaagaagaaaacaacaatgaggatgcgcctgatcctatcgaaggtgagggagaggagaagcaggaccaggagccggttgaacgcccacggaaaacatccaagtatatgactaaatacgagagagcccgtattctggggacgagggcactgcaaattagcatgaatgctccagtaatggtggagttggagggtgaaacggatccattggagattgcaatgaaggaactgagagagcgaaaaatacccttcaccatccgtcgttacctccctgatggaagttatgaagattggggagtggatgagttaattgtggaggactcgtggaaaaggcaagttggaggtgactgaaacgcttttgttccttcttggtgaatttttgttttgtttgtaagagcaacttgcattgtgtacaaaatttatcagaagatctgactaactatgtggagttccagtattatcagtgcctgcttttgaatggggatcttgttattgaacttgaaacatctacggctcttctgattttgaagtggtgtttgcttttgctttttttgtggt

SEQ ID NO: 3795 - DNA, 715 bp, Petunia hybrida
ttccaagagcctcctattagtttctcctcaggctgtctgctgaaagggaaattggacgcaacaatggcagacgaagagtacgatatggatggaggatatgaggatgagcccatagagcccgagcttgatgaaggagcagaggttgaagaagataatggcaatgaggagttaccagacccccttctgggtgaaggagaggaaaaaccagaacaggagcctgtggagcgacctcggaaaacatccaaatatatgacaaaatatgaacgcgcaagaatcctgggtactcgagcactccagatcagcatgaatgctcctgtgatggttgagttggagggtgaaactgatcctcttgagattgcaatgaaagagctccgagaaaagaaagtgcccttcacaattcgtcgatacctgccagatggaagttatgaagattggggagttgatgaattgatcgtcgaggattcatggaagagacaagttggaggagcttgaaaaatgttttacatgctgtctgaagtgcatctgcttatagtctctatgaaatacttaactagttgtgaagaactattgatgtagataaatgcttgcgtgctacctgaatagtttactgctggtcttggttgtcacatcttcgtgttactactgcacgccttttgtgtactatcttaaaatagtattctgctattgatttttctaagaaacaaacgtgcttctg

SEQ ID NO: 3796 - DNA, 964 bp, Orobanche aegyptiaca
gcagaccccgtctctgtctttttctctcaaaatctaagacgccggctcgcaaataatccctgaaacaaggaaaaaaaatcacaccaacttcggaagatcggtccaaatctgaaacactcgctctgtacttcctgaagatcgccccacttccatttatatattctgtcaaagcgagagcaaagccgagatagagcgagcgatagaaaaagaaacgcaatggcagacgaggactatgaaatggacggcggatacgaggatgaaccaatggatcctgagcttgacgaagaagcagagttggaagaagaaaacaacaatgaggatgcgcctgatcctattgaaggtgagggggaagagaagcaggaccaggagccgattgcacgcccacggaaaacatccaagtatatgactaaatacgagagagcccggattctgggcacgagggcactgcaaattagcatgaatgctccagtgatggtggagttggagggtgaaacggatccattggagattgcaatgaaggaactgagagagcgaaaaatacccttcaccatccgtcgttacctccctgatggaagttatgaagattggggagtggatgaattgatcgtggaggactcatggaaaaggcaagttggaggtgactgaaacgcttttgttccttctggtgaagagatttgggattttgttttgtttgtaagaggaaattgcagtgtgtacaaaacttgttatcagaagatgtgactataaccttgtggagttccagtgttatcagtgcctgcttttgagtgggatcttgttattgaacttgaaacatttactgctttactgattttaaagtgtgttggcttgtgctcttttgtggtcaatcactaaaattcaaggtaacatgatataactcttgaaaaactaatatatcaagcattatataacatcttcgtgctgcttgatgatattaaccaacata

SEQ ID NO: 3797 - DNA, 727 bp, Triphysaria pusilla
tgcggctcccccatcccgaacgaacggctcccccatcccgaacgaaagctgctctaaagaaaaaccctaatcgcaatggcagacgaggactatgaaatggacggagggtacgaggatgagccgatggatcccgagcccgacgaaggggcagagctagaagaagaaaacctcaacgaggaagcagctgatccactcgaaggcgagggagaagataaacaggagcaggagcctgttgaacgcccacgtaaaacatccaagtatatgactaagtacgagcgtgccaggattctgggcacgagggctctacagattagcatgaatgctccggtgatggtggagttggagggcgaaactgatccattagagatcgccatgaaggaacttcgagagcgaaaagtacccttcacaattcgtcgttacctccctgatggaagttatgaagactggggagtggatgaactgattgtcgaggactcgtggaaaaggcaagttggtggtaattgaaacatgcctgtgcgtgttccttactactttagagatttgggactctggtttcatttgtaagagcaaatctcccgttatattaagatcgagcaacttgtgtaaaaaccttttcgtcggaacatgaatatgaccatatggatttctagtgttgtgattaaacacaacttataaagcccttatgattttagtgttgttggcgttgccgttatgcagcaccagatac

SEQ ID NO: 3798 - DNA, 934 bp, Olea europaea
tcttcttttgcagtttcttccttctccaacaaacaaatcgcggtaaagggcgaaacacacacacgggcgcaatggccgatgaagactacgagatggacggaggatacgaggatgagccactagatccagaacccgatgaaggtgtagaggtggaagaagagaacaataacaatgaggatgctccggatgacattttaggcgaaggcgaagaaaaacaggaggaagtacctgttgaacgccctcggaaaacgtccaagtatatgaccaaatatgagcgtgcgaggattttgggtacgagggcattgcagattagcatgaatgctccggtgatggttgagttggagggtgaaacggatccacttgagattgcaatgaaagagctgcgagagcgaaagataccattcaccattcgtcgttacctccctgatggaagttacgaagattggggagttgatgaattgatagtggaagattcctggaaaagacaagtcggaggtgactgagatgctcgtgcctgatgggctagctcaagtgttagaggaggcttttgtttataacgcttgtgtgtttgtgcacattgatggtttatactgtatcaccttttaagcatcatgtaccagacatatcttcatacattgctggttatttaaagtgtttaaacactattctatcctgaataatgctgcttggacagggaaaaaagggggtacagtgacaggatgatttggccacctccgattgggtggttttttcttcttgttttttttttttttaaaaaaaaattgggccggggttggttggaaaaaaaaaaaaaaaaaaaaaaaaaaaaaaaaaaaaaaaaactcccttttttttttggaaaggtttggttttaaaaaaaagttttttttttttttttttgttggcgcagaaaaggtttcttcttctgataaaa

SEQ ID NO: 3799 - DNA, 727 bp, Catharanthus roseus
gccgtagcgaagggagagagagcgaacgagcgaagggtgccaccgagctgtagtaggaaaacaatggcggacgaagaatatgagatggacggagggtatgaagatgaacctatggagcccgagcctgatgaaggggctgaggtggaggaagaaaataacaatgaggatggccctgatcctattttaggtgacactgaagaaaagcaggaggaacaaccaagggagcgtcctcggaaaacatccaaatatatgacaaaatacgaacgtgctaggatcctgggtactcgagctctacagatcagcatgaatgcccctgtcatggtagagttggagggagagactgacccgcttgagattgcaatgaaggagttgcgagagaggaagattcctttcaccattcgcagatatctccctgatggaagttatgaagactggggtgtggatgaattgattgtggaggattcttggaaaagacaagtcggtggggattgagtggttgatgtacttgttttgagtctctgaagctgcctgctgtttcttcagctgtacttgatagaactataactgaaactgtgaattattggcactaagactttaattttgtagttgataactttccagtgatgtaacccaatctatgtgtgctgatatattcaggaggggacttcaagactgatctataaatattaatgttgagaagatcttgttagtaaaaaaaaaaaaaaaa

SEQ ID NO: 3800 - DNA, 685 bp, Fraxinus spp
ggagggaggcggagaaggaaaagcgtcataaaatggctgacgaggactatgagatggacggaggatacgaagatgagccaatggagcctgagcccgatgaaggggcagaggtggaagaagagaacaataacaacgaggaggctgcagatgcttttgaaggtgagggggaagataaacatgaacaagaaccagcagaacgccctcggaaaacgtccaagtatatgacgaaatacgagcgtgcgaggattttgggcactcgtgccttgcagattagcatgaatgctcctgtcatggttgaattggagggtgaaactgatcctcttgagattgcaatgaaggaactgcgagagcgaaagataccattcactattcgtcgttacctccctgatggaagttacgaggattggggagttgatgaattgattgtggaagactcgtggaagagacaagttggaggcgactaagatacttgtgccctactgcttaaatggttgtgtttggagtaatgtttgtgggaattttagataatgacagtcttcaagtatgtactaacagtgacttgtgatcataacatcttggactaaagtcatcaatgctaactgtcgtgagttgtcgttccaatgaatttctgttctgactgatatttctgaagagtaattgaattttgttttgttgggatttaaag

SEQ ID NO: 3801 - DNA, 632 bp, Fraxinus spp
gttcttcctttcccacaatcaaatcgcgaaaccaacacagacgcaatggccgatgaggactacgagatggacggaggatacgaagatgagccaattgatcctgaacccgatgaaggtgtagagttggaagaagagaacaataataatgaggatgctccggatgacattgtaggagaaggcgaagagaaacaggaggaagtacctgttgaacgccctcggaaaacgtccaagtatatgaccaaatatgagcgtgcgaggattttgggtacacgggcattgcagattagcatgaatgctccagtgatggttgagttggagggtgaaaccgatccacttgagattgcaatgaaggagctgcgagagcgaaagataccattcaccattcgccgttaccttcctgatggaagttacgaagactggggagttgatgaattgatagtggaagactcctggaaaagacaagtcggaggtgactaaatgctcttgcctgatagctgaagtgttcgagaagggttatgtttatatcgtgtgtgtgtgtgagcgtgagcgtgtgcacgtggaagctttatactgtagtaacctcttaagaatcatgtaccagacttcttatctacatacctgctggttgagaa

SEQ ID NO: 3802 - DNA, 621 bp, Olea europaea
gagtacgcggggtccacaaacaagtcgcgaaacccacacaaacgcaatggcagatgaggactacgacatggacgggggatacgaagatgagccaattgaaccggaacccgatgaaggtgtagagttggaagaagagaacaatgaagatgctccagatgacattgtaggcgaaggcgaagagaaacaggaggacgaacccgttgaacgccctcggaaaacgtccaagtatatgaccaaatacgagcgtgcgaggattttgggtacgcgggcgttgcagataagcatgaatgctccagtgatggttgagttggagggcgaaacggatccacttgagattgcaatgaaggagctgcgagagcgaaagataccattcactattcgccgttacctccctgatggaagttacgaagactggggagtcgatgaattgatcgtggaagactcctggaaaagacaagtaggaggtgactaaaatgcttgtgcccgatagctgacgtgttatgtttatatcgtgtgtgtgagcgtactggagtactgccttttaagaatcatgtaccagacttatctacattccctgctggttgagaagtgttaaaaacacaaaatttaccctgaacgact

SEQ ID NO: 3803 - DNA, 714 bp, Olea europaea
cgcattgctccggttaaaatcaaggagatgtgggagcgtgctgggctttctcaactgttgctgctgtagaaagcataaaccagatagttacagggggatcttcgtttcccacaaacaagtcgcgaaacccacacaaacgcaatggcagatgaggactacgacatggacgggggatacgaagatgagccaattgaaccggaacccgatgaaggtgtagagttggaagaagagaacaatgaagatgccccagatgacattgtaggcgaaggcgaagagaaacaggaggtcgaacccgttgaacgccctcggaaaacgtccaagtatatgaccaaatacgagcgtgcgaggattttgggtacgcgggcgttgcagataagcatgaatgctccagtgatggttgagttggagggcgaaacggatccacttgagattgcaatgaaggagctgcgagagcgaaagataccattcactattcgccgttacctccctgatggaagttacgaagactggggagtcgatgaattgatcgtggaagactcctggaaaagacaagtaggaggtgactaaaatgcttgtgcccgatagctgacgtgttatgtttatatcgtgtgtgtgagcgtactggagtactgccttttaagaatcatgtaccagacttatctacattccctgctggttgagaagtgttaaaaacacaaaatttaccctgaacgc

SEQ ID NO: 3804 - DNA, 768 bp, Lippia dulcis
gagcgcgaaaagccgaagagagagagaaagggagaaaacgccatggccgacgaggagtatgatatggatggagggtacgaggatgagccattggagcccgagttggatgagggggctgagattgaagaggatatcaacaacaatgaggaagtacccgacccaattgaaggtgaaggcgacgataaacaggagcaagagccggttgaacgcccacgtaaaacatccaagtatatgactaagtatgagcgggccaggattttgggtacacgggcccttcaaattagcatgaatgctcctgtgatggttgagttggagggtgaaacggatccactggagattgcaatgaaggagctccgggagcgaaaaattcccttcaccattcgtcgttacctcccagatggaagctatgaagactggggagtggatgaactgattgtggaggattcttggaaaagacaagttggaggcgattgaagcatctatgtttgcggtggtttttatctacagcacaaagtgaaatatcattttctacagcatcgagtattctgtacaaaaagaaaggaaaaacaaacaaacatcttgactctggactaagccttgctctgtggtgctatcaactcctgttgttaaacttgtctctatgcattttcctcctgtcattttcaattattgttggcttttcttatgatttagatgatccgaatcatggagatggtttacaaagaatgatgggtgtaaaatattattaattattcatattatagttgc

SEQ ID NO: 3805 - DNA, 851 bp, Sesamum indicum
gggggtctcattttacattcttgcttccagactcatcctcggattgcagcaagcgggagaaagagagaagtttgagagaggaaaaagatcggttgaaaccatggctgacgaggactatgacatggacggagcgtatgaagatgagccgttggagcctgagcctgatgaaggggcagaggtggaagacgagaacaataacaatgaggacggccccgacccaatcgaaggtgacggtgatgagaagcaggagcaagaaccggtggaacgaccgcggaaaacgtctaaatacatgacgaaatacgagcgcgcgaggattttgggcacgcgtgctctgcagataagtatgaatgcccctgtgatggtcgagttggagggtgagactgatccacttgagattgcaatgaaagagctacgagagagaaaaatacctttcaccattcgtcgctaccttcctgatggaagctatgaagactggggagtcgatgaattgatagtggaagactcctggaaaagacaagttggaggcgactgagattcttgttctttcacgcccaagaggtctggggtctgtcatgtttgtagagtatgcagcaggatcttcctgaaactcccaattatcattacaagacattgcatgatataccagatcaaaccgttaggctgcttatggtgtcgatttgcctttgttctgtgcttgtgattgaactctggccccacaaatcctttgtgatgtgatgcttgtgattatatacaagttgggctcatttgcgaagaatgtgcatgcatcaatttacaaattcttggttgattgaactgttcttgacatcatgtcatgtttgtagagtatgcag

SEQ ID NO: 3806 - DNA, 814 bp, Lippia dulcis
caactacaaacatcgcagcgagcagagagagaccaactgctagagaacagagagaggaaaaccctaggcgccatggctgatgaagactatgatatggatggagggtacgaggatgagccaccggagcccgagcttgatgaaggagcagaggctgaggaagatgacgccgctgctgaggacataccggatgccctcgaaggcgagggagatgagaaacaggaacaggaaggggtggaacgccctaggaaaacgtccaagtatatgactaagtatgagcgggcgaggattttgggcacacgggcgctgcagattagcatgaatgctccggtgatggtagaattggagggcgaaactgatccactggagattgcaatgaaagagctgcgagagcgaaaaatacctttcacaatccgtcgttatctccctgatggaagctacgaagattggggggtgatgaattaatcgtcgaggattcctggaaaaggcaagttggaggcgaatgaaacagctatccttctgtaaagatattttggttcttttttctttaaatcgaagcagcttgaacaaaatatgtggttgaaccaaaactaagccgtgaagagatactgatttctatgatggactcaactttctatcttcaaattgatggtgtaatgctttaggtttggttctttaccatcctacttggaaatgtttcaaattagaactctagattttccgttgtatccaaatgacattacatcttaggttaaaaaaagtcttttgtgtttttattacggttctataggaaaaggataattttatcaaaaaagaa

SEQ ID NO: 3807 - DNA, 494 bp, Sesamum indicum
gtttgagaattcctagcagagctgcagagagagccctaaacgacaccgaagcactgaaaaaagtttgcagccatggcggacgaggactatgatatggacggagcgtacgaagatgagccaatggagcctgagcctgatgaaggtgcggaggtggaagaagagaacaataacaatgaggatggcccggatcctgttgagggagacggcgatgagaaacaggagcaggaaccgattgaacggccccggaaaacatctaagtacatgacgaagtacgagcgtgcgaggattttgggcacacgggctctgcagataagcatgaatgcaccagtaatggttgagttggagggtgaaactgacccgcttgagattgcaatgaaggagctgagagagcgaaaaatacccttcactattcgtcgttacctccctgatggaagctacgaagattggggagtggatgaattgattgtggaggactcctggaaaagacaagttgg

SEQ ID NO: 3808 - DNA, 608 bp, Triphysaria pusilla
aaagataaaccctaatcgcaatggcggacgaggactatgagatggacggagggtatgaggatgagccgatggaccccgagctcgatgaaggggcagaggtagaagaagaaaaccctaatgaggaagctcctgatcctatcgaaggcgagggagatgataagcaggagcaggaggcggttgaacgcccacgtaaaacgtcgaagtatatgacgaagtacgagcgggctagaattctcggcacgagggctttgcagattagcatgaatgctccggtgatggtggagttggagggtgaaactgatccattggagattgcaatgaaggaactgcgtgagcgaaaaatacctttcacaatccgtcgttacctccctgatggaagttatgaagattggggagtagatgaactgattgttgaggactcgtggaaacggcaagttggtggtaattgaaatatgccaagcaaatatcagggtatattaacttgtgtacaaattttatcgtcagaacatggctataacaaccatatgtatgtctagtgttgtgacttgtgagtgtccactttcgtattggaatcttgttattgaaacctaacctataaagttcgtatg

SEQ ID NO: 3809 - DNA, 768 bp, Vaccinium corymbosum
cgaaggtagaagaaggataaaagcgatacccatcatttttgcagaatatggctgacgatggggactacgatatggacggaggatacgaagatgagccaatagagcccgagcccgaagaaggggcagaagaggaagcagataacgagaacaatgatgatgctgtcgatgcccttttagccgaagctgaggaaaaagagggcgaaccaaaagaacgagctcgaaagacctcgaaatacatgacaaagtatgaacgcgcaagaattttaggtactcgtgccctgcaaatcagtatgaatgcacctgtgatggttgaattggaaggtgaaactgatccacttgagattgcaatgaaggagctccgagagcggaagatacctttcaccattcgccgctacctgcctgatggaagttatgaagattggggagtggatgagctaattgttgaggattcgtggaagaggcaagtgggaggtgattagtccaaagtatgcgcgctggtgttatggttctgaaagtcatgtttacaatgggttcttggatgttatgttgccaccttacatgctttaatgctgtgatgaaactataagcacaacttctttcagagtgtcgtgtcctgctactgagggtctgtaatgttgatactactgctttcaggtcaacttaaactttttccccacagttattgagatcatctagctatggttggccaggatccggttaagtttgaaaacatcgtattctgtatatgggtgggcagttaagtgtcgt

SEQ ID NO: 3810 - DNA, 755 bp, Vaccinium corymbosum
cgcagaccacttctcttcaactctccggccgttagcgaaggtagaagaaggataaaagcgatacctatcatttttgcagaagatggccgacgatggggactacgatatggacggaggatacgaagatgagccaatagagcccgagcctgaagaaggggcagaagaggaagcagataacgagaacaatgatgatgctgtcgatgcccttttagccgaagctgaggaaaaagagggcgaaccaaaagaacgagctcgaaagacctcgaaatacatgacaaagtatgaacgcgcaagaattttaggtactcgtgccctgcaaatcagcatgaatgcacctgtcatggttgaattggaaggtgaaactgatccacttgagattgcaatgaaggagctccgagagcggaagatacctttcaccattcgccgctacctgcctgatggaagttatgaagattggggagtggatgagctaattgttgaggattcgtggaagaggcaagtgggaggtgattagtccaaagtatgcgtgctggtgttatggttctgaaagtcatgtttacaatgggttcttggatgttatgttgccaccttccatgctttaatgctgtgatgaaactataagcacaacttctttcagagtgtcgtgtcctgctactgagggtctgtaatgttgattactactgctttcaggtcaacttaaactttttccccacagttattgagatcatctagctatggttggccaggatccggtt

SEQ ID NO: 3811 - DNA, 975 bp, Vaccinium corymbosum
accacacgagagggagagggaggcgttcgaaggaggagaagaagaactgaagaagacacagaccgcttctcttcaactctccgggtttggttttggatttagtgggagagcagttgttatacaggccgttagcgaaggtagaagaaggataaaagggttaacccatcatttttgcaaaagatggccgacgatggggactacgatatggacggaggatacgaagatgagccaatagagcccgagccagaagaaggggcagaagaggaagcagataacgagaacaatgatgatgctgtcgatgcccttttagctgaagctgaggaaaaagaggacgaaccaatagaacgagctcggaagacctcgaaatacatgacaaagtatgaacgtgcaagaattttaggtactcgtgccctgcaaatcagtatgaatgcacctgtgatggttgaattggaaggtgaaactgatccacttgagattgcaatgaaggagctccgagagcggaagatccctttcaccattcgccgctacctgcctgatggaagttatgaagattggggagtggatgaattaattgttgaggattcgtggaagaggcaagtgggaggtgattagtccaaagaatgcgccgctggtgttatggttctgaagttcatgtttacatgggttcttgaatgttatgttgccaccttacaagctttaatggtgtgatgaaactttaagcagagcttctttcagagtgtgtcgtgtcctgctactgatggggtatgtaaggttgcttactactactttcaggtcaacttaaacttttcccccagaattactgagatcatctagctatggccaggatccggttaagtttgaaaacatcgtattctgtatattggtgccttcgtgggcagttcagcgtcattaactaaatacttcgtattttggttccgactcttattttatttttctctactattattcttgaac

SEQ ID NO: 3812 - DNA, 926 bp, Vaccinium corymbosum
acccaaacaccctactgggcgcacgactcccccctcctaggcgttaaacagccgatcaattatcgtactaccacacaagagagggagagggaggcgttcgaaggagaagaagaactgaagaagacacagaccgcttctcttcaactctccggccgttagcgaaggtagaagaaggataaaagcgttaacccatcatttttgcaaaagatggccgacgatggggactacgatatggacggaggatacgaagatgagccaatagagcccgagcccgaagaaggggcagaagaggaagcagataacgagaacaatgatgatgctgtcgatgcccttttagccgaagctgaggaaaaagaggacgaaccaatagaacgagctcggaagacctcgaaatacatgacaaagtatgaacgtgcaagaattttaggtactcgtgccctgcaaatcagtatgaatgcacctgtgatggttgaattggaaggtgaaactgatccacttgagattgcaatgaaggagctccgagagcggaagatccctttcaccattcgccgctacctgcctgatggaagttatgaagattggggagtggatgagttaattgttgaggattcgtggaagaggcaagtgggaggtgattagtccaaagtatgcgcgctggtgttatggttctgaaagtcatgtttacaatgggttcttgaatgttatgttgccaccttacatgctttaatgctgcgatgaaactataagcacaacttctttcagagtgtcatgtcctgctgctgagggtctgtaatgttgattactactgctttcaggtcaacttaaactgtttccccacaattattgagatcatctagctatggatggccaggatccggttaagtttgaaaacatcgtattctgtatatgggtgggcagttaagtgt

SEQ ID NO: 3813 - DNA, 773 bp, Platanus occidentalis
tgcagcgaagcgcaggagagacgcttcttcagcaacaacaatggcagacgaagactacaacgacgtggatatgggatatgaggatgagcctccggagcctgaggttgaggaaggggcagaggaggatgtggaaaataataataatgaagacatccctgaccctcttttggcggaaggtgaagaaaaagcagaacaagtaccaatagaacggcctcgaaagacttctaaatttatgacgaagtatgagcgtgcaagaatattgggtacacgtgccctgcagatcagcatgaatgcccccgtgatggtcgagttggagggtgagactgatccacttgagattgcaatgaaggagctccgggagcgcaagatacccttcaccatccgtcgttatttgcccgatggaagttatgaagattggggagttgatgaactgattgtggaagactcctggaagaggcaagtgggaggtgactgatcaaaccatccgtgtcatgtctcttgacttgaaacgttatattagctagagggtgatatgtatagatctgaactagttgctactgaccctataaccctagaatcagtctattgtgactgctactgtgtgttaatatgagaacatgtgctgtttgcattctgctcaaagcaggacgatccctatgtttttgtggcttgaagacgggtattatgccattgttgtgccacccagtcaggtagtcaaccttctacattgtatgcaactgtatacataagattactgttggtagaactatcca

SEQ ID NO: 3814 - DNA, 873 bp, Platanus occidentalis
gggttcacgggtcgtatcaacgatcgccaccactagttccgattaaaattgaggtttaacgagcttctttctctttctcctattccgcgagtaagggttttgcagacgagcgcaaggagaaaagcttcttcaacagcaatggcggacgaagattacaacgacgtcgatctggggtatgaggatgagcctccggagcctgagattgaggaaggagcagaggaggatgtggacaataataataatgaggatgtccctgaccatcttttggtggaaggtgaagaaaaagaggtacaagaaccagtagaacggccccgaaagacttcaaaatatatgacaaagtatgagcgtgcaagaatcttgggtactcgtgccctgcagatcagcatgaatgcgcctgtgatggttgagttggagggtgagactgatccacttgagattgcaatgaaggagctccgggagcgcaagatacccttcaccatccgtcggtacttgcctgatggaagttatgaagattggggagttgatgagctgattgtggaagactcctggaagaggcaagttggaggcgactgatcagtacatccctctgtcacatcgttttagtcaaatgtcacattagcttgggtttgaaagtttcctcccagtcaatgtcttgtagaattgaacctatgagcatgtagtgttgataaatttgcattgtgcgacaactaatctactgtttcaatgttaccatgtgttgatatggaaacattggcctaggttgttgaaggcagtggtgtattttggttcatttcttgcagatttgaacttggttgtaaatggccctcttaagcgtatataatgtcatatgcgagttctgtacaaacataaggt

SEQ ID NO: 3815 - DNA, 811 bp, Nicotiana benthamiana
ctctagcccttgccacctctgtcgcttcaactttgatggtaagttagagctctcaatcggaagcaaaaatggctgacgaggattatgatatggacgaaggatacgaggatgagcccatagagcccgagcctgatgaaggagcagaggttgaagaagataatgtcaataatgaggaagtgccagacccctttttgggtgaaggtgaggaaaaaccagagcaggaacctgtggaacgacttcggtaaacatccaagtatatgacaaaatatgaacgtgcaagaatcctgggtactcgagcgctccagatcagcatgaatgctcctgttatggttgagttggagggtgaaactgacctgtttgagattgcaatgaaagagctccgagaaaagaagatacccttcacaattcgtcgatatctgccagatggaagttatgaggattggggagttgatgaattgatcgttgaggatacatggaagagacaagtcggaggagcttgaaacatgtttacaggctgtctgaactgcctctacctgtaggctcgttaagaactattcggtcgatcaatatattctctatgaaatcccaaattagttgtgctttgtgaacaactattgatgtagataaatgcttgtgtactccccgaagatattactataggtcttggttttcacatctttgtgtttaatagaccgaggctttgttagtatcttataatggtattctaccattgatcttctaaggaaagcacaggtgcttacgcctgctggctgttcttgcttgttactgttttatctttattgcttaaatt

SEQ ID NO: 3816 - DNA, 736 bp, Cucurbita pepo
ctaaagttctgtgactgagggtttggggagtaaccagagagcgcggcaacagtttctccatcgaacatcaatggcggacgatgattacaatgacctcgacatgggatatgacgatgagccaccagaaccagaattggaggaaggtgctgaagaagaattggataataataacaatgatgatgttcctggtgaacctgttgaagcagaggaaaaggaagatgaagaacctgttgaacgtgtgcgtaaaacctcaaaatttatgacaaaatatgaacgtgctagaattttgggtacacgtgccctccaaatcagcatgaatgctcctgtgatggttgaattggagggcgagactgatccacttgagattgcaatgaaggagcttcgtgagcggaagatacccttcaccatccgtcgctacctgccagatggaagttatgaagactggggcgttgatgaactgattgtggaggactcttggaagaggcaagttggtggcgcttgactgatctttagttagttgtgtgggcgtcaccatatgtgagatgatagttagaactacatagccattaggtcacggtgttcccatttatgcagcttgtgaaaacactactgttttgttgcataactctactctataatatattggaaaggaatcactattgacaaacacctatttatgactataaaccatgccattaacactggatattctgtaatcttcaattgtgcgtttctt

SEQ ID NO: 3817 - DNA, 857 bp, Phalaenopsis aphrodite
gggccccgcggctttggagctagggttttaggcgagagtttgacgcaggacgacagaaagaacttggaaaaaagcaagagtttatcagtaagatggcggacgatgactacaacgatatggacatggggtatgaggatgagccgccggaacctgaaattgaggaaggtgcagaggtagaggaagataacaatgatgatgttccagatgatgttgttggtgttgaaaatgaagaaaaggaccaagaaccagttgagaaacctaggaaaacatccaagtatatgacaaagtatgagcgtgcaaggatattaggcacacgtgctcttcagatcagcatgaatgcccctgtaatggttgagcttgaaggtgaaactgatcctctggagattgcaatgaaagagcttcggcagcgcaagatacccttcaccattcgaaggtatcttcctgatgggagttatgaggactggggtgttgatgagctgatagtagaggactcctggaagcggcaggttggtggagattgagattagccagccttcaagcctcccaatgcattgcttcgatctgcaacccaaacacgtatctcctgtttataaactttgtgctaaatttcatgttgagctatgaatgtatgtagtgcaacttttgtctgtgtagggattttgagcacaactttagcacaactttgatttattaccgtttcgagatttccatgcatcctttttatgaagtggttgatattatataaatatgtttagggaaatttacattggtacaacaacaattcttatgtatttgtaaatctaaaacctaaattttgatgtttataactattgacaccttgttgcaataaaaaaaaa

SEQ ID NO: 3818 - DNA, 818 bp, Sarracenia psittacina
aaactgatgatgccccctttcctgtagaaaacggaggataaaatgcacagataagctgctggaagctagagcgaggcgagagcgacgacagattagctgctggaagctagagcgaggcgagagcgacgagcataatcagcaaaaatggccgacgaggattacgagatggacggaggatatgatgatgagcccttggagcctgagcctgaactggatgaaggggtagaagaagatgtggataacaataacaatgacgacgttcctgatcctcttttagctgaaactgaagaaaaagatgatcaggaaccaagagagcgacctcggaagacatcaaagtatatgacaaaatatgaacgtgcaagaattttaggtactcgtgccctgcaaatcagcatgaatgcacctgtgatggttgagttggaaggtgaaactgacccacttgagattgcaatgaaggagctccgacagaggaagatacccttcacgattcgccgctatctgcccgatggaagttatgaggactggggagtggatgaattgatcgtcgaagactcatggaagaggcaagtgggaggtgattaatctgcaaatatgctcttttcatgagagggttgttgaaggttttgtctttgtttagtcaatgatattatgtgagtttttaaccattagcgtgtcttgaaacttggcataacttcatggataaagttgaagcctatctgtttggtctaagcgcctattggttgaatttctttcatcttttgatttcatttttttattttccaaatcttgatgagataaactcaaaaagtaaaaactgt

SEQ ID NO: 3819 - DNA, 786 bp, Citrullus lanatus
tactggtgtcgcgtcggagtcggagttgacgtccgccgtcgtcagttacatcggcaattgagggttttagggtgtaaccactaaccagagaggcgacacagtttctgtcgatcatcaatggcggacgacgattacaatgacctcgacatgggatatgaagatgagccaccagaacccgagattgaggaaggtgctgaagaagaattggataataataacaacgatgatgttcctggtgaacctgttgaagctgaggaaaaggaagatgaagaacctgttgaacgtgtgcgtaaaacctcaaaatttatgactaagtatgagcgtgctaggattttgggtacacgtgccctccaaatcagcatgaatgctccagtgatggttgagttggagggtgagactgatccacttgagattgcaatgaaggagcttcgtgagcggaagatacccttcaccatccgtcgctacctgccagatggaagttatgaagactggggcgttgatgaattgattgtggaggactcttggaaaaggcaagttggcggcgcttgattgatctgtgtgggtgttgttacgatatatgagataatagatttcaatttcacagcgattagcgcaccagttcccatttgaaaaggagaacacgactactatgttttgttgcataactctattctctataatatatattggaaaggaacttctgttactgtattgactagcattgtttttaccattataaaccatgccataacaattcgactttcatttatcttcaattgtgctttc

SEQ ID NO: 3820 - DNA, 623 bp, Fraxinus spp
gttcttcctgtcccacaatcaaatcgacgaaaccaacacagacacaatggccgatgaggactacgagataggacggaggatacgaagatgagccaatgatcctgaaccgctgaaggtgtagagttggaagaagagaacaataacaatgaggatgctccggatgacattgtaggagaaggcgaagagaaacaggaggaagtacctgttgaacgccctcggaaaacgtccaagtatatgaccaaatatgagcgtgcgaggattttgggtacacgggcgttgcagattagcatgaatgctccagtgatggttgagttggagggtgaaaccgatccacttgagattgcaatgaaggagctgcgagagcgaaagataccattcaccattcgccgttacttcctgatggaagttacgaagactggggagttgatgaattgatagtggaagactcctggaaaagacaagtcggaggtgactaaatgctcttgcctgatagctgaagtgttcgagaagggttatgtttatatcgtgtgtgtgtgagcgtgagcacgtggaagctttatactgtagtaacctcttaagaatcatgtaccagacttatctacatacctgctggttgagaattg

SEQ ID NO: 3821 - DNA, 872 bp, Coffea canephora
gggggagaataaagaaagtgaaaatctcgcgtgatattttctgcccaagtatcgcgaagctagaaagggagagcatcagagcaagacactgatcctgaggcaggttctcgattgacaatggcggacgaagactttgagatggacggagggtatgaggaggaaccattggaccctgagccagaggaaggggctgagttggaagaagaaaataataatgaagaaggccctgatccagttcttggtgaaaatgaagaaaagcaagatgtgccagttgaacgccctcggaaaacttccaagtatatgacgaaatatgaacgtgctaggattttgggaactcgtgctctgcaaatcagcatgaatgctcctgtcatggttgagctggagggtgaaactgatccacttgagattgcaatgaaggagcttagagagaggaagatacccttcactatccgccgttaccttccggatggaagttatgaggattggggagtcaatgaattgatcgtggaggactcgtggaaaagacaagtgggaggtgattgagaacttgcaaaatctagtaaatggttattttgagggcggtacctgtcatcaaaagcagaatgcttagagtatttgaaactgttctagctgatgatatggtagatttgtcacagacttttagttgtatgtattgtggtgatattgagtaacaaaattaagttcttcttgaacagttgccagaataaaaaacagattgcatctcgtcaatctctttagtacttgactctattgtgtgtttttattttagtatctatacgtgggttgtatacgtagccacgctgcagttgtatgtgaagtatattgatagtgatggttgaccccaaaaaaaa

SEQ ID NO: 3822 - DNA, 834 bp, Lippia dulcis
gggaggagagagagagcgcgactgagaaaccggtagacagcagaaaggaaaaaccctcagtgccatggcagatgaagactatgatatggatggagggtacgaggatgagccaccagagcccgagcttgatgaaggagcagagttagaggaagataccgccgctgaggagataccagacgccgaagaaggtggtggagatgagaagcaggagcaggaggcggtggaacgcccgcggaaaacgtccaaatatatgaccaagtatgagcgagctaggattttgggaacgcgggcgctgcagattagtatgaatgctccggtgatggtggagttggagggcgaaactgatccactggagattgcaatgaaagagctgcgtgagcgaaaaatacctttcacaatccgccgttacctccctgatggaagctacgaagattggggcgtggatgaattgatcgtcgaagactcctggaaaaggcaagttggaggcgactgaaacaacttattcctgtgcaaagttgtgtggggtcttgtttagaatcgaagcagcttgaaaaacatatgttatcgaaacctaagacagccatgaagagaaactgctgtttgtgattgacccaactttccatcttatacttgatggtgtaatgttttaggtttggcacttaccacccaccttaaattgaaatggttcaaattagagatctcaattatccgttctatctaaatgacgttacattttggtaaaaagaattctgtgctttaattagcaagatgagatttttattgtaaatttaaatgttggtattgtggaatattattgagattttcttagagttc

SEQ ID NO: 3823 - DNA, 593 bp, Vinca minor
gagagagaagaaagcgacaccgagcttcagcaggaaaacaatggcggacgaagactatgatatggacggaggatatgaagatgaaccagtggagcccgaggctgatgaaggggctgaggtggaggaagagaacaataatgaggagaacgctgatcctattttaggtgacgctgaagaaaagcaggaggaggaaccaagggagcgtcctcggaagacatccaaatatatgacaaaatatgaacgtgcaaggatcctaggtactcgtgctttgcagattagcatgaatgcccctgtcatggtagagctggagggggagactgacccgcttgagattgcaatgaaggagttgcgagagaggaagatacctttcaccattcgccgataccttcctgacggaagttatgaagactggggagtggatgaattgattgtggaggattcgtggaaaagacaagtcggaggcgattaagtggttcagacacattttcatggttacttttcttttgtatctctgaagctgcctgttgaatctttctgtatgcttggtgaacctgtaactgaaccttgaatttggcgacgtttttgtagtttga

SEQ ID NO: 3824 - DNA, 634 bp, Vinca minor
agcaggaaatcaatggcggacgaagactatgatatggacggaggatatgaagatgaaccagtggagccagaacctgatgaaggggctgaggtggaggaagagaacaacaatgaggagggcgttgatactattttaggtgacactgaagaaaagcaggaggaagaaccaaaggagcgccctcgaaagacatccaaatatatgacaaaatatgaacgtgcaaggatcctaggtactcgagctctacagattagcatgaatgcccctgtcatggtagagctggagggggagaccgacccgcttgagattgcaatgaaggagttgcgagagaggaagatacctttcaccattcgccgataccttcctgatggaagttatgaggactggggagtggatgaattgattgtggaggattcatggaagagacaagttggaggcgattgagtggttcagacactctctttcgtagttcttgccttttggatcaccgaagctgcctgttgactcttgggttgtattcttggtggacctgtaactgaaccgtgaactgggctcttaagatattttttgttgttgataaatatctaatgatgtgccctatctatctgtgtgctgatattttgccaagacttcaaaa

SEQ ID NO: 3825 - DNA, 789 bp, Cucumis melo
aaaagaactcttaaaacccttccctctctctttctccttcgtcaaaccctattcctctcgaaaatatttctcaagggttttgaatcccagtcgagacccagggttttccacagaccaacagtttttctatccatcatcaatggcggacgacgattacaatgaccttgacatgggatacgaagatgagccaccagaacctgagattgaggaaggtgctgaagaagaattggatactaacaatgatgatgttcctggtgaacccgttgaagcggaggaaaaggaagatgaagaacctgttgaacgtgtgcgtaaaacctcaaaatttatgactaagtatgaacgtgctagaattttgggtacacgcgccctccaaatcagcatgaatgctcctgtgatggttgaattggagggtgagactgatccacttgagattgcaatgaaggaacttcgtgagcggaagatacccttcaccatccgtcgttacttgccagatggaagttatgaagactggggcgttgatgaactgattgtggaagactcttggaagaggcaagttggtggtgcttgattaatctgtgtttgttgttaccaaatgtgaaatactagcgattggaacaagaagttcccatttatgcagtagtgaaaaggaaaacaggactactgttgtttgtactcataattctcctctgtgatatattggaaaggaacctctgttaatgtattgactggcgttattttaacgacattaaatataaatactagaacggatctaatgaaaatagagttgaa

SEQ ID NO: 3826 - DNA, 763 bp, Momordica charantia
ggttatttctgaagttctgcgactgagggttttggggaggagtaaccagaggtgagaggctgaccaaagcttttctatcgagtatcaatggcggacgacgattacaatgacctggatatgggatatgaagatgagccaccagaacccgagatggaggaaggggctgaagaagaattggataataataacaatgatgatgttcttggtgaacctgttgaagctgaggaaaaggaagatgaagaacctgttgaacgtgtgcgtaagacctcaaaatttatgacaaagtatgaacgtgctagaattctgggtacacgtgcactccagatcagcatgaatgctcctgtgatggttgagttggagggtgagactgatccacttgagattgcaatgaaggagcttcgtgagcgaaagatacccttcacaatccgtcgctacctgccagatggaagctatgaggactggggtgtcgatgaactgatcgtggaggactcgtggaagaggcaagttggcggcgcttgattgaatcttgtttggttgtgtagctgacaccgtatgaatagtttcaactgcatagcgattgtggcaccatattcccacttaagcaccttgtgaacgatgccatggttgtgcttttgattgactgctatggttttgttgcataactatctatgatatattgaataggaatcaccattgacaaacattttttacttttttaaagcgtaccagtaacaattatttttcattaatcgatatacctttt

SEQ ID NO: 3827 - DNA, 1083 bp, Cajanus cajan
ggcgaacccaaccgatttatggtggtactagtgtctattttttcccacattctttcttctagggtttctgagtttctctgctttcgttctcaactcgctcccctctcttctcacaatcaaagcgagttctgagttctgacttctccctccccttcttcatttgctctactaaaccctaattactactgtttaaatttgctatagtgcattttttgagaggatttagggtttttagggcatagacagcgggtttaagctcagagaccggctatatttctgcaatcgtgatggctgatgatgactatgatgacatggacatggggtatgaggatgagccacaagagcctgagattgaggaaggagcagaagaggagctggataacaacaaaaatgatgacgcaactggagaccctcttgaaactgtggaaaaggaagaggagcaaccagtagagcggcctcggaagacatcgaaatatatgaccaagtatgagcgtgccaggattttgggtactcgcgccctacaaatcagtatgaatgcacctgtcatggtagagttggaaggggaaactgacccacttgagattgccatgaaggagcttcgagagcggaaaataccctttactatccggcgctacttgcctgatggaagctatgaagattggggagttgatgaactgattgtggaagactcctggaagaggcaagtgggtggcgattgatggttgaactgacacaggtgtggggaggagtcaatggcactaagattttgtcctcataacttttatctttgatttgtttgaggttgatactgatgatcccaccttaaaattggctcacagctatgtattagtttttgggtgtctgtatatctgttgactgtttttggtgctttagctcagtataatttctgtttaagcttgtttatatatatcggctttcaatagtgtttgttgctgtttgtcaaatcagttagatgctaatgtaactattatccattaacatgataccaaagaacatggtagatagtcttgtactttaaaattgatgaatactcaaaatcaaaagcttttaatgtgttggaat

SEQ ID NO: 3828 - DNA, 636 bp, Ambrosia trifida
acaaccaaaactagaaacaccgctactggtgtgaaacagcgtatcatatcatcatcctcttcatctttaccttcaacttgtaacaatatcaatggccgatgaagagtatgagatggacggagggtatgatgatgagccaatggaacccgaggctgatgaaggagcagaggaggatgttgacggcgagaataaagatgatgatgcaccagatcctcttctaggtgacgatgaagagaaggaagagcaagaacaaggtgaacgacctcggaaaacgtcaaaatacatgaccaagtatgaacgggctagaatcttgggtacacgtgctctacagatcagcatgaatgctcctgttatggttgaattggagggcgagactgacccacttgagattgccatgaaggagcttcgtgagaagaagatacctttcaccattcgtcgatacttgccagatggaagttatgaagactggggagttgatgagctgattgtggaagactcttggaagagacaagtcggtggtgattaacccacccctgctttcgtctcctgcacattgtcatttagtatgtggtgctgaatataacgctaggtttgctgtcttagttagaaatctaatcactatcagtctgtctgccg

SEQ ID NO: 3829 - DNA, 1004 bp, Vaccinium corymbosum
cttatatcctactgcagtctctattcggtattaccaacaccactggcgcacgactcccctcctacggcgttaaacagccgatcaattatcgtactaccacacaagagaggaggagggaggcgttcgaaggagaagaagaactagaagaagacacagaccgcttctcttcaactctccggccgttagcgaaggtagaagaaggataaaagcgttaacccatcatttttgcaaaagatggccgacgatggggactacgatatggacggaggatacgaagatgagccaattgagcccgagcccgaagaaggggcagaagaggaagcagataacgagaacaatgatgatgctgtcgatgcccttttagctgaagctgaggaaaaagaggacgaaccaacagaacgagctcggaagacctcgaaatacatgacaaagtatgaacgtgcaagaatttttagtactcgtgccctgcaaatcagtatgaatgcacctgtgatggttgaattggaaggtgaaactgatccacttgagattgcaatgaaggagctccgagagcggaagatccctttcaccattcgccgctacctgcctgatggaagttatgaagattggggagtggatgaattaattgttgaggattcgtggaagaggcaagtgggaggtgattagtccaaagaatgcgccgcgggtgttatggttctgaagttcatgtttacatgggttcttgaatgttatgttgccaccttacaagctttaatggtgtgatgaaactataagcagaacttctttcagagtgtgttgtgtcctgctactgatggggtatgtaaggttgcttaccactactttcaggtcaatttaaacttttcccccagaattattgagatcatctagctatggacggccaggatccggttaagttttgaaaacatcgtattctgtatattggtgccttggtgggcagttcagcgtcattaacaaatctgattttggccatctatttattttgc

SEQ ID NO: 3830 - DNA, 739 bp, Chelidonium majus
aacctttgctgcagtaacaatggcggacgaagactacaatgaaatggacatgggatatgaggatgaacctgtggagccggaaattgaggaaggagcagaagaggaggtcgagaataacaacgaagatgttgccgatcctttggtagatggtgaagagaaagaggaacaagaacctgtggaacgagctcgaaagacatcaaagtatatgactaagtacgagcgtgcaagaattcttgggacccgtgctctgcagatcagcatgaatgccccagtgatggttgagttggagggtgagactgatccgcttgagattgcaatgaaggagcttcgagagcgcaagatccctttcaccatccgccgctatttgcctgatggaagttatgaagattggggagttgatgagctgattgttgaagattcttggaagaggcaagtgggaggcgagtgataattcgttctcgttttgtcctcatcattaaattgctcatctgcaccgatgtacaaagtttactctcatactgatgttgctaatctacttatgattgtgggtctttgttatacatgtttgtactagtgatttgtgtgaaggactaggtggtttgctgacttttacagttttactggaccatttatcagcttcagcatcctcatcttatggctatgtacttgggcaatgtaagcctgaagcattagatcaaggacccgtctagtaaactaaacacttactcttaaaacctta

SEQ ID NO: 3831 - DNA, 732 bp, Allium cepa
ccgaccagaggtattatatattttgtacagagaagtgaagggtttagggtttctgcaatttctgttggagcttagattttcgtgaaatctgcgatggcggacgacgattataatgacatggatatgggatatgaagatgagccgccagagcctgaaattgaggagggagctgaggaagacatagataataataatgaagatgttccagaagatataattggagaaggggaagagaaagagcaggaagaagttgagagagcgcgcaaaacttcaaagtatatgacaaagtacgaacgcgcaagaatactaggcacaagggctttgcaaatcagcatgaatgcacctgtgatggttgagcttgaaggagagactgatccccttgagattgcaatgaaggagcttcgagagcgtaagattccatttaccattcgccgctatctgcctgatggaagttacgaggactggggggtagatgagttgattgtagaggactcctggaaaaggcaagttggtggcgattaaggcctttggaaaaatgctcgcagttttgatctgatctactccttgttcataaatatatatttagaatgcttaatgatatgacatgttacaaatgttgctaccagtccaatttctgtactcgtgttctaatggttgaattaaaacctttatgctctgttatgtgcaactactttatttgagttatgtgataacctattatccggttggtgt

SEQ ID NO: 3832 - DNA, 737 bp, Allium cepa
agggtttctgcaatttctgttggagcttagattttcgtgaaatctgcgatggcggacgacgattataatgacatggatatgggatatgaagatgagccgccagagcctgaaattgaggagggagctgaggaagacatagataataataatgaagatgttccagaagatataattggagaaggggaagagaaagagcaggaagaagttgagagagcgcgcaaaacttcaaagtatatgacaaagtacgaacgcgcaagaatactaggcacaagggctttgcaaatcagcatgaatgcacctgtgatggttgagcttgaaggagagactgatccccttgagattgcaatgaaggagcttcgagagcgtaagattccatttaccattcgccgctatctgcctgatggaagttacgaggactggggggtagatgagttgattgtagaggactcctggaaaaggcaagttggtggcgattaaggcctttggaaaaatgcttgcagttttgctctgatctactccttgttcataaatatatatttagaatgcttaacgatatgacatgttacaaattttgctaccagtccaatttctgtactcgtgttctaatggttgaatttaaacctttatgctctgttatgcgtaactactttatttgaattatgtgataatctattatccgtttggtgtaaaatagtttgattggtggatcatgatacttattgctctgtgtgacccgt

SEQ ID NO: 3833 - DNA, 619 bp, Parthenium argentatum
aatggcagacgaagagtatgaaatggacggagggtatgatgatgagccaatggaacccgaggctgatgaaggagcagaggaggatgtcgacggcgagaataaagatgatgacgcaccagatcctcttctaggtgatgatgaagagaaggaagagcaagaacaaggggaacggcctcgtaaaacatcaaagtatatgaccaagtatgaacgagctagaatcttgggtacacgtgctctacagatcagcatgaatgctcctgtcatggttgaattggaaggtgagactgatccgcttgagattgcgatgaaggagcttcgtgagaaaaagatacctttcaccattcgtcgatacttgccagatggaagttatgaagactggggagttgatgagctgattgtggaagactcttggaagagacaagtcggcggtgattagcccacctccgctttcgtctcctgctcattgtcatttaatatgtggtgctaaatataactttaggtttgctgtcttagttagaaatctaatcactatcagtcggtttgccgtttggaatatgtttgataccatttggatgtttgaagtaaactgtagtttatcattgtctatgctggaattatt

SEQ ID NO: 3834 - DNA, 860 bp, Malus domestica
atggcgaacgagaagaagcaccagctagggtttcaggtagaagaagaagatggatataagggggaaaacgacggcgtcttactgaagaagcttgaaggaaagagaaactttacggtggtcgttggcacacctgatcgttcaaaaaccttatttcaaaccctaatcccttcccacattattccagacgccatctctctctctctcgaaaagttcataaaccctaaaccagaacttcttcacccatcaacaatggcggacgacgactacaacgacgttgacatgggataccaggatgagcctccggagcccgaaattgaagaaggtgcagaggaggaggatgttgacaatttaaacaatgatgatgacgttgcaggagatcccatcgaagcggaggagaaggaagaacaagagggggtggaacggcctcggaaaacctcgaaatatatgaccaagtatgagcgtgctagaatcttgggtacccgtgctctgcagattagcatgaatgcccctgttatggttgaattggagggcgagactgacccgcttgagattgctatgaaggagcttcgtgagcggaagataccattcaccatacgccgttacctgcctgatggaagctatgaagactggggcgtagatgaattgatcgtcgaagactcctggaagaggcaggtgggaggtgattgatcagatatcgtttatgcatggagaatggtttccgatgtctatattagcctctaagtattaggaagatctctcttttggcactggacctatgaacttacatgttggaagacttaaaaacttttttggtaaatatgttgaaagaatgctgagacaccccagcaatgtagttcatc

SEQ ID NO: 3835 - DNA, 716 bp, Elaeis guineensis
tcgggccgtgtcccttgagggtttctttcccctagttcaaggatcgagaggagagcaggggaagaaagggtgctttcgcttcaagaatggcggacgatgactacaacgacatggacttcggggggtatgaagatgagcctccagaacctgaggtggaggaaggaggagaggaggagcgagaaaacaacaatgacgatgttccagatgatgtggtgggtgcagaagctgaagaaaaggagcaagtatctgtcgaacggcctcggaaaacatcaaaatacatgacaaaatatgaacgtgctagaatcctgggcacacgagctttgcaaattagtatgaatgcaccagtgatggttgagctagagggcgagactgatcctttggagattgcaatgaaggaacttcgagagcgtaagataccattcacaatccggcggtatctgccagatggaagttatgaggactggggagtagatgaacttatagtggaggactcgtggaagaggcaagttggtggggactgagttactgcctgcgtcacttttgtgacacctggatattttctgttttataaattcatatgatgtagtttctagtgatacttgatatggcagagatgttacaaaagcttcctttgtgtactaaccctttgacttggttaaaattaggtgcagtttacttgcttctaaaccatcgtttctgggaaagcgttttataat

SEQ ID NO: 3836 - DNA, 575 bp, Bruguiera gymnorhiza
gagggccgtgtccaaagtagcagagaggagggtaaaagccttcttcgtctctgtagacgagcaatggccgacgacgactacaacgacgatttaggatatgaggatgagccgccagagcctgagattgaagaaggagctgaggaggaggatgttgataatgctaatgaagacattcctggggaacccattgaaactgaggacagagcagagcaagaaccagtggagcgacttcgcaaaacttcaaaatttatgacaaaatatgagcgtgctagaattttgggtacccgtgctctgcagatcagcatgaatgctcctgtgatggttgagttggaaggtgagactgacccactagagattgctatgaaggagcttcgtgagcggaaaatacctttcacaattcgtcgctatttgccagatggaagctatgaggactggggagtcgatgagttgattgtagaagactcgtggaagaggcaagtgggaggtgattgatgagttgtctcattgtttggtgtggtcatttgtcataaagagatgggtttttaaaaagcataaagagtgtggtatcggtgcat

SEQ ID NO: 3837 - DNA, 718 bp, Euphorbia peplus
cgctttggcacagaggtgaaggggaaaaaagaaaaaaaggtatctctgagcttcttcacttcgacgattgaccatggcggacgacgactacaatgatatggacatggggtacgaggatgagccaccagagcccgagattgaggaaggagcagatgaggaacttgagaacaataacaatgatgatgtgccaggggatcccattgaaactgaggatagagaagaacaggaagcagtagaacgacctcgcaaaacttcaaaatatatgaccaagtatgagcgagccagaatattgggtactcgtgctctgcaaatcagcatgaatgctcctgtgatggttgagttggaaggagaaacagacccacttgagattgcgatgaaggaactccgagagcggaaaatacctttcaccatccggcgttacttgcctgatggaagttacgaagactggggagtagatgaactgattgtggaagattcgtggaagaggcaagtgggaggtaattgatctactagcatttggtgattgcagtttgtgaatgaaaaatggtttacaaaagcaatgatgtattgttgtaccttcaaaccattgctgttaaagcactgcattatcgttttagtgacggattgcttccagatgtatacatataagcgtacttgtcccttagaaaatgatgtgcagttgccatgagtgatgtgtcttgtggggtgaatctgcccg

SEQ ID NO: 3838 - DNA, 747 bp, Flaveria ramosissima
aggagagaccgctgcaggtgtaaaagggcaatcttcatcatcttcttcgcgttgagcttcaacctctaacaatggcggatgaggagtatgagatggacggagggtatgatgatgagccaatggaacctgaggctgaagaaggagcagaggaggatgttgaaggcgagaataaagatgatgatgcacccgatcctcttctaggtgacgatgaagagaaggaagatcaagaacaaggagaacgacctcgtaaaacgtcaaaatatatgacaaagtatgaacgggctagaatcttgggtacacgcgctctacagatcagcatgaatgctcctgtaatggttgaattggagggtgagactgacccccttgagattgccatgaaggagcttcgtgagaaaaaaatacctttcaccatccgtcgatatttgccggatggaagttatgaagattggggggtggatgagctgattgtggaagactcttggaagagacaagttggtggtgattaacaaccccctatcctcttgcttgttatcgtttaatatgtggtgttgaacctctttgtactcggataatatagcattaattactatcagcctggttttcagttggaatatgttcataccgtttggatgttggagaagtaaactcaactctcatatttcatattgttgttagaattatcaaatgaggcgggttgggaagacaaggtaatatgggaatgatctggtgtttcaagtttataaggtt

SEQ ID NO: 3839 - DNA, 595 bp, Flaveria ramosissima
aacaatggcggatgaggagtatgagatggacggagggtatgatgatgagccaatggaacctgaggctgaagaaggagcagaggaggatgttgaaggcgagaataaagatgatgatgcacccgatcctcttctaggtgacgatgaagaaaaggaagagcaagaacaaggagaacgacctcgtaaaacgtcaaaatatatgacgaagtatgaacgggctagaatcttgggtacgcgtgctctgcagatcagcatgaatgctcctgtaatggttgaattggagggtgagacagacccccttgagattgccatgaaggagcttcgtgagaaaaagatacctttcaccatccgtcgatatttgccggatggaagttatgaagactggggggtcgatgagctgattgtggaagactcttggaagagacaagttggtggtgattaacacccctcctctcttctcttgcttgtaatcgtttaatatgtggtgttaaacctgtttgtaatcggataatatagcattaatcactatcagtctggttgtcagttggaatatgttcatgccgtttggatgttggagaagtaaactcaactctatatt

SEQ ID NO: 3840 - DNA, 937 bp, Elaeis guineensis
ggtggagagagcgagagcgagtgcgaggtctccaaattcccaatggcggacgacgattacaacgacatggacatggggtatgaggatgagccaccagagcctgagattgaggaaggggcagagaaggaggatgcagataataacaatgaagaaattcctgatacctttataggcacagaagctgaggaaaaggaggagcaagcaccagtggaacgacctcggagaacttcgaagtacatgaccaagtatgagcgtgcaagaatcttgggtacacgtgctcttcagattagcatgaatgctcctgtgatggttgagctggagggggagactgatccacttgagattgcaatgaaggaacttagggaacgaaagattcctttcactattcgccggtacttacctgatggaagctatgaagactggggagttgatgagctgattgtggaggactcttggaaaaggcaagtgggtggcgactgatggcaaatacatagattgtagttactctatacaacttttgtggtcttcatgcgagaaactgctagcttcctctagtttccagtgatggtttcagttctttggatagattgatggcagatatattgaagtagaaggctttatagctagaaatatacttgcaatggtgtaactatggtggtttcagttctatggataggttgtcagcttgctctggtttctagtcttggtatggtactaaagtttggaggttttgctcatgggatctattcaaggacctttatgacgtatttgtagtccactgtttatctttatttgaaaattaacactgcatgtgatccaactgggaacctctcctgagctcagttgctactgggagaggtgccaaccagcaattgaactaggtggattgaaatgcactgtatgcttgttttctctgattgcagttattacggtgtct

SEQ ID NO: 3841 - DNA, 780 bp, Helianthus annuus
ccggttaacaatcaacaaaccggtttaatcactccacagtcatccttataacctaaattcatcaatcaaaaacccaccttcttcttctttcttattccgatcaaaaacacacaaaaccttcatccctgaacaaaaatggcagacgatgactacgaaatggacgtcggagggtacgaagacgagccaatcgaaccagaactcgatgaaggtgttgaggaagatgttgacggagagaacaaggatgaagatattccggatccattgttgggcgagaatgaagagaaagaagaaggtgaaggtgttgagaagcccaggaagacgattaagtatatgaccaagtatgaaagggctaggattttgggtactcgtgcgttgcagataagtatgaatgctccggtgatggttgagttggagggtgagactgatccacttgagatcgctatgaaggagcttagacagcggaaaatacccttcaccattcgccgatatctacccgatggaagctatgaagactggggagttgatgaactaatcgtcgaggattcttggaagagacaggttggtggcgaatagtttgtccaccgcacccctctactgcttgaaatactctcgagcgtgtttacggtcctcaccacatgggtttggtggatagtggataccaccagtcttgtgatataatgttcaacttctttgtgctgtgcgttttatgaatatgatgatttattttgttaagttgttatgtgatatagacgatcaccattagcaggcaggacataattc

SEQ ID NO: 3842 - DNA, 669 bp, Helianthus annuus
aaaaacacacaaaaccttcatccctgaacaaaaatggcagacgatgactacgaaatggacgtcggagggtacgaagacgagccaatcgaaccagaactcgatgaaggtgttgaggaagatgttgacggagagaacaaggatgaagatattccggatccattgctaggtgagaatgaagagaaagaagaaggtgaaggtgtcgagaagcccaggaagacgattaagtatatgaccaagtatgaaagggctaggattttgggtactcgtgcgttgcagataagtatgaatgctccggtgatggttgagttggagggtgagactgatccacttgagatcgctatgaaggagcttagacagcggaaaatacccttcaccattcgccgatatctacccgatggaagctatgaagactggggagttgatgaacttatcgtcgaggattcttggaagaggcaggttggtggcgaatagtttgtccaccgcacacctcctctactgcttgaaatactctcgagcgtgtttacggtcctcaccacatgggtttggtggatagtggataccaccagtcttgtgatataacgttcaacttctttgtgctgtgcgttttatgaatatgatgatttattttgttaagttgtcttgtgatatagacgatcaccattagcaggc

SEQ ID NO: 3843 - DNA, 730 bp, Citrullus lanatus
ctgagatcctttgcaactgagaattttcgatagtaaccacaaagcgcgccaacagtttctctatccatcatcaatggcggacgacgattacaatgacctcgacatgggatatgaagatgagccaccagaacccgagattgaggaaggtgctgaggaagaattagatactactaacaatgatgatgttgctggtgaacccgttgaagctgaggaaaaggaagatgaagaacctgttgaacgagtgcgtaaaacgtcaaaatttatgactaaatatgaacgggctagaattttgggtacacgtgccctccaaatcagcatgaatgctcctgtgatggtcgagttggagggtgagactgatccacttgagattgcaatgaaggaacttcgtgagcggaagatacccttcaccatccgtcgctacctgccagatggaagttatgaagattggggcgttgatgaactgattgtggaggattcttggaagaggcaagttggtggcgcttgattttgatgtgtttgtgaggtaatagttttgctttcaattgcatagcgatttcttcccccctcctctaatcagcttgtgaatcttgtggttgttgtttaaccatctatctataatatattgaaaaggaaccactattgacaaaacatttctcgctattataaactaagcatgtcatttacacttgaaaaaccttttcgaaagccttcattaatcaataactttgtg

SEQ ID NO: 3844 - DNA, 654 bp, Actinidia deliciosa
  misc_feature (617)..(617): n is a, c, g, or t
  misc_feature (620)..(621): n is a, c, g, or t
caaaagcggaggggagagagagagagagcatactcagttcttcaacaatggccgacgaagactacgaaatggacggaggatatgatgacgagccagtggagcctgagcctgatgaaggggcagaagaggaggcggataacgataacaataacgaggacattcctgaccctcttttagctgatactgaagataaaaatggacaggaacgaggagaaaaatctcggaagacatcaaaatatatgacaaaatatgagcgtgcaagaattttgggtactcgtgccctgcaaatcagcatgaatgcacctgtgatggttgagttggaaggggaaactgatccacttgagattgcaatgaaggagctccgacagcggaagatacctttcaccatacgccgctacctgcctgatggaagctacgaggattggggagttgatgaattgatcgtggaagactcgtggaagaggcaagtgggaggtgattaatctgcgaatgcttcttcgatgagatgggtttgtggaaggttctatctgtgagactttgtaaactttaatagttgggattaaacctattggcataactcttggacaaagtttaagtatctgtattggagtattgcnggnnatggtgcattttccggcttcattttaaaaaaaa

SEQ ID NO: 3845 - DNA, 717 bp, Helianthus annuus
aggtgtgaaacagccagcaatcaccatcgtctctcttcatcttaatcttcgcgttgagcttcaacctctaacaatggcggatgaagagtatgagatggacggagggtatgaagatgagccaatggaacctgaggctgatgaaggagcagaggaggatgttgacggtgagaataaagatgatgaggcaccagatcctcttctaggtgacgacgaagataaggaagagcaagaacaaggagagcggcctcggaaaacatcaaagtatatgaccaagtatgaacgggctagaatcttgggtacacgcgctctgcagatcagcatgaatgctcctgtaatggttgaattggagggtgagaccgacccacttgagattgccatgaaggagcttcgtgagaaaaagatacctttcactattcgtcgatacttgccagatggaagttatgaagattggggagttgatgagctgattgtggaggactcttggaagagacaagttggcggtgattaaccacccccgcttgttgtcatttattgtggtgctaaatataatgttaggtcggtcggtcgtactagtcagaaatctaatcactatcagtctgattgtcatttggagtatgttgaagtaaactgtagtttataatcatatgcctgctaagtaactagtattctttttgttcttcttttttatccttcatactggaattgttggttaattat

SEQ ID NO: 3846 - DNA, 685 bp, Helianthus annuus
ccatcgtctgtcatcgtcttcgcgttgagcttcaacctctaacaatggcggatgaagagtatgagatggacggagggtatgaagatgagccaatggaacctgaggctgatgaaggagcagaggaggatgttgacggtgagaataaagatgatgatgcaccagatcctcttctaggtgacgacgaagataaggaagagcaagaacaaggagagcggcctcggaaaacatcaaagtatatgaccaagtatgaacgggctagaatcttgggtacacgcgctctgcagatcagcatgaatgctcctgtaatggttgaattggagggtgagaccgacccacttgagattgccatgaaggagcttcgtgagaaaaagatacctttcactattcgtcgatacttgccagatggaagttatgaagattggggagttgatgagctgattgtggaggactcttggaagagacaagttggcggtgattaaccaatcacccccgttttcgtctcctgcttgttgtcatttattgtggtgctaaatataatgttaggtcggtcgtactagtcagaaatctaatcactatcagtctgtttgtcatttggagtatgttgatatcatttggatgttgaagtaaactgtagtttaatcatatgcctgggacatagctaagtaactagtattcttttttgttc

SEQ ID NO: 3847 - DNA, 631 bp, Fraxinus spp
agaccagagcgagaacactagagagtcagaaagagggcgagggaggcggagaaggaaagcatcagtaaaaatggactgacgaggactatgagatggacggaggatacgaagatgagccaatagagcctgagctcgatgaaggggcagaggtggaggaagagaacaataacaacgaggatgctccagatgcttttgaaggtgaaggggaagataaacaggagcaagaaccagtagaacgccctcggaaaacgtccaagtatatgacgaaatacgagcgtgcgaggattttgggcactcgtgccttgcagattagcatgaatgctcctgtcatggttgaattggagggtgaaactgatcctcttgagattgcaatgaaggaactgcgagagcgaaagataccattcactattcgtcgttacctccctgatggaagttacgaagattggggagttgatgaattgattgtggaagactcgtggaagagacaagttggaggcgactaagatactcgtgccctactgcttaaatggttgtgttcagagtaatgtttgtgggaattttagataatgacaagtcttcaagtatgtagtaacagtgacttgtgatcataacatcttggactaaagtcatc

SEQ ID NO: 3848 - DNA, 824 bp, Lactuca sativa
ggggatcaaatttgcaattttatctgtaaaaaataacaaaattattattatttttaactaagtcataccctattttctctgagactcgtttataaccctacttactcacagaagtcttcttcttgttaccgtctttcgatcaaactagtctgaagagaaaaggagcttttctctgataaaatggccgacgatgactatgatatggacgctggaggttacgacgatgagccagccgaacccgaactcgatgaaggggctgaggaagagattgatggagataaagtggaagaagacgttcccgatccacttttaggtgacaacgaagataaagaagaacaggaagctgtagaaaaacctcggaagacgataaagtatatgacgaaatatgaaagggctagaatcttgggtacccgtgcacttcaaattagcatgaatgctccagtgatggttgagcttgagggtgaaactgaccccctcgagattgcaatgaaggagcttagacagaggaagatacccttcaccattcgtcgataccttccggatggaagctatgaagactggggagttgatgaactaatcgttgaggattcatggaagagacaagttggtggggactagttgaaataaatcatctgaatgtcatgtttatgatggattatgttgatacaaatgatttgaattgttatcatctcatgatgcatatttatgttcaacttggaattattatgatttgaaaattgtgaaaggtggttttgttatgaagttgttttgtatctttgtttccaacaagaatcaatcatatatattttgtaaatcttgtttta

SEQ ID NO: 3849 - DNA, 723 bp, Artemisia annua
cgtgtctctattatcacgcagtactccgacggggatatctttgttcagtctctttgtctaaaaaataaaaatggctgacgatgactacgatatggacgccggaggttacgacgatgagccagttgaacccgaactagatgaaggggctgaggaagatattgatggagatgctaaggatgaagatgttccagatccacttatgggtgatggtgaagataataaggaagaacaagaacctgtcgataaacctcgtaaaactattaaatatatgactaaatatgaacgtgctaggatcttgggtactcgtgctctccaaattagcatgaatgcgccggtgatggttgaattggagggtgaaactgatccccttgagattgctatgaaggaacttaggcagcggaagatacccttcactattcgtcgatacctgccagatggaagctacgaagactggggagttgatgagctaatcgtggaggattcttggaagagacaagttggaggagagtaatttatccgggctctttaagctgcttgaaatactccttgaatgtcatgtttatagcctgcactagtggatttgaatactatgttcaagtcattaccattcttgtggatttgaatattatgtaacttgttgacgaaaatttgaaactattgtggtttgcttttttatgaggatggttttgatggctgatttttcttaattttaattcgagttaa

SEQ ID NO: 3850 - DNA, 738 bp, Musa acuminata
cgaaacttctagggttcctgcttctgggtagaggggagagggagagaactataagggggcttttcggcttggataatggccgacgatgactacgatgacgtcgacatgggttatgaagatgagccaccagaaccagaaattgaggaaggagtagaggaagatcaggaaaataacaatgaagacatgccggatgatgttgtaggagctgagggcgaggaaaaggagcaagaacgagttgaacggcctagaaaaacatcaaaatacatgacaaaatatgaacgtgctaggattcttggtacacgagctctgcaaatcagcatgaatgctccagtgatggttgagttggagggtgagactgaccctttggagatagcaatgaaagaacttcgcgagcgcaagataccatttaccatccggcgatatttaccagatggaagttacgaagactggggagtcgacgaactaatagtggaggattcctggaagaggcaagttggcggggactaagctgatgaccatcaaaccccttcttgtttccatgcttgctacatttgctgtgtacctatcacactagattgaattagatggatggaagttgattggagaaggatcatctgaatagcatgctgtcataaaacgtttaatcacgcatgccaacgaaggctgtcctctttggtcaatttcacctatttgtgaccgttgtttgtagactatgcttggcaaatgtggtggtttaac

SEQ ID NO: 3851 - DNA, 799 bp, Manihot esculenta
ggcgatacatacgggcatactttaaccaaattaactccggataaagtagagaaagggtttttgcttcagtatccctgcttaggttttgcttgtcttccataatcaatcatggcggatgacgactacaatgaaatggatatgggatatgaggatgagccgccagagcctgaggttgaagaaggagccgaggaggacgttgataacaataacaatgaggatgttcaaggggaacccattgaaactgaggataaagaagatcaagaacctgtggaacgtcctcgcaaaacatcaaagtatatgacaaaatatgagcgtgctagaattttgggaactcgtgctttgcagatcagcatgaatgcacctgtaatggttgagttggagggtgaaactgacccactcgagattgctatgaaggaactaagagagcgaaaaatacctttcaccatccggcgctacctccctgatggaagttatgaggactggggagtagatgaactgattgtggaagactcgtggaagaggcaagttggaggtgattgatagctggatttttaatcgttggaagatggctggtgaaaagcgtttgatgatgtattaccagaacttcaaagcaagtccgctaaagcagtgtaacatcattttatgtttgagaaacttccagttgtataaatatactacctgggaactggtatattgactgatggttgctgaacttttaggaatatacttttgccttaaaacactttgagcctgacaatttcaagtgaatgttgagtgaaccttttccttgtttgggtac

SEQ ID NO: 3852 - DNA, 745 bp, Cucurbita pepo
tgggtgaatccagagaggcgagaacagctttctatcgatcatcaatggcggatgatgattacaatgacgtcgacatgggatatgaagatgagccaccagagcctgagatggaggaaggagctgaagaagaattagataacaataatgccgatgatgttcctggtgaacctgttgaagcagaggataaggaagatgaagaacctattgaacgtgtgcgtaaaacctcaaaatttatgacgaagtacgaacgtgctagaattttgggtactcgtgccctccaaatcagcatgaatgctcctgtcatggtcgagttggagggtgagactgatccacttgagattgcaatgaaggagcttcgtgagcggaagatacccttcaccattcgtcgctacctaccagatggaagttatgaagactggggcgttgatgaacttattgtggaggactcttggaagaggcaagttggtggcgcttgatctatatcctttgttgtgtggctgtcagcgtatgtgagatagtagtttcaactgcatggcgattagagccccatggtccaatacagtcatcttcgaacggtgagatggttgctcgccattattgttttgttatataactatctatagtatattgggaaagaaccactaatggcaaacattctttactattataaagcatgtcattaacacttccattagtcggtagcttttttactcttcaattgttctttctaacctgtcattagaaa

SEQ ID NO: 3853 - DNA, 673 bp, Unknown
  Sequence found in Organisms: Euphorbia peplus, Euphorbia esula
aacccctctttcgtctcgggggcttctgtacagagagagttttgagaaaaaggattttggggttcttcacttggacgatcaaccatggcagacgacgactacaatgatatggacataggatacgaggatgagccagcagagccggagattgaggaaggagcagatgaggagattgataacaataacgaggatgtacctggggatcctattgaagctgaggatagagaagaacaagaagctgtggaaagacctcgtaaaacatccaagtacatgacaaaatatgagcgtgctagattattgggtactcgtgctctgcaaatcagcatgaacgctcctgtcatggttgagttggaaggagaaacagacccgcttgagattgccatgaaagagctccgggagaggaagatacctttcacaatccggcgttacctccctgatggaagttatgaagactggggagtagatgaactgattgtggaagattcatggaagagacaagttggtggtaattgatctactggtgattggagccttgaatgatgtatcgctgtaacttttaaccagtactgtaaaaattaactgttggccttttacttctagacatatacatttaagtgtaaactttctctggttccctggaaaatgggtgtagtgatatattttgtgttccttg

SEQ ID NO: 3854 - DNA, 788 bp, Populus trichocarpa
cgacagtgtttcttgctctctcgtattccggagacagaaagggttttagacctacaaagaaccagagagaagctctccttccttcttcaagaatcaataatggcagacgaagattacaatgatgttgacatgggatatgaggatgagccaccagagcctgagattgaagaaggggttgaagaagatgcagataacgataacaatgaagatgacaaaggggaaccaattgaaactgaagacaaagaggaacaggaaccagtggagcggcctcgtaaaacatcaaaatttatgacaaaatatgagcgtgctagaattttgggaacccgtgctcttcaaatcagcatgaatgctcccgtgatggttgagttggagggtgagactgacccgctcgagattgctatgaaggagcttcgtgagcgaaaaatacctttcaccatccgtcgctacttgcctgatggaagttatgaagactggggagttgatgaactaatcgtggaggactcgtggaagaggcaagtgggaggtgattgagaaaccaagatttggttggtgaaccctgttgcaatttgatcaagttggagatagtttaaagccttgtataatatgtaaccaaaagtatttgctctaattgctcggaacatgacctgtgaaactaaactgaatatgtggtgttatgacagattttgaactctagaagtgcttgtgattcttagaaagaaatgaatgtgggtgctttgaatttcaaatgttgtatgccaaagttctgatggaacgattggttggatgca

SEQ ID NO: 3855 - DNA, 922 bp, Populus trichocarpa
gtaaaatataaagcaatgccagcgacagtgtttcttgctctctcgtattccggagacagaaagggttttagacctacaaagaaccagagagaagctctccttccttcttcaagaatcaataatggcagacgaagattacaatgatgtggacatgggatatgaggatgagccaccagagcctgagattgaagaaggggttgaagaagatgcagataacgataacaatgaagatgacaaaggggaaccaattgaaactgaagacaaagaggaacaggaaccagtggagcggcctcgtaaaacatcaaaatttatgacaaaatatgagcgtgctagaattttgggaacccgtgctcttcaaatcagcatgaatgctcccgtgatggttgagttggagggtgagactgacccgctcgagattgctatgaaggagcttcgtgagcgaaaaatacctttcaccatccgtcgctacctgcctgatggaagttatgaagactggggagttgatgaactaatcgtggaggactcgtggaagaggcaagtgggaggtgattgagaaaccaagatttggttggtgaaccctgttgcaatttgatcaagttggagatagtttaaagccttgtataatatgtaaccaaaagtatttgctctaattgctcggaacatgacctgtgaaactaaactgaatatgtggtgttatgacagattttgaactctagaagtgcttgtgattcttagaaagaaatgaatatgggtgctttgaatttcaaatgttgtatgccaaagttctgatggaacgattggttggatgcatgttctgggacatgagaagtattttattctcctgctgccaggcatagaaaagaagttttcttgaatttatttcaagtaactgcaaagttaatcatgaatctattgccgacta

SEQ ID NO: 3856 - DNA, 665 bp, Helianthus annuus
aaaaacacacaaaaccttcatccctgaacaaaaatggcagacgatgactatgaaatggacgtcggagggtacgaagacgagccaatcgaaccagaactcgatgaaggtgttgaggaagatgttgacggagagaacaaggatgaagatattccggatccattgttgggtgagaatgaagacaaagaagaaggtgaaggtgttgagaagcccaggaagacgattaagtatatgaccaagtatgaaagggctaggattttgggtactcgtgcgttgcagataagtatgaatgctccggtgatggttgagttggagggtgagactgatccacttgagatcgctatgaaggagcttagacagcggaaaatacccttcaccattcgccgatatctacctgatggaagctatgaagactggggagttgatgaactaatcgtcgaggattcttggaagagacaggttggtggcgaatagtttgtccaccgccccctctactgcttgaaatactctcgagcgtgtttacggtcctcaccacatgggtttggtggatagtggataccaccagtcttgtgatataatgttcaacttctttgtgctgtgcgttttatgaatatgatgatttattttgttaagttgtcttgtgatatagacgatcaccattagcaggc

SEQ ID NO: 3857 - DNA, 1514 bp, Sarracenia psittacina
catgctttactttctcctccatgaccccatcactggattaagtcaaacgacaacgtttgaactcacatcaggagcccacagcaggcccctttcggtacaaacggatgatgaaagcccggattagctgctggagcattagcaagagcgaggcagagcgagcgagagcgagcgagcgagcgagcgagcataatcagttctgcaaaatggccgacgaggattacgagatggacggaggatatgatgatgagcctttggagcccgagcctgaactggatgaaggggtagaagaggatgcagataataatacgaatgacgacgttcctgatcctcttttagctgaaaatgagaaaaagatgatcaggaaccaagagagcgacctcggaagacatcaaagtatatgacaaaatatgaacgtgcaagaattttgggtactcgtgccctgcaaatcagcatgaatgcacctgtgatggttgagttggaaggtgaaactgacccacttgagattgcaatgaaggagctccgacagaggaagatacccttcacgattcgccgctatctgcccgatggaagttttgaggactggggagtggatgaattgatcgttgaagactcgtggaagaggcaagtggggggtgattaatctgcaaatatgctcttttcacgagagggttgttgaaggttttgtgtctgtgttgagtcaatgatattatgtgagttttaaccagtagtgtgtcttgaagctattagcttatcttcatggataaagttgaagcctatctgtttgggctaaatccggagattttgtttttttttggaaaatgtgaagcaataccattctctatgatccaactttaaaagaaatgcatacagtgagtcgatcaagaggagcaatcaacatgcaaaactacagcgtgcataattcaattgaaaccatatcaagaaatgtcatgtccaatgagatttgactacacccaattgaaaaagaaaaaaaacaatgtaagcactaaacctgcaagaagactagaggtacaggtcagacatttttgttcttcttcatctttgaaggtggccatcggcctttcttcctcatgcggcgcttcctgacaagcttctttcttctaagtctaatcttctttgccaatttcatcttcatcttctgttcaagttttaactgcagcttggactccaacgggagattctcaaatggcatagcattttcctcaccttcagacggaggatcaacaccatctgatcctgtcccatcgacctcaacggatgccttagcaatcactgcacttctttctttgatgataagggatgtattaatttggaatccataggaagattttgggtgcagacaggtgaattccttgtgcaacctagagaagaggtttgcgttgatggccaaagttaatacagatgacgatgatggtggtggtggtgtaacaaaggagagagaaggggtgctactgaagatgagaacagccatttctccctactggctttagatttct

SEQ ID NO: 3858 - DNA, 711 bp, Prunus persica
cttgaaacattactctctctctctctcgcgcgcgcgcgcgctctttctatctcgctcaagttctcaacccctcagagcttgttcactcattaacaatggcggacgaggattacaacgacatggatatgggatatgaagatgagccaccagagccagaaattgaagaaggtgcagaggaggatgtggacaatattaacaatgatgatcttccaggagacgccattgaagctgaagacaaagaggagcaagcacaggtggaaggacctcggaaaacctcaaaatttatgaccaaatatgaacgtgctagaatcttgggtacccgggcactgcagattagcatgaatgccccggtgatggttgaattggagggtgagactgacccacttgagattgctatgaaggagcttcgtgagcggaagatacccttcaccatacgccgctacctgcctgatggaagttacgaagactggggagtagatgaattgattgtggaagactcatggaagagacaggtgggaggtgattgatcagatttcatttacgcatggagaatggtacaatgtcaatatgtaatctataattgtaggaagatctgccttttgcactggcctatgaacttacatgtgaaacactgttattttgggtatatgtggactctttgcaactcacattgttcatatggccttttttttgtttttttttgtttttttt

SEQ ID NO: 3859 - DNA, 764 bp, Prunus persica
atccaaaaccttatttcaaaccctaaacccagtcccctgcttgaaacattactctctctctctctcgcgcgcgcgcgcgctctttctatctcgctcaagttctcaacccctcagagcttgttcactcattaacaatggcggacgaggattacaacgacatggatatgggatatgaagatgagccaccagagccagaaattgaagaaggtgcagaggaggatgtggacaatattaacaatgatgatcttccaggagacgccattgaagctgaagacaaagaggagcaagcacaggtggaaggacctcggaaaacctcaaaatttatgaccaaatatgaacgtgctagaatcttgggtacccgggcactgcagattagcatgaatgccccggtgatggttgaattggagggtgagactgacccacttgagattgctatgaaggagcttcgtgagcggaagatacccttcaccatacgccgctacctgcctgatggaagttacgaagactggggagtagatgaattgattgtggaagactcatggaagagacaggtgggaggtgattgatcagatttcatttacgcatggagaatggttacaatgtcaatatgtaatctataattgttaggaagatctgccttttgccactggccctatgaacttacatgttgaaacactgtttatttttgggtaaatatgttggaactcttttgcagacatcagcattgttcatatggccttttttttgtttttttgttttttttt

SEQ ID NO: 3860 - DNA, 787 bp, Fragaria vesca
atttgttccctctccctgcttggctttccttcctggctctattctgcgaagtgcgaacacaaagaaaattagggcttctgattcacaggaagctgagtgatatttcgaggagcaaggttgttcttggggattagaaaaagaggctttttaaccaattcacaatggctgatgacgattacaatgagatggatattggatatgaggatgagcctgtggagccagagatggaagaaggtgcagaggaggaggatttggataacaatgatgatatggctggagatgccattgaaactgatgacaaggaagaacaagcaccagtggaacggcctcgcaaaacatcaaaatttatgaccaaatatgaacgcgctagaatcttgggtacccgtgctgtgcagattagcatgaatgcacctgtgatggttgagttggagggcgagactgacccgcttgagattgcaatgaaagagcttcgtgagcggaagataccctttaccatccgccgctacctgcctgatggaagttatgaagattggggagttgatgaactgattgtggaagattcctggaagaggcaggtgggaggtaactgatcctttagttacaagcaaggaaaatgcattgtgcttcaaatcttgttcggaggattttgttcttgtcattgtgtttcggcactgaacctatgaactacatgtcaaaacacttttatgtccagtaggtttgaaactttggtgtatgctgcttatttgttaaatatgtactccgttggcagttcattagttgggttatt

SEQ ID NO: 3861 - DNA, 714 bp, Amsonia hubrichtii
tatcccttcggctgcagagagagagagagggcacttacaagagccagaggcgctaccgagctgcagcaggaaaacaatggcggacgaagactttgagatggacggaggatatgatgatgaaccagtggagcccgagcctgaagaaggggctgaagtggaagaagagaacaataacaatgaggatggccttgatcctattttaggtgacactgatgacaagcaggaggaggtaccaagggagcgccctcggaaaacatcaaaatttatgacaaaatatgaacgtgcaaggatcctgggtactcgagctctacaaattagcatgaatgcccctgtcatggtagagttggagggagagactgacccacttgagattgcaatgaaggagttgcgagagaggaagatacctttcactattcgacgctaccttcctgatggaagttatgaagattggggagtggatgaattgattgtggaggattcttggaaaagacaagtgggtggcgattgagtctctctgatggcactctctcatggttctgcattttgaatctctgaaagctgcctgttgattcttgggctgtatgcgcttagaggatctgtaactgaactgtggattgtgcggaaagacttttttgtagttgtcaaagtatccaatgatgtaccttaatctgtgtgtgctgatactgaggaaaaacttcatatttggctttaaaa

SEQ ID NO: 3862 - DNA, 822 bp, Antirrhinum majus
  misc_feature (772)..(772): n is a, c, g, or t
tcttagtttaattctctcacacgctccaagccctagcctggcaaagcagataacagagtgaaagctcgcaaaagacatacgccatggcggacgaggagtatgagatggacggagggtatgacgatgagccaatggagcctgagcttgaagagggggtagaggcggaggaagagaataatgaggaagcgccggatctgatggaaggcgaaggagatgataaacaagaccaggagccgattgagaggccgcggaagacgtctaagtacatgacaaagtatgagcgtgctaggattttgggcactcgtgctctgcagataagcatgaatgctcctgtcatggttgagttggagggtgaaactgatcctcttgagatcgcaatgaaggagctacgagagagaaaaatacctttcaccattcgtcgctacctccctgatggaagttatgaagattggggtgtggatgaactgattgttgaagactcctggaaaagacaagttggaggccagtgaaaatacttattcctttatgcttaagtggttgaagattggtctgccatgtatatctcagttgcaatgtaccgaactcaaggctagtcttgtcacttggacttatccgaattatcaaaaacagaactttggacttgacttaccctgctacacttaatgctttcttgtgtgtttaaatcttttgattagatgtcatgtttagtgtttgtttattgagcttgattacatccgtgatatgtggtttgaggtgatagtcctagtattgnttttgttattaaataactgaaattaaacacattaaaagctttgagatttg

SEQ ID NO: 3863 - DNA, 670 bp, Ipomoea nil
ggtgagcattagctgaagaagagtttcggagctttgctggtagggagaactgagaagcacctcaaaaatggcggacgaagactatgagatggacggaggatatgaggaggagccagtagagcctgagattgaagaaggagttgagccagaggaggataatgctcagccagaagatgtacctgacgccctaatgggtgacggtgatgataaaaatgagcaggatgcagtggaacggcctcggaaaacatcaaaatatatgacaaaatatgagagagcaagaattctgggtacccgtgcacttcagatcagcatgaatgctcctgtgatggttgagttggagggcgaaagtgatccccttgagattgctatgaaagagcttcgagagaggaagattcccttcacaattcgccgttacttgcctgatggaagttatgaagattggggggttgacgaactgatagttgaagactcgtggaaacgacaagtaggtggggcgtaagcaatacttgctgaactgttgtagtcgctctaataggatgttatgtattgcgtggtttggggaactagtagggggaactatacctcctactaaatattgttgtgatggagatattaacaactttgtgcttgtgaagtgatgtgttttgtccggaattgcatgtttgattgc

SEQ ID NO: 3864 - DNA, 778 bp, Cichorium intybus
cgggggatcattcgtccctagataggacaaagaaacgacagtcgaaatacaccttcaatcaaacgacacatctcagaaggggctttcatccgaaaaatggccgacgatgactatgatatggacgccggagggtacgacgatgagcccaacgagcccgaactcgaggaaggggccgaggaagagattgatggagataaaccggacgaagacgttcctgatccactcttaggtgacaacgaagataaagaagaacaggaagctgtagaaaaacctcggaagacgataaagtatatgacaaaatatgaaagggctagaatcctgggtacccgtgcgctgcaaattagcatgaatgctccagtgatggttgagctggagggtgaaactgacccccttgagattgctatgaaggagcttagacagaggaagatacccttcaccattcgtagatacctgccagatggaagttatgaagactggggtgttgatgaactaattgtggaggattcttggaagagacaagttggtggcgactagtttctgaatgtcatgattatgattctgcacgtatggatgttgattcttatgatttaacttgtcaccagccttgtgatctctcatgcatgtttatgttcaacttgatgaaaacttggaattattgtaatttgtgatttgtgaaggtggttttgttatgaagttgagtaagtttagactttgttaaatacaagggttgtgtttgttacacaggagtggacaagcggagcgagggggggcccggtac

SEQ ID NO: 3865 - DNA, 596 bp, Guizotia abyssinica
gaccggaaaggagagagagctacaggtgtgaaacggcaattatcaccgtcttcgcgtcgagcttgagcttctaacaatggcggatgaggattatgagatggacggagggtatgatgatgaaccaatggaacctgaggctgaagaaggagcagaggaggatgttgaaggcgagaataaagatgatgatgcaccagatcctcttctaggtgataatgaagggaaggaagaccaagaacaaggagaacgacctcgagggggtcaaagtacatgacaaagtatgagcgggctagaatcttgggtacacgcgctctacagatcagcatgaatgctcctgtaatggttgaattggagggtgagaccgacccccttgagattgccatgaaggagcttcgtgagaaaaagatacctttcaccattcgtcgatacttgccagatggaagttatgaagactggggagttgatgagctgattgtggaagactcttggaagagacaagttggtggtgattaacaaccccaacccgtctcgttagtgtttagtatgtggtttgcaggggataatcttagcgttgttaatctttctgttatgttgtgagc

SEQ ID NO: 3866 - DNA, 620 bp, Ambrosia trifida
cttcttcttctcccgataaaaaaacacatagaaccttcttctcttaacaacaatggccgacgatgactatgagatggacgttggaggatacgaagatgagccagtagagccagaactcgatgaaggggctgaggaagatgttgatggtgagaataaggatgaagatattcctgatcctttgttgggagataatgatgataaggaagaaggtgaaggtgttgagaagcccaggaagactattaagtatatgactaagtatgaaagagctagaatcttgggtactcgtgctttgcagataagtatgaatgctccagtgatggttgaattggagggtgagactgatccacttgagatcgctatgaaggagcttagacagaggaaaatacccttcactatccgtcgatacctaccggatggaagctatgaagactggggggttgatgagctaatcgtcgaggattcttggaagagacaggtcggtggcgaatagtttgtccacccactcccctctactgcttgaaatactcttgaatgtcgtgtttacggtcctccacatatgctttggtgtacacttcctgtcttgtgatataatgttcaagtactttattatctgcatttta

SEQ ID NO: 3867 - DNA, 578 bp, Ambrosia trifida
aatggccgacgatgactacgagatggacgttggaggatacgaagatgagccaatagaaccagaactcgatgaaggggctgaggaagatgttgatggtgagaataaggatgaagatattcctgatcctttgttaggtgataatgatgataaggaagaaggtgaaggtgttgagaagcccaggaagactattaagtatatgactaagtatgaaagagctagaatcttgggtactcgtgctttgcagataagtatgaatgctccagtgatggttgaattggagggtgagactgatccacttgagatcgctatgaaggagcttagacagcggaaaatacccttcactatccgtcgatacctaccagatggaagctatgaagactggggggttgatgagctaatcgtcgaggattcttggaagagacaggtcggtggcgaatagtttgtccacccactcccctctactgcttgaaatactcttgaatgtcgtgtttacggtcctccgcatatgctttggtgtccacttcctgtcttgtgatataatgttcaagtactttatatctgcattttatgaagatgaa

SEQ ID NO: 3868 - DNA, 961 bp, Musa acuminata
ctttcggccatggggtaaaggcgggtcggatatttatccctccgaatccgacctcctgccagagtaagtgggtcggacatttccatccgatatctttaaatttgatccgttttctaccgacctttaccgcaccctccgtgacgttttgttgctggccgtcgtacgaaatttctagggcttctgctcgcgagagagagagagaagagaggggcttctccacttccggaatggcggacgacgactatgacgatgtcgacatgggttatgaagatgaaccaccagaacccgaaattgaggaaggagttgaggaggatcaggaaaacaatgaagatgctccagacgatgttgtggggccagaggctgaagacaaggaacaagaaaaagttgaacgacctagaaaaacatcaaaatacatgacaaaatatgaacgtgctagaattcttggtacacgagctctgcaaattagcatgaatgctcctgtgatggttgagctagagggtgagactgatcctctggagattgcaatgaaagaacttcgcgagcgcaagataccatttaccattcgacggtatttgccagatggaagctacgaggactggggagtcgacgaattaatagtggaggattcatggaagaggcaagttggtggggactaacatgacgatcatccgcagttgttttcggggattctacacgaattgaacctctttcggctacatgcctaacttcttaaactgaattagacagttttgcttggaaacgtatcatctgaactacttgcttcaattgtaatgttcggaagtgtgacagtttatgtaactgctttcaaattgttagttttactgtagatggttgtcttgcttcaaacaatctcccaatacattctcgtttattttgtttaatacagccacactgggtaataaagtaacccttattgccaaacgtgatatcattacttcat

SEQ ID NO: 3869 - DNA, 734 bp, Cucumis sativus
tctcgaaaatattacttcaaagggttttgaatcccagtcgagaccgagggttttccacaggccaacagtcttctctatccatcatcaatggcggacgacgattacaatgaccttgacatgggatatgaggatgagccaccagaacccgagattgaggaaggtgctgaagaagaattggatactaacactgatgatgttcctggtgaacccgttgaagcagagggaaaggaagatgaagaacctgttgaacgtgtgcgtaaaacctcaaaatttatgactaagtatgaacgtgctagaattttgggtacacgcgccctccaaatcagcatgaatgctcctgtgatggtcgagttggagggtgagactgatccacttgagattgcaatgaaggaacttcgtgagcggaagatacccttcaccatccgtcgctacttgccagatggaagttatgaagactggggcgttgatgaactgattgtggaggactcttggaagaggcaagttggtggtgcttgaattttgatgtttttgtgagataatatatagcttttctgtcaattgcatagccgatttgttcgctcctttaatcaacttgtgaatgttgtggttgttgcataacttatctataatattggaatgaaatcacttttgagaaacagacatttcttgtttgtttataactacacatgccattaacacttgaataacattcattaacccaaaaactttgtgtc

SEQ ID NO: 3870 - DNA, 569 bp, Flaveria ramosissima
accttaagcttctaaaaatggcggatgaggagtatgagatggacggagggtatgaggatgagccaatggaacctgagcctgaagaaggagcagaagaggatgttgaaggagagaataaagacgatgacatgccggatcctctgctagctgacaatgaagataatgaagagcaagaacaaggagaacgacctcgaaaaacatcaaagtatatgacaaagtatgaaagggctagaatcttgggtacacgtgctctacagatcagcatgaatgctcctgtaatggttgaattggagggtgagaccgacccccttgagattgccatgaaggagcttcgtgagaaaaagatacctttcaccattcgtcgatacttgccagatggaagttatgaagactggggagttgatgagcttattgtggaagactcttggaagagacaagttggtggtgattaacattgcccgtctcctgctcattgtcgtgtaatgcacttagtcccatttgcagttggataataatattagcataggcctgtcagcttgcctgacttggtcgtaaatttatcactatct

SEQ ID NO: 3871 - DNA, 1259 bp, Aristolochia fimbriata
agattcaaatgaaaaagtcgggacagccctttcccaaaacttgttccttcccgacgtctcccttctcttctctctttagtttccctccccctcttacactctttacgtttctcccccgctctctctcggtgtttcggtcacagccgtcttccaacttccggtgacatcttttcctaaccggcgtgtaaaggcttaagttcagcattttttggaagaggaggattttttgctagagtacaacagtgatggcagacgatgattataatgatatggacatggggtatgaagatgagcctccagaaccagaaattgaggagggggttgaagaggagatcgataataacaatgaagatctgcctgatactgttgaacctgaaagtgaagcaaaagaaaacgaggaagcaactcaacggcctcgaaaaacgtcaaaatacatgacaaaatatgagcgtgctagaattcttggtacccgggcccttcagatcagtatgaatgcacctgtaatggttgagctggagggagagactgatccactggagatagccatgaaagagcttagagagcgaaagatcccatttaccattcgacgatatttgccagatggaagttacgaagattggggtgtcgatgaacttatagtagaggactcctggaaaaggcaagttggaggcgactgaacttggcaaatcggcctatgaaactttaggtcttggcttttctggaactcattatacttcacgttttcttgttgctgtttacatagtgtgtgattaggtagcgagctgctgcaaaccacccatgctcagtgcttgtacttgtagttgaactgtcttcgagggtggtctggtcctctgattgtgattgtgaacgttttcttcttttaaatttacatgttctgctgtggctttattaaattgtttttcggtgttaagatttctaactactaattttttaatttatttatgcatattttccttgttaaaatgttatttatgaagtacaaaatctttgttaattagcttgactttacctgaatgcggaataccaactagactaatcgaggccagctttaatttggaaagagttggcaaatcatcagtgcctcctttactgccatcttgtttccctggctcctcttggttgttctaaatcatacttaattatgattaccatacaaggtattcataataatcttgtatatgaattttgactgcacatgcctcttatttgcatcgtttcttatttgcgctcatgcactt

SEQ ID NO: 3872 - DNA, 995 bp, Eucalyptus grandis
gaagcggtcggggttagaatcaatcggaaccgaaactccgatcaaattagggttttagctttagctcctttccccccgattcgcccttcctcctcccgctcggagctcgccggctgatcgcaatggcggacgacgactacaatgaagtcgacatggggtacgaagatgaaccgccagagcctgagcttgaagaaggtgtcgaggaggatgtagaaaacgctaaccatgaggatgttcctgatgctcttgatggtgaagaaaaggaagaagaacctgtagagcggcctcgtaagacatcaaagtttatgacgaaatatgagcgtgctagaattctgggtactcgtgctctgcagatcagcatgaatgcgcctgtcatggttgagttagagggcgaaactgatccactagagattgccatgaaagagctccgagagaggaaaataccattcaccatccgtcgctatctccccgatggaagttatgaggattggggagtagacgaattgatcgtggaagattcctggaagaggcaagtggggggtgattgatactttcgtcgtgtgtgaagattggatgtgttctgtaaatgctagtggtttagggcaatgaaccactcaacaagcaaaattaatgacaatgccagtgtcaaggtcacggacattttgatgtgcattcgcacctggtagctctgagatggtgtgtttgataaaagatccggcgacttttaaatgctctacttcatacatgtattttgtcagggagtcgttgctttaaatatatcatacctcaagaaaggatttcctattagatcaagacgttcttccttaattcttatatcgattagggaattgctagtcgagtcttgaccgcctgcccgtcatcattgcgatcttaagatgacaaaatggaaacggtaccgtccattcttagttatttctgcataatgcataaaataatactttatgaagcatacgtacgaccaatctctagttcat

SEQ ID NO: 3873 - DNA, 1013 bp, Vitis vinifera
attggtttttttttttttttttacctctactaaatctaaaaattaaaagggccacccacttctgaagttgccctccagccgagagaattcccctttccccttttctgaagctgccctccaccgctgaagctgccctccagccaagagagttcctcttcctaaaaagacctatcttcctctgccactctcaatcctcgcagtggactattcaacgcacccagctagggtttttgcgtagaaagcagagagagacggcaccttcatcaatcgacgatggcggacgaagagtacaacgacgtggatatgggatatgaggatgagccgccagagcctgagattgaagagggtgcagaggaagaagccgaaaataataacaatgaagatgttccagatgctcttgaagagcaagaaaaagaagtacatgagacggtagaacggcccagaaagacttcaaagtatatgacaaaatatgagagagcaagaatcttgggtacccgtgctctgcagatcagcatgaatgcgcctgtgatggttgaattggagggtgagacagatccacttgagattgcaatgaaggaacttcgtgagcggaagatacccttcaccatccgccgctacctgcctgatggaagttatgaagattggggagtggatgaattgattgtagaggattcatggaagaggcaagttggaggtgattgactaacccacgttgggctgtggggaaatggactcttggaagtcctgtttgatgtggctttgtaactcactgatagtgacactattagtaggatcaacaatacataatttgcaaatacattgtgtgtgaaattaatgttgaatctcttactatccttccaagtttattttcatggagacctagaatgttgaaggtctttgtgtgtgaaatgattaacactacttccactggtattttgtcacccacaacctgggtcatgggctcctgccatgaaactacagacctcaatgatttgtccctgcgccaatggact

SEQ ID NO: 3874 - DNA, 779 bp, Quercus alba
ccgttctccaaagaagccacaacttggcgaccattttttgatctttcggccaaataggtaatcaagtcctacatactatttagttctttgactaagagtgttggtgacgaagccaagtgtagagggaaaagcttcttcagcaatcaacaatggctgatgaagattacaatgatttggacatgggatatgaggatgagcccccagagcccgagatcgaggaaggtgcagaggaggatttagagaacaatgccaatgaagatgctccggtagagattgaaggtgaggagagagaagagcaggaaccagttgaacgtcctcgtaagacctcaaagtacatgacaaaatatgagcgtgccagaatattgggtacccgtgctctgcagatcagtatgaacgcacctgtgatggttgagttggagggtgaaactgacccacttgagattgcaatgaaggagcttcgtgagcggaaaatacctttcaccatccgccgctacttgccagatggaagttatgaagactggggagttgatgaactgattgtggaagactcatggaagaggcaagtgggtggcgattgatcagtcattaattggactaagggagttctgaatgacgtgaattcaaagtttgtagctccctatttttggcccccccacccaaaaaaaaaaaaatactggtttaacttcagactactgatcctaagtgcgttaatctcgtacgtaactcacatttagtagtgatgtagttattattattattattatttatttttaattata

SEQ ID NO: 3875 - DNA, 824 bp, Allium cepa
ttctttgtgaaaaataaggaaccgaaaactcctagggtttggaaaacgtcaatctaagttctaatggcagacgacgattacaatgacatggatatgggatatgaagatgaaccaccagagcccgaacttgaggatggagctgaggaagaaatagagaacaacaacgaagaagttgcagatgatattattggagaaggtgaagagaaggatcaggaatctgttgaccgagttcgcaaaacatcgaagtatatgacaaagtatgagcgtgcgagaatactgggaacacgtgccttgcaaattagcatgaacgcaccagtcatggttgagcttgaaggagagactgatcctcttgagattgcaatgaaggagcttcgggagcgcaagataccatttaccatccgccgctatttacctgatggaagttatgaggattggggagtagacgagttgatagtggaggactcttggaagaggcaagttggcggcgattagagcaatgctactctgctcttctctttgtctaccatgggaactgcactcctatttgtcactgcttgttcatatgatctttataatatttcgtaaccatgatgtgttttaaatgcttctactgtaaacagactgcatggagatgtgcttcatgagaaacagtttatcatctctaggtatagaatgttgagctttttagggaatttgcatcaaggtgcatccgcatgattatgatcgttgctctagcaattgctagggtttacatgatgatgattcggattgacaatccaactgcttaagcagttgatttatatcatgtgaaataataagtagaa

SEQ ID NO: 3876 - DNA, 882 bp, Rosa hybrid cultivar
ggttcgcgttccttcctggctttactctgcaaccataaaaattagggcttctgattcacaggaagctgagtgatattttgcagagcaaggtcgtgcttggggattagaaaagaggctttttaaccaattaacaatggctgatgatgattacaatgagatggatattggatatgaggatgagcccgtggagccagagattgaagaaggtgcagaggaggatgtggataacaatgatgatcttgctggagatgccattgaaactgatgacaaggaagaacaagtaccagtggaacggcctcgcaaaacatcaaaatttatgaccaaatatgaacgggctagaatcttgggtacccgtgctgtacaaattagcatgaatgcccctgtgatggttgagttggagggtgagactgacccgcttgagattgctatgaaggagcttcgtgagcggaagataccctttaccatccgccgctacttgcctgatggaagttatgaagattggggagttgatgaactgattgtggaagattcctggaagaggcaggtgggaggtaactgatcagattaatacaagcaaggaaaatgttttgtgctcaatcttgttcggaggatcttgcttatgtcattttgtgttttggcactggccatatgaactacatgtcaaaacactattatgtcagtatgtttgaaacgttggtgtatgctgcttttatgtcaaatatgtgctatgttggcagttgagtagtggttattattgaatcaatatgcatgtacacaaaatgcaaaccaattgctttggctcagggcaagccttcatagatcttgagcattgaccaaggaaacaaatataatgtgtagcaaataaggttcccattcaagggc

SEQ ID NO: 3877 - DNA, 662 bp, Zingiber officinale
actcaccaaaggggagagagatagagggggaagaagagcgtgtctactcaaatcgataatggcggaagatgattacgatgatgtcgacatgggttatgaagatgagccaccggaaccagaaatcgaggaggggatggaggaggatcaggaaaataacaacgaagacgtcccagatgatgttgttggtgatgctgaagaaaaacagcaagaaattgttgaacggcctagaaaaacatcgaagttcatgacaaagtatgagcgtgctagaatccttggtacacgggctttgcaaattagcatgaatgctccagtgatggttgagttagagggtgagactgatcctttggagattgcgatgaaggaacttcgtgagcgcaagataccgttcaccattcgacgatatttaccggacgggagctactaagattggggagtcgacgaactgatcgtggaggattcctggaagcgacaagttggtggtgactaagccaatgacttagaaaccctaagacttgtctaagttgggattagatcaattctggtggaagtattaacatagtgatgtgatgtcagtctttctagcactttgttttgtatgattgcaacgtcagaggttgttgacttgtggtgtatgtttagtttattgatgaaccccctcgtgc

SEQ ID NO: 3878 - DNA, 699 bp, Gerbera hybrid cultivar
gggttttagcaaggaggagttaggagactcatcatcagcttcagcatctaaaaatggcggatgaagactacgagatggacggagggtatgatgatgagccaatggaacctgagcctgaagaaggggctgaggaggatgttgaaggagagaataatgatgaattaccagatcctcttttagctgatactgaagagaaggaagaactagaacaaggagaacgaactcggaaaacgtcaaaatatatgacaaagtatgaaagggctagaatcttaggtacccgtgctcttcagatcagcatgaatgctcctgtgatggttgaattggagggtgagactgacccacttgagattgcgatgaaggagcttcgtgagaaaaagatacccttcaccattcggcgacacctgccagatggaagttacgaagactggggagttgatgaattgatcgtggaagactcgtggaagaggcaagttggtggtgattaacctctttcattattagttaatttgtggtaaatcctttgttcactagattctcttagtttgtttagataatctacaattaaaccttagcgtgcccgaatttagttagaaatcttattaggattggactgtatgttattgtttgcgaatgtgttgcaacattaggatgtttgactagtaaaattgcaggtaccagactttatggaaaaaaaaaaaa

SEQ ID NO: 3879 - DNA, 715 bp, Primula obconica
ggcaactcccggctcaccaatccttcaggcatggcagatgaggattatgagatggacggaggatatgaagatgagccaatcgagcctgagctcgatgacggagcagaagtggaagaggaaaatgagaacgatgaagaagctcctgatccgttgctagctgatactgaagacaaactggaacaagaagctggggaaaaacctcgcaagacttcaaaatatatgacaaagtatgaacgtgcgcggattttaggtacccgtgctcttcaaatcagcatgaatgcacctgtgatggttgtgctcgaaggtgaaactgatcctcttgagattgcaatgaaggagctccgagagcgtaaaattcccttcaccatccgtcgatatctacctgatggaagttatgaagattggggagttgatgaattgattgtcgaggactcgtggaagagacaagtcgggggtaattgatcaagtgttatatgttacttatcgacttttcaaggatgggcttgttaggattttggctgacttgtagttgacaatgtaccaaatttaataaacttgtgattctggtcttttaccaaattctcttttccttttatcatgcatgttgaaaccgagtcctgagatagatgggtaagatgagcctctctatagtacacaagcatcatacaaataatttagaatctacttaacaaaaaaaaaaaaaaaactccagggt

SEQ ID NO: 3880 - DNA, 880 bp, Manihot esculenta
gatgaaccgatagtgaacggcggcgttccaactaaatcaaagcgggataaattagagaaggtttttttttttgctacactttccctgcttagggctttggactcagaccgagtgaaaggaataaagctttattcgtcttcaacgatcaactatggcggacgacgatttcaatgatatggatatgggatacgaggatgagccgccagagcctgagatcgaagaaggagcagaggatgatgttgataacaataataatgaggatgttcctggggaacccattgaaactgaggataaagaagaacaggaacctgtggaacatcctcgtaaaacatcaaaatatatgacaaaatatgagcgtgccagaattttggggacacgcgctctgcagattagcatgaatgcaccagtaatggttgaattggagggtgagacagacccacttgagattgctatgaaggaactccggcagcggaaaatacctttcaccatccgtcgctacctccctggtggaagttacgaggactggggagtagatgaactgattgtggaagactcgtggaagaggcaagttggaggtgattgatcaactggcattttaccgttgcagtctgtcctttggtcgttgcaaagatggcttgtaaatgcgttatgtgatgtatggccgtatcttcagaactgttatgtaaaacaccgtcgtttaaccatccacatgcttccagttatatggtccgtaactttctgctagtcccttggaacatgaagcacagtacaattgctactgtattttatcctggttaacgctggctgaagtcaacagcattaaggctgcatcagtatgatattattttaaataaatatatcaacataaattattaaagag

SEQ ID NO: 3881 - DNA, 677 bp, Euonymus alatus
agggctttggcgcaccagcaaccggagctcgaggtggggttgcgaacagcttctccagttttcagccatggccgatgatgactacaacgatgtcgatatggggtatgaagatgagccgccagaacctgaaattgaagaaggtgcagaggaggacgtagataatgataacaacgatgatattcctggggagcccattgaaactgaggaaattgagaaggaagttggggaacgtgctcgtaaaacatctaaatatatgacaaaatatgagcgtgccagaatactgggcacgcgagcactgcagatcagcatgaatgctcctgtgatggttgagttggagggtgagactgacccacttgagattgctatgaaggagcttcgtgagcggaaaataccgtttaccattcgtcgctatctgcctgatggaagctatgaagactggggagtcgatgaattgattgtggaggactcatggaagagacaagtgggaggtgattgatcagtcaagtgtgtcagcgatcatggaatgggtgctgaatagcaagtttttcgccggaagacatgaaaaccgaactgtgtgtattggacttcttacttttcaccactagcctgttattataaactcaactctagttcccttggcgtaatattactatatatatattagtgacaagctttat

SEQ ID NO: 3882 - DNA, 692 bp, Euonymus alatus
agttagggctttggcgcaccagcaaccggagcgcggggtggggttgcgaacagcttctccagttttcagccatggccgatgatgactacaacgatgtcgatatggggtatgaagatgagccgccagaacctgaaattgaagaaggtgcggaggaggacgtagataatgataacaacgatgatattcctggggagcccattgacactgaggaaattgagaaggaagttggggaacgtgctcgtaaaacatctaaatatatgacaaaatatgagcgtgccagaatactgggcacgcgtgcactgcagatcagcatgaatgctcctgtgatggtcgagttggagggtgagactgacccacttgagattgctatgaaggagcttcgcgagcggaaaataccgttcaccattcgtcgctatctgcctgatggaagctatgaagactggggagtcgatgaattgattgtggaggactcatggaagagacaagtgggaggtgattgatcattcaagtgtgtcagcgatcatggaatgggtgctgaatagcaagtttttcgccggaagacgtgaaaaccgaattgtgtgtgttggacttctgacttctcaccactagcctgttattataaactcatgttattataaactcaactctagttcccttggcgtaatattactatatatattagtgacaagttt

SEQ ID NO: 3883 - DNA, 543 bp, Flaveria ramosissima
ggatgaggagtatgagatggacggagggtatgatgatgagccaatggaacctgaggctgaagaaggagcagaggaggatgctgaaggcgagaataaagatgatgatgcacccgatcctcttctaggtgacgatgaagacaaggaagagcaagaacaaggagaacgacctcgtaaaacttcaaaatacatgacgaagtatgaacgcgctagaatcttgggtacacgtgctctgcagatcagcatgaatgctcctgtaatggttgaattggagggtgagaccgacccccttgagattgctatgaaggagcttcgtgagaaaaagatacctttcaccatccgtcgatacctgccagatggaagttatgaggactggggagttgacgagctgattgtcgaagactcttggaagagacaagttggtggtgattaagcccctccctcctctcctcttgcttctcattgtttaatatgtggggttgaacctgtttgtaatcggataatacggcattaatcactcagtctggttgtcagttggaatatgtt

SEQ ID NO: 3884 - DNA, 1001 bp, Cajanus cajan
gtatgtgttggggtttagtgggatttatctatcgaacccgcattcaccatttagcacatatataaaatctaatttcgaagtttggcttttcgtgagggtttagttgaaggcacacagcttaggcctcagggaaaaagggtttctttcattctctgcaattcgccatggccgacgacgactatgatgacatggacatggggtacgaggatgagcccccagagcctgagattgaggaaggtgcagaggaggatgcggaaaacaacaaaaacgatgagttaactggagagccactcgaagctgaggataaggaagaaggacaaccggtggagcggcctcggaagacatcaaagtatatgactaagtatgaacgtgccaggattttgggtacccgtgctcttcaaatcagtatgaatgcacctgtcatggtcgagttggagggggaaactgatccacttgagattgccatgaaggagcttcgagagcggaagataccctttacaatccggcgctacttgcctgatggaagctatgaagactggggagttgatgaactgattgtggaagactcctggaagaggcaagtgggcggtgattgattgttgacagaggtgggaggagtaacaggcactaatatttgtcttctcatatcttttatctttggcttgattgaggttgatactaatctatgattccccaccttaaactttgcttacagcgatgtctatgtatccctgttggtgtaatctctgtttcaacttgtttatatatacaatatatctctaggcgttcaatagtggttctgatttttcaaatcaactatcgggacacccctagctcaacgaagattggagtgatactttttaatatttgttctctagtaagcttcttgttgtctttctctagtttcttactgttttgtgggaacattttggaaatatcagttataccgtccctaatgaaaaatgatggcaaggcaatatttggatatgattagattgaga

SEQ ID NO: 3885 - DNA, 775 bp, Populus trichocarpa
ccgacaaaggtttccagctctctcccattccatagcaacagaccgggctttagaccttcaaagaactagagagaagctttgcttccatccttacgaatttacaatggcagacgatgaatacaatgatgttgacatgggatatgaggatgagccggcagaacctgagattgaagaaggagctgatgaagatgccgagaacaataacaatgaagatgacacaggggaaccaattgaaactgaagataaagaggaacaggcaccagtggagcggcctcgtaaaacatcgaaatttatgacaaaatatgagcgtgccagaattttgggtacccgtgcacttcagatcagcatgaatgctcctgtgatggttgagttggagggtgagactgacccacttgagattgctatgaaggagcttcgtgaacgaaaaatacctttcaccatccgtcgctacctgcctgatggaagttatgaagattggggagttgatgagctaattgtagaggactcgtggaagaggcaagtgggaggtgattgagcaatcattatttggtgattcatgctaccatttgatcaattgatagtttaaagccttgtatgatatgtaaccaaacatcaatgttctaattgctcagaacatgacctgtgaaactaaactgaatatgtgtggtgtcatgacagtttttgaactctagaaatgcttgtgatttctagaaagaaaggaatgtgggtgctttaaatttcaaatgttagtgcaaagtgcgttctggctctacaa

SEQ ID NO: 3886 - DNA, 777 bp, Populus trichocarpa
caaaggtttccagctctctcccattccatagcaacagaccgggctttagaccttcaaagaactagagagaagctttgcttccatcctcacgaatttacaatggcagacgatgaatacaatgatgttgacatgggatatgaggatgagccggcagaacctgagattgaagaaggagctgatgaagatgccgagaacaataacaatgaagatgacacaggggaaccaattgaaactgaagataaagaggaacaggcaccagtggagcggcctcgtaaaacatcgaaatttatgacaaaatatgagcgtgccagaattttgggtacccgtgcacttcagatcagcatgaatgctcctgtgatggttgagttggagggtgagactgacccacttgagattgctatgaaggagcttcgtgaacgaaaaatacctttcaccatccgtcgctacctgcctgatggaagttatgaagattggggagttgatgagctaattgtggaggactcgtggaagaggcaagtgggaggtgattgagcaatcattatttggtgattcatgctaccatttgatcaattgagagatagtttaaagccttgtatgatatgtaaccaaacatcaatgttctaattgctcagaacatgacctgtgaaactaaactgaatatgtgtggtgtcatgacagtttttgaactctagaaatgcttgtgatttctagaaagaaaggaatgtgggtgctttaaatttcaaatgttagtgcaaagtgcgttctggctctacaatt

SEQ ID NO: 3887 - DNA, 551 bp, Tripterygium wilfordii
agccgaggcactactcacaaaccccggtttgggatttgcaccatcaacgggatcgccgggtagggagacgaagagcttctctagtttgcagccatggccgatgatgactataacgatgtcgatatggggtatgaagatgagccaccagagcctgaaattgaagaaggtgcagaagaggacatagataacaataacaatgatgatgttccaggggagcccattgaaactgaggaaaatgaggacaaggaagtaggggaacgcgctcgtaaaacgtctaaatatatgacaaaatatgagcgtgccagaatactgggaactcgggcactgcagatcagcatgaatgctcctgtgatggtcgagttggagggtgagactgacccacttgagattgctatgaaggagcttcgtgagcggaaaataccattcaccattcgtcgctatctgcctgatggaagctatgaagactggggagttgatgagttgattgtggaggactcatggaagagacaagtgggaggtgattgatcagtcagtgtgtcagcgatcacaga

SEQ ID NO: 3888 - DNA, 772 bp, Cirsium arvense
tagaagactccactagtataagctggtacgatccgagaagaaagagggggaagaactacaagtgtgtaagcgcaattatcatcgctttcgtcttcacggggagcttgggcttgtaaaaatggcggatgaagaatatgagatggacggagcatatgaggacgagccaatggaacctgaacctgaagaaggagcagaagaagatgttgaaggagagaataaagatgatgaattaccagatcctcttctagctgacaatgaagagaaagaggagcaagaacaagcagaacgacctcgaaaaacatcaaaatatatgaccaaatacgaaagggctagaattttgggtacccgtgctctgcagatcagcatgaatgctcctgttatggttgaattggagggtgagactgacccccttgagattgcgatgaaggagcttcgtgagaaaaagataccatttaccattcgtcgacacctgccagatggaagttatgaagattggggagtggatgagttgattgtggaagactcttggaagagacaagttggtggcaactaacccccattaagctttagttttagtgtcgatatgtgtgctaaaaataccgttaggttgtggtggcttaatcaaacttaggattctaattactaccgatctatgttgggagtcgatgggaagattcgtatacagctcctctttgttagtagtgtgaactgaattctgtcttaactcaaatttagaatcgtaattagtaaaaaagaaaaagtaccgactgcg

SEQ ID NO: 3889 - DNA, 662 bp, Eschscholzia californica
cacgtttttctcctaccagagtaagatcattactgtcagttctccctctaccaacaacaatggcggacgaagaatacaacgacatggacatgggatacgaggatgaacctccagaacctgatgttgaggaaggagttgaagaggatgctgagaataatgaagacgcagatgctgtggttgtagaaggtgaagagaaagaagaacaagaacctaaagaacgcccacgtaagacatccaagtatatgaccaagtatgaacgagctcgaattctcggaactcgtgctctacagatcagcatgaatgcccctgtgatggttgagttggaaggcgagacagatcccctcgagatcgcaatgaaagagcttcgtgcgcggaagataccttttaccatccgtcgttacttacctgatggaagctacgaagattggggagttgatgagctgattgtcgaagactcttggaagaggcaagtgggaggtgattaatcgatgtggcgctacatcttaaactagtaatattagtccatgtcagaatttgcagaaactgtgatcttttgcactatgatcccagactgttggataatgtttgtaattattgacaatttggatttcactatcaacactgaaaaactatatttatgtagcaggttttgaacccaattc

SEQ ID NO: 3890 - DNA, 780 bp, Humulus lupulus
ttacggccggggcctaaagccaaacttgtttcaaaactttttcagtgcagttcagacgcatcgaccagagagagaccaaggtagggtttgctctgcgctccaaccacaccagagagagggaaaaggcttcttcatcaattgaaaatggccgacgacgattacaatgaagtggatatgggttacgaggatgagcccccagaacctgaaattgaagaaggtgcagaggatgatgtggagaatgctaacaatgatgaccttcctggggatgccattgaaactgaggaaaaagaagaaacagaagcagtagaacgtcctcgtagaacttcaaagtttatgacaaagtatgaacgggcaagaatcctgggcacgcgtgccctgcagatcagcatgaatgcaccagtaatggttgagttggaaggtgaaacagatccacttgagattgctatgaaggagcttaggcagcggaagattcccttcaccatacgccgctacctgcctgatgggagttatgaggactggggtgttgatgaactaattgtggaggactcatggaagaggcaggttggtggtgattgaagctactcacttggtcatggagatctgtatatcattaggatttttctggaagttagtaaaatggatttgaaacattttgggactagaattatcttttctacttgtcaaattcggatagagacttccagtgatgttactcatctatatttttatatgtgatcatgaatatgctaaagactattgtatctaaggcgccaaaaaaaa

SEQ ID NO: 3891 - DNA, 973 bp, Allium cepa
tattcatataatttttgtatttcaaagaatgatggatttcaaaattttctgttaatttactaaccaaattgtcatgggtgatgtaatatcatagatcctaatttacctaatcgttgggcgttcaggttttcaagcaaaacgcaaccttagggctttctattacttttagtcaaagctcgagccttttcaagtctaatggcggacgatgattacaacgacatggacatgggatacgaggatgagccaccggaacctgaaattgaggatggagctgaggatgacatagataataataatgaagaagtccctgatgatattattggtgaaggcgaagagaaggatcaggaatcaattgagcgagcacgcaaaaccaccaagtatatgacaaaatatgagcgtgcaagaatactgggcacacgggccttacaaattagcatgaatgcacctgtgatggttgagctcgaaggagagactgatccccttgagattgcaatgaaggaacttcgccagcgcaagataccatttactattcgtcgctatttgcctgatggaagctatgaggattggggagtggatgagctgattgtagaggactcctggaaaagacaagttggtggtgattagggcaatactcgtcttttgttgccggataaatatgggagctgtgcccgtgtttaacgatcattattcatataatattaagaatgttcaatgacaactttcagaatgtttcttttgattatgcaattttcttgaaaatgttaacaatgaacagatgttattactttgatgtctatgctggtgatagtgagagaacaatgaatatatctgcaccttaacggttaaattgacaccgcagaaatgtaaattatgggtgtgttcttttcttaagagggcatttgaaagtggtatgaaaagagattgtttaacggaaggagaatgtggttttttgttgtgaaaatgacatttagtt

SEQ ID NO: 3892 - DNA, 655 bp, Fagus grandifolia
ttttgtgacgaagtcaagcacagagggaaaagcttcttcaccaatcaacaatggccgacgaagattacaacgatgtggacatgggatatgaggatgagccaccagagcccgaaatggaggaaggcgcagaggaggatctagagaataatgccaatgaagatgttcctctagaggttgaaggtgaggagaaagaagagcgggaaccagccgaacgtcctcgtaagacctcaaaatatatgacgaaatatgagcgtgccagaatactgggtacccgtgctctgcagatcagtatgaacgcacctgtgatggtcgagttggagggtgaaactgacccacttgagattgcaatgaaggaacttcgtgagcggaaaataccgttcaccatccgccgctacctgccagatggaagttatgaagactggggagttgatgaattgattgtggaagactcatggaagaggcagggtggggggcgattgatctgcctttggatcagtcattaatggactatgggagttctttatgatgtgaatttgaaagtttgaagctactttcttatgggcaaaaatgaaaaagaaacaaacaaactgttataaacttcttgctactgattctatgtgagttatgtatgatgtgaattgaaagtttgtagctc

SEQ ID NO: 3893 - DNA, 699 bp, Cirsium arvense
ggcttagaattatttactaagaaccccggttcacaagcatataaaaaccggtgacgtaggcagtttgttattgcgctctttataccctactttctctcaaagccttcgtcttctacttccgtctcccgatcaaaacacagagaagggtttttcatcagcttctttctctcttaaaaatggccgacgatgacttcgatatggacgccggaggatacgacgatgagccagtcgagcctgaactcgatgaaggggctgaggaagatgttgatgcagataacaaggaagaagatgttccagatccacttgtaggtgacaatgaagataaggaagaaacggaagctgtagaaaaacctagaaagactataaaatatatgaccaaatatgaaagggctagaattctgggtacccgtgctttgcaaattagcatgaatgctccagtgatggttgagttggagggtgagactgacccccttgagattgcaatgaaggagcttagacagcggaagatccccttcaccattcgtcgatatctgcctgatggaagttacgaagactggggagttgatgaattaatcgtggaggattcttggaagcgacaagttggtggcgactagtttctttgaccacatgtgctgattgaaacacactgaatgtttgtccagtttattgacacaaaacgatggattcaattgttcaact

SEQ ID NO: 3894 - DNA, 646 bp, Cynara scolymus
  misc_feature (53)..(53): n is a, c, g, or t
  misc_feature (75)..(75): n is a, c, g, or t
  misc_feature (101)..(101): n is a, c, g, or t
  misc_feature (222)..(222): n is a, c, g, or t
  misc_feature (248)..(248): n is a, c, g, or t
  misc_feature (507)..(507): n is a, c, g, or t
  misc_feature (520)..(520): n is a, c, g, or t
  misc_feature (524)..(524): n is a, c, g, or t
  misc_feature (617)..(617): n is a, c, g, or t
  misc_feature (619)..(619): n is a, c, g, or t
gcgggggtcttctcttcgtctcccatcaaaagacagtctagggtttttcatcngcttttctctcttaaatggccnatgatgactttgatatggacgccggnggatacgacgacgagccagtcgagcccgaactcgatgaaggggctgaggaagatattgatgcagataacaaggaagaagatgttccagatccacttgtaggtgataatgaagataaggaanaaccggaagctgtagaaaaacctagnaagactataaaatatatgaccaaatatgaaagggctagaattctgggtactcgtgccctgcaaattagcatgaatgctccagtgatggttgagttggagggtgaaactgacccccttgagattgccatgaaggagcttagacagcggaagatccccttcaccattcgtcggtacctgcctgatggaagttacgaggactggggagtcgatgagttaattgtggaggattcttggaagcgacaggttggtggagactagnttctttgatcacntgcnctgatccaaacactctgaatgttgtctagtttatggatatcttgatacaaatgatggatttgaattgttcaacttgttgatgatgatttgaantntgatatgcagcaatttgtgaaaaaaga

SEQ ID NO: 3895 - DNA, 757 bp, Cynara scolymus
  misc_feature (36)..(36): n is a, c, g, or t
  misc_feature (741)..(741): n is a, c, g, or t
ctcgcggggagaagaggggagagctacaggctgtanccgcaattatcatcgatttcgtcttcaaggggagtttgggcttgtaaaaatggcggatgaagaatatgagatggacggagcatatgatgacgagccaatggaacctgagcctgaagaaggagcagaggaagatgttgaaggagagaataaagaagatgaattaccagatcctcttctagctgacaatgaagaaaaggaagaacaagaacaagaacaagcagaacgacctaggaaaacatcaaaatatatgaccaagtatgaaagggctagaatcttgggtacccgtgctctgcagatcagcatgaatgctcctgtcatggttgaattggagggtgagactgacccacttgagattgccatgaaggagcttcgcatgaaaaagataccattcaccattcgtagacacctgccagacggaagttatgaagattggggagtggatgagttgattgtggaagactcttggaagagacaagttggtggcgactaaccccctcctcctcttgagtggttagtgtcgatatgtgttactaaatactatcgatagatatacgttatagtttgtaaatggggaagactcttgttagtcgtatatgtgtgtgctaaatcctgtcttaactcaaacttagaattgtaactaataccagtgatatgatttccatgcctgtttctggtatgcaaaaagaaaaactcgggtctgtccgngctcctttcaaagaaa

SEQ ID NO: 3896 - DNA, 684 bp, Medicago truncatula
ggaaggaaagggtttaagaaattggacacaaacaaacaagcagagcttcagcgtaagggtttctcatcacaatggccgacgatgactacaatgacttggacatcggatacgaagatgagccaccaaagcctgggattgaagaaggtgcagaggtggatgcagatgacaacgacaacaatgatgagatggctggagagcctattgaaaccgaggaaaaggaacaagaagagccaacagaaaggcctcgaaagacatcgaaatatatgaccaagtatgagcgtgcacggattttgggtacccgtgctcttcaaatcagtatgaatgcacctgtcatggttgagttggaaggggagactgacccgcttgagattgccatgaaagagcttcgagagaaaaagataccctttaccatccgtcgttatttgcctgatggaagctatgaagactggggagttgatgaattgattgtggaagactcatggaagaggcaagttggtggtgattgatggctgaaactagaactgacaagattagtctgacgtttaaatacactaatcataaacttgacttgtagtgtggcactaattttggatgtctatgtatcttcgatgcttatactttgatgtttgtacactatcataacctctgattatcgcgtggtactaatttttcgatgtttgtaca

SEQ ID NO: 3897 - DNA, 747 bp, Trigonella foenum-graecum
gactattaataaaaaataaaaaaatggagtagaggagatacaaaagcacaagagagtgtcttcttctctgcaagggtttaagagttttgacacaaaaaagtcaaaaacaatcaaacaaacaaagcttcacaggcagcgaaagggtttttcaacacaatggctgacgacgactacaatgacttgaacatcggatatgaagatgagccaccagagcctgagattgaagaaggtgcagaggaggatgcggatgacaatgacaacaatgatgagatggctggagagcctattgaaactgaggaaaaggaacaagaagagccaacggaaaggcctcgaaagacatcgaaatatatgaccaagtatgagcgtgcacggattttgggtacccgtgctcttcaaatcagtatgaatgcacctgtcatggttgagttggaaggggagactgacccgctagagattgccatgaaagagcttcgagagaaaaagataccctttaccatccgtcgttacttgcctgatggaagttatgaagattggggagttgatgaattgattgtagaagactcctggaagaggcaagttggtggtgattgatggctgaaactagaactaacaagtttagtgtgacgtttatatacactaatcataacttgacttgtagcgtggtactaatgttgaatgtctatgtatttctgatgcttatactttgatgtttgtacactatcatagcctctgattatcgtgcggtac

SEQ ID NO: 3898 - DNA, 720 bp, Persea americana
attgagggtttgtttttcgggggagatctttcgtttcgaagaagaaggcgttgaaggaagaagtccgattgatctcatcaatggcggacgacgagtacaatgatccagacatgggatatgaggatgagcctccggagcccgagattgaggaaggagcagaaccagaggaggatgcagagaacaacaatgacgagatggctgatgcttttgtagctgctgaaggcgaggagaaaggggatgaacaaactgttgaacggcctcggaagacatcaaaatacatgacaaagtatgagcgtgctagaatcttgggtactcgtgctctgcagatcagcatgaatgctcctgtgatggttgagttagagggtgaaactaatccactggagattgccatgaaagagctcagggagcggaagatacctttcacgatccgtagatacttgcctgatggaagttatgaggacgtggggaggtcgatgagctgatagtagaagactcttggaaaaggcaagtgggaggcgactgatggatcaacccgttcctgctggtcccattcatgttttgtggacttagttggtatgtacaaatgttgaatcatgcacttcttaggttgtgtaatgtgtggtgttgggaagaccaaatgatttaatgataccatggactctattccgggaagtgttgttatacagtcaatattacagttcttaatagctttgaatgaag

SEQ ID NO: 3899 - DNA, 965 bp, Citrus clementina
ggttatttgcgaggtttaaatagcaactagggttcaaaaatgaaaaaattaaaaaccgacatattcaatccacaagcccaagatcagggctagcccactagggctcccgataaattcttctcctcacggtttcgtgctggggtttaggagccgggtagcagaagcacatcgcctgaattcttatttaataaactcgaccggcgaccaaagaaactcgagtagtccacaatggccgacgaagactacaatgatttggacatgggatacgaggatgagccgccagagcctgaaattgaagaaggtgcagaggaggatgcagaaaacatcaacaatgatgacatcaatggagagcctattgagaccgaggaaaaggaggagcaggagcagaaagaagcagctcggaaaacttccaagtacatgactaaatacgagcgtgccagaatattgggtacccgagctctgcaaatcagtatgaatgctcctgtgatggttgagttggagggggagaccgacccacttgagattgctatgaaggagctacgcgagcggaaaattcccttcacaatccgtcgctacctccctgatggaagttatgaagattggggagtcgatgaattgattgttgaagattcgtggaagagacaagtgggtggtgattaatcggttatggtcttgggataaatcttttttttaaagaatgcgtctatggtaattaatggtcaaatgtgacatttgttgacccatcaccatgagctgaacagtcgaaacttagatatgtattagtacttgatttttggatgccttcgattgtaaacaaaatgaatgtgcgtggatggttaagcagggatattgtttgttcttttcccttgtactctgtttataattaacaagtgaaacaatgaaatgcgtcgagaataagtcaatgaaaattttcttcaatcagccaatatgcggggctaaatttt

SEQ ID NO: 3900 - DNA, 764 bp, Euonymus alatus
cggccggggggctattttcttctcgcgatagtatttgcctacttggtagcagcgagacgctggagccttcttagatattcgcacaaatcccagtttcggtttctgctttgcaccatcaacgggagcgccgggtagggtgacaaagagcttctctagttgtcagcaatggccgacgatgactacaacgatgttgatattgggtacgaagaggagccaccagagcctgaacttgaagagggtgcagaggaggacatagataacaataacaatgatgatgttccgggagagcccattgaaactgaggaaaatgaggacacagaagtaggtgaacgcgctcgtaaaacatctaaatatatgacaaaatatgagcgtgccagaatattaggaacgcgtgcgctgcagatcagcatgaatgctcctgtgatggttgagttggagggtgagactgacccacttgagattgctatgaaggagcttcgtgagcgcaaaataccgttcaccattcgtcgctatctgcctgatggaagctatgaagactggggagttgatgaattgattgtggaggactcatggaagagacaagtgggaggtgattgatcagtcagtctgtcagcaatcacgattgcaagctcgcgactaacctatccatatataaactctagttttgttggctttggactataatgcttttttctgggtttggctttggacaagtgggaggtgattgtatgaacttgttgatcaaacagctttttgtacagttc

SEQ ID NO: 3901 - DNA, 703 bp, Euonymus alatus
acttggtagcagcaagacgctggagcctttcttagttatagcacaaatcccagtttcggtttgtgcttcgcaccatcaacgggagcgccgggtagggtgacgaagagcttctctagttttcagcaatggccgacgatgactacaacgatattgatattgggtacgaagaggagccaccggagcctgaacttgaagagggtgcagaggaggacatagataacaataacaatgatgatgttccaggagagcccattgaaactgaggaaaatgaggacacagaagtaggtgaacgcgctcgtaaaacatctaaatatatgacaaaatatgagcgtgccagaatattaggaacgcgtgcgctgcagatcagcatgaatgctcctgtgatggttgagttggagggtgagactgacccacttgagattgctatgaaggagcttcgtgagcgcaaaataccgttcaccattcgtcgctatctgcctgatggaagctatgaagactggggagttgatgaattgattgtggaggactcatggaagagacaagtgggaggtgattgatcagtcagtctgtcagcaatcacgatagcaagcttgcgactaacctatccatatataaactctagttttgttggctttggactaatactttttctgggtttggctttggacaagtgggaggtgattgcatgaacttgttgatcaaa

SEQ ID NO: 3902 - DNA, 3101 bp, Setaria italica
atgttgagcgcatcgactaggaagagcaagctagttggcgcaagtaagaagagcaaggtcgcctcgactgctgctacggtgacggcccaacgcacacatccgcgtaggatccccacctctcttttgttcgcccttcctgcttttcttggccttccttccgctgtcctccagttttggctcctcccccatcacccgcagccgcacggcgaaaaccctagcgagctaaccaccggagcagcgggcgtttgggcggcgggagccatggcggacgacgattacaacgaaatggacatggggtacgaggatgagcccccagaacctgagattgaggaaggggctgaggaagagcttgaaaacaacaatgaggacacccctgatgatgttgtaggtgccgagggtgaagaaaaggaacaggaaaaggccaagagtgagcgcaaaacgtcaaaatatatgacaaagtatgagcgtgcacgcatcttgggtacacgggctttgcagataagcatgaatgctccagtcatggttgagctcgagggagaaactgatcctcttgagattgcaatgaaggagctgagagcgcgcaagatccccttcacaatcaggaggtacttacctgatggaagctatgaggactggggagttgatgagctcatcgtggaggattcgtggaaacgccaggttggtggggactgaagctaccgagctactcggcatgaaaggcctttgtggtgcagctggactttcctgtagttataatggtctatgctactccaatattagtggatgctgtagtggatgaactgagatgtgatgatgctatgtaaccttaacgtctgtggttgccttgcacgctggaactgtaatctgctagattggttgcacttcgtatgtttcggtctcagacttgcagtttcagagctcctgtgaatgccttgtggagttgaagcctagtccactatcagtagaccgctagattggtttgtttgcctagtccactatcgcaaatggtcaatcttgtttctgcacgatgttgagagatgtggccagctgatttatgtaatcatgagcctgttggtgtcgctcatggcaagagtctatgcaaaccttcctctgtaggtgtgtattctagttgcatttctgtctctttctagagttcgatgcaacatcaggtaagcaaatatggttgaatctagcgcaaacccactgttgtgttttggtttttaacatcaaagtcccaagatttggaggatcaaatccagaagggtgagcttggccgagcagaaaatttgcgcaagcagggtgtagtggtgtacgcgtccatgctgctttgtttgtttagactgggttttgtatcagagtttgcaaagatcgatatcaaccatccgcaactccactactacaagtgtgatcgtatcgttcaccagtgcggtgttacatacagacagacatgcatgctcctgtatcacgaactttgtaatgtttcttttatcaatcacgtttcctgtctccctacaactgaagctccttcattcctcagcatcggactccagggggcacgagccgtcgtcgacgacggccatcgggtcaaacatgtccgagttgggatccatgcacccgctcacgatgtccagcttgcaccggtctccctgcaatcgccatgccagagtcagttcaggaccggtgatgatgtcaaccaacacaagagcagagcttgatcccgagaacacagcagtcagcagagctgcagagggtgaatggttaacccaccccctcttcgtagtagccgtctatggcgcagctggtgatggcgatgttctcgtccgggtagatggcctggtcgcaggcgccctccctgttcagctcgcccgccaggccctgcaccaccatgatcaaacacaccaatcagtcatcaccaaacaaaattcctttcttcgtcttcttcttcttctttttgcactgtcttcgtcgtagtaataatcaatcaagcttcgtcatcacctcgttgaagaagctcagcggcttgttctgccatggcttggggaccttgaacttgagggtgtagggcccgtcccactcggccccgttggtgaaggagaagatcaggctcacggctgcagcaaatcgtttggttcagtgtctgctcgtgcgtcgtaggataagatgaaggtgagttgaaacttgaaagaaagagaggccgacgggcgccggcgacgcaccgtgctgcgggacgcgtatcctgatggagtagatgggcgggtcggcgctgcccctgacctgcagcgtcatctgcctcggctcgccgccgcacatgatgggctggttgaacccgccgttgaacgccacgccgaacacctcgttcggggacagcttcgtcgccgccgggttgtagaacagggtcaggccctcaccctgcccatatccatccgtgtcagcaaaagcaagatccgaaaaggaaaattgagcagaaaggaagatgatccatcatccatgggcgacgactcacgggggagggagggaggccgttgctggtcttccagtacaccggcgcccgccccagctcgaactccgaccatgtcggcagcgacaccctgccaagccatatccagcaccagtcaacagctgcaagacgatggcaaaggggagtttggcaagtttgttatcctcactccttatccttctgctctacgacggcagccggggccgccatggcggcggcgcgaatgctcgaggaggagctccggcaggtgacgacgacccctgagcggccaggctgccggcgatggtggcggcggatggccgcggcgccggtgccgctcaggcggctgcaggaggagagcgtggccatcgatcgcccgctacagcttcttgcaaaattgtgggtgatgaactggccgacgagacagttccgtgctccggccgttcgagcagcgctgggggtgtcaccgcatcaggccgccggcgtatatagggatgatggatggatcggtgggtgcgggtggacgtgtgtggtggggaggcggcaacgacagggagtgtctggaatggatgatgccactcagcttcactaagaagcgcccggcttggtctgcttgatctttttt

SEQ ID NO: 3903 - DNA, 659 bp, Carpinus betulus
gccatcttcaagctttctagctgcaacagccatcttcaagcttcagaccccaatccgcaatcaacaatggccgacgaagattacaacgaattggacatgggatatgaggatgaaccagtggagcctgagattgaagaaggtgctgaggaagatgtagagaataataacaatgaagacattgctggagatcctgttgaaactgaggagaaagaagagcagcaaccggtacaacgccctcgtaagacctcaaaatatatgacaaagtatgagcgtgccagaatcttgggtacccgcgctctccagatcagcatgaatgcacctgtgatggttgagttggagggtgaaactgacccactcgagattgcaatgaaggagcttcgggagcggaaggtacccttcaccattcgccgctacctgcctgatggaagttatgaagactggggagtcgatgaattgatcgtggaagactcctggaagaggcaagtgggaggtgattgatcttcttttgtattagtcattattaatggactctagaagttatctatgacgtgaactgtaaccttgtatagccctcttctttagtccagagaaagggggaatcgaaactcctcaacttgattgtaatcctttaatggtgctgtagttaatattatgttatt

SEQ ID NO: 3904 - DNA, 964 bp, Citrus sinensis
ggttatttgcgaggtttaaatagcaactagggttcaaaaatgaaaaaattaaaaaccgacatattcaatccacaagcccaagatcagggctagcccactagggctcccgataaattcttctcctcacggtttcgtgctggggtttaggagccgggtagcagaagcacatcgcctgaattcttatttaataaactcgaccggcgaccaaagaaactcgagtagtccacaatggccgacgaagactacaatgatttggacatgggatacgaggatgagccgccagagcctgaaattgaagaaggcgcagaggaggatgcagaaaacatcaacaatgatgacatcaatggagagcctattgagaccgaggaaaaggaggagcaggagcagaaagaagcagctcggaaaacttccaagtacatgactaaatacgagcgtgccagaatattgggtacccgagctctgcaaatcagtatgaatgctcctgtgatggttgagttggagggggagaccgacccacttgagattgctatgaaggagctacgcgagcggaaaattcccttcacaatccgtcgctacctccctgatggaagttatgaagattggggagtcgatgaattgattgttgaagattcgtggaagagacaagtgggtggtgattaatcggttatggtcttgggataaatctttttttaaagaatgcgtctatggtaattaatggtcaaatgtaacatttgttgacccatcaccatgagctgaacagtcgaaacttagatatgtattagtacttgatttttggatgccttcgattgtaaacaaaatgaatgtgcgtggatggttaagcagggatattgtttgttcttttcccttgtactctgtttataattaacaagtgaaacaatgaaatgcgtcgagaataagtcaatgaaaattttcttcaatcagccaatatgcggggctaaatttt

SEQ ID NO: 3905 - DNA, 2875 bp, Oryza sativa
caaccgacgctggcggacaaagtggcgtagaacgaaaaaaattcgtatcctaaattcctaatgtcatagtctgaaaacaacggatagactgataaattctgcagggcgcattgaatgccatattttgaaatttctgcagatacggatcatacggtccagatccttctacgattctccggggattgtccccgttctttttcccgggctggtgggccgtccgttgcgctctcccagagtcccatttgccccctttctccctgtcgagcaccgcttggccgccgtgcggcgaaaccctagcgattgtagcggccggaatcagaggcggcggaagccatggcggacgacgactacaacgacatggacatggggtatgaggatgagccaccagaacctgagattgaggaaggggctgaagaggaacctgagaataacgaggatggccctgatgaggttgtaggggcagaggctgaagataaggaacaagaaaaaactcagcgcccacgcaaaacgtcaaagtatatgacaaagtatgagcgtgcccgcatcctgggtacacgtgcattacagataagcatgaatgctccagttatggttgagcttgagggagaaactgatcctcttgagattgccatgaaagagctgagagcacgcaagatcccattcacaattaggcggtacttacctgacggaagctatgaggactggggcgttgacgagcttattgtggaggactcctggaaacgccaggttggaggcggctaagctgtgactgaggctactcaaaacgaacagcaatgtgctgcaagttgactttgcccttgtagtaatatggtctgtgcaactccattatgactggatgctgtatcagtgaactggcgtgatgatggcatgccatgttgccttgacatgtatgccttctttccgcagtgtaactgtgactgaaatttgcatggttgcatcagtttgcttggaccatttgcagactttgtcctgtgaatgttcaaggcttaatgcttggtttttttttttcttggcctaatttggtagtcgtctagcagacatgagcgacatttttgcagtacgtagacatcagacaaacgggcggatgcctggaattgtgctggaactgaacttaaattccggttgattcgtgttctgggtccatttccacttttccagtataagtatcaaactctgaactgaaggctatatagataaatcagaaaataatttttttttctccttgtttaatcaggagttatcccgtgtttttggaacttttggtcacgtgccgacactttctttgatggtatttgtataggttgatctctattaaattcagagtagttctgtcacaaattaacaaccacatttgtatgaggcctacagttgtgtattcttttcaccaaatgcagcacacatcattccctaataccattctatcacacatctgtgctttcttgtacatcataccgtgtcgcttctttctttttacattgaacaacagtggccactaattacagcttctccttgctaataaaactcgctgagactgtagttcagttcattcctcggaatcggaatccattgggcatgatccgtcatccacggtggcgagtggatcaaacatgtgcgagtttggatccatgcaccctgacacaatgtccagcttgcagcgatctccctgccagtgccaggggatgcagcaacggttcagaactggctaggattaatcatgaatttgagataaaggttaaaagttttaccccctcttcgtagtagctgcccatctcgcagcttgtgatgacaacgttttcgtctgggaagatggctctgtcgcatgccccttctctgttcagttcgtctgctagaccctgcatcgtcgtcacagataatttttaaaataactctctttattagcacaaaaggtgcattctaaaagttaacactgatccaaagaggagtttcaacttttccagtgcataagctatcaagaaatggtaattaacaataaaattggattcaaggtacaaatcaagcttgtttgattgaaaacaacacgaactcggagcaaaattttacctcgttgaagaagctcaagggcttgttgagccatggcttggggaccctgaacttgagggtgtacggtccatcccaatccaccccgtttgtgaaggagaagacgagggtcatggctgcgagtgcaaaaccaaccagacaaaatctcactccgatgacaacatgctattacatacatacagtactagtaacgaatccatggccactcagatgacaacatgctattacatacatacagtactagtaacgatcacttgaacatatggtgtcagcatgatgcaaaagcttaatttaagttaatgagaaattgcaggcgaatcattcatatcttcaacgaaacaaaacaatcagctgctgaccatgctgcggcacacgtatcctgatggtgtatatgggaggatcagctgatcccctctcttgcagcgtcatctgcctcggctcaccaccgcacatgatcggctggttaaaaccacctgcagcaaataaagtctcagttatcaactcctgaatcagattcagatcaaaccaatttgtagcctgaatttttcccggacactgggtgggtgaaaaggagaattaagagggtgctcaattaccattaaacgcgatgccaaactgagcgttgggggtcatcttggtcgctgccgggttgtagaaaaggatcaggccctctccctggtaagaacacagcggcagcttaattagctactatttccatgatgaatctgccaggttgctagtactaccgctgttccatattataagttgcttttgactttctttttcttattatttt

SEQ ID NO: 3906 - DNA, 767 bp, Juglans hindsii x Juglans regia
cgaactgttataaacaatcaaggagggatttctagcagttttccgactagcgagggttttcgacttcgagaccaccaagagcagcgagggtaaagcttcttcaccaatcaacgatggccgacgaagattacaatgatttggacatgggttatgaggatgagccaccggagcctgagattgaggaaggtgcagaggaggatatagagaacaccaacaatgatgacgttcctgtagaacctgaagctgatgagaaaggagaagagcatccagttgaacgccctcggaagacctcaaaatatatgacaaaatatgagcgtgccagaatcttgggtactcgtgctctgcagatcagcatgaatgctcctgtaatggtcgagttggagggtgaaactgatccactggagattgcaatgaaggagcttcgtgagcggaggatacccttcactatccgccgctacctgccagatggaagttacgaagactggggagttgatgaattgatcgtggaagactcgtggaagaggcaagtggggggcgattgatctgtttatgggttagtcattaacggacactggaagttgtgcatgatgtgtagtgaaaactttgtagctccttcgtcctcttttggccccaaagaagaaaagagttgatacttgatagcgctgccgtgtttagtattaactattatatatactgcgacttttttacccgccgggtttaatgctatttgcccgaaaagaagccatgtcacttgtttgagttgtttg

SEQ ID NO: 3907 - DNA, 873 bp, Prunus mume
agcggcatattcttattatttattagggtggtcatcccctcatcgaatcatccaaaaccttatttcaaaccctaaacccagtcccctgcctcggacattactctctctctctctctctctctctcaagttctcaacccctcagaacttgttcactcattaacaatggcggacgaggattacaacgacatggatatgggatatgaagatgagccaccagagccagaaattgaagaaggtgcagaggaggatgtggagaatattaacagtgatgatcttccaggagacgccattgaagctgaagacaaagaggagcaagcacaggcggaaggacctcggaaaacctcaaaatttatgaccaaatatgaacgtgctagaatcttgggtacccgtgcactgcagattagcatgaatgccccggtgatggttgaattggagggtgagactgacccacttgagattgctatgaaggagcttcgtgagcggaagataccctttaccatacgccgctacctgcccgatggaagttacgaggactggggagtagatgaattgattgtggaagactcgtggaagagacaggtgggaggtgattgatcagatttcatttacccatggagaatggttacaatgtcaatatgtaatctataattgttaggaagatctgccttttgccgctggccctatgaacttacatgttgaaaaactgtttatttttgggtaaatatgttggaactcttttgcagacatcagcaatgttcatgtggcctttttttttttttgggggggccccctttggttcccatctgttaaaattggcactgatcaaccttaaagttacaaattatcataccattgacccttattcggtgggc

SEQ ID NO: 3908 - DNA, 690 bp, Acacia harpophylla
ctggtggattgattcttcgaaggcttctgtgagggtgtcgcggcggaggcaaaggggaacgtcggcaatactcaatggcggatgacgactacaatgacatggatatgggatatgaagatgaaccaccagagcctgagattgaagaaggtgcagaggaggatttggaaaacaataacaatgatgacttggccggagaacaacttgaaactgaggatagggaagaacaagaagctacagaaaggcctaggaaaacatccaaatatatgacaaaatatgagcgtgcccgaatattgggtacccgtgctcttcaaattagtatgaatgcacctgtcatggtggagttggaaggggagactgaccctttggagattgccatgaaggagcttcgagagcggaagattccatttaccatccgccgatacttgcccgatggaagctatgaagattggggagttgatgaactgattgtggaagactcctggaagaagcaagtgggtggtgattgatttgctttccgatctaccaaaatgaggcttgtggagtaaaaaaggaaactaagaacatagaaatttgaaaatatctcttctatatgatctatcaccttggatctgtgtcttgatgccaaaactatgaccttgctaaaaacttcgcttgttgtgctgttagaaacattggctttgtctaaaaaaa

SEQ ID NO: 3909 - DNA, 847 bp, Amorphophallus konjac
cggctcttcgcttcctactcttcggcgtcctactcgtatcacccgattagggcttcgaatcagggtttctgggggcaggctgagtctggtgttcagcgatggcggatgatgactacgatgatatggacatggggtacgaggatgaacctccagaaccagaagtggaggaaggagcagaggaggaggaggcagagaagaacaatgaagatgttccggacgcaattgttggcgaaggtgcagataaagaagagagaccgccagtagaacgtcctaggaggacaacaaaatacatgaccaagtatgagcgtgcaagaattttggggacacgtgctcttcagataagcatgaatgcacctgtgatggttgagttggagggtgaaactgatccgttagagattgccatgaaagagcttcggcaacggaagattcccttcacaatccggcggtatttgcccgatggaagttacgaggattggggagtcgatgagttgatagtggaggacacttggaggcggcaagtgggcggcgattaatgcgaatgcttaacctgcacttgctgatgcatattttggacccgtagtttttcgtgaatatggaagaaccttccctgtagactctgtaaacggatcggatgcagagcggatagtgtgatatccgaatttgtatttgattaataatcgaatgatctgtctgttattttattcggataattatcggattaatacgaactcggttcgaattttaaacagatatttgttaagtttatttaaaggtgagttgtgtgagtcgtgtgagagcgttgtacgttgtttttccaagaaaaagataatggggtgtttggttgttc

SEQ ID NO: 3910 - DNA, 435 bp, Aquilegia formosa
atggctgatgaggattacaatgatgctgacatggggtatgaagatgagccagatgttgagattgaggaaggaatagaggaagaagttgaaaataatgaaaatgaagatattcctgatgtcccggttggagaagctgaagagaaagaggagcaacagtctgtgaaaaaggatcgcaaaacctcaaaatatatgacgaagtacgagcgagcaagaatcctggggactcgtgctttgcagatcagcatgaatgcccctgtcatggttgaattggagggtgagactgatcctctcgagatcgccatgaaggagcttcgggaccgaaagatacctttcaccatacgtcgctacttgcccgatggaagttacgaagattggggtgtcgatgaactgattgttgaagattcatggaagaggcaagtggggggcgatcgatag

SEQ ID NO: 3911 - DNA, 776 bp, Castanea mollissima
ctactttctagctagttcttcgactgactgagggttttggtgaggaagcagaggggagagtgaaaagcaaaagcttcttcttcttcttcttcagcaatcaacaatggccgatgaagattacaatgatttggacatgggatatgaggatgagccgccagagcccgagatcgaggaaggtgcagaggaggatccagagaataatgccaatgaagacgttcctggagaccttgttgaaggtgaggataaagaagagccggaaccagttgaacgtcctcgtaagacctctaaatatatgacaaaatatgagcgcgctagaatattgggtacccgtgctctgcagatcagtatgaatgcacctgtgatggtcgagttggagggtgaaactgatccacttgagatagcaatgaaggagcttcgtcagcggaaagtaccattcaccatccgccgctacctgccagatggaagttatgaagactggggagttgatgaattgattgtggaagactcatggaagaggcaagtggggggcgattgatctgcttttggatcagtcattggactatgggagttctgtatgatgtgaattgaaagtttgaagctcctttctactggccaattaaaaaaaaatggaactgttttaacttattgctactgatttctgtgtgtaatcgtgaatatgactgacattaatatgtagtgactgttaaactcttttttgaccttttgtgtgtgtgtgtgcgtgcgcgcgtgtgtgtgtgtacaatgaacatgataca

SEQ ID NO: 3912 - DNA, 644 bp, Eschscholzia californica
cagagtaagattattactgtcagttctccctctaccaacaacaatggcggacgaagaatacaacgacatggacatgggatacgaggatgaacctccagaacctgatgttgaggaaggagttgaagaggatgctgagaataatgaagacgcagatgctgtggttgtagaaggtgaagagaaagaagaacgagaacctaaagaacgcccacgtaagacatccaagtatatgaccaagtatgaacgagctcgaattctcggaactcgtgctctacagatcagcatgaatgcccctgtgatggttgagttggaaggtgagacagatcccctcgagatcgcaatgaaagagcttcgtgcgcggaagataccttttaccatccgtcgttacttacctgatggaagctacgaagattggggagttgatgagctgattgtcgaagactcttggaagaggcaagtgggaggtgattaatcgatctggcgctacatcttaaactagtaatgttagtccctgtcagaacttgcagaaactttgtgttcttttgcactatgatcccagactgttggataatgtttgtaattattgacaatttagatttcactatcaacactgaaaaactatatttatgtagctggtttgaaccgaa

SEQ ID NO: 3913 - DNA, 858 bp, Tropaeolum majus
catgcccatcttttactatttcctccttatataaacttctcctaatttcatatccttaattcgcctccccattttgacttgaagaaatcaaagcttccacttccttcagtatctaccatggccgacgaggactataacgatgatatgggatatgaggatgagccagcagagcctgagcttgaagaaggcatagaggaggatgcggacaacaaagataatgacgatgatatgggtgaaccccttgaaactgagggaaaaggagaccaagaaccaggagaacgacctcgtaaaacctcaaaatttatgactaagtacgagcgggcaagaattctgggtactcgtgctctgcaaatcagcatgaatgctcctgtcatggttgaactagagggcgagactgatccacttgagattgcgatgaaggagcttcgtgagcgtaaaataccttttaccatccgcagatatttaccggatggaagttatgaagattggggagtggatgagttgattgttgaagactcgtggaagaggcaagttggaggtgattgatgggggagtgtaaactagatccgacttatgacccatgtaatgtactctttaaattttaatagtcatgaatggtggtgaggttaatatgtagtgtgttgctttggcttttactagtattatgaatacatatatgtgattatccatccaatattgaagtggctttgataccgagtatgattaacatagttagcttacgatgatgagtaagattatggttagaaatgtttcctctggtattgcttctattttatttgtctagtagtagtggttgtacaatacatctatgaatcacgtaacaatcatgaaaaataa

SEQ ID NO: 3914 - DNA, 870 bp, Quercus alba
gagggttttggtgaggaagcagaggggagatagaaaagtaaaagcttcttcttcttcttcttcttctttcttcagcagtcaacaatggccgatgaagattacaatgatttggacatgggatatgaggatgagccaccagagcccgagatcgaggaaggtgcagaggaggatctagagaataatgccaatgaagacgttcctggagacctcgttgaaggtgaggataaagaagagccggaaccagttgaacgtcctcgtaagacctctaaatatatgacaaaatatgagcgcgctagaatattgggtacccgtgctctgcagatcagtatgaatgcacctgtgatggtcgagttggagggtgaaactgatccacttgagattgcaatgaaggagcttcgtcagcggaaagtacccttcaccatccgccgctacctgccagatggaagttatgaagactggggagttgatgaattgattgtggaagactcatggaagaggcaagtggggggcgattgatctgctcttggatcagtcattgatggactatgggagttctgtatgatgtgaattgaaagtttgaagctcctttctcgctactgatttctgtgtgtaatcatgaatgtgactgacatttaatatgtagtgactgttaaaactcttttgtgtgtatgtgcccgcgcgcacaaagaacatgatacatgaaggaatggaacctttctcccaaaaaaagaaaaatgtacatgtagaataaaagtgtaaattcctctcggttaatgaggggaatgaagtgttccacaatccattcacttacaccccaaaacacacgcagtcctctcttgctattttccaaaaacaatgaattatcaatta

SEQ ID NO: 3915 - DNA, 1258 bp, Solanum phureja
atccctaaccccttcatcactgatcccgtttctctacggtcgccgcgattcatatttcccggccagcgaacttcacaattgttctccggccgccgccgtcgccgtcgccgtctccattgcctgcggattttgaagcataagagaagaagggccctggattgaccattccaacaagttgtccacgtagctttctgggttgcgaactataattgacacataaggaagcgtctgcactaggcagactccatgtgcggatgatctgttacttgttaagtcgaggaatgaatgcttgttaaggacttgattagctgatcttccatcgtagggtttcatgctcgagctattatcggcttggcaaaggacgaattcgcttcactttaaagtaggtgtgcaatggaattgaatgctaacgtgtccacaaaaaggacaataaaccctaggaagacggatatcggaggtaaaccctttatactcatcatttgtggcagcctcgtttactaccactgtgcctatcggaattctagtctcgtctctctcatctcagacgtctttattgtactcctttgttccctcgccattctcggactcctctttcgccagatgaacatctcggtacctgtggatcctcttgagtggcagatctctcaggacgctgccaacatgttttttgcctgcctcgccaatactatcggtgctgctgagtctgttctacgggttgctgctactggccatgataagcgcttgttccttaaggttgtggctgctctgtatgttctatcatctcttggaaggatagcatcgggtgttaccattgcctatgctggactctgctttctttgcctttacatgctcgctgagaacttgcaattgattagctcgaggtatccaaggagaagagacggcacgaacacagttcaggacgactaaattgatttgatccggttcaaaaaggatgaaggaaggagtcaatgcattatttacagctcttgcttctagttatgccaggttcatcgcgtgttatttgccttattaatgtgatttctctttccattcatgtctgcagtcttgtgatttccttacatgtccctgtaatatattcccagtcctatgatcattgtctccccagttaaaggatacatgatataagttgttagctcactgttaacaaaagaaaagaatacgcttgtgatgtgaattgaaagataagtattttttctaaattgtactttattatgatacatacaaacttgggatttac

SEQ ID NO: 3916 - DNA, 1334 bp, Solanum tuberosum
gaaaagcacaaaagttaagttttagagtccccaaataacccccgcaatccctaaccccttcatcactgatcccgtttctctacggtcgccgcgattcatattttccggccagcgaacttcacaattgttctccggccgtcgccgtcgccgtcgccgtcgccgtcgccgtcgccgtcgccgtcgccgtctccattgcctgcggattttgaagcataagagaagaagggccctggattgaccattccaacaagttgtccacgtagctctctgggttgcgaactataattggcacataaggaagcgtctgcactaggcagactccatgtgcggatgatttgttacttgttaagtcgaggaatgaatgcttgttaaggatttgattagctgatcttccatcgtagggttccatgctcgagctattatcggcttgacaaaggacgaattcgcttcactttaaagtaggcgtgcaatggaattgaatgctaacgtgtccacaaaaaggacaataaaccctatgaagacggatatcgaaggtaaaccctttatactcatcatttgtggcagcctcgtttactaccactgtgcctatcggaattctagtctcgtctctctcatctcagacgtctttattgtactcctttgttccctcgccattctcggactcctctttcgccagatgaacatctcggtacctgtggatcctcttgagtggcagatctctcaggacgctgccaacatgttttttgcctgcctcgccaatactatcggtgctgctgagtctgttctacgggttgctgctactggccatgataagcgcttgttccttaaggttgtggctgctctgtatgttctatcatctcttggaaggatagcatcgggtgttaccattgcctatgctggactctgctttctttgcctttacatgctcgctgagaacttgcaattgattagctcgaggtatccaaggagaagagacggcatgaacacagttcaggacgactaaattgattgatccggttcaaaagggacgaaggaaggagtcgatgcattatttacagctcttgcttctagttatgccaggttcatcacatgttttttgcccttattaatgtgatttctctttccattcatgtctgcagtcttgtgatttccttacatgtccctgtaatatattcccagtcctatgatcattgtctccccagttatcaaggatacatgatataagttgttagctcacggttaacaaaagaaaagaatacacttgtgatgtgaattgaaagataagtattttttttaaattgtactttattatgatacatacaaacttgggattt

SEQ ID NO: 3917 - DNA, 1253 bp, Solanum melongena
ataaaagaaaagcacaaaagtcacctttttcgattcccccaaatcacttcgtgcaatccctaggcccttaatcagtgatcccgtttctctactgtcgccgcgatttatattttccggccagaaaacttcagaatccttcttcctctgccgcctccaccgccgtcgctgtcgtcgtctttactgattgtggatttgaagcataagaaaagaagtgtgtcaaggattgaccattccaacgaattgtccacgtagcctatctgggttgcgaactatatcggaagtgtgtgtgccaggcagactccatatggggataatctgtaacttgtaaagtcgaggaatgaatgcttattaaggacttagctggctgatctgccattatagggttccacacactggtaaatatcagcttgggaaaggacgaagtcactacacttgaaagtaggtgtaatggatacgaatgagtccgcagcaaggacaataaaccctaggaaggcggatattggtggtaaacccttcatactcatcatttgtggcagcctcgtttactaccactgtgcctatcggaattctagtcttgtctctctcatctcagacgtctttattgtactcctttgttctctcgccattctcggactcctctttcgccagatgaacatctcggtacctgtggatccacttgagtggcagatctctcaggatgctgccaacagtttttttgcctgcctcgccaatactataagtgctgctgagtctgttcttcgggttgctgctactggtcatgataagcgcttgttctttaaggttgtggctgctttgtatgtgctgtcttccctgggaaggatagcgtcgggtgttaccattgcctatgctggactctgctttttttgtctttatatgcttgctgagaacttgcaactgattagctcgaggtatccatgcagaaaggactgcacaaacacaattcaggatgactaaattgatttgatctgtttcagaggggtcgaaggaaggagtcaatgcattatttgcatttcgtgcttccagttttgccaggttcatcgtgtgtttttgtcatattaatgtgaattctctttctacacatgtctgtagccttgtgatttccttacatatccctgtaatatattcccagtcccatgataattgtctccccagttaacaaggagacatgatataatttgtaggaaaaagaaaacaaacacttgtgatgtcaattgaaagatcagcattttttc

SEQ ID NO: 3918 - DNA, 1064 bp, Nicotiana benthamiana
acagccgacggattttgaagtatcagaaaagaggtgtccaggattgaccattctaacaaatcatccatattgtctatatgggtggccaactctaataaatgcatggggaagccctcaagaaagaattttttgagagtaacaaatcttttcagttcgcttttggaaaacttgttggtcacggattagtccgttctatgccctagcagcctcaactcaaagtcgcatgttgatctctttgattgaggcgcgtcaatggaattgaatgttaacgagactacagcaaggacaataaaccccaggaaggcggatgttgggggtaaacccttcatactcatcatctgtggcagcctcgtttactaccactgcgcctatcggaattccagtcttgtctctcttgtctcagatgtctttattgtactcctttgttccctcgccattcttggcctcctctttcgccagatgaacatctcagttcctgtggatccgcttgagtggcagatctctcaggacgctgccaacagtgtctttgcttgcctcgctaatactataggtgctgctgagtctgttctccgggttgcggctacaggccatgacaaacgcttgttctttaaggttgtggctactctttatgtgctatcagctctgggaagggtagcgtcaggtgttactattgcctatgctggactctgctttctttgcctttatatgcttgctgagaacttgcaattgattagctcgaggaatccgaggttaagggactgcacgaacacagttcaggatgactaaatttaatttgatctgtcaaaaaggaaggaggtgatgctttgttcgcaattccttgcgttcaattttgccaggtctgtcgcgtgttttggccaaattaatgtgaatattctctttcgacacagctgtcttatgatttccttgtccatgtaatgtattcccagttcgatgatgactatttccccagttaagaaggatacatgatataagttgttagctcgttgttaattatgctagccagtttgcaaacacttgtaatgtgaattttgaaggctaagtac

SEQ ID NO: 3919 - DNA, 871 bp, Nicotiana benthamiana
tctctttgattgaggcgcgtcaatggaattgaatgttaacgagactacagcaaggacaataaaccccaggaaggcggatgttgggggtaaacccttcatactcatcatctgtggcagcctcgtttactaccactgcgcctatcggaattccagtcttgtctctcttgtctcagatgtctttattgtactcctctgttccctcgccattcttggcctcctctttcgccaaatgaacatctcagttcctgtggatccgcttgagtggcagatctctcaggacgctgccaacagtgtctttgctggcctcgctaatactataggtgctgctgagtctgttctcagggttgctgctacaggccatgacaaacgcttgttctttaaggttgtggttactctttatgtgttatcagctctgggaaggatagcgtcgggtgttactattgcctatgctggactctgctttctttgtctttatatgcttgctgagaacttgcaattgattagctcgaggaatccaaggagaagggactgcacgaatacagtggaggacgactaaatttgatttgatctatcaaaaagaattaagggaggtggtgcttagtttgcaattccttgcgttcaattttgccacgtctgttgcgtgttttggccaaactaatgtgaatattctctttttaccgggctgctttatgatttccttacttgtccctgtaatgtattcccagtccgatgatgactatttcaccagtttagaaggatacatgatataagttgttagctcgttgttaataatgctagccagtttgctaacacttgtgatgtgaattaaaagataaatactttattagtatgatatctacaagattgggat

SEQ ID NO: 3920 - DNA, 897 bp, Capsicum annuum
cttattaaggaatcagttagctgatctgtgattacagggttccatcatctggctattatctgctcgggaatgaattaagtcacttcactccaaagtactggtgcaaatggaattgaatgctaatgagaccacagcaaggccagtaaactctagaaagacggatatcggggtaaccattcatactcatcatatgtggcagccttgtctactaccactgtgcctatcggaattccagtctcatctctcttgtctcggatgtctttattgtactcctttgttccctcgccattctaggcctcctctttcgccaaatgaacatctcggtacctgtggatccgcttgagtggcagatatctcaggacgctgcgaacaggttttttgcctgcctcgccaatactattggtgctgctgagtctgttcttcgggttgctgctactggtcatgataagcgcttgttctttaaggttgtggttgctctgtatgtgctatcagctcttggaaggatagcctcgggtgttaccattgcctatgctggactctgctttctttgcctttatatgctttctgagaacttgcaattgattagctctagatatacaatgagacggggctgcacgaacacagttcaggacgactaaattgagttgatctgtttcaaaattgaaagggacgaaggaaggagttgatgcattgtttgcaactcttgcttccagttttaccaggttcatcgtgtgtttttgtcatattaatgtgaattctctttgtactcatgtctgcagcctagtgatttccttacatatccctgtaatatattcccagtcccatgatgatataagttgttagctcactgtataaaatgtaaacacttgtgttgtcaattgaaagctaagtattttc

SEQ ID NO: 3921 - DNA, 950 bp, Solanum tuberosum
atcaggcagaggacgagacagaacgcagaaagagctaagcgaaaggacatagttggtcttcctgtcccaattgagggtagagctcagctgtttcccattcatttcttgaagcagagctggaactgaattctgagggatgctaggaaaatcatttgctactcctttgctgacctttaactctgcatcatgcttctcctctcctggttgtgattccgtctcaacaacagcaaacactctagtaggttatgtaaattgctcgagtagcattacatttaatgtcactaggggatcttggacgtccaattatccatccaagaaatggacgttgcattcaacagttactgacaatatagtattaactgaagaagagaagaaaacatggaacgatagcagacaagctctttctgcattaaaatttagcccagatgaagaagacaaaatattaggaaaagcatttggccacatacattcgccttactggtatgaagaacggaagaaagaggttccacgactagaagttgtgaatgagatactggattatctaaggagtttaagccttactgatgatgatctcactaaacttgtcaagaaattcccagaagttcttggatgtagccttgaagatgaaatgaaaaccaatgtcgaaattctggaaaagcaatggggaattgaaggtaaaactctgagaaatttgcttcttcgaaatccaaaagttttaggctacaatgttgattgcaaaggtgattgtgtggctaaatgcactcgctgttgggctcggttctagctgtgtattcttgttttcattctcatactcttctttatgtataactttcgtcaaccattgtatctaattattcaatatcgcaagtaaattcatacaatatcagacttctgtattgcactgagatgtgactcaagtttagatcaaaggatgttacagagacaatgaa

SEQ ID NO: 3922 - DNA, 940 bp, Solanum phureja
gagctaagcggaaggacatagttggtcttcgtgtcccaattgagtgtagagctcagctgtttaccattcatttcttgaagcagagctggaatctgaattctgagggatgctaggaaaatcatttgctactcctttgctgacctttaactctgcatcatgcttctcctctcctggttgtgattccgtctcaacaacagcatacactctagttgggtatgtaaattgctcgagtagcattacatttaatgtcactaggggatcttggacgtccaattatccatccaagaaatggacgttgcattcaacagttactgacaatatagtattaactgaagaagagaagaaaacatggaacgatagcagacaagctctttctgcattaaaatttagcccagatgaagaagacaaaatattaggaaaagcatttggccacatacattcgccttactggtatgaagaacggaagaaagaggttccacgactagaagttgtaaatgagatactggattatctaaggagtttaagccttactgatgatgatctcactaaacttgtcaagaaattcccagaagttcttggatgtagccttgaagatgaaatgaaaaccaatgtcgaaattctggcaaaacaatggggaattgaaggtaaaactctgagaaatttgcttcttcgaaatccaaaagttttaggctacaatgttgattgcaaaggtgattgtgtggctaaatgcactcgctgttgggctcggttctagctgtgtattcttgtttttcattctcatacttttctttatgtataactttcgtcagccattgtatctaattattcaatatcgaaagtaaatttatacaatatcagatttctgtattgcactgagatgtgactcaagtttagatcaaagtatgttacagagacaatgaaatgaaaaaaatcagagcaa

SEQ ID NO: 3923 - DNA, 1099 bp, Capsicum annuum
gcacgaggcacaggttgagcgagaggacgtagttcctcttcgtgtccctttctgacacatcacaaaaagattagtccactcctgctgctcaattgcgattttaccgagtctagctctttcaacactttcttctgcttccggacatcccattcatttcttgaaactaagggatgctaggaaaatcatttgctactcctttgctgaccttcaaccctgcgtcatgctgctctcctggctgtgattccagctcaacaacagcaagcagtctaatagggtatataaattgctctaataacattacatctaatgtcactatgggatcttggaagtccaattatccatccaggaaatggacgttgcactcaacagctactgacaatatagcattaaccgaagaagagaagaaaacttggaacgatagcagacaaactctttctgctttaaagtttagcccagaggaagaagacaaaatattgggaaaagcatttggtcacatacattcgccttactggtatgaagaacggaagaaagaggttccacgattagaagttgtgaatgagatactggattatcttaggagtttaaaccttactgatgatgatctcattaaacttctcaagaaatttccagaagttcttggatgtagccttgaagatgaaatgaaaaacaatgtggaaattttggcaaagcaatgggggattgaaggcaaaactctgagaaatttgcttcttcgaaatccaaaagttttaggctacaacgtcgattgcaaaggtgattgtgtggctaaatgcactcgttgttgggctcggttctagttgtattcttgcttttcattctcttccttttctttatgtataatattttacacgatatcattcttcaaccgttgtttcgaagtatagatgataatgaggatctagtggcaatctaatgtgcagagccaaatcactcccaatgcttcctttgtttggagctattgctagtaatggtcctccgcgcttacgttctgtgatacatggaacttgctggtctaaatcattttcgattatttgtttacagtggaagagttattaaccttcccaaataacaacaaactggg

SEQ ID NO: 3924 - DNA, 870 bp, Nicotiana benthamiana
gcaactcaattgggattgtacccgtacattctcttccctttacttgagctggtatccgtttccaagatttttctctgttgttcttctgcttcctgacttccccatttattcttgaagccgggctggaatataagggatgctaggaaaatcatttgcttctcctttgctgacctttaaccccgcatcatgcttctcctctcctggttgtgattccggctcaacagcagcaaacaatctagcatggtggtatgtaaattgctcgaataactttacatcaaatgtcaccaaaggatcttggacatctgataatctgcccaagaaatggaagttgcattcaacagctactgacaatatagaattaactgaagaagagaagaaaacatggaatgatagcagagaagctctgtctgcattcaaatttagccccgaggaggaagacaaaatcttaggaaaagcatttggccagatacattcgccttattggtatgaagagcggaagaaagaggtgccaagacttgaagttgtgaatgagatattggattatctaaggagcttaagccttactgatgatgatcttactaaacttctcaagaaattcccagaagttcttggatgtagccttgaagatgaaatgaaaaacaatgtggaaattttggcgaaacaatggggaattgaaggtaaaactctgacaaaagtgctgcttcgaaatccaaaagttttaggctacaacgtcgattgcaaaggtgattgtgtggctaaatgcactcgttgttgggctcggttctaactgtattcttgttgcttctttctcgtcctttttactttatgtataatgagtgtctcacacagaatcattcttcaaaccttgta

SEQ ID NO: 3925 - DNA, 968 bp, Nicotiana tabacum
  misc_feature (91)..(91): n is a, c, g, or t
  misc_feature (124)..(124): n is a, c, g, or t
  misc_feature (419)..(419): n is a, c, g, or t
  misc_feature (443)..(443): n is a, c, g, or t
  misc_feature (538)..(538): n is a, c, g, or t
  misc_feature (550)..(550): n is a, c, g, or t
  misc_feature (631)..(631): n is a, c, g, or t
  misc_feature (661)..(661): n is a, c, g, or t
  misc_feature (730)..(730): n is a, c, g, or t
  misc_feature (747)..(747): n is a, c, g, or t
  misc_feature (759)..(759): n is a, c, g, or t
  misc_feature (767)..(767): n is a, c, g, or t
  misc_feature (782)..(782): n is a, c, g, or t
  misc_feature (801)..(801): n is a, c, g, or t
  misc_feature (803)..(803): n is a, c, g, or t
  misc_feature (807)..(809): n is a, c, g, or t
  misc_feature (841)..(841): n is a, c, g, or t
  misc_feature (852)..(852): n is a, c, g, or t
ggagctcaactgtggtatctgtttccaagatttttctctgttgttcttctgcttcctgacttccccattcattcttgaagctgggctggantataagggatgctaggaaaatcatttgcttctnctttgctgacctttaactccgtatcatgcttctcctctcctggttgtgattctggctcaatagcagcaaacaatctagtagggtggtatgtaaattgctcgaataactttacatcaaatgtcaccaaaggatcttggacatctgataatctgcccaagaaatggaagttgcattcaacagctactgacaatatagaattaactgaagaagagaaaaaacatggaatgatagcagagaagctctgtctgcattcaaatttagccctgaggaggaagacaaaatcttaggaaaagcntttggccagatacattcgcttatnggtatgaagaacggaagaaagaggttccaagacttgaagttgtgaatgagatattggattatctaaggagcttaagccttaccgatgatgatctnactaaacttctnaagaaattcccagaagttcttggatgtagccttgaagatgaaatgaaaaacaatgtggaaatcttggcgaaacaatggggnattgaaggtaaaactctgacaaaagtgctncttcgaaatccaaaagttttaggctacaacgtcgattgcaaaggtgattgtgtggctaaatgcactcgntgttgggctcggttctnactgtattcttnttgtttcnttctcatcctttttnctttatgtataataatgtntnacannnaatcattcttcaaaccttgtatctaattatanatgatgagganaatgattcagcggtaaagctgttatcctgcatcatagggttctaagattagattttcaccaaatctttatgttgtcgtaaacttaaaatattaaatataatgagcaacaccaccca

SEQ ID NO: 3926 - DNA, 836 bp, Solanum tuberosum
atcaggcagaggacgagacagaacgcagaaaagtcttcaatggcttctctgctgaacccacctctcattctgcctcaaaacaagctgaatcctgggggtgtcctcgctgcatctactagtggaataccaagcaaaaaatttcagccatcttcaacacgatggagccacaggcgttgtttgctgatgagaactaaaacatcagtggaaagggatatgctggcgaatgattctgtaggcaccgatgctgttgatgataaggattttggagttgtttgcatgcaccacgttggaatactatgtgaaaaccttgagaggtcattagacttttaccagaatattcttggactagaaataaatgaggcaagaccacatgaaaagcttccctacagaggtgcttggttgtgggtgggttctgaaatgatacatcttatggagcttccaaatccggatccctttaccggccgacctgagcatgggggcagagatcgtcatacctgcatagcaattcgcgatgtgtctaagctgaaagctattcttgataaagcttgcattccctacacccttagtcgctctgggagaccagccattttcactcgagaccctgatactaatgcactagaatttactcaagttgatgcttgacaggatctggactgcttgctctccaatttgcaatccttatatagttaaatatacagctattgtgaatatacatataggggatattcaacaagtagaatcaatagctctttgaagcacttcagctattagtggttatggcttatcaatccccacaaatgtcatgtgctatttatatgatttgaacatctgtggtt

SEQ ID NO: 3927 - DNA, 882 bp, Solanum phureja
aaaaaaatcagtcttcaatggcttctctgctgaacccacctctcactctgcctcaaaacaagctgaatcctgggggtctcttcgctgcatctactagtggaataccaagcaaaaaatttcagccatcttcaacacgatcgagccacaggcgttgtttgctgatcagagctaaaacatcagtggaaacggatatgctggcgaatgattctgtaggcaccgatgctgttgatgataaggatttcggagttgtttgcatgcaccacgttggaatactatgtgaaaaccttgagaggtcattagacttttaccagaatattcttggactagaaataaatgaggcaagaccacatgaaaagcttccctacagaggtgcttggttgtgggtgggttctgaaatgatacatcttatggagcttccaaatccggatccctttaccggccgacctgagcatgggggcagagatcgtcatacctgcatagcaattcgcgatgtgtctaagctgaaagctattcttgataaagctggcattccctacacccttagtcgctctgggagaccagccattttcactcgagaccctgatactaatgcactagaatttactcaagttgatgcttgacaggatctggactgcttgctctccaatttgcaatccttatatagttaaatatacagctatcatgaatatacatataggggatattcaacaagtagaatcaatagctctttgaagcacttcagctattagtggttatggcttatcaatccccacaaatgtcatgtgctatttatatgatttgaacatctgtggttaatacaattttcgcgaataagcgttctgtttactcatatttaaataacaccatctgcagagctttatg

SEQ ID NO: 3928 - DNA, 873 bp, Solanum melongena
agaatcagtcttcgatggcttctctgctgaacccacatctcactctgcctcaaaataagctgaaccctggtggtggcctagctgtatttactagtggaataccaaacaaaaattttcaacgatctcaatggagccacaggcattgtttgctgatcagagctaaaacagcggaaacggatatgcttgcaaaagactctgttggcaccaatgctgttgatgataaggattttggagttgttagcatgcaccacgttggaatactatgtgaaaaccttgagaggtcattagacttttaccagaatattcttggactagaaataaatgaggcaagaccacatgacaagcttccctacagaggtgcttggttgtgggtgggttctgagatgatacatctgatggagcttccaaatccagatcccaaaactggtcggccagagcacgggggccgagatcgtcatacttgcatagcaattcgtgatgtgtctaagctgaaagctattcttgataaagctggcattccgtacactcttagtcgctctgggagaccagccattttcactcgagacccagatactaatgcactagaatttactcaagttgatgcttgacaggatctggactgcttgctcttcaatttgtaatccttacatagttaatacaacagccattgtgaatatatgtataggggatattcaacaagtagaatcaagaactctttgaagcacttctactgttagtggttatggcttatcaatacctgcgaagtcatgtgctgttaatatgatttgaacatctgtggttaatacaatcttcacgaatatgtttactagttactcttatttaaataacaccatctgcagatctttatgccgt

SEQ ID NO: 3929 - DNA, 1090 bp, Capsicum annuum
tcagcatagtagtgcagtggtgcactttgcctgaaaattatgagccgctcaaatggagccatctcataacataacatcgttttcaattattattattagccaaataaaacccataaatgtaaaactaacgaccaagtaatccccaaagttgaaagaaagaatcattcttcgatggcttctttgattaacccacctctcactcttcctcaaaacaagctgaaccctgggggtgtcctagctgtatctaccagtggaataacaaacaaaatttttcaaccatcttcaacacgatggaaccacaggcgttgtttgttgatgagagccaaaacatcagtggaaatggatatgcttgcaaaagaatctgtaggcaccaacgctgttgataataaggattttggagttgtaagcatgcaccacgttggagtactatgtgaaaaccttgagaggtcattggacttttaccagaatattcttggactaaaaataaatgaggcaagaccacatgacaagcttccctacagaggtgcttggttgtgggtgggtactgagatgatacatctaatggagcttccaaatccggatcccttaactggtcggcccgagcatgggggaagagatcgtcatacttgcatagcaattcgcgatgtgtcgaagctgaaagctgttcttgataaagctggcattccctacagccttagtcactctgggagaccagccattttcactcgagacccagatgctaatgcactagaatttactcaagttgatgcttgataggatgtggactgcttgctctctaattgtaatccttatgtacgcttttttaaattattggataaatagagaaaatataacaatcctttgcaaaatgcataaagttgaactcttaccaatcattacttacacagttgcaatcatcagagcttctcccgccttcattcttgttgtgtccttagttcattttgtgaaaggggacaaacttgacttataatgtagaatcagaaaaaagaccatattcaaattcactaagatgtgagtatctgattgtgatggagttaaagcattttaatattagtataatattaatttg

SEQ ID NO: 3930 - DNA, 975 bp, Nicotiana tabacum
tcgctaaatacctgtaaatccccaaagttgaaactttccttcttcgatggcttctctgctgaacccacctctcactctgcctcaaaacaagctgaatcctgggggtgtcctatctgtagctaccagcacaataccatgcaaaaaatttcaaccatttttaacacggcaaaggagccacaggcattgtttgctgatgagagctaaagcgtcggttgaaacggatatgcttgcaaaagattctgtaggcgccaatgctgttgatgataaggattttggagttgttagcatgcaccacgttggaatactatgtgaaaaccttgagaggtcgttggacttttatcagaatattcttggactagaaataaatgaggcaagaccacatgacaagcttccctacagaggtgcttggttgtgggtgggatcagagatgatacatctaatggagcttccaaatccagatcccttgactggtcggcctgaacatggggggcgagatcgtcatacttgcatagcaattcgcgatgtgtctaagctgaaagttatccttgatgaagctggtattccctacacccttagtcgctctgggaggccagccattttcactcgagacccagatgctaatgcactagaatttactcaagttgatgcttgacataatttggactgcttgctctctaatctgtgatctttatatagttaaaatatacagctgctgtgcatatatgtatagggatattcaacaaattcagtcaataactgtttgaagcattgcagctatcagcatcatttaaagttagatatagtggttatggtttgtcaacctaaacaaaaaagggaaaaaaaaaagtcatgtgctgtgtatatgatttgaatatatgctgctcctagttgaatatatgtgataaaaggatcagctaatacaattttcacgaatacgtgtaagttattttgtaagatttaccccaattccaaatt

SEQ ID NO: 3931 - DNA, 930 bp, Nicotiana benthamiana
tcactaaataccctaaatcaccaaagttgaaactttccttcttcgatggcttctctgctgaacccacctctcactctgcctcaaaacaagctgaatcctgggggtgtcctatctgtagctaccagcacaataccatgcaaaaaaattcaaccatttttaacacggcaaaggagccacaggcattgtttgctgatgagagctaaagcatcggtggaaacggatatgcttgcaaaagattctgtaggcgccgatgctgttgatgataaggattttggagttgttagcatgcaccatgttggaatactatgtgaaaaccttgagaggtcattggacttttaccagaatattcttggactagaaataaatgaggcaagaccacatgacaagcttccctacagaggtgcttggttgtgggtgggctcagagatgatacatctaatggagcttccaaatccagatcccttaactggtcggcctgaacatgggggccgcgatcgtcatacttgtatagcaattcgcgatgtgtctaagctgaaagttattcttgatgaagctggtattccctacacccttagtcgctctgggaggccagacattttcactcgagacccagatgctaatgcactagaatttactcaagttgatgcttgacataatttgtactgcttgctctctagtctctgatctttatatagttaaaatatacagctgctgtgcatatatgtatacaatgctatcagcatcatttaaagttagatatagtggttatggtttgtcaaccaaaaaaaaaaaaagaaaaaaagtcatgtgttgtgtatatgatttgaatatatgctgctcctagttgaatatatgtgataccttgaacagctaatacaattttcacgaatacgcgtaagttattttgtaagatttaccccattccaaatt

SEQ ID NO: 3932 - DNA, 1032 bp, Nicotiana benthamiana
agtctttttccgttagccaaataaaatccagaaatataaaactaacgactctcactaaatacccatagatcgccaaagttgaaagttgaaactttccttctttgatggcttctctgctgaacccacctctcactctgcctcaaaacaagctgaatcctgggggtgtcctatctgtagctatcagcacaataccatgcaaaaaatttcaaccatttttaacacggcaaaggagccccaggctttgtttgctgatgagagctaaagcgtcggtggaaacggatatgcttgcaaaagattctgtaggcgccgatgctgttgatgataacgattttggagttgttagcatgcaccacgttggaatactatgtgaaaaccttgagaggtcgttggacttttaccagaatatacttggactagaaataaatgaggcaagaccacacgaaaagcttccctatagaggtgcttggttgtgggtgggttcagagatgatacatctaatggagcttccaaatccagatcccttaactggtcggcctgaacatggggggcgagatcgtcatacttgcatagcaattcgcgatgtgtctaagctgaaagttattcttgatgaagctggtattccctacacccttagtcgctccgggaggccagccattttcactcgagacccagatgctaatgcactagaatttactcaagttgatgcttgacataatttggactgattgctctctaatctgtgatctttatatagttaaaatatacagcttctgtgcatatatgtatagggatattcaacaaattcagtcaataactgtttgaagcattacagctagcagcatcatttaaagttagatatagtgattatggtttgtcaaccaaaaaaaaaaggaaaaagaaaaaagtcatgtgctgtgtatatgatttgaatatatgctgctcgtagttgaatataggtgatacaaggaacagctaatacaattttcacgaatacgcgatagttattttgtaagatttaccccattccgaatt

SEQ ID NO: 3933 - DNA, 568 bp, Solanum tuberosum
gtttactccaatggcgtctggatggggaattacagggaacaaaggacgatgttatgatttctggatggatttcagtgagtgtatgtctcgatgcagggagcccaaggactgtgtccttcttagagaagactacttcgagtgtcttcatcattccaaagagtatcaacgtaggaaccgaatctacaaagaggagcagcgccaattgagagctgcttcacaaaagaaaaaggaaggtgtagatggtggtggtggtcatcactgacctttattcttgatcaatcatggttttatcaaccaaaagacattgaagtaaactgtatgtcgttttgaattttgaaataaagaattaaatcagttgcatttgatgtgagctgcatcattgaaatgactcagttcagtttctttctcatatggcctttgtttgtttgttggttatgcaacatatgttttaagggttaccatttggcactagacttgtgatgtcagttctttctttgaaatctgtgactcttaaatggaacgatcattcctcaagtattacgtataatatgagatgcacgatgatcca

SEQ ID NO: 3934 - DNA, 618 bp, Solanum phureja
accaatttccatagcagaggaagaagaaagagtttactccaatggcgtctggatggggaattacagggaacaaagggcgatgttatgatttctggatggatttcagtgagtgtatgtctcgatgcagggagcccaaggactgtgtccttcttagagaagactacttcgagtgtcttcatcattccaaagagtatcaacgtaggaaccgaatctacaaagaggagcagcgccaattgagagctgcttcacaaaagaaaaaggaaggtgtagatggtggtggtggtggtggtcatcactgacctttattcttgatcaatcatggttttatcaaccaaaagacatggaagtaaactgtatgtcgttttgaatttttgaaataaagaattaaatcagttgcatttgatgtgagctgcatcattgaaatgactcagttcagtttctttctcatatggccttcgttttgttggttatgcaacatatgttttaagggcacatttacttctcaccattggcactggacctatgatatcagttctttctttgaaatctgtgactcttaaatggaacaatcattttcctcaagtatattatgtataatatgaaattcgcggtgatcca

SEQ ID NO: 3935 - DNA, 544 bp, Solanum melongena
atgatctcaattcgccaatttccatagcagaggaaggaagattttactccaatggcgtctggatggggaattacagggaacaaagggagatgctatgatttctggatggatttcagtgagtgtatgtctcgatgcagggagccaaaggactgtacccttcttagagaagactacttcgagtgtcttcatcattccaaagagtatcaacgtaggaaccgaatctacaaagaggagcagcgtcagttgagagctgcttcacaaaagaaaaaggaaggtgaagatggtggtggtggtcatcactgacctttatttttgatcaatcatggttttatcaaccggaagacatactgtatgtcattttgaatttgaaataaagaattaaatcagttgcatttgctgtgagctgggatcattgagataactctgttcagtttgtttctcatgtggcctttgttttgttggtgatatgcaacatatgttttaagggcacatttgcttcttaacattggcactggacttatgatatatcagttctttcttggcg

SEQ ID NO: 3936 - DNA, 501 bp, Nicotiana tabacum
  misc_feature (446)..(446): n is a, c, g, or t
  misc_feature (452)..(452): n is a, c, g, or t
  misc_feature (459)..(459): n is a, c, g, or t
  misc_feature (477)..(477): n is a, c, g, or t
  misc_feature (484)..(485): n is a, c, g, or t
gagtacctgcacgcagaagttcagaggaagaggaacaagagtttgcttcaatggcgtcaggatggggaataacagggaacaaagggcgatgctatgatttctggatggacttcagtgagtgtatgtctcgatgcagggagccaaaagactgttcccttcttagagaagactacttcgaatgccttcatcattccaaagagtatcaacgtaggaaccgaatctacaaagaggagcagcgccagttaagagctgcttcacaaaagaaaaaagaaggtggagacggtggtggtggtcatcactgacattgattgtgaaaacatggttttatcaaccaaaagacgtggaagtaactgtatgtcgttttgaactttgaaataaagagtaaagtcagttgcatttgatgtgagctggataattgaaatggctctgttcagtttctttctcantgtggnctatgtnttgttggtgatatgcaanatatgtnnaagggcacatttgcgt

SEQ ID NO: 3937 - DNA, 648 bp, Nicotiana benthamiana
gatcgcaacattcccaatcactattgcggaagttcagaggaagaggaacaagagtttgctccaatggcgtcaggatggggaattacagggaacaaaggccgatgctatgatttctggatggacttcagtgagtgtatgtctcgatgcagggagcccaaagactgttcccttcttagagaagactactttgagtgccttcatcattcaaaagagtatcaacgtaggaaccgaatctacaaagaggagcagcgccagttaagagctgcttcacaaaagaaaaaagaaggtggagatggtggtggtggtcataactgacgttgattgtggaaacatggttttctgtaccaaaaggcgtggaagtaactgtgtgtcgttttgaactttgaaataaagagttaaatcagttgcatttgatgtgagctggataattgaaatggctctgttcagtttctttctcaatgtggcctttgtttgttggtgatatgcaacatatgtttaagggcacttttgcgtccaaccatgggcactggaatatgatatcttttctcttggaaatttgggactcgtaaatgggatgatcgttttcttcaagtaattatgtagtatatcaatttcacaacgatccaatctggagcctgggtcatgaat

SEQ ID NO: 3938 - DNA, 554 bp, Capsicum annuum
cgcagtgttgtttagtgtgggaatggcgtcaggatggggaataacggggaacaaaggtcgatgttacgatttctggatggatttcagtgagtgtatgtctaaatgtagggaacctaaagactgttcccttcttagagaagattatttcgagtgtcttcatcattccaaagagtatcaacgtaggaaccgtatctacaaagaggagcagcgccagttgagagctgctgcacaaaagaaaaaggaaggtggagatgttggtggtggtggtggtcatcactgacctttattattgatcaatcatggtttttatcacaatcgaatgacatggaagttactgtatgtcattttgaattttgaaataaagaagtaaatcagttgcatttgatgtgagctggatcattgaaatggctctgttcagtttctttctcgtgtggcctttgttttgttggtgatatgcaacatatgtttaggggcacatttgcttcttaccattggcgttggacttatgatatcagttctttattggaaatttgagactcctccaatggaacgat

SEQ ID NO: 3939 - DNA, 688 bp, Petunia hybrida
ggctctttgataagaagagtcaattgggatcgcaattcgcaattcgcaattcgcataggcaatggcgtcaggatggggaataacagggaacaaaggaagatgctatgatttctggatggacttcagtgagtgtatgtctcggtgtagggagcccaaggactgttcccttcttagggaagactatttcgagtgtcttcatcattccaaagagtatcagcgtaggaaccgaatctacaaagaggagcagcgccagttaagagctgcttcacaaaagaacaaagatgatggaggtggtggtggtcatcactgaaattgattgttgctcattgttctatcaaccgaaaggcatggaagcaaccgtgtgttgttttgctctttgaaataaagaattaaatatgttccttttgattggagctggatcattgaaatggctctgttcagtttctttctcatctggcctttgttttgttgatgatatgcaacatatatttaagggcagatattgcttcctaccatttgcactggactgtgacttcaattcttccttggaaacttgggactcataaaatgggacaatcttttccttcaagtataatttgtaggatgtcaatttcgatccaatttgtgtctgcatcatgaatttatgggaaataacattctcacttggccagtatctgttatttatttt

SEQ ID NO: 3940 - DNA, 675 bp, Coffea canephora
cggccgggggaagaaaggggcactgccataatttcgtctctaattaaacaaataaataaaagaaattggaatcccgaaaatatccttagaccatccgatccggaattagaagtgacaaccgagcggcgaaagcagcaccgaagcggcggcggagaaagcaatggcgtccgggtggggaataacggggaacaaaggaagatgctacgatttctggatggatttcagtgaatgtatgtctcgttgtagagaacccaaggattgcgctcttctcagagaagactatttcgagtgtctccaccactctaaagagtttcaacgtagaaacagaatctacaaggaggagcagagacagctaagagcagctacgcagaaaggtgaggatggtggacatggtggaagtcatcactgataaatgtattttgagagggtgggcggtaaatgttcgactactgaatcttttgaaataattgccaaatcagttgtatttttcttgtcagcgatggaaacaaaacattttgtatttgtcaattgtctttgtttcttgcaagatacaacaaatttccttgcagaggaagatacatagttatttctttggtttatggatgagtgctgataaaataaccatagacacataaactacttatgttgaatttcagaaggtctcacctggatggc

SEQ ID NO: 3941 - DNA, 522 bp, Olea europaea
tcgtgttcactcgcacaacatgaaacaaaaagtccactgagctgacggaaggttcgagaaaaatccactgtcgagagatcgccggcgtaaaatggcatcaggatggggtataacggggaacaaagggaggtgctacgatttttggatggatttcagcgagtgcatgtcccgttgccgggagcccaaggactgtgctctgctccgtgaagactattttgagtgccttcaccactccaaagagttccaacgtaggaatcggatctacaaggaggagcagcgacagctgagagcagctgcacagaaggccaagggaggtggagatgatggtcatcactgataatcattattggtgatcttttttaatcggttggaagatggaaggaaattaatcaattttcttgagaacttgttgaaaataaaaaataaatgaactgtattatgtgttctggaacgatgaaaacatgaacgtaaatgtatttcttggtgcaaaaaagggggtaatttgttttctttgtgttgaga

SEQ ID NO: 3942 - DNA, 470 bp, Ipomoea batatas
caccagcgaacaccgaagagttgaggtggcggaggatggcgtcgggatgggggataacgggaaacaaaggccgctgctatgatttctggatggacttcagcgagtgcatgtctcgctgccgagagcccaaggactgcgctcttctcagagaagattacctggagtgcctccaccactccaaagagtaccagcgcaggaatcggatctacaaggaagagcagcgtcaactaagagcggctacgcataaggaaaaggaaggtggacatggtgatgggggaacacatcactgagttaatttttcctttttggcagtttttatgaccatacgcatttcgagttctttgaaaataaagaattaatcatctgcatttctgtgtgaaccggaattgtggaagcctgccttccctgcccttcttgtattcattggtaacaaggaatgatgacatccattttaagcctcccagtctgcg

SEQ ID NO: 3943 - DNA, 620 bp, Fraxinus spp
aacattttaactcattgaatcagctccgagcggaacttgcgttcagtcgcaaaaagtccgctgaacagagcaggtttgggaaaaatccacagtcgagatatcgcaggcgaaaatggcatcgggatggggcataacggggaacaaagggaggtgctacgatttctggatggatttcagcgagtgcatgtcccgttgccgggagcccaaggactgtgctctgctccgtgaagactatttcgagtgccttcaccactccaaagagttccaacgcaggaaccgagtctacaaggaggagcagcgccaactaagggcggctgcgcagaaggtcaagggaggtggagatgatggccatcactgataatcattattggttttctttaatcagttgaaaaatggaaggaaagtgagtgttgtcttgagaacttgttaaagataaagaaataagtcaactgtattcatagtgttctggaacgttgaaaacatgacggagaatgattcttgatgcaaaagactagttaaatttgttttctttgagttgtgacacttcaccccttgctagtttcctctggcactggtggcattatgttcaattctttggattgttaccaaaaaagaaaaaa

SEQ ID NO: 3944 - DNA, 574 bp, Fraxinus spp
gtgttcacgcgcaaaaagtccactgaacagacagcaggtttgagaaaaatctagtaatccacagtcgagatatcgccggcgaaaatggcatcgggatggggcataacggggaacaaagggaggtgctacgatttctggatggatttcagcgagtgcatgtcccgttgccgggagcccaaggactgtgctctgctccgtgaagactatttcgagtgccttcaccactctaaagagttccaacgcaggaaccgagtctacaaggaggaacagcgccaactaagggcagctgcgcagaaggtcaagggaggtggagatgatggccatcactgataatcattattggtttttcttttaatcagttgaaaaatggaaggaaagtaagtgttgcctcgagaacttgttaaagataaagaaataagtcaactgtattcatgtgttctggaacgttgaaaacatgatggaggatgattcttgatgcaaaagactagttaaatttgttttctgtgttgagacacttcgccccttgctagtttccgctggcactgtggcattatgttcaattcttggattgtta

SEQ ID NO: 3945 - DNA, 549 bp, Ipomoea nil
ggaccgttgaaccggtcgcagttttcatcatcggcaaacaccggagagtcgaggaggcggagtatggcgtcgggatgggggataacgggaaacaaaggccgctgctatgatttctggatggacttcagtgagtgcatgtctcgttgccgagagcccaaggactgctctcttctcagagaagattacctggagtgcctccaccactccaaagagtaccagcgcaggaatcggatctacaaggaagagcagcgtcaactaagagcggctgtgcataatgaaaaggaaggtggccatggtgatgggggaacacatcactgagttaattttttccttttttttttggcagtttttatgaccatatgcatttcgagttctttgaaaataaagaattaatcatctgtatttctgtgtgaaccggaacccttcttgtattcattggtaacaaggaatgatgacatcattgtctgcggcatactgtgtggcagtgatcttctgtttttaccttctcatctaaatcaatgatgatcgtgtttttcagcaaaaaaaaaa

SEQ ID NO: 3946 - DNA, 421 bp, Olea europaea
ggaggaggaacttgtgttcgctcgcaccacattgatagaagtccactgaacggacagcagatttgagaaaaatccacaatctagatatcgccgtcgaaaaatggcatcgggatggggcataacggggaacaaagggaggtgctacgatttctggatggatttcagcgagtgcatgtcccgttgccgggagcccaaggactgtgctctgctccgcgaagattatttcgagtgccttcaccactccaaagagttccaacgaaggaaccgagtatacaaggaggaacagcgccaactaagggcagctgcacagaaggtcaagggaggtggagatgatggccatcattgataatcgttattggtttttctttaatcagttgaaaaatggaaggaaagtaattgttgtcttgagaacttgttgaag

SEQ ID NO: 3947 - DNA, 778 bp, Olea europaea
aggctagtacgcggggacaatttcagtggctaattaataaacaattaactctttgaatcggctccgagaggaacttgtgttcgctcgcaccacattgatagaagtccactgaacagacagcagatttgagaaaaatccacaatctagatatcgccgtcgaaaaatggcatcgggatggggcataacggggaacaaagggaggtgctacgatttctggatggatttcagcgagtgcatgtcccgttgccgggagcccaaggactgtgctctgctccgcgaagattatttcgagtgccttcaccactccaaagagttccaacgaaggaaccgagtatacaaggaggaacagcgccaactaagggcagctgcacagaaggtcaagggaggtggagatgatggccatcattgataatcgttattggtttttcttttaatcagttgaaaaatggaaggaaagtaattgttgtcttgagaacttgttgaagataaagaaataagtattcatgtgttctggaacgttgacaacatgacgaagaatgtgtttcttgatgcaaaagactagataaatttgttttctttgtgttgagacacttcgccccttgctactttctgctggcactgtggcattatgttcaattcttggattgttattgattctgattttatcatttgctttggttatttcattttggtaaagcagtttgttaagaattggaacctcttctccttgcacacttgctggaatctttataaatgaccttcatttgcatgctaaaaa

SEQ ID NO: 3948 - DNA, 690 bp, Lactuca sativa
gccagtaggaactcagggagtaatggactatgtagaattgtggtcttgtatgaggcccaagcccaatggcccaaaaacaaaggtaggtccgtcatcagaatacactggtatggtgtggtaagttgccatcatcatcatcaaccttctttaggttcaggaggaaatcgtaaggtcaaattcagaaccaatggcgtccggctgggggataacagggaacaaagggaggtgttatgatttctggatggatttcagcgagtgtatgtctcgttgcagagaacccaaggactgctctcttctccgtgaagactatctcgagtgtcttcaccactccaaagagtttcaacgaagaaatcggatatacaaagaggaacaacgccagataagagctgctgcacagaaggcaaaaggtggagttggagatggagatggagttcctcatcactaaaactttccttcttctttctgcgtgctttttaaataatatgattgaagtctgcaatctatattttttcccttaaaaaatttggtgggattttatccccctttttgttgttccaaaatgattgacttatcctgttgtcatgatatttttgattcaaacttctcaacacattatcccataatctttatcatagacacccttatttgttgtttttcatttgatgcacttggattgtttttatatttgtg

SEQ ID NO: 3949 - DNA, 556 bp, Amsonia hubrichtii
ttgttgatccgaaattttcattgattaagaaggaagattcctagatggcgtccggatggggaataaatgggaacaaaggcagatgctatgacttctggattgacttcagtgagtgtatgtctcgctgcagagaacccaaggattgctctcttctcagagaagactatctcgagtgccttcaccattctaaagagtatcagcgtaggaaccgaatctacaaagaagagcagcgtcagctgcgagcagctgcacaaaaggccaatgaaggtggacatgggggcggaagtcatcactagtaactgtgtatttctcccgctatttcaaagagagggtgagtacaaagtgtcagctgtttaactctttccaaataaattactcggttgtatttgcacttttttggaaccattgaaagcatagaccggttttgtatctttcaaatgtgtttatttcctggtgcaaaatagcaaggaaaactgagtttattcggacaaggacatgtatttttgacatgtcgctgttgccagtcatgatttttgaagtttatcatttgtatttt

SEQ ID NO: 3950 - DNA, 695 bp, Catharanthus roseus
aattcggcacgaggcagagaagaaattgttcaggaattgttgatccaaaactttacctaagatttgtagatggcgtctggatggggaataactgggaacaaaggcagatgctatgacttctggattgacttcagtgagtgtatgtctcgctgcagagaacctaaggattgctctcttctccgagaagactatctcgagtgtcttcaccattctaaagagtatcaacgaaggaaccgaatctacaaggaagaacaacgtcagctgcgagcagctgcacagaaggcaaatgaaggcggacatgatggcggaagtcatcactagtaactgtggatctctcttatttcaaagaggttgagcacaaaagtttctcatctgtttaactcttttcaaataaattactcggtttgtatttgcagttcttgaacaattcacagcgtcgagccgttctatatctttcaatgtgtttatttcctggtacaaaatagcgaggaaaactgagtttcttttgaatcagacgtgtacttttcacatgttgcaggtccattcatgaatttttgaagttttaacattctgattttctcaggcttaaactatttcaaattacctaaagcaatgatcaatggtcaatgtgaaccaatgatttgtaacttgaagccgattactatacattatatcaaagttttaaggtttcgttt

SEQ ID NO: 3951 - DNA, 519 bp, Centaurea maculosa
ggcgggggattaggcccaaaacaaagttccaccatcaacaagcgttgttaggaactgagagagatcgtaaggtgaaaatcaggatcgaatcatggcgtcagggtgggggataactggaaacaaaggcagatgttacgacttctggatggatttcagcgagtgtatgtctcgttgcagagaacccaaagactgttctcttctccgtgaagactatctcgagtgtcttcaccactctaaagagttccaaaggcgaaaccggatctacaaagaggagcagcgccagataagagcggctgcacagaaggcaaaaggtggagatggtgatggagttcctcatcattagtgtaaaattctcaaaatttctggatttttaataaggattgaagtgtgcaatctattttatttctggagatcttgttgttccagatggttgagtacctgttttatcagcaacatgctcatgatttgaatgtttgagcacattttgttataatgttaatcatagaccctttttgttgt

SEQ ID NO: 3952 - DNA, 2330 bp, Centaurea maculosa
tttgctccagtaactcctatcttttttcttcttcgttttcttcatttctatactatctgcagatgcattctattatattaatctgctttttgcattttacttttccatgttactctcttcagtttccggcgaggtacccgacgaacctgttgtttctaagtcgtctggatacttttcgacaagcgtctgattcagagacacatatcggatcatggaagatgtcctgttactggggagtcgttaactatggatgaccttataccgataaaaactggcaagatagtgaagcctagacaagtacaggctgcaagtattcctgggatgcttggaatgttccagaatgaatgggatgctttggtgctgtctgcttttgcatccgagcaacaacttcatacaacaaggcaggagcttagtcattgtttataccagcacgattcagcttgccgtgtaattgcaagattaaagaaagagctagatgaggccaggacaatgctggcaaatttagaaaggcaagcacccatgccggcatcaacggcaatgccagcaaatgcctccgctgcaatcaatggcaaaagagctgcagagggtgatgagttgggtccagatggtaagaaaatacgcccaggaatctcagctagtataattgcagagttaacggactgcaatgctgcactttcacagcaaaggaaaaaacgacagattccttcctcgttggctcccttggatgctgttgagaggtatacccagcttaatagttatcctcttcacaaaacaaacaaagctggcatattatctattgatattcatcattcgaagggtattattgctactggtggagttgatacgaatgcagtagtcttcaatcaaacctcaggggagatattatccacactcagtggtcattcaaagaaggtcactagcgtcaagtttgttgctgatggtgagttggttgttactggttctgctgataagacagttcgtgtgtggcaagggtctgaagatggaaattatgattgtaggcatgttttaaaggatcatgccgccgaggtacaagctgttaccgtccatgctaccaatggttactttgttacggcttctctcgacaatacatggtgcttttatgagctatcttctggtctatgtctcgcacaggttgcagattcctctgaatctgatggatatacatctgcagcttttcatcctgatggtctcattcttggaacaggcacgaccggatcacttgtaaaaatctgggatgtaaagagtcaggcaaatgttgcaagatttgacgggcatgttggagccgtaaccgcaatttccttttcagagaatggctactttttagctactgctgctcaagatggtgttaaattgtgggatcttcgcaagcttagaaattttaggagctttacaccatatgatgagaacacacccacccaatctgttgaatttgaccatagtggaagttaccttgcattaggaggctcagacataagggtttatcaagtggcaaatgtgaagtctgagtggaactgtatcaaaacattcccagatttgtcgggaacaggcaagataaactctgtaaaatttggacgcgatgcgaaatacatagcggtcgggtcaatggacaggaaccttcgactgtttgggctgcctgaagaaacaaccgagtcttagaagacatttatttttaactcctaaatggattttggtaggatctcggacaatgaaaatatacggtgagaaccagtgagagatgtaacaaaattagagcatgcgggattttgttgacgcagagtcgcagtcggtacttttttctttttcgacaaaatgtatgattaacattatgagataatgtgcttaaaagttcaaatcaacaatatcatggaacaagcaggtactcaacgacttgaaacaacaaaaaggcgcacgaaattgcaccaaatccccaggggaaagaaatcgattgcacacttttgagtcattattatgaagcagaaagaaagaaaaccgtacgctagtgatgaggaactccatctccatctccaccttttgccttctgtgcagccgctcttatctgacgctgctcctctttgtatatccgatttcttcgttgaaactctttggagtggtgaaggcactcgagatagtcttcacggagaagagaacagtctttgggttctctgcaacgagacatacactcgctgaaatccatccagaaatcgtagcaccttcccttgttccctgttatcccccatcccgacgccattgattctgaattttgacctctcgatctcctttctgaaactctgaagaatagtataaccctg

SEQ ID NO: 3953 - DNA, 462 bp, Centaurea maculosa
gtcaaattcgaatcatggcgtcgggatgggggataacagggaacaagggaaggtgctacgatttctggatggatttcagtgagtgtatgtctcgttgcagagaacccaaagactgttctcttctccgtgaagactatctcgagtgccttcaccactccaaagagtttcaacgaagaaatcggatatacaaagaggagcagcgccagataagagcggctgcacagaaggcaaaaggtggagatggagatggagttcctcatcactagcgtacggttttgctttctttctgcttcataataatgactcaagtgtgtgcaatcgatttctttcccatggggatttggtgcaatttcatgcggctttttgttgtttcaagtcgttgagtacctgcttgttccatgatattgttgatttgaacttttaagcacattatctcataatgttaatcatacattttgtcgg

SEQ ID NO: 3954 - DNA, 1673 bp, Cirsium arvense
tcttctcctccacttaaccttccgacctcatatccttcatccaccgtcaaccaccacacctccgccgtggccgccgtctccggccacactaagaggagactatcgctcactcgaacattagtcgcaaaagcttcagaaaacgacgatgaaactccgtcgtcgtttaatccgttcggtttcgtcaccgataatccgtcgagccggagcgccattcaacttcctgaagctccggcggaggacggaaacgtcggccagatgctctatagaatagaagataagggaagggaatatggttcttacatcaaatctggaggctttagatggtttgtcagagaaacagggtcatctgatgcccggcttggtcctcgtggaactgttgttttcctccatggtgctccgacacagtcctacagttatcgagttgtaatgtctcagttggcagattctggcttccactgttttgcgcctgattggataggatttggtttcagtgacaagccacagccaggatatggctatgactacactgagaaagagtaccatgaacaactggataaattgctcgacaaactggagatcaaatcgcctttctcgctagtggttcagggatttcttgttggttcttatggattgacttgggccttaaaaaaccccagcaggatatccaaacttgtaataatgaacactcctctgacaacttcatctcctatcccaggattatttcaacagctcaggattcctctacttggtgaattcacttgccagaatgctataatggctgagcgctttattgaagcaggtagcgcctatgtcctgaaggtggaaaaagctgatgtttatcgactcccatatcttagaagcagcggtcctggatttgctttgcttgaagctgccaaaagaatcaacttcagagcaactgcaggccagatagctgatggcttcaaacccgagagatgggataaaccaatattagttgcatggggtatgtccgataaatatctccctcagtcgatcgcggaggagttccaaaaaggaaacccaagtgcggtaactctcaaattaatcgaaggggctggtcatatgcctcaagaagactggcctgagaaagttattgatgctcttagatacttcctctgattatgttatcattgtaagtatatttctgttttgtgcatatagtatccttcacttgatattattgtaaaccttttttctttttaatcgacaaaatgtaagattaacattatgagataatgtgcttaaaagttcaaatcaacaatatcatgaaacaagcaggtactcaacgacttgaaacaacaaaaaggcgcacgaaattgcaccaaatccccaggggaaagaaatcgattgcacacttttgagtcattattataaagcagaaagaaagaaaatccttcgctagtgatgcgggactccatctccatctccaccttttgccttctgtgcagccgctcttatctgacgctgctcctctttgtatatccgatttcttcgttgaaactctttggagtggtgaagacactcgagatagtcttcacgaagaagagaacagtctttaggttctctgcaacgagacatacactcactgaaatccatccagaaatcgtagcatctgcccttgttccctgttatcccccatcccgacgccattgatg

SEQ ID NO: 3955 - DNA, 629 bp, Cirsium arvense
attggttgaattcaggtttataatatatcacagaaggaaggatatcgtgaggtcaaaatcagaatcaatggcgtcgggatgggggataactgggaacaaaggcaggtgttatgatttctggatggatttcagtgagtgtatgtctcgttgcagagaacccaaagactgctctcttctccgtgaagactatctcgagtgtcttcaccactccaaagagtttcaacgaagaaatcggatatacaaagaggagcagcgtcagataagagctgctgcacagaaggcaaaaggtggagacggagatggagttcctcatcactaacgtacaattttctttctttctgctttataataaataatgactcaagtgtgcaatcaatttctttcccctgggaatttggtgcaatttcgtgcgcctttttgttgttccaagttgttgagaacctgcttgttatcagcaatatgcttatgatatcgttgatttgaacttttaagcacattatttcataatgttgatcgtacttttttccataaaaatcagatatcgtaatcttctcaaaaagcaaaaaaaaattacaagaaagaaatatcttaacaaaagaatgtcaaaagtaacaattatttcatttttg

SEQ ID NO: 3956 - DNA, 597 bp, Carthamus tinctorius
  misc_feature (246)..(246): n is a, c, g, or t
gaggaggagatcgtgaggtcaaatcagaatcaatggcgtccggatgggggataacagggaacaagggcaggtgctacgatttctggatggatttcagcgagtgtatgtctcgttgcagagaacccaaagactgctctcttctccgtgaagactatctcgagtgtcttcaccattccaaagagtttcaacgaagaaatcggatatacaaagaggagcagcgtcagataagagcggctgcacagaagncaaaaggtggagatggagatggagttcctcatcactagcgtacggttttgctttctttctgcttcataataatgactcaagtgtgcaatcgatttctttcccctgaggacttggtgcaatttcgtgcgcctttttgttgtttcaagtcgttgagtacctgtttgattgttatcagcaaacatgctcttatgatatcgtcgatttgaacttttaagcacattatctcataatgttaatcatacattttgtcgactagagctcttacttgctcgtcttcatcggtgtatgattataaagaagttgttcaatggctcatagtttgaaaactctatatattgacaatccttttgc

SEQ ID NO: 3957 - DNA, 714 bp, Helianthus annuus
acagtggtgaaggggcgacaattgacatcatcttcaacctcggttaggttcagaaagatcaaaatcagaatcaatggcgtcaggatgggggataaccggaaacaagggaagatgctacgacttctggatggatttcagcgagtgtatgtctcgttgcagagaacccaaagactgctctcttctccgtgaagactatctcgagtgtcttcaccactctaaagagtttcaacgacgaaaccggatttacaaagaggaacaacgtcagataagagctgctgcacagaaggcaaaaggtggggatggagatggagttcctcatcattagtgtaaaattatcaaattttccggtttacaataatggttgaagtgtgcaatctattttatttcttgaaaggtggcgcaattttgtgtgcctctttgttgtttcaagtgattgagtacttgtcaattttcatcagcaacatcctcatgatattgttaaattgagtgtttgagcacattattttataatcttaatcatagcccttttttacgttacatattagacgttgttatcttcttgtacagagggatgctgatttcagaacccataatatgttgagaactacaagaactggtttaaccgttttgtgctatttattttataacactaaaatgtatgtggatttcagtatgtttgagatttatttttaaaaaaatatggtattgctagaa

SEQ ID NO: 3958 - DNA, 646 bp, Tabernaemontana elegans
tgtcaatcggtttcagattgttatccgatattcagttccatttctcttggttgcgaatctattgatcttccttgaccctcttcaagaatattacctctcccctcttagggattttgcttctattttttattcaactctccataattttgcttcgaatttctaatttttaggaattgttgatccaaaattttgagtagttaagaaggacctaagatttgcaaatggcgtccggatggggaataacgggaaacaaaggcagatgctatgacttctggattgacttcagtgagtgtatgtctcgctgcagagaacccaaggattgctctcttctcagagaagactatctcgagtgcctccaccattctaaagagtatcaacgtagaaaccgaatttataaggaagagcagcgtcagctgcgagcagctgcacggaaggccgatgaaggtgaacatgggggcggaagtcatcattagtaactgccaatttcccctatttcaaagagagggtgggccaaagtgttagctgttcaatttctttcaaataaattatagttgtatttcaactttttgaaccattcaaagcatggattggatatctttcaaatgtgttcatttcctgtgacaaaacagcaaggaaaactgagttt

SEQ ID NO: 3959 - DNA, 623 bp, Helianthus annuus
ctgattatgggcctttgggcccataatcagaagaagcgagggcgaccaccatcaacaaccgtggttataggttcagaaactgaaacgtaaggtcaaactcaggatcgaatcatggcgtcagggtgggggataacaggaaacaagggaagatgctacgacttctggatggatttcagcgagtgtatgtctcgttgtagagaacccaaagactgctctcttctccgtgaagactatctcgagtgtcttcaccactctaaagagtttcaaaggcgaaatcggatctacaaagaggagcaacgccagataagagcagctgcacagaaggcaaaaggtggagatggtgatggtgatggagttcctcatcattagtgtaaaattctcaatatttctggtttttaataatgattgaagtgtgcaatctattttatttctggaaatttggtgcacccctttgttgttccaaatggttgagtacctgtttcatcagcaacatgctcatgatttgaatgtttgagcacattttgttataatgttaatcatagaccctttttgttgttattgcgcgcgcgcatgcatttctgtgatcatatatgggtagaaatgtataaacaacctgcaaattg

SEQ ID NO: 3960 - DNA, 583 bp, Taraxacum officinale
ggttaggttcagaaagagatcgtaaggtcaaaatcagaaccaatggcgtccggctgggggattacagggaacaaagggaggtgttatgatttctggatggatttcagtgagtgtatgtctcgttgcagagaacccaaggactgctctcttctccgtgaagactatctcgagtgtctccaccactccaaagagtttcaacgaagaaatcggatatacaaagaggaacaacgtcagataagagctgctgcacaaaaggcaaagagtggaggtggagatggagatggggttcctcatcactagtgtaaaactctttttttcttcatgttttataataatgattgaagtatgcaatctattattttccccaaaatttggtgtggttttctccgcctcgtttgttgttccaagtgattgagtactttgttgttatcatgatattgttaatttcaacttttgaacacattttctcataatctttaatatagaccctttttttgttgtgtttttgacaattggaggtctaccatctacatgtatctggttcctgacttgaatttcaatttgaatttttgaaagagtataa

SEQ ID NO: 3961 - DNA, 1048 bp, Artemisia annua
tttacttgtaaatgactcgttgatcattccaatactcgcacaattttgaatgttatataacaagacaccaataaacacatgcattgattgtgcaacagcacttaactagggatcaacaagagatagacattttaattcactgtaacgaaaacttttgtacaagtctagtgcacaaaagtactatgcggaaacatttctcaagattgtacatatttgggttggtatacattgtgtgtaggtaatgcaattttaaactatttcatgttcataaagacttgtatttgtatctacaagctgctgcagttccagttcaatctctatagagcaaacaaatttcaaacattatctttgcaccaacgttaagctagaacagtaggatcattgctacaatgaacaagataactgaacatcccatcgcagcaattgcagaggcagcaagacctgcacgttccctaggatctttccgataataatttccaaaatagagaaatgtggcatagtaccacatcacagggaatgcaaatcctattaagaaagagaaccatccaattccacagccaaaacaagatcatcaaaatcaaaagcatcaatggcgtctggatgggggataacagggaacaaaggaagatgttacgatttctggatggatttcagcgagtgtatgtctcgttgcagggaacccaaagactgtggtctccttcgtgaagactatcttgaatgtcttcatcactccaagagtttcaacgacgtaaccggatatacaaagaggagcaacgccagataagagctgctgcacaaaaggcaaaaggtggagatgtagatggagaaggggttcctcatcattagtgtaaaatgttccattgtggtttataataatgattgaaggtgtgcaatctatgttgttcctggaaatttggtgcattttgtgcctttttgttgtttcgagtggttatgtactttgtcatcagcaacatgctcatgatattctcaatttgaacttttaagcacattatttcataatgctaatcatagaccgcttttgttgtgc

SEQ ID NO: 3962 - DNA, 546 bp, Fraxinus spp
aaaaagtccactgaacagacagcaggtttgagaaaaatccagtaatccacagtcgagatatcgccggcgaaaatggcatcgggatggggcataacggggaacaaagggaggtgctacgatttctggatggatttcagcgagtgcatgtcccgttgccgggagcccaaggactgtgctctgctccgcgaagactatttcgagtgccttcaccactccaaagagttccaacgcaggaaccgagtctacaaggaagagcagcgccaactaagggcagctgcgcagaaggtcaagggagtggagatgatggccatcactgataatcattattgccttttctttaatcagttgaaaaatggaaggaaagtaagtgttgtctcaagaacttgttaaagataaagaaataagtcaactgtattcatgtgttctggaacgttgaaaacatgacggagaatgattcttgatgcaaaagactagttaaatttgttttctgtgttgagacacttcgcctcttgctagtttccgctggcactgtggcattatgttcaa

SEQ ID NO: 3963 - DNA, 513 bp, Ipomoea batatas
  misc_feature (23)..(23): n is a, c, g, or t
  misc_feature (32)..(32): n is a, c, g, or t
  misc_feature (38)..(38): n is a, c, g, or t
aaaaatacaccgtcggggaacgngcgcctgcnggtcgnctctagtaacatccaaagggcgaagagtttcagaagaagagatctgcgtcgggatggggaatctcggggaacaaaggccgttgctacgatttctggatggatttcagtgaatgtatgtctggttgccgagagcccaaggactgcgctcttctccgagaagactatctcgagtgtctccaccactccaaagagtatcaacgcaggaatcggatatacaaggaagagcagcgtcaactaagagcagctgtgcagaaggacaaggcaggtgaaaatggtggtggaactcatcattgattgacatttttcctttattgttatggttttaaccatttgaagcaggttgacatgaatgcttctaaatcctctgagaataaagaattagatcaattgtactttttgtgacatggaatgttgacagcatctattattggttgcttgccaagttagactcctaaatgccaagtaatcaccatta

SEQ ID NO: 3964 - DNA, 375 bp, Arabidopsis lyrata
acgggtatctcgggtcatccaaacccaaacccgaaccattttcgttgacgaaacgaaacctgtctggttttgttgcgttcttccgatttgggttggagaggaaatggcgtcgggatggggaataacgggaaacaaagggagatgctacgatttctggatggatttcagtgaatgtatgtctcactgcagagagcccaaagattgtactctccttcgtgaagattacctcgagtgtctccaccattccaaagagtttcaaagaaggaacaggatatacaaggaggagcagcgtaaactacgagcagcttcgaggaaaggtgaagaaggcgtggatgggactcatacccatcactagtctcaacaatcctcctccaa

SEQ ID NO: 3965 - DNA, 758 bp, Aristolochia fimbriata
gacccgggactggccttttcctcgattcgtcgccattcgatcaaatacactcgagactagcgactggaagaaggtgaaaggagagggcgagagagatggcttcaggttgggggatcaccgggaacaagggtcgctgctacgatttctggacagatttcagcgagtgtatgtctcgatgcagggagccgaaggactgtgctctcctccgagaagattacctcgaatgtctccaccacgcaaaagagtttcagcgaagaaacagaatttacaaagaggaacagcggcaaattagagctgcagaacgcaaggccaaagaggaggttgaaagcggaggaggtggtcatcattagaggcaaatcatcttttctactgaaagaataaaacttagctcaagttctcttccgatggaaaacccactcccgtttgcagttctttttgctgtagattttcctaaaaagataagataacaattgatttcagatgaaaactgttggttgttggggttgataactcactattttgaggccacatgcatcattttcaccactcgagtgttaaatgaagttgaagctattgacgggacctgacttattggtgaacagcaacttaggcagactttttaaactcgtgggctggcttcaagaaatagcgcttttagtacgctctgcgaggaaaattgtacaaggcaacctgtcgcagagttttttgttttgtttgcatctttacgagaggaaacaagtaattaagaagtcaatttt

SEQ ID NO: 3966 - DNA, 369 bp, Flaveria ramosissima
gaccatcatcgtcaaccttggttaggatcagaaggagattgcaaaagtcaaagtcaaaatcaatggcgtcggggtgggggataacagggaacaaggggagatgctacgatttctggatggatttcagtgagtgtatgtctcgttgcagagaacccaaagactgctctcttctccgtgaagactatctcgagtgtctttaccactctaaagagtttcaacgacgaaaccggatttataaagaggaacaacgtcagattagagctgctgcgcagaaggcaaaaggtggtgatggagatggagttcctcatcattagtgtaaaattttcaaaatgtccgctttataataatgattgaagcgtgctatcaatt

SEQ ID NO: 3967 - DNA, 486 bp, Guizotia abyssinica
cggggaagagatcgtaaggtgaaaatcaggatccatggcgtcggggtgggggataacaggtaacaagggaagatgctacgacttctggatggatttcagcgagtgtatgtctcgttgcagagaacccaaagactgttttcttcttcgtgaagattatctcgagtgccttcaccactctaaagagttccaaaggcgaaatcggatttacaaagaggagcaacgtcagataagaactgctgcacagaaagcaaaaggtggagatggtgatggtgttcctcatcactagtgtaaaattttcaaaatttctggttctaataatgattgaagaatgcaatctatttcatttctggaatttagcaccaccccctttgttgttccaagtggtttgagtacctatcatcagcaacatgctcatgatatttttaatttgaatgtttgagcacattttattataatgataatcatagacccttttttgttgtgtgt

SEQ ID NO: 3968 - DNA, 538 bp, Lippia dulcis
tcaaaacccaaattaacaagcccaactgaacaaccctagagagagaaaactcggacgggtaaacatggcgtcgggatggggaataaccgggaacaaaggcagatgctacgatttctggatggatttcagcgactgtatgtcgcgctgccgggagcctaaggactgtaccctcctccgcgaagattatttcgagtgcctccaccactctaaagagttccagcgcaggaaccgaatctacaaggaggagcagcgtcaactaagagcatccacggagaaggccaagggaggtggagagagcggtcaccattgataatcatttttgctctcttcgtttaacctagtgaaggggatgagaagcaattgatttctttagaactttgttgaaaataaagatgaatcggttgtatttacttcttgtggaatggttaaatgcaagaacatattccatggaagttggtgcaaaaacaaagacatgcatgttttctttgcacatgaggatgcttttgtatttgccacttgcgttgaggcatttatctac

SEQ ID NO: 3969 - DNA, 565 bp, Lippia dulcis
agagaaaggtcgaggaagaggtgaaaatggcatctggatggggaatcaccggcaacaagggccgatgctacgatttctgggtcgatttcagcgaatgtatgtcaacttgccgagagcctaaggactgcggcctcctccgcgaagattatttcgagtgtctccaccactctaaagagttccaacggaggaacagagtttacaaggaggagcagcgtcagctgagagcagctgcagataaggccaagggaggaggcggaggtggagatggtggccatcattgagaattgctaaaaggagccaatggagggatgggaagtaattgattttcttcaaaactttgttcgaaataaaccataaatgaattgtatttgtgttatcggatgttaaatatacaaaacatctttaaaatgggagtctcggtgcaggaaccgctgctgtatgtttcattgcgtctgtatttcttgccatttgccctactgttggatgatatatgttttgctcactttgtcaagctaacttgctttcacagtgtgcttggtagatttatttaagtgttcatgcttgc

SEQ ID NO: 3970 - DNA, 422 bp, Platanus occidentalis
aaatggcgtcagggtggggaatcacaggaaacaagggaaggtgctacgatttctggatagacttcagcgagtgtatgtctcgttgtagggaacccaaagactgtggtcttctcagggaagactatctcgagtgtcttcaccactccaaagagtaccaacggagaaaccgaatttacaaagaggagcaacgtcaattaagagcagctgcacggaaggccaaagatggaggtgcagatggtggtgaaaacaatcatctgtaagatccaatcattagcaatcatcttttggactttttgaataaagattgggttttccagttgtattttggtggggactggtctgtttgtagacctttttgttgttgctctcaaattgagtatatgtttcttcatctacgcagaagtgcataatattaatctgag

SEQ ID NO: 3971 - DNA, 604 bp, Platanus occidentalis
acctgcagcctcgccgcgataaacagagggaaggtagaaacaggagagagagagaggggaaatggcttcaggttgggggattacaggaaacaagggaaggtgctacgatttctggatagatttcagcgagtgtatgtctcgttgcagggagcccaaagactgtgctcttctcagggaagactatctcgaatgtcttcaccactccaaagagtatcaacgaagaaaccgaatttacaaagaggagcagcgtcaaataagagcggctgcacagaaggccaaagaaggaggtggagatggtggagaaaacaatcatatgtaggatccaatcattagctgtcaatcttttggactttgtgaataaagattgagttgcctagtggcattttgatgggggctgggtatgtttgtcaaccgttggctgctctcaaatttgagtttgggattctggccacgcagaagtgggtaatattagtctatgcttgcattgaaacaccattggttaatgatgttattagaccttaatattaccttgtaagttgtttttatttgtttctttcacttgtagatctcaaatgccaaactttaatgttatttatttttatta

SEQ ID NO: 3972 - DNA, 502 bp, Brassica oleracea
gcggggaggtgaagagatgaacgtatctatctaatcatccagtttcatcaatggcgtcggggtggggaataacggggaacaaagggagatgttacgatttctggatggatttcagcgagtgtatgtctcattgcagagagcccaaggactgctctcttcttcgcgaagactacctcgagtgtcttcaccattccaaagagttccaacgaagaaacaggatatacaaagaggaacaacgcaaactgagagcagcttcaaggaaaggccaagataccggcggtgatgccaccactaatactagtaatcactagtcgtgaagccaagtttgcatctttcgcaaccgggaaaaagaataatgaaagtttcgtgaaagattctctgtatgttgtgtgtcgaactccttttgattgttttcacttcgcttctgcaatgaatgaatattctgccttttttacttcttacattttgactgagttgtaataaaatacccttttggctgggc

SEQ ID NO: 3973 - DNA, 2802 bp, Theobroma cacao
ggcaaggaccaattacatgactttatgttattttaccctaatatctacttagcatctatttaatttgttactagttcgagtggtagagtatatataacaaaagaacaaatgttttactaatacattttgttattttccaatgttgcaatgggttgattagtccgaaaaacggatgacgacccgtggtccatgggtagcccgcaaacccgtgcgtaaatacacacttctccgcacaatcagattgaacatttttactcgactacaatccatctgatcgggcggagaacgacagacatggcgtcaggttggggaatcaatgggaacaaaggtaggtgctacgatttctgggtcgatttcagcgagtgtatgtcccgttgcagagagcccaaggactgcgctctactccgcgaagactatctcgagtgcctccaccattccaaagagtttcaacgaagaaatcgaatttataaggaggagcaacgtaaattaagagctgctacacggaaaggcaaggaaggcgaagatggtgttggccatcatgcatagtaataattcatgatcctttgaatttccaagaataataatgcatggagattgttgtattttttgttcggattggtattttaactcttttcgaaattaccttggtttccttttctttggaatggatattgttgaacgggtattgttgttttgagcctgtgcaaagaggcaatgattagtctttggtcacattcctgggtgtggagcaacattatttgagaatctgatgtgtccattgaactctcataatattgcagttatagttcaaattctgagaaccatatagtctccttggattatgaatctttgaataattttttaatcataataatcaagtgaatattcaagtgaacttgaatatcatacattcaaaacaatttgcacgaagaccctaccgtccccctttgtctctctcaattttcaaaaccctaaataaatctctttccgaagatctccgtctcgtcgtctcagaacaacctcccttctcgcaagaaaaagaaatgagtagccgttcgagtcgaactctgtatgttgggaatcttcctggcgatgtacgcgagagggaagtggaagatttgttttacaagtatggtcctatagcccatattgacctgaaaattccaccaaggcctccaggttatgcatttgttgagtttgaagaggctcgagatgctgaagatgctattcgtggtcgtgatggctatgattttggaggacatcgtttgcgggttgaacttgcacatggtgggcgtgggcgttcatcagtagatcgtcatagcagttttagtggtgggcgtgggcgtgggccatccagacgttctgaatatcgtgtgttagtcactggattgccatcttctgcttcatggcaggaccttaaggatcacatgcgtcgagctggggatgtttgtttttctcaagttttccgtgatggtagtggaacaacagggattgtggactacaccaactatgatgatatgaaatatgctattaagaaacttgatgactctgagtttcggaatgcattttctcgggcttacgttcgggttagggaatatgattctaagcgggactcctctagaagccctagtcgtggtcgatcactctcaagaagccgtagccggagccgaagccgtagtcgcagccgtagccgcagccgcagtcgtggacggagctatagtcggagcaagagccacagcaagtctccaagagcaaaaccttcgcgaaagtcaccagcaaagtcaagatctaggtctgcttctcgttcccgctctgcatcaaggactcgctctttgtcaagatatggataaatgcagcaaactgggaattggatattaggatcttgtgggaatatggttcaattgcatgcaactcgtttggttgcagagatttggaacaaaggagacaatggactgcgataatagagctggatttctttacaaggaattgcaatagtagagctggatttcagtgaagtaaatgcattgggatttgcaagtcaccatcattgagcggtagaaacatttcactgtcaatttcagctccagatattgccaagctaataggacatgctatgtggattaacctgtggattttggtggcacatagcgaagcatgctcattctctatccactggtgtcggaatatgaaaaataattcttttaaggaatttcattttgttagattaggttttttttttttttccttacgtaggcaggtttgtgagctggtcctattctttatttccttatttaactgctaaagatttatgctttcttctttattccttttgaatatggtgattctgacgtggaaggggcatcaaggctcttggatgaaagttgttaaaaggaaggtgttgattttaaacttgggttctttctggaacttttgcagatctcgatcaagatccagatctcctttgccttctcgtcaaaaaggaaagagtaagagtccaaaaagacgcactgttagcaggagtccaagtgggagcagaagcaggagtaggagcaagagtttatccaggtaagacacaattgctgagttgatttgcgacccagaagctgaagactcttattaatttaagttttttattaaaaaattaccttgagcactggaaaacttgtcaaaaaagtttagcaatcatgttggatttcattaaaacattttatgtttgtgctgttattgaagacattttatatacctgtttttagcatttaatattatgattgattgttggtttaatgaattttgttggggtgc

SEQ ID NO: 3974 - DNA, 589 bp, Ambrosia trifida
taatgacgacccaaaagcaaagttaggaggaggcggaggcccataaacaaataacaatcatcttcaaccttggttaggtaagttcaggagaagaagatcagggaataaatggcatctggttggggaataacagggaacaagggaagatgctacgatttctggatggatttcagtgagtgtatgtctcgatgcagagaacccaaagactgctctcttcttcgtgaagactatctcgagtgtcttcaccactctaaagagtttcaaagacgaaaccgtatttacaaagaggagcagcgccagataagagctgctgcacagaaggcaaaaggtggagataccgatggagttcctaaacattagtgtaaaattttcatatttctggtttacaataatgattgaagtgtgcaatctttttattttatgaaatctggtgcaattttgtgtgcctctttgttgtttcaagtgatttgagtacttgtcatcagcaacatgctcatgatattgctttattgaatgtttgagcacaatatttttataatctaaaatcatagaccctttttgtagttaaaaaaagaaaaaagtaccgact

SEQ ID NO: 3975 - DNA, 679 bp, Brassica juncea
aaactaaaagtccatttagaaactatttcgggtggagaaaacccgaagaaccgtggagggaggattgaatcggagtgaatcaaagggaaagaggaggagattggaaatggcgtcgggatggggaataacggggaacaaagggagatgctacgatttttggatggatttcagcgaatgtatgtctcactgcagagagcccaaggactgctctcttctccgtgaagattacctcgagtgcctccaccattccaaagagtttcaaagaagaaacaggatctacaaggaggagcaacgtaaactaagggcagcctctaggaaagatgaacaaggtgtggatggtactcatacacatcactagtcatcaatcctcctccaagtttgcctcttcatcccattccagccaagatgaataaatgcaagatgattttgtatctttgtttagagcagaatctcaaaaaacactggtcctttttcacttttacaaatttatcgaatgattttctgctttctttccatgttcattgtctcaactttggagttgcaaacataacttgggagacgtatgtatctatactctttgcacctgaaattatggatatctgctctacttgtcttcatttcaactctatccaaccacgaaacttaactgcttcaattttttggcgagataaaagagtcg

SEQ ID NO: 3976 - DNA, 542 bp, Vaccinium corymbosum
acaatcagcagcagcagcccacaatctaaaatcgaacagggactggagagggatggcatctggatgggggataacgggaaacaaagggaggtgctatgatttctggatggacttcagcgagtgcatgtctcgttgcagggaacccaaggactgctctcttcttagagaagactatctcgagtgtctccaccattccaaagagttccagcgtaggaatcgaatttacaaggaggagcagcgtcaactgagagcagctgcgcgaaagggcaaggaaggtggagatgctgccgttcatagtcattaaaagagttgtgattgaactattttttgcttccaggaataagaatgcataactcagcttttaagcttaaacgggattcgttgctatctgcaaaaacggcaaggaaaatttggctgccttgcatgtggacaccagtggtgctattactggtgaggcattgactgtatcatgtaaacgcccttttttggttttgttcaactgctgatgcgatggtgaaccaaccttgttttgcttcctattc

SEQ ID NO: 3977 - DNA, 541 bp, Flaveria ramosissima
tgggaggcccataatctggtgattggtgaagacaggtgaagattgaccatcatcgtcaaccttggttaggttcagaagcagattgtaaggtcaaagtcaaaatcaatggcgtctggatgggggataacggggaacaaggggcgatgctacgacttctggatggatttcagcgagtgtatgtctcgttgcaaagaacccaaagactgctctcttctccgtgaagattatctcgagtgtcttcaccactctaaagagtttcagcgacgaaaccgaatctataaagaggaacaacgtcagattagagctgctgcgcagaatgcaaaaggtggagatggagatggagttcctcatcattagtgtaaattttttaaaatgtccggtttataataatggttgaagcgtgcaatcaatatatttcctgaaatttggtgcaattttgtatgcctctttgttgttccaagtggttgagtagtacatgtcatcagcaacatgctgctcatgatactgttaaattgaattttgaatgcacttttataaggtt

SEQ ID NO: 3978 - DNA, 777 bp, Mimulus guttatus
atccgtaaagaacgaggcacgcacgcaacaacccccaaattcagagtccaacagagcagtagtctagagatagaaattagagagctcgagagaaacaggtaaaatggcgtcgggatgggggataaccggaaacaaggggcggtgctatgatttctggatggatttcagtgaatgcatgtcccgctgccgcgagcccaaggattgcacactcctccgtgaagattatttcgagtgtctcaaccattccaaagagtttcagcgcaggaaccgagtctacaaagaggagcagcgtcaactgagagcagctgcagagaaggccaagggaggtggggttgatgttcatcactgagaatcattacttttatcttcgttcgattgagtgaaaataggggttggaagtaatttgttttcttcgatctttcttgaaaataaaaaaaaacacgaagcagttgtatttatgtgctgtggaatgttgaatacaagaatgtatttcgcagcttgaagaatggatatttgccggaaaaaacccgaccaggtgtatgttttttgttgtatggatacttgccatttgttctggcactgagagatgcttttgtttgttcactttgttaaccttaactcgtttgaagattctctgtcacaaatataattttgtggtaccaaattttcattaaaaaggggataattacagtttttatccctcaagttgcacccatttcacatttggtcccccatgttcacaaaacatacgtttaataattcatgtttcaataatct

SEQ ID NO: 3979 - DNA, 794 bp, Mimulus guttatus
cctggatcggcaccatccgtaaagaacgaggcacgcacgcaacaacccccaaattcagagtccaacagagcagtagtctagagatagaaattagagagctcgagagaaacaggtaaaatggcgtcgggatgggggataaccggaaacaaggggcggtgctatgatttctggatggatttcagtgaatgcatgtcccgctgccgcgagcccaaggattgcacactcctccgtgaagattatttcgagtgtctcaaccattccaaagagtttcagcgcaggaaccgagtctacaaagaggagcagcgtcaactgagagcagctgcagagaaggccaagggaggtggggttgatgttcatcactgagaatcattacttttatcttcgttcgattgagtgaaaataggggttggaagtaatttgttttcttcgatctttcttgaaaataaaaaaaaacacgaagcagttgtatttatgtgctgtggaatgttgaatacaagaatgtatttcgcagcttgaagaatggatatttgccggaaaaaacccgaccaggtgtatgttttttgttgtatggatacttgccatttgttctggcactgagagatgcttttgtttgttcactttgttaaccttaactcgtttgaagattctctgtcacaaatataattttgtggtaccaaattttcattaaaaaggggataattacagtttttatccctcaagttgcacccatttcacatttggtcccccatgttcacaaaacatacgtttaataattcatgtttcaataatctaac

SEQ ID NO: 3980 - DNA, 804 bp, Glycine max
cggcggcagaggctgaaaggggtttgaagttggaagaaggagtgagatcagaggaagggaggaggcattaggtgtagaaagagcgaaagagagagagatggcgtcggggtggggaatcacaggaaacaaaggtcgctgctacgatttctggatggatttcagcgagtgcatgtctcgctgccgagagcccaaggactgtgctcttctccgcgaagactacctcgagtgcctccaccattccaaggagtttcaacgacgaaaccgaatttacaaggaggagcagcgcaaactaagggctgcttccaggaaaggccaggaggatggggttaatgaacatcatcattagcacctgaagttaattttcaatttaagcttctgaacaattatttttgataaaacgtttgtgatttgcttggatcggtattcctgcatgttctgtgagcccatattttatactttgatgttgcgggcttgttttccctgtgcaataaattcagaaatcaacctggggctgcaaattacactataagtttgctgagtgaatttggtaaatgtctttgagatgcaaacatgggttaaaaggattggaattctcaaaatgaaaaagatcaacagattcaaatcttgattgtgaggaagagtgagggactacatttctatttctaaaaaaaaatacatcaaaatcaatttgatctttttcttcttttaggaacaacggattaaggctaaatcttcctatgctcttcgtgattattatcaaggattatgctttatatctctaattgaacagcaatgggtttattg

SEQ ID NO: 3981 - DNA, 827 bp, Glycine max
aaggtggtaatttggtaatttagcggcggcagaggctgaaaggggtttgaagttggaagaaggagtgagatcagaggaagggaggaggcattaggtgtagaaagagcgaaagagagagagatggcgtcggggtggggaatcacaggaaacaaaggtcgctgctacgatttctggatggatttcagcgagtgcatgtctcgctgccgagagcccaaggactgtgctcttctccgcgaagactacctcgagtgcctccaccattccaaggagtttcaacgacgaaaccgaatttacaaggaggagcagcgcaaactaagggctgcttccaggaaaggccaggaggatggggttaatgaacatcatcattagcacctgaagttaattttcaatttaagcttctgaacaattatttttgataaaacgtttgtgatttgcttggatcggtattcctgcatgttctgtgagcccatattttatactttgatgttgcgggcttgttttccctgtgcaataaattcagaaatcaacctggggctgcaaattacactataagtttgctgagtgaatttggtaaatgtctttgagatgcaaacatgggttaaaaggattggaattctcaaaatgaaaaagatcaacagattcaaatcttgattgtgaggaagagtgagggactacatttctatttctaaaaaaaaatacatcaaaatcaatttgatctttttcttcttttaggaacaacggattaaggctaaatcttcctatgctcttcgtgattattatcaaggattatgctttatatctctaattgaacagcaatgggtttattg

SEQ ID NO: 3982 - DNA, 509 bp, Eutrema halophilum
gaaatggcgtcgggatggggaataacgggaaacaaagggagatgctacgatttctggatggatttcagcgaatgtatgtctcactgcagagagcccaaggattgctcgcttcttcgtgaagattatctcgagtgtctccaccattccaaagagtttcaaagaagaaacaggatatacaaggaggagcagcgtaaactaagagcagcctcgaagaaaggtgaagaaggcggggatgggactcatacccatcactagtcaacaatacccctccagatttgcatcttcatcccattccagacaagaataaatatggttcatggaagattttgtatgtgtttcaacacagaatcccaaaaaacccttttattgtttttctcagtttgcaatttatcgaatgatgttctgctttcttttcatgttcattgactcgacttttagatgctacataccttgaggcatatactcttttcacctgaattacggatacctgcaacaacatttgttgagtt

SEQ ID NO: 3983 - DNA, 1515 bp, Eutrema parvulum
ccgaattcttcttctctttgggttgggagagaaatggcgtcaggatggggaataacgggaaacaaaggaagatgctacgatttctggatggatttcagtgaatgcatgtctcattgcagagagcccaaggattgctcgcttcttcgtgaagattacctcgagtgtctccaccattccaaagagtttcaaagaagaaacaggatatacaaggaggagcagcgtaaactaagagcagcctccaggaaaggtgaagaaggcggggatgggactcatacccatcactagtccacaatcctcctccaagtttgcagacaagaataaataaagttcatggaagattttgtatcttgttcaaaacagattctcaaaaacgctttgatcgtttttcagtctgcaatttatccaatgatggaaggttctgatttcttttcatgttcattgtctcaactttgagttgcaacataccttgagacgtatactcttttcacctgagttattatgataatctgtaacatttattcagctataactagctccgtcctgccaggaaacttaactgcttcaattttggcaagataagattcggtcgaatcttctgtttgataacaacgattcttggaaagctcacaatgtacattggaaaccagttatagttacatcataaacaagttttgatcgatcaaacaagtccccagtcttttttatacattgttcatactcctgatggaattcttccaggtggcttcagagttcagaaacgcaacttttctcagaagtgtctgtgccagaggctagagattgtgcgatgattggagggaacagggaaatgtggaaaccaatctctctcccaagcatgaaattgatcagtttctggttcatggagtccacctgatgagctcggtggtggataaatgaagaatccaacgttttgatctggcattggtgggggtaatccccttcttgtcatggagaccagaggcggtgcaagattgggaatattggcatgatgttgcctctgatgattaaaaacttgatgctgcgtgtgaaggtgttcaagcatttgggtgctgcttccttggtgagtgttaattgctggtgaggttcttggattagacctacattgcccacataaaaaaaaaacatatcaaaacttgctgcaaaaattgagagtttattttgagagcaatatggcgctcgagaagctaaccggttactaaagagaaatgggtgtggatgagatattccccgagctactaaagagtccatttcaccatcaatcacatgaacaccgggtatagaaaacgaaggggaatgatgatgatgatactggggagcaacagagagctggtgaaagtggtcactagagtggctgttccacggatggtcatctgtgttgttactgttatcgctagttctcggagtggcggctgggcctggtccaacatatgcaagatatgaatgattcatagcagcggcgtggtgcccatggaactcattatgatctacgaaagagaa

SEQ ID NO: 3984 - DNA, 865 bp, Fagus grandifolia
aataataaaaaaataaaattgggcacaacaaattcccagcaagagagcttcactgcctcaaggccatctcaatatccacattttgaccctccaagagagcagcaaaagggaaaaaagaatggcgtcaggttggggaatcacagggaacaaaggccgatgctacgatttctggatcgacttcagcgagtgcatgtctcgctgccgtgagcccaaggactgcactctcctccgcgaagactatctcgagtgtctccaccactccaaagagttccaaaggagaaatcggatctataaggaggagcagcgtaaactacgagcagctgcacggaaggccaaagagggtgacgtgggtgttgataaccatcatcattagtccgtaattgatcatcttcttaaactcgagaataaagactgtacggagatgttgtattcataacttgttttatgttattctgtttttcttctcctggaatgttaagcacttctttggcatgtgcaattagacgaagatcaaatttgtttttctagctgcatattggacactggtattcttggtgaatctggaatatcctgttaaagggcaatttgagtaataaatccactcacactcactgcacaattgagtattgctaaatgatacttctatggtacaccatttgttgctggtgatctggtgaggtgaattttgaatcctaatatcaaaatgattttggatgtactaagagaatctgcaaggagacaagagaatggtgattgaaacagagcacaatataggattcaatgcatgccatcaggaagagaaggtatcttgtgcatccagagtatgtattatctctctctataaatatgtgtcgtttgcatcggg

SEQ ID NO: 3985 - DNA, 487 bp, Cicer arietinum
gaaaatggcgtcaggttggggaatctctggaaacaaaggtcgttgctacgatttctgggtcgacttcagcgagtgtatgtctacctgcagagaacccaaagactgtgttctcctccgtgaagattacttcgagtgccttcaccattccaaagagttccgacgaagaaaccggatttacaaggaggagcaacgccaactaagagctgcttccaagaaaggtaacagcgagggggatggggttgttagtgaacatcattaacattcgtaattatctgtcgacttaagcttctgtattttaataaaatgtttgtaatttcgcttggatcggtattcgtacaagttgtgtgagccttttttttataactttgatggggcttcttttccctgtggaataatttggaggtcaacttgctattgcaaattatatgtggagcttgctgagtgaatttggttcatttcttttgctaatatacttgggtttaaagga

SEQ ID NO: 3986 - DNA, 870 bp, Cicer arietinum
ttttaatgaataaaaaaaaaattatatgtattaaaaagtgttttgcaaacacttatcaacagtgttatatttagggattaaaccgaggatatatttggaaaaaaggaaaagagtgatggcagtatggtaatatagcattgactgaatgtggttatgaacttagaacttggaagcaaaaatcagtgagatcggcgaagcggaagaaattagttgcaggtcgagaaaatggcgtcaggttggggaatctctggaaacaaaggtcgttgctacgatttctgggtcgacttcagcgagtgtatgtctacctgcagagaacccaaagactgtgttctcctccgtgaagattacttcgagtgccttcaccattccaaagagttccgacgaagaaaccggatttacaaggaggagcaacgccaactaagagctgcttccaagaaaggtaacagcgagggggatggggttgttagtgaacatcattaacattcgtaattatctgtcgacttaagcttctgtattttaataaaatgtttgtaatttcgcttggatcggtattcgtacaagttgtgtgagccttttttttataactttgatggggcttcttttccctgtggaataatttggaggtcaacttgctattgcaaattatatgtggagcttgctgagtgaatttggttcatttcttttgctaatatacttgggtttaaaggattgaaattactgaaaaagaaaaaacggcataaaattttgagatgtagtaatttggattgtacgtagatggccattacaagtagtcggcatggacacacaataagcatgtcgtcggcaataacacaaaataagcacatcattaactgttgcatcgagatcaat

SEQ ID NO: 3987 - DNA, 714 bp, Eucalyptus grandis
cgggggagcaaaacccccccggaccacaccgccatcgccatcgtcgagctgcagacgtcgagatcgagagcgagggagggaggcagaagagagctcaggagcaatggcgtcgggctggggaatcacggggaacaaggggaggtgctacgatttctgggtcgacttcagcgagtgcatgtcgcgctgcagagagcccaaggactgcgccctccttcgcgaagactacctcgagtgcctccaccactccaaggagttccaacggagaaacagaatttacaaggaagagcagcgtaaacttcgggcagccacacaaaagactgagggcggagataaacctcacggccatcacgcatgacaggaacatgtcatctttgcaaactctgaactgaataagcacatgtatgaggatctcttatcaactggactttgtcatttgacttttctgtacactcctgattcattggagggttttgttgctttggtcgtctttgcaaaaggggaatatccgacttgtttctcgcgcaatttgaggatttgaaagttgttttatagttgattctggtcttcaaataaaagggcctttgtaggtgggagaatgtctgccttattaacatttttgacttcctttgctaggtctagagagagtatcggctttgactgaagatagaccattaagcagtgcgcgtattatgcattaaaagtcctctcaattgt

SEQ ID NO: 3988 - DNA, 526 bp, Camellia sinensis
aggaagaaagagaagagagagaaaggcaaagtttgcagagagagagagagagagagagagagagagagatggcatctggatgggggataacgggaaacaaaggcaggtgctacgatttctggatggacttcagtgagtgcatgtctcgttgcagagaacccaaagactgcgcttttctccgagaagactatctcgagtgtctccaccactccaaagagtttcaacgtaggaatcgagtttacaaggaggagcaacgtcaactgagagcagctgcacggaagggcaaggaaggtggagatattgccgggcatcatcattgatagagttgtgattgattaccttttggactttcaataataagaatgcataactcagttgtattcggtcttttttgccagctgttttcatgacctgtttttgtatctcttaaattggatttatgagtatctgcaaaacggcaaggtaaatttaactttccttgcatgtagacaccaatgacatgtgcttttgctgaggcttcaatgaa

SEQ ID NO: 3989 - DNA, 2546 bp, Ricinus communis
agggcgggtgtggatagtccgaacgttcaagtaataccccgtaaccgcaagtccatggatagctccaactctagactccggcattttggctcagcagcaagctaccaaaccacactgtactttcaccagtcatcaaaaactgaacatttgacgcaacgctacaatcggctaagctttcaatcggtgaagttcgcgagaaatggcatcaggatgggggatcacaggaaacaagggcagatgctatgatttctgggttgactttagcgagtgtatgtctcgttgcagagaacctaaggactgcggtctcctccgtgaagactaccttgagtgccttcaccactctaaagagtttcaacggagaaaccggatttacaaggaggagcagcgtaagctacgagcagctaagcaaaatagcaaggagggtggagacagcactgacaaacaccacgcatagccatagtgatgagcttctgaaattctagtaataaagaatgtgctgaggtgtatttttcttacatttgatattctaattatgttcaagtgattctgttgttcttttattcagaatggagatgtgaatgtgtctttttcgtgcaataacatgaagtttagtacttcgtcgcatttatttgccagggaaaaaaatgagcagccgtgctagcaggactctttatgttgggaatcttcctggtgatattcgtgagagagaagtagaagatttattctacaagtatggacccatagctcacattgatttaaagatcccaccaaggccccctggttatgcatttgttgagtttgaggaggctcgagatgctgaggatgcaattcgtggtcgtgatggctatgattttgatgggcatcaattacgggttgagcttgctcatggggggcgtggacattcttcctcagatcgtcatagtagtcacagtggtggtggtcgtggccgaggagtttctagacgctctgaatatcgcgttctggtcactgggttaccctcttctgcttcatggcaagaccttaaggatcacatgcgccgtgcaggtgatgtctgtttctctcaagttttccgcgatggtagtggcactacaggaattgtggattacacaaattatgaagacatgaagcatgcgatcaagaaacttgatgactctgagtttcgaaatgcattttctcgtgcgtatgttcgggtgaaggaatatgactccaagcgggactcatccaggagtcctagtcgtggtcgatctcattcaagaggccgtagccgtagtcgtggccgaagttctagtcgaagcaggagccaaagcaaatctcccaaaaccaaatctacacgtcgctcacctgctaggtcaagatcaagatctgcttctcgctccgggtcaaaaccacggtctttgtcaagtgaactggggattggattaggatcttggtgggatttggttcagttcctgcatcttttttggttgtggaggtatgctgtttttcaaatgggcagctttggaaaccttcatggcatgccttgtctgatgtatttagtattataaatgtccatgggtgctagattgggaacaaaggagattatggattgcaatagtaaagctggatttcagtgaactaactgctagtggatctggaagtcaccggcaatgagcggtagaaactatgtcattatcattttccactccaacaattgccaagctaatagaacctgctagctggacgcactggattttgtggtacaatagggaagcatgcttctttcctgtccaatgggagctcgaaaacacataattacttaattaagatttttgtttctttctttaattaggtgctttgattgggtgggaattgttttaattggacctgatatttatgttctgtttttgtcttaaattgctaaagattgtggctcttccttttatccttttgaatttggtaactctgacgtggaagaggcatcaaggctcttggatgaaagttgttaaaaaggaacgtgtggattttaaatttgggttgtttctggaacttttgcagatcacgttcaagatcaagatctccacttccatctcgacagaaacggatgagtaaaagtcctaaaaaacggagtgttagccggagccctagcaggagccggagccggagccggagcttatcccggtgagatgggagagaggctaagttgtcgagacaggggaaggttgaaacgagcgtatgatgtttagacttttgcatgatgcgcgataagttattgaagggcagtcgagttgtggacaacatttgtaggcttgatgtggattcttgttttaagttcaataatttttattctgatggatttgagtggatatattaagatggattttctattatttttaaaagcctgttccccttcatttggctacctggtagttaccgcaggaaattatattatataggttaattgaattcagcaataaaaacttcttacagaattaagaatttttttaatatgatccttaaaagatatgtaattgataatcaataaaaaaatttatattattttcatatta

SEQ ID NO: 3990 - DNA, 501 bp, Antirrhinum majus
  misc_feature (25)..(25): n is a, c, g, or t
  misc_feature (30)..(30): n is a, c, g, or t
ggcgtctggatggggaattacaggnaacanaggacgatgctacgatttctggatggactttagcgaatgtatgtctcgttgccgtgagcctaaggactgttcgcttcttcgtgaagactattttgagtgccttcatcactctaaagagttccaacgtaggaaccgtgtctacaaggaggagcagcgtcaattgagagcggccgtagagaagaccaagggtggtgcagatgatggccatcattgagaagcattaccatttgcctgtcttctaacaggggaaagggaagaaaggcattactttgagaatttgttgagaaataaagaaatgaatcaattgtatttgtgttttggaatgtatgcaaaactcatatattctgcatcttcaacgctgatttttggtgccaagttgattagatatttgtttttccttgaatatggatgccttttattctgtcatatacttctggcattgaggcactgtttataattcctcgcttcttt

SEQ ID NO: 3991 - DNA, 600 bp, Arabidopsis lyrata
ggattaacctgaatagatcggatcctcggaaatcaggcgaagaagacgactaaatttctcctgggattagagagagaggaaggaaaaatggcgtcggggtgggggataacgggaaacaaagggaggtgttacgatttctggatggatttcagcgaatgtatgtctcattgcagagagcccaaagactgtactcttcttcgtgaagactacctcgagtgtcttcaccattccaaagagttccaacgaagaaacaggatatacaaagaagaacaacgtaaactaagagctgcatcaaggaaaggcgaagaaaccggggatgggactcatactcatcactagtcgagattttcctcctatctccaaagtttgcatctttcgaagaataaacaaaagtttcttgaagatttctgtatcttgtgtgccaaacttcatttgatcgtattctgtttgcttttgcaatggattttttttgtctttgctttgtctattacctttgactgagttgtaatctgcctttggctactcgtcaaacacagactccttctttaatggtaataattactcctacagttatattaaaatcattattcgagagacatt

SEQ ID NO: 3992 - DNA, 663 bp, Arabidopsis thaliana
atggatatctcgggtcatccaaaaacccgaacccgaaccattttcgatgaagttgacgaacctgtctggttttgttgcgttcttccgatttgggttggagaggaaatggcgtcgggatggggaataacgggaaacaaagggagatgctacgatttctggatggatttcagtgaatgtatgtctcactgcagagagcccaaagattgtacccttcttcgtgaagattacctcgagtgtctccaccattccaaagagtttcaaagaaggaacaggatatacaaggaggagcagcgtaaactaagagcagcttcgaggaaaggtgaagaagccggagatgggactcacaaccatcactagtctcaacaatcctccttcaagcttcatccgattccagagaagaataataaaaggttcatggaagattttgtatcttggaatctctaaacgctttgattgtttttcagttttcaattttatccaatcatgttctgctttctttttatgttaaatcgtctctttgagacgtatacttttccacctgaattatggacatgtggattgtggatcatttacttcttcactattactccatccaaccaggaacaatggcaacattttgtcgataacttgtgtttaattaattataacaattgttcttggaaa

SEQ ID NO: 3993 - DNA, 599 bp, Arabidopsis thaliana
ggattaacctgaatagatcggatcctcggaaatcaggcgaagaagacgactaaatttctcctgggattagagagagaggaaggaaaaatggcgtcggggtgggggataacgggaaacaaagggaggtgttacgatttctggatggatttcagcgaatgtatgtctcattgcagagagcccaaagactgtactcttcttcgtgaagactacctcgagtgtcttcaccattccaaagagttccaacgaagaaacaggatatacaaagaagaacaacgtaaactaagagctgcatcaaggaaaggcgaagaaaccggggatgggactcatactcatcactagtcgagattttcctcctatctccaaagtttgcatctttcgaagaataaacaaaagtttcttgaagatttctgtatcttgtgtgccaaacttcatttgatcgtattcagtttgcttttgcaatggatttttttgtctttgctttgtctattacctttgaccgagttgtaatatgcctttggctactcgtcaaacacagactccttctttaatggtaataattactcctacagttatattaaaatcattattcgagagacatt

SEQ ID NO: 3994 - DNA, 533 bp, Brassica oleracea
gagagcatcaaatcaaatggcgtcgggatggggaataacggggaacaaagggagatgctacgatttctggatggatttcagtgaatgtatgtctcactgcagagagcccaaggactgctctcttctccgtgaggattacctcgagtgcctccaccattccaaagagtttcaaagaagaaacaggatctacaaggaggagcaacgtaaactaagggcagcctctaggaaaggtgaacaagttgtggatggtactcatacacatcactagtcaccaatcttcctccaagtttgcttattcatcaccattccaatccagacaagaagaagaataaatccaagattttgaatcttgtttagagcagaatctcaaaaaacactggtcgtttttcaaatttatcgaatgatgttctgctttcttttttcatgttcatttgtctcaactttggagttgcaaacataccttaagagacgtgtatgtatacgcttttcagacacctgaaattatggatatctgctctacttttattcagttc

SEQ ID NO: 3995 - DNA, 598 bp, Castanea mollissima
ctggtaccctcgagcccatctgaaatccacattttgagaccgacgactgagcagcaaagagagagagaagaaaaaaaagaatggcgtcaggttggggaatctcaatgaacaaaggccgatgctacgatttctggatcgacttcagcgagtgcatgtctcgttgccgtgagcccaaggattgtactctcctccgtgaagactatttcgaatgtctccaccactccaaagagttccgaagaagaaatcggatctacaaggaggagcagcgtcagctccgagcagcttcacgaaagggcaaagatggtgaagagggtggtgataaacatcatcattagtctgaaattgatcatcttcttaatctcgagaataaagactgaggagatgttgtattcataacttgttttatgttattctgcttttcttctcctggaatgttatgcacttctttggcatgtgcaatgagactgagataaatttgttttgctagctgcgtattggacactgattttcttggtgtatctggagtatcctgttaaagggcagtttgagtaataaatccactcacactcactacaaattgagtattgacaaaaaaaaa

SEQ ID NO: 3996 - DNA, 381 bp, Carpinus betulus
atcaataaccaggtagaaggccaccacaaatcacattgagagagggcaaggcgagaatggcgtcagggtggggaatcacagggaacaaaggccgatgctacgacttctgggtggacttcagcgagtgcatgtctcgctgccgcgagcccaaagactgcactctcctgcgcgaggactatctcgagtgcctccaccactccaaagagttccaacgaagaaatcgaatatataaggaggagcagcgtaaactgcgagcagctgcacggaagggcaaagagggtggagagggcattgatacccatcatcactagtccgtagttgatcatcttcttagactttgagaataaagattgttcggagatgttgtattcataacttgtt

SEQ ID NO: 3997 - DNA, 549 bp, Orobanche aegyptiaca
taaacgcccaaattatattacagtcaaactgaacaaccctagtcagcgaaagctcgaaatacaggtgaaaaatggcgtcgggatggggtataacgggaaacaagggccgctgctacgatttctggacggactttagcgagtgcatgtcccgttgtcgggagcctaaggattgcgggctccttcgtgaggattattttgagtgtctcaaccactctaaagagtttcaacgcagaaatagagtctacaaggaggagcagcgtcaactgagagcagctaaagagaaggccaagggaggcggacatgatgttcatcattgaggatcattattatttttcgttttggttatcttcgaactttgttgaaaataatgaaagacctaagttgtatttacgtgttgtgcaatgttgaatacgagaatatatctgcaacttcaagaaacgggatgtctgggtaaaaacaaacaatgagatgtatgttccgtatgtatgatgtgttgtcattcgtcatttgcgttatgacattcctttgtttggtttgttcactttgtga

SEQ ID NO: 3998 - DNA, 686 bp, Salvia sclarea
ctactagaccttggctgtcactcaaaaaatccaaactttacaaccctagagagagaaagcttgaggaagaggggaaaatggcgtctggatggggaatcacgggcaacaagggccgatgctacgatttctgggtcgatttcagcgaatgtatgtcaacttgccgcgagcctaaggactgcggtctcctccgggaagattatttcgagtgtctccaccactctaaagagttccaacggaggaaccgagtctacaaggaggagcagcgtcagctgagagcagctgctgataaggccagtggaggtggcgataaagggcatcattgagaattgcttttcagcggagccaaaggagtgatgggaagtaattgattttcttcaaaactgtctgaaataaaacataaatgagttgtatttatgtgttatcagatgttaaatacaaatgaagcactcaaagcatctttgaaatgggactcttggtgcagtaacaactgctatatgttttgttgctgggcatgtatttcttgccatttgccctatctgtgtgggctgatattgttttagctcactttgtcaagctagcttgctttacactttgtgcttaattgattgatttaagtgttcatgcttgctggcatgggtggtctatgtctgtgtttgggagattcgcagtgagtgacaggctagtag

SEQ ID NO: 3999 - DNA, 566 bp, Sesamum indicum
atggcgtcgggatggggaataacggggaacaagggccgctgctacgatttctggatggacttcagtgactgcatgtcccgctgccgggagcccaaggattgcgcactcctccgtgaagattatctcgagtgcctccaccactctaaagagtttcaacgcaggaaccgagtctacaaggaggagcagcgtcaactgagagcagcttcagagaagggcaagggaggcatagatgatgttcatcactgagaaacattattatttctcttcgtttcaaccgagtgaaaagaggaatgaactaaatgattttcttcaaacattgttggaaataagaaatgaatcagttgtatttacgtgttgtgcaatgtcaagtacaaggatgtttttccgcatctgccaaatgcgaggtttggtgcaaaaagagtgagatgcatgtttccttgcatatgatgatgattgggctatttgtcactggcattgaggcttttttcttaattgtttctcctctccgcgttgtcgaccttttcttcttcgaacgcaagtttctcaagtagatttttattgtgaaa

SEQ ID NO: 4000 - DNA, 522 bp, Eutrema halophilum
ttgtcttggatttagattgggagaaaaatggcgtcggggtggggaataacgggaaacaaagggagatgttacgatttctggatggatttcagcgaatgtatgtctcactgcagagagcccaaggattgttcacttcttcgtgaagactacctcgagtgtcttcaccattccaaagagttccaacgaagaaacaggatatacaaagaggaacagcgtaaacttagagcagcttcaaggaaaggcgaagaaaccggggatggcactcatactcatcattaaattgacaaccatcctccttcaagtttgcatctttcgcagccaggaagaagaataaaaaaggttcttgatgattctgtatcttgtgccaaacttcatttgtgattgttttatgtttgcttgctctgtttgttttttccttgtctattactttttgactgagttgtaatttacctttggctgtttgtcaaacacagacttcttctttcatggaattaattatcttacaggtatattaaaatctta

SEQ ID NO: 4001 - DNA, 444 bp, Panax ginseng
ggggggagacagagatggcgtcgggttggggaataacagggaacaaaggaaggtgctatgacttttggatggacttcagcgagtgtatgtctcgttgcagagaacccaaagactgcggtcttctccgtgaagattatctcgagtgtcttcaccattccaaagagttccaacggagaaaccgggtttacaaagaggagcaacgtcaactaagagcggctgcacaaaaagcaaaagggggaggtggagataaagctcagaaccactagtattatattttacttttaccctcgaggagtttccaataatgattgagttgtgcaatctaatttgacaaagatttagtaagatattaaactcagtgcttttttgttgttccgaaaggagtgaatgtcttgttatagtccaatatttgcaacatattgttatatatactttgtttatggc

SEQ ID NO: 4002 - DNA, 624 bp, Populus trichocarpa
acttgtatgaaaagcccaaacccgcttataacaccagtgagttgatgggtagctccacttatgaattggactttgtgttctagcagttgagggcagcacaaaatactcccttcgtcaataacatcatcggatagatcatcgagtagagcgaggcagagccaaggaagaaatggcatccgggtggggaatcacaggaaacaaaggcaggtgctacgatttttggatggatttcagcgagtgcatgtctcaatgcagagaacccaaggactgcgctttcctccgtgaagattacctcgagtgcctccaccactccaaagagttccaacgaagaaatcgaatttacaaggaggaacagcgcaaactaagagctgcttctcagaaagcggacggaggagatggcaaagataaccatcattgatagccaaaattgatcgtctttttgaattctagcaataagactgatgtggagatgtttgaacttttgtcatgttgtttaaattgactgttctttttatcccaaaatggaattgatttgagcactttgtgtttgtgcaataaggtgaaaattggtgctttgtgacattgatttgctaagtgaatgaatctcggtatctagggttgaag

SEQ ID NO: 4003 - DNA, 821 bp, Populus trichocarpa
gcctccattggaccactactcttctattccttcaaggccacaaatggttctggaccactggtaggagtatcaggacttgtatgaaaagcccaaacccgcttataacaccagtgagttgatgggtagctccacttatgaattggactttgtgttctagcagttgagggcagcacaaaatactcccttcgtcaataacatcatcggatagatcatcgagtagagcgaggcagagccaaggaagaaatggcatcagggtggggaatcacaggaaacaaaggcaggtgctacgatttctggatggatttcagcgagtgcatgtctcaatgcagagagcccaaggactgcgctttcctccgtgaagattacctcgagtgcctccaccactccaaagagttccaacgaagaaatcgaatttacaaggaggaacagcgcaaactaagagctgcttctcagaaagcggacggtggagatggcaaagataaccatcattgatagccaaaattgatcgtctttttgaattctagcaataagactgatgtggagatgtttgaacttttgtcatctggtacttcaaggttgtttaaattgactgttctttttatcccaaaatggaattgatttgagcactttgtgtttgtgcaataaggcgaaaattggtgctttgtgacattgatttgctaagtgaatgaatctcggtatctagggttgcagtgcatttccacccgcatgcaagtatgtacaagaagcatttttatgcaggattttagaactccttttgtgatcccttcttttccttcaaggtttttacattgtttccgcaa

SEQ ID NO: 4004 - DNA, 854 bp, Ricinus communis
ctccggcattttggctcagcagcaagctaccaaaccacactgtactttcaccagtcatcaaaaactgaacatttgacgcaacgctacaatcggctaagctttcaatcggtgaagttcgcgagaaatggcatcaggatgggggatcacaggaaacaagggcagatgctatgatttctgggttgactttagcgagtgtatgtctcgttgcagagaacctaaggactgcggtctcctccgtgaagactaccttgagtgccttcaccactctaaagagtttcaacggagaaaccggatttacaaggaggagcagcgtaagctacgagcagctaagcaaaatagcaaggagggtggagacagcactgacaaacaccacgcatagccatagtgatgagcttctgaaattctagtaataaagaatgtgctgaggtgtatttttcttacatttgatattctaattatgttcaagtgattctgttgttcttttattcagaatggagatgtgaatgtgtctttttcgtgcaataacatgaagtttagtacttcgtcgcatttatttgccaggtaaacacttatggtatgtcgagtaaagaggctacatagtcacacatatgcagactgcaattatatgtgaaattctagatatccttcgggatagtgcttttcttcagaccggggtgattgaacccgagattactgttcactggctcctctaaagatggattgatatcttattttcatgttgggattgcaggagtgagattgtccgctgtgcatccctaaattataagttctcttttcatttatcatcgagataattttgcgtcatttttctcatgctctcgactcctggtttt

SEQ ID NO: 4005 - DNA, 602 bp, Elaeis guineensis
accgagtcgagcaccagaggagtggggagagagcgaccaagaggactcacagagaggagaaagaagagaggatggcgtcggggtggggtataacggggaacaagggacggtgctacgatttctggatggacttcagtgagtgcatgtcccattgccgcgagcccaaggactgctccctcctccgcgaggactacctcgagtgtctccaccactccaaagagttccaacgaagaaacagaatttataaagaggagcaacgtcaaatcagagcagctgcaagaaaggccaagggggaagctgaagagggtggtgcaaacactcaccattagcagtcatcacgagtatctactacgaagctgaggactaaatcttgagcagatactttgtgttttaatgtttcatgtgatatgattggctgatgcaaaggccaaggtaataatcataataacctgaatgaggatatcattttgttttaaatttggtctgattgtcagtgcggattatgaaaatttttcttttgactgctcatgctcttttggctgttcatctttgacatgcagaacgttacaatgatatacacggttgcatgtcttgccaagttt

SEQ ID NO: 4006 - DNA, 534 bp, Sarracenia psittacina
ggagagtgagtgggtgagagagatggcgtccggatgggggataactggaaacaaaggcaggtgttacgatttctggatggacttcagtgagtgcatgtctcgttgcagagagcccaaggactgcgctcttctccgagaagactatctcgagtgcctccaccactccaaagagttccaacgtcggaatcgaatttacaaggagcagcagcgtcaactgagagcggctgctcggaatgccaaggaaggtggagatgttgccgagcatcatcattgatagagttgggatttatcatgtttttggacattcaacaataagattatgcataactcagttgtatttggtgttttttctggcatgattgtttacgtgacctcgtttttgcccgtcttgaatggaatttgttggcatcgcaaaatatcgaggtagttctgtctccttgcatgtggacaccaataatcatatgttgtgttgacagtgttaaggcattgattttatcatgcaaaccaattttttagtgtgaagtgagtctacaa

SEQ ID NO: 4007 - DNA, 662 bp, Phaseolus vulgaris
ataaaaacagagagggcaaagagagagacggtggtagtttggtaatttaggcgtggtagaaggcaaggagggtttgaagttggaggaagcagtgagatcagagagagcgagagagaatggcgtcggggtggggaattacaggcaacaaaggtcgatgctacgatttctggatggatttcagcgaatgcatgtctcgctgcagagagcccaaggactgcgctcttctccgcgaagactacctcgagtgcctccaccattccaaagagtttcaacgacgaaaccggatttacaaggaggagcagcgccaaataagggttgctgccaggaaaggcaaggatgaaggagttggtaatgatcatcattagcacccgtcaaggttttcaatttaagcttctgaacaattattttgttaaaacggttgtaatttgcttggatccgtattcctgcatgttctgtcagcccttattttatagttgagtttgcgaacttcattttccctgtgcaataaatcagtggccaacttgggactgcaagttagactataagtttgcctagtgaaatgcaaacatgctggctaatgattgaaatccacgaaatgaaaatacaaacagctgaaaattttattttggcttacataatcattttttccgtttgtgaacttg

SEQ ID NO: 4008 - DNA, 579 bp, Aquilegia formosa
gcttcagtgcttttttcgaagaagaagaagaaggagagagagaaagagaaagagaatcatcaatcaatcaatcaatcaatcaatggcatcaggttggggaataacaggaaacaaaggaagatgttatgatttctggatcgatttcagtgattgtatgtctcgttgtagagaacctaaagattgtgttcttcttcgtgaagactatcttgaatgtcttcaccatgccaaagagtaccagcgaaggaaccgtatttacaaagaggagcaacgacagataagagctgcagctcggaaggcaaaagaaggtgacagtggtgttgagaccaaagtgcattaacgcaaagacataattcatcatcttttggcctgagaataaggattgtttttgcatggaagtggaaacttgttgtgtattgttttccagctcaactgcctttccctgcagtcaaatcagctgtaattttcttggtttctggagacattaattttctagttgcatgggcaaccatccatctatctcctatatgtttggtgagacctctgtgtttttatgttgaattttcatcaggtatattcttc

SEQ ID NO: 4009 - DNA, 355 bp, Arabidopsis lyrata
agacgacgaaatttctccaggatttgggattcgagagagagagtgagaaaaatggcgtcggggtgggggataacgggaaacaaagggagatgttacgatttctggatggatttcagcgaatgtatgtctcattgcagagagcccaaagattgtacacttcttcgtgaagactacctcgagtgtcttcaccattccaaagagttccaacgaagaaacaggatatacaaagaggaacaacgtaaactaagagctgcttcaaggaaaggcgaagaaaccggggatgggactcatactcagcactagtcagagaatttttctcctatctccaaagtttgcatctttagcagacgagaag

SEQ ID NO: 4010 - DNA, 603 bp, Brassica rapa
gggtcgttagtaatcaggtgaagaagaagaagtctcctcagatcgggatcaggtttgtggattgggaaagagagagatggcgtcggggtggggaataacgggaaacaaggggagatgttacgatttctggatggatttcagcgagtgtatgtctcactgcagagagcccaaggattgctctcttcttcgtgaagactacctcgagtgtctccaccattccaaagagttccaacgaagaaacaggatttacaaagaggaacagcgtaaactaagagctgcttcaaggaaaggtgaagaaactggcgatgctactcatactcatcactgatcaaagtttttttctccttctactcctccaagtttgcatctctcgcagctgagaagaagaagaataaggaagattctatatgttgtgtgtcaaactccattttgagttttttttttcagtttgcttttgccttctctatttttttacctttggactgagttgtaatatgggcttttagccttcactcacaaaaacaacttctttctttgcaataatttaaaacagactagtggatggaataatgaaatggtccattgactttctcttcgtcgtct

SEQ ID NO: 4011 - DNA, 651 bp, Phaseolus vulgaris
gagggcaaagagagagacggtggtagtttggtaatttaggcgtggtagaaggcaaggagggtttgaagttggaggaagcagtgagatcagagagagcgagagagaatggcgtcggggtggggaattacaggcaacaaaggtcgatgctacgatttctggatggatttcagcgaatgcatgtctcgctgcagagagcccaaggactgcgctcttctccgcgaagactacctcgagtgcctccaccattccaaagagtttcaacgacgaaaccggatttacaaggaggagcagcgccaaataagggttgctgccaggaaaggcaaggatgaaggagttggtaatgatcatcattagcacccgtcaaggttttcaatttaagcttctgaacaattattttgttaaaacggttgtaatttgcttggatccgtattcctgcatgttctgtcagcccttattttatagttgagtttgcgaacttcattttccctgtgcaataaatcagtggccaacttgggactgcaagttagactataagtttgcctagtgaaatgcaaacatgctggctaatgattgaaatccacgaaatgaaaatacaaacagctgaaaattttattttggcttacataatcattttttccgtttgtgaacttg

SEQ ID NO: 4012 - DNA, 557 bp, Cleome gynandra
gtccgagaaattcttctatccagttgatttcacatcatctgcgatctatttgatcgagagaacatggcgtcgggttggggcatcacggggaacaaagggagatgctacgatttctggattgatttcagtgaatgtatgtccaattgcagacagcccaaggactgcgttctccttcgcgaagactatctcgagtgtctccatcattccaaagagttccaaaggaggaacaggatatacaaggaggaacagcgtaaactaagagcagcttctaggaaaggggaagagagtggggacgggacgcatgaccatcattagccatgaatgaagcgtcctatatgcatcttttggcaaccatctgatcctagagaataataaaaaaggttcatgaagtttatgtatgtttgttggatacagcattttaagatactttgattgattttcagtttggtctgcaatggatattctgttgtttcttatcaactcccactatgtcttgaaatgtttctgacttgggttgtgatcagacacatacttcgttcatggtgaataaaaaaaaa

SEQ ID NO: 4013 - DNA, 509 bp, Cleome spinosa
gacgaataagtctgagctatttttcacatctcgtgcgatcgggagaaaatggcgtcgggttggggaatcacgggaaacaaaggaagatgctacgatttctgggttgatttcagcgaatgcatgtccacttgcagacagcccaaggattgtgccctccttcgcgaggactatctcgagtgtctccaccattccaaagagttccaacggaggaataggatatacaaggaggaacagcgcaaactaagagcagcctctaggaaaggcgaagagggaggggacgggacaaatgctcatcactagccatgaccgaagcctccttcctatatgcatctcccacaaaccatccgattcctgagaataataaaaaggtttgcgaggattttgtatgttgttggagacagatactttgatcgttttcagttttctctgcattggatattctgttgtttcctgtccactcgtgatttgccttgtcttgggctgtgatcagacgcatacttccttcatgg

SEQ ID NO: 4014 - DNA, 600 bp, Vigna unguiculata
taatttagggttggtagagggcgaagagggtttgaagttgtaagaagcagtgagatcagagagcgagagagagagagagagagaatggcgtcaggatggggaattacagggaacaaaggtcggtgctacgatttctggatggatttcagcgaatgcatgtctcgctgccgagagcccaaggactgtggtcttctccgagaagattaccttgagtgcctccaccattccaaagagtttcaacgacgaaacaggatttacaaggaggagcagcgcaaaataagggctgctgccaagaaagacaaggatgatggggttgctaaggaacatcattagtacccgttgtcaagattttcaacttaagcttctgaacaattattttgttaaaacttttgtaatttgcttggatcggtattcctgcatgttctgtcagcccatatttttacttgagtttgcagacttcatttttcctgtgcaataatccaaaggtccacttggaactgcaatttagactataagtttgctgagtttggtaaatgtcttttgaaatgcaaacatccacgaaatgaaaatatctaccgcataaaactttatttgggtttg

SEQ ID NO: 4015 - DNA, 613 bp, Epimedium sagittatum
catcaaacaaacaaaatcttcgatcgagtcgagaccaaaatcagaagggagaaagagagaaggaagaaagggatggcatcaggttggggaatcacaggtgacaaaggaagatgctacgatttctgggtagatttcagtgagtgtatgtctcgttgcagagaacccaaagactgtgttcttctcagagaagactatctcgaatgtcttcaccactccaaagagttccagcgccggaaccgagtttacaaggaagagcagcgtcagattagagcagctgctcggaaggccaaagaaggtgacacgggcggtcagagtgttcctcattagcaactgagattacttgttttatctttgttggatttgagaataaagtctgcttgcattttgatgtggaatgatacagttgatttgttcttgcacttttgcttgtgaattagcaacttaatttcaacttctattggcatttggaagacccacctatccgtatcagatctctgttgtagctttcattgttttgttcttcttgtagcactcgtcaattgagtttttacgctccttaccttgaatatatacaagggaaatgaggttttagtaattacaatgatgatgttgg

SEQ ID NO: 4016 - DNA, 573 bp, Euonymus alatus
gccaaattcgccaaacaaaacaggcggccaggccatttctgttcacattcatagttcgagggagactactatcgcgagagagagagcgagcgatggcatccggttggggaatctccgggaacaaaggcagatgctacgatttctggatagacttcagtgagtgcatgtctcgttgccgtgaacccaaggactgttttctcctccgtgaagactacctcgagtgcctccaccactccaaagagtttcaacgaagaaatcgcatttacaaggaagagcagcgtaaggttagagcagctgcgcggaagggcaaggaaggtggagatggtattgataaacaccattagctgtaatcaatttacctttcaaaagttctactaataaagaatatttgaagatgtatttgtctggactcgtattttgacttgttcaagtgacattatatttgtttaccctgtgatggatgtgggcggttttggtttgtgcaataaggtaaaggtcaataacctctacttgtgtaaggcatatttgctgcttgagtcgaaaattatatgccttgttatgcaaattacacat

SEQ ID NO: 4017 - DNA, 352 bp, Flaveria ramosissima
gggtgggggataacggggaacaaaggccgatgctacgacttctggatggatttcagcgagtgtatgtctcgttgcagagaacccaaagactgctctcttctccgtgaagactatctcgagtgtcttcaccactctaaagagtttcaacgacgaaaccgtatttataaagaggaacaacggcagattagagctgctgcgcagaaggcaaaaggtggaggtggagatggagttcctcatcattagtgtaaaatttataatgtccggttataataatggttgaagcgtacaatcaatttattcttgaaatttggtgcaatttgtatgcctctttgttcttccaagtggttgagta

SEQ ID NO: 4018 - DNA, 590 bp, Glycyrrhiza uralensis
ggcagttggccgaaactgaagtgaaagaagggggaagctggttaggaagaatcggtgagatcagggaaagggaagagagagagagatggcgtcagggtggggaataacagggaacaaaggtcgatgctacgatttctggatggacttcagcgagtgcatgtctcgctgcagagagcccaaagactgttctctcctccgtgaagactacctcgagtgcctccaccattccaaagagttccaacgaagaaaccgggtttacaaggaggagcagcgcaaactaagagctgctgccaggaaaggtcaggaggatggggttgttaacgaacatcattagcactcgtgattaactgtcaattcttctgaacaattattttaataaaacgtttgtaatttcacttggattggttttcctgcatgtcctgtgagctttgacgtgtgggcttttttccctgtgcaaattcggaggtcaacttgcgactgcaaattaaactatgagcttgctgagtgaatttggcacatttctgttgcaaacatgctgggttaaaaggatcgaaatcctcgaaatgaaaaagatcaacagattaaaattt

SEQ ID NO: 4019 - DNA, 734 bp, Medicago truncatula
gtttggtaatttggctttgtaagaagacgaaggttgagatgattcagaagttgttgttagttggaagcaaaaaatcggtgagatcgagttgagcgaaagaaattagaataaggtgaaggtgaagaaatggcgtcaggttggggaatcactggtaacaaaggtcgttgctacgatttctggatcgatttcagcgagtgcatgtctacttgtagagagcccaaagattgtgttctcctccgtgaagattacttcgaatgtcttcaccattccaaagagttccaacgaagaaaccggatttacaaggaggaacaacgcaaactaagagctgctgccaggaaaggtcaagatgacgggaaagttgctgaacatcattagcattagtaattaattgtcaatttaagcttctgaacaattattttaataaattgtttgtaattccgcttggatcgctatttctgcgttttgtgtgagcccttcggcgggcaggcttcttttccctgtgcaataattcagaggtcaacttgcgactgcaattagacactgaactatgctgagttaatttggttattttcttttgctctgacatgcttgaggataaaggattgaaatcctcaaaataaaaaagaatcatcagataaaatggtgagatatagtgtaattatgcagtaaattttggatttctgtgaacacgagccttcaactttttttcttattaaatctttctttttaaacac

SEQ ID NO: 4020 - DNA, 555 bp, Mimulus guttatus
caaattatagttcgagcaacggcaattacagccctagagagagagagagaagagagagaggtcgagaaagaggtaaaaatggcgtcgggatggggaataacgggaaacaaggggcgatgctatgatttctggatggatttcagcgaatgtatgtcgcagtgccgccagcctaaggattgcggtctcctccgtgaagattatttcgagtgtctcaaccactctaaagagttccaaagaaggaatcgagtgtacaaggaggagcagcgtcaactgagagcagctgcagagaaggctaagggaggtggggttgatgttcatcactgaaaacggaaaagaatcgttaactttggactgggatttagtcgactttattcgacctttcttgaaaataaaaaatgtatgtatctgcattttgtggaatctctcaagtacaacaacatagtttttatttcacatcttgagaattggaattcttgctgcaaaatcaatgagatgttgtgtgtttccttgtgttttgaattggcatttaagcagtcttttggttgttcactatgt

SEQ ID NO: 4021 - DNA, 606 bp, Mimulus guttatus
aaagaaaaaaaaaaccccaaattatagttcgagcaacggcaattacagccctagagagagagagagaagagagagaggtcgagaaagaggtaaaaatggcgtcgggatggggaataacgggaaacaaggggcgatgctatgatttctggatggatttcagcgaatgtatgtcgcagtgccgccagcctaaggattgcggtctcctccgtgaagattatttcgagtgtctcaaccactctaaagagttccaaagaaggaatcgagtgtacaaggaggagcagcgtcaactgagagcagctgcagagaaggctaagggaggtggggttgatgttcatcactgaaaacggaaaagaatcgttaactttggactgggatttagtcgactttattcgacctttcttgaaaataaaaaatgtatgtatctgcattttgtggaatctctcaagtacaacaacatagtttttatttcacatcttgagaattggaattcttgctgcaaaatcaatgagatgttgtgtgtttccttgtgttttgaattggcatttaagcagtcttttggttgttcactatgtgaatcttatgattccttttttttttttttttttt

SEQ ID NO: 4022 - DNA, 657 bp, Quercus alba
acccacaacaattaccaggttgagctttacccattactggtatcctcgagcccatccgaaatccacattttgagaccgacgactgagcagcacagagagaaaaaaagaatggcgtcaggttggggaatctcaatgaacaaaggccgatgctacgatttctggatcgacttcagcgagtgcatgtctcgctgccgtgagcccaaggattgtactctcctccgtgaagactatttcgaatgtctccaccactccaaagagttccgaagaagaaatcggatctacaaggaggagcagcgtcagctccgagcagcttcacgaaagggcaaagatggtgaagagggtgttgataaacatcatcattagtccaaaattgatcatcttcttaatctcgagaataaagactgtgaggagatgttgtattcataacttgttttatgttattctgcttttcttctcctggaatgttatgcacttctttggcatgtgcaatgagactaagatcaatttgttttgctagctgcgtattggacactgattttcttggtgaatctggaatatcctgttaaagggcagtttgagtaataaatccactcacactcactacaaaaaattgagtattgctaaacggtacttttatggtaccttgtgttggtgatt

SEQ ID NO: 4023 - DNA, 468 bp, Primula obconica
accgaaaggttggtgggtagggggatggcgtcagggtggggaataacggggaataaagggcggtgttacgatttctggatggatttcagcgagtgtatgtctctttgcagagagcccaaagactgctctctcctccgtgaagattatctcgagtgccttcaccactccaaagaattccaacgcaggaatcgaatctataaggaggaacaacgccagttgagggcagctgctcgaaagaaggaaggcgggaatgtcgagtcccatgatcagcattgagaatattttggtttgatcctctttcaaaaacttgcaggaataaaagaatttaccttcacttgaatttgttgtctatggcgatttgcccaactgagccttttcatatggtatccttgtaagggatttctcgtctcagattcactgaaccttggatatagatgcctcttgtggtattctttttaatgatatact

SEQ ID NO: 4024 - DNA, 585 bp, Raphanus sativus
gagaggatcaaatcgggaacaggagagagagagagagagagatggcgtcggggtggggaataacggggaacaaggggagatgttacgatttctggatggatttcagcgagtgtatgtcacactgcagagagcccaaggattgttctcttcttcgtgaagactacctcgagtgtctccaccattccaaagagttccaacgaagaaacaggatatacaaagaagaacagcgtaaactaagagcagcttcaaggaaaggtgaagaaactggcgatgcttctcatactcatcactaatcaaaatatttttctccttctactccaagtatgcatctctcgcattggagaagaaagaataaggaaaagtttcgtcaagtttctgtatcttgtgtgtcaaactcccttttgattgtttccagtttgcttctgcaatcaatgttttgtctttttttgcttttcctctattttacctttggattgagttgtaatatgggcctttagcctgttcatctcacacaaacttgtttcttcatggcaataattttataatagacagagtggatgaaataatgaaatgatacatttgact

SEQ ID NO: 4025 - DNA, 753 bp, Glycine max
caacgagagagctgaggagaaattgggtgtagaaacagcgaaagagaaagagagagagagagagagatggcgtcgggctggggaattaccggaaacaaaggtcgctgctacgatttctggatggatttcagcgagtgcatgtctcgctgccgtgagcccaaggactgtgcttttctccgcgaagactacctcgagtgcctccaccattccaaagagtttcaacgacgaaaccggatttacaaggaggagcagcgcaaactaagggctgctaccaggaaaggccaggaggatggggttaatgaacatcatcattagaacctggagttaattttcaatctaagcttctgaacaattattttgataaaatgtttgtgatttgcttggatcggtattcctgcatgttctgtgagcccatattttatacttttgatgttgcgggcttcttttccctgtgcaataaattcagaagtcaacttaggactgcaaatttcactataagtttgctgagtgaatttggtaaatgtctttgagatgtaaacatgggttaaaaggattgaaattctctaaatgaaaaagatcaacaaattaaaatcttgattgtgaggaagagcgtaggactacatttctaattttacaaaaagggtggattcatcaaaatcttaagaacaatggattaaggctaaatcttcccatgctcttcgtgattattatcaaggattctgctttatctctctaattgaatatttgaatagc

SEQ ID NO: 4026 - DNA, 823 bp, Glycine max
ttttgtatagctattaaatatgaaatattcctcttttaggagcaatttgtcacatcaacgagagagctgaggagaaattgggtgtagaaacagcgaaagagaaagagagagagagagagagatggcgtcgggctggggaattaccggaaacaaaggtcgctgctacgatttctggatggatttcagcgagtgcatgtctcgctgccgtgagcccaaggactgtgcttttctccgcgaagactacctcgagtgcctccaccattccaaagagtttcaacgacgaaaccggatttacaaggaggagcagcgcaaactaagggctgctaccaggaaaggccaggaggatggggttaatgaacatcatcattagaacctggagttaattttcaatctaagcttctgaacaattattttgataaaatgtttgtgatttgcttggatcggtattcctgcatgttctgtgagcccatattttatacttttgatgttgcgggcttcttttccctgtgcaataaattcagaagtcaacttaggactgcaaatttcactataagtttgctgagtgaatttggtaaatgtctttgagatgtaaacatgggttaaaaggattgaaattctctaaatgaaaaagatcaacaaattaaaatcttgattgtgaggaagagcgtaggactacatttctaattttacaaaaagggtggattcatcaaaatcttaagaacaatggattaaggctaaatcttcccatgctcttcgtgattattatcaaggattctgctttatctctctaattgaatatttgaatagcaatgtgtttattatt

SEQ ID NO: 4027 - DNA, 560 bp, Eutrema parvulum
tttcatcacagctttggattgggagaaaatggcgtcggggtggggaataacgggaaacaaagggagatgttacgatttctggatggatttcagcgaatgtatgtctcattgcagagagcccaaggactgttctcttcttcgtgaagactacctcgagtgtcttcaccattccaaagagtttcaacgaagaaacaggatatacaaagaggaacaacgtaaactaagagcagcttcaaggaaaggcgaagaaacaggcgacgccactcatactcatcactaatcgtgaaactttcctccttctcaaagtttccatctttcacagcagccgagaagaagaataacgaaggttcgtgaagattctgtattttgtgtgtcaaactccatttcaatgttttcagtttgcttttgcaatgaatgttgcgtctttttttccttgtctattcaccttttgactgagttgtaatatggccctcggctattcatcaaacacagactccttctttcgtcgtaataattactcttacaggttggtatattaaaatctacattcgattgaaatt

SEQ ID NO: 4028 - DNA, 864 bp, Triphysaria pusilla
gaatggttatgtgaaaaataaaatggaattggacactcaccattggagatctctaacaaaggccgagtggcatcggaaaaaatatccgctcagtgacatagagaaccacacaagtccagcggattttccgacttgtggattcttttataatttgtagttaattaaattctcaccaactgcgtgtacggatggcgaaaaatattatattttcagtctctttgcatgacggatagtcatggccgcctcatctcgtattctgcaatgcctcgcagcccccaaatattgttttaatttaacccgcacgtcgtctatttcttgtttgataccctgattttttttacgtttaaatttacaattttgggaatctagggttttttaagtccaagagcttttagaaccgaaggtaaaagggagagagaaagagagctcgaaatacaggtgaaaatggcgtcgggatggggaatcacggggaacaagggccgctgctacgacttctggatggacttcagtgagtgcatgtcccgctgccgggaacctaaggactgcacactccaccgtgaggattattttgagtgtcttcatcactctaaagagttcggacgcagaaacagagtctacaaggaggagcagcgtcaactaagagcagctgcagagaatgccaaaggtcgtggagatgatggtcatcattgaggatcattatcatttctctttgtttcgaccgagcgaaagtgatggattggatcgggaagttactgattttcttcgaaatttgttgataataaaaaacaactcagttgtattgtatgtactcgttgtggaatgttgaatacaggaaaaaactccacttctttaaaaccagatttt

SEQ ID NO: 4029 - DNA, 564 bp, Triphysaria pusilla
agagcgagctcgcaatacaggtgaaaatggcgtctggatggggaatcacggggaacaagggccgttgctacgatttctggatggaatttagtgaatgcatgtcccgctgccgggagcccaaggactgtacactccaccgtgaggattatttcgagtgtctacatcactctaaggagttcggacgcagaaacagagtctacaaggaggagcagcgtcaactgagagcagctgcagagaaggctaaaggtggtggagataatcctcatcattgaggatcattatcatttctccttgtttcgaccgagtgaaagtgatgcattggattggggagttactggttttcttcgaaatttgttgaaaataaaaaatgtctcagttgtatgtacgctttgtggaatgttgaatacagtaaaacatgccacattttaaaaatgtgatattttgcaagacaatgagatgtatgttccgtttgcttatggatgcgatgccatttgctggcattagggcattcttccgtgtttgttcactttgtgaaacttccaaaacattctgattttctcaagt

SEQ ID NO: 4030 - DNA, 569 bp, Humulus lupulus
aatcacccagctccaggctaggcagagtgaccaaatcgatcccaacaccctcttattgcttgaattgagaagaaggtgttgatttcatcgagagagagagagagagagagatggcatcagggtggggaatcacagggaacaaagggcgttgctacgacttttgggttgacttcagcgagtgtatgtctcgatgccgcgagcccaaggactgtactcttctccgggaagactacctcgagtgcctccaccattccaaagagttccaacgaagaaaccggatttacaaggaggagcagcgtaaaattagagcagctgccaggaagaagaaggagggtgagaatgttgatcatcatcatgcatagcagttggtcattatcttttgaagtcaaaataatgatgaagcaagccatattgtattttttctggactagattcttacttcatgttgtggatctgttttgtttgtgctggaattggtatagacctctctggtctatgcaataaaacaaagattaatttcttttttcttgcaacagcagccgcagggtaatgaaaagtaaccctccttt

SEQ ID NO: 4031 - DNA, 581 bp, Utricularia gibba
ggcgaaaatcggagaagccccacaaagaaaggatcgtccggagtagcgtgggagcagcggaagatggcatccggatggggaattacgggtaacaagggtcgttgtcatgatttctggatggattttagtgagtgtatgtcgcgctgccgtgagcccaaggactgcaccctcctccgtgaagactattttgagtgtctccatcactcaaaagagttccagcgcaggaaccgagtttacaaagaggagcagcgccagttgagggaagctgcagagaaagcaaagggaggtggaggtgattctcataaacactgagatgatgcttccttggcccatgaccaagtttgttttttgtctttctgttgggaaataaaagaaaaacagcaaccagacttgtaggctgcaacattcccttatcttgtgactgtgaccatctacactccctgtggaatgatcctttagattgaggggtggtggagtattggtgtccatgccactgggcctcttgataacctaaatcattgccccagatcaagtttgttaaatatgggagaacgcaaagataacaaaaaaaaaaaaaacac

SEQ ID NO: 4032 - DNA, 642 bp, Amorphophallus konjac
caccgaaaagtgggaaaagggtagttccgagggagaagaggaggggtggaaggcgatggcgtcgggctgggggatcacggggaacaaggggcgctgctacgatttatggaatgacttcagcgagtgcatgtcccagtgtcgggagcccaaggactgcgccctcctccgcgaggactacctcgaatgcctccaccacgccaaggagttccaacggagaaatagaatttataaggaggaacagcgtcaaatcagagcagctgcaaggaaggacaaggagggagctgaaggtggaggtcaggcaactcatcattaacgtagtatcaacaccaccttcccatgaaaccgatgaataaactcttcactgcgtctcggtgggcaatgggatttgctttcttgttttcgttagttgtgcaaggctgtcttggctgatcgatttctcagaaaataatactctttgcttatacaactggagttattttggatatttgactatccccctctcccttagcgcaaactttgtacactgccatctttcctggattatattctgtgcctttgcactggatcttagaagttagaatgttggtttggagcatggaatgaccttgggttgttctaagatgatgtttgctggttcagtta

SEQ ID NO: 4033 - DNA, 268 bp, Manihot esculenta
gcgagaaatggcgtcaggttgggggatcacaggaaacaagggcagatgctacgatttctggattgacttcagcgaatgcatgtctcgttgcagagagcctaaggactgtgcactcctccgcgaagattaccttgagtgcctccatcactctaaagagtttcaaagaagaaatcggatttacaaggaggagcagcgtaaaatacgagcagctgcacgaaagggcaaggagagtggggatggcgttgatagccatcatgcctaaccaata

SEQ ID NO: 4034 - DNA, 562 bp, Gossypium hirsutum
gttggaaattttacagtatacaatccattttgatcgagcggacaagagaggggacaagagaggtagagaaatagtgtgatggcatccgggtggggaatcaacggtaacaaaggcaggtgctacgatttctgggtcgacttcagcgagtgcatgtcccgttgcagagaacccaaggactgtggtcttctccgtgaagattatctcgagtgcctccaccattctaaagagtttcaacgaaggaatcgaatttataaggaggagcaacgtaaattaagagctgccgcacgaaaagacaaggaaggcgaaaatggtgttcatcatcatgcatagtcataatttgtgatcctttaatttgccaataataataatgcgtggagattgttgtatttatgttgggattggtattttaactctttgctaaattaccttttggtttccctttcgttggaatggacattgttgttttctgcctgtggctgtgggagcaaagttaaattggagtgagcgaaacttttttactcaaaaaaatttcgaattttgaattaatcgaatcgaattattt

SEQ ID NO: 4035 - DNA, 624 bp, Gossypium raimondii
gtcttttcatcacttctctgcacaattaaattggaaattttacagtatacaatccattttgatcgagcggacaagagaggtagagaaatagtgtgatggcatccgggtggggaatcaacggtaacaaaggcaggtgctacgatttctgggtcgacttcagcgagtgcatgtcccgttgcagagaacccaaggactgtggtcttctccgtgaagattatctcgagtgcctccaccattctaaagagtttcaacgaaggaatcgaatttataaggaggagcaacgtaaattaagagctgccgcacgaaaagacaaggaaggcgaaaatggtgttcatcatcatgcatagtcataatttgtgatcctttaatttgccaataataataatgcgtggagattgttgtatttatgttgggattggtattttaactctttgctaaattaccttttggtttccctttcgttggaatggacattgttgttttctgcctgtggctgtgggagcaaagttaaattggagtgagcgaaacttttttactcaaaaaaatttcgaattttgaattaatcgaatcgaattattttactttttcgagtttgaatcgagttaaattttacaatttgaataa

SEQ ID NO: 4036 - DNA, 545 bp, Heritiera littoralis
gatcaaaattgaacattttacttgagtatacaatccatctgttcaagcagaccagagcagcgtggaccagacacgaagagaaagagagagatggcatctggttggggtatcaatggtaacaaaggcaggtgctacgatttctgggtcgacttcagcgagtgtatgtcccgttgcagagagcccaaggactgcgctctcctccgtgaagactatcttgagtgcctccaccattccaaagagtttcaacgaagaaatcgaatttacaaggaggagcaacgtaaaataagagctgctgcacgaaaagacaaggaaggtgaaggtggtgttcaccatcatgcatagtgataatctatgatcctttaaatttccaagaataataatgcatggagaattttgtatttttgttgggatcggtgttctaactcttttctaaattacattggtttccctttccttgtattgaatattgttgttttgagcctgtccaaagaggcagtgattatcattcatcacacatctgggtgtggcagtaacattcatttgat

SEQ ID NO: 4037 - DNA, 859 bp, Cajanus cajan
agagaagaaatggtggtagtttggtaatttaactgtggcagaaggtgaagaagggaagggggtttggaggaagcagtgagatcaaaggaattcggcgaagaaagagagaatggcgtcgggttggggaattacaggaaacaaaggtcgttgctacgatttctggattgatttcagcgaatgcatgtctcgctgccgagagcccaaggattgcgctcttctccgcgaagactacctcgagtgcctccaccattccaaagagtttcaacgacgaaaccggatttacaaggaggagcagcgcaaactaagggctgctgccaggaaaggccaggaggatggggttgttaatgaacatcatcattagcacccggagttaattttcaatttaagcttctgaacaattatttcataaaacgtttgtaatttgcttggatcagtattcctgcatgttctgtgagcccatattttatacattttgaccttgcgggcttcgtttccttgtgcaataattggaggtcatcttgggactgcaaattgctatataagtttgctgagttaatttggtaaatgtctttttaggtgcaaacatgctatgctgggtaaaggattgaaatcctcgaaatgaaaaaaaaaataatcaaaagattaaagttgttaggtgttagctaataaattttggatttttattaaaaatcctcgaaaggaaatgactctattatcagtggatcgtgctggttcaacatttaaattttattgtgtaaagatgtattttggatttcactgtattgtactgtatttattatttttggtcttagaagtttgccgaatatttattccttcctcaatgaggaaacaactaatg

SEQ ID NO: 4038 - DNA, 616 bp, Rosa hybrid cultivar
aacagagagcgaagcaaccactgaaacccaaacccccgattagtttgtgacccatcaattaatcgccgttgacgccgccgattcgagatggcttccggctggggaatcaccgggaacaaagggcgctgctacgatttctgggtcgacttcagcgagtgcatgtctcgctgccgcgagcccaaggactgctctctcctccgcgaggactacctcgagtgcctccaccactccaaagagtttcaacggaggaatcgaatttacaaggaggagcagcgtaaactaagagcagctgcacgggccaaggagggtggagttgttaatgaccatcattcgtagcagaaatcaatcctcttctgaactcgagaattaataaaatgtgtggagatcagatgttgtattttgttttttccagaccggcatttttacttgattatctgttttgtttctcctggaatgatgagtgtagcccgcgctggtctatgcaataagataatggtcactttacccttgctttgcagtagcggcaccttgtacattgaattgcttggtgtactagaatgctgtttgtgctctccagactaaaatgacttgtggaatacaaacccatttcttactt

SEQ ID NO: 4039 - DNA, 557 bp, Fraxinus spp
ccgacgtgaacaagagacgaaggttagggaaaaataccacagtcgagtatatacgacgaggacgaaaagtaggacgtagtcgggagtggggcgagtaacggggaacaaagggaggtgctacgatttctggatggatttcagcgagtgcatgtcccgttgccgggagcccaaggactgtgctctgctccgtgaagactatttcgagtgccttcaccactccaaagagttccaacgcaggaaccgagtctacaaggaggagcagcgccaactaagggcggctgcgcagaaggtcaagggaggtggagatgatggccatcactgataatcattattggtttttctttaatcagttgaaaaatggaaggaaagtgagtgttgtcttgagaacttgttaaagataaagaaataagtcaactgtattcatgtgttctggaacgttgaaaacatgacggagaatgattcttgatgcaaaagactagttaaatttgttttctttgtgttgtgacgcttcgccccttgctagtttcctctggcactgtggcattatgttcaattct

SEQ ID NO: 4040 - DNA, 651 bp, Acacia harpophylla
ggaactctgaaccgcgaatcactttgatcatcgcgttccgccgcggaatcagttatctgtaatctccagcgagggctgaacctgatactcaccgaaggagaccgagatggcatcagggtggggaattaccgggaacaaaggtcgctgctatgacttctggatcgacttcagcgagtgcatgtctcgctgccgagaacccaaggactgtactcttctccgtgaagactacctcgagtgcctccaccattctaaagagttccaacgaaggaatcggatttacaaggaggagcagcgtaaaataagagctgctgcccggcagggtcaggagggtgaaagcgtgggcgggcatcactagcaccggtgattaaaattgctgttttgactctcagaataagttgtggtgaaattgttgttattttgatcgaattggcgtttatgcgtgttatatgtgcgttgtttttttaacttcatccatggtcgatggtctattttctattagtaataatccaaaaaatggacaatgtcccgccgagtgaatgcgttatatagttcatgcgccttgtgagacagaggaatttaagcttttattattgctattttaaagtttaaactaaattcgagattattatgggcaaaaaaaaaaaaaaaaag

SEQ ID NO: 4041 - DNA, 356 bp, Brassica juncea
aatggcgtcgggatggggaataacggggaacaaagggagatgctacgatttctggatggatttcagcgaatgcatgtctcactgcagagagcccaaggactgctctcttctccgtaaggattacctcgagtgcctccaccattccaaagagtttcagagaagaaacaggatctacaaggaggagcaacgtaaactaagggctgcctctaggaaaggtgaacaagttgtggatgctactcatacacatcactagtcaccaatcttttgcttcttcatcccatcccagacaagaagaataaatccaagattttgcatcttgtttagagccgaatctcaaaaaacactggtcttttttc

SEQ ID NO: 4042 - DNA, 517 bp, Brassica napus
gcatcaaatcaaaaatggcgtcgggatggggaataacggggaacaaagggagatgctacgatttctggatggattttagccaatgcatgtctcactgcagagagcccaaggactgctctcttctccgtgaggattacctcgagtgcctccaccattccaaagagtttcaaagaagaaacaggatctacaaggaggagcaacgtaaactaagggctgcctctaggaaaggtgaacaagttgtggatgctactcatacacatcactagtcaccaatcttcctccaagtttgcttcttcatccccatcccatcccattccagacaagaagaataaatccaagattttgcatcttgtttagagccgaatctcaaaaaacactggttttttttctctttaaatgatgttctgctttcttttttcatgttcatttgtctcaacttttgagttgcaaacataccttgagagacgtatctatactcttttcagacacctgacattatggatatctgctctacttt

SEQ ID NO: 4043 - DNA, 542 bp, Lotus japonicus
ggaaggttgtagaccaaatggggttttgaaggtgaaatcgaagcagtgagatcagcgaagaagagagcagagaaatccatcggagaaagagagagcgatggcatcagggtggggaatcacaggaaacaaaggtcgctgctacgatttctggatcgacttcagcgaatgcatgtctacttgcagagagcccaaggactgtgctctcctccgtgaagattacctcgagtgcctccaccattccaaagagttccaacgaagaaaccgtatttacaaggaggagcagcgcaaactaagagctgcctccagaaaaggtcaggatgagggggttgttagtggacatcattagcactcaaaatatgttgtcaatttaaacttttgaacagttttttttgacaaaacgtttgtaatttcgcttggatcggcattcctacatgttctgatattttatactttgacattgtgggattcttttccctgtgcaataattcggatgccaactttcgactgcaaaataattaattaaactatgagcttgctgagtg

SEQ ID NO: 4044 - DNA, 827 bp, Papaver somniferum
tggaccccattcacagagaaacaccttcagcgaatacaacggtctcagctctctacagatagagcaaacaaatttgtagagatggcatcaggatggggaataacaggaaacaaagggcggtgttatgatttctggacagatttcagtgagtgtatgtctagttgtagacaacctaaagattgtgttcttcttagagaggattatctcgaatgccttcatcatgccaaagagtttcaacgaagaaatagggtttacaaagaggagcagcgtcaaataagagcagctgtgcgtaaagccaaagaaggcgaagagggtggtgtaaacaagcatcattagcagtgatgaggattggctgcccctgcatcaactaggctccagtccacaaggttataattttttggacttcgcggacaatgatggagtcgctacctgcttagcgttttgatgtacgactgagttgtttgtaatttcagactcaattatttgcttgccactcgcaaaaagaatttaggttcctgtggaaccgcggagtattagaatttaatctagcaagcaatgttgattcatgttgtagttaaaacctctcttctttttcttctttatgcagagtgcttcatctctctgaatcagcccatgagcttatcctgattttgtttatgcagtggttccatagtgcaaagttatcgtgtgaataccatattcagttagtctcaatgtaatttcactcctttcaaagagtgatcctgttacggtgtttcatggacaactatgaactactgaaccaaaattgcagcatttggtgacgttcatttgagaatttaaatcca

SEQ ID NO: 4045 - DNA, 744 bp, Raphanus sativus
  misc_feature (189)..(189): n is a, c, g, or t
  misc_feature (309)..(309): n is a, c, g, or t
  misc_feature (460)..(460): n is a, c, g, or t
  misc_feature (736)..(736): n is a, c, g, or t
ttcaccgcaaatactagtttggctcattattgccgagataatggcctacttcttcacatccaccgtgcaatgcacgctgttattgatagacagaagaatcatggtatgcacttccgtgtactagctaaagctttacgtctatcgggtggagatcatgttcacgcgggtacagtagtaggtaaacttggnagagacgaagggataatctattactcgagtttcattcatcaatggcgtcggggtggggaataacggggaacaaagggagatgttacgatttctggatggatttcagcgagtgtatgtctnattgcagagagcccaaggattgttctcttcttcgtgaagactacctcgagtgtcttcaccattccaaagagttccaaagaagaaacaggatatacaaagaggaacaacgtaaactaagagcagcttctaggaaaggccaagataccggcgntgatgccactcatcactagtcatcactagtcgtgaagttaagccaagtttgcatctttcgtaaacgggaagaagaagaataatgaaaagtttcgtgaagattctctgtatgttgtgtgtcaaaactccttttgattgttttcactttgcttctgcaactgcaatgaatgaatattctgtcttttttaccttctctattttacattttaactgagttgtaatataccatttggttgtttatcaatcagatcagacttctttgatggtaataatttantcttaaga

SEQ ID NO: 4046 - DNA, 623 bp, Raphanus sativus
gggggtcgttggtaagaaagatatcaggtaggtcttcgttgaagagaggatcaaatcggaatcaggagagagagatggcgtcggggtggggaataacggggaacaaagggagatgttacgatttctggatggatttcagcgagtgtatgtcacactgcagagagcccaaggattgttctcttcttcgtgaagactacctcgagtgcctccaccattccaaagagttccaacgaagaaacaggatatacaaagaggaacagcgtaaactaagagcagcttcaaggaaaggtgaagaaactggcgatgcttctcatactcctcactaatcacatatttttctcctccaagtttgcatctctcgcatttggagaagaaagaataaggaaaagtttcgtcaagtttctgtatcttgtgtgtcaaaaactcccttttgattgtttccagtttgcttctgcaatgaatgttttgtctttttcatcttctcctctatttttacctttggattgagttgtaatatgggcctttagcctgttcatctcacacaaacttgtttcttcatggcaataattttaaaacagacagaagtggatgaaataatgaaatgatacattgacattctctta

SEQ ID NO: 4047 - DNA, 609 bp, Raphanus sativus
  misc_feature (25)..(25): n is a, c, g, or t
  misc_feature (30)..(30): n is a, c, g, or t
agggggaattggattgaattgaatngaatngaattgaattgaattgaatcgaatcagagcatcgcatcgcatgaaatggcgtcgggatgggggataacggggaacaaagggaggtgctatgatttctggatggatttcagtgaatgtatgtctcactgcagagagcccaaggattgctctcttcttcgtgaggattacctcgagtgcctccaccattccaaagagtttcaaagaagaaacaggatctacaaggaggagcaacgtaaactaagggcagcctctaggaatggtgaacaagttgtggatgctactactcattcacatcactagtcatcaatcctcctcctccaactttgcttcttcatccccattccagacagacgaagatgaataaatgctagattttgcatcttgtttggagcagaatctcaaaaacactggccgctttttcactttacaaatgtagcgaatcatgttctgctttttttccatgttcattgtctctcgactttggagttacaaacataccttgagagacgtgtatctccatactcttttcaccttaaaaattatggatatctgctctacttgtattaagttcaaactcca

SEQ ID NO: 4048 - DNA, 644 bp, Trigonella foenum-graecum
taattttgtcttgtaagaagatgaagaatgagatggttctgaagttgcaactgagaagcaaaaatcggtgagatcgacgaagcagaagaaattggggagaaatggcttcagggtggggaattaccggaaacaaaggtcgttgctacgatttctggatcgacttcagcgagtgcatgtctacctgccgagaacccaaagactgtgttctcctccgtgaagattacctcgaatgcctccaccattccaaagagttccaacgaagaaaccggatttacaaggaggaacaacgcaaactaagagctgctgccaggaaaggtcaggatgatgggaaagttactgagcatcattagcattcgtaattaactgtccaatttaagcttctgaacaactattttaataaaacatttgtaatttcgcttggattggttttcctgcattttgtgtgagcactttgacgggcaggcttcttttccctgtgcaataattcggaggtcaacatgcaattgcaaattagacactgaacttgttgagtgaatgtggttcttttcttttgctaatatgcttaaggttaaaggattgaaatccttgaaatgaaaaaaatcaacagatttttttttggagatatagcataattatgcagtaaa

SEQ ID NO: 4049 - DNA, 1567 bp, Brassica rapa
aaactattaaagtccattagaaggtggagaaaacgggagactgaatcaatcagaggaggaggagcatcaaatcaaaaatggcgtcgggatggggaataacggggaacaaagggagatgctacgatttctggatggattttagccaatgcatgtctcactgcagagagcccaaggactgctctcttctccgtgaggattacctcgagtgcctccaccattccaaagagtttcagagaagaaacaggatctacaaggaggagcaacgtaaactaagggcagcctctaggaaaggtgaacaagttgtggatgctactcatacacatcactggtcaccaatcttcctccaagtttgcttcttcatccccattccagacaagaagaataaatccaagattttgcatcttgtttagcgcagaatctcaaaaacactggtcttttttcaatttatcgaatgatgttctgctttcttttttcatgttcatttgtctcaaactttggagttgctaacataccttgagagacgtatctatactcttttcagacacctgacattatggatatctgctctacttttattcaattcaactctatccaaccaaccacgaaacttatttaactgcttcatttttggcaagataaagaatcggttgaatcttctgtttagtaacaacaatccttggcaaggccacaatgtacattggaaaccaagttatagttacatcataaacaagttttgatccatcaaacaagtctcccagtttttttatacatggtagaattcttccacaggcaacttctctcagaagtgtctgtgccagaagctagagattgtgcggtgaatcgaggggatagggaaatgtggaaaccagtctctctcccaaggatgaaactgatcgctttctggttcacggtgtccacctgatgtgctcggtggttgtggtggtggtggataaaggaagaatccaacgttctgatctggcatgggtagtggctgcaatccccttcttgtcatagagaccagaggtgatgcgagattgggaccattaacatgatgttgcctttggttattataaacatgatgctgctgctgcgtgtgaaggtgttcacgcatttgggcactgctgcttccttgttgagtgttaattgctggtgaggttcttggattagacctgcattgcccaaatccaacataagaaaaacattcttaaacttgctgcaaaagttgggaagatattatactgagctctagaagctaaccggtaaccgaagagaaatgggtgtggatgagatatgccccgtgctgctgaggagtcgatttcaccatcaatcacatgagcacctggaagagaaaacgatgtagaatgatgatgatgatggtgatagtggggagcaacagagagctggtgaaagtggtcactagagtggctgttccagggatggtcatctgggttgttgctgttatcgctagttcttggagtggaggctgggcctggtgcaacgtatgcaggatatgaatggttcatagcaacggcatggtgcccatggaactcattatgatctaaagaaa

SEQ ID NO: 4050 - DNA, 597 bp, Brassica rapa
ccgggttgtaattggataaacccgaatcgtccggatcgttggggaatcaggtcttcttcctgaagagacgaacgtatcttctaatcatccagtttcatcaccaatggcgtcggggtggggaataacggggaacaaagggagatgttacgattgctggatggagttcagcgagtgtatgtctcactgcagagagcccaaggattgctctcttcttcgtgaagactacctcgaatgtcttcaccattccaaagagttccaacgaagaaacaggatatacaaagaggaacaacgtaaactaagagcagcttcaaagaaaggccaagataccggcggtgatgccactcatactagtaatcactagtcgtgaagccaagtttgcatcttccgtaaccaggaagaagaataaccaaagtttcgtgcagattctctgtatgtgttgtctgtcaaactccttttgattgttttcactttgcttctgcaaatgaatatactgttttttttttccttctcaatttgactgagtatatcctttggctgttcatcaaacagacttctttcatggtaataatttactcttacagttaatcttaattaaca

SEQ ID NO: 4051 - DNA, 541 bp, Brassica napus
atctggtttgtggattgggaaagagagagatggcgtcgggtggggaataacgggaaacaaggggagatgttacgatttctggatggatttcagcgagtgtatgtctcactgcagagagcccaaggattgctctcttcttcgtgaagactacctcgagtgtctccaccattccaaagagttccaacgaagaaacaggatttacaaagaggaacagcgtaaactaagagctgcttcaaggaaaggtgaagaaactggcgatgctacccatactcatcactgatcaaagtttttttctccttctactcctccaagtttgcatctctcgcagctgagaagaagaagaataaggaagattctatatgttgtgtgtcaaactccattttgagttttttttttcagtttgcttttgccttctctatttttttacctttggactgagttgtaatatgggcttttagccttcgctcacaaaaacctcttctttctttccaataatttaaaacagactagtggatggaataatgaaatggtccattgactt

SEQ ID NO: 4052 - DNA, 612 bp, Gossypium hirsutum
ctgaaactaacaaagattgagtctatcgcttctctgcacaatcaaattgagctgagactaccatccatcggatcgagcaggtagagaaagagagagatggcatccggttggggaatcaatggcactaaaggaaggtgctacgatttctgggttgacttcagcgagtgcatgtcccgttgcagagagcccaaggattgctctctccttcgtgaagactatctcgagtgcctccaccattccaaagagtttcagcgaagaaatcggatttacaaggaagagcaacgaaaaataagagctgccacacgaaaagaaaaggatggcggagatggtgttcaccatcatgcatgatgataatttgtgatcattcaaatttccaagaaaaataatgcatggagattgttgtatttttgttggatctttcctatatttcctgttccttggaatggagactgttgttttgagcccgtgcaacagaggcaatggttaatctttcatcactagacctggatgtgacagcaatatttgcgactttaattttcaaattctgagaattttattttagttcagctggagcattattgtttaaatcgaattaaactgattggatcagaa

SEQ ID NO: 4053 - DNA, 1067 bp, Gossypium raimondii
gagtgaccataacctaagttttgatagttaggtgaccaaattgtaattttaagtttagtttaataaccatttgtgaaatttaacctaaaattcagtagtcaggcagccggatgcgcaatccatgggtaaccccgtaaacatgttcgtctagtattttggtaattttgcatctactgaaaagtgaaaaggctgaaactaacaaagattgagtctatcgcttctctgcacaatcaaattgagctgagactaccatccatcggatcgagcaggtagagaaagagagagatggcatccggttggggaatcaatggcactaaaggaaggtgctacgatttctgggttgacttcagcgagtgcatgtcccgttgcagagagcccaaggattgctctctccttcgtgaagactatctcgagtgcctccaccattccaaagagtttcagcgaagaaatcggatttacaaggaagagcaacgaaaaataagagctgccgcacgaaaagaaaaggatggcggagatggtgttcaccatcatgcatgatgataatttgtgatcattcaaatttccaagaaaaataatgcatggagattgttgtatttttgttggatctttcctatatttcctgttccttggaatggagactgttgttttgagcccgtgcaacagaggcaatggttaatctttcatcactagacctggatgtgacagcaatatttgcgactttaattttcaaattctgagaattttattttagtctctccagcaggagcattattgtttgaatcgaattaaactgattggatcagaaattgattgggatactaatttggagagagagattaaactgattaatttgtaaaccggtatgaatcgattgaatcagctgtagaattagttcttttaaaaaaatttcttttatgaatttttaataataatttatttaattaaattggtcgaaccgatcaaactaactaaacaaatttggtaacctatctggtttttgctatgatcacatatccttgtgtgacatggatgtcctccttagaagcaagcgtggtaaaaaagaacaa

SEQ ID NO: 4054 - DNA, 1166 bp, Vitis vinifera
ctcatcttcgtgagcggcccatttactaagcaagcccaatatgctgtctggccgtcaaaaccttcgtcttcgatgcggaggtgtgagtgagccctagagagaagagagaagagagaaaagaggagagaggagagagatggcatcaggttgggggattacagggagcaaagggaggtgctatgatttctggactgatttcagcgaatgtatgtctcgttgcagagaacccaaggactgctctcttctccgcgaagactatctcgagtgccttcaccattccaaagagttccaacgaagaaaccgaatatataaagaggagcagcgtcaaataagagcagctgcacgcaaggccaaaggggaaggggaaggtgaagatggtgttcagaacagtcatcattagtgtccagacataagcattagtttctggacttcttttgaataatgatttgactttcccagtttcattttgatggaaatctggtatggaagaattttaaattctgaatcatcattgtgttgcttttaaaatgagtggatatttgcagtctgcacaaattggcagggagggccagtgtgtactctgtggaaatcaatgctcagcattgttaattaaaccattattttactttcttcactgattcctgttactattgtctgctaatgctgcattcttctagacaaatttagggaaataattggcagttttgctttacattgtgtcatccaggattgattactaatctcaaccacagagtgattgccatgatacttgagctgtggtcacacttcattgagttttaagaaatgccatggttccaaactttggggagatagattgagagtcaagtacaaatgcagaaaatagagaagaaacagtggagctttatctatgaagaggcattggtttagactctcaaaaactctttcctataccctatctagctttgagcaagaaagtctttatatgattcctctgtgtccattctagattgtgttgattggttggagtcttcttgatgaaagagaggtgtttttttgtcaatctctccatctaatcacattttttcgcacctttgtatgctccttgtgtacttcaatgcaccctctttggattaggtgccgataataatactttttttttgcctataaaaaaaaaagggaaaaaa

SEQ ID NO: 4055 - DNA, 470 bp, Glycyrrhiza uralensis
gatcgtgttcgttcctgccactacccaccggatcaaaaaattgagcgcgcgcgcgtgtgtgtgtgagagagagagatggcatcagggtggggaataacggggaacaaaggtcgatgctacgatttctggatggacttcagcgagtgcatgtctcgctgccgagagcccaaggactgtgctctcctccgcgaagactacctcgaatgcctccaccattccaaagagttccaacgacgaaatagggtttacaaggaggagcagcgcaaactaagggctgctgctcggaaaggcaaggaagatggagttgttagtgaacatcattcgcactcgtaatttgttgtcagtttaaactggaagcttccgaataagtattttgataaaacgttgtaattttgcttggggcggcattcatgcatgtctttatgctacacctctaatgttacgggcttctttctctcggcattggcaat

SEQ ID NO: 4056 - DNA, 592 bp, Malus domestica
acctccacaatcgctgatccctcttgacctccatcaaccgtcgatacaaccgattttcgattttctatccgccgccgcgcgagagaagaaatggcatcggggtggggaatcaccggcaacaaagggcggtgctacgatttctgggtcgacttcagcgagtgcatgtctcgctgccgtgagcccaaggactgcgtcctcctccgcgaagactacctcgagtgcctccaccactccaaagagtttcaacgaaggaatcgtatttacaaggaggagcagcgtaaaatcagggctgctgcacgggccaaggagggtggggaggttgataagcatcaccattcgtagcagaaatcgatcttatccttcaaactgaagaagtaataaataggtggagaacggaggtcgtaattttgtccaaacttgtcccgttacttgattctgaatgtgtgcctcattggtttatgcaaataaggttttgcttgcagtatgtggaatataaaccggattcctttttaaactcttcgtttttttcttctatatattccgggaaattgttcttacgggctgaaatggatttgatttcgtttgaattctc

SEQ ID NO: 4057 - DNA, 551 bp, Prunus persica
gcacgagggcggcagctggagcgaagcaaccattaaatcccgattacttttgaacccattaaccttcgtcgacaacagccccggcaaattgatttgattcgacgctcagtgagagacgaaaatggcatcgggttggggaatcacagggaacaaagggcgctgctacgatttctgggtcgacttcagcgagtgcatgtctcgctgccgtcagcccaaggactgtgttcttcttcgcgaagactacctcgagtgtcttcaccactccaaagagtttcaacgaagaaaccgaatttacaaggaggagcagcgtaaaataagggcagctgcacgggccaaagagggtggagaggttgataagcatcaccatccatagcagaaatcgatcatcatttgaactgaagaaataataatgcttggagaatggatgctgtattttttttttccaagactggtcttttacttgattatgtgatctgttttgtttctcctggaatgagtgtgggccttgttggtctatgcaataagataatggtcaacttagttttgcttgc

SEQ ID NO: 4058 - DNA, 421 bp, Prunus mume
agcaaccattaaatcccgattaattttgaacccattaaccatcgtcgacaacgctaccggcaaattgatttgattcgacgctcagtgagagacgaaaatggcatcgggttggggaatcacagggaacaaagggcgctgctacgatttctgggtggacttcagcgagtgcatgtctcgctgccgtcagcccaaggactgtgttcttcttcgcgaagactacctcgagtgtcttcaccactccaaagagtttcaacgaagaaaccgaatttacaaggaggagcagcgtaaaataagggcagctgcacgggccaaagagggtggagaggttgataagcatcaccatccatagcagaaatcgatcatcatttgaactgaagaaataataaatgtttggagaatggatgctgtattttttttccaa

SEQ ID NO: 4059 - DNA, 519 bp, Brassica juncea
aatggcgtcggggtggggaataacggggaacaaagggagatgttacgatttctggatggatttcagcgagtgtatgtctcactgcagagagcccaaggattgctctcttcttcgtgaagactacctcgagtgtcttcaccattccaaagagttccaaagaagaaacaggatatacaaagaggaacaacgtaaactaagagcagcttcaaagaaaggccaagataccggcgctgatgccactcatactagtaatcactagtcgtgaagccaagtttgcatcttccgtaaccaggaagaagaataatcaaagtttcgtgcagattctctgtatgtgttgtctgtcaaactccttttgattgttttcactttgcttctgcaaatgaatatactgttttttttttccttctcaatttgactgagtatatcctttggctgttcatcaaacagacttctttcatggtattaatttactcttacagtaaaagaagtctgtttgatgaacatgcccctcaaaaatag

SEQ ID NO: 4060 - DNA, 537 bp, Manihot esculenta
gtgtatttttttcacctcaggatcggcctctagcgaacaaaactaaaccacccgtatcgataggtgccatcggcgaagcttgagtgagaaatggcttcaggttgggggatcaccggaaacaaggggagatgctacgatttctggattgacttcagtgaatgcatgtctcgttgcagagagcccaaggactgcgctctcctccgcgaagattaccttgagtgcctccaccactccaaagagtttcaaagaagaaaccgcatttacaaggaggagcagcgtaagatacgagcagctgctcggaagaccaaggacggtgaacatggcattgatagtcaccatgcataaccaataattcgtcatcttttgaaattctagtaataaagaacatgtgaaggtgtattttccatccatatgataatcgaactgtgttcaagttattctgtttttgtttatttcagaatggaaatgcaaatgtgagtctttttaatttgtgcaatgacatgaagttctgcacttcataagattgatttgccggat

SEQ ID NO: 4061 - DNA, 731 bp, Chelidonium majus
gagatggcttcaggttgggggatcacagggaacaaagggcgttgctacgatttctggacagatttcagtgagtgtatgtcaacttgcagggagcccaaagactgtgctcttctcagagaagactatcttgagtgccttcatcacgccaaagagtttcaacgaagaaacagggtttataaagaagagcagcgtcaaataagagcagctgcacggaaagccaaagaaggtgaagggggtggggaaagcaatcaccaatagaacccaattaaaagctatgatctttttcaactttgagaataaaagtggggttgcttgctggtgcgttttgatggaaggctgatgtgtttgtaatttctgactcaattttctcttgttgctcagatactcagaatatgagtgtaggttcttggtttatttgaaacggcaaggtcagtctattcttgcaatgggacgttgtccaatcatgttgtagtcttaagtcttaacttattttacattgtaaagtttttcatctcatataacactgcttgagctttcatgctcctttgttcggattatgttttttaattgtattatttttttaattgtattatttacgtgtagagttaatgtggggggtccactcttattcgatgaaatgtatcacatacgggaggatgaacatgacttaggacttaattctaacaatcttgatgttactactgcgtttaccacgaataagaatcatttca

SEQ ID NO: 4062 - DNA, 595 bp, Gossypium hirsutum
cacattccatctgctctaatcaagttaaagagggttgacagagatggcatctggttggggaatcaacggcaccaagggcaggtgctacgatttctgggttgacttcagcgagtgtatgtcccgttgcagagagcccaaggattgtgctctcctccgtgaagactatctcgagtgtctccaccattccaaggagtttcaacgaagaaaccgaatttataaggaggagcaacgtaaactaagagccgcagcacgaaaggacaaggaaggtgaagccggtgttcaccatcatggatagtgagaatttgttgattcttttaaattcccaagaataatggaatggcatggaagttgtttcatcttttattgggattaatcttccaaacttttttccatcttactttgggtttctcttcccttgaaatgaaatattgttgtgttgagcctatgccaagaggcattaattaatcatttgctagcatcaatgatttgggaatttgttgtgtccattgaactctcttttaatattgcagatgttttggatgttaaaagaaaatacaatagtgtcctcgttcgctttactatcagaaaagaaaaa

SEQ ID NO: 4063 - DNA, 636 bp, Gossypium hirsutum
gccatttggtcatttagtaaacccacctgaaaccatcgagttttctcgctcggcaaaatcacattgaagttggaaattttgcttcaaattcacattccatctgctctaatcaagtgaaagagggtgacagagatggcatctggttggggaatcaacggcaccaagggcaggtgctacgatttctgggtcgacttcagcgagtgtatgtcccgttgcagagagcccaaggactgtgctctcctccgtgaagactatctcgagtgtctccaccattccaaggagtttcaacgaagaaaccgaatttataaggaggagcaacgtaaactaagagctgcagcacgaaaggacaaggaaggcgaagctggtgttcaccatcatggatagtgagaatttgttgatccttctaaattcccaagaataatagaatggcatggaagttgtttcatcttttattgggattgatcttccaaacttttttccttcttactttgggtttctctttccttgaaatgaaatcttgttgttttgagcctatgccaagaggcattaattaatctttgctagcatcaatgatttgggaatttgttgtgtccattgaactctcttataatattgcagatgttttggatgttaaaa

SEQ ID NO: 4064 - DNA, 928 bp, Gossypium raimondii
taaacccgtccgtcttgccatttggtcatttagtaaacccacctgaaaccatcgagttttctcgctcggcaaaatcacattgaagttggacattttgcttcaaattcacattccatctgctctaatcaagtgaaagagggtgacagagatggcatctggttggggaatcaacggcaccaagggcaggtgctacgatttctgggtcgacttcagcgagtgtatgtcccgttgcagagagcccaaggactgtgctctcctccgtgaagactatctcgagtgtctccaccattccaaggagtttcaacgaagaaaccgaatttataaggaggagcaacgtaaactaagagctgcagcacgaaaggacaaggaaggcgaagctggtgttcaccatcatggatagtgagaatttgttgatccttttaaattcccaagaataatagaatggcatggaagttgtttcatcttttattgggattaatcttccaaacttttttccttcttactttgggtttctctttccttgaaatgaaatcttgttgttttgagcctatgccaagaggcattaattaatctttgctagcatcaatgatttgggaatttgttgtgtccattgaactctcttttaatattgcagatgttttggatgttaaaagaaaatacgatagtgtcctcgttcgttttacgatcaacacaatatgcttttcttaaggggataatcattaaaaagcaatggaagttgtgtaagaaacatgaagaatacaaacatacatgcaaggacgagattgaatgatgccaaaccaaacttgtcttgtgacgtcttccaatctctcaaccttagaaattgacttgactttgctctataaaaacttcaacatatttattcttccattaaagggaagagatatgggtagtttaattaaaaaagaaa

SEQ ID NO: 4065 - DNA, 783 bp, Prunus persica
acaggcgaaaatttccatcggtttacattcgtaccgccaatagtcagcggcagctggagcgaagcaaccattaaatcccgattacttttgaacccattaaccttcgtcgacaacagccccggcaaattgatttgattcgacgctcagtgagagacgaaaatggcatcgggttggggaatcacagggaacaaagggcgctgctacgatttctgggtcgacttcagcgagtgcatgtctcgctgccgtcagcccaaggactgtgttcttcttcgcgaagactacctcgagtgtcttcaccactccaaagagtttcaacgaagaaaccgaatttacaaggaggagcagcgtaaaataagggcagctgcacgggccaaagagggtggagaggttgataagcatcaccatccatagcagaaatcgatcatcatttgaactgaagaaataataatgcttggagaatggatgctgtattttttttttccaagactggtcttttacttgattatgtgatctgttttgtttctcctggaatgagtgtgggccttgttggtctatgcaataagataatggtcaacttagttttgcttgcagttgttgcagtggacattgatttgcttggtgacttaaaccggcgtttctgctctccagactaaaatgacttgccgaatataaacctgattcggttttaagttttttgtttatctttgggatcattcggaaagttattcctacaggcttacatggattatgaattctcctatgcttggcatggtttttaaagca

SEQ ID NO: 4066 - DNA, 665 bp, Fragaria vesca
gtaaatttccattagtcacaacaaccaggacaccaggcattggtagaagcgggtagagcgaagcaaacccaaaccccgattagttcgtaacccatcaattaatcgccgccgattcgagaatggcttccggctggggaatcaccggcaacaaagggcgttgctacgatttctgggtcgacttcagcgagtgcatgtctcgctgccgcgagcccaaggactgttctctcctccgcgaggactacctcgagtgcctccaccactccaaagagtttcaacgaaggaatcgaatttacaaggaggagcagcgcaaaataagagctgctgcacgggccaaggagggtggagttgttaatgaccatcattcgtagcagaaatgaaccctctactgaactcgagaattaataaaatgtgtggagatcatgttgtattctgttttttgtccagaccggcattttacttgattatgttatctgttttgtttctcctggaatgatgagtgtagccctcgttggtctatgcaataagattgtggtcgctctgccttgctttgcagtagctgtgcaccttgtacatcgaccttgtacatcgacttgcttggtgtattagaatgctgtttctgctctccagactcatatgacttgtggaatataaacccatttcttctc

SEQ ID NO: 4067 - DNA, 2920 bp, Triticum aestivum
gcaaccttgagttcttgctgagtttgttggtcaagaagatcacatctgggagaggatggcgtcgagatcctactccaacctcttggagctcgccggcggggctgaccgcgaccagccgctgccgtccctcgggcagccacggataccgcgggtgatgacggcgtctggcattgtgcccggccttgaccgcgccgacgccgcagctgacgccgacgccgacgccgcctcggtggcctccgacgaccaacccgaccagccgccgcgggagcgcaccatcatcgtggccaaccagctccccatccgcgcctgccgcggcgccgacggcgcctgggagttctcctgggaccaggacagcctcctgcggcagctcaaggaggctctgcgcgcgcaccagggccgcgcccacatggacttcgtctacatcggcggcctgcgcgacgacatcccggcggaggagcaggacaaggtcgcgctcgagctctacgaccgcttccgctgcgtgcccgccttcctgccggacgacctccgctcccgcttctaccacggcttctgcaagcagcagctgtggccactgttccattacatgctgccactgtcgcccgagctcggcggccgctttgaccgcgacctgtggaaggcctacctgtccgtcaacaagatcttcaccgacaagatcatggaggtgatcaaccccgaggaggacttcgtctgggtgcacgactaccatctcatgctcctgcccaccttcctgcgcaagaaattcaaccgtgtcaggctgggcttcttcctgcacagcccgttcccatcatcggagatctacaagaccctgccggtgcgcgaggaggtgctccgggcgctgctgaatgccgacttgattgggttcccacatttgattatgccaggcatttcctctcatgctgcagcaggatgctgggaatgaaatacgagtcgcagaggggatacattggactggagtattatggacggactgtcactgtcaagatactgccggtggggatacatttgatgcagctgcaggcagtgctcaacctcccggagaccgggctcaaggtcgccgagcttatgaaggagttccctgatcgtcaccgcatcatgatgcttggtgtggatgacatggacatatttaaaggcatcagtctgaagcttctggcatttgaggagctcttgacgcagcatccagagtatcgaggaaaggtggtgctggtacagattgccaatccggcgagggggaagggaaaggatgtgaaggaggtacaggatgagagctatgccatggtgaagcgcatcaatgaggcatttgggcagccagattaccagccagtcatattgatcgacaggccactgcacttctatgagaggatggcatactatgttgttgctgagtgctgcttggtgaccgcggtgagggatggcatgaatcttataccatatgagtacatcattgctaggcaagggaatgaaaagattgacaggatcctgggtctcagcccttccacaaggaagaagagcatgcttgtcgtgtcggagttcattggctgctcgccctccctgagtggcgcgattcgggtgaacccttggaacattgagtcagtggccgaggcaatggacaaggccttgcacacaggtgaaggtgagcaggcgctgaggcacgagaagcatcacaaatttgtgagcacacatgatgtcggatactgggcaaacagcttcctgcaggatctggcgaggacttgccaagaccataacaagaggcgctgctggggcataggatttgggctaaggttcagggttgtggcccttgatacgagcttcaagaagctcgcggctgagcagctcatctcagcctaccggaaggcaagcacgcgtgccattctcttggactatgatggtacgctcatgcctgagtcatcgtttcgtaagatgccgagctccaaaacaataaacatgttgaacagcctctgtcgcgatgagaagaacttggtcctaatcgcaagcacaaagacccgggcgaccttaagtgaatggttctcagcatgtgaggacctaggccttgctgctgagcatggctacttcatcaggctggaaagagatgcagaatgggagacatgcggcccggcaacagacttcagctggaagcaaatcgcggagccggtgatgaagacctacaccgagacaacggacgggtcgatcatcgaggacaaggagacagcaatcgtgtggtgctacaaggacgccgaccgtgattttggatcttgccaggccaaggagctccatgatcacctggagagtgtcctctccaacgagccggtatcagtcaaagctgacctgaactatgttgaggtgaagccacagggtgtgagcaagggcctggtggcgaagcggatgctgtcgacaatgcaggagctggggctccagcctgacttcatcctctgcgtcggggatgaccgctccgacgaggacatgttcgaggtgatcaccaccgcggtggacggcccctacctgagcccttccgcgacggtcttcgcctgcaccattggccaaaagcccagcaaggccaagtactacctggacgaacccgccgacatcaagcgcatgatccgggccctcgcgagcgtctctgaccaggagctggcgctggaggagggcgaagagctggaggagggcgaagaccctccttaccctttccttgccggcgacggcaccagcagcgacgacacctggctggactgaggggggaagctggcagagaagaccagcagcagcgcagcctccggcctgaataagacagcataatggaccgtgccgtcgtaaacggcaccatagttgtgtttctgcttggttgttgttctgcctgtttcgcccattgtgtatatagactccgttgaacttggttaaattaccg

SEQ ID NO: 4068 - DNA, 3397 bp, Secale cereale
cgtccgtctctgccaatccgtccgtcgagctttcccggagtttcctaccgccctctctcgagctttttctcgtcgctggttaatgctggtcgtcgggatggacggcggcgtcttgtgttgtgccgtggcggcgatctgtcgatgtggcggtcgcgtgggcggcgggaggaggagcacctgagacggtgccgctctgccgccgtgttccctttgaccgaaaggtgccgctcctttccggaaagggggaatttgtttctgcgcttctggcgacttcctttgcgccgattccattccttcttgcctcgctaaatctcgcccggatttcctcttcccctcccggccgcggatccttttcctccctgctcgcccattcttgctctgctcggtttctcactctgcaactgcaactgcaactgcaaccttgagttcttgctgagtttgttgctgggggcggtgaagaagatcacatctgggggaggatcttggtttggtggtggacgggatggcgtctagatcctacgccaacctcatggagctcgctggcggcgctgaccgcgaccagcctctgccgtccctcgggcagccacgggtaccgcgggtgatgacggcgtctggcattgtgcccggcctcgactgctccggcgcggccgctgacgccgcctcggtggactccgacgaccaatccaaccaggcgccgcgggagcgcaccatcctcgtggccaaccagctccccatccgcgcctgccgcggcgccgacggcgcctgggacttctcctgggaccaggacagcctcctgcggcagctcaaggagagcctgcgcgcgcaccagggccgcgcccacatggacttcgtctacatcggctgcctgcgcgacgacatcccggcggaggagcaggacaaggtcgcgctcgagctctacgagcgcttccgctgcgtgcccacgttcctgcccgacgacctccgctcccgcttctaccacggcttctgcaagcagcagctgtggccactgttccattacatgctgccactgtcgcccgagctcggcggccgctttgaccgcaacctgtggcaggcctacctgtccgtcaacaagatcttcactgacaagatcctggaggtgatcaaccccgaggaggacttcgtgtgggtgcacgactaccatctcatggtcctgcccaccttcctgcgcaagaaattcaaccgcgtcaggctcggcttcttcctgcacagcccgttcccgtcatcggagatctacaagaccctgccggttcgagaggaggtgctccgggcgctgctgaatgccgatttgattggcttccacacatttgattatgccaggcatttcctctcatgctgcagcaggatgctgggaatgaaatacgagtcgcagaggggatacattgcactggagtattatggacggaccgtcactgtcaagatactgccggtggggatacatttggtgcagctgcaggcggtgctcaacctcccggacaccgaactcaaggtcgccgagcttatgaaggagttctgtgatcgggaccgcatcatgatgctcggcgtggatgatatggacatctttaaaggcatcagtctgaagcttttggcatttgagcagctcctgatggagcatccaaagtggcgagggaaggtggtgctggtgcagattgccaatccggcgagggggaaggggaaggatgtgaaggaggtacaggatgagagctatgccatggtgaagcgcatcaatgagacatttgggaggccagattaccagccagttatattgatcgacaggccactgcacttctatgagaggatggcatactatgttgttgctgagtgctgtttggtgaccgcggtgagggatggcatgaatcttataccatatgagtacatcattgctaggcaagggaatgcgaagattgacaggatcctgggtctcagccctttcacaaggaagaagagcatgcttgtcgtgtcggagttcattggctgctcaccctccctgagtggcgcaattcgggtgaacccttggaacattgagtcggtggcagaggcaatggagagggccttgcacacaggtgatgatgagaaggcgctgaggcacgagaagcatcacaaatttgtgagcacacatgatgtcggatactgggcaaacagcttcctgcaggatctggagaggagttgccaagaccataacaagaggcgctgctggggcataggatttgggctgaggttcagggttgtggcccttgatacgagcttcaagaagctcgcgtttgagcagcttgtctcagcctaccggaaggcaagcacgcgcgtcattctcttggactatgatggtacgctgatgcctcagtcatcgtttggtaagatgccgagctccagaacaatagacatgttgaacagcctttctcgggatgagaagaacatggtgttgctcgcaagcacaaagacccgggcgaccttgagtggatggttctcacgatgcgaggacctaggccttgctgctgagcatggcttcttcatcaggccgaatagagatgcagaatgggagacatgcggcctggcaacagacttcagctggaagcaaatcgcggagccagtgatgaagacctacaccgagacaacggacgggtcaatcatcgaggaaaaggagacagcaatcgtgtggtgctacaaggacgccgaccgtgattttggatcttgccaagccaaggagctccatgagcacctggagagcgtcctttccaacgagccggtctcagtcaaagctgacctgaactatgttgaggtgaagccacagggtgtgagcaagggcctggtggcgaagtggatgctgtcgacaatgcaggcggggggtttcctgcccgacttcatcctctgcgtcggggacgactgctccgacgaggacatgttcgaggtgatcaccaccgcggtggacggcccctacctagaccctgccgcgacggtcttcgcctgcaccgtcggccgcaagcccagcaaggccaagtactacctggacgagcccgacgacatcaagcgcctgatccgtgccctcgcgagcgtctccgaccaggagctggaggagctggaggacctggaggagggcgacgacgacgactctccttaccctttcctggccggcgacgacgaagacgacggcaccagcaccgacgacacctggctgagctgaggaggggaggccggcagagaaggaccagcagcagcgcagcccccggcctgaataagacagcataatggacccgtgccgtcgtcggcaccgtgttgtgtttctgcttggttgttcctctgtctgtttcgcccttgtgtacatagactccgttgaaccttggtttaaattaccgactaaatttccagaaaaaaaaaaacgaca

SEQ ID NO: 4069 - DNA, 3511 bp, Secale cereale
ccgcgctcgccagctcgagcaagggcgagaaaaatactctatccactcttctatacaaagaaaagcctccattccattacttacttgtagtcgtgatagatcccagccagcccttccgatcctcaagagccaccgccacacgccgaccgaggatcaaccccccgccaccgcctatcctccctcctccgccgcgtccgtcgagctttcccggagtttccaccgccctctttcgagccttttcttggtgttgttaatgctggtcgtcgggatggacggcggcgtattctgctgtgccgtggcggcgatctgtcgatgtggcggtcgcgtgggcggcgggaggaggagcacctgagacggtgccgctctgccgccgtgttccctttgaccgaaaggtgccgctcctttccggaaagggggaatttgtttctgcgcttctggcgacttcctttgcgccgattccattccttcttgcctcgctaaatctcgcccggatttcctcttcccctcccggccgcggatcctttacctccccgcccgcccattcttgctctgcccggtttgtcactctgcaactgcaaccttgagttcttgctgagtttgttgctgggggcggtgaagaagatcacatctgggggaggatcttggtttggtggtggacgggatggcttcgagatcctacgccaacctcatggagctcgccggcggcgctgaccgcgaccagccgctgccgtccctcgggcagccacgggtaccgcgggtgatgacggcgtctggcattgtgcccggcctcgactgctccggcgcggccgctgacgccacctcggtggactccgacgaccaatccaaccaggcgccgcgggagcgcaccatcctcgtggccaaccagctccccatccgcgcctgccgcggcgccgacggcgcctgggagttctcctgggaccaggacagcctcctgcggcagctcaaggagagcctgcgcgcgcaccagggccgcgcccacatggacttcgtctacatcggctgcctgcgcgacgacatcccggcggaggagcaggacaaggtcgcgctcgagctctacgagcgcttccgctgcgtgcccacgttcctgcccgacgacctccgctcccgcttctaccacggcttctgcaagcagcagctgtggccactgttccattacatgctgccactgtcgcccgagctcggcggccgctttgaccgcaacctgtggcaggcctacctgtccgtcaacaagatcttcaccgacaagatcctggaggtgatcaaccccgaggaggacttcgtgtgggtgcacgactaccatctcatggtcctgcccaccttcctgcgcaagaaattcaaccgcgtcaggctcggcttcttcctgcacagcccgttcccgtcatcggagatctacaagaccctgccggttcgagaggaggtgctccgggcgctgctgaatgccgatttgattggcttccacacatttgattatgccaggcatttcctctcatgctgcagcaggatgctgggaatgaaatacgagtcgcagaggggatacattgcactggagtattatggacggaccgtcaccgtcaagatactgccggtggggatacatttggtgcagctgcaggcggtgctcaacctcccggacaccgaactcaaggtcgccgagcttatgaaggagttctgtgatcgggaccgcatcatgatgctcggcgtggatgatatggacatctttaaaggcatcagtctgaagcttttggcatttgagcagctcctgaaggagcatccaaagtggcgagggaaggtggtgctggtgcagattgccaatccggcgagggggaaggggaaggatgtgaaggaggtacaggatgagagctatgccatggtgaagcgcatcaatgagacatttgggcggccagattaccagccagttatattgatcgacaggccactgcacttctatgagaggatggcatactatgttgttgctgagtgctgtttggtgaccgcggtgagggatggcatgaatcttataccatatgagtacatcattgctaggcaagggaatgcgaagattgacaggatcctgggtctcagccctttcacaaggaagaagagcatgcttgtcgtgtcggagttcattggctgctcaccctccctgagtggcgcaattcgggtgaacccttggaacattgagtcggtggcagaggcaatggagagggccttgcacacaggtgatgatgagaaggcgctgaggcacgagaagcatcacaaatttgtgagcacacatgatgtcggatactgggcaaacagcttcctgcaggatctggagaggagttgccaagaccataacaagaggcgctgctggggcataggatttgggctgaggttcagggttgtggccctcgatacgagcttcaagaagctcgcgtttgagcagcttgtctcagcctaccggaaggcaagcacgcgcgtcattctcttggactatgatggtacgctgatgcctcagtcatcgtttggtaagatgccgagctccagaacaatagacatgttgaacagcctttctcgggatgagaagaacatggtgttgctcgcaagcacaaagacccgggcgaccttgagtggatggttctcacgatgcgaggacctaggccttgctgctgagcatggcttcttcatcaggccgaatagagatgcagaatgggagacatgcggcctggcaacagacttcagctggaagcaaatcgcggagccagtgatgaagacctacaccgagacaacggacgggtcaatcatcgaggaaaaggagacagcaatcgtgtggtgctacaaggacgccgaccgtgattttggatcttgccaagccaaggagctccatgagcacctggagagcgtcctttccaacgagccggtctcagtcaaagctgacctgaactatgttgaggtgaagccacagggtgtgagcaagggcctggtggcgaagtggatgctgtcgacaatgcaggcggggggtttcctgcccgacttcatcctctgcgtcggggacgactgctccgacgaggacatgttcgaggtgatcaccaccgcggtggacggcccctacctagaccctgccgcgacggtcttcgcctgcaccgtcggccgcaagcccagcaaggccaagtactacctggacgagcccgacgacatcaagcgcctgatccgcgccctcgcgagcgtctccgaccaggagctggaggagctggaggacctggaggagggcgacgacgacgactctccttaccctttcctggccggcgacgacgacgacgacggcaccagcaccgacgacacctggctgagctgaggaggggaggccggcagagaaggaccagcagcagcgcagcccccggctgaataagacagcataatggacccgtgccgtcgtcggcaccgtgttgtgtttctgcttggttgttcctctgtctgtttctcccttgtgtacatagactccgttgaactt

SEQ ID NO: 4070 - DNA, 3916 bp, Secale cereale
tcagcagtagagcagagccgattaatatccgccccggaaacaaatagcgccaatggttttatcatgaatgctttagcttctgttaggtggagggcacgcgggacggcgcccggggacgagacgcccgtgcttatccagggtgcttaccgcgaaattcccgattatatttaatcggcgtacgggccgggggcgagaggcaccatcgcaggcagagttcatcagacccgcgctcgccagctcgagcaagggcgagaaaaatactctatccactcttctatacaaagaaaagcctccgttccattacttacttgtagtcgtgatagatcccagctagcccttccgatcctcaagagccaccgccgcacgccgaccgacgatcaaccccgcctcctcccgccaccgcctctcctccctcttccgccgcgtccgtctttgccaatccgtccgtcgagctttcccggagtttccaccgccctctttcgagctttttcttggtgttgttaatgctggtcgtcgggatggacggcggcgtcttctgctgtgccgtggcggcgatctgtcgatgtggcggtcgcgtgggcggcgggaggaggagcacctgagacggtgccgctctgccgccgtgttccctttgaccgaaaggtgccgctcctttccggaaagggggaatttgtttctgcgcttctggcgacttcctttgcgccgattccattccttcttgcctcgctaaatctcgcccggatttcctcttcccctcccggccgcggatccttttcctccccgcccgcccattcttgctctgctcggtttctcactctgcaactgcaaccttgagttcttgctgagtttgttggtgggggcggtgaagaagatcacatctgggggaggatcttggtttggtggtggacgggatggcgtcgagatcctacgccaacctcatggagctcgccggcggcgctgaccgcgaccagccgctgccgtccctcgggcagccacgggtaccgcgggtgatgacggcgtctggcattgtgcccggcctcgactgctccggcgcggccgctgacgccgcctcggtggactccgacgaccaatccaaccaggcgccgcgggagcgcaccatcctcgtggccaaccagctccccatccgcgcctgccgcggcgccgacggcgcctgggacttctcctgggaccaggacagcctcctgcggcagctcaaggagagcctgcgcgcgcaccagggccgcgcccacatggacttcgtctacatcggctgcctgcgcgacgacatcccggcggaggagcaggacaaggtcgcgctcgagctctacgagcgcttccgctgcgtgcccacgttcctgccagaagacctccgctcccgcttctaccacggcttctgcaagcagcagctgtggccactgttccattacatgctgccactgtcgcccgagctcggcggccgctttgaccgcaacctgtggcaggcctacctgtccgtcaacaagatcttcaccgacaagatcctggaggtgatcaaccccgaggaggacttcgtgtgggtgcacgactaccatctcatggtcctgcccaccttcctgcgcaagaaattcaaccgcgtcaggctcggcttcttcctgcacagcccgttcccgtcatcggagatctacaagaccctgccggttcgagaggaggtgctccgggcgctgctgaatgccgatttgattggcttccacacatttgattatgccaggcatttcctctcatgctgcagcaggatgctgggaatgaaatacgagtcgcagaggggatacattgcgctggagtattacggacggactgtcactgtcaagatactgccggtggggatacatttggtgcagctgcaggcggtgctcaacctcccggacaccgaactcaaggtcgccgagcttatgaaggagttctgtgatcgggaccgcatcatgatgctcggcgtggatgatatggacatctttaaaggcatcagtctgaagcttttggcatttgagcagctcctgatggagcatccaaagtggcgagggaaggtggtgctggtgcagattgccaatccggcgagggggaaggggaaggatgtgaaggaggtacaggatgagagctatgccatggtgaagcgcatcaatgagacatttgggaggccagattaccagccagttatattgatcgacaggccactgcacttctatgagaggatggcatactatgttgttgctgagtgctgtttggtgaccgcggtgagggatggcatgaatcttataccatatgagtacatcattgctaggcaagggaatgcgaagattgacaggatcctgggtctcagcccgttcacaaggaagaagagcatgcttgtcgtgtcggagttcattggctgctcaccctccctgagtggcgcaattcgggtgaacccttggaacattgagtcggtggcagaggcaatggagagggccttgcacacaggtgatgatgagaaggcgctgaggcacgagaagcatcacaaatttgtgagcacacatgatgtcggatactgggcaaacagcttcctgcaggatctggagaggagttgccaagaccataacaagaggcgctgctggggcataggatttgggctgaggttcagggttgtggcccttgatacgagcttcaagaagctcgcgtttgagcagcttgtctcagcctaccggaaggcaagcacgcgcgtcattctcttggactatgatggtacgctgatgcctcagtcatcgtttggtaagatgccgagctccagaacaatagacatgttgaacagcctttctcgggatgagaagaacatggtgttgctcgcaagcacaaagacccgggcgaccttgagtggatggttctcacgatgcgaggacctaggccttgctgctgagcatggcttcttcatcaggccgaatagagatgcagaatgggagacatgcggcctggcaacagacttcagctggaagcaaatcgcggagccagtgatgaagacctacaccgagacaacggacgggtcaatcatcgaaggaaaaggagacagcaatcgtgtggtgctaacgaaggaccgccgaccgtgtagttttggattcttcgaccaacgccgaaggagcctccatgagccaccgtggagagccgttccctttaccaacgacggccggtcctcagtacaaagctcgacctagaactatgttggaggtagaacgccacgagggtgtgagacgaacgggccgtggtggacgaaggtggatgctgtcgaacaatgcaggcggggggtttcctgcccgacttcatcctctgcgtcggggacgactgctccgacgaggacatgttcgaggtgatcaccaccgcggtggacggcccctacctagaccctgccgcgacggtcttcgcctgcaccgtcggccgcaagcccagcaaggccaagtactacctggacgagccggacgacatcaagcgcctgatccgtgccctcgcgagcgtctccgaccaggagctggaggagctggaggacctggaggagggcgacgacgacgactctccttaccctttcctggccggggacgacgacgacgacggcaccagcaccgacgacacctggctgagctgaggaggggaggccggcagagaaggaccagcagcagcgcagcccccggcctgaataagacagcataatggacccgtgccgtcgtcggcaccgtgttgtgtttctgcttggttgttcctctgtctgtttctcccttgtgtacatagactccgttgaacttggttaaattaccgactaaatttacctagaaaaaaaaaaagaaaaaaaaaagaaaaaagaaaaaaaaaaaaaagaaaaaagaaaaaagaaaaagaaaagaaagaagagacacacgacgac

SEQ ID NO: 4071 - DNA, 1199 bp, Hordeum vulgare
ctcgcgcaccggacatctccacccaaacacacacacacacacaccatcctccagttgatctcactgagctcgcaggcagccccagccaccagcgaaatggccgcgtcggcgctgcaccagacgaccagcttcctcggcaccgccccgcggcgcgatgacctcgtccgcagcgtcggcgacttcggcggccgcatcaccatgcgccggaccgtcaagagcgcgccccagagcatctggtacggccctgaccgtcccaagtacctgggcccgttctccgagcagaccccgtcgtacctgaccggcgagttccccggcgactacgggtgggacaccgcgggattgtcggctgacccagagaccttcgccaagaacagggagctggaggtgatccactcgcggtgggcgatgctcggagccctcgggtgcgtgttccccgagatcctgtccaagaacggcatcaagttcggcgaggctgtctggttcaaggccggcgcgcagatcttctccgagggcggcctcgactacctgggcaaccccaacctggtgcacgcgcagagcatcctcgccatctgggcatgccaggtggtgctcatgggcttcatcgagggctaccgtgttggtggcggacccctcggtgagggcctcgacatcatctacccgggtggcgccttcgacccacttggcctcgccgacgaccccgacacagccgccgagctcaaggtcaaggagctcaagaacggccgcctcgccatgttctccatgttcggcttcttcgtgcaggccatcgtcaccggaaagggaccggttgagaacctcttcgaccacatcgccgacccagtgaacaacaacgcgtgggccttcgccaccaacttcgcccccggaagttaaatgtgtttagcagccatccgtctgtccatcggacgagatatgcatgtgtacttgtacgtcgtggatcaacgtgtagctgcacgtactttgtgtgtttatttgtatcatcatcatcatcgagcgagcgagatgccctctccctagctgtgcgcaatgtaaattaattgagcacaaggtgtgcacgagcgaatggatggaaggattgtgtgtcaatactccacatcaaccagtgtcacggcgtatatggtatataccccatgaaaggaagaaaaatgagggcaagtgttgagtaaataggcaattttccgagt

SEQ ID NO: 4072 - DNA, 1084 bp, Hordeum vulgare
tccacccaaacacacacacacacacaccatcctccagttgatctcactgagctcgcaggcagccccagccaccagcgaaatggccgcgtcggcgctgcaccagacgaccagcttcctcggcaccgccccgcggcgcgatgacctcgtccgcagcgtcggcgacttcggcggccgcatcaccatgcgccggaccgtcaagagcgcgccccagagcatctggtacggccctgaccgtcccaagtacctgggcccgttctccgagcagaccccgtcgtacctgaccggcgagttccccggcgactacgggtgggacaccgcgggattgtcggctgacccagagaccttcgccaagaacagggagctggaggtgatccactcgcggtgggcgatgctcggagccctcgggtgcgtgttccccgagatcctgtccaagaacggcatcaagttcggcgaggctgtctggttcaaggccggcgcgcagatcttctccgagggcggcctcgactacctgggcaaccccaacctggtgcacgcgcagagcatcctcgccatctgggcatgccaggtggtgctcatgggcttcatcgagggctaccgtgttggtggcggacccctcggtgagggcctcgacatcatctacccgggtggcgccttcgacccacttggcctcgccgacgaccccgacacagccgccgagctcaaggtcaaggagctcaagaacggccgcctcgccatgttctccatgttcggcttcttcgtgcaggccatcgtcaccggaaagggaccggttgagaacctcttcgaccacatcgccgacccagtgaacaacaacgcgtgggccttcgccaccaacttcgcccccggaagttaaatgtgtttagcagccatccgtctgtccatcggacgagatatgcatgtgtacttgtacgtcgtggatcaacgtgtagctgcacgtactttgtgtgtttatttgtatcatcatcatcatcgagcgagcgagatgccctctccctagctgtgcgcaatgtaaattaattgagcacaaggtgtgcacgagcgaatggatggaaggattgtgtgtcaa

SEQ ID NO: 4073 - DNA, 952 bp, Leymus cinereus x Leymus triticoides
gcacgaggcaccagttcatctcactgagctcgcaggcagtcccagccactagcgaaatggccgcgtcggcgctgcaccagacgaccagcttcctcggcaccgccccgcggcgcgatgacctcgtccgcagcgtcggcgacttcggcggccggatcaccatgcgccggaccgtcaagagcgcgccccagagcatctggtacggccctgaccgtcccaagtacctgggcccattctcagagcagaccccgtcgtacctgaccggcgagttccccggcgactacgggtgggacaccgccgggctgtcggccgaccccgagacgttcgcgaagaaccgggagctggaggtgatccactcacggtgggccatgctcggcgccctggggtgcgtgttccccgagatcctgtccaagaacggcatcaagtttggagaggccgtctggttcaaggccggcgcccagatcttctctgagggcggcctcgactacctaggcaaccctaacctggtgcacgcgcagagcatcctcgccatctgggcgtgccaggtggtgctcatgggcttcatcgagggttaccgtgttggtggcggccccctcggcgagggcctcgacatcatctacccgggcggcgccttcgacccacttggcctcgccgacgaccccgacaccgccgccgagctcaaggtcaaggagctcaagaacggccgcctcgccatgttctccatgttcggcttctttgtgcaggccatcgtcaccggaaaggggccagttgagaacctcttcgaccacatcgccgacccggtcaacaacaacgcgtgggccttcgccaccaacttcgcccccggaagttaaatgtgtttagccatccgtctgtccatcggacgagatatgcatgtgtacttgtacgtcgtggatcaacgtgtagctgcacgtactttgtgtgtttatttgtacca

SEQ ID NO: 4074 - DNA, 1087 bp, Secale cereale
agtgtggttcaaggacaggatctccgggaacacacaccatccaccagtccatctcactgagctcgcaggcagccccagccaccagcgaaatggccgcgtcggcgctgcaccagacgaccagcttcctcggcaccgccccgcgccgcgatgacctcgtccgcagcgtcggcgacttcggcggccgcatcaccatgcgccggaccgtcaagagcgcgccccagagcatctggtacggccctgaccgtcccaagtacctgggcccgttctccgagcagaccccgtcgtacctgaccggcgagttccccggcgactacgggtgggacaccgcggggctgtcggccgacccagagaccttcgccaagaaccgggagctggaggtgatccactcgcggtgggcgatgctcggcgccctggggtgcgtgttcccggagatcctgtccaagaacggcatcaagttcggcgaggcagtgtggttcaaggccggcgcccagatcttctccgagggcggccttgactacctgggcaaccccaacctggtgcacgcgcagagcatcctggccatctgggcggttcaggtggtgctcatgggcttcatcgagggctaccgcgttggcggcggccccctcggcgagggcctcgacatcatctacccgggcggcgccttcgacccgcttggcctcgccgacgaccccgacaccgccgccgagctcaaggtgaaggagctcaagaacggccgcctcgccatgttctccatgttcggcttcttcgtgcaggccatcgtcaccgggaaggggcccgttgagaacctcttcgaccacgtcgccgacccagtcaacaacaacgcctgggccttcgccaccaacttcgcccccggaagctaaatgtgtttagccatcggacgagatatgcatgtgtacttgtacgtcgtggatcaacgtgtagctgcacgtactttgtgtgtttatttgtaccatgatcgagcgagcgagaggtcctctcgctggctgtgcgcaatgtaaattaattaagcacgaggtgcacgagcaaatggatggaagaatcgtgtgtcatttagtacattactcaa

SEQ ID NO: 4075 - DNA, 1029 bp, Secale cereale
gactttcttacttacctattcctaccagtccatctcactgagctcgcaggcagccccagccaccagcgaaatggccgcgtcggcgctgcaccagacgaccagcttcctcggcaccgccccgcgccgcgatgacctcgtccgcagcgtcggcgacttcggcggccgcatcaccatgcgccggaccgtcaagagcgcgccccagagcatctggtacggccctgaccgtcccaagtacctgggcccgttctccgagcagaccccgtcgtacctgaccggcgagttccccggcgactacgggtgggacaccgcggggctgtcggccgacccagagaccttcgccaagaaccgggagctggaggtgatccactcgcggtgggcgatgctcggcgccctggggtgcgtgttcccggagatcctgtccaagaacggcatcaagttcggcgaggcagtgtggttcaaggccggcgcccagatcttctccgagggcggccttgactacctgggcaaccccaacctggtgcacgcgcagagcatcctggccatctgggcggttcaggtggtgctcatgggcttcatcgagggctaccgcgttggcggcggccccctcggcgagggcctcgacatcatctacccgggcggcgccttcgacccgcttggcctcgccgacgaccccgacaccgccgccgagctcaaggtgaaggagctcaagaacggccgcctcgccatgttctccatgttcggcttcttcgtgcaggccatcgtcaccgggaaggggcccgttgagaacctcttcgaccacgtcgccgacccagtcaacaacaacgcctgggccttcgccaccaacttcgcccccggaagctaaatgtgtttagccatcggacgagatatgcatgtgtacttgtacgtcgtggatcaacgtgtagctgcacgtactttgtgtgtttatttgtaccatgatcgagcgagcgagaggtcctctcgctggctgtgcgcaatgtaaattaattaagcacgaggtgcacgagcaaa

SEQ ID NO: 4076 - DNA, 1120 bp, Secale cereale
gtccatctcactgagctcgcaggcagccccagccaccagcgaaatggccgcgtcggcgctgcaccagacgaccagcttcctcggcaccgccccgcgccgcgatgacctcgtccgcagcgtcggcgacttcggcggccgcatcaccatgcgccggaccgtcaagagcgcgccccagagcatctggtacggccctgaccgtcccaagtacttgggcccgttctccgagcagaccccgtcgtacctgaccggcgagttccccggcgactacgggtgggacaccgcggggctgtcggccgacccagagaccttcgccaagaaccgggagctggaggtgatccactcgcggtgggccatgctcggcgccctgggctgcgtgttcccggagatcctgtccaagaacggcatcaagttcggcgaggcagtgtggttcaaggccggcgcccagatcttctccgagggcggcctcgactacctgggcaaccccaacctggtgcacgcgcagagcatcctggccatctgggcggttcaggtggtgctcatgggcttcatcgagggctaccgcgttggcggcggccccctcggtgagggcctcgacatcatctacccgggcggcgccttcgacccgcttggcctcgccgacgaccccgacaccgccgccgagctcaaggtgaaggagctcaagaacggccgcctcgccatgttctccatgttcggcttcttcgtgcaggccatcgtcaccgggaaggggcccgttgagaacctcttcgaccacgtcgccgacccagtcaacaacaacgcctgggccttcgccaccaacttcgcccccggaagctaaatgtgtttactgtttagccatccgtccgtccgtccatcggacgagatatgcatgtgtacttgtacgtcgtggatcaacgtgtagctgcacgtactttgtgtgtttatttgtaccatgatcgagcgagcgagaggtcctctcgctggctgtgcgcaatgtaaattaattaagcacgaggtgcacgagcaaatggatggaagaatcgtgtgtcatttagtacattactcaagatcatcaactggcatgcatggcgtatatggtacttcaagctcatgaaacgggaca

SEQ ID NO: 4077 - DNA, 1088 bp, Secale cereale
tctcactgagctcgcaggcagccccagccaccagcgaaatggccgcgtcggcgctgcaccagacgaccagcttcctcggcaccgccccgcgccgcgatgacctcgtccgcagcgtcggcgacttcggcggccgcatcaccatgcgccggaccgtcaagagcgcgccccagagcatctggtacggccctgaccgtcccaagtacttgggcccgttctccgagcagaccccgtcgtacctgaccggcgagttccccggcgactacgggtgggacaccgcggggctgtcggccgacccagagaccttcgccaagaaccgggagctggaggtgatccactcgcggtgggcgatgctcggcgccctggggtgcgtgttcccggagatcctgtccaagaacggcatcaagttcggcgaggcagtgtggttcaaggccggcgcccagatcttctccgagggcggccttgactacctgggcaaccccaacctggtgcacgcgcagagcatcctggccatctgggcggttcaggtggtgctcatgggcttcatcgagggctaccgcgttggtggcggccccctcggcgagggcctcgacatcatctacccgggcggcgccttcgacccgcttggcctcgccgacgaccccgacaccgccgccgagctcaaggtgaaggagctcaagaacggccgcctcgccatgttctccatgttcggcttcttcgtgcaggccatcgtcaccgggaaggggcccgttgagaacctcttcgaccacgtcgccgacccagtcaacaacaacgcctgggccttcgccaccaacttcgcccccggaagctaaatgtgtttagccatccgtccatcggacgagatatgcatgtgtacttgtacgtcgtggatcaacgtgtagctgcacgtactttgtgtgtttatttgtaccatgatcgagcgagcgagaggtcctctcgctggctgtgcgcaatgtaaattaattaagcacgaggtgcacgagcaaatggatggaagaatcgtgtgtcatttagtcacaaaaaaaactaaacgagactagccaacggacgacacacgggaggagtagccc

SEQ ID NO: 4078 - DNA, 1097 bp, Secale cereale
ctccccttcgtcgttggccttcggccgagtctcacgcaccactccacccacgtccactctcactgagctcgcaggcagccccatccaccagcgaaatggccgcgtcggcgctgcaccagacgaccagcttcctcggcaccgccccgcgccgcgatgacctcgtccgcagcgtcggcgacttcggtggccgcatcaccatgcgccggaccgtcaagagcgcgccccagagcatctggtacggccctgaccgtcccaagtacttgggcccgttctccgagcagaccccgtcgtacctgaccggcgagttccccggcgactacgggtgggacaccgcggggctgtcggccgacccagagaccttcgccaagaaccgggagctggaggtgatccactcgcggtgggccatgctcggcgccctgggctgcgtgttcccggagatcctgtccaagaacggcatcaagttcggcgaggcagtgtggttcaaggccggcgcccagatcttctccgagggcggcctcgactacctgggcaaccccaacctggtgcacgcgcagagcatcctggccatctgggcggttcaggtggtgctcatgggcttcatcgagggctaccgcgttggcggcggccccctcggtgagggcctcgacatcatctacccgggcggcgccttcgacccgcttggcctcgccgacgaccccgacaccgccgccgagctcaaggtgaaggagctcaagaacggccgcctcgccatgttctccatgttcggcttcttcgtgcaggccatcgtcaccgggaaggggcccgttgagaacctcttcgaccacgtcgccgacccagtcaacaacaacgcctgggccttcgccaccaacttcgcccccggaagctaaatgtgtttactgtttagccatccgtccgtccgtccatcggacgagatatgcatgtgtacttgtacgtcgtggatcaacgtgtagctgcacgtactttgtgtgtttatttgtaccatgatcgagcgagcgagaggtcctctcgctggctgtgcgcaatgtaaattaattaagcacgaggtgcacgagcaaatggatggaagaatcgtgtgt

SEQ ID NO: 4079 - DNA, 984 bp, Secale cereale
atctcactgagctcgcaggcagccccatccaccagcgaaatggccgcgtcggcgctgcaccagacgaccagcttcctcggcaccgccccgcgccgcgatgacctcgtccgcagcgtcggcgacttcggtggccgcatcaccatgcgccggaccgtcaagagcgcgccccagagcatctggtacggccctgaccgtcccaagtacttgggcccgttctccgagcagaccccgtcgtacctgaccggcgagttccccggcgactacgggtgggacaccgcggggctgtcggccgacccagagaccttcgccaagaaccgggagctggaggtgatccactcgcggtgggccatgctcggcgccctggggtgcgtgttcccggagatcctgtccaagaacggcatcaagttcggcgaggcagtgtggttcaaggccggcgcccagatcttctccgagggcggccttgactacctgggcaaccccaacctggtgcacgcgcagagcatcctggccatctgggcggttcaggtggtgctcatgggcttcatcgagggctaccgcgttggtggcggccccctcggcgagggcctcgacatcatctacccgggcggcgccttcgacccgcttggcctcgccgacgaccccgacaccgccgccgagctcaaggtcaaggagctcaagaacggccgcctcgccatgttctccatgttcggcttcttcgtgcaggccatcgtcaccgggaaggggccagttgagaacctcttcgaccacgtcgccgacccagtcaacaacaacgcctgggccttcgccaccaacttcgcccccggaagctaaatgtgtttagccatcggacgagatatgcatgtgtacttgtacgtcgtggatcaacgtgtagctgcacgtactttgtgtgtttatttgtaccatgatcgagcgagcgagaggtcctctcgctggctgtgcgcaatgtaaattaattaagcacga

SEQ ID NO: 4080 - DNA, 1097 bp, Secale cereale
tcaggttccatctcactgagctcgcaggcagccccagccaccagcgaaatggccgcgtcggcgctgcaccagacgaccagcttcctcggcaccgccccgcgccgcgatgacctcgtccgcagcgtcggcgacttcggcggccgcatcaccatgcgccggaccgtcaagagcgcgccccagagcatctggtacggccctgaccgtcccaagtacttgggcccgttctccgagcagaccccgtcgtacctgaccggcgagttccccggcgactacgggtgggacaccgcggggctgtcggccgacccagagaccttcgccaagaaccgggagctggaggtgatccactcgcggtgggcgatgctcggcgccctggggtgcgtgttcccggagatcctgtccaagaacggcatcaagttcggcgaggccgtgtggttcaaggccggcgcccagatcttctccgagggcggcctcgactacctgggcaaccccaacctggtgcacgcgcagagcatcctggccatctgggcggttcaggtggtgctcatgggcttcatcgagggctaccgcgttggcggcggccccctcggcgagggcctcgacatcatctacccgggcggcgccttcgacccgcttggcctcgccgacgaccccgacaccgccgccgagctcaaggtcaaggagctcaagaacggccgcctcgccatgttctccatgttcggcttcttcgtgcaggccatcgtcaccgggaaggggcccgttgagaacctcttcgaccacgtcgccgacccagtcaacaacaacgcctgggccttcgccaccaacttcgcccccggaagctaaatgtgtttactgtttagccatccgtccgtccgtccatcggacgagatatgcatgtgtacttgtacgtcgtggatcaacgtgtagctgcacgtactttgtgtgtttatttgtaccatgatcgagcgagcgagaggtcctctcgctggctgtgcgcaatgtaaattaattaagcacgaggtgcacgagcaaatggatggaagaatcgtgtgtctatttagtacaattactacaagatcatacaactagacaaaaaaaaa

SEQ ID NO: 4081 - DNA, 1009 bp, Secale cereale
tctcactgagctcgcaggcagccccagccaccagcgaaatggccgcgtcggcgctgcaccagacgaccagcttcctcggcaccgccccgcgccgcgatgacctcgtccgcagcgtcggcgacttcggcggccgcatcaccatgcgccggaccgtcaagagcgcgccccagagcatctggtacggccctgaccgtcccaagtacctgggcccgttctccgagcagaccccgtcgtacctgaccggcgagttccccggcgactacgggtgggacaccgcggggctgtcggccgacccagagaccttcgccaagaaccgggagctggaggtgatccactcgcggtgggcgatgctcggcgccctggggtgcgtgttcccggagatcctgtccaagaacggcatcaagttcggcgaggcagtgtggttcaaggccggcgcccagatcttctccgagggcggcctcgactacctgggcaaccccaacctggtgcacgcgcagagcatcctggccatctgggcggttcaggtggtgctcatgggcttcatcgagggctaccgcgttggcggcggccccctcggcgagggcctcgacatcatctacccgggcggcgccttcgacccgcttggcctcgccgacgaccccgacaccgccgccgagctcaaggtcaaggagctcaagaatggccgcctcgccatgttctccatgttcggcttcttcgtgcaggccatcgtcaccgggaaggggcccgttgagaacctcttcgaccacgtcgccgacccagtcaacaacaacgcctgggccttcgccaccaacttcgcccccggaagctaaatgtgtttactgtttagccatccgtccgtccgtccatcggacgagatatgcatgtgtacttgtacgtcgtggatcaacgtgtagctgcacgtactttgtgtgtttatttgtaccatgatcgagcgagcgagaggtcctctcgctggctgtgcgcaatgtaaattaattaagcacgaggt

SEQ ID NO: 4082 - DNA, 1052 bp, Triticum aestivum
ccatccaccagttcatctcactgagctcgcaggcagccccagccaccagcgaaatggccgcgtcggcgctgcaccagacgaccagcttcctcggcaccgcaccgcggcgcgatgacctcgtccgcagcgtcggcgacttcggcggccgcatcaccatgcgccggaccgtcaagagtgcgccccagagcatctggtacggccctgaccgtcccaagtacctgggcccgttctccgagcagactccatcgtacctgaccggcgagttccccggcgactacgggtgggacaccgcggggctgtcggctgacccagagaccttcgccaagaaccgggagctggaggtgatccactcacggtgggcgatgctcggcgccctggggtgcgtgttcccggagatcctgtccaagaacggcatcaagttcggcgaggccgtgtggttcaaggccggcgcccagatcttctccgagggcggcctcgactacctgggcaaccccaacctggtgcacgcgcagagcatcctggccatctgggcggttcaggtggtgctcatgggcttcatcgagggctaccgcgttggtggcggccccctcggcgagggcctcgacatcatctaccccggcggcgccttcgacccacttggcctcgccgacgaccccgacaccgccgccgagctcaaggtgaaggagctcaagaacggccgcctcgccatgttctccatgttcggcttcttcgtgcaggccatcgtcaccggaaagggacccgttgagaacctcttcgaccacgtcgccgacccagtcaacaacaacgcgtgggccttcgccaccaacttcgcccccggaagctaaatgtgtttagccatccgtccgtccgtccgtccatcggacgagatatgcatgtgtacttgtacgttgtggatcaacgtgtagctgcacgtactttgtgtgtttatttgtaccatgatcgagcgagcgagaggtcctctcgctagctgtgcgcaatgtaaattaattaagcacaaggtgtgcacgagggaatggacggaagaatcgtgt

SEQ ID NO: 4083 - DNA, 989 bp, Triticum aestivum
gttcatctcactgagctcgcaggcagccccagccaccagcgaaatggccgcgtcggcgctgcaccagacgaccagcttcctcggcaccgcaccgcggcgcgatgacctcgtccgcagcgtcggcgacttcggcggccgcatcaccatgcgccggaccgtcaagagtgcgccccagagcatctggtacggccctgaccgtcccaagtacctgggcccgttctccgagcagactccatcgtacctgaccggcgagttccccggcgactacgggtgggacaccgcggggctgtcggctgacccagagaccttcgccaagaaccgggagctggaggtgatccactcacggtgggcgatgctcggcgccctggggtgcgtgttcccggagatcctgtccaagaacggcatcaagttcggcgaggccgtgtggttcaaggccggcgcccagatcttctccgagggcggcctcgactacctgggcaaccccaacctggtgcacgcgcagagcatcctggccatctgggcggttcaggtggtgctcatgggcttcatcgagggctaccgcgttggtggcggccccctcggcgagggcctcgacatcatctaccccggcggcgccttcgacccacttggcctcgccgacgaccccgacaccgccgccgagctcaaggtgaaggagctcaagaacggccgcctcgccatgttctccatgttcggcttcttcgtgcaggccatcgtcaccggaaagggacccgttgagaacctcttcgaccacgtcgccgacccagtcaacaacaacgcgtgggccttcgccaccaacttcgcccccggaagctaaatgtgtttagccatccgtccgtccgtccgtccatcggacgagatatgcatgtgtacttgtacgttgtggatcaacgtgtagctgcacgtactttgtgtgtttatttgtaccatgatcgagcgagcgagaggtcctctcgctagctgtgcgcaat

SEQ ID NO: 4084 - DNA, 1006 bp, Triticum aestivum
atctcactgagctcgcaggcagccccagccaccagcgaaatggccgcgtcggcgctgcaccagacgaccagcttcctcggcaccgccccgcggcgtgatgacctcgtccgcagcgtcggcgacttcggcggccgcatcaccatgcgccggaccgtcaagagcgcgccccagagcatctggtacggccctgaccgtcccaagtacctgggcccgttctccgagcagaccccgtcgtacctgaccggcgagttccccggcgactacgggtgggacaccgccggattgtcggctgacccagagaccttcgccaagaaccgggagctggaggtgatccactcacggtgggcgatgctcggcgccctggggtgcgtgttcccggagatcctgtccaagaacggcatcaagttcggcgaggccgtgtggttcaaggccggtgcccagatcttctccgagggcggcctcgactacctgggcaaccccaacctggtgcacgcgcagagcatcctcgccatctgggcggttcaggtggtgctcatgggcttcatcgagggttaccgcgttggtggcggccccctcggcgagggcctcgacatcatctacccaggcggcgccttcgacccacttggcctcgccgacgaccccgacaccgcagctgagctcaaggtcaaggagctcaagaacggccgcctcgccatgttctccatgttcggcttcttcgtgcaggccatcgtcaccggaaaggggcccgtagagaacctcttcgaccacgtcgccgacccggtcaacaacaacgcgtgggccttcgccaccaacttcgcccccggaagctaaatgtgttaagccatctgtccgtccatcggacgagatatgcatgtgtacttgtacgtcgtggatcaacgtgtagctgcacgtactttgtgtgtttatttgtaccatgatcgagcgagcgagatgacctctcgctggctgcgcgcaatgtaaattaattaagcacgagatgcacgag

SEQ ID NO: 4085 - DNA, 1332 bp, Triticum aestivum
ccgaaggtctacccgaaaggccagtcggtagtcaacgacagaggtacgcggggacccaaacacacaccatccaccagttcatctcactgagctcgcaggcagccccagccaccagcgaaatggccgcgtcggcgctgcaccagacgaccagcttcctcggcaccgccccgcggcgtgatgacctcgtccgcagcgtcggcgacttcggcggccgcatcaccatgcgccggaccgtcaagagcgcgccccagagcatctggtacggccctgaccgtcccaagtacctgggcccgttctccgagcagaccccgtcgtacctgaccggcgagttccccggcgactacgggtgggacaccgccggattgtcggctgacccagagaccttcgccaagaaccgggagctggaggtgatccactcacggtgggcgatgctcggcgccctggggtgcgtgttcccggagatcctgtccaagaacggcatcaagttcggcgaggccgtgtggttcaaggccggtgcccagatcttctccgagggcggcctcgactacctgggcaaccccaacctggtgcacgcgcagagcatcctcgccatctgggcggttcaggtggtgctcatgggcttcatcgagggttaccgcgttggtggcggccccctcggcgagggcctcgacatcatctacccaggcggcgccttcgacccacttggcctcgccgacgaccccgacaccgcagctgagctcaaggtcaaggagctcaagaacggccgcctcgccatgttctccatgttcggcttcttcgtgcaggccatcgtcaccggaaaggggcccgtagagaacctcttcgaccacgtcgccgacccggtcaacaacaacgcgtgggccttcgccaccaacttcgcccccggaagctaaatgtgttaagccatctgtccgtccatcggacgagatatgcatgtgtacttgtacgtcgtggatcaacgtgtagctgcacgtactttgtgtgtttatttgtaccatgatcgagcgagcgagatgacctctcgctggctgcgcgcaatgtaaattaattaagcacgagatgcacgagcaaatggatggaagaatcgtgtatcattagtacattactcgagatcatcaactggcatggcgtatatggtacttcaagctcatgaaacgggacattcgcaacggcatacggagatccaacgggccaactatacaactctgtctttgtggctattcttggttcagaaacccagtttctctcgtttgaaatccttttcagatcgtaactttgaaactcatgcaagcatgaacatgaatacacagattt

SEQ ID NO: 4086 - DNA, 1076 bp, Triticum aestivum
ggggacccaaacacacaccatccaccagttcatctcactgagctcgcaggcagccccagccaccagcgaaatggccgcgtcggcgctgcaccagacgaccagcttcctcggcaccgccccgcggcgcgatgacctcgtccgcagcgtcggcgactttggcggccgcatcaccatgcgccggaccgtcaagagcgcgccccagagcatctggtacggccctgaccgtcccaagtacctgggcccgttctccgagcagaccccgtcgtacctgaccggcgagttccccggcgactacgggtgggacaccgccggattgtctgctgaccccgagacgttcgccaagaacagggagctggaggtgatccactcgcggtgggcgatgctcggcgccctcgggtgcgtgttcccggagatcctgtccaagaacggcatcaagttcggcgaggccgtgtggttcaaggccggcgcccagatcttctccgagggcggcctcgactacctgggcaaccccaacctggtgcacgcgcagagcatcctcgccatctgggcggtgcaggtggtgctcatgggcttcatcgagggctaccgtgttggtggcgggcccctcggcgagggcctcgatatcatctacccaggcggcgccttcgacccacttggcctcgccgacgaccctgacaccgccgccgagctcaaggtgaaggagctcaagaacggccgcctcgccatgttctccatgttcggcttcttcgtgcaggccatcgtcaccgggaaggggccagttgagaacctcttcgaccacgtcgccgacccggtcaacaacaacgcctgggccttcgccaccaacttcgcccccggaagctaaatgtgtttagccgtccgtccgtccgtccgtccatcggacgagatatgcatgtgtacttgtacgtcgtggatcaacgtgtagctgcacgtactttgtgtgtttatttgtaccatgatcgagcgagcgagaggtcctctcgctagctgcgcgcaatgtaaattaattaagcacaaggtgtgcacgagggaatggatggaagaatcgtgtgtcatta

SEQ ID NO: 4087 - DNA, 1039 bp, Triticum aestivum
gaattcggcacgagagttcatctcactgagctcgcaggcagccccagccaccagcgaaatggccgcgtcggcgctgcaccagacgaccagcttcctcggcaccgccccgcggcgcgatgacctcgtccgcagcgtcggcgactttggcggccgcatcaccatgcgccggaccgtcaagagcgcgccccagagcatctggtacggccctgaccgtcccaagtacctgggcccgttctccgagcagaccccgtcgtacctgaccggcgagttccccggcgactacgggtgggacaccgccggattgtctgctgaccccgagacgttcgccaagaacagggagctggaggtgatccactcgcggtgggcgatgctcggcgccctcgggtgcgtgttcccggagatcctgtccaagaacggcatcaagttcggcgaggccgtgtggttcaaggccggcgcccagatcttctccgagggcggcctcgactacctgggcaaccccaacctggtgcacgcgcagagcatcctcgccatctgggcggtgcaggtggtgctcatgggcttcatcgagggctaccgtgttggtggcgggcccctcggcgagggcctcgacatcatctacccgggcggcgccttcgacccacttggcctcgccgacgaccccgacaccgccgccgagctcaaggtgaaggagctcaagaacggccgcctcgccatgttctccatgttcggcttcttcgtgcaggccatcgtcaccgggaaggggccagttgagaacctcttcgaccacgtcgccgacccggtcaacaacaacgcctgggccttcgccaccaacttcgcccccggaagctaaatgtgtttagccgtccgtccgtccgtccgtccatcggacgagatatgcatgtgtacttgtacgtcgtggatcaacgtgtagctgcacgtactttgtgtgtttatttgtaccatgatcgagcgagcgagaggtcctctcgctagctgcgcgcaatgtaaattaattaagcacaaggtgtgcacgagggaa

SEQ ID NO: 4088 - DNA, 1051 bp, Triticum aestivum
atccaccagttcatctcactgagctcgcaggcagccccagccaccagcgaaatggccgcgtcggcgctgcaccagacgaccagcttcctcggcaccgccccgcggcgtgatgacctcgtccgcagcgtcggcgacttcggcggccgcatcaccatgcgccggaccgtcaagagcgcgccccagagcatctggtacggccctgaccgtcccaagtacctgggcccgttctccgagcagaccccgtcgtacctgaccggcgagttccccggcgactacgggtgggacaccgccggattgtcggctgacccagagaccttcgccaagaaccgggagctggaggtgatccactcacggtgggcgatgctcggcgccctggggtgcgtgttcccggagatcctgtccaagaacggcatcaagttcggcgaggccgtgtggttcaaggccggcgcccagatcttctccgagggcggcctcgactacctgggcaaccccaacctggtgcacgcgcagagcatcctcgccatctgggcggttcaggtggtgctcatgggcttcatcgagggctaccgcgttggtggcggccccctcggcgagggcctcgacatcatctaccccggcggcgccttcgacccacttggcctcgccgacgaccccgacaccgccgccgagctcaaggtgaaggagctcaagaacggccgcctcgccatgttctccatgttcggcttcttcgtgcaggccatcgtcaccggaaaggggccagttgagaacctcttcgaccacgtcgccgacccagtcaacaacaacgcgtgggccttcgccaccaacttcgcccccggaagctaaatgtgtttagccatccgtccgtccgtccgtccatcggacgagatatgcatgtgtacttgtacgtcgtggatcaacgtgtagctgcacgtactttgtgtgtttatttgtaccatgatcgagcgagcgagaggtcctctcgctagctgcgcgcaatgtaaattaattaagcacaaggtgtgcacgagggaatggatggaagaatcgtgtg

SEQ ID NO: 4089 - DNA, 1071 bp, Triticum aestivum
cccaaacacacaccatccaccagttcatctcactgagctcgcaggcagccccagccaccagcgaaatggccgcgtcggcgctgcaccagacgaccagcttcctcggcaccgccccgcgccgcgatgacctcgtccgcagcgtcggcgacttcggcggccgcatcaccatgcgccggaccgtcaagagcgcgccccagagcatctggtacggcccagaccgtcccaagtacctgggcccgttctccgagcagaccccgtcgtacctgaccggcgagttccccggcgactacgggtgggacaccgccggattgtctgctgaccccgagacgttcgccaagaacagggagctggaggtgatccactcgcggtgggcgatgctcggcgccctggggtgcgtgttcccggagatcctgtccaagaacggcatcaagttcggcgaggccgtgtggttcaaggccggcgtccagatcttctccgagggcggcctcgactacctgggcaaccccaacctggtgcacgcgcagagcatcctcgccatctgggcggtgcaggtggtgctcatgggcttcatcgagggctaccgtgttggtggcggccccctcggcgagggcctcgacatcatctacccaggaggcgccttcgacccacttggcctcgccgacgaccctgacaccgccgccgagctcaaggtgaaggagctcaagaacggccgcctcgccatgttctccatgttcggcttcttcgtgcaggccatcgtcaccgggaaggggccagttgagaacctcttcgaccacgtcgccgacccggtcaacaacaacgcctgggccttcgccaccaacttcgcccccggaagctaaatgtgtttagccgtccgtccgtccgtccgtccatcggacgagatatgcatgtgtacttgtacgtcgtggatcaacgtgtagctgcacgtactttgtgtgtttatttgtaccatgatcgagcgagcgagaggtcctctcgctagctgcgcgcaatgtaaattaattaagcacaaggtgtgcacgagggaatggatggaagaatcgtgtgtcatta

SEQ ID NO: 4090 - DNA, 1092 bp, Triticum aestivum
accagttcatctcactgagctcgcaggcagccccagccaccagcgaaatggccgcgtcggcgctgcaccagacgaccagcttcctcggcaccgccccgcggcgcgatgacctcgtccgcagcgtcggcgacttcggcggccgcatcaccatgcgccggaccgtcaagagcgcgccccagagcatctggtacggccctgaccgtcccaagtacctgggcccgttctccgagcagaccccgtcgtacctgaccggcgagttccccggcgactacggctgggacaccgccgggctgtctgccgaccccgagacgttcgccaaaaaccgggagctggaggtgatccactcgcggtgggcgatgctcggcgccctggggtgcgtgttcccggagattctgtccaagaacggcatcaagttcggcgaggccgtgtggttcaaggccggcgcccagatcttctccgagggcggcctcgactacctgggcaaccccaacctggtgcacgcgcagagcattctcgccatctgggcggttcaggtggtgctcatgggcttcatcgagggttaccgcgttggtggcggccccctcggcgagggcctcgacatcatctacccgggcggcgccttcgacccgcttggcctcgccgacgaccccgacaccgccgccgagctcaaggtcaaggagctcaagaacggccgcctcgccatgttctccatgttcggcttcttcgtgcaggccatcgtcaccgggaaggggccagttgagaacctcttcgaccacgtcgccgacccagtcaacaacaacgcgtgggccttcgccaccaacttcgcccccggaagctaaatgtgtttagccatccgtccgtccgtccgtccatcggacgagatatgcatgtgtacttgtacgtcgtggatcaacgtgtagctgcacgtactttgtgtgtttatttgtaccatgatcgagcgagcgagaggtcctctcgctagctgtgcgcaatgtaaattaattaagcacaaggtgtgcacgagggaatggatggaagaatcgtgtgtcattactcaagatcatcaactgcatggcgtatatggtacttcaa

SEQ ID NO: 4091 - DNA, 1043 bp, Leymus cinereus x Leymus triticoides
cagttcatctcactgagctcgcaggcagtcccagccactagcgaaatggccgcgtcggcgctgcaccagacgaccagcttcctcggcaccgccccgcgccgcgatgacctcgtccgcagcgtcggcgacttcggtggccgcatcaccatgcgccggaccgtcaagagcgcgccccagagcatctggtacggccctgaccgtcccaagtacctgggcccattctccgagcagaccccgtcgtacctgactggcgagttccccggtgactacggatgggacaccgcgggactgtcggccgaccctgagacgttcgccaagaaccgggagctggaggtgatccactcgcgctgggcgatgcttggtgccctcgggtgcgtgttccccgagatcctgtccaagaacggcatcaagttcggcgaggctgtgtggttcaaggctggcgcccagatcttctccgagggcggcctcgactacctgggcaaccccaacctggtgcacgcgcagagcatcctggccatctgggcggttcaggtggtgctcatgggcttcatcgagggttaccgtgttggtggcggccccctcggtgagggactcgacatcatctacccgggcggtgccttcgacccacttggcctcgccgacgaccccgacaccgccgccgagctaaaggtcaaggagctcaagaacggtcgcctcgccatgttctccatgttcggcttcttcgtgcaggccatcgtcaccggaaaggggccagttgagaacctcttcgaccacatcgccgacccagtcaacaacaacgcgtgggccttcgccaccaacttcgcccccggaagttaaatgtgtttagccatccgtctgtccatcgggcgagatatgcatgtgtacttgtacgtcgtggatcaacgtgtggctgcacgtactttgtgtgtttatttgtaccatgatcgagcgagcgagatgccctctccctagctgtgcgcaatgtaaattaattaagcacaaggtgtgcacgagcgaatggatggaagaatcgtgtgtcatta

SEQ ID NO: 4092 - DNA, 1017 bp, Lolium multiflorum
gccaccagttcatctcactcactgtcctagctagcaggccagtagctcggaatggccgcgtcggcgctgcaccagaccaccagcttcctcggcactgccccacgccgtgatgacctcgtccgcagcgtcggcgacttcggcggccgcatcaccatgcgccggactgtgaagagcgccccccagagcatctggtacggtcctgaccgtcccaagtacctgggtccattctcggagcagaccccatcttacctgaccggcgagtttcccggtgactacgggtgggacaccgcagggttgtcagctgacccagagacgttcgccaagaatagggagctagaggtgatccactcgaggtgggcgatgcttggcgcactcgggtgtgtgttcccagagatcctgtccaagaacggcatcaagttcggtgaggccgtgtggttcaaggccggcgctcagattttctctgagggcggtctcgactacctcggcaaccctaatctggtgcacgcacaaagcatcctcgccatctgggctacccaagtggtgctcatgggcttcatcgagggctaccgtgttggtggcggtcctctcggtgagggcctcgacaagatctacccaggcggctccttcgacccacttggccttgccgacgatcccgacaccgctgccgagctcaaggtcaaggagctcaagaatggccgcctcgccatgttctccatgttcggtttctttgtacaggccatcgtcaccggcaagggacccatcgaaaacctcttcgaccacgttgctgacccagtcaacaacaacgcatgggctttcgccaccaacttcgctcctggaagttaaatgagttagccatccgtccgaccaccgggcgagatatgcatgtgtacttgtacgtcgtggatcaacgtgtagctgcacgtactttgtgttattatctgtactatcattgagcgagtcccgtctcgctagttgtacgcaatgtaattaagcacaaggtacgccagtgaatgaatg

SEQ ID NO: 4093 - DNA, 1077 bp, Avena sativa
agtcctcctgctcctagctcggaatggccgcgtcggcgctgcaccagaccacctccttcctcggcaccgcaccacgccgtgatgacctcgtccgcagcgtcggcgacttcggcggccgcatcaccatgcgcaggactgtcaagagcgcgccccagagcatctggtacggccctgaccgtcccaagtacctaggcccattctcggagcagaccccatcttacctgaccggcgagttccccggcgactacgggtgggacaccgcagggttgtcggcggacccggagacgtttgccaagaacagggagctcgaggtcatccactcgaggtgggcgatgcttggcgcacttggatgtgtgtttcccgagatcttgtccaagaacggcatcaagttcggtgaggccgtatggttcaaggctggcgctcaaatcttttccgagggcggtctcgactatctaggcaaccccaaccttgtgcacgcacaaagcattctcgccatctgggccacccaagtggtgctcatgggcttcatcgagggctaccgggttggtggcggcccgctcggcgagggcctcgaccagatctacccaggcggcgcctttgacccacttggcctcgccgatgatccggacaccgcagccgagctcaaggtcaaggagctcaagaacggccgcctcgccatgttctccatgttcggtttcttcgtgcaggccatcgtcaccggcaagggacctatcgagaacctcttcgaccacgttgccgaccctgtgaataacaacgcatgggctttcgctaccaacttcgcccctggaagttaaatgagttagccatccgatccgaccaccggatgggatatgcatgtgtacttgtacgtcacggacggatcaacatgtagtagctgcatgtactttatctattcaccagggatctttggtgtggtgttataccaatcgctataagagtcttgaagattgttaaactattagtgtgccttggtcgtacgattctattgaactcgtggcaatttgtatctttttataatgacgacaaaaaccacgcatgaaaatgatagtacacttt

SEQ ID NO: 4094 - DNA, 1172 bp, Avena sativa
agtcctcctgctcctagctcggaatggccgcgtcggcgctgcaccagaccacctccttcctcggcaccgcaccacgccgtgatgacctcgtccgcagcgtcggcgacttcggcggccgcatcaccatgcgccggactgtcaagagcgcgccccagagcatctggtacggccctgaccgtcccaagtacctaggcccattctcggagcagaccccatcttacttgaccggcgagttccccggtgactacgggtgggacaccgcagggttgtcggcggacccggagacgtttgccaagaacagggagctcgaggtcatccactccaggtgggcgatgcttggcgcacttggatgtgtgttccccgagatcttgtccaagaacggcatcaagttcggtgaggccgtatggttcaaggctggcgctcagatcttttccgagggcggtctcgactatctaggcaaccctaaccttgtgcacgcacaaagcattctcgccatctgggccacccaagtggtgctcatgggcttcatcgagggctaccgggttggtggcggcccgctcggcgagggcctcgaccagatctacccaggcggcgcctttgacccacttggcctcgccgatgacccggacaccgccgccgagctcaaggtcaaggagctcaagaacggccgcctcgccatgttctccatgttcggtttcttcgtgcaggccatcgtcaccggcaagggacctatcgagaacctcttcgaccacgttgccgaccccgtgaataacaacgcatgggctttcgctaccaacttcgcccctggaagttaaatgatttagccatccgatccgaccaccggatgggatatgcatgtgtacttgtacgtcacggacggatcaacatgtaattcaccagggatctttggtgtggtgttataccaatcgctataagagtcttgaagattgttaaactactagtgcgtcctggcacacgatcccgttgaactcgtgtcaatttgtattcttttataatgacgacaaaatccacgcatgaaaatgatagtacactttataggctttacaaaatgaagattttaggatttatacaaagcactcaataatatgaaacattgcttgtacgtttccatgaaaacataaataaaaagtgagatatttatagaaaaaaaa

SEQ ID NO: 4095 - DNA, 997 bp, Secale cereale
gtccatctcactgagctcgcaggcagccccagccaccagcgaaatggccgcgtcggcgctgcaccagacgaccagcttcctcggcaccgccccgcgccgcgatgacctcgtccgcagcgtcggcgacttcggcggccgcatcaccatgcgccggaccgtcaagagcgcgccccagagcatctggtacggccctgaccgtcccaagtacttgggcccgttctccgagcagaccccgtcgtacctgaccggcgagttccccggcgactacgggtgggacaccgcggggctgtcggccgacccagagaccttcgccagaaccgggagctggaggtgatccactcgcggtgggcgatgctcggcgccctggggtgcgtgttcccggagatcctgtccaagaacggcatcaagttcggcgaggccgtgtggttcaaggccggcgcccagatcttctccgagggcggcctcgactacctgggcaaccccaacctggtgcacgcgcagagcatcctggccatctgggcggttcaggtggtgctcatgggcttcatcgagggctaccgcgttggtggcggccccctcggcgagggcctcgacatcatctacccgggcggcgccttcgacccgcttggcctcgccgacgaccccgacaccgccgccgagctcaaggtcaaggagctcaagaacggccgcctcgccatgttctccatgttcggcttcttcgtgcaggccatcgtcaccgggaaggggccagttgagaacctcttcgaccacgtcgccgacccagtcaacaacaacgcctgggccttcgccaccaacttcgcccccggaagctaaatgtgtttagccatcggacgagatatgcatgtgtacttgtacgtcgtggatcaacgtgtagctgcacgtactttgtgtgtttatttgtaccatgatcgagcgagcgagaggtcctctcgctggctgtgcgcaatgtaaattaattaagcacgaggtgcacgag

SEQ ID NO: 4096 - DNA, 1050 bp, Triticum aestivum
aaacacacaccatccaccagttcatctcactgagctcgcaggcagccccagccaccagcgaaatggccgcgtcggcgctgcaccagacgaccagcttcctcggcaccgccccgcggcgcgatgacctcgtccgcagcgtcggcgactttggcggccgcatcaccatgcgccggaccgtcaagagcgcgccccagagcatctggtacggccctgaccgtcccaagtacctgggcccgttctccgagcagaccccgtcgtacctgaccggcgagttccccggcgactacgggtgggacaccgccggattgtctgctgaccccgagacgttcgccaagaacagggagctggaggtgatccactcgcggtgggcgatgctcggcgccctcgggtgcgtgttcccggagatcctgtccaagaacggcatcaagttcggcgaggccgtgtggttcaaggccggcgcccagatcttctccgagggcggcctcgactacctgggcaaccccaacctggtgcacgcgcagagcatcctcgccatctgggcggtgcaggtggtgctcatgggcttcatcgagggctaccgtgttggtggcgggcccctcggcgagggcctcgacatcatctacccgggcggcgccttcgacccacttggcctcgccgacgaccccgacaccgccgccgagctcaaggtgaaggagctcaagaacggccgcctcgccatgttctccatgttcggcttcttcgtgcaggccatcgtcaccgggaaggggcccgtagagaacctcttcgaccacgtcgccgacccggtcaacaacaacgcgtgggccttcgccaccaactttccccccggaagctaaatgtgttaagccatctgtccgtccatcggacgagatatgcatgtgtacttgtacgtcgtggatcaacgtgtagctgcacgtactttgtgtgtttatttgtaccatgatcgagcgagcgagatgacctctcgctggctgcgcgcaatgtaaattaattaagcacgagatgcacgagcaaatggatggaagaatcgtg

SEQ ID NO: 4097 - DNA, 1062 bp, Triticum aestivum
aaacacacaccatccaccagttcatctcactgagctcgcaggcagccccagccaccagcgaaatggccgcgtcggcgctgcaccagacgaccagcttcctcggcaccgccccgcggcgtgatgacctcgtccgcagcgtcggcgacttcggcggccgcatcaccatgcgccggaccgtcaagagcgcgccccagagcatctggtacggccctgaccgtcccaagtacctgggcccgttctccgagcagaccccgtcgtacctgaccggcgagttccccggcgactacggatgggacaccgccggattgtcggctgacccagagaccttcgccaagaaccgggaggctggaggtgatccactcgcggtgggcgatgctcggcgccctggggtgcgtgttcccggagatcctgtccaagaacggcatcaagttcggcgaggccgtgtggttcaaggccggcgcccagatcttctccgagggcggcctcgactacctgggcaaccccaacctggtgcacgcgcagagcatcctggccatctgggcggttcaggtggtgctcatgggcttcattgagggttaccgtgttggtggcggccccctcggcgagggcctcgacatcatctacccgggcggcgccttcgacccgcttggcctcgccgacgaccccgacaccgccgcggagctcaaggtcaaggagctcaagaacggccgcctcgccatgttctccatgttcggcttcttcgtgcaggccatcgtcaccggaaagggacccgttgagaacctcttcgaccatgtcgctgacccggtcaacaacaacgcgtgggcctttgccaccaacttcgccccggaagctaaatgtgtttagccatccgtccgtccgtccgtccatcggacgagatatgcatgtgtacttgtacgtcgtggatcaacgtgtagctgcacgtactttgtgtgtttatttgtaccatgatcgagcgagcgagaggtcctctctctggctgtgcgcaatgtaaattaattaagcccaacgtgtgcacgagggaatggatggaagaatcgtgtg

SEQ ID NO: 4098 - DNA, 1083 bp, Avena sativa
ctcctagctcggaatggccgcgtcggcgctgcaccagaccacctccttcctcggcgccgcaccacgccgtgatgacctcgtccgcagcgtcggcgacttcggcggccgcatcaccatgcgccggactgtcaagagcgcgccccagagcatctggtacggccctgaccgtcccaagtacctaggcccattctcggagcagaccccatcttacctgactggcgagtttcccggtgactacgggtgggacaccgcagggttgtcagcggacccggagacgtttgccaagaacagggagcttgaggtgatccactcgaggtgggcgatgcttggcgcacttggatgtgtgttccccgagatcttgtccaagaacggcatcaagttcggtgaggccgtatggttcaaggctggcgctcagatcttttctgagggcggtctcgactatctaggcaaccccaaccttgtgcacgcacaaagcattctcgccatctgggcaacccaagtagtgctcatgggcttcatcgagggctaccgtgttggtggcggccctctcggtgagggcctcgaccagatctacccaggcggcgcctttgacccacttggcctcgccgacgatcctgacaccgccgctgagctcaaggtcaaggagctcaagaacggccgcctcgctatgttctccatgttcggtttcttcgtacaggccatcgtcaccggcaagggacctatcgagaacctcttcgaccacattgccgacccagtgaataacaacgcatgggctttcgccaccaacttcgcccccggaagctaaatgagttagccatctgtccgaccaccggatgggatatgcatgtgtacttgtacgttgtggatggatcaacatgtagtagttgcacgtactttatctgttcactagggatctttggcacggcgtgcaccggtggtgttataccgatccctataagagtcttgtagattgttaaactatatttgttttttaaattaagttgttggctattctggtggctttagcttttgctactgtgcgatttagcgcaggagatgtatgcacacactcgtacgaccacg

SEQ ID NO: 4099 - DNA, 846 bp, Secale cereale
tcaggtccatctcactgagctcgcaggcagccccagccaccagcgaaatggccgcgtcggcgctgcaccagacgaccagcttcctcggcaccgccccgcgccgcgatgacctcgtccgcagcgtcggcgacttcggcggccgcatcaccatgcgccggaccgtcaagagcgcgccccagagcatctggtacggtcctgaccgtcccaagtacctgggcccgttctccgagcagaccccgtcgtacctgaccggcgagttccccggcgactacggatgggacaccgcggggctgtccgctgacccagagaccttcgccaagaaccgggagctggaggtgatccactcgcggtgggccatgctcggcgccctggggtgcgtgttcccggagatcctgtccaagaacggcatcaagttcggcgaggcagtgtggttcaaggccggcgcccagatcttctccgagggcggcctcgactacctgggcaaccccaacctggtgcacgcgcagagcatcctggccatctgggcggttcaggtggtgctcatgggcttcatcgagggctaccgcgttggcggcggccccctcggcgagggcctcgacatcatctacccgggcggcgccttcgacccgcttggcctcgccgacgaccccgacaccgccgccgagctcaaggtgaaggagctcaagaacggccgcctcgccatgttctccatgttcggcttcttcgtgcaggccatcgtcaccgggaaggggcccgttgagaacctcttcgaccacgtcgccgacccagtcaacaacaacgcctgggccttcgccaccaacttcgccccggagctaaatgtgttta

SEQ ID NO: 4100 - DNA, 1102 bp, Triticum aestivum
aaacacacaccatccaccagttcatctcactgagctcgcaggcagccctagccaccagcgaaatggccgcgtcggcgctgcaccagacgaccagcttcctcggcaccgccccgcggcgcgatgacctcgtccgcagcgtcggcgacttcggcggccgcatcaccatgcgccggaccgtcaagagcgcgccccagagcatctggtacggccctgaccgtcccaagtacctgggcccgttctccgagcagaccccgtcgtacctgaccggcgagttccccggcgactacggatgggacaccgccggattgtcggctgacccagagaccttcgccaagaaccgggagctggaggtgatccactcgcggtgggcgatgctcggcgccctgggctgcgtgttcccggagatcctgtccaagaacggcatcaagttcggcgaggccgtgtggttcaaggccggcgcccagatcttctccgagggcggcctcgactacctgggcaaccccaacctggtgcacgcgcagagcatcctggccatctgggcggttcaggtggtgctcatgggcttcattgagggttaccgtgttggtggcggccccctcggcgagggcctcgacatcatctacccgggcggcgccttcgacccgcttggcctcgccgacgaccccgacaccgccgcggagctcaaggtcaaggagctcaagaacggccgcctcgccatgttctccatgttcggcttcttcgtgcaggccatcgtcaccggaaagggacccgttgagaacctcttcgaccatgtcgctgacccggtcaacaacaacgcgtgggcctttgccaccaacttcgccccggaagctaaatgtgtttagccatccgtccgtccgtccgtccatcggacgagatatgcatgtgtacttgtacgtcgtggatcaacgtgtagctgcacgtactttgtgtgtttatttgtaccatgatcgagcgagcgagaggtcctctctctggctgtgcgcaatgtaaattaattaagcccaacgtgtgcacgagggaatggatggaagaatcgtgtgtcattactcaagatcatcaactggcatggcgcgcgcgtata

SEQ ID NO: 4101 - DNA, 897 bp, Secale cereale
tcagccatccaccagtccatctcactgagctcgcaggcagccccagccaccagcgaaatggccgcgtcggcgctgcaccagacgaccagcttcctcggcaccgccccgcgccgcgatgacctcgtccgcagcgtcggcgacttcggcggccgcatcaccatgcgccggaccgtcaagagcgcgccccagagcatctggtacggccctgaccgtcccaagtacctgggcccgttctccgagcagaccccgtcgtacctgaccggcgagttccccggcgactacgggtgggacaccgcggggctgtcggccgacccagagaccttcgccaagaaccgggagctggaggtgatccactcgcggtgggcgatgctcggcgccctggggtgcgtgttcccggagatcctgtccaagaacggcatcaagttcggcgaggcagtgtggttcaaggccggcgcccagatcttctccgagggcggccttgactaccgtgggcaaccccaacctggtgcacgcgcagacgcatcctggccagtctgggcggttcaggtggtgctcatgggcttcatcgagggctacgcgttggcggcggccccctcggcagggcctcgacatcatctacccgggcggcgcctttcgacccgctttgggcctcgccgacgacccccgacaccgccgccgagctcaaggtgaaggagctcaagaacggccgcctcgccatgttctccatgttcggcttcttcgtgcaggccatcgtcaccgggaagggggcccgttgagaacctcttcgaccacgtcgccgacccagtcaacaacaacggccctggggccttcgccaccaacttcgcccccggaagtctaaatgtgtttagccatcggacgagatatgcatgtgtactt

SEQ ID NO: 4102 - DNA, 1891 bp, Oryza sativa
gctgtacaattttttgtttccggtagaccatcagcacttcagcagcaagctacttctagctaggtgagttggttggtgggtgcagatagtgttggatgcaggagacgagatctttccgtccaggtggcatcagcggattggtggagtggacggggaggagattccgcgccatacccatatccagtcgcgggggcgcggcggccaattgtgtggcgcggacgtggcgcgccgcgcgtccaccagtccaccgctccgccactcgtacgccgtataaagatctcccctcccgcgccgcccatctccaccacacaccacaaaaaaccaacccaaccgccgccgcatcgccctcgttagaacgatggccgcgtcggcgctgcaccagaccaccagcttcctcggcaccgcccctcgccgggatgagctcgtccgccgcgtcggcgactccggtggccgcatcaccatgcgccgcaccgtcaagagcgcgccccagagcatctggtatggacctgaccgtcccaagtacctgggcccgttctcggagcagacgccatcgtacctgaccggagagttcccgggagactacgggtgggacacggcggggctatcggccgacccggagacgttcgcgaggaacagggagctggaggtgatccactcgcggtgggcgatgctgggggcgctgggctgcgtcttcccggagatcctgtccaagaacggggtgaagttcggggaggcggtgtggttcaaggccggcgcgcagatcttctccgagggggggctcgactacctggggaaccccaacctggtgcacgcgcagagcatcctcgccatctgggcggtccaggtggtgctcatgggattcgtcgagggctaccgcgtcggcggcggcccgctcggcgagggcctcgacaaggtgtacccaggcggcgccttcgacccgctcggcctcgccgacgaccctgacaccttcgccgagctcaaggtgaaggagctcaagaacggccgcctcgccatgttctccatgttcggcttcttcgtccaggccatcgtcaccggcaagggccccatcgagaacctcttcgaccacgtcgccgaccccgtcgccaacaacgcctgggcatacgccaccaacttcgtccccggcaagtgagcacaacgacacgatcgagatggtgccaaccaacgtaccatgtgtacacttgtagtagccacgcaccgaccctgcagttgcagttgcagcagtgcatgtatgtatgtaccttaattgtgtgtgtgtgtgtgatcgatcgaggagatttctagcttaattaatttctgtctgtcatcatctttgcttctttggatcgagatttaatgtaagccgcaggccgcatccaagggatgatcgaattaatgatgtatcgttattataggatctacaacgaagccagctaaaacgatgccaatttgtgcgtcgacccaataaatcggtgcgggacccagttcacgcgagcacgccagcgttgcgggcttgcgtctcgcgctcccgcgccccagctggaccctgcgagcggctaaggaaaatgttcactcggggtccctcgtcttatggaaaagtgtttagttttagaatcatcgctaaaccgaaattcttcctccgtttcacaatgtaagtcattttagtattttccacattcatattaatactaatgaatctagatagatatatatgtctagattcattagcatcaatataaatctaggaaatgctagaataacttacattgtgaaacggagggagtaaatctagattcattagcatcaatatgaatgtgggaaatgctaaaatgacttatattgtgaaacgaagggagtaacatatataacacattactaatcttgcaaaaccaaa

SEQ ID NO: 4103 - DNA, 1045 bp, Panicum virgatum
acccagccgaacaatctcagctcgccggacacgcagaattgattgaagatggccgcgtcggcgctgcaccagaccaccagcttcctcgggcaggccctggtctcccgccccgccggcggcgccgacgccggcgggcgcatcaccatgcgccgcaccgtgaagagcgcgccccagagcatctggtacggccccgaccgccccaagtacctcggcccgttctccgagcagacgccgtcgtacctgaccggcgagttccccggcgactacgggtgggacacggcggggctgtccgccgacccggagacgttcgcgcgcaaccgcgagctggaggtgatccactcgcggtgggcgatgctgggcgcgctggggtgcgtgttcccggagatcctggccaagaacggcgtcaagttcggcgaggccgtgtggttcaaggccggcgcgcagatcttctccgagggcgggctggactacctggggaacccgaacctggtgcacgcgcagagcatcctggccatctgggcgtgccaggtggtgctcatgggcttcgtcgagggctaccgcgtcggcggcgggccgctcggcgaggggctcgacaaggtgtaccccggcggcgccttcgacccgctgggcctcgccgacgacccggacaccgccgcggagctcaaggtcaaggagctcaagaacggccgcctcgccatgttctccatgttcggcttcttcgtgcaggccatcgtcaccggcaagggccccatcgagaacctcttcgaccacgtcgccgaccccgtcgccaacaacgcctgggcctacgccaccaacttcgtccccggcaaatgaatgctgctctgctctgcttgtccaagaatgcagtaggcgtgtagagttgcacgcgccggcgtatgcttcgtaagctcgtcagattcagatcagatcagcggctgcgtctgcctgcacgtgatgtaaacttgtaaactacgcacagagatgcatgtgtaagatcaatggtgtaccgtaccattcatgagtggatcttgttgtcacttgtcca

SEQ ID NO: 4104 - DNA, 1276 bp, Zea mays
caatggcctgggcgcggacgtggcgcgccgggcgtccactagtcgcgccccgcaccgttgagcccttgagccgtcgtataaagatctccccgccgcaccaggccattcccaccagcaagaccaacaaacccacttctgactgaccactgtgccgcgccgtggtcaccggacggacacacagaacgacgatggccgcgtcggcgctgcaccagaccaccagcttcctcgggcaggccctggtctcccgcgccgccggcgtcgatgccggcggccgcatcaccatgcgccgcaccgtcaagagcgttccccagagcatatggtacggccctgatcgccccaagtatcttggcccgttctccgagcagacgccgtcgtacctgaccggcgagttccccggcgactacgggtgggacaccgcgggcctctcggccgacccggagacattcgcgcgcaaccgggagctggaggtgatccactcccggtgggcgatgctgggcgcgctgggctgcgtgttcccggagatcctggccaagaacggcgtcaagttcggcgaggcggtgtggttcaaggccggcgcgcagatcttctcggagggcgggctggactacctggggaaccccaacctggtgcacgcacagagcatcctggccatctgggcgtgccaggtggtgctcatgggcttcgtcgagggctaccgcgtcggcggcggcccgctcggggaagggctcgacaaggtgtaccccggcggcgccttcgacccgctgggcctcgccgacgacccggacaccgccgccgagctcaaggtgaaggagctcaagaacggccgccttgccatgttctccatgttcggcttcttcgtgcaggccatcgtcaccggcaagggccccatcgagaacctcttcgaccacgtcgccgaccccgtcgccaacaacgcctgggcatacgccacgaacttcgtccccggcaactaactgactgagcaacgccgtacatgtgtactaccatcagatccatccattcgttcgtccgtccgtcgagtgaacagtgtggtcttctctgtactctacttgttcagatcgtaggcgtgtagtagttgcaccagccggcgtatgctcatgatcgatgtgtgctcatcaatcaatgtcaatggctgcctgctgtaagcggtcgatgtaaactaagcacagacgcatgtatcgtcatcagtggatgaatcaatctatcgatggcctgtgccattcatttttgaatcgatcaacatcactccatcgatcga

SEQ ID NO: 4105 - DNA, 972 bp, Pennisetum glaucum
agccgagaactaacaatcagcagcgccgtcgtgctcgctcaccggacacgcagaagatggccgcgtcggcgctccaccagaccaccagcttcctcggccaggccctggtctcccgcccagccgccgccgatgccggcggccgcatcaccatgcgccgcaccgtcaagagcgctccccagagcatctggtacggccccgaccgccccaagtaccttggcccgttctccgagcagaccccgtcgtacctgaccggcgagttccccggcgactacggctgggacacggcggggctctccgccgaccccgagaccttcgcccgcaaccgcgagctggaggtgatccactcccggtgggcgatgctcggcgcgctcgggtgcgtgttcccggagatcctggccaagaacggcgtcaagttcggcgaggccgtgtggttcaaggccggcgcgcagatcttctccgagggcgggctggactacctgggcaacccgaaccttgtgcacgcgcagagcatcctggccatctgggcgtgccaggtggtgctcatgggcttcgtcgagggctaccgcgtcggcggcggcccgctcggtgagggcctcgacaaggtctaccccggcggcgccttcgacccgctgggcctcgccgacgacccggacactgccgccgagctcaaggtgaaggagctcaagaacggccgcctcgccatgttctccatgttcggcttcttcgtgcaggccatcgtcaccgggaagggacccatcgagaacctcttcgaccacgtcgccgaccccgtcgccaacaacgcgtgggcctacgccaccaacttcgtccccggaaagtgatctctccgcttgtgtgagtaggcgtgtagtagttgcacgcgccggcgtattgctctgtgtcgttgtgcttgtcagagagatcagatcagcggctgcctggacgtgcccgatgtaaaattactgtaaactaagc

SEQ ID NO: 4106 - DNA, 1741 bp, Panicum virgatum
atgaaatcttggtcatgttttgcaaattttcatcctttggcttacaaagtcccctagagataattatctgaaccaaaaagatagggacagcttacaaatacaaatacaaaacataactgtctgagccaaaaggatcacgatattttcgaaacttcaacctcacaacattttcacaagaagcggcgagtagggctgtaggagtaacaaaatacaacggctagtacgcaaacggccgtgatgcctgagctgcttgtttggtccagatagccttggatttgggcgaggcgatctttgcctccacctggcagccggccattgggcgcccaggccgcgcgatatccagggcgcgcggcggcggccaatgggctcgccgcggacgtggcgcgccgcgcgtccaccagtcccgccgcgcgtccaccggtcggcggccgtataaagatctcctccggcgccggccattcccatccaccaccacccagccgaacaatctcagctcgccggacacgcagaattgattgaagatggccgcgtcggcgctgcaccagaccaccagcttcctcgggcaggccctggtctcccgccccgccggcggcgccgacgccggcgggcgcatcaccatgcgccgcaccgtgaagagcgcgccccagagcatctggtacggccccgaccgccccaagtacctcggcccgttctccgagcagacgccgtcgtacctgaccggcgagttccccggcgactacgggtgggacacggcggggctgtccgccgacccggagacgttcgcgcgcaaccgcgagctggaggtgatccactcgcggtgggcgatgctgggcgcgctggggtgcgtgttcccggagatcctggccaagaacggcgtcaagttcggcgaggccgtgtggttcaaggccggcgcgcagatcttctccgagggcgggctggactacctggggaacccgaacctggtgcacgcgcagagcatcctggccatctgggcgtgccaggtggtgctcatgggcttcgtcgagggctaccgcgtcggcggcgggccgctcggcgaggggctcgacaaggtgtaccccggcggcgccttcgacccgctgggcctcgccgacgacccggacaccgccgcggagctcaaggtcaaggagctcaagaacggccgcctcgccatgttctccatgttcggcttcttcgtgcaggccatcgtcaccggcaagggccccatcgagaacctcttcgaccacgtcgccgaccccgtcgccaacaacgcctgggcctacgccaccaacttcgtccccggcaaatgaatgctgctctgctctgcttgtccaagaatgcagtaggcgtgtagagttgcacgcgccggcgtatgcttcgtaagctcgtcagattcagatcagatcagcagctgcgtctgcctgcacgtgatgtaaacttgtaaactacgcacagagatgcatgtgtaagatcaatggtgtaccgtaccattcatgagtggatcttgttgtcacttgtccatcgatgctctgattctttctcaagtaggctgaggaggagcagagaagctgtccgttcccctcccaacgaacgatgccatcgtgcaatttcagatcattgactcctcaaccttcacaatttcagacgctgtagtaggtagggtctgtgagcttgtcttaaaaacaaaaaggtaacgcgcaacctgcatgcttgggtctaactcattaacggaactaaggtcttg

SEQ ID NO: 4107 - DNA, 1114 bp, Panicum virgatum
cccagccgaacaatctcagctcgccggacacgcagaattgattgaagatggccgcgtcggcgctgcaccagaccaccagcttcctcgggcaggccctggtctcccgccccgccggcggcgccgacgccggcgggcgcatcaccatgcgccgcaccgtgaagagcgcgccccagagcatctggtacggccccgaccgccccaagtacctcggcccgttctccgagcagacgccgtcgtacctgaccggcgagttccccggcgactacgggtgggacacggcggggctgtccgccgacccggagacgttcgcgcgcaaccgcgagctggaggtgatccactcgcggtgggcgatgctgggcgcgctggggtgcgtgttcccggagatcctggccaagaacggcgtcaagttcggcgaggccgtgtggttcaaggccggcgcgcagatcttctccgagggcgggctggactacctggggaacccgaacctggtgcacgcgcagagcatcctggccatctgggcgtgccaggtggtgctcatgggcttcgtcgagggctaccgcgtcggcggcgggccgctcggcgaggggctcgacaaggtgtaccccggcggcgccttcgacccgctgggcctcgccgacgacccggacaccgccgcggagctcaaggtcaaggagctcaagaacggccgcctcgccatgttctccatgttcggcttcttcgtgcaggccatcgtcaccggcaagggccccatcgagaacctcttcgaccacgtcgccgaccccgtcgccaacaacgcctgggcctacgccaccaacttcgtccccggcaaatgaatgctgctctgctctgcttgtccaagaatgcagtaggcgtgtagagttgcacgcgccggcgtatgcttcgtaagctcgtcagattcagatcagatcagcagctgcgtctgcctgcacgtgatgtaaacttgtaaactacgcacagagatgcatgtgtaagatcaatggtgtaccgtaccattcatgagtggatcttgttgtcacttgtccatcgatgctctgattctttctcaagtaggctgaggaggacaacgaacgatgccatcgtgcaatttcagatc

SEQ ID NO: 4108 - DNA, 1522 bp, Setaria italica
tgggcgaggcgatccttgcctccacctggcagccggccattgggcgcccgggcgcgcgatatccagcggcgcgcggcggcagccaatgggctcggcgccgacgtggcgcgccgcttgaccaccagtcgatcgcgccgcgcgccaatcggcgtccgtataaagatcctcctccctcgccggcaattcccaccactcgatcagccgaaaacaatctcactgaccagtaggcagcagcgccgtcgtgctcaccggacacgcagaagatggccgcgtcggcgctccaccagaccaccagcttcctcggccaggccctggtctcccgccccgccgccgccgccgatgccggcggccgcatcaccatgcgccgcaccgtcaagagcgctccccagagcatctggtacggccctgaccgccccaagtacctgggcccgttctcggagcagacgccgtcgtacctgaccggcgagttccccggcgactacgggtgggacaccgcggggctctccgccgacccggagaccttcgcgcgcaaccgcgagctggaggtgatccactcgcggtgggccatgctcggcgcgctggggtgcgtgttcccggagatccttgccaagaacggcgtcaagttcggcgaggcggtgtggttcaaggccggcgcgcagatcttctccgagggcgggctggactacctgggcaaccccaacctggtgcacgcgcagagcatcctggccatctgggcctgccaggtcgtgctcatgggcttcgtcgagggctaccgcgtcggcggcggcccgctcggggagggactcgacaaggtctaccccggcggcgccttcgacccgctgggcctcgccgacgacccggacaccgccgccgagctcaaggtgaaggagctcaagaacggccgcctcgccatgttctccatgttcgggttcttcgtgcaggccatcgtcaccggcaagggacccatcgagaacctcttcgaccacgtcgccgaccccgtcgccaacaacgcatgggcgtacgccaccaacttcgtccccggcaagtgatgtgccctctgctcgtgagtaggcgtgtagtagttgcacgcgccagcgtattgctttgtgctcgtgagctcttcagatcagaccagaccagaccagctagcagctgcctggacgtgcccgacgatgtaaaattattgtaaactaagcacagatgcgtatgtcagctgatgatgaatcaatgcaacggtgtaccattcgtgagtgaaccgtcacttgtcagatcgatcttcagttagttatctcatgggacacactcgtgcacgcaacaacgttgttttttctcaaacaaagaaagtagagagtgatgacattgcattttagagacactaaaattcaggcatagtttaccatacctcgtcttacatcacgttttcctctatttttgaccctacaagaaacacagatctcagaggtatagcgaattcggtagctatatgactagttgagcatgtatatagttgaaacatttactt

SEQ ID NO: 4109 - DNA, 1080 bp, Sorghum bicolor
gatctcctccccacaccggccattcccaccaccaccaccgccaccgaacatttctcactgaccactgtgccgcgccgtgctcacacacagaacgacgatggccgcgtcggcgcttcaccagaccaccagcttcctcgggcaggccctggtctcccgccccgccgccgccgccgccgatgccggcggccgcatcaccatgcgccgcaccgtcaagagcgctccccagagcatctggtacggccctgaccgccccaagtaccttggcccgttctcggagcagacgccgtcgtacctgaccggcgagttccccggcgactacgggtgggacacggcggggctgtcggcggacccggagacgttcgcgcggaaccgcgagctggaggtgatccactcgcggtgggcgatgctgggcgcgctggggtgcgtgttcccggagatcctggccaagaacggcgtcaagttcggcgaggcggtgtggttcaaggccggcgcgcagatcttctcggagggcgggctggactacctgggcaacccgaacctggtgcacgcgcagagcatcctggccatctgggcgtgccaggtcgtgctcatgggcttcgtcgagggctaccgcgtcggcggcggcccgctcggggaagggctcgacaaggtctaccccggcggcgcgttcgacccgctcgggctcgccgatgaccccgacaccgccgcggagctcaaggtgaaggagctcaagaacggccgcctcgccatgttctccatgtttgggttcttcgtccaggccatcgtcaccggcaagggacccatcgagaacctcttcgaccatgtcgctgaccccgtcgccaacaacgcctgggcttacgccaccaacttcgtccccggcaactaaagctgatcgagcgagcgagctgaagctgagcagagcatccatgcgtgcatgtcgagcgaggtctcttgtactctacttgttgttttcaatcgtaggcgtgtagtagttgcacgagatcgatgtaaactaagcacagatcgcatgtaacatcagtgtggatgaatcaatctatatcgatggcctgtaccatattc

SEQ ID NO: 4110 - DNA, 1416 bp, Sorghum bicolor
tgggcggggcgatctttgcctccacctggcagccgcccattggtcgccccggcgcgcgatatccagagaggcgcggcggcagccaatggcctcggcgcggacgtggcgcgccgcgcatccaccagtcgcgccgcgcaccgttgagccgtcgacccgtcgtcgtataaagatctcctccccacaccggccattcccaccaccaccaccgccaccgaacatttctcactgaccactgtgccgcgccgtgctcacacacagaacgacgatggccgcgtcggcgcttcaccagaccaccagcttcctcgggcaggccctggtctcccgccccgccgccgccgccgccgatgccggcggccgcatcaccatgcgccgcaccgtcaagagcgctccccagagcatctggtacggccctgaccgccccaagtaccttggcccgttctcggagcagacgccgtcgtacctgaccggcgagttccccggcgactacgggtgggacacggcggggctgtcggcggacccggagacgttcgcgcggaaccgcgagctggaggtgatccactcgcggtgggcgatgctgggcgcgctggggtgcgtgttcccggagatcctggccaagaacggcgtcaagttcggcgaggcggtgtggttcaaggccggcgcgcagatcttctcggagggcgggctggactacctgggcaacccgaacctggtgcacgcgcagagcatcctggccatctgggcgtgccaggtcgtgctcatgggcttcgtcgagggctaccgcgtcggcggcggcccgctcggggaagggctcgacaaggtctaccccggcggcgcgttcgacccgctcgggctcgccgatgaccccgacaccgccgcggagctcaaggtgaaggagctcaagaacggccgcctcgccatgttctccatgtttgggttcttcgtccaggccatcgtcaccggcaagggacccatcgagaacctcttcgaccatgtcgctgaccccgtcgccaacaacgcctgggcttacgccaccaacttcgtccccggcaactaaagctgatcgagcgagcgagctgaagctgagcagagcatccatgcgtgcatgtcgagcgaggtctcttgtactctacttgttgttttcaatcgtaggcgtgtagtagttgcacgagatcgatgtaaactaagcacagatcgcatgtaacatcagtgtggatgaatcaatctatatcgatggcctgtaccatattcaattttcgatcaatcatcgttaattactccatcgctctatcgatcgaccattgattctttctggagtagtaacatgaatccacgatgggttgcctagtttgatgcgtgtgtatgcagtgcttggacgaggaatgttgttgcgaaaaatatcccagcgcaatagcgcat

SEQ ID NO: 4111 - DNA, 1997 bp, Panicum virgatum
aatttaccatgagatcttgggcacgttttgcaaatttccgtcctttggctcacaaagtcccctagagataattatctgaaccaaaatgacagggacggctcgcaaataaaacataactgtgcgaggcaaaaggatcacgatattttcgaagcttcaacctcacaacattttcacaagagtaacaaaatacaacggctagctagtacacagacatagtccaatacgtacaacgactgtgatgcctgagctgcttgtttggtccagatagcgttggatttgggcgaggcgatctttgcctccacctggcggccggccattgggcgccctggccgcgcgatatccaggcggcgcggcggcagccaatgggctcgccgccgacgtggcgcgccgcccgtccaccagtcccgccgcgcgtccgccagccggcggccgtataaagatctcctctccggcgccggccattcccatccaccaccgctcgatcggccgaacaatctccccggacacgcgcgcagaaccgaagatggccgcgtcggcgctgcaccagaccaccagcttcctcgggcaggccctggtaccccgccccgccggcgccggcgccgacgccggcggccgcatcaccatgcgccgcaccgtgaagagcgctccccagagcatctggtacgggcccgaccgccccaagtacctgggccccttctccgagcagacgccgtcgtacctgaccggcgagttccccggcgactacgggtgggacaccgcggggctctccgccgacccggagaccttcgcgcgcaaccgcgagctggaggtgttccactcgcggtgggcgatgctgggcgcgctggggtgcgtgttcccggagatcctggccaagaacggcgtcaagttcggcgaggcggtgtggttcaaggccggcgcgcagatcttctccgagggtgggctggactacctgggcaaccccaacctggtcacgcgcagagcatcctggccatctgggcttgccaggtggtgctcatgggcttcgtcgagggctaccgcgtcggcggcgggccgctcggggaggggctcgacaaggtgtacccgggcggcgccttcgacccgctggggctcgccgacgacccggacaccgccgcggagctcaaggtgaaggagctcaagaacggccgcctcgccatgttctccatgttcggattcttcgtgcaggccatcgtcaccggcaagggccccatcgagaacctcttcgaccacgtcgccgaccccgtcgccaacaacgcctgggcctacgccaccaacttcgtcccgggcaactgatcaatctgctctgcttgtaggcgtgtagtagttgcacgcgccggcgtatgctccgtgtgctctcgtcagattcagattcagatcatcagcagctgcgtctgcctgcacgtgatgtaaacttgtaaactacgcacggagatgcatgtgtaagatcaatggtgtacgtgtaccataccattcatgagtggatcttcttgtcactcatccatcgatgctgattctttctctcaagtagtccggatgaggaggagcagaggagctgcccgttcccctcccaacgaacgacgccattgtgcaattcagatcatgcactcctcaaccttcacaatctaacactctgtagtaggtagggtctgtgagctcttgtcttgaaaacaaaaaggtataacgcgcaacctgcatgcttgggtctaactgataaacggaataattaagagagcaagaaccttcagttagttacttcatcgagctatcagcaaaggaacttcaagtattagctacagcacattttatttaggagtcctgatctctcgtgcagggttggattatgagagtggtcgaaccatggattcaaccagtctagaaaacgtagcgccgttgactttgggttgggcttcgcttcacccagattcaacatagagatcactgtgagcgagcctcttgaagatgatgacgcagttgactgt

SEQ ID NO: 4112 - DNA, 1120 bp, Panicum virgatum
cctcctcatccggactacttgagagaaagaatcagcatcgatggatgagtgacaagaagatccactcatgaatggtatggtacacgtacaccattgatcttacacatgcatctccgtgcgtagtttacaagtttacatcacgtgcaggcagacgcagctgctgatgatctgaatctgaatctgacgagagcacacggagcatacgccggcgcgtgcaactactacacgcctacaagcagagcagattgatcagttgcccgggacgaagttggtggcgtaggcccaggcgttgttggcgacggggtcggcgacgtggtcgaagaggttctcgatggggcccttgccggtgacgatggcctgcacgaagaatccgaacatggagaacatggcgaggcggccgttcttgagctccttcaccttgagctccgcggcggtgtccgggtcgtcggcgagccccagcgggtcgaaggcgccgcccgggtacaccttgtcgagcccctccccgagcggcccgccgccgagcggtagccctcgacgaagcccatgagcaccacctggcaagcccagatggccaggatgctctgcgcgtgcaccaggttggggttgcccaggtagtccagcccaccctcggagaagatctgcgcgccggccttgaaccacaccgcctcgccgaacttgacgccgttcttggccaggatctccgggaacacgcaccccagcgcgcccagcatcgcccaccgcgagtggaacacctccagctcgcggttgcgcgcgaaggtctccgggtcggcggagagccccgcggtgtcccacccgtagtcgccggggaactcgccggtcaggtacgacggcgtctgctcggagaaggggcccaggtacttggggcggtcgggcccgtaccagatgctctggggagcgctcttcacggtgcggcgcatggtgatgcggccgccggcgtcggcgccggcgccggcggggcggggtaccagggcctgcccgaggaagctggtggtctggtgcagcgccgacgcggccatcttcggttctgcgcgcgtgtccggggagattgttcggccgatcgagcggtggtggatgggaatggccggcgccggagaggaga

SEQ ID NO: 4113 - DNA, 1137 bp, Cynodon dactylon
atacatctcatcatcagttgcgtcttgctcgccggacacatcacacaagaaaatggccacctccgcgctgcagcagaccaccagcttcctcggccaggctctcgtgagccgcgtcggcgtcgatgccggcggccgcatcaccatgcgccgcaccgtgaagagcgcgccccagagcatctggtacggccctgaccgtcccaagtaccttggcccgttctccgagcagaccccgtcatacctgaccggcgagttccccggtgactacgggtgggacaccgctgggctctccgccgacccggagaccttcgcccgtaaccgcgagcttgaggtgatccactgccgctgggccatgctcggcgctctcgggtgcgtgttcccggagatccttgccaagaacggcgtcaagttcggcgaggccgtctggttcaaggccggcgctcagatcttcagcgagggcgggctggactacctgggcaacccgaacctggtgcacgcgcagagcatcctggccatctgggctgtccaggtcgtgctcatgggcttcgtcgagggctaccgtgtcggcggcggcccgctcggcgagggcctcgacaagatctaccccggcggcgccttcgacccgcttggcctcgccgatgaccccgacaccgcggcggagctcaaggtgaaggagatcaagaacggcaggctcgccatgttctccatgttcggattcttcgtgcaggccatcgtcaccgggaagggacccatcgagaacctcttcgaccacgtcaacgaccccgtcgccaacaacgcctgggcgtacgccaccaacttcgtccccggcaagtgagaagtcacccacccgtccaattcacggaggtagtcgcgtagtagttgcacgcgcgtgtatatgccctgtgcttgtcagaagctggctgtgtacgtgatgtaaattaagcacaggtgcatgatgatgaatggatcaacaatcatgtgtaccagtaccactcgttcgatgaccctttttttttttttattcttcagcaatgggtttccaaaactctcgatgtatatgagactttggtctctctaatagcttcaaacttgcgacaactgctctatcttttctgtaagactcccttcattcgttaggaa

SEQ ID NO: 4114 - DNA, 1106 bp, Eragrostis curvula
gctcacgcggtggcggccgcggggactcaactgaagaacaatctcagctgcctgcttcgccggacacactagtcacaatggccgcgtcggcgctgcagcagaccaccagcttcctcggccaggctctggtgagccgcgtcggcgtcgatgccggcggccgcatcaccatgcgccgcacgtcagagcgcgcccagagcatctggtacggccccgaccgtcccaagtaccttggcccgttctccgagcagacgccgtcgtacctgaccggcgagttccccggcgactacggctgggacaccgccggcctctccgccgaccctgagaccttcgcccggaaccgggagctggaggtgatccacgcgcggtgggcgatgctgggcgcgctgggctgcgtgttcccggagatcctggccaagaacggggtcaagttcggcgaggccgtctggttcaaggcgggggcccagatcttcagcgagggcgggctcgactacctgggcaaccccaacctggtgcacgcgcagagcatcctggccatctgggccgtccaggtcgtgctcatgggcttcgtcgagggctaccgcgtcggcggcggcccgctcggcgagggcctcgacaaggtctaccccggcggcgccttcgacccgctcggcctcgccgatgaccccgacaccgccgccgagctcaaggtcaaggagatcaagaacggccgcctcgccatgttctccatgttcggattcttcgtccaggccatcgtcaccgggaagggacccatcgagaacctcttcgaccacgtcaacgaccccgtcgccaacaacgcatgggcatacgccaccaacttcgtccccggcaagtgagagcctcagagctagccatccatccatggagacatggagcattatactctatctgctgaattgtggtaggcgtgtagtagttattgcacgcgcgtatgctttgtgtgctcgctcctctgaagccgtacgtgatgtaaattaagcgcaggtgcatgatgatgaatgtatcattcaatgggtgtaccactcgatcgacgattgatcacctatcagtttttttggaccgggctctcaatgtcgtttctgttgcca

SEQ ID NO: 4115 - DNA, 1098 bp, Elaeis guineensis
cagccgaaaacaatctcactgaccagtaggcagcagcgccgtcgtgctcaccggacacgcagaagatggccgcgtcggcgctccaccagaccaccagcttcctcggccaggccctggtctcccgccccgccgccgccgccgatgccggcggccgcatcaccatgcgccgcaccgtcaagagcgctccccagagcatctggtacggccctgaccgccccaagtacctgggcccgttctcggagcagacgccgtcgtacctgaccggcgagttccccggcgactacgggtgggacaccgcggggctctccgccgacccggagaccttcgcgcgcaaccgcgagctggaggtgatccactcgcggtgggccatgctcggcgcgctggggtgcgtgttcccggagatccttgccaagaacggcgtcaagttcggcgaggcggtgtggttcaaggccggcgcgcagatcttctccgagggcgggctggactacctgggcaaccccaacctggtgcacgcgcagagcatcctggccatctgggcctgccaggtcgtgctcatgggcttcgtcgagggctaccgcgtcggcggcgggccgctcgggagggctcgacaaggtgtacccggcggcgccttcgacccgctggggctcgccgacgacccggacaccgccgcggagctcaaggtgaaggagctcaagaacggccgcctcgccatgttctccatgttcgggttcttcgtgcaggccatcgtcaccggcaagggacccatcgagaacctcttcgaccacgtcgccgaccccgtcgccaacaacgcatgggcgtacgccaccaacttcgtccccggcaagtgatgtgccctctgctcgtgagtaggcgtgtagtagttgcacgcgccagcgtattgctttgtgctcgtgagctcttcagatcagaccagaccagaccagctagcagctgcctggacgtgcccgacgatgtaaaattattgtaaactaaagcacagatgcgtatgtcagctgatgatgaatcaatgcaacggtgtaccattcgtgagtgaaccgtcacttgtcagatcgatcttcagttagttatctcaaaaaa

SEQ ID NO: 4116 - DNA, 1003 bp, Antirrhinum majus
  misc_feature (866)..(868): n is a, c, g, or t
  misc_feature (911)..(911): n is a, c, g, or t
  misc_feature (913)..(916): n is a, c, g, or t
  misc_feature (947)..(948): n is a, c, g, or t
  misc_feature (951)..(951): n is a, c, g, or t
cgaattcggcacgaggcagaagcaactaaagagaaaagctgtagaaaaaaaaaaaaaatatggcaacttctgcaatccaacaatctgcttttggcggccagacagcgttgaagccgaagaatgagctgatccgaaaggtcggaaacctcggcaccggcggccgcttcaccatgagacgtaccgtcaagagtgctcctcagagcatctggtatggaccagaccggccaaagtacttgggtccattctcagagcaaaccccatcatacctcactggtgaattccctggtgactacggttgggacactgctggactctcagccgacccagaaacattcgccaagaaccgcgaactcgaagtgatccactcccgttgggccatgcttggtgcattgggctgcgtcttccccgaaatcctttctagaaatggtgtcaaattcggtgaggccgtttggttcaaagccggatcccaaatcttctctgaaggtgggcttgactatttgggcaacccaaaccttgtccatgcccaaagcattttggctatttgggccgtccaagttgtgctaatgggcttcgtcgagggctacagagttggtggaggcccacttggtgaaggactcgacaagatctacccgggtggggcttttgacccattgggcctggccgatgacccggaagctttcgctgagttgaaggttaaggaactcaagaatggtcgtcttgctatgttctcaatgttcggattctttgtccaggctattgttactggaaagggtccggtcgagaacttgtttgatcatgttgctgatccagttgccaacaatgcatgggcatttgccacaaactttgtgcccggaaaatgagtttgnnnttgtgttgatcgatgaagttgtgtaaatttgaaatgtattgangnnnnggttcatggacttggatttgtgtgctttaannaangaatcttactgctataaatggcagaacttggaactcctctttcttacagtac

SEQ ID NO: 4117 - DNA, 1145 bp, Aristolochia fimbriata
acctgcagtcggccagaccaagagaaagaagaaagaagcaaagagagttgcagagatggccgcctcagcgatccagcagtccgcattcgccggccagacggcgctgaagcagcgcgacgagctcgtccgcaaagtcggcgtcttcgacggccgcatctccatgcgccggaccgtcaagagcgccccccagagcatctggtacggtcccgaccgccccaagtacttgggccccttctcggagcagacgccgtcttacctgaccggagaattccccggcgattacgggtgggacaccgccgggctctccgccgaccccgagaccttcgcgaagaacagggagctggaggtgatccactgcaggtgggccatgctcggcgccctcggctgcgtcttcccggagatcctctccaagaacggcgtcaagttcggggaagccgtttggttcaaggccggcgcccagatcttctccgagggcggactcgactacttgggcaaccccaacctggtccacgcccagagcatcctcgccatttgggcgtgccaggtggtgctcatgggcttcgtcgaagggtaccgagtcggcggcggacccctcggagagggccttgacgccatctaccccggcggcgccttcgaccccctgggactcgccgacgacccggaggcgttcgccgagttgaaggtgaaggagatcaagaacggccgcctcgccatgttctccatgttcgggttcttcgtgcaggctattgtcaccggcaagggccccatcgagaacctctccgaccacattgctgaccctgttgctaacaatgcctgggcttacgccaccaacttcgtcccagggaagtgaacaatgaaaaggccggggatttactgctctgagagactgaaacttgtactattattagtattgagaggattcgggagagatttatgatcagtggtgggttgcctgtgggaatctatgtaaaatgtagctttgctgatgttagaaatagatgaaacattaccgtgtctaatcttcccttgtgggtgatgaaattctgaatcttggattgcacggattaatttttgcttttccttctgggctgatagggagaaatacctctctcaaccggcatagacaaggcttctttcactcagta

SEQ ID NO: 4118 - DNA, 1000 bp, Cucurbita pepo
ttcagccccccttaagaagtttcacacaaatatggccacctctgctatccaacaatccgcctttgcaggccagactgccttgaagcaatccaatgagcttgtccggaaggtcggcgctttcggtggcagccgcttcaccatgcggcggacagttaagagtgctccacagagcatatggtatggggcagatcgcccaaaatacttgggaccattctctgaacaaacaccatcttacctgactggagagttccctggtgactatggatgggacacagccggtctgtcagccgatcccgaaacatttgcgaagaaccgtgagctcgaggtgatccactcccgatgggccatgcttggtgcattaggttgtgtcttccctgaaatccttgcaaagaatggtgtcaagtttggtgaatcagtttggttcaaggctggttctcagatcttctctgagggtggtctagattacctcggcaacccaaacctcatccatgctcagagtattcttgcaatctgggcatgccaggttgtgctcatgggctttgttgaaggataccgggttggtggcggtccccttggtgaaggactagacccaatttacccaggaggcgccttcgacccgctcggattggcagatgatccagatgcatttgctgagttgaaggtgaaggaactaaagaatggaaggctggcaatgttctccatgttcggattcttcgtccaggctattgtcaccggaaagggtcctgttgagaatctctttgaccatgttgcagatcctgttgccaacaatgcatgggcttacgccaccaacttcgtccccggaaaatgaagaaacatgtcgtaaaaactctgttttaccatgctcaaaattcttatgtttcctgaaaatcttatgctgtggactccattagtgctgatgtaatttctctagtagaaacatccattgaagttcaaagttctctgtgctatgtcttcttttcacatatagaatttcagcatg

SEQ ID NO: 4119 - DNA, 994 bp, Actinidia deliciosa
cttcttcttcacaccatcctacaacaaaccattgtgaaaaaacataagcaacaaagaagctccgcagagtaatggcgacctccgctatccaacacgcagcctttgccggccagacggctttgagtcgccagaatgagttcttcaggaaggtcggacccattggtggtacccgtttcaccatgagacgcaccgtgaaaagtgctccccaaagcatatggtatgggccggaccgcccaaagtacttgggcccattctccgagcaaactccatcatacttgacaggtgaattccccggtgactacgggtgggatactgctgggctgtcagctgaccccgagacctttgccaagaaccgtgagctcgaagtgatccactcccgctgggccatgctcggtgcactgggctgtgtgttccctgaaatcctttccaaaaacggtgtcaagttcggcgaggcagtttggttcaaggccggatcccaaattttctccgaaggcggccttgattacctaggaaaccctaacctcgtccacgctcagagcatccttgcgatctgggcctgccaagtggtgctcatgggctttgttgagggataccgggttggtggaggcccacttggtgaagggctcgacaagatctaccctggaggagcctttgacccacttggactggccgatgacccagaggcatttgcagaattgaaggtgaaggagctcaagaatggccggctagcaatgttttcgatgttcggattcttcgtccaggccatcgttactggaaagggcccaattgagaacctttccgaccaccttgctgatcctgtggccaacaatgcatgggcttatgccactaacttcgtacccggaaaatgaagagtgagctgaaacattactagagcttcttgatgtaattgagtttctctacctgtggatggaatcagtactgatgtaatattacttgcagaaactggttatctaagatctatattgtcacttga

SEQ ID NO: 4120 - DNA, 931 bp, Liriodendron tulipifera
gaaagcttaagcaaaatcctgtaagcatctccatggccacctctgcaatccaacggtccgccttcgccggccagaccgtgctgaagccccagaatgaactcgtcaggaaggttggcgtcttcgagggccgcatctcgatgcgacggacggttaagagcgctccccagagcatttggtacggccctgatcgcccaaaatacttgggcccattttccgagcaaactccatcgtacctgacaggtgaattccccggcgactatggttgggacactgccggtctgtctgcagacccagagaccttcgccaagaaccgcgagctggaggtgatccacagccggtgggccatgcttggagcattgggctgtgtcttccctgaaatcctctcgaagaacggggtcaaattcggggaggccgtttggttcaaagctggctcccaaatcttctctgaaggcgggcttgactaccttggaaacccaaacctcatccatgcccagagcatccttgcaatctgggcttgccaggttgtcctcatgggctttattgaggggtacagggttggtggtggcccgcttggtgaagggctggatgccatctatccgggtggtgccttcgacccactggggctagctgatgatccagaggcatttgcagagctgaaggtgaaggagatcaagaacggccgcctggcaatgttctccatgttcggattcttcgtccaggctattgtcaccggcaaaggcccgattgagaacctctttgaccatcttgctgatcctgtggctaacaatgcatgggcctatgctaccaactttgtacccgggaagtgattggcttccacgccttttctggcttgtattattatgagactttggttggttgtaatctctggctgtgggttcagtaactcaataaaaatgtagttttaccatca

SEQ ID NO: 4121 - DNA, 1206 bp, Cucumis sativus
ctatgtgaattgtgaatgatcccaccaatatcttggatgccacgtggcttggcaatacgccattaataatctgcatgaaaatctgggtttgagcagaagaaccaataggatgttgctgacttgtaacaatcctaatccactatatctttccatccccaatataacctccattttcactaccttcatcctcgtctaaaaccaaccttcacccctcctttggcattgcatcaaacttcttacaaagcttcatacactcatggccacctctgctattcaacaatccgccttcgccggccagactgccttgaagcaatccaatgagcttgtccgaaaggtcggtgctctcggtggcgcccgcttcaccatgaggcggacagttaagagtgctccacagagcatttggtatggacctgatcgcccaaagtacttgggaccattctctgaacaaacaccatcttacctgactggagagttccctggtgactatggatgggacacagccggtctgtcagcagatcccgagacttttgcaaagaaccgtgagcttgaggtgatccactcccgatgggccatgcttggtgcgttaggttgtgtcttccctgaactccttgcaaagaatggcgtcaagttcggtgaatcagtttggttcaaggctggttctcagatcttctctgagggtggtctagactaccttggcaacccaaaccttatccatgctcagagtatccttgcaatctgggcttgccaggttgtgctcatgggatttgttgaaggttaccgtgttggtggcggtccccttggtgaaggactagacccaatttacccaggaggtgccttcgacccactcggattggcagatgacccagatgcatttgctgagttgaaggtcaaggaacttaagaacggaaggctggcaatgttctccatgttcggattctttgtccaggctatcgtcaccggcaagggtcctattgagaatctctttgaccatgtcgcagatcctgttgccaacaatgcatgggcttatgccaccaactttgtccccggaaaatgaagaaacctgtaggaaacaactatctgttttacacacttaagcatctcctcctgaaaatcacatgttgatgtaatttctcaagtagagactccctgcaattaaatctgtatcagtaaagttcaaaattttctatgctttgtgttattttcacg

SEQ ID NO: 4122 - DNA, 963 bp, Flaveria ramosissima
cctcaacaatctatcatcaattcactttccccttactcaaatggcgacctctgcaatccaacagtcagcattcgccggctccgcggcgttgaagccacaaaacgagctcgtcaagaagaccggtagcttcaacggcggccgcttcaccatgcgccgaaccgtcaagagtgcaccacaaagcatttggtatgggccggacaggcccaagtacttgggcccgttctcagagcaaaccccatcatacctaaccggagaattccctggtgattatgggtgggacacagctggattatcagctgatcccgagacatttgccaagaaccgtgagcttgaagtgatccactcccggtgggccatgctcggcgcactcgggtgcgtgttccccgagattctttcaaagaacggtgtcaaattcggtgaagcagtctggttcaaggcgggctcccaaatattctcagaaggtgggcttgactacctcgggaaccccaacttgatccatgctcagagcatcttagctatctgggcttgtcaggttgttctcatgggcctcattgaagggtaccgcgttggtggaggcccattgggtgaagggctcgacaagatttacccaggtgggtcttttgacccacttggattggctgatgacccggatgcatttgctgagttgaaggttaaggagcttaagaatggacgactggctatgttttcgatgttcgggttcttcgttcaggccatcgttactggaaaaggcccgatcgagaacttgtttgatcatgtaagtgatccggtggctaacaacgcttgggcttatgccaccaactttgttcctggaaaatgagtttgattagtgtaaatttgatgatgattatgaagtaatattacaagtttccggctaattttgttatttgatgtttcaatactttaaagtcgatagttctttttattaatcaagtggctaatttc

SEQ ID NO: 4123 - DNA, 1364 bp, Populus trichocarpa
ttttgttttaaatttaatctctatataatgtggcttgaatcgatgataagcaccccaccaacaaagatctttcaactccacatggcataagagtagcctatattttcttggaaaaaatcgacatggaaatccacatcctatccagtaaccaatgggataccgctgacgtgtagatttcctaatccacaacatcttgtcatttcatatacatctcccctcttcctgcgttgattagcatctacactcagtcagccttgatagagtaagagaaaagcagagcaagcaacttagaggcagcattaacaaagaagagtcatggcagcctctgcaatccaacagtctgcatttgctggccagaccgccttgaagcaaccaaatgatcttgtccggaaggttggttcctttggtggtggtcgtgttaccatgcgcaggactgtgaaaagtgctccccaaagcatatggtatggcccagaccgcccaaagttcttgggtccattctctgagcaaaccccatcatacctgaccggtgaattccctggtgattatggatgggacactgctggtttgtctgcagatcctgagacatttgccaagaaccgtgagcttgaggtgatccacagcagatgggccatgcttggtgcacttggatgtgtctttcctgaaattcttgcaaagaatggtgtcaagttcggtgagtcagtttggttcaaggctggagctcaaatcttctcagagggtggccttgattaccttggcaaccccaacctcatccatgctcagagcatcctcgccatctgggcttcccaggttgtgcttatgggattcgttgaagggtacagagtgggtggagggccacttggcgaaggacttgaccccatttatcctggcggtgcctttgacccacttggcctcgctgatgatcctgatgcatttgcagagttgaaggtgaaggaactcaagaatggccgcctcgcaatgttctcaatgtttggattcttcgttcaggccattgtcactggaaagggtcctgttgagaaccttttggatcaccttgccgatccagtggccaacaatgcttgggcatacgccactaacttcgttcctggaaaatgaagaaactcagatggttgccttgtagcttgtgacattactaattagtccttgtgcttttgttgaaaacttctggttctggactccaccggtacttgtgatttcagcagtggatattttacatgtatcggaaaagtactgtatccccttttcactatgaacatgagactcttttgtgcttgaatctactttttttagttggatttgtctcgtggataagtttttagataaaaacaaaaataagtaacagttcc

SEQ ID NO: 4124 - DNA, 1019 bp, Camellia sinensis
ggggacacaaacttacctacaacaaacaagcctacagagaaacatcagcaccaacaaagaagctctcacgcagtcatggccacctctgctatccaacagtcggctttcgctggacagactgccctgaagccccagaatgagcttgtcaggaagatcggcagcttcggaggtggccgcatcaccatgaggcgcactgtgagaagtgctccccaaagcatatggtatgggccagaccgcccaaagtacttgggcccattctccgagcaaactccatcatacttgaccggtgaattccccggtgactatggttgggacactgctgggctttcagcagaccccgagacctttgccaagaaccgtgaactcgaggtgatccactgccgctgggccatgctcggtgcactgggctgtgtcttccccgaaatcctttccaagaatggtgtcaagttcggtgaggcagtttggttcaaggctggagcccaaattttctccgaaggtggccttgattaccttggcaatccaaacctgatccatgcccagagcatcctcgcaatctgggcttgccaagtagtgctcatgggcttcattgagggctaccgggttggcggaggcccacttggcgaaggactcgacaaaatctaccccggaggagcctttgacccacttggacttgctgatgatccagaagcatttgcagagttgaaggtgaaggagatcaagaatggacggctggcgatgttttcaatgtttggattcttcgtccaggccatcgttactggaaagggcccaattgagaacctcttcgaccatctcgctgatcctgtggccaacaatgcttgggcttatgccactaacttcgtacctggaaaatgaagtatgaagattgagctgtaacattacttaaagcttcttggggtaattgaatgtgtattgggtccatcctgatgtaatattacttgcagaaactgcctatctgagacttttattgccacttttgagtgttcagatgttatggttgc

SEQ ID NO: 4125 - DNA, 1356 bp, Triticum aestivum
tcccttatcccttgtcggttgcctttggcagtctcgtagaagcctggatcaacccagacgtacgcggggacccaaacacacaccatccaccagttcatctcactgagctcgcaggcagccccagccaccagcgaaatggccgcgtcggcgctgcaccagacgaccagcttcctcggcaccgccccgcggcgtgatgacctcgtccgcagcgtcggcgacttcggcggccgcatcaccatgcgccggaccgtcaagagcgcgccccagagcatctggtacggccctgaccgtcccaagtacctgggcccgttctccgagcagaccccgtcgtacctgaccggcgagttccccggcgactacgggtgggacaccgccggattgtcggctgacccagagaccttcgccaagaaccgggagctggaggtgatccactcacggtgggcgatgctcggcgccctggggtgcgtgttcccggagatcctgtccaagaacggcatcaagttcggcgaggccgtgtggttcaaggccggtgcccagatcttctccgagggcggcctcgactacctgggcaaccccaacctggtgcacgcgcagagcatcctcgccatctgggcggttcaggtggtgctcatgggcttcatcgagggttaccgcgttggtggcggccccctcggcgagggcctcgacatcatctacccaggcggcgccttcgacccacttggcctcgccgacgaccccgacaccgcagctgagctcaaggtcaaggagctcaagaacggccgcctcgccatgttctccatgttcggcttcttcgtgcaggccatcgtcaccggaaggggcccgtagagaacctcttcgaccacgtcgccgacccggtcaacaacaacgcgtgggccttcgccaccaacttcgcccccgaaagctaaatgtgttaagccatctgtccgtccatcggacgagatatgcatgtgtacttgtacgtcgtggatcaacgtgtagctgcacgtactttgtgtgtttatttgtaccatgatcgagcgagcgagatgacctctcgctggctgcgcgcaatgtaaattaaattaaagcacgagatgcacgagcaaatggatggaagaatcgtgtatcattagtacattactcgagatcatcaactggcatggcgtatatggtacttcaagctcatgaaacgggacattcgcaacggcatacggagatccaacgggccaactatacaactctgtctttgtggctattcttggttcagaaacccagtttctctcgtttgaaatcctttcagatcgtaactttagtaaactacatagcaagcatgaacatgaatacacagatttgtac

SEQ ID NO: 4126 - DNA, 1364 bp, Populus trichocarpa
tttgttttaaatttaatctctatataatgtggcttgaatcgatgataagcaccccaccaacaaagatctttcaactccacatggcataagagtagcctatattttcttggaaaaaatcgacatggaaatccacatcctatccagtaaccaatgggataccgctgacgtgtagatttcctaatccacaacatcttgtcatttcatatacatctcccctcttcctgcgttgattagcatctacactcagtcagccttgatagggtaagagaaaagcagagcaagcaacttagaggcagcattaacaaagaagagtcatggcagcctctgcaatccaacagtctgcatttgctggccagaccgccttgaagcaaccaaatgatcttgtccggaaggttggttcctttggtggtggtcgtgttaccatgcgcaggactgtgaaaagtgctccccaaagcatatggtatggcccagaccgcccaaagttcttgggtccattctctgagcaaaccccatcatacctgaccggtgaattccctggtgattatggatgggacactgctggtttgtctgcagatcctgagacatttgccaagaaccgtgagcttgaggtgatccacagcagatgggccatgcttggtgcacttggatgtgtctttcctgaaattcttgcaaagaatggtgtcaagttcggcgagtcagtttggttcaaggctggagctcaaatcttctcagagggtggccttgattaccttggcaaccccaacctcatccatgctcagagcatcctcgccatctgggcttcccaggttgtgcttatgggattcgttgaagggtacagagtgggtggagggccacttggcgaaggacttgaccccctttatcctggcggtgcctttgacccacttggcctcgctgatgatcctgatgcatttgcagagttgaaggtgaaggaactcaagaacggccgcctcgcaatgttctcaatgtttggattcttcgttcaggccattgtcactggaaagggtcctgttgagaaccttttggatcaccttgccgatccagtggccaacaatgcttgggcatacgccactaacttcgttcctggaaaatgaagaaactcagatggttgccttgtagcttgtgacattagtaattagtccttgtgcttttgttgaaaacttctggttctggactccaccggtacttatgatttcagcagtggatattttacatgtatcggaaaagtactgtatccccttttcactatgaacatgagactcttttgtgcttgaatctactttttttagttggatttgtgtcgtggataagtttttagataaaaacaaaaataagtaacagttcca

SEQ ID NO: 4127 - DNA, 872 bp, Ambrosia trifida
tcaacacacaccttcaactatctattcacagccccaatggccacctctgcaatccaacagtcagcattcgccggccaggctgcgttgaagccacaaaatgagcttgtcaggaagaccggcagcttcaacggtggccgctacaccatgcgccgaaccgtcaaaagcgcaccacaaagcatttggtacggacctgaccgtcccaagtacttgggcccattctctgagcaaaccccatcatacctaaccggtgaattccctggtgattacgggtgggacactgccggattatccgctgaccccgagacattcgccaagaaccgtgagctcgaggtgatccactctaggtgggcaatgcttggtgcactcgggtgcgtgttccccgagattctttcaaagaacggtgtcaaattcggtgaagccgtttggttcaaggccggttcccaaattttctccgaaggcgggctcgactacctagggaacccaaacttgatccatgcccaaagcatcttagccatatgggcttctcaagttgtgctaatgggcctcattgaaggataccgtgttggtggcggcccactcggtgaagggcttgacaaaatctacccaggtgggtcttttgacccacttgggttggctgatgacccagacgcgtttgctgagttgaaggttaaggagcttaagaacggtcggttggctatgttttcgatgtttgggttctttgttcaggccattgtaacaggaaagggcccaattgaaaacttgtttgaccatcttagtgacccagtagctaacaacgcatgggcctatgctaccaactttgttcctggaaaataagttgaatgattgtaatttgatatggttatgcagtaatg

SEQ ID NO: 4128 - DNA, 1408 bp, Cannabis sativa
taataacaaaaatcgttactcagatgagatttcgttatatcttacacttccctaaccaaatttccaaactttgctaaaatttcatttctgtggtcagcatcgactgagtacccacattgccacgtgtcaacccatcaacctctgagaaaatctgcatggaaatccacaatagtttatgagagccaataagatgttggtgacgtgtagatttccttatccaaaacatcttcaaattccttattataacgttcgatagcaaactcagtacttcctcaaaatacataccaaagatatatcaaaacaaactaagaaaggttatagagagtaacctaagctttaacacaaaccctttatatggccacctctgctattcaacagtcggcctttgccggccagactgctctgaaacagtccaatgagctcgtcaggaaggtcggcggcggcagcagtggtggccgtgccactatgaggagaactgttaaaagtgctccccagagcatctggtatgggccagatcgtccaaagtacttgggcccattctcagaacaaattccatcatacctgaatggtgaatttccaggtgactatggatgggacacagctggattatcagctgacccagaaacattcgctagaaaccgtgaacttgaggtcatccacagtagatgggctatgcttggggcacttggctgtgttttcccagagattctatccaagaacggtgtcaagtttggtgaggcagtgtggttcaaggccggttcacagatcttctcagaaggtgggctcgattaccttggcaacccaaaccttgtccatgctcagagcatcttagccatttgggctacccaagttgttctaatgggctttgttgagggttacagagttggtggaggcccacttggtgagggcttagacccaatctaccctggtggagcttttgacccattgggccttgctgatgacccagatgcatttgctgagttgaaggttaaggaactcaagaatggaaggttggctatgttttcaatgtttgggttctttgttcaggccattgttactggcaaaggtccagttgagaacctctttgaccatcttgctgatccagtaaccaacaatgcttgggcctatgccacaaactttgtccctggaaaatgagaaaattaaacccaaatgctttgttaattaataatgtacgctctccttttctttttttagttgtaatgacttaatttacctaaaaaaattggtgctctagttgaagctttttctatctttgtactgatcaattaagctctgcttctataaatatggtttgctatgtgcttgaaaataatcattgcaagtatactaattaactaagtattcattaatcaaattaggaaaagatgtttatttattgcacaccaaa

SEQ ID NO: 4129 - DNA, 1175 bp, Cannabis sativa
aaaacatcttcaaattccttattataacgttcgattgcaaactcagtacttcctcaaaatacataccaaagatatatcaaaacaaactaagaaaggttatagagagtaacctaagctttaacacaaaccctttatatggccacctctgctattcaacagtcggcctttgccggccagactgctctgaaacagtccaatgagctcgtcaggaaggtcggcggcggcagcagtggtggccgtgccactatgaggagaactgttaaaagtgctccccagagcatctggtatgggccagatcgtccaaagtacttgggcccattctcagaacaaattccatcatacctgaatggtgaatttccaggtgactatggatgggacacagctggattatcagctgacccagaaacattcgctagaaaccgtgaacttgaggtcatccacagtagatgggctatgcttggggcacttggctgtgttttcccagagattctatccaagaacggtgtcaagtttggtgaggcagtgtggttcaaggccggttcacaaatcttctcagaaggtgggctcgattaccttggcaaccccaaccttgtccatgctcagagcatcttagccatttgggctacccaagttgttctaatgggctttgttgagggttacagagttggtggaggcccacttggtgagggcttagacccaatctaccctggtggagcttttgacccattgggccttgctgatgacccagatgcatttgctgagttgaaggttaaggaactcaagaatggaaggttggctatgttttcaatgtttgggttctttgttcaggccattgttactggcaaaggtccagttgagaacctctttgatcatcttgctgatccagtaaccaacaatgcttgggcctatgccacaaactttgtccctggaaaatgagaaaataaaacccaaatgctttgttaattaataatgtacgctctccttttctttttttagttgtaatgacttaatttacctaaaaaaattggtgctctagttgaagctttttctatctttgtactgatcaattaagctctgcttctataaatatggtttgctatgtgcttgaaaataatcattgcaagtatactaattaactaagtattcattaatcaaattaggaaaagatgtttatt

SEQ ID NO: 4130 - DNA, 1053 bp, Castanea mollissima
tacccagaagagaaacaccaagaatctggtcgtagtaaatcatggcaagctccaccattcaacgatcagcatttgccggccagaccgctttgaagcagtccaatgagcttgtccgtaaggttgggagctttgctggtggccgcgttaccatgaggcgaacagtgaagagtgctccacaaagcatatggtatggcccagaccgcccaaagtacttgggaccattctctgagcaaactccatcataccttactggtgaattccctggtgactatggctgggacactgctggtttatccgcagaccctgagacctttgcaaggaaccgtgagcttgaggtgatccatagccgatgggccatgcttggagctttgggctgtgtgttccctgaagtcctttcaaagaatggtgtcaagtttggtgaagcagtttggttcaaggctggtgcacagattttctctgaaggtggtcttgattatcttggcaacccaaacctcattcatgcacaaagcatcttggcaatctgggctgttcaagttgtgcttatgggcttcattgaagggtatagagttggtggaggaccactcggtgaaggacttgaccccatttaccctggtggtgcctttgacccacttggactagctgatgatcccgaagcattcgcagaattgaaggtgaaggaactaaagaatgggaggttggcaatgttctccatgtttggattctttgttcaggctattgttactgggaaaggcccaattgagaacctcttcgaccatgttgctgacccagtagccaataatgcatgggcttacgccactaactttgtccctggaaaatgaagaaacttaaatgttctactgtaactttactcatcaatcttcttgcttgtggtcaacttctctcttgctgtgttcatctatattgtattgatgctaccacaaactgcttttctttaaactatatattaatgtatcacttctaaagtacaagacatttggtcttttgtgcttgaacttacattaatgttggtagaaatgagtgttataatttgaa

SEQ ID NO: 4131 - DNA, 964 bp, Eschscholzia californica
ttggtctagtaatttagcttcacatactaatcagagcttcagtcatggcaacttctgcaatccaacagtcaactttcgccggtcagacagcgttgaaatcacgaaatgagcttgtccgtaaggttggagacttcggaggccgcatttccatgaggaggacagtgaaaaaaagtgtatccgagagcatctggtacggcgaagacagaccaaagtatttgggcccattttcagagcaaactccttcctaccttaccggtgaattccctggtgactatggttgggacactgccggattatcagcagatccagagacatttgccaagaaccgtgaacttgaagtaattcattctcgatgggccatgcttggtgcactcggatgtgtctttcctgagatcctatccaaaaatggtgttcaattcggtgaggcagtttggttcaaagctggttcccagattttctccgaaggcggacttgattatcttggcaacccaaaccttgttcatgctcaaagtatccttgcaatttgggctgtccaagttgttttgatgggttttgttgaagggtacagagttggtggaggcccacttggagaaggccttgacaaaatttatcctggtggagctttcgacccacttgggttggctgacgacccagaatcattctcagaattgaaggtgaaagagatcaagaacggacgcttagctatgttttcgatgtttgggttctttgttcaggctattgtgaccggaaaaggcccagtcgagaacctattcgaccaccttgctgacccagcaaccaacaatgcatgggcttatgctacaaactttgttcccggaaagtgagaatgagattttgttgtatgttaatattgaagtttgttagcttaattggactactttcttatgcctataataaagattagtattggagatctcagtagctccagtggcataccaacttatgg

SEQ ID NO: 4132 - DNA, 933 bp, Flaveria ramosissima
ccctcaacaatctatcatcaattcactttccccttactcaaatggcgacctctgcaatccaacagtcagcattcgccggctccgcggcgttgaagccacaaaacgagctcgtcaagaagaccggtagcttcaacggcggccgcttcaccatgcgccgaaccgtcaagagtgcaccacaaagcatttggtatgggccggacaggcccaagtacttgggcccgttctcagagcaaaccccatcatacctaaccggagaattccctggtgattatgggtgggacacagctggattatcagctgatcccgagacatttgccaagaaccgtgagcttgaagtgatccactctcggtgggccatgctcggcgcactcgggtgcgtgttccctgagattcttgcaaagaacggtgtcaaattcggtgaagcagtctggttcaaggcgggctcccagatattctcagaaggtgggcttgactacctcgggaaccccaacttgatccatgctcagagcatcttagctatctgggcttgtcaggttgttctcatgggcctcattgaagggtaccgtgttggtggaggcccattgggtgaagggctcgacaagatttacccaggtgggtcttttgacccacttggtttggctgatgatccggatgcttttgctgaattgaaggttaaggagcttaagaacggacgattggctatgttttcgatgttcggattcttcgttcaggccatcgttaccggaaaaggcccgatcgagaacttgttcgatcatgtcagcgatccggtggctaacaacgcttgggcttatgccaccaactttgttcctggaaaatgagtttgattagtgtaattttgatgatgattattaagtaatatcacacgtttccggctaattttgttatttaatctttcaatattttaaagtcgat

SEQ ID NO: 4133 - DNA, 984 bp, Flaveria ramosissima
tcaattcactttccccttactcaaatggccacctctgcaatccaacagtcagcattcgccggctccgccgctttgaagccacaaaacgagctcgtcaagaagaccggtagcttcaacggcggccgcttcaccatgcgccgaaccgtcaagagtgcaccacaaagcatatggtatgggccggataggcccaagtacttgggccctttctcggaacaaaccccatcatacctaactggagaatttcctggtgattatgggtgggacacagctggattatcagctgatcccgagacatttgccaagaaccgtgagcttgaagtgatccactctcggtgggccatgctcggtgcacttgggtgcgtgttccccgagattcttgcaaagaacggtgtcaaattcggtgaagcggtctggttcaaggcaggctcccaaatattctcagaaggtgggcttgactacctcgggaaccccaacttgatccatgctcagagcatcttagctatctgggcttgtcaggttgttctcatgggcctcattgaagggtatcgtgttggtggaggcccgttgggtgaagggctcgacaagatttacccgggtgggtcttttgacccacttggtttggctgatgatccggatgcttttgctgaattgaaggttaaggagcttaagaatgggcgattggctatgttttcgatgtttgggttcttcgttcaggccatcgttaccggaaaaggcccgatcgagaacttgtttgatcatgtcagcgatccggtggctaacaacgcttgggcttatgccaccaactttgttcctggaaaatgagtttgattagtgtaattttgatgatgattattaagtaatatcacaagtttccggctagttttgttatctaatgtttcaataccataaagtcgatagtttctagttaaactaaaaaaaaaaaaaaacaaaaaagttactactgtcgttagataccatacgctt

SEQ ID NO: 4134 - DNA, 930 bp, Flaveria ramosissima
tctatcatcaattcactttccccttactcaaatggccacctctgcaatccaacagtcagcattcgccggctccgccgctttgaagccacaaaacgagctcgtcaagaagaccggtagcttcaacggcggccgcttcaccatgcgccgaaccgtcaagagtgcaccacaaagcatatggtatgggccggataggcccaagtacttgggccctttctcggaacaaaccccatcatacctaactggagaatttcctggtgattatgggtgggacacagctggattatcagctgatcccgagacatttgccaagaaccgtgagcttgaagtgatccactctcggtgggccatgctcggtgcacttgggtgcgtgttccccgagattcttgcaaagaacggtgtcaaattcggtgaagcggtctggttcaaggcaggctcccaaatattctcagaaggtgggcttgactacctcgggaaccccaacttgatccatgctcagagcatcttagctatctgggcttgtcaggttgttctcatgggcctcattgaagggtatcgtgttggtggaggcccgttgggtgaagggctcgacaagatttacccgggtgggtcttttgacccacttggtttggctgatgatccggatgcttttgctgaattgaaggttaaggagcttaagaatgggcgattggctatgttttcgatgtttgggttcttcgttcaggccatcgttaccggaaaaggcccgatcgagaacttgtttgatcatgtcagcgatccggtggctaacaacgcttgggcttatgccaccaactttgttcctggaaaatgagtttgattagtgtaattttgatgatgattattaagtaatatcacaagtttccggctagttttgttatctaatgtttcaataccataaagtcgatagttctt

SEQ ID NO: 4135 - DNA, 974 bp, Flaveria ramosissima
accctcaacaatctatcatcaattcactttccccttactcaaatggcgacctctgcaatccaacagtcagcattcgccggctccgcggcgttgaagccacaaaacgagctcgtcaagaagaccggtagcttcaatggcggccgcttcaccatgcgccgaaccgtcaagagcgcaccacaaagcatttggtatgggccggacaggcccaagtacttgggcccgttctcggagcaaaccccatcatacctaaccggagaattccccggtgattatgggtgggacacagctggattgtctgctgatcccgagacatttgccaagaaccgtgagcttgaagtgatccactctcggtgggccatgctcggcgcactcgggtgcgtgttccccgagattcttgcaaagaacggtgtcaaatttggtgaagcagtctggtttaaggcgggctcccaaatattctcagaaggtgggcttgactacctcgggaacccgaacttgatccatgctcagagcatcttagctatctgggcttgtcaggttgttcttatgggcctcattgaagggtaccgcgttggtggaggcccattgggtgaagggcttgacaagatttatccaggtgggtcttttgacccgcttggtttggctgatgacccggatgcttttgctgagttgaaggttaaggagcttaagaacggacgattggctatgttttcgatgttcgggttcttcgttcaggccatcgttactggaaaaggcccgatcgagaacttgtttgatcatgtcagcgatccggtcgctaacaacgcttgggcttatgccaccaactttgttcctggaaaatgagtttgattagtgtaaatttgatgatgattatgaagtaatatcacaagtttccggctaattttgttatttaatttttcaatactttaaagtcgatagttcttttttattaatcaagtggctaatttcagctaaat

SEQ ID NO: 4136 - DNA, 948 bp, Flaveria ramosissima
ctttctccttactcaaatggcgacctctgcaatccaacagtcagcattcgccggctccgcggcgttgaagccacaaaacgagctcgtcaagaagatcggtagcttcaacggcggccgtttcaccatgcgccgaaccgtcaagagcgcaccacaaagcatttggtatgggccggacaggcccaaatacttgggcccgttctcggagcaaaccccatcatacctaaccggagaattccctggtgattatgggtgggacacagctggattatcagctgatcccgagacatttgccaagaaccgtgagcttgaagtgatccactctcggtgggccatgcttggtgcactcgggtgcgtgttccccgagattcttgcaaagaacggtgtcaaattcggtgaagcagtctggttcaaggcgggctcccagatattctcagaaggtgggcttgactacctcgggaacccaaacttgatccatgctcagagcatcttagctatctgggcttgtcaggttgttctcatgggcctcattgaagggtaccgcgttggtggaggcccattgggtgaagggctcgacaagatttacccaggtgggtcttttgacccacttggtttggctgatgacccggatgcatttgctgagttgaaggttaaggagcttaaaaatggacgattggctatgttttcgatgttcgggttcttcgttcaggccatcgttactggaaaaggcccgatcgagaacttgtttgatcatgtcagcgatccggtggctaacaacgcttgggcttatgccaccaactttgttcctggaaaatgagtttgattagtgtaaatttgatgatgattatgaagtaatatcacaagtttccggctaattttgttatttaatgtttctaatactttaaagtgcattagttctttttattaatcaagtgctaatttcagctaatt

SEQ ID NO: 4137 - DNA, 985 bp, Flaveria ramosissima
cggtaaggtgtaaatttgtaaccctatttacttactttgtatgtatctttctaggtaaatgagtctaacgtctcccaaagtgtacttttagtagcatacaactctatcatcaattcactttccccttactcaaatggcgacctctgcaatccaacagtcagcattcgccggctccgcggcgttgaagccacaaaacgagctcgtcaagaagaccggtagcttcaatggcggccgcttcaccatgcgccgaaccgtcaagagcgcaccacaaagcatttggtatgggccggacaggcccaagtacttgggcccgttctcggagcaaaccccatcatacctaaccggagaattccctggtgattatgggtgggacacagctggattatcagctgatcccgagacatttgccaagaaccgtgagcttgaagtgatccactctcggtgggccatgcttggtgcactcgggtgcgtgttccccgagattcttgcaaagaacggtgtcaaattcggtgaagcagtctggttcaaggcgggctcccagatattctcagaaggtgggcttgactacctcgggaacccgaacttgatccatgctcagagcatcttagctatctgggcttgtcaggttgttcttatgggccttattgaagggtaccgtgttggtggaggcccattgggtgaagggcttgacaagatttatccaggtgggtcttttgacccgcttggtttggctgatgacccggatgcttttgctgagttgaaggttaaggagcttaagaacggacgattggctatgttttcaatgttcgggttcttcgttcaggccatcgttactggaaaaggcccgatcgagaacttgtttgatcatgtcagcgatccggtggctaacaacgcttgggcttatgccaccaactttgttcctggaaaatgagtttgattagtgtaaatttgatgatgattatgaagtaatatcacaagtttccgg

SEQ ID NO: 4138 - DNA, 908 bp, Flaveria ramosissima
ctatcatcaattcactttccccttactcaaatggcgacctctgcaatccaacagtcagcattcgccggctccgcggcgttgaagccacaaaacgagctcgtcaagaagaccggtagcttcaatggcggccgcttcaccatgcgccgaaccgtcaagagcgcaccacaaagcatttggtatgggccggacaggcccaagtatttgggcccgttctcggagcaaaccccatcatacctaaccggagaattccctggtgattatgggtgggacacagctggattatcagctgatcccgagacatttgccaagaaccgtgagcttgaagtgatccactctcggtgggccatgcttggtgcactcgggtgcgtgttccccgagattcttgcaaagaacggtgtcaaattcggtgaagcagtctggttcaaggcgggctcccagatattctcagaaggtgggcttgactacctcgggaacccaaatttgatccatgctcagagcatcttagctatctgggcttgtcaggttgttctcatgggcctcattgaagggtaccgcgttggtggaggcccattgggtgaagggctcgacaagatttacccaggtgggtcttttgacccacttggtttggctgatgacccggatgcatttgctgagttgaaggttaaggagcttaagaacggacgattggctatgttttcgatgttcgggttcttcgttcaggccatcgttactggaaaaggcccaatcgagaacttgtttgatcatgtcagcgatccggtggctaataacgcttgggcttatgccaccaactttgttcctggaaaatgagtttgattagtgtaaatttgatgatgattatgaagtaatatcacaagtttccggctaattttgttatttaatgtttcaat

SEQ ID NO: 4139 - DNA, 1226 bp, Vitis vinifera
aaaaatcagcatggaaatccacacccaaaacaacagccaatcagatggtgctgatgtgtagatatcctaatccacagcatcttcccacttcccttataacttctcctctcttctccttcccacccatctccctagtcttcactattctccttgcaactttagagcaaaacctcatcaacaaagaagattagctgagtatcatggcaacttctgcaatccagagatcagcattcgccggccagaccgccttgaagcagcccaatgagcttgtccggaaggttggtggcctcggtggtggccgcatcaccatgcgccggactgttaaaagcaccccacaaagcatatggtatggcccagaccgccccaagtacttggggccattctctgagcaaactccatcatacctgaccggtgaattccctggtgactatgggtgggacactgctgggttatcagcagatcctgagacattcgccaagaaccgtgagcttgaggtcatccactgcagatgggccatgcttggtgcactgggttgtgtcttccctgagattctttcaaagaatggtgtcaaatttggtgaggctgtctggttcaaggctggagctcagatcttctcagagggtggtctcgactaccttggcaaccccaaccttgttcatgcccagagcatccttgcaatctgggcctgccaagttgtgctcatgggattcgttgaaggataccgtgttggtggaggcccacttggtgagggactggatgcaatttacccaggtggggcttttgacccacttggtttggcagatgaccctgatgcatttgcagaactgaaggtgaaggagatcaagaacggtcgcctggcaatgttttcaatgtttggattcttcgttcaggctattgtcactggaaagggcccaattgagaacctcgttgaccaccttgctgatccagttgccaacaacgcatgggcttatgccaccaactttgtccccggcaagtgaagataagtgtgagattcaccttttcagctgtaacattacttaaccttgttggtctttattgaacttgtcttctgtggattgggttggtaatgatgtaatttgctagtagaactgcttggaactactgtattactaatgagaccagctcctttgttgccatagtttgtgtttcccttttcttgcatacttacctgcattcaatacatctacatcttaaaaaaaaaaaaa

SEQ ID NO: 4140 - DNA, 1171 bp, Jatropha curcas
cagtggtatcaacgcaggagtacgcggggacaggcaaaaactaacacataaggcatagtctgaagtgcttaagaaagtaatagccatggcaacctctgcaatccaacaatctgcatttgctgggcagacggctttgaagcaatcaaatgagcttgtccgcaaggtcggttcctttggaggtggtcgcatcaccatgcgcagaactgtcaagagtgctccccaaagcatatggtatggcccagaccgcccaaagtacttgggtccattctctgagcaaactccatcatatctgaccggtgaattcccaggtgattatgggtgggatactgctggtttatctgcagaccctgagacatttgccaagaaccgtgagcttgaggtgattcactgcagatgggccatgcttggagcacttggttgtgtcttccctgaaatactttcaaagaatggtgtcaagtttggagaggcagtttggttcaaggccggagcccaaatcttctctgagggtggtcttgattaccttggcaaccccaacctcatccatgctcagagcatccttgcaatctgggcggtccaggttgtgctcatgggattcgtcgaagggtacagagttggtggaggaccgcttggtgaaggtcttgaccccatttaccctggcggtgcctttgaccctctgggattggccgatgatcctgatgcatttgcagagttgaaggtgaaagaaatcaagaatggacgtttggcaatgttttccatgtttggattcttcgttcaggctattgtcactggaaagggacccatagagaacctctctgatcaccttgcggatccagtggccaacaatgcatgggcctacgccactaactttgttcctggaaaatgaagagaatcattacatgccattaggttgtaacattactcagtcctgtccttcggttgaaatgctcttgttgtcgactccaacattactcgtgttatagtagtggaaactgattgtctggattctggaagtattgtatcattaatacatcagactcctttgtgcgtgaacccatctatattgttggaatgtgccataaaatttaataatttagccacaccagtaatatcaaatgttttcagtctttcatacagttgcaacaacagctccattactccctaaaaaaaaaaa

SEQ ID NO: 4141 - DNA, 1065 bp, Cucumis melo
tttggcattgcatcaaacttcttagaaagcttcacatactcatggccacctctgctattcaacagtcagccttcgccggccaggctgccttgaagcaatccaatgagcttgttcgaaaggtcggtgctgtcggtggcagccgcttcaccatgaggcggacagtcaagagtgctccacagagcatttggtatggacctgatcgcccaaagtacttgggaccattctctgaacaaacgccatcttacctaactggagagttccccggtgactatggatgggatacagccggtctgtcagcagatcccgagacttttgcaaagaaccgtgagcttgaggtgatccactcccgatgggccatgcttggtgcattaggttgtgtcttccctgaactccttgcaaagaatggcgtcaagttcggtgaatcagtttggttcaaggctggttctcagatcttctctgagggtggtctagactaccttggcaacccaaaccttatccatgctcagagtatccttgcaatctgggcttgccaggttgtgctcatgggctttgttgaaggttaccgtgttggtggcggtcccctcggtgaaggactagacccaatttacccaggaggtgccttcgacccactcggattggcagatgacccagatgcatttgctgagttgaaggtcaaggaacttaagaatggaaggctggcaatgttctccatgttcggattctttgtccaggctatcgtcaccggcaagggacctattgagaatctctttgaccatgttgcagatcctgttgccaacaatgcatgggcttatgcaaccaactttgttcccggaaaatgaagaaacctgtaggaaacaacaatctgttttaccacacttaagcatctcctgaaaatcatatgttgatgtaatttctcaagtagagactccctgaaattaaatctgtatcattaaagttcaaaattttctatgctttgtgttgttttcacatatagaatatcagcagcatctcggcagatgacacacactatttataggttttaaaatatatataccaattgattga

SEQ ID NO: 4142 - DNA, 1117 bp, Quercus alba
ttctaaactttcaacatacccaaaaaagaaacaccaagaatcttgtcgtagtaagtcatggcaagctccaccattcaacgatcagcattcgcaggccagaccgctttgaagcagtccaatgagcttgtccgtaaggttgggagctttgccggtggccgcgttaccatgaggcgaacagtgaagagtgctccacaaagcatatggtatggcccagaccgcccaaagtacttgggaccattctctgagcagactccctcataccttactggtgaattccctggtgactatggctgggacactgctggattatccgcagaccctgagacatttgctaggaaccgtgagctggaggtaatccacagccgatgggccatgcttggagctttgggctgtgtgttccctgaagtcctttcaaagaatggtgtcaagtttggtgaagcagtttggttcaaggctggtgcacagattttctctgaaggtggtcttgattatcttggcaacccaaacctcattcatgcacaaagcattttggcaatctgggctgttcaagttgtgcttatgggcttcattgaaggatacagagttggtggaggaccactcggtgaaggacttgaccccatttaccctggtggtgcctttgacccacttggactggctgatgatcctgaagcattcgcagaattgaaggtgaaggaactaaagaatgggaggttggcaatgttctccatgtttggtttctttgttcaggctattgttactggaaagggtccaattgagaacctgtttgaccatgttgctgacccagtcgccaacaatgcatgggcctacgccactaactttgtccctggaaaatgaagaaacttaaatgttctactgtaactttactcatcaatcttcttgcttgtgttcaacttctctcttgctgtgttcatctatattgtattgatgctaccacaaactgcttttcttcaaactatatattaatgtatcacttctaaagtacaagacatttggtcttttgtgcttgaacttacattaatgttggtagatatgtgtgttataatttgaatattctctatctcaacttgaagcatatatatatgcaattttcttttta

SEQ ID NO: 4143 - DNA, 1115 bp, Quercus alba
aacgcagagtacatggggacaccatcttctaagttctaaactttcaacatacccgaaaaagaaacaccaagaatcttgttgtagtaaatcatggcaagctccaccattcaacgatcagcattcgccggccagaccgctttgaagcagtccaatgagcttgtccgtaaggttgggagctttgccggtggccgcgttaccatgaggcgaacagtgaagagtgctccacaaagcatatggtatggcccagaccgcccaaagtacttgggaccattctctgagcagactccctcataccttactggtgaattccctggtgactatggctgggacactgctggattatccgcagaccctgagacatttgctaggaaccgtgagctggaggtaatccacagccgatgggccatgcttggagctttgggctgtgtgttccctgaagtcctttcaaagaatggtgtcaagtttggtgaagcagtttggttcaaggctggtgcacagattttctctgaaggtggtcttgattatcttggcaacccaaacctcattcatgcacaaagcattttggcaatctgggctgttcaagttgtgcttatgggcttcattgaaggatacagagttggtggaggaccactcggtgaaggacttgaccccatttaccctggtggtgcctttgacccacttggactggctgatgatcctgaagcattcgcagaattgaaggtgaaggaactaaagaatgggaggttggcaatgttctccatgtttggtttctttgttcaggctattgttactggaaagggtccaattgagaacctgtttgaccatgttgctgacccagtcgccaacaatgcatgggcctacgccactaactttgtccctggaaaatgaataaacttaaatgttctactgtaactttactcatcaatcttcttgcttgtgttcaacttctctcttgctgtgttcatctatattgtattgatgctaccacaaactgcttttcttcaaactatatattaatgtatcacttctaaagtacaagacatttggtcttttgtgcttgaacttacattaatgttggtagatatgtgtgttataatttgaatattctctatctc

SEQ ID NO: 4144 - DNA, 1069 bp, Quercus alba
actttcaacatacccaaaaaagaaacaccaagaatcttgtcgtagtaagtcatggcaagctccaccattcaacgatcagcattcgccggccagaccgctttgaagcagtccaatgagcttgtccgtaaggttgggagctttgccggtggccgcgttaccatgaggcgaacagtgaagagtgctccacaaagcatatggtatggcccagaccgcccaaagtacttgggaccattctctgagcagactccctcataccttactggtgaattccctggtgactatggctgggacactgctggattatccgcagaccctgagacatttgctaggaaccgtgagctggaggtaatccacagccgatgggccatgcttggagctttgggctgtgtgttccctgaagtcctttcaaagaatggtgtcaagtttggtgaagcagtttggttcaaggctggtgcacagattttctctgaaggtggtcttgattatcttggcaacccaaacctcattcatgcacaaagcatcttggcaatctgggctgttcaagttgtgcttatgggcttcattgaaggatacagagttggtggaggaccactcggtgaaggacttgaccccatttaccctggtggcgcctttgacccacttggactggctgatgatcctgaagcattcgcagaattgaaggtgaaggaactaaagaatgggaggttggcaatgttctccatgtttggtttctttgttcaggctattgttactggaaagggtccaattgagaacctgtttgaccatgttgctgacccagtcgccaacaatgcatgggcctacgccactaactttgtccctggaaaatgaagaaacttaaatgttctactgtaactttactcatcaatcttcttgcttgtgttcaacttctctcttgctgtgttcatctatattgtatcgatgctaccacaaactgcttttcttcaaactatatattaatgtatcacttctaaagtacaagacatttggtcttttgtgcttgaacttacattaatgttggtagatatgtgtgttataatttgaatattct

SEQ ID NO: 4145 - DNA, 1077 bp, Quercus alba
cagagtatatgggacaccatcttctaagttctaaactttcaacatacccaaaaaagaaacaccaagaatcttgtcgtagtaagtcatggcaagctccaccattcaacgatcagcattcgcaggccagaccgctttgaagcagtccaatgagcttgtccgtaaggttgggagctttgccggtggccgcgttaccatgaggcgaacagtgaagagtgctccacaaagcatatggtatggcccagaccgcccaaagtacttgggaccattctctgagcagactccctcataccttactggtgaattccctggtgactatggctgggacactgctggattatccgcagaccctgagacatttgctaggaaccgtgagctggaggtaatccacagccgatgggccatgcttggagctttgggctgtgtgttccctgaagtcctttcaaagaatggtgtcaagtttggtgaagcagtttggttcaaggctggtgcacagattttctctgaaggtggtcttgattatcttggcaacccaaacctcattcatgcacaaagcatcttggcaatctgggctgttcaagttgtgcttatgggcttcattgaaggatacagagttggtggaggaccactcggtgaaggacttgaccccatttaccctggtggcgcctttgacccacttggactggctgatgatcctgaagcattcgcagaattgaaggtgaaggaactaaagaatgggaggttggcaatgttctccatgtttggtttctttgttcaggctattgttactggaaagggtccaattgagaacctgtttgaccatgttgctgacccagtcgccaacaatgcatgggcctacgccactaactttgtccctggaaaatgaagaaacttaaatgttctactgtaactttactcatcaatcttcttgcttgtgttcaacttctctcttgctgtgttcatctatattgtattgatgctaccacaaactgcttttcttcaaactatatattaatgtatcacttctaaagtacaagacatttggtcttttgtgcttgaacttacattaatgttggtaga

SEQ ID NO: 4146 - DNA, 1298 bp, Quercus alba
acacgtagtataagcaagtggtatcaacgccagagtacatgggacaccatcttctaagttctaaactttcaacatacccgaaaaagaaacaccaagaatcttgttgtagtaaatcatggcaagctccaccattcaacgatcagcattcgccggccagaccgctttgaagcagtccaatgagcttgtccgtaaggttgggagctttgccggtggccgcgttaccatgaggcgaacagtgaagagtgctccacaaagcatatggtatggcccagaccgcccaaagtacttgggaccattctctgagcagactccctcataccttactggtgaattccctggtgactatggctgggacactgctggattatccgcagaccctgagacatttgctaggaaccgtgagctggaggtaatccacagccgatgggccatgcttggagctttgggctgtgtgttccctgaagtcctttcaaagaatggtgtcaagtttggtgaagcagtttggttcaaggctggtgcacagattttctctgaaggtggtcttgattatcttggcaacccaaacctcattcatgcacaaagcatcttggcaatctgggctgttcaagttgtgcttatgggcttcattgaaggatacagagttggtggaggaccactcggtgaaggacttgaccccatttaccctggtggcgcctttgacccacttggactggctgatgatcctgaagcattcgcagaattgaaggtgaaggaactaaagaatgggaggttggcaatgttctccatgtttggtttctttgttcaggctattgttactggaaagggtccaattgagaacctgtttgaccatgttgctgacccagtcgccaacaatgcatgggcctacgccactaactttgtccctggaaaatgaagaaactctgttgtaatttgactccttaatcttcttgtttgtgatctactttttattgttcatcagtttaaattaagcggattctattttataaaaccctcaatcgaagggtaaaacattgacacttgaatcaccatatccgaggatacactacccctttgggatgcggtctcacttgggtggaaatgcattagttacccattatgccaaaccttagtttcttagttagtgcagtaaatgatccgagctctgttgatgatagaatgttaaaagcttggtttaacaataaaagtaaaatattcaaactcggcttgagcttgaaccaaatgtataaacaatgtttgaacttggcttggatcatcttaattcattagtcaagctgagt

SEQ ID NO: 4147 - DNA, 1145 bp, Quercus alba
ccatcttctaagttctaaactttcaacatacccaaaaaagaaacaccaagaatcttgtcgtagtaagtcatggcaagctccaccattcaacgatcagcattcgcaggccagaccgctttgaagcagtccaatgagcttgtccgtaaggttgggagctttgccggtggccgcgttaccatgaggcgaacagtgaagagtgctccacaaagcatatggtatggcccagaccgcccaaagtacttgggaccattctctgagcagactccctcataccttactggtgaattccctggtgactatggctgggacactgctggattatccgcagaccctgagacatttgctaggaaccgtgagctggaggtaatccacagccgatgggccatgcttggagctttgggctgtgtgttccctgaagtcctttcaaagaatggtgtcaagtttggtgaagcagtttggttcaaggctggtgcacagattttctctgaaggtggtcttgattatcttggcaacccaaacctcattcatgcacaaagcattttggcaatctgggctgttcaagttgtgcttatgggcttcattgaaggatacagagttggtggaggaccactcggtgaaggacttgaccccatttaccctggtggtgcctttgacccacttggactggctgatgatcctgaagcattcgcagaattgaaggtgaaggaactaaagaatgggaggttggcaatgttctccatgtttggtttctttgttcaggctattgttactggaaagggtccaattgagaacctgtttgaccatgttgctgacccagtcgccaacaatgcatgggcctacgccactaactttgtccctggaaaatgaagaaacttaaatgttctactgtaactttactcatcaatcttcttgcttgtgttcaacttctctcttgctgtgttcatctatattgtatcgatgctaccacaaactgcttttcttcaaactatatattaatgtatcacttctaaagtacaagacatttggtcttttgtgcttgaacttacattaatgttggtagatatgtgtgttataatttgaatattctctatctcaacttgaagaacaaaaaaaacaaaaaaaagtactctgtcgttagactacca

SEQ ID NO: 4148 - DNA, 1173 bp, Quercus alba
atgggacaccatcttctaagttctaaactttcaacatacccaaaaagaaacaccaagaatcttgtcgtagtaagtcatggcaagctccaccattcaacgatcagcattcgcaggccagaccgctttgaagcagtccaatgagcttgtccgtaaggttgggagctttgccggtggccgcgttaccatgaggcgaacagtgaagagtgctccacaaagcatatggtatggcccagaccgcccaaagtacttgggaccattctctgagcagactccctcataccttactggtgaattccctggtgactatggctgggacactgctggattatccgcagaccctgagacatttgctaggaaccgtgagctggaggtaatccacagccgatgggccatgcttggagctttgggctgtgtgttccctgaagtcctttcaaagaatggtgtcaagtttggtgaagcagtttggttcaaggctggtgcacagattttctctgaaggtggtcttgattatcttggcaacccaaacctcattcatgcacaaagcatcttggcaatctgggctgttcaagttgtgcttatgggcttcattgaaggatacagagttggtggaggaccactcggtgaaggacttgaccccatttaccctggtggcgcctttgacccacttggactggctgatgatcctgaagcattcgcagaattgaaggtgaaggaactaaagaatgggaggttggcaatgttctccatgtttggtttctttgttcaggctattgttactggaaagggtccaattgagaacctgtttgaccatgttgctgacccagtcgccaacaatgcatgggcctacgccactaactttgtccctggaaaatgaagaaacttaaatgttctactgtaactttactcatcaatcttcttgcttgtgttcaacttctctcttgctgtgttcatctatattgtattgatgctaccacaaactgcttttcttcaaactatatattaatgtatcacttctaaagtacaagacatttggtcttttgttgcttgaacttacattaatgttggtagatatgtgtgttataatttgaatattctctatctcaacttgaagcatatatatatgcaattttcttttttattcaaacaaaataatatgattgatttcccattgat

SEQ ID NO: 4149 - DNA, 1165 bp, Quercus alba
acaccatcttctaagttctaaactttcaacatacccgaaaaagaaacaccaagaatcttgttgtagtaaatcatggcaagctccaccattcaacgatcagcattcgccggccagaccgctttgaagcagtccaatgagcttgtccgtaaggttgggagctttgccggtggccgcgttaccatgaggcgaacagtgaagagtgctccacaaagcatatggtatggcccagaccgcccaaagtacttgggaccattctctgagcagactccctcataccttactggtgaattccctggtgactatggctgggacactgctggattatccgcagaccctgagacatttgctaggaaccgtgagctggaggtaatccacagccgatgggccatgcttggagctttgggctgtgtgttccctgaagtcctttcaaagaatggtgtcaagtttggtgaagcagtttggttcaaggctggtgcacagattttctctgaaggtggtcttgattatcttggcaacccaaacctcattcatgcacaaagcatcttggcaatctgggctgttcaagttgtgcttatgggcttcattgaaggatacagagttggtggaggaccactcggtgaaggacttgaccccatttaccctggtggcgcctttgacccacttggactggctgatgatcctgaagcattcgcagaattgaaggtgaaggaactaaagaatgggaggttggcaatgttctccatgtttggtttctttgttcaggctattgttactggaaagggtccaattgagaacctgtttgaccatgttgctgacccagtcgccaacaatgcatgggcctacgccactaactttgtccctggaaaatgaagaaacttaaatgttctactgtaactttactcatcaatcttcttgcttgtgttcaacttctctcttgctgtgttcatctatattgtatcgatgctaccacaaactgcttttcttcaaactatatattattgtatcacttctaaagtacaagacatttggtcttttgtgcttgaacttacattaatgttggtagatatgtgtgttataatttgaatattctctatctcaacttgaagcatatatatatatgcaattttctttttatcaaacaaatatatgattgattcccattgct

SEQ ID NO: 4150 - DNA, 1075 bp, Quercus alba
aagcagtgtatcaacgcagagtacatggggacaccatcttctaagttctaaactttcaacatacccgaaaaagaaacaccaagaatcttgttgtagtaaatcatggcaagctccaccattcaacgatcagcattcgccggccagaccgctttgaagcagtccaatgagcttgtccgtaaggttgggagctttgccggtggccgcgttaccatgaggcgaacagtgaagagtgctccacaaagcatatggtatggcccagaccgcccaaagtacttgggaccattctctgagcagactccctcataccttactggtgaattccctggtgactatggctgggacactgctggattatccgcagaccctgagacatttgctaggaaccgtgagctggaggtaatccacagccgatgggccatgcttggagctttgggctgtgtgttccctgaagtcctttcaaagaatggtgtcaagtttggtgaagcagtttggttcaaggctggtgcacagattttctctgaaggtggtcttgattatcttggcaacccaaacctcattcatgcacaaagcatcttggcaatctgggctgttcaagttgtgcttatgggcttcattgaaggatacagagttggtggaggaccactcggtgaaggacttgaccccatttaccctggtggcgcctttgacccgcttggactggctgatgatcctgaagcattcgcagaattgaaggtgaaggaactaaagaatgggaggttggcaatgttctccatgtttggtttctttgttcaggctattgttactggaaagggtccaattgagaacctgtttgaccatgttgctgacccagtcgccaacaatgcatgggcctacgccactaactttgtccctggaaaatgaagaaactctgttgtaatttgactccttaatcttcttgtttgtgatctactttttattgttcatcagtttaaattaagcggattctattttataaaaccctcaatcgaagggtaaaacattgacacttgaatcaccatatccgaggatacactacccctttgggatgcggtctcac

SEQ ID NO: 4151 - DNA, 1100 bp, Quercus alba
tcaacgcagagtacatggggacaccatcttctaagttctaaactttcaacatacccgaaaaagaaacaccaagaatcttgttgtagtaaatcatggcaagctccaccattcaacgatcagcattcgccggccagaccgctttgaagcagtccaatgagcttgtccgtaaggttgggagctttgccggtggccgcgttaccatgaggcgaacagtgaagagtgctccacaaagcatatggtatggcccagaccgcccaaagtacttgggaccattctctgagcagactccctcataccttactggtgaattccctggtgactatggctgggacactgctggattatccgcagaccctgagacatttgctaggaaccgtgagctggaggtaatccacagccgatgggccatgcttggagctttgggctgtgtgttccctgaagtcctttcaaagaatggtgtcaagtttggtgaagcagtttggttcaaggctggtgcacagattttctctgaaggtggtcttgattatcttggcaacccaaacctcattcatgcacaaagcatcttggcaatctgggctgttcaagttgtgcttatgggcttcattgaaggatacagagttggtggaggaccactcggtgaaggacttgaccccatttaccctggtggcgcctttgacccacttggactggctgatgatcctgaagcattcgcagaattgaaggtgaaggaactaaagaatgggaggttggcaatgttctccatgtttggtttctttgttcaggctattgttactggaaagggtccaattgagaacctgtttgaccatgttgctgacccagtcgccaacaatgcatgggcctacgccactaactttgtccctggaaaatgaagaaacttaaatgttctactgtaactttactcatcaatcttcttgcttgtgttcaacttctctcttgctgtgttcatctatattgtattgatgctaccacaaactgcttttcttcaaactatatattaatgtatcacttctaaagtacaagacatttggtcttttgtgcttgaacttacattaatgttggtagatatgtgtgttataatt

SEQ ID NO: 4152 - DNA, 1177 bp, Quercus alba
atcaacgcagagtacatgggacaccatcttctaagttctaaactttcaacatacccaaaaaagaaacaccaagaatcttgtcgtagtaagtcatggcaagctccaccattcaacgatcagcattcgcaggccagaccgctttgaagcagtccaatgagcttgtccgtaaggttgggagctttgccggtggccgcgttaccatgaggcgaacagtgaagagtgctccacaaagcatatggtatggcccagaccgcccaaagtacttgggaccattctctgagcagactccctcataccttactggtgaattccctggtgactatggctgggacactgctggattatccgcagaccctgagacatttgctaggaaccgtgagctggaggtaatccacagccgatgggccatgcttggagctttgggctgtgtgttccctgaagtcctttcaaagaatggtgtcaagtttggtgaagcagtttggttcaaggctggtgcacagattttctctgaaggtggtcttgattatcttggcaacccaaacctcattcatgcacaaagcatcttggcaatctgggctgttcaagttgtgcttatgggcttcattgaaggatacagagttggtggaggaccactcggtgaaggacttgaccccatttaccctggtggcgcctttgacccacttggactggctgatgatcctgaagcattcgcagaattgaaggtgaaggaactaaagaatgggaggttggcaatgttctccatgtttggtttctttgttcaggctattgttactggaaagggtccaattgagaacctgtttgaccatgttgctgacccagtcgccaacaatgcatgggcctacgccactaactttgtccctggaaaatgaagaaactctgttgtaatttgactccttaatcttcttgtttgtgatctactttttattgttcatcagtttaaattaagcggattctattttataaaaccctcaatcgaagggtaaaacattgacacttgaatcaccatatccgaggatacactacccctttgggatgcggtctcacttgggtggaaatgcattagttacccattatgccaaaccttagtttcttagttagtgcagtaaatgatccgagctctgttgatgatagaatgttaaaagcttggtttaacaat

SEQ ID NO: 4153 - DNA, 1105 bp, Quercus alba
accatcttctaaagttctaaactttcaacatacccgaaaaagaaacaccaagaatcttgttgtagtaaatcatggcaagctccaccattcaacgatcagcattcgccggccagaccgctttgaagcagtccaatgagcttgtccgtaaggttgggagctttgccggtggccgcgttaccatgaggcgaacagtgaagagtgctccacaaagcatatggtatggcccagaccgcccaaagtacttgggaccattctctgagcagactccctcataccttactggtgaattccctggtgactatggctgggacactgctggattatccgcagaccctgagacatttgctaggaaccgtgagctggaggtaatccacagccgatgggccatgcttggagctttgggctgtgtgttccctgaagtcctttcaaagaatggtgtcaagtttggtgaagcagtttggttcaaggctggtgcacagattttctctgaaggtggtcttgattatcttggcaacccaaacctcattcatgcacaaagcatcttggcaatctgggctgttcaagttgtgcttatgggcttcattgaaggatacagagttggtggaggaccactcggtgaaggacttgaccccatttaccctggtggcgcctttgacccacttggactggctgatgatcctgaagcattcgcagaattgaaggtgaaggaactaaagaatgggaggttggcaatgttctccatgtttggtttctttgttcaggctattgttactggaaagggtccaattgagaacctgtttgaccatgttgctgacccagtcgccaacaatgcatgggcctacgccactaactttgtccctggaaaatgaagaaacttaaatgttctactgtaactttactcatcaatcttcttgcttgtgttcaacttctctcttgctgtgttcatctatattgtatcgatgctaccacaaactgcttttcttcaaactatatattattgtatcacttctaaagtacaagacatttggtcttttgtgcttgaacttacattaatgttggtagatatgtgtgttataatttgaatattctctatctcaacttgaag

SEQ ID NO: 4154 - DNA, 1094 bp, Quercus alba
tatcaacgcagagtacatgggacaccatcttctgagttctaaactttcaacatacccaaaaaagaaacaccaagaatcttgtcgtagtaagtcatggcaagctccaccattcaacgatcagcattcgcaggccagaccgctttgaagcagtccaatgagcttgtccgtaaggttgggagctttgccggtggccgcgttaccatgaggcgaacagtgaagagtgctccacaaagcatatggtatggcccagaccgcccaaagtacttgggaccattctctgagcagactccctcataccttactggtgaattccctggtgactatggctgggacactgctggattatccgcagaccctgagacatttgctaggaaccgtgagctggaggtaatccacagccgatgggccatgcttggagctttgggctgtgtgttccctgaagtcctttcaaagaatggtgtcaagtttggtgaagcagtttggttcaaggctggtgcacagattttctctgaaggtggtcttgattatcttggcaacccaaacctcattcatgcacaaagcatcttggcaatctgggctgttcaagttgtgcttatgggcttcattgaaggatacagagttggtggaggaccactcggtgaaggacttgaccccatttaccctggtggcgcctttgacccacttggactggctgatgatcctgaagcattcgcagaattgaaggtgaaggaactaaagaatgggaggttggcaatgttctccatgtttggtttctttgttcaggctattgttactggaaagggtccaattgagaacctgtttgaccatgttgctgacccagtcgccaacaatgcatgggcctacgccactaactttgtccctggaaaatgaagaaacttaaatgttctactgtaactttactcatcaatcttcttgcttgtgttcaacttctctcttgctgtgttcatctatattgtatcgatgctaccacaaactgcttttcttcaaactatatattattgtatcacttctaaagtacaagacatttggtcttttgtgcttgaacttacattaatgttggtagatatgtgtgt

SEQ ID NO: 4155 - DNA, 1058 bp, Citrus sinensis
aaacatcttcagagtgcgaaaagaagcttcagcaacaaaaggaaaagctttcgcataagaacatatggcaacctctgctatccaacaatcagcatttgctggccagaccgccttgaggcaatccaatgagtttgtccgcaaggttggagttgctgacggtggccgtatcaccatgaggaggactgtcaaatccgctccccagagcatctggtacggcccagaccgcccaaagtacttgggaccattctctgagcaaacaccatcatacttgactggtgagttccctggtgactatggctgggataccgctggtttatcagcagaccccgagacatttgctaagaaccgtgagctagaggtgatccacagcagatgggcaatgcttggagctcttggctgcgtcttccctgaaatcctctccaagaatggagtgaagttcggcgaagcagtttggttcaaggctggcgctcaaatattctctgaaggtggccttgactatcttggcaaccccaacctcattcatgctcagagcattttggctatctgggcctgccaggttgtgcttatgggttttgttgaaggatacagaattggtggcggtcctcttggtgaaggacttgacccactttaccctggtggtgcttttgacccacttggtttggctgatgaccccgatcaatttgctgagttgaaggtcaaggagctcaagaatggccgtctggctatgttctccatgtttggattctttgttcaggctattgtcactgggaagggtccaattgagaacctctacgaccacattgctgatcctgtggccaacaatgcctgggcttatgccactaactttgttcccggaaagtgaagaaactcatgacttgatggtgtctgtttcagctgtaacattattctatgtatcgtatgtgcttttgtggaaaactctgtcatggacttattagtagctctgtaatgttaccattagaaatgctatgctcctgatcttttatttccatcagaatttcagaagttgatttagaatttaaagtgttgattgatacttc

SEQ ID NO: 4156 - DNA, 1072 bp, Carica papaya
acccccacacagccaagccagccagacccaacatttcattgaaaaaaggatccgttggtcaacagagaaacctcagcctcagatagcaatggcaacctctgctatccaacaatctgcatttgctggccagacagctttgaagcaggccaatgagctcgtccacaaggtcggtgccttcggcggtggacgtgctaccatgaggcgcaccgtgaaaagcgctcctcagagcatctggtatggccctgaccgcccgaagtacttgggtccattctcagagcaaactccatcctatttgacaggagaattccccggcgactacggatgggacacagctgggttgtcagctgacccggaaacattcgccaagaaccgtgagctcgaagtgatccactgcagatgggcaatgctcggcgccctcggctgcgtcttccccgaaatcctcgcaaagaacggtgtcaagttcggcgaagccgtctggttcaaggctggttctcaaatcttctcggagggtggccttgactacctcggaaaccccaacctgattcacgcacagagcatcctagctatctgggcttgccaggttgtgctcatgggcttcgtcgaaggctacagagtcggcggcggaccgctcggtgaaggactcgacccaatctaccctggtggtgcttttgacccactcgggttggctgatgaccctgaagcttttgcagagttgaaggtgaaggagatcaagaatggacgtttggctatgttttccatgtttggcttcttcgttcaggctattgtgactggtaagggtcctattgagaacctcttcgaccacgttgctgatccagtcgccaacaacgcctgggcttacgcgaccaacttcgtgcccgggaaatgaagaaatttgcatggagatttttatgcaacgttgtaacattactgcgtcttcttcgtggtttcctcaaactgtactgttgtgagctttggaactgatgtaattttatcagtacaatgaactggctataatggaattattattatcactgaatcaaccagctctatgtttgtattgcaactataaaaa

SEQ ID NO: 4157 - DNA, 1053 bp, Tripterygium wilfordii
caatcacagtccagcaaagaaactaaatttgatacttccatggcaacctctgctatccaacaatccgcattcgccggccaaactgccttgaagcagccaaatgagttcgttcggagggttggttccttcggaggcggccgcatttcgatgcgccggaccgtcaagagcgctccccagagcatctggtatgggccggaccgtccaaagtatttgggcccattctcggagcaaactccttcgtacctcaccggagaatttcccggcgactacgggtgggacactgccggattatccgccgatccagaaacatttgccaagaaccgtgaactcgaagtgatccactccagatgggccatgcttggtgctctgggctgcgtcttccccgaaatcctctcgaagaacggtgtcaagttcggcgaggcggtttggttcaaggccggatctcagatcttctccgaaggtgggctcgactaccttggcaacccaaacctcattcacgcccaaagcattctcgcaatctgggcttcccaggttgtgttaatgggctttgtcgaagggtacagaattggtggcggcccactcggtgaaggacttgacccactttatccaggtggtgcatttgacccattgggcttggcggatgacccagaagcctttgcagagttgaaggtcaaggagctcaagaatgggcgacttgcaatgttttcaatgtttggattcttcgttcaagctattgtgactgggaagggacccattgagaacctgttcgatcatgttgcggatccggtggccaacaatgcttgggcttatgccaccaactttgtccctggaaaatgaagatattgattacctactatgaactctaaacttcattgtaacattattgtacaatcttggttatgtgcttgtgttgaaaattagtgctgttgattacatcgttgtccttggaatgtttacaaggtaagataaatcgatggacttgcacaataacctacaaacaacgcgtgtagagtaaacattagtaatttcatatacgggttcagtaagaatcga

SEQ ID NO: 4158 - DNA, 1133 bp, Populus trichocarpa
ctttctgccttgatcatcgtatatcctactcgggcaacctagatacagtaaaagtaaagaagaagaagaagaagaaaagagggtcatggcaacctctgcaatccaacaatctgcatttgctggccagaccgctttgaagcagtcaaatgagcttgtccgtaaggttggttcgtctggtgatggtcgtattaccatgcgcaggactgtcaaaagtgctccacaaagtatatggtatggcccagaccgcccaaagtacttgggtccattctctgagcaaactccatcatacctgaccggtgaattccctggtgattatggatgggacacagctggtttgtctgcagaccctgagacatttgccaaaaaccgtgagcttgaggtgatccatagcagatgggccatgcttggtgcactcggatgtgtcttccctgaaattcttgccaagaatggtgtcaagttcggcgagtcagtttggttcaaggctggatctcaaatcttttcagagggtggccttgattaccttggcaaccccaatctcattcatgctcagagcatcctcgcaatctgggcttcccaggttgtgctcatgggattcgttgaagggtacagagtgggaggaggaccacttggcgaaggacttgaccccatctatcctggtggtgcctttgacccacttggcctcgctgatgatcctgatgcatttgcagagttgaaggtgaaggagctcaagaacggccgccttgcaatgttctcaatgtttggattcttcgttcaggccattgtcactggaaagggacctatcgagaatcttttggatcaccttgccgatccagtggccaacaatgcttgggcatatgccactaacttcgttcctggaaaatgaagaaactcagatgtttgccttgtagattgctactttacttgatacttgtgtttttgttgaaaaaaacttgttatggactccgccagtacttgtgtttttactagtggaactgaaactgcttatatacatgggaagttctttatcaccatgaatccactaagaacatcagactcttttgtgcttggatctacatttttggtttgattgtgccatagacaagttgcccccagaatagttagatcaatgtttt

SEQ ID NO: 4159 - DNA, 910 bp, Scabiosa columbaria
gctctcttcaagccatcccgtagcacaaaacatatataaagacagtggggatattttaatagaataaaaagaagctttatcaatggccacttctgcaattcagcactctggtttggctctaaagccgcagaacgagctcgttcgcaaggtcgggagcttcggcaccagcaggcttaacatgaggcggactgtcaaaagcgccccgcaaagcatttggtatggacctgaccgtcccaagtacttgggcccattctctgaacaaactccgtcatacttgaccggtgagttccccggtgactacgggtgggacactgctggactatccgctgacccagagaccttcgcaaagaaccgtgagctagaagtcatccacagccgatgggccatgctcggtgcattgggttgcgtgttccctgaaatcttgtccaagaacggtgtaaaattcggcgaagcagtttggttcaaggccgggtcccaaattttctcagaaggtggcctagactatctaggaaaccctaaccttatccatgcacaaagcatcttagccatatgggctagccaagtggtcctaatgggcttgatcgaaggttaccgtgttggtggtggcccacttggtgaagggctcgattcgctttaccctggtggagcatttgacccattgggtttggcggatgatcctgaagcgtttgcagagttgaaggttaaggagttgaagaacggaagattggctatgttttcgatgtttgggttctttgttcaagctattgtgaccggaaagggaccggttgagaacctatatgaccatgttgctgaccccgtggctaacaatgcttgggcctatgcaactaactttgtacccggaaagtgaacttatgtgtatgcttaaatttggacctaatgtttttatgct

SEQ ID NO: 4160 - DNA, 968 bp, Scabiosa columbaria
attagctctcttcaagccatcccgtagcacaaaacatatacaaacacatagtggggatacattaatagaataaaaagaagctttatcaatggccacttctgcaattcagcactctggtttggctctaaagccgcagaacgagctcgttcgcaaggtcgggagcttcggctcgagcaggcttaacatgaggcggactgtcaaaagcgccccacaaagcatttggtatggacctgaccgtcccaagtacttgggcccattctccgaacaaactccgtcatacttgaccggtgagttccccggtgactacgggtgggacactgctggactatccgctgacccagagaccttcgcaaagaaccgtgagctagaagttatccacagccgatgggctatgctcggtgcattgggttgcgtgttccccgaaatcttgtccaagaacggtgtaaaattcggtgaagcagtttggttcaaggccgggtcccaaattttctcagaaggtggcctagactatctaggaaaccctaaccttatccatgcacaaagcatcttagccatatgggctagccaagtggtcctaatgggcttgatcgaaggttaccgtgttggtggcggcccacttggtgaaggccttgattcgctttacccgggtggagcatttgacccattgggtttggcggatgatcctgaagcgtttgcagagttgaaggttaaggagttgaagaacggaagattggctatgttttcgatgtttgggttctttgttcaagctattgtgaccggaaagggaccggttgagaacctatatgaccatgttgctgaccccgtggctaacaatgcttgggcctatgcaactaactttgtacccggaaaatgagtttatctatatgtttaaatttcgatgtattgattttatgctacttttacttggtgtgattaattaactatgttgtcatttgaatattttactg

SEQ ID NO: 4161 - DNA, 1058 bp, Citrus clementina
aaacatattcagagtgcgaaaagaagcttcagcaacaaaaggaaaagctttcgcataagaacatatggcaacctctgctatccaacaatcagcatttgctggccagaccgccttgaggcaatccaatgagtttgtccgcaaggttggagttgctgacggtggccgtatcaccatgaggaggactgtcaaatccactccccagagcatctggtacggcccagaccgcccaaagtacttgggaccattctctgagcaaacaccatcatacttgactggtgagttccctggtgactatggctgggataccgctggtttatcagcagaccccgagacatttgctaagaaccgtgagctagaggtgatccacagcagatgggcaatgcttggagctcttggctgcgtcttccctgaaatcctctccaagaatggagtgaagttcggcgaagcagtttggttcaaggctggcgctcaaatcttctctgaaggtggccttgactatcttggcaaccccaacctcattcatgctcagagcattttggctatctgggcctgccaggttgtgctcatgggttttgttgaaggatacagaattggtggcggtcctcttggtgaaggacttgacccactttaccctggtggtgcttttgacccacttggtttggctgatgaccccgatcaatttgctgagttgaaggtcaaggagctcaagaatggccgtctggctatgttctccatgtttggattctttgttcaggctattgtcactgggaagggtccaattgagaacctctacgaccacattgctgatcctgtggccaacaatgcctgggcttatgccactaactttgttcccggaaagtgaagaaactcatgacttgatggtgtctgtttcatctgtaacattattctatctatcgtatgtgcttttgtggaaaactctgtcatggacttactagtagctctgtaatgttaccattagaaatgctatgctcctgatcttttatttccatcagaatttcagaagttgatttagaatttaaagtgttgattgatacttc

SEQ ID NO: 4162 - DNA, 985 bp, Sesamum indicum
agaaaaaactgttgaaaatggcaacttcagcgtttcagcaatctgcatttggtgggcagacggctttgaagccccagaatgagctgatcaggaaggtcggcaacgtcagtgccggaggccggttcaccatgagacgtactgtcaagagcgctcctcagagcatctggtacggaccggataggcccaagtacttgggcccattctccgagcaaaccccatcataccttactggtgaattccctggagattatggttgggacactgcagggctgtcggctgatcccgagacattcgctaagaaccgtgagcttgaggtgatccactgccgttgggccatgcttggtgcattgggttgcgttttcccagagatcctgtccaagaatggggtcaaattcggagaggccgtgtggttcaaggccggagcccagatcttctcggaaggcgggctcgactatttaggcaaccctaacctcatccacgcacagagcatcttggccatctgggcctgccaagtcgtgttgatgggtttcgtcgaaggatacagagtcggaggaggcccacttggagagggactcgacaagatctaccctggcggagcgttcgacccgttgggcttggccgacgatcctgaggcatttgccgagttgaaggttaaggaaatcaagaatgggagattggcaatgttctcaatgtttggattctttgtgcaggccattgtgactggaaagggcccaattgagaacctctttgaccatgttgctgatccagtggccaacaatgcttgggcctatgccacaaactttgtgcctggaaaatgagatacttagacaaaatgtgctaatgttaggggagtgttgctgaaactattgtattgtgaatttgaggtgtattcctggtatgatgatgtgagaatgtttcaactctaaatttgctgttcttggcaccttttaccttacattacataacaacgtacttttaatgtaat

SEQ ID NO: 4163 - DNA, 844 bp, Flaveria ramosissima
caccctcaacaatctatcatcaattcacaacccccttactcaaatggcgacctctgcaatccaacagtcagcattcgccggctccgcggcgttgaagccacaaaacgagctcgtcaagaagatcggtagcttcaacggcggccgtttcaccatgcgccgaaccgtcaagagcgcaccacaaagcatttggtatgggccggacaggcccaaatacttgggcccgttctcggagcaaaccccatcatacctaaccggagaattccctggtgattatgggtgggacacagctggattatcagctgatcccgagacatttgccaagaaccgtgagcttgaagtgatccactctcggtgggccatgcttggtgcactcgggtgcgtgttccccgagattcttgcaaagaacggtgtcaaattcggtgaagcagtctggttcaaggcgggctcccagatattctcagaaggtgggcttgactacctcgggaacccaaacttgatccatgctcagagcatcttagctatctgggcttgtcaggttgttctcatgggcctcattgaagggtaccgcgttggtggaggcccattgggtgaagggctcgacaagatttacccaggtgggtcttttgacccacttggtttggctgatgacccggatgcatttgctgagttgaaggttaaggagcttaaaatggacgattggctatgttttcgatgttcgggttcttcgttcaggccatcgttactggaaaaggcccgatcgagaacttgtttgatcatgtcagcgatccggtggctaacaacgcttgggcttatgccaccaactttgttcctggaaaatgagttt

SEQ ID NO: 4164 - DNA, 889 bp, Flaveria ramosissima
accctcaacaatctatcatcaattcactttccccttactcaaatggcgacctctgcaatccaacagtcagcattcgccggctctgcggcgttgaagccacaaaacgagctcgtcaagaagatcggtagcttcaatggcggccgctcaccatgcgccgaaccgtcaagagcgcaccacaaagcatttggtatgggccggacaggcccaagtacttgggcccgttctcggagcaaaccccatcatacctaactggagaatttcctggtgattatgggtgggacacagctggattatctgctgatcccgagacatttgccaagaaccgtgagcttgaagtgatccactctcggtgggccatgcttggcgcactcgggtgcgtgttccccgagattcttgcaaagaacggtgtcaaattcggtgaagcagtctggttcaaggcgggctcccagatattctcagaaggtgggcttgactacctcgggaacccaaacttgattcatgctcagagcatcttagctatctgggcttgtcaggttgttcttatgggcctcattgaagggtaccgtgttggtggaggcccattgggtgaagggctcgacaagatttacccaggtgggtcttttgacccacttggtttggctgatgacctggatgcatttgctgagttgaaggttaaggagcttaagaacggacgattggctatgttttcgatgttcgggttcttcgttcaggccatcgttactggaaaaggcccgatcgagaacttgtttgatcatgtcagcgaccccgtggctaacaacgcttgggcttatgccaccaactttgttcctggaaaatgagtttgattagtgtaaatttgatgatgattatgaagtaatataacaagttt

SEQ ID NO: 4165 - DNA, 991 bp, Quercus alba
accatcttctaagttctaaactttcaacatacccaaaaaagaaacaccaagaatcttgtcgtagtaagtcatggcaagctccaccattcaacgatcagcattcgcaggccagaccgctttgaagcagtccaatgagcttgtccgtaaggttgggagctttgccggtggccgcgttaccatgaggcgaacagtgaagagtgctccacaaagcatatggtatggcccagaccgcccaaagtacttgggaccattctctgagcagactccctcataccttactggtgaattccctggtgactatggctgggacactgctggattatccgcagaccctgagacatttgctaggaaccgtgagctggaggtaatccacagccgatgggccatgcttggagctttgggctgtgtgttccctgaagtcctttcaaagaatggtgtcaagtttggtgaagcagtttggttcaaggctggtgcacagattttctctgaaggtggtcttgattatcttggcaacccaaacctcattcatgcacaaagcattttggcaatctgggctgttcaagttgtgcttatgggcttcattgaaggatacagagttggtggaggaccactcggtgaaggacttgaccccatttaccctggtggtgcctttgacccacttggactggctgatgatcctgaagcattcgcagaattgaaggtgaaggaactaaagaatgggaggttggcaatgttctccatgtttggttctttgttcaggctattgttactggaaagggtccaattgagaacctgtttgaccatgttgctgacccagtcgccaacaatgcatgggcctacgccactaactttgtccctggaaaatgaagaaactctgttgtaatttgactccttaatcttcttgtttgtgatctactttttattgttcatcagtttaaattaagcggattctattttataaaaccctcaatcgaagggtaaaacattgaca

SEQ ID NO: 4166 - DNA, 1104 bp, Quercus alba
taagttctaaactttcaacataccaaaaaagaaacaccaagaatcttgtcgtagtaagtcatggcaagctccaccattcaacgatcagcattcgcaggccagaccgctttgaagcagtccaatgagcttgtccgtaaggttgggagctttgccggtggccgcgttaccatgaggcgaacagtgaagagtgctccacaaagcatatggtatggcccagaccgcccaaagtacttgggaccattctctgagcagactccctcataccttactggtgaattccctggtgactatggctgggacactgctggattatccgcagaccctgagacatttgctaggaaccgtgagctggaggtaatccacagccgatgggccatgcttggagctttgggctgtgtgttccctgaagtcctttcaaagaatggtgtcaagtttggtgaagcagtttggttcaaggctggtgcacagattttctctgaaggtggtcttgattatcttggcaaccaaacctcattcatgcacaaagcattttggcaatctgggctgttcaagttgtgcttatgggcttcattgaaggatacagagttggtggaggaccactcggtgaaggacttgaccccatttaccctggtggtgcctttgacccacttggactggctgatgatcctgaagcattcgcagaattgaaggtgaaggaactaaagaatgggaggttggcaatgttctccatgtttggtttctttgttcaggctattgttactggaaagggtccaattgagaacctgtttgaccatgttgctgacccagtcgccaacaatgcatgggcctacgccactaactttgtccctggaaaatgaagaaacttaaatgttctactgtaactttactcatcaatcttcttgcttgtgttcaacttctctcttgctgtgttcatctatattgtattgatgctaccacaaactgcttttcttcaaactatatattaatgtatcacttctaaagtacaagacattttggtcttttgtgctttgaactttacattaatgttggtagatatgtgtgttataatttgaatattctctatctcaacttgaagcatatata

SEQ ID NO: 4167 - DNA, 1026 bp, Prunus persica
aggcaccaccccacttcgaacaggagagcatagtcatggcaacctctgcaatccaacaatcagcatttgctggccagactgctttgaagcagtcaaatgagctcatccgaaagattggcggccttggtggcggccgcatcaccatgaggcgcaccgtcaaaagcaccccccaaagcatatggtatggcccagaccgcccaaaatacttgggaccattctctgagcaaactccatcatacttgactggtgaattccctggtgactacggatgggacactgctggactatccgcagaccctgagacatttgccaaaaaccgtgagcttgaggtgatccacagccgatgggccatgcttggtgcactgggatgtgtcttcccagaaatcctgtcaaagaatggtgtcaagttcggcgaggctgtttggttcaaggctggatctcaaatcttctccgagggtggccttgactatcttggcaacccaaaccttgtccatgcccagagcatcttggcaatctgggctgtccaggttgtgctcatgggatttgtcgaaggatacagggttggtggaggaccacttggtgaaggactggatccactttaccctggaggggcctttgacccacttggactggctgatgatcctgaggcgtttgctgaactgaaggtgaaagagcttaagaatgggcggctggcaatgacttcaatgtttggattctttgttcaggctattgtaactggaaagggcccagttgagaacctatatgaccatgttgctgatccagttgccaacaatgcatgggcttatgccaccaactttgtccctggaaaatgaagaaacctaaatgcatggctgttcatatgtaacattacccgaacttcttgcctttgttgaggttctgttgttgtggactccattagttctgatgtaatcttactagaaactgcttgtattgaaatcacttatccagtaaaaccgcccagctcctttgtgcttgaactccttatttgtctagatgtgttgaaca

SEQ ID NO: 4168 - DNA, 1618 bp, Prunus mume
actttttggagaatcaccctttactcttcttccactgcaaaccatttctgccctgctatggtttgctgttgttttgtcaatactgcggcaaattaaccttttcacagcagccaaggaacagttcgaattttagaggttggcgttttttaccttaagccaacaaaaacacccaaggaaagtttatgctttcatggtttcatcaacgggggcctattaaatatttgtcttttggttggagctggcatgaccttctacagtacaactaatcttgtggcctgcgttcaccaaccacaaatattgcaccaatttgcctgccacgtggctaagagataacccctctctcactagaacaatcagtttggaaatctaaatccaattgagaaccaatagaatgttgctgatctgtagatatcctaatccacaacatcttcacattcccgttataacatcccagcgctctccttgtccaaggcatctcattaggcctcacaacaccaccccacttcgaacaggagagcttagtcatggcaacctctgcaatccatcaatcagcatttgccggccagactgctttgaagcagtcaaatgagctcatccgaaagattggcggccttggtggcggccgcatcaccatgaggcgcaccgtcaaaagcaccccccaaagcatatggtatggcccagaccgcccaaaatacttgggaccattctctgagcaaactccatcatacttgactggtgaattccctggtgactacggatgggacactgctggactatccgcagaccctgagacatttgccaaaaaccgtgagcttgaggtgatccacagccgatgggccatgcttggtgcactgggatgtgtcttcccagaaatcctgtcaaagaatggtgtcaagttcggcgaggctgtttggttcaaggctggatctcaaatcttctccgagggtggccttgactatcttggcaacccaaaccttgtccatgcccagagcattttggcaatctgggctgtccaggttgtgctcatgggatttgtcgaaggatacaggattggtggaggaccacttggtgaaggactggatccactttaccctggaggggcctttgacccacttggactggctgatgatcctgaggcgtttgctgaactgaaggtgaaagagcttaagaatgggcggctggcaatgacttcaatgtttggattctttgttcaggctattgtaactggaaagggcccagttgagaacctctatgaccatgttgctgatccagttgccaacaatgcatgggcttatgccaccaactttgtccctggaaaatgaagaaacctaaatgcatggctgttcatctgtaacattacccgaacttcttgcttttgttgaggttctcttgttgtggactccattagttctgatgtaatcttactagaaactgcttgtattgaaatcacttatccagtaaaaccgcccagctcctttgtgcttgaactccttatttgtctagatgtgttgaacattcaaaagttccagtcaacaaatgcatgctttgctgcaatatagtaaatctaaaccagagaataaatatataacaaccaaaatacaagggaaaataaaaatta

SEQ ID NO: 4169 - DNA, 904 bp, Ambrosia trifida
agggcaccatctaatctttaatctacaaacacacctaccttcaagtaacaatctatcaatggccacctctgcaatccaacagtcagcattcgcaggccaggctgctttgaagccacaaaatgagcttgttaggaagaccggcagcttcaatggtggccgcttcaccatgcgccgaaccgtcaaaagcgcaccacaaagcatttggtacggacctgaccgccccaagtacttgggcccattctctgagcaaaccccatcatacctaaccggtgaattccctggtgactacggatgggacactgccggattatctgctgaccccgagacattcgccaagaaccgtgagctcgaggtgatccactctaggtgggccatgctcggcgcactcgggtgcgtgttccccgagattctttcaaagaacggtgtcaaattcggtgaagccgtctggttcaaggccggttcccaaattttctccgaagacgggcttgactacctagggaacccgaacttgatccatgcccaaagcatcttagccatctgggcttctcaagttgtgctaatgggcctcattgaaggataccgtgttggaggcggcccactcggtgaagggctagacaaaatctacccgggtgggtcttttgacccacttgggttggctgatgacccagatgcatttgctgagttgaaggttaaggagcttaagaatggtcggttggctatgttttccatgtttgggttctttgttcaggccattgtaacaggaaagggcccaattgagaacttgtttgaccatttgagtgacccagtagctaacaacgcatgggcctatgctaccaactttatgcctggaaaatagttgaatgattgtaaagtttattatggctatgcactaatgttaacaaag

SEQ ID NO: 4170 - DNA, 976 bp, Ambrosia trifida
cttcaccaccatctaatctttaatctacaaacacatcttcaagtaacaatctatcaatggccacctctgcaatccaacagtcagcattcgcaggccaggctgctttgaagccacaaaatgagcttgccaggaagaccggcagcttcaatggtggccgcttcaccatgcgccgaaccgttaaaagcgcaccacaaagcatttggtacggacctgaccgccccaagtacctgggcccattctctgagcaaaccccatcatacctaactggtgaattccctggtgactacgggtgggacactgccggattatctgctgaccccgagacattcgccaagaaccgtgagctcgaggtgatccactctaggtgggccatgctcggcgcactcgggtgcgtgttccccgagattctttcaaagaacggtgtcaaattcggtgaagccgtctggttcaaggccggttcccaaattttctccgaaggcgggctcgactacctagggaacccaaacttgatccacgcccaaagcatcttagccatctgggcttctcaagttgtgctaatgggcctcattgaaggatatcgtgttggaggcggcccactcggtgaagggctcgacaaaatctacccaggtggatcttttgacccacttgggttggctgatgacccagacgcatttgctgagttgaaggttaaagagcttaagaatggtcggttggctatgttttccatgtttgggttctttgttcaggccattgtgacaggaaagggcccaattgagaacttgtttgaccatcttagtgacccagtagctaacaatgcatgggcctatgctaccaactttgtgcctggaaaataagttgaatgattgtaaagtttattatggctatgcactaatgttacaagtttttgggtattttagttgctttgtttcttttttattatttttcactaataatattagctaccaccttttggttt

SEQ ID NO: 4171 - DNA, 1163 bp, Malus domestica
gcgggcttgctcaacgccaccaatacttcaaacagaaaaaggaaaaaaaaaaaaaaaaaagcagcaagccatggcaacctctgctatccaacgatcagcatttgctggccagactgttttgaagcagtcgaatgagctcgtccggaagatcggcggccttggtggcggccgcttctccatgcggcgcacagtcaaaagtgctccccagagcatatggtacggcccagaccggccgaagtacttgggaccgttctccgagcaaactccatcatacttgaccggtgaattccccggtgactacggatgggacactgctggactatctgcagaccccgagacatttgccaagaaccgtgagcttgaggtgatccactccagatgggccatgcttggtgcactgggatgcgtcttcccagaaatcttgtcaaagaatggggtcaagttcggcgaggcagtttggttcaaggctggatctcaaatcttctccgagggcggccttgactaccttggcaacccaaaccttatccatgctcagagcatcttggctatctgggctgtccaggttgtgctcatgggattcattgagggatacagagttggtggaggaccactcggtgaaggacttgacccactttacccaggaggtgcctttgatccactcggacttgctgatgatcctgaagcttttgctgaactgaaggtgaaggaacttaagaacgggcgtctggctatgacctcgatgtttggattctttgttcaggctattgtcacaggaaagggcccagtcgagaacctctttgaccacattgctgatccagtggccaacaacgcatgggctttcgccaccaactttgtccctggaaagtgaagaaacctaaatccatggctgtttccgatttaattttactagaaactgcttgtattgaaatcgctgtacccagtaaaaccaccgagctcctttgtttaatttgtctaattgtgctgcacattcaagcattcctgtcaatagatgcatgctttgcactttgcagtaatagagtatatctaaaccaggaaacaaatggaggacgcttccaactagcaatacacaagagaaaaacaacattgaaacattaagttcatagattgatcttagatttcttcatctatcaccattaggcaaa

SEQ ID NO: 4172 - DNA, 1098 bp, Catharanthus roseus
ggtgagaagaaaagaagaagaagaaaactcaataagaaataatggcaacctcaggtcttcaacaatctacatttgctgggcagactctcttgaagccacaaaatgaactcatcaggaaggttggaaccgttggtggtggccgttttaccatgaggaggactgttaaaagtgttccacaaagcatttggtatgggccagatcgtcccaaatacttgggcccattttctgaacaaactccatcctatctcactggtgaattccctggtgattatggatgggacaccgctgggctttcagctgatccagagacatttgccaagaaccgggagcttgaagtgatccacagccgatgggctatgctcggagctttgggctgcgtcttccctgagatcctagcaaagaacggcgtaaagttcggggaggccgtctggtttaaggcgggagcccaaatcttttccgagggtggactcgactacctcggaaacccaaacctgatccatgcccaaagcatcctagctatctgggcttgccaagttgttctcatgggcttgattgaaggatacagagtcggtggtggacccctcggagagggactcgacaagatctacccaggaggagcattcgacccattgggcttggctgatgatccagaggcatttgctgaattgaaagtgaaggagatcaagaatggtagattagctatgttctctatgtttggattctttgtgcaggctattgttactggaaaaggcccaattgagaacctttttgaccatgttgctgatccagtggccaacaatgcctgggcttatgccacaaactttgtgcctggaaagtgaaaaactcatcaaatctctcaggttgtgtgaatcttggaaaatgttaatgtaatcttatctcatgacttgaatgctaagacctttttttcttttttttttctcacattggcacttccttttatttgtgtttacttattaaacaaatgtccttgactcataatgaaatttacataataatttcaagggttttgaggaggaagttatagaagctactatcaagtttcatgaacaagatcctagaaattaaaaagcaatatta

SEQ ID NO: 4173 - DNA, 1036 bp, Flaveria ramosissima
agatgatttttttaaatattttatcatacacatcctaacacatatatctacttaaattccacagataacatccaatactacaccatcatcacacccttcaacaaacagtcatctcttcagtcttcacagccccaaatggcaacctctgcaatccaacagtcagcattcaccagccagccggcattgaagccgcaaaacgagctcgtcaagaagaccggcgacttcaatggcggccgcttcaccatgcgccgcacggtcaaaagtgcgccacaaagcatttggtatggcccggaccgcccgaagtacttgggcccattctctgagcaaaccccatcatacctaactggtgaattcccaggtgattatggttgggacactgctggattgtcagccgacccagagacatttgccaagaaccgtgagctcgaggtgatccactctaggtgggccatgcttggcgcactggggtgtgtgttccccgagattcttgaaaagaacggtgtcaaattcggtgaagcggtctggttcaaggcgggttcccaaattttctcagaaggtgggcttgactacctcgggaacccaaacttgatccatgcccagagcattttagctatctgggcttctcaagttgttctcatgggcctcattgaaggataccgggttggaggcggcccactaggtgaagggcttgacaagatttaccctggaggctcatttgacccacttggattggctgatgacccagatgcatttgcggagttgaaggttaaggagcttaagaacggccgattggctatgttttcgatgtttgggtttttcgttcaagccattgtaaccggaaagggcccgatcgagaacttgtttgaccatcttagtgaccctgtggctaacaacgcatgggcgtacgccactaactttgtgcccggaaaatgagttgaatacctgtaaaccaaaaataatggttatgcaataatattacaagcttgtgtttttgtcaagatatatttatgtatgtgtgtatgtatacatatacctg

SEQ ID NO: 4174 - DNA, 949 bp, Fraxinus spp
gagaaagcaaatcaccgctacaaagaaagaaactcacaagcaaaaacatggcaacttcagcaatccaacaatctgcatttgctggccagacagccttgaagtcccagaatcagctcatcagaaaggttggcaacctcagaggtggccgcttcaccatgagacgtaccgttaaaagtgctccccagagcatttggtatggaccagaccgccccaagtacttgggtccattctctgagcaaactccatcatacctcactggtgaattcccaggtgattatggttgggacacagctggactgtcagcagaccctgagacatttgccaagaaccgcgagcttgaggttatccactgccgttgggccatgctcggcgcattgggctgtgttttcccagaaatccttgccaagaatggtgtcaagttcggtgaagctgtttggttcaaggctggagctcagatcttctcagaaggtggccttgactaccttggcaacccaaatctcatccatgcccaaagcatccttgctatctgggcttgtcaagttgtgctcatgggatttgttgaaggatacagagttggtgggggcccacttggtgaggggctagataaaatctaccccggtggagccttcgacccacttgggttggcagatgatcctgaggcatttgctgaattgaaggtaaaagaaatcaagaatggacgactggctatgttctcaatgttcggattcttcgtccaggctattgttactggaaagggcccaatagagaacctcttcgaccacgtcgcagatccagttgcgaacaatgcatgggcatatgccacaaactttgtacctggaaaatgaattacattagtgtatacatctcacgcataacaatactaaaatgtttgtctatctcgatgaagttctgtagcttgtgtggaattgagcagaattgatgtaatgtt

SEQ ID NO: 4175 - DNA, 1530 bp, Allium cepa
cacatacttgcctcactgttcacacatacagtttcaacctacatacaatggcagcttcagcaatacaacagtcttcctttgcaggtcaaaccgccctcaaaacctcaaacgaccttcttcgcaaagtcaacctctctggcaatggccgcttcaccatgcgccgcactgtcaaaagcgctccacaaagcatctggtacgggccggaccgtcccaaatacctcggcccgttctcagagcaaaccccatcctatttaaccggtgaattccctggtgactacgggtgggacacagcaggcctatccgccgacccggaaactttcgccaagaaccgagagcttgaagtgatccactgcagatgggccatgcttggcgctttgggctgcgtctttcctgaagttctttccaagaacggggtcaagttcggtgaagctgtctggttcaaggccggatctcagattttctctgaaggtgggctggactacttgggcaacccaaatctggttcatgcccaaagcattcttgcaatctgggccgttcaggttgtgctaatgggattcatagagggatacagagtgggaggagggccgctaggggaagggcttgatgccctttacccaggaggtgcatttgatcctctaggacttgctgatgaccccgacgcttttgcagagttgaaagtgaaagagatcaaaaatggtcgcttggccatgacctccatgttcgggttctttgttcaagccatcgttaccggaaagggtccagttgaaaatttgtttgaccatttggataacccgacggccaataatgcatgggcctttgccaccaacttcgttcctgggaagtgatgttgttttgatatgcttggaccgtgtaaaagtatgatgtcgatgatgaaagagttatgtatttatttaagataatttaaatgtcgaatgtagaaatatggctgcattatggtttttgaatttgtttgaatttcgtataatcactctaatttggtattcattctttcaataaagagcttttgctgtattaaatcatgcaaccagcattgcttccagaaggaaaaaggtaaactatacaggaaacattggtactataacattgctgaaagtcattcattacagtattccctcagaaagtgtactggataagtaactactgtaactgagtaatagttacaatcagcattaaagtaacctttacttgtagaaaagtttacaaccccagttataaacaaggtacatactatttcattaagttggaagtagcagccagcagaacttacagtagatctgaatatcagaatatgcaactcttgatttcttgtgctacgattgcattcgtcgacttcttttttatcaacatttctacgtcaagttttccaagagtgggtcctgaggaaccaagaaaattaaatatcgttccctacgttagatttcataccaacataaatgttatagatacaatggcttcagaatacatgtaaatttataaatgcaattcttagaaaaatataattaaatgttt

SEQ ID NO: 4176 - DNA, 1075 bp, Populus trichocarpa
ctttctgccttgatcatcgtatatcctactcgggcaacctagatacagtaaaagtaaagaagaagaagaagaagaaaagagggtcatggcaacctctgcaatccaacaatctgcatttgctggccagaccgctttgaagcagtcaaatgagcttgtccgtaaggttggttcctctggtgatggtcgtattaccatgcgcaggactgtcaaaagtgctccacaaagcatatggtatggcccagaccgcccaaagtacttgggtccattctctgagcaaactccatcatacctgaccggtgaattccctggtgattatggatgggacacagctggtttgtctgcagaccctgagacatttgccaaaaaccgtgagcttgaggtgatccatagcagatgggccatgcttggtgcactcggatgtgtcttccctgaaattcttgccaagaatggtgtcaagtttggcgagtcagtttggttcaaggctggatctcaaatcttttcagagggtggccttgattaccttggcaaccccaatctcattcatgctcagagcatcctcgcaatctgggcttcccaggttgtgctcatgggattcgttgaagggtacagagtgggaggaggaccacttggcgaaggacttgaccccatctatcctggtggtgcctttgacccacttggcctcgctgatgatcctgatgcatttgcagagttgaaggtgaaggagctcaagaacggccgcctggcaatgttctcaatgtttggattcttcgttcaggccattatcactggaaagggacctatagagaatcttttggatcaccttgccgatccagtggccaacaatgcttgggcatatgccactaacttcgttcctggaaaatgaagaaactcagatgtttgccttgtagattgctacattacttgatccttgtgtttttgtttaaaacaacttgttatggactccgccagtacttgtgtttttagtagtggaactgaaactgcttatatacatgggaagttctttatcaccatgaatccacaaagaacatcatactcttttgtgcttggatctaca

SEQ ID NO: 4177 - DNA, 1101 bp, Primula obconica
cggccgaaaaagcttcttcaaacttaccatttcagacaacaactaatcaaagggtattagtgcaaaagaagctctattgacatggcaacctcggcgatccaacagtcagcatttgccggccagactggattgaaggctcagaatgagcttgtccgaaaagtcgggagcttcggtggtgaccgtgccactatgcgccgaactgtcaaaagtacttctcagagcatctggtacggtgaggatcgcccaaagtacttaggccaattctctgagcaaaccccatcgtatttaacaggtgagttccctggtgactatggatgggacactgcagggctatcagctgacccagagacctttgctaagaaccgcgagcttgaggtgatccactccaggtgggccatgctcggggctttgggttgtgtctttcctgaaatcctctctaaaaacggtgtcaaattcggtgaagcagtctggttcaaggccgggtcacagatcttctctgagggagggcttgactacctcggaaaccctaaccttgtccacgcccaaagcatcctcgccatctgggccagccaggttgtcctcatgggatttgtagagggataccgtgttggtggtggcccacttggcgaagggctcgataagatttaccctggtgggtcatttgacccattgggcttggccgatgacccagaggcgttttcagaattgaaggtgaaggagctcaaaaacggaagattggctatgttttcgatgtttgggttctttgtgcaggctattgtgacggggaagggaccagttgagaacctgtatgaccacttggcggatcctgtggccaacaacgcttgggcctttgccactaactttgcacctggaaagtgaaaattttaatttgtaagagtgatccgtatcgatgtaacattagaagcacaaaaatgttaatgagattattttcgcaatcatgggcttatgtcctccgctatacttccaactttatacttaacgtcgttttactctagtgcatatgaagcatctggaaagtttgaaggaattcctaatctgagaagcaatgacaaaaccatgtgcaaataaacttgcaaccac

SEQ ID NO: 4178 - DNA, 1028 bp, Prunus persica
cacaacaccaccccacttcgaacaggagagcatagtcatggcaacctctgcaatccaacaatcagcatttgctggccagactgctttgaagcagtcaaatgagctcatccgaaagattggcggccttggtggcggccgcatcaccatgaggcgcaccgtcaaaagcaccccccaaagcatatggtatggcccagaccgcccaaaatacttgggaccattctctgagcaaactccatcatacttgactggtgaattccctggtgactacggatgggacactgctggactatccgcagaccctgagacatttgccaaaaaccgtgagcttgaggtgatccacagccgatgggccatgcttggtgcactgggatgtgtcttcccagaaatcctgtcaaagaatggtgtcaagttcggcgaggctgtttggttcaaggctggatctcaaatcttctccgagggtggccttgactatcttggcaacccaaaccttgtccatgcccagagcatcttggcaatctgggctgtccaggttgtgctcatgggatttgtcgaaggatacagggttggtggaggaccacttggtgaaggactggatccactttaccctggaggggcctttgacccacttggactggctgatgatcctgaggcgtttgctgaactgaaggtgaaagagcttaagaatgggcggctggcaatgacttcaatgtttggattctttgttcaggctattgtaactggaaagggcccagttgagaacctatatgaccatgttgctgatccagttgccaacaatgcatgggcttatgccaccaactttgtccctggaaaatgaagaaacctaaatgcatggctgttcatatgtaacattacccgaacttcttgcctttgttgaggttctgttgttgtggactccattagttctgatgtaatcttactagaaactgcttgtattgaaatcacttatccagtaaaaccgcccagctcctttgtgcttgaactccttatttgtctagatgtgttgaaca

SEQ ID NO: 4179 - DNA, 1047 bp, Helianthus annuus
tatggcctcgcaacggggatcaacaaacaacttcaacaacctaccatccattcacagccccaatggccacctccgcaatccaacagtcagcattcgccggccaggccgcgttgaagccacaaaacgagctccttaggaagaccggcagcttcaatggcggccgcttcaccatgcgtcgaaccgtcaaaagcgcaccacaaagcatttggtacggacctgaccgtcccaaatacttgggcccattctctgagcaaaccccatcatacctcactggtgaattccccggtgactacgggtgggacaccgccggattatccgctgaccccgagacattcgccaagaaccgtgagctcgaggtgatccactctaggtgggccatgctcggtgcactcgggtgtgtgttccccgagattctttcaaagaacggtgtcaaattcggtgaagcggtctggttcaaggccggttcccagattttctccgaaggtgggctcgactacctcgggaacccgaacttgatccatgcacagagcatcttagccatctgggcttctcaggttgttctcatgggcctcattgaaggataccgtgttggtggcggcccactcggggaagggctggacaagatttacccaggagggtcttttgacccacttgggttggctgatgacccagatgcatttgctgagttgaaggttaaggagcttaagaatggtcgattggctatgttttccatgtttgggttctttgttcaggccattgtaacaggaaagggcccaattgagaacttgtttgaccatcttagtgacccagtagctaacaacgcttgggcttatgctaccaactttgtgcccggaaaataagttgaatgattgtaaatttgatcatggttatgggacaatgttgcaagtttttggctattttagttttttaacggcaaaggttacatgctctctatttttaaattataccaaatttatcctttgtcaagaattgaaccctgttatttcccttcaatgacataaagcatataccacccaccaaagtggt

SEQ ID NO: 4180 - DNA, 1128 bp, Nicotiana tabacum
ggccattacggccggggatagagtaagttttttcatagttcaaacttagcatcagcacaaagaagataaaaaagaaatcttcaaatggcaacttctgcaattcaacaatctgcattttctgggcagacagctcttaagtcacaaaatgagctcgttaggaaaattggtagctttaatggtggacgtgccacaatgagacgtaccgttaaaagtgccccacaaagcatttggtatggagaagacaggccaaagtacttgggaccattctccgagcaaactccatcttacttgactggcgagtttccaggtgattatgggtgggacaccgctggactctcagctgaccctgaaacattcgccaggaaccgtgagcttgaggtgatccattgccgttgggccatgcttggtgctttgggttgtgtcttccctgaaatcctttccaagaatggtgttaaattcggtgaggcagtttggttcaaggctggatctcaaattttctcagaaggcggtcttgactaccttggtaacccaaaccttattcatgcacagagcattcttgctatttgggcatcccaagttgtgctcatgggcttaattgaaggatacagagttggcggaggcccactgggtgaaggtcttgacaaaatttatccgggaggagcttttgacccactagggctcgctgatgatcccgaggcattcgctgagttgaaggtgaaggaaatcaagaacggccgattggctatgttctcaatgtttggatttttcgttcaagcgattgtcacaggaaagggaccaattgaaaaccttttcgatcacattgctgaccctgtagccaacaacgcttgggcttttgccactaactttgtacccggaaaatgaaatgaatagcctgtaatatgtaaaatgtgtggagctagctgtttcatattcttgatgtaatatgaacttgctaatactaatgcaaactggtctagtcatatacctctcgttaagatagtcatttaaagatttccatggtagaagaagcactttttaggtaccttaatgctatataaagtaacgatatttcaatgagttctttgtattttgtactgttaaagtatgcactttttagtactaatttgc

SEQ ID NO: 4181 - DNA, 976 bp, Nicotiana tabacum
gatagagtaagttttttcatagttcaaacttagcatcagcacaaagaatatagaaaagtcttcaaatggctacttctgcaattcaacaatctgcatttgctggacagacagctcttaagtcacaaaatgaactcgttaggaaaattggtagctttaatggtggacgtgcaacaatgagacggaccgttaaaagtgccccacaaagcatttggtatggagaagacaggccaaagtacttgggaccattctccgagcaaactccatcttacttgactggtgagttcccaggtgattacggatgggacactgctggactctcagctgacccagagacattcgccaggaaccgtgagcttgaggtgatccattgtcgttgggccatgcttggtgctttgggctgtgtcttccctgaaatcctttccaagaatggtgttaaattcggtgaggcagtttggtttaaggctggatctcagattttctcagaaggcggtcttgactaccttggtaacccaaatcttatccatgcacagagcattcttgccatttgggcatcccaagttgtgctcatgggcttaattgaaggatacagagttggcggaggcccacttggtgaaggtcttgacaagatctatcccggaggagcttttgacccacttgggctcgctgatgatcccgaggcattcgctgagttgaaagtgaaggaaatcaagaacggccgattggctatgttctcaatgtttggtttctttgttcaagctattgtcacaggaaagggaccaattgaaaacctcttcgaccatgttgctgaccctgttgccaacaacgcttgggcttatgccacaaactttgtacccggaaaatgaaatgagtagcctgttatatgtaaaatttgtggggctactgcatgttttggatgtactatgaccttactaatatatatgcaaaagccaacattacatattactcaggactcatc

SEQ ID NO: 4182 - DNA, 850 bp, Flaveria ramosissima
ctgggacctcaacaatcatcatcaattcacaaccccttacctcgaatggcgacctctgcaatccaacagtcagcattcgccggctccgcggcgttgaagccacaaacgaactcgtcagaagaccggcggcttcaacggcggccgcttcaccatgcgccgaaccgtcaagagtgcaccacaaagcatatggtatgggccggataggcctaagtacttgggcccgttctcagaacaaaccccatcatacctaaccggagaattccctggtgattatgggtgggacacagcgggattatcagctgatcccgagacatttgccaagaaccgtgagcttgaagtgatccactctcggtgggccatgctcggcgcactcgggtgcgtgttccctgagattcttgcaaagaacggtgtcaaattcggtgaagcagtctggttcaaggcgggctcccagatattctcagaaggtgggcttgactacctcgggaaccccaacttgatccatgctcagagcatcttagctatctgggcttgtcaggttgttctcatgggcctcattgaagggtaccgtgttggtggaggcccattgggtgaagggctcgacaagatttacccaggtgggtcttttgacccacttggtttggctgatgatccggatgcttttgctgaattgaaggttaaggagcttaagaacggacgattggctatgttttcgatgttcggattcttcgttcaggccatcgttaccggaaaggcccgatcgagaacttgtttgatcatgtcagcgatccggtggctaacaacgcttgggcttatgctaccaactttgttcctggaaatgagtttgatttag

SEQ ID NO: 4183 - DNA, 1088 bp, Quercus alba
gacccttttcaatatatatacacacaaaaaagtgaaaaacacagagaagaagcttagcgtactaaacgatggcaacttccaccatccaacgatctgcgtttgccgggcacacccacaccgctttgaagcagtccaatgacttcatccgtaaggttggcggctttggcggtggccgtgttaccatgaggcgcacagtaaagagtgctccacaaagcatttggtatggcccagaccgcccaaagtacttgggaccattctctgagcaaactccatcataccttactggtgaattccctggtgactatggctgggacactgctggattatcagcagaccctgagacatttgctaggaaccgtgagctggaggtaatccacagccgatgggccatgcttggagctttgggctgtgtgttccctgaaatcctttcaaagaatggtgtcaagtttggtgaagcagtttggttcaaggctggtgcacagattttctctgaaggtggtcttgattatcttggcaacccaaacctcattcatgcacaaagcatcttggcaatctgggctgttcaagttgtgcttatgggcttcattgaaggatacagagttggtggaggaccactcggtgaaggacttgaccccatttaccctggtggtgcctttgacccacttggactggctgatgatcctgaagcattcgcagaattgaaggtgaaggaactaaagaatgggaggttggcaatgttctccatgtttggtttctttgttcaggctattgttactggaaagggtccaattgagaacctgtttgaccatgttgctgacccagtcgccaacaatgcatgggcctacgccactaactttgtccctggaaaatgaagaaacttaaatgttctactgtaactttactcatcaatcttcttgcttgtgttcaacttctctcttgctgtgttcatctatattgtatcgatgctaccacaaactgcttttcttcaaactatatattaatgtatcacttctaaagtacaagacatttggtcttttgtgcttgaacttacattaatgttggtagatatgtgtgttataatttgaata

SEQ ID NO: 4184 - DNA, 1029 bp, Quercus alba
ataacataacattaacatctctcgatcccctgacccttttcaatatatatacacacacacaaaaaacacagagaagaagcttagcgtactaaacgatggcaacttccaccatccaacgatctgcatttgccgggcacacccacaccgctttgaagcagtccaatgacttcatccgtaaggttggcggctttggcggtggccgtgttaccatgaggcgcacagtaaagagtgctccacaaagcatttggtatggcccagaccgcccaaagtacttgggaccattctctgagcaaactccatcataccttactggtgaattccctggtgactatggctgggacactgctggattatcagcagaccctgagacatttgctaggaaccgtgagctggaggtaatccacagccgatgggccatgcttggagctttgggctgtgtgttccctgaaatcctttcaaagaatggtgtcaagtttggtgaagcagtttggttcaaggctggtgcacagattttctctgaaggtggtcttgattatcttggcaacccaaacctcattcatgcacaaagcatcttggcaatctgggctgttcaagttgtgcttatgggcttcattgaaggatacagagttggtggaggaccactcggtgaaggacttgaccccatttaccccggtggtgcctttgacccacttggactggctgatgatcctgaagcattcgcagaattgaaggtgaaggaactaaagaatgggaggttggcaatgttctccatgtttggtttctttgttcaggctattgttactggaaagggtccaattgagaacctgtttgaccatgttgctgacccagtcgccaacaatgcatgggcctacgccactaactttgtccctggaaaatgaagaaactctgttgtaatttgactccttaatcttcttgtttgtgatctacttcttattgttcatcagtttaaattaagcggattctattttataaaaccctcaatcgaagggtaaaacattgacacttgaa

SEQ ID NO: 4185 - DNA, 933 bp, Flaveria ramosissima
atcatcaattcactttccccttactcaaatggcgacctctgcaatccaacagtcagcattcgccggctccgcggcgttgaagccacaaaacgagctcgtcaagaagaccggtagcttcaatggcggccgcttcaccatgcgccgaactgtcaagagtgcaccacaaagcatatgggtatgggccgggacaggcccaagtacttgggcccgattctcggagcaaaccccatcatacctaaccggagaatttcctggtgattatgggtgggacacagctggattatctgctgatcccgagacatttgtccaagaaccgtgagcttgaagtgatccactctcggtgggccatgctcggcgcactcgggtgcgtgttccccgagattcttgcaaagaacggtgtctaatttggtgaagcagtctggtttaaggcgggctcccaaatattctcagaaggtgggcttgactacctcgggaacccgaacttgatccatgctcagagcatcttagctatctgggcttgtcaggttgttcttatgggcctcattgaagggtaccgcgttggtggaggcccattgggtgaagggcttgacaagatttatccaggtgggtcttttgacccgcttggtttggctgatgacccggatgcttttgctgagttgaaggttaaggagcttaagaacggacgattggctatgttttcaatgttcgggttcttcgttcaggccatcgttactggaaaaggcccgatcgagaacttgtttgatcatgtcagcgatccggtgctaacaacgcttgggcttatgccaccaactttgttcctggaaaatgagtttgattagtgtaaatttgatgatgattatgaagtaatatcaataacgttccggacttaattttgttatttaattttacaattaatttaaagtctattaagtt

SEQ ID NO: 4186 - DNA, 961 bp, Olea europaea
caacaaagaaagaaactcacgagcaaaaacatggcaacttcagcaatccaacaatctgcatttgcaggccagacagccttgaagtcccagaatcagctcatcagaaaggttggcaacctcggaggtggccgcttcaccatgagacgtactgttaaaagtgctccccagagcatttggtacggacctgaccgccccaagtacttgggtccattctctgagcaaactccatcatacctcactggtgaattcccaggtgattatggttgggacacagctggactatcagcagaccctgagacatttgccaagaaccgtgagcttgaggttatccactgccgttgggccatgctcggcgcattgggctgtgttttcccagaaatccttgccaagaatggtgtcaagtttggtgaggctgtttggttcaaggctggagctcagatcttctcagaaggtggccttgactaccttggcaacccaaatctcatccatgcccaaagcatccttgctatctgggcttgtcaagttgtgctcatgggatttgttgaaggatacagagttggtgggggcccacttggtgaggggctcgacaaaatctaccctggaggagccttcgacccacttgggttggcagatgatcctgaagcatttgccgaattgaaggtaaaagaattcaagaatggacgactggctatgttctcaatgtttggattcttcgtccaggccattgttactggaaagggcccaatagagaacctctttgaccacatcgcagatccagttgccaacaatgcatgggcatatgccacaaactttgtacctgggaaatgaattacattagtgtatacatctcatgcataacaataccaaaatgttttgtctatctcgatgaagttctgtggctcgtctggcattgagcagaattgatgtaatgtttcatgcagacacgaatttatctcttaac

SEQ ID NO: 4187 - DNA, 973 bp, Ambrosia trifida
aataacatccaatattgtagcatcaacacaaacacacagcatctcttcacaacccataatggcaacctctgcaatccaacagtcagcattctccgggcaggcggcattgaagccactaaacgagcttgtccgaaagaccggcagtgtcaatggtggccgcttcactatgcgccgcacagtcaaaagtgcaccacaaagcatttggtacgggcctgaccgccccaagtacttgggcccgttctctgagcaaaccccatcatacttaactggtgaattccctggtgactacggttgggacaccgctggattatctgctgaccccgagacttttgccaagaaccgtgagctcgaggtgatccactctcgatgggccatgctcggtgcacttggatgcgtgttccctgagattcttgcaaagaacggtgtcaaattcggtgaagcagtctggttcaaggcgggatcccagattttctcggaaggtggcctagactacctcgggaacccaaacttgatccatgcccagagcattttagccatctgggcatcacaggttgttctcatgggactcatcgaaggataccgtgttggtggtggcccgcttggtgaagggctcgacaagatttacccgggagggtcatttgacccgcttggattggcagatgatccagatgcgtttgctgagttgaaggttaaggagcttaagaacggacggttggctatgttttccatgttcggatttttcgttcaggccattgtaacaggaaaaggcccgatcgagaacttgtttgaccatcttagtgacccagtagctaacaacgcatgggcttacgctaccaactttgtacctggaaaatgagttcaattaattatgcaatattacaactaaaagctttcgcttttaaagcctgtcttgttattcttgtgtggtttacccttagaatgaagtatttcaggcaaactgttggattgttgt

SEQ ID NO: 4188 - DNA, 1102 bp, Malus domestica
atctcggcaggcttgctcaacaccaccaaaacttcaaacagaaaaaaagcagcaagcaatggcaacctctgcaatccaacaatcagcatttgctggccagactgctttgaagcagtccagtgagctcgtccgaaagatcggcggccttggcggcggccgcttctccatgcggcgcaccgtcaaaagtgccccccagagcatatggtacggcccagaccgccccaagtacttgggaccattctccgagcaaactccgtcatacttgaccggtgaattccccggagactacggatgggacactgctggactatctgcagaccccgagacatttgccaagaaccgtgagcttgaggtgatccactccagatgggccatgcttggtgcactgggatgcgtcttcccagaaatcttgtcaaggaatggcgtcaagttcggcgaggctgtctggttcaaggctggatcgcaaatcttctctgagggcggccttgactaccttggcaacccaaaccttatccatgctcagagcatcttggcaatctgggctgtccaggtcgtgctcatgggattcattgagggatacagagttggaggaggaccactcggtgaaggactagacccactttacccaggaggggcctttgacccccttggacttgctgatgatcccgaagcttttgctgaactgaaggtgaaggaacttaagaacgggcgtctggctatgacctcaatgttcggattctttgttcaggctattgtaactggaaagggaccggtggagaacctcttcgaccacatcgctgacccagtggccaacaacgcatgggcttacgccaccaacttcgtccctggaaagtgaagaaacctcaagtcatggccgttcatctgtaacattacccgaacttactgcttttgttgaggttctcttgttgtggactccattagttctgatgcaattttactagaaactgcttgtattgaaaccgctgtatgcagtaaaaaactcccaagctccttcgttttatttgtctaattgtggtgcacattcaagaattcctatcaatagatgcatgctttgtggcaatatagtaaatctaaactagga

SEQ ID NO: 4189 - DNA, 1013 bp, Artemisia annua
accttcaacaaacaacattatctttacttcacaaccctcttaaccaaatggcaacttcagcaatccaacaggcagcatttgctggtcagtcggctttgaagccgcaaaacgagctcgttaggaaggttggtggcttccatggtggacgctacactatgcgcagaactgttaaaagtgctccacagagcatttggtacggacctgaccgccccaagtacttgggcccattctcagagcaaaccccatcatacttgactggtgaattccctggtgactacgggtgggacactgctggactatcagctgaccccgagacattcgccaagaaccgtgagcttgaggtgatccactctaggtgggccatgcttggtgcactcgggtgcgtattccctgaggtgctttcaaagaatggtgttaaattcggtgaagccgtttggttcaaggcaggatcacaaattttctctgaaggtgggctcgactacctcggaaaccccaacttgatccatgcccagagcattttagccatctgggcatcacaagttgtgcttatgggcctcattgaaggttaccgtgttggtggaggccccctcggtgaagggcttgacagcatttacccaggagggtcttttgacccacttggattggctgatgatccagaagcatttgctgagttgaaggtaaaggagctaaagaatggtcgattggcgatgttttccatgtttgggttctttgttcaggctatcgtaacaggaaagggtccaatcgagaacttatttgaccatcttgctgacccagcagctaacaatgcatgggcttatgccaccaactttgtacctggaaaatgagtttagtatatgtaaatttgatgaacattatgcaatattaaagtagagggtgttgtcgagaaacatatatgtgtgtatgtatttatatatggcactcctgtgacaagaaccatggtttgtttgcaaaacaagctccaatgaaaaataaaacgaatggtgaaagtataa

SEQ ID NO: 4190 - DNA, 1004 bp, Chelidonium majus
attcaagcccttcatactactctagagatcaaacttagtaaggaagagaacaacaaagaaacctctgagagtcatggccacctctgccatcaaccagtcagcattcgccggtcagaccgctttgaaacagcagaatgagcttgtccgaaaggtcggtaccttcggtggccgtatctccatgcgccgcactgtaaagagcaccccagaaagcatttggtacggaccagacagacccaagtacttgggcccattctcagaacaaactccatcatacttgaccggtgaattccctggtgattacgggtgggacaccgctggattatccgctgacccagaaaccttcgctaagaaccgtgagcttgaggtgatccattccagatgggccatgttgggagcactcggttgcgtcttccctgaggttctatcaaagaatggtgtcacgttcggtgaggcagtatggttcaaggccgggtctcagattttctctgagggtgggctagactacctaggaaacccaaaccttgtacatgctcagagcattcttgctatctgggcttcccaagttgttcttatgggtttaattgaggggtaccgagttggtggaggaccactcggagaaggattagatcaaatttacccaggtggatcctttgacccactcgggttggctgatgacccagaagcctttgcagaattgaaggtgaaggagctcaagaatggacgtcttgctatgttctctatgtttgggttctttgttcaagccatcgtcacaggaaagggtcccatcgagaacctttacgaccatcttgccgatccagttgcaaacaatgcatgggcatatgcaactaacttcgttcccggtaaataaacatgagttgtaaccttttctggactgtatcattttacttcaggcttgttgagtttgttgtaattctctggctgtaaatgtaattctacttatctgagttatcctactacctggaaccgctttgctactgaaaaaa

SEQ ID NO: 4191 - DNA, 1105 bp, Gossypium hirsutum
ggagactacaataaccatcggcaaacaaaccaagtcaacctaaagccttaggcaccatggcaacctctgctatccaacaatctgctttcgttggccagaccgctttgaagcagtccaatgagctcttacgcaaagtcggagctttcgatggtggtcgtgttaccatgcgcagaactgtgaaaagtgcccctaccagcatctggtacggccctgaccgcccaaagtacttgggtccattctcagaccaaatcccatcatacctgacaggtgaattccctggtgactatgggtgggacactgctgggttatcagctgacccagagacatttgctaagaaccgtgagcttgaagtgatccactgcagatgggcaatgcttggtgcccttggttgtgtcttccctgaaattctttcaaagaatggagttaagttcggagaggcagtttggttcaaagctggatctcaaatattctccgagggcggccttgactatcttggcaacccaaaccttatccatgctcagagcattcttgcaatctgggcttgccaagttgtgctcatgggatttgttgaaggatacagagttggtgggggaccactcggtgaaggactggacccaatttacccaggtggtgctttcgacccacttggactggctgatgatcctgacgcgttcgcagaattgaaggttaaggagatcaagaatggccgccttgcaatgttctccatgtttggattctttgtccaggctattgtcacaggaaagggtcccattgagaacctctttgaccaccttgccgatccggtggccaacaacgcatgggcttatgccactaactttgtccccggaaaatgaacttagattatagatatgtctctgaaagctgtaacattaattgctatgtagcatctgttgctgtgtactgatgtaattcactgctagtcttttgagctgttgtatcattaaatccatatcctttttccctgaaatagcacctttcttgaaatgagatgagatcataaagcaaatgttttattttgtagtaagaggctggttcagttagttgatataaataaagcgcaagaaatatatctagccatttctat

SEQ ID NO: 4192 - DNA, 1049 bp, Gossypium hirsutum
ggcaaacaaaccaagtcaacctaaagccttaggcaccatggcaacctctgctatccaacaatctacttttgttggccagaccgctttgaagcagtccaatgagctcttacgcaaagtcggagctttcaatggtggtcgtgttaccatgcgcagaactgtgaaaaatgcccctactagcatctggtatggccctgaccgcccaaagtacttgggtccattctcagaccaaatcccatcatacctgacaggtgaattccctggtgactatgggtgggacactgctgggttatcagctgaccctgagacatttgctaagaaccgtgagcttgaagtgatccactgcagatgggcaatgcttggtgcccttggttgtgtcttccctgaaattctttcaaagaatggagttaagttcggagaggcagtttggttcaaagctggatctcaaatattctccgagggcggccttgactatcttggcaacccaaaccttatccatgctcagagcattcttgcaatctgggcatgccaagttgtgctcatgggatttgttgaaggatacagagttggtgggggaccacttggtgaaggactggacccaatttacccaggtggtgctttcgacccacttggactggctgatgatcctgatgcgttcgcagaattgaaggttaaggagatcaagaatggccgccttgcaatgttctccatgtttggattctttgtccaggctattgtcacaggaaagggtcccattgagaacctctttgaccaccttgccgatccggtggccaacaatgcatgggcttatgccactaactttgtccccggaaaatgaacttagattatagatacgtctctgaaagctgtaacattaattactatgtagtgtctgttgctgtgtactgatgtaattcactgctagtcttttgagctgttgtatcattaaagccatatcctttttccctgaaatagcacctttcttgaaatgagatgagatcataaatcaaatgttttattttgtagtaagaggctgcttcagtttgttgata

SEQ ID NO: 4193 - DNA, 962 bp, Gossypium hirsutum
caaacaaaccaagtcaacctaaagccttaggaaccatggcaacctctgctatccaacaatctgcttttgttggccagaccgctttgaagcagtccaatgagctcttacgcaaagtcggagctttcaatggtggtcgtgttaccatgcgcagaactgtgaaaagtgcccctaccagcatctggtatggccctgaccgcccaaagtacttgggtccattctcagaccaaattccatcatacctgacaggtgaattccctggtgactatgggtgggacactgctgggttatcagctgaccctgagacatttgctaagaaccgtgagcttgaagtgatccactgcagatgggcaatgcttggtgcccttggttgtgtcttccctgaaattctttcaaagaatggagttaagttcggagaggcagtttggttcaaagctggatctcaaatattctccgagggcggccttgactatcttggcaacccaaaccttatccatgctcagagcattcttgcaatctgggcatgccaagttgtgctcatgggatttgttgaaggatacagagttggtgggggaccacttggtgaaggactggacccaatttacccaggtggtgctttcgacccacttggactggctgatgatcctgatgcgtttgcagaattgaaggttaaggagatcaagaatggccgccttgcaatgttctccatgtttggattctttgtccaggctattgtcacaggaaagggtcccattgagaacctctttgaccaccttgccgatccggtggccaacaatgcatgggcttatgccactaactttgaccccggaaaatgaacttagattatagatacgtctctgaaagctgtaacattaattactatgtagtgtctgttgctgtgtactgatgtaattcactgctagtcttttgagctgttgtatcattaaagccatatcctttttccc

SEQ ID NO: 4194 - DNA, 814 bp, Taraxacum officinale
gtcctattcccctcacagaaatggcaagctctgcgatccaacagtcagcattcactggccaacaggccttgaagccacagaacgagcttgtcagaaagaccggcaacttcaatggcggcaccatcaccatgcgccgcacagtcaaaagtgcaccacaaagcatctggtacggaccagaccgtccaaagtacttgggcccattctccgagcaaaccccatcatacctgaccggagaattccccggtgactacggttgggacactgctggactctcagctgaccccgagacatttgccaagaaccgtgagctcgaggtgatccactcacggtgggccatgctcggtgcacttgggtgcgtgttccctgagcttctttccaaaaacggtgtcacattcggtgaagccgtctggttcaaggcgggttcccagattttctcggaaggtggtctcgactacctcggaaaccctaatttggtccatgcccaaagcattcttgctatctgggcatctcaagttgtcctcatggggctcattgagggataccgtgttggtggtggcccacttggtgaagggcttgacaagatttaccccggtgggtcttttgacccgcttggattggctgatgacccagaagcatttgccgagttaaaggttaaggagcttaaaaatgggagattggcaatgttttccatgtttggattctttgttcaggctattgtgacagggaaaggacccatcgagaacctgtttgaccatcttgctgaccccgtagctaacaacgcatgggcttatgctaccaactttgtccccggaaa

SEQ ID NO: 4195 - DNA, 993 bp, Flaveria ramosissima
caccatcaacacacccttcaacaaacaaacagtcatctcttcagtcttcacagccccaaatggcaacctctgcaatccaacagtcagcattcgccggccagccaacgctaaagccacaaaacgaactcgtcaagaagaccggcggcttcaatggcggccgcttcaccatgcgccgaaccgttaaaagcgcgccacaaagcatttggtacggaccggaccgccccaagtacctgggcccattctctgagcaaaccccatcatacttaactggcgaattcccaggtgactatggttgggacactgctggattgtcagctgaccccgagacatttgccaagaaccgtgagctcgaggtgatccactctaggtgggccatgctcggcgcactcgggtgcgtgttccccgagattcttgaaaagaacggtgttaaattcggtgaagcggtctggttcaaggcgggttcccaaattttctcagaaggtggccttgactaccttgggaacccgaacttgatccatgcccagagcattttagccatctgggcttctcaagttgttctcatgggcctcattgaaggataccgggttggaggcggcccacttggtgaagggcttgacaagatttacccaggagggtcatttgacccacttggattggctgatgacccggatgcatttgcggagttgaaggttaaggagcttaagaacggccgattggctatgttttcgatgtttgggtttttcgttcaagccattgtaaccggaaagggcccgatcgagaacttgtttgaccatcttagcgacccggtggctaacaacgcatgggcgtatgctaccaactttgtgcccggaaaatgagttgtatacctgtaaaccaaaaataatggttatgcaataatattacaagcttgtgtttttgtcaagaaatatttatgtatgtttgtatgtatacatatacctgccaaaagaaaaacaatggtttgttagacatatt

SEQ ID NO: 4196 - DNA, 950 bp, Flaveria ramosissima
tcaacacacccttcaacaaacagtcatctcttcagtcttcacagccccaaatggcaacctctgcaatccaacagtcagcattcaccagccagccggcattgaagccgcaaaacgagctcgtcaagaagaccggcggcttcaatggcggccgcttcaccatgcgccgcaccgttaaaagcgcgccacaaagcatttggtatggaccggaccgccccaagtacttgggcccattctctgagcaaaccccgtcatacctaaccggtgaattccctggtgactatggttgggacactgctggattgtcagctgacccagagacatttgccaagaaccgtgagctcgaggtgatccactctaggtgggccatgcttggcgcactggggtgcgtgtttcccgagattcttgaaaagaatggtgtcaaattcggtgaagcggtctggttcaaggcgggttcccaaattttctcagaaggcgggcttgactacctcgggaacccaaacttgatccatgcccagagcattttagctatctgggcttctcaagttgttctcatgggcctcattgaaggataccgggttggtggcggcccacttggtgaagggcttgacaagatttacccaggaggctcatttgacccacttggattggctgatgacccagatgcatttgcggagttgaaggttaaggagcttaagaacggacgattggctatgttttccatgtttgggtttttcgttcaagccattgtaaccggaaagggcccgatcgagaacttgtttgaccatcttagtgacccggtggctaacaacgcatgggcgtacgctaccaactttgtgcccggaaaatgagttgtatacctgtaaaccaaaataatggttatgcaataatattacaagcttgtgttttgtctaagaatattatgaatgtatgtatgtatactatatacctag

SEQ ID NO: 4197 - DNA, 901 bp, Flaveria ramosissima
agtcttcacagcctcaaatggcaacctctgcaatccaacagtcagcattcaccagccagccggcattgaagccgcaaaacgagctcgtcaagaagaccggcggcttcaatggcgggcgcttcaccatgcgccgcaccgttaaaagcgcaccacaaagcatttggtatggaccggaccgccccaagtacttgggcccattctctgagcaaaccccgtcatacctaactggtgaattccctggtgactatggttgggacactgctggattgtcagctgaccccgagacatttgccaagaaccgtgagctcgaggtgatccactctaggtgggccatgcttggcgcactcgggtgcgtgttccctgagattcttgaaaagaacggtgtcaaattcggtgaagcggtctggttcaaggcgggttcccaaattttctcagaaggcgggcttgactacctcgggaacccaaacttgatccatgcccagagcattttagctatctgggcttctcaagttgttctcatgggcctcattgaaggataccgggttggtggcggcccactaggtgaagggcttgacaagatttacccaggaggctcatttgacccacttggattggctgatgacccagatgcatttgcggagttgaaggttaaggagcttaagaacggacgattggctatgttttccatgtttgggtttttcgttcaagccattgtaaccggaaagggcccgatcgagaacttgtttgaccatcttagtgacccggtggctaacaacgcatgggcgtacgctaccaactttgtgcccggaaaatgagttgtatacctgtaaaccaaaaataatggttatgcaataatattacaagcttgtgtttttagtaacgaaaaaaaaaaaaaaaaaaa

SEQ ID NO: 4198 - DNA, 1145 bp, Flaveria ramosissima
ccccctactccctcgtgtcgtccgttcggcgacgtctctagtaaagacgagtggtagtacaacgacagagtacagtacggaccactacaacacacccttcaacaatagtcttctcttcagtcttcacagccccaaatggcaacctctgcaatccaacagtcagcattcaccagccagccggcattgaagccgcaaaacgagctcgtcaagaagaccggcggcttcaatggcggccgcttcaccatgcgccgcaccgttaaaagcgcgccacaaagcatttggtatggaccggaccgccccaagtacttgggcccattctctgagcaaaccccatcatacctaactggtgaattccctggtgactacggttgggacactgctggattgtcagctgaccccgagacatttgccaagaaccgtgagctcgaggtgatccactctaggtgggccatgcttggcgcactcgggtgcgtgttccctgagattcttgaaaagaacggtgtcaaattcggtgaagcggtctggttcaaggcgggttcccaaattttctcagaaggcgggcttgactacctagggaacccaaacttgatccatgcccagagcattttagctatctgggcttctcaagttgttctcatgggcctcattgaaggatatcgggttggaggtggcccacttggtgaagggcttgacaagatttacccaggagggtcatttgacccacttggattggctgatgacccagatgcatttgcggagttgaaggttaaggagcttaagaacggacgattggctatgttttccatgtttgggtttttcgttcaagccattgtaaccggaaagggcccgatcgagaacttgtttgaccatcttagtgacccggtggctaacaacgcatgggcatacgctaccaactttgtgcccggaaaatgagttgtatacctgtaaaccaaaaataatggttatgcaataatattacaagcttgtgtttttgtcaagatatatttatgaatgtatgtatgtatacatatacctgacaaaagaaaaccattgtttgttaagaaaacaaaaaaaaaaaaaaaactaataactagtcgtagtacacctactacgtacttctagagaaccctacgacgacgacaacg

SEQ ID NO: 4199 - DNA, 929 bp, Flaveria ramosissima
gcagtagtactatgggtaactacctttctttactttaattttcttatcatcaattcacaacccccttactcgaatggcgacctctgcaatccaacagtcagcattcgccggctccgcggcgttgaagccacaaaacgaactcgtcaagaagaccggcggcttcaacggcggccgcttcaccatgcgccgaaccgtcaaaagtgcaccacaaagcatatggtatgggccggacaggcccaagtacttgggccctttctcggagcaaaccccatcttacctaactggtgaatttcctggtgattatggatgggacacagctggactatccgctgatcccgaaacatttgccaagaaccgtgagctcgaggtgatccactctcggtgggccatgctcggcgcactcgggtgcgtgttccccgagattcttgaaaagaacggtgtcaaattcggtgaagcggtctggttcaaggcaggttcccaaatattctcggaaggtgggcttgactatctcgggaacccaaacttgatccatgctcagagcatcttagctatctgggcttgtcaggttgttctcatgggcctcattgaagggtaccgtgttggtggaggcccattgggtgaagggcttgataaggtttacccaggtgggtctttcgacccacttggattggccgatgatccggatgcatttgctgagttgaaggttaaggagcttaagaacggtcgattggctatgttttcgatgtttgggttcttcgttcaagccattgttaccggaaaaggcccgatcgagaacctgtttgatcatattagtgatccggtggctaacaacgcttgggcttatgccaccaactttgttcctggaaaatgagtttgaatagtgtaaatttgatgatgattatgaagtaatatcacaagtttccggctaa

SEQ ID NO: 4200 - DNA, 890 bp, Flaveria ramosissima
cagtcatctcttcagtcttcacagcctcaaatggcaacctctgcaatccaacagtcagcattcaccagccagccggcattgaagccgcaaaacgagctcgtcaagaagaccggcggcttcaatggcggccgcttcaccatgcgccgcaccgttaaaagcgcgccacaaagcatttggtatggaccggaccgccccaagtacttgggcccattctctgagcaaaccccatcatacctaactggtgaattccctggtgactatggttgggacactgctggattgtcagctgacccagagacatttgccaagaaccgtgagctcgaggtgatccactctaggtgggccatgcttggcgcactagggtgcgtgttccccgagattcttgaaaagaacggtgtcaaattcggtgaagcggtttggttcaaggcgggttcccaaattttctcagaaggcgggcttgactacctcgggaacccgaacttgatccatgcccagagcattttagctatctgggcttctcaagttgttctcatgggcctcattgaaggataccgggttggtggcggcccactaggtgaagggcttgacaagatttacccaggaggctcatttgacccacttggattggctgatgacccagatgcatttgcggagttgaaggttaaggagcttaagaacggacgattggctatgttttccatgtttgggtttttcgttcaagccattgtaaccggaaagggcccgatcgagaacttgtttgaccatcttagtgacccggtggctaacaacgcatgggcttacgctaccaactttgtgcccggaaaatgagttgtatacctgtaaaccaaaaataatggttatgcaataatattacaagcctgtgttttgtc

SEQ ID NO: 4201 - DNA, 2452 bp, Gossypium raimondii
aattttatttattttaactttttaaaagatatttttattattcactaatagcttcaccaccaaaaacatcaacaagatttttccaaatccacgcggcataaaatcaacctatacaactgtccagaaaatccaattgcaaatccacaccaatgcagcaaccaatagactgctgctgacaagtacatttcctgatccacaacatcttctcatttccattataaccccttcctctcctccaaaccaaaatagactacaataaccatcggcaaacaaaccaagtcaacctaaagccttaggcaccatggcaacctctgctatccaacaatctgctttcgttggccagaccgctttgaagcagtccaatgagctcttacgcaaagtcggagctttcgatggtggtcgtgttaccatgcgcagaactgtgaaaagtgcccctaccagcatctggtatggccctgaccgcccaaagtacttgggtccattctcagaccaaatcccatcatacctgacaggtgaattccctggtgactatgggtgggacactgctgggttatcagctgaccctgagacatttgctaagaaccgtgagcttgaagtgatccactgcagatgggcaatgcttggtgcccttggttgtgtcttccctgaaattctttcaaagaatggagttaagttcggagaggcagtttggttcaaagctggatctcaaatattctccgagggcggccttgactatcttggcaacccaaaccttatccatgctcagagcattcttgcaatctgggcttgccaagttgtgctcatgggatttgttgaaggatacagagttggtgggggaccacttggtgaaggactggacccaatttacccaggtggtgctttcgacccacttggactggctgatgatcctgacgcgttcgcagaattgaaggttaaggagatcaagaatggccgccttgcaatgttctccatgtttggattctttgtccaggctattgtcacaggaaagggtcccattgagaacctctttgaccaccttgccgatccggtggccaacaatgcatgggcttatgccactaactttgtccccggaaaatgaacttagattatagatacgtctctgaaagctgtaacattaattgctatgtagcatctgttgctgtgtactgatgtaattcactgctagtcttttgagctgttgtatcattaaatccatatcctttttccctgaaatagcacctttcttgaaatgagatgagatcataaatcaaatgttttattttgtagtaagaggctgcttcagtttgttgatataaataaagcgcaagaaatatatctagccatttctataaaccctcaaaagtgatgacaaaacacaacctgaagaccttaaagttattatgcggatcttccctttcagtcctgttgaaagatggcaataataccagccaacatctgaggtaatcaccaaaaatctttgcaagaacacaatccatctttaaaatgatgaaaccggctattatctctcacaataatctcacgtctatagattttagaaagcagtttagtgacagaatggcaatcactacaaacacgaaggttcttcatgatgcgaatgggacatccagcttcagtattgatgagaccaaaggcaatagccaacctctcactatggttttccaattctgcttctttctcttcctcctcttcgatatacaacaacacttggcttgtgtcaggaacatgtcctgccaatttcaatttctctctcatctcagccaatttggaataaatttcttttgtttgcggatgtgatttatctcccacaataaagttatgaaccacacctttatgctctattgaactgcagccggaatcttttcttaatcctctcttcttcatcatttctcttacctcagaaactttctcccactcacctgctacagcatacatattggaaaggacaacataaccaccagtagtctctggagccaattcaatcaaatttgtgtttctatggttcctagcaccactaagcaatgtcatccagattactttgtttggtctcatgggcatttcttcaatgatatcttttgcttcttcaagacaaccagctcagcataatatgtccaccaaacaaccataatgttctatagcaggtttaattccatattcatttatcatcatattaaaatatttgtgaccatcgttaatcaatccaacatgactacaagcattaagcacaccaacaaaagttatagcattaggcttcacaccaattcttcgcatttcaagaaatagcttcagagcatggtcagccatgccatgaatactcaaacctacaattatagcagtccaatgccccaactttttgtggcttattgtccgaaaaacagttaccgcactatcaatgcctccgcacttggaatacatttcgatcagcactgtccca

SEQ ID NO: 4202 - DNA, 1883 bp, Gossypium raimondii
tttatatatatttaaattgaataattttatttattttaaccttttaaaagatatttttattattcactaatagctgcttatatctatacggatgatacaagagatactagaacatgagaaatattagcagagttaagtggctatatatatggctttagcttcaccaccaaaaacatcaagaagatttttccaaatccacgcggcataaaatcaacctatacaactctccaaaaaatccaattgcaaatccacaccaatgcagcaaccaatagactgctgctgacatgtacatttcctgatccacaacatcttctcatttccattataaccccttctctccaaaccaaaatagactacaataaccatcggcaaacaaaccaagtcaacctaaagccttaggaaccatggcaacctctgctatccaacaatctgcttttgttggccagaccgctttgaagcagtccaatgagctcttacgcaaagtcggagctttcaatggtggtcgtgttaccatgcgcagaactgtgaaaagtgcccctaccagcatctggtatggccctgaccgcccaaagtacttgggtccattctcagaccaaatcccatcatacctgacaggtgaattccctggtgactatgggtgggacactgctgggttatcagctgaccctgagacatttgctaagaaccgtgagcttgaagtgatccactgcagatgggcaatgcttggtgcccttggttgtgtcttccctgaaattctttcaaagaatggagttaagttcggagaggcagtttggttcaaagctggatctcaaatattctccgagggtggccttgactatcttggcaacccaaaccttatccatgctcagagcattcttgcaatctgggcttgccaagttgtgctcatgggatttgttgaaggatacagagttggtgggggaccacttggtgaaggactggacccaatttacccaggtggtgctttcgacccacttggactggctgatgatcctgatgcgttcgcagaattgaaggttaaggagatcaagaatggccgccttgcaatgttctccatgtttggattctttgtccaggctattgtcacaggaaagggtcccattgagaacctctttgaccaccttgccgatccggtggccaacaatgcatgggcttatgccactaactttgtccccggaaaatgaacttagattataatacgtctctgaaagctgtaacattaattgctatgtagcatctgttgctgtgtactgatgtaattcactgctagtcttttgagctgttgtatcattaaatccatatcctttttccctgaaatagcacctttcttgaaatgagatgagatcataaatcaaatgttttattttgtagtaagaggctgcttcagtttgttgatataaataaagcgcaagaaacatatctagccatttctataagacacgcaacaggtgatgacaaaacacagcctgaagaccttaaagttatcatgagggtcttccctttcagttccgttgaaagatggcaataataccagccaacatctgagattttagaaagcagtttagtgatggaatggcaatcactacaaacacgaaggttcttcatgatgcgaatgggacatccagcttcagtattgttgagaccaaaggcaatagccaacctctcactatggttttccaattctgcttctttctcttcctcctcttcgatatacaacaacacttggcttgtgtcaggaacatgtcctgccaatttcaacttctctctcatctcagccaatttggaataaatttcttttgtttgcggatgtgatttatctcccacaataaagttatgaaccacccctttatgctctattgaactgc

SEQ ID NO: 4203 - DNA, 1043 bp, Actinidia deliciosa
attcattgcaaaggctgcttcttcacaccattctacaacaacccattgagaaaaaacatcagcaccaaagaagctccacagagtaatggcaacctctgccatccaacacgcagcctttgccggccagacggctttgaatcgccagaatgagttcttcaggaaggttggacccatcggtggtacgcgtttcaccatgagacgcaccgtgaaaagtactcctcaaagcatatggtatgggccggaccgcccaaagtacttgggcccattctctgagcaaactccatcatacttgacaggtgaattccccggtgactatgggtgggacactgctgggctatcagcagaccccgagacgtttgccaagaaccgtgagctcgaagtgatccactgccgttgggccatgctcggtgcactgggctgtgtgttccccgaaatcctttccaagaacggtgtcaagttcggcgaggcagtttggttcaaggccggatcccaaatattctccgaaggtggccttgattacctcggcaaccctaatctcgtccacgcccagagcatcctcgcgatctgggcttgccaagtggtgctcatgggcttcgtcgagggataccggattggcggaggcccacttggtgaagggctcgacaagatctaccctggaggagcctttgacccacttggactggctgatgacccagaggcatttgcagagttgaaggtgaaggagatcaagaacggccggctagcaatgttttcgatgttcggattcttcgtccaggccatcgttactggaaagggtccaattgagaacctttctgaccaccttgctgatcctgtggccaacaatgcatgggcttatgccactaacttcgtacccggaaaatgaagagtgagctgaaacattactaaagcttcttggtgtgattgactttttctgcctgtggatggaatcagtaatgatgtaatattacttgcagagactgcttatctaagatctatattgtcacttgagttttcagctcttattgtcactataaaaaaaaaaa

SEQ ID NO: 4204 - DNA, 1041 bp, Nicotiana benthamiana
gcaatgtaatatagagcaagtcttctcatagttttctaactaagcatcagcacaaataagattaaaaatcttacaaatggctacttctgcaattcaacaatctgcatttgctggacagacagctcttaagtcacagaatgagctcgttaggaagattggtagctttaatggtggacgtgccactatgcgacgtaccgttaaaagtgccccacaaagcatttggtatggagaagatagaccaaagtacttgggaccattctcagagcaaactccatcttacttgactggtgagtttccgggtgattatgggtgggataccgcgggactttcagctgacccagaaacattcgccaggaaccgtgagcttgaggtgatccattgccgttgggccatgcttggtgctttgggttgtgtcttccctgaaatcctttccaagaatggtgttaaatttggtgaggcagtttggttcaaggctggatcccaaatcttctcagaaggcggtcttgactaccttggtaacccaaaccttattcatgcacaaagcattcttgctatttgggcatcccaagttgtgctcatgggcttaattgaaggatacagagttggcggaggcccactgggtgaaggtcttgacaagatctatccgggaggagcttttgacccactagggctcgctgatgatcccgaggcattcgctgagttgaaggtgaaggaaatcaagaacggccgattggctatgttctcaatgtttggatttttcgttcaagccattgtcacaggaaagggaccaattgaaaacctttacgatcatattgctgaccctgttgccaacaacgcatgggcttttgccactaactttgtacccggaaaatgaaatgaatagcctgtaatatgtaaaatttgtggagctagttgtttcatattcttgatgtgatatgaacttgctaatatatatgcaaaagccaatattacatattcttcaattcagtatctctattaaaaaataatcattagaagtttcctctgatgtcaacatgaaaa

SEQ ID NO: 4205 - DNA, 1064 bp, Nicotiana benthamiana
  misc_feature (12)..(12): n is a, c, g, or t
  misc_feature (21)..(21): n is a, c, g, or t
  misc_feature (40)..(40): n is a, c, g, or t
ggccgctcttanactagtggnatcccccgggcctgcaggnaattcggcacgagggttttctaactaagcatcagcacaaataagattaaaaatcttacaaatggctacttctgcaattcaacaatctgcatttgctggacagacagctcttaagtcacagaatgagctcgttaggaagattggtagctttaatggtggacgtgccactatgcgacgtaccgttaaaagtgccccacaaagcatttggtatggagaagatagaccaaagtacttgggaccattctcagagcaaactccatcttacttgactggtgagtttccgggtgattatgggtgggataccgcgggactttcagctgacccagaaacattcgccaggaaccgtgagcttgaggtgatccattgccgttgggccatgcttggtgctttgggttgtgtcttccctgaaatcctttccaagaatggtgttaaatttggtgaggcagtttggttcaaggctggatcccaaatcttctcagaaggcggtcttgactaccttggtaacccaaaccttattcatgcacaaagcattcttgctatttgggcatcccaagttgtgctcatgggcttaattgaaggatacagagttggcggaggcccactgggtgaaggtcttgacaagatctatccgggaggagcttttgacccactagggctcgctgatgatcccgaggcattcgctgagttgaaggtgaaggaaatcaagaacggccgattggctatgttctcaatgtttggatttttcgttcaagccattgtcacaggaaagggaccaattgaaaacctttacgatcatattgctgaccctgttgccaacaacgcatgggcttttgccactaactttgtacccggaaaatgaaatgaatagcctgtaatatgtaaaatttgtggagctagttgtttcatattcttgatgtgatatgaacttgctaatatatatgcaaaagcccaatattacatattcttcaattcagtatctctattaaaaaataatcattagaagttttcccctgatgtcaacatga

SEQ ID NO: 4206 - DNA, 1090 bp, Olea europaea
ccgtcggggtatcccaacaaagcagaaagcaaatcaccgcaacaaagaaagaaactcacgagcaaaaacatggcaacttcagcaatccaacaatctgcatttgcaggccagacagccttgaagtcccagaatcagctcatcagaaaggttggcaacctcggaggtggccgcttcaccatgagacgtactgttaaaagtgctccccagagcatttggtacggacctgaccgccccaagtacttgggtccattctctgagcaaactccatcatacctcactggtgaattcccaggtgattatggttgggacacagctggactatcagcagaccctgagacatttgccaagaaccgtgagcttgaggttatccactgccgttgggccatgctcggcgcattgggctgtgttttcccagaaatccttgccaagaatggtgtcaagtttggtgaggctgtttggttcaaggctggagctcagatcttctcagaaggtggccttgactaccttggcaacccaaatctcatccatgcccaaagcatccttgctatctgggcttgtcaagttgtgctcatgggatttgttgaaggatacagagttggtgggggcccacttggtgaggggctcgacaaaatctaccctggaggagccttcgacccacttgggttggcagatgatcctgaagcatttgccgaattgaaggtaaaagaaatcaagaatggacgactggctatgttctcaatgtttggattcttcgtccaggccattgttactggaaagggcccaatagagaacctctttgaccacatcgcagatccagttgccaacaatgcatgggcatatgccacaaactttgtacctgggaaatgaattacattagtgtatacatctcatgcataacaataccaaaatgttttgtctatctcgatgaagttctgtggctcgtctggcattgagcagaattgatgtaatgtttcatgcagacacgaatttatctcttaactaccatggttgcagcgctttttactacaccaccaccccccacacaccactatattctgtctctcacactctgaagtagtagaacaacata

SEQ ID NO: 4207 - DNA, 861 bp, Petunia hybrida
tggtttaagtttcaacatatatagcatcatcagtacataaaagatatatattaaaggggttagatggcaacttctgcaattcaacaatcagcatttgctggacaaacagctcttaagtcacagaatgagcttgttaggaagattggtagctttggtggtggccgtgccaccatgagacgtactgttaaaagtgccccacaaagcatttggtatggagaagataggccaaagtacttgggaccattctctgagcaaactccatcatacttgactggcgagttccctggtgactatggatgggatactgctggactctcagccgaccctgaaacatttgccaggaaccgtgagcttgaggtgatccattgccgttgggcaatgcttggtgctttgggatgtgttttccctgaaatcctttccaagaatggtgttacattcggtgaggcagtttggttcaaggctggatctcaaattttctcagaaggtggtcttgactaccttggcaacccaaaccttatccatgctcagagcattcttgccatttgggcagcccaagttgtgctcatgggctttgttgaaggatacagggttggtggaggtccacttggtgaaggacttgacaagatctacccaggaggtgcctttgaccctcttggtttggctgatgatccagaggcatttgctgaattgaaggtgaaggaaatcaagaatggtcgattggctatgttctcaatgtttggattctttgttcaagccatcgtcacaggaaagggaccaattgagaacctctatgaccacgttgctgaccctgtggccaacaatgcttgggcttttgctactaactttgtacccggaaagtga

SEQ ID NO: 4208 - DNA, 937 bp, Solanum tuberosum
aagaaaaacttcagcaaattaaaaaaaaaaatggccacttctgcaattcaacaatcagcctttgttggtcaagcagttggtaaatctcaaaatgagtttgttaggaaagttggcagcttcggtgaaggccgtattaccatgaggcgtactgttaaaagcgctcctcaaagcatctggtacggagaagaccgtcctaagtacttgggcccattttctgagcaaacaccatcatacttgactggtgaattcccaggtgactacggatgggacacggctggactttctgctgacccagagacatttgctagaaaccgtgagcttgaggtgatccattgccgttgggctatgcttggtgctttgggctgtgttttccccgaaatcctttcgaagaacggtgttaaattcggtgaggctgtttggttcaaggctggatctcagattttctcagaaggtgggcttgactaccttggaaacccaaaccttgtccatgcccaaagcattcttgccatttgggcctgccaagttgttcttatgggctttgttgaaggttacagagttggtggaggcccacttggtgagggtcttgacaagatctacccaggaggtgcctttgacccactcggtcttgctgatgatcccgaggcttttgctgaattgaaggtcaaggaaattaagaacggacgtttggctatgttctccatgtttggattctttgttcaagctattgttactggaaagggcccaattgagaacctttctgaccacattaatgacccagtggctaacaacgcttgggcttacgccacaaactttgtacctggaaagtgaagtaattagtagtatgtaatctgtaaaatttgggctaattaatgaagttttatgcttgtgaaaaattggtttgtaccttgatgcactatttaacatgctgatattttaa

SEQ ID NO: 4209 - DNA, 1094 bp, Solanum phureja
gagaaaatctcacccaacagatgtctaaactccacgtggcagaacagaggcctctatatgtcataagggaaatccaaatactaaaccataaccaatcaacaattgcttagttgtacatcttgtaatcctcaaaatccattaatttgcatatatattgccccacatctccttcttcccttcatatcatcagaaaaaaaagcaaaaaagaaaaacttcagcaaattcaaaaaaaaaaaatggccacttctgcaattcaacaatcagcctttgttggtcaagcagttggtaaatctcaaaatgagtttgttaggaaagttggcagcttcggtgaaggccgtattaccatgaggcgtactgttaaaagcgctcctcaaagcatctggtacggagaagaccgtcctaagtacttgggcccattttctgagcaaacaccatcatacttgactggtgaatttccaggtgactacggatgggacactgctggactttccgctgacccagagacgtttgctagaaaccgtgagcttgaggtgatccactgccgttgggctatgcttggtgctttgggctgtgttttccccgaaattctttcaaagaacggtgttaaattcggtgaggctgtttggttcaaggctggatctcagattttctcagaaggtgggcttgactaccttggaaacccaaaccttgtccatgcccaaagcattcttgccatttgggcctgccaagttgttcttatgggctttgttgaaggttacagagttggtggaggcccacttggtgagggtcttgacaagatctacccaggaggtgcctttgacccactcggtcttgctgatgatcccgaggcttttgctgaattgaaggtcaaggaaattaaaaacggacgtttggctatgttctccatgtttggattttttgttcaagctattgttactggaaagggcccaattgagaacctctctgaccacattaatgacccagtggctaacaacgcttgggcttacgccacaaactttgtacctggaaagtgaagtaattagtagaatgtaatctgtaaaatttgggctaattaatgaagttttatgcttgtg

SEQ ID NO: 4210 - DNA, 1000 bp, Nicotiana tabacum
ggccattacggccggggatatcaaactcaacagaaaaagaaaaaaagaagcttctttatctcaccagttaaaaaaatggccacttctgcaattcaacaatctgcatttgttggccagacagtggctaaatcacaaaatgagctagttaggaaaattggcagctttggcggtggccgtgctaccatgagacgtaccgttaaaagtgctcctcaaagcatctggtatggagaagaccgcccaaaatatttgggcccattctctgagcaaactccatcatacctcaccggtgagttcccaggtgactatggttgggacactgctggactctcagctgacccagagacattcgctagaaaccgtgaacttgaggtgatccattgccgttgggccatgcttggtgctttgggttgtgtctttcccgaaatcctttcaaaaaatggtgttaaattcggtgaagctgtttggttcaaggcaggagcccaaatcttctcggaaggtggacttgactacctcggcaacccaaaccttgtccatgcccaaagcatcctcgctatttgggcatgccaagttgtcctaatgggcttgattgaaggatatagggttggtgggggcccacttggtgaaggtcttgacaagatttacccaggaggtgcctttgacccacttggccttgctgatgatcccgaggcttttgctgagctaaaggttaaggaaatcaagaacggacgattggctatgttttcaatgttcggattctttgttcaggctattgttactggaaaaggcccaattgagaacctctttgaccatattaatgacccagtggccaataatgcttgggcttttgccactaactttgtacccggaaagtgaaatgttgtgtgtgtgatctgtaaaaatatgggctaatgaagttttctgtttgtaaaaataactttgtggttactgaactgtccacataatgattcaatttaaacgaaaaacaattatatagtttgcc

SEQ ID NO: 4211 - DNA, 1115 bp, Tripterygium wilfordii
acactaccatggccacctctgcaatccaacaatcggcgttcgcaggccaaactgctctgaagcagccaaatgagttcgttcggagggttggttccttcggaggtggccgcatttcgatgcgccggaccgtcaagagcgctccacagagcatctggtatgggccggaccgtccgaagtacttgggcccattctcggagcaaactccgtcgtacctctccggagaattccccggcgactacggctgggacaccgccggattatccgccgatccagaaacatttgccaagaaccgtgaactcgaggtgatccactccagatgggccatgcttggtgctctgggctgcgtcttccccgaaatcctttcgaagaacggagtcaagtttggagaagcagtttggttcaaggccggggcccagattttctcggaaggtgggctggactaccttggcaacccaaacctgattcacgcccaaagcattcttgcaatatgggcttcccaggttgtgctaatgggctttgttgaagggtacagaattggtggcggcccacttggtgaaggacttgacccactttacccaggtggagcatttgacccattgggcctggctgatgacccagaagcctttgcagaattgaaggtcaaggagttgaagaatggtcggctggcaatgttttccatgtttggattctttgtgcaggctattgtgactgggaagggaccaattgagaatctctttgatcatgttgctgatccagtggccaataatgcttgggcttatgccactaactttgtacccggaaaatgaggatagatggtggtagttaagcacactatcaactctacttttcttgtgaacgtgttattgtacaatccaagtttgtgcttatgttgaaattctacttctgtttttttccccttaagtttgtgatttttgccatattatgctagaacccagtaataacaaaaatgataaagatccaaagtgattattgtccccaaaaacatatgtggcacacatttatttgggtgtgttttctaacgggtattttgttatagatgttaccgcattcaacagaatgttgtgtcacacactgctgagattgttttttgagat

SEQ ID NO: 4212 - DNA, 1042 bp, Juglans hindsii x Juglans regia
gcagcatacaaaccagccaaccaagaagcttgtcatagatcatggcaacctccgccatccaaaggtcagccttcgccggccaaaccgctttgaagcaatccaatgagctggtccgcagggctggtggcatcggtggtggccgtgtcaccatgaggcgcaccgtgaaaagtgccccacagagcatatggtatggcccagaccgccctaagtacttgggtccattctcagagcaaactccatcatacctgaccggtgaattccccggtgactacggctgggacactgctggcttatcggcagaccccgagacgttcgccaagaaccgtgagttggaggtgatccactcccgatgggccatgctcggagctctgggttgtgtcttccctgaagtcctttcaaagaatggtgttaagtttggcgaggcagtatggttcaaggccggtgcccaaatcttctctgagggtggcctcgattaccttggcaacccaaacctggttcatgctcagagcatcctggctatctgggctgttcaggttgtgctcatgggtttcgttgagggctacagaattggtggaggaccactcggcgaaggactcgacccaatctaccccggcggtgcctttgacccacttggactggccgatgatcctgaggcatttgcagagttgaaggtgaaggagctcaagaacggccggctggcaatgttttccatgttcggtttcttcgttcaggctattgtcaccggaaagggcccgattgagaacctctacgaccatgttgctgatccggtggccaacaatgcatgggcttatgccactaactttgtccccggaaaatgagcaaatccaaacagatacatcatgatgtctctgcagttgtaacattactcgaatcttcttaattgcctttgctgatgttgtcttgttgttcctctgtgctgatgtattaataatttaatactactactgccaccggtagaaactgtgtctgcaaattactattgtatcagtacttgaagttaagacgctgatctttgggctgc

SEQ ID NO: 4213 - DNA, 1340 bp, Citrullus lanatus
tattgggccttcaagtctcattagttcgctcggcccattaaaatgagctgatttagtacaatagaaacttgtggctatgtggatgaccccaccaatatcttggatgccacgtggcttaacaataagccataaataatctgcatgaaaatctgggtttaagcagaagaaccaataggatgctgctgacttgtagcaatcctaatccactatatctttccatccccgatataacctccattttcactaccatcatcctcgtctaaaaaccagccttcagccctcctttggcatcgcatcaaacttctaagaaagcttcacacacttatggccacctctgctatccaacagtccgccttcgccggccaggctgccttgaagcaatccaatgagctcgtccgaagggttggcgctgtcggtggcggccgcttcaccatgcgacgaacagtcaagagtgctccacagagcatatggtatggaccagatcgcccaaaatacttgggaccattctctgaacaaacaccatcttacctgactggagagttccccggtgactatggatgggacacagccggtctatcagcagatcccgagacttttgcgaagaaccgtgagcttgaggtgatccactcccgatgggcgatgcttggtgcattaggttgtgtcttccctgaactccttgcaaagaatggtgtccagtttggtgaatcagtttggttcaaggctggttctcagatcttctctgagggtggtctagattaccttggcaacccaaacctcatccatgctcagagtatccttgcaatctgggctgtccaggttgtgctcatgggcttcgttgaaggttaccgggttggtggtggtccccttggtgaaggactggacccaatttacccaggaggcgccttcgacccactcggattggcagatgacccagatgcatttgctgagttgaaggtgaaggaactaaagaatggaaggctggcaatgttctccatgttcggattctttgtccaggctatcgtcacaggaaagggtcctattgagaatctctttgaccatgttgcagatcctgttgccaacaatgcatgggcttacgccaccaacttcgtccccggaaaatgaagaaacctgtaggaaacaactctttgttttaccacacttaagcatctcactcttcctgaaaatctcatattgatgtaatttctctagtagaaacttcctgcagtgaaatctgtatcattaaagttctgtgctttgtgttgctttcacatgaatttcagcatgcatctcggcagatagcgcatactattaacaggttttaaaaatataccaatgattga

SEQ ID NO: 4214 - DNA, 981 bp, Citrullus lanatus
aaacttctaagaaagcttcacacacttatggccacctctgctatccaacagtccgccttcgccggccaggctgccttgaagcaatccaatgagctcgtccgaagggttggcgctgtcggtggcggccgcttcaccatgcgacgaacagtcaagagtgctccacagagcatatggtatggaccagatcgcccaaaatacttgggaccattctctgaacaaacaccatcttacctgactggagagttccccggtgactatggatgggacacagccggtctatcagcagatcccgagacttttgcgaagaaccgtgagcttgaggtgatccactcccgatgggcgatgcttggtgcattaggttgtgtcttccctgaactccttgcaaagaatggtgtccagtttggtgaatcagtttggttcaaggctggttctcagatcttctctgagggtggtctagattaccttggcaacccaaacctcatccatgctcagagtatccttgcaatctgggctgtccaggttgtgctcatgggcttcgttgaaggttaccgggttggtggtggtccccttggtgaaggactggacccaatttacccaggaggcgccttcgacccactcggattggcagatgacccagatgcatttgctgagttgaaggtgaaggaactaaagaatggaaggctggcaatgttctccatgttcggattctttgtccaggctatcgtcacaggaaagggtcctattgagaatctctttgaccatgttgcagatcctgttgccaacaatgcatgggcttacgccaccaacttcgtccccggaaaatgaagaaacctgtaggaaacaactctttgttttaccacacttaagcatctcactcttcctgaaaatctcatattgatgtaatttctctagtagaaacttcctgcagtgaaatctgtatcattaaagttctgtgctttgtgttgctttcacatgaatttc

SEQ ID NO: 4215 - DNA, 1127 bp, Solanum melongena
aggatatcaggaaaaaaaaaaagaagaagaagaagaagaaaaagcttcaggaaatggccacttctgcaattcaacaatccgcatttgttggtcaatcgcaaaatgagtttgtcaggagattcggcaatgtcggcggaggccgtattaccatgaggcgtactgttaaaagcgctcctcaaagcatctggtacggagaagaccgtccaaagtacttagggccattttctgagcaaacaccatcataccttactggtgaattcccaggtgactacggatgggacactgctggactgtcagctgacccagagacatttgccagaaaccgtgagcttgaggtgatccactgccgttgggccatgcttggtgctttgggctgtgttttccccgaaatccttgccaagaacggtgtcaaatttggtgaggcagtttggttcaaggctggatcccagatcttctccgaaggtgggcttgactaccttggaaacccaaaccttgttcacgcccaaagcattcttgccatttgggcttgccaagttgtcctaatgggctttgttgaaggatacagagttggtggaggcccacttggtgagggtcttgacaagatctacccaggaggtgccttcgacccactcggcctggctgatgatcctgatgcttttgctgaattgaaggtcaaggaaattaagaatggacgattggcaatgttctccatgtttggattcttcgttcaggctattgttactggaaagggcccaatcgagaacctctttgatcacattaatgacccagtcgctaacaacgcttgggcttacgccacaaactttgtccccggaaagtgaaataatcatgtgtaaaatttgggctaattaatgaagttttatgcttgtcattcatattcttttacattaaacaaatatcaccgaaaaatatgaaatgagggccaatatcattaacctgcaaataaattcatgttttggtatatacattcatgccataaatttgaaatttaagagtagtgaggtcaaagcattagattgactaccacatgaatcaaaattttcactaattatgtttaaaattagtaaacacatcaagaaacaaagaaaattcaacatatatttcaatcc

SEQ ID NO: 4216 - DNA, 1265 bp, Quercus alba
atggggttcattctgacatggctgaacatgtattatccacattctcatcccaaagaagaaatcagcacgaaaggaaatccacatccaatatgtgaaccaataggatggtgctgatgtgtagtgtagataatccacaacatcttctcattcccttaattataacataacattaacatctctcgatcccctgacccttttcaacatatatacacacaaaaaacacatagaagaagcttagcgtactaaaccatggcaacttccaccatccaacgatctgcatttgccggccacacccacaccgctttgaagcagtccaatgacttcatccgtaaggttggcagctttggcggtggccgtgttaccatgaggcgcacagtaaagagtgctccacaaagcatttggtatggcccagaccgcccaaagtacttgggaccattctctgagcagactccctcataccttactggtgaattccctggtgactatggctgggacactgctggattatccgcagaccctgagacatttgctaggaaccgtgagctggaggtaatccacagccgatgggccatgcttggagctttgggctgtgtgttccctgaagtcctttcaaagaatggtgtcaagtttggtgaagcagtttggttcaaggctggtgcacagattttctctgaaggtggtcttgattatcttggcaacccaaacctcattcatgcacaaagcatcttggcaatctgggctgttcaagttgtgcttatgggcttcattgaaggatacagagttggtggaggaccactcggtgaaggacttgaccccatttaccctggtggcgcctttgacccacttggactggctgatgatcctgaagcattcgcagaattgaaggtgaaggaactaaagaatgggaggttggcaatgttctccatgtttggtttctttgttcaggctattgttactggaaagggtccaattgagaacctgtttgaccatgttgctgacccagtcgccaacaatgcatgggcctacgccactaactttgtccctggaaaatgaagaaacttaaatgttctactgtaactttactcatcaatcttcttgcttgtgttcaacttctctcttgctgtgttcatctatattgtatcgatgctaccacaaactgcttttcttcaaactatatattattgtatcacttctaaagtacaagacatttggtcttttgtgcttgaacttacattaatgttggtagatatgtgtgttataatttg

SEQ ID NO: 4217 - DNA, 975 bp, Quercus alba
acacacaaaaaacacatagaagaagcttagcgtactaaaccatggcaacttccaccatccaacgatctgcatttgccggccacacccacaccgctttgaagcagtccaatgacttcatccgtaaggttggcagctttggcggtggccgtgttaccatgaggcgcacagtaaagagtgctccacaaagcatttggtatggcccagaccgcccaaagtacttgggaccattctctgagcagactccctcataccttactggtgaattccctggtgactatggctgggacactgctggattatccgcagaccctgagacatttgctaggaaccgtgagttggaggtaatccacagccgatgggccatgcttggagctttgggctgtgtgttccctgaagtcctttcaaagaatggtgtcaagtttggtgaagcagtttggttcaaggctggtgcacagattttctctgaaggtggtcttgattatcttggcaacccaaacctcattcatgcacaaagcatcttggcaatctgggctgttcaagttgtgcttatgggcttcattgaaggatacagagttggtggaggaccactcggtgaaggacttgaccccatttaccctggtggcgcctttgacccgcttggactggctgatgatcctgaagcattcgcagaattgaaggtgaaggaactaaagaatgggaggttggcaatgttctccatgtttggtttctttgttcaggctattgttactggaaagggtccaattgagaacctgtttgaccatgttgctgacccagtcgccaacaatgcatgggcctacgccactaactttgtccctggaaaatgaagaaactctgttgtaatttgactccttaatcttcttgtttgtgatctactttttattgttcatcagtttaaattaagcggattctattttataaaaccctcaatcgaagggtaaaacattgacacttgaa

SEQ ID NO: 4218 - DNA, 1101 bp, Quercus alba
atgggaacgcggagtacatggggaccccttttcaacatatatacacacaaaaaacacatagaagaagcttagcgtactaaaccatggcaacttccaccatccaacgatctgcatttgccggccacacccacaccgctttgaagcagtccaatgacttcatccgtaaggttggcagctttggcggtggccgtgttaccatgaggcgcacagtaaagagtgctccacaaagcatttggtatggcccagaccgcccaaagtacttgggaccattctctgagcagactccctcataccttactggtgaattccctggtgactatggctgggacactgctggattatccgcagaccctgagacatttgctaggaaccgtgagctggaggtaatccacagccgatgggccatgcttggagctttgggctgtgtgttccctgaagtcctttcaaagaatggtgtcaagtttggtgaagcagtttggttcaaggctggtgcacagattttctctgaaggtggtcttgattatcttggcaacccaaacctcattcatgcacaaagcatcttggcaatctgggctgttcaagttgtgcttatgggcttcattgaaggatacagagttggtggaggaccactcggtgaaggacttgaccccatttaccctggtggcgcctttgacccacttggactggctgatgatcctgaagcattcgcagaattgaaggtgaaggaactaaagaatgggaggttggcaatgttctccatgtttggtttctttgttcaggctattgttactggaaagggtccaattgagaacctgtttgaccatgttgctgacccagtcgccaacaatgcatgggcctacgccactaactttgtccctggaaaatgaagaaacttaaatgttctactgtaactttactcatcaatcttcttgcttgtgttcaacttctctcttgctgtgttcatctatattgtatcgatgctaccacaaactgcttttcttcaaactatatattattgtatcacttctaaagtacaagacatttggtcttttgtgcttgaacttacattaatgttggtagatatgtgtgttataatttgaa

SEQ ID NO: 4219 - DNA, 1081 bp, Quercus alba
aacattaacatctctcgatcccctgacccttttcaacatatatacacacaaaaaacacatagaagaagcttagcgtactaaaccatggcaacttccaccatccaacgatctgcatttgccggccacacccacaccgctttgaagcagtccaatgacttcatccgtaaggttggcagctttggcggtggccgtgttaccatgaggcgcacagtaaagagtgctccacaaagcatttggtatggcccagaccgcccaaagtacttgggaccattctctgagcagactccctcataccttactggtgaattccctggtgactatggctgggacactgctggattatccgcagaccctgagacatttgctaggaaccgtgagttggaggtaatccacagccgatgggccatgcttggagctttgggctgtgtgttccctgaagtcctttcaaagaatggtgtcaagtttggtgaagcagtttggttcaaggctggtgcacagattttctctgaaggtggtcttgattatcttggcaacccaaacctcattcatgcacaaagcatcttggcaatctgggctgttcaagttgtgcttatgggcttcattgaaggatacagagttggtggaggaccactcggtgaaggacttgacccccatttaccctggtggcgcctttgacccacttggactggctgatgatcctgaagcattcgcagaattgaaggtgaaggaactaaagaatgggaggttggcaatgttctccatgtttggtttctttgttcaggctattgttactggaaagggtccaattgagaacctgtttgaccatgttgctgacccagtcgccaacaatgcatgggcctacgccactaactttgtccctggaaaatgaagaaacttaaatgttctactgtaactttactcatcaatcttcatgcttgtgttcaacttctctcttgctgtgttcatctatattgtatcgatgctaccacaaactgcttttcttcaaactatatattattgtatcacttctaaagtacaagacatttggtcttttgtgcttgaacttacattaatgttggta

SEQ ID NO: 4220 - DNA, 1442 bp, Ambrosia trifida
atccaatactaacacaacccacaatggcaacctctgcaatccaacagtcagcgttcgcaggccaggcggcattgaagccacaaaacgagcttgtccgcaagaccggcagtgtcaatggtggccgcttcactatgcgccgcacagtcaaaagtgcaccacaaagcatttggtacgggccggaccgccccaagtacttgggcccgttctctgagcaaaccccatcatacttgaccggtgaattccctggtgactacggttgggacaccgctggattatctgctgaccccgagacttttgccaagaaccgtgagctcgaggtgatccactctcgatgggccatgctcggtgcacttggatgcgtgttccccgagattcttgcaaagaacggtgtcaaattcggtgaagcagtctggttcaaggcgggatcccagattttctcggaaggtggcctagactaccttgggaacccgaacttgatccatgcccagagcattttagccatctgggcatcacaggttgttctcatgggactcatcgaaggataccgtgtcggtggtggcccgcttggtgaagggctcgacaagatttacccgggagggtcatttgacccgcttggattggctgatgatccagatgcatttgctgagttgaaggttaaggagctcaagaatggacgcttggctatgttttccatgttcggatttttcgttcaggccattgtaacaggaaaaggcccaatcgagaacttgtatgaccatcttagtgacccggtagctaacaacgcatgggcttacgctaccaactttgtacctggaaaatgagttcaattagtgtagatttgacgaccgttatgcaatattacaactaaaagcgagctttcgcttttaaagctaaaaaagaaaaatagtatatcataaaacattggggggcccaatcacatgttcgatgcagtagcagcatctaataataataataataataactaacaaccattaaattcctttagtctgttttcactttatgttgaaaaacagaccacctcacactattacctacatcattaaagatcaagtagtagtacataatatgtatgtattcattcatacattgtgtaaatattcatgaactctaggggcattttggtccaccttgctgtgtcttccagttgttgtagcatggacacacttgcttgttgccataaaagcctggaggaacacacaagcattttgcacaacacttttggcagaagaacatgcatggcttgtggtattgtgttttgctgcatcttcttgtgcattgtccagggcactgggagcttgtcaagcttcctggaccaaatccgccacggtgtcctccactagcagaaacattcgcttgaaacatggaaatggcaatgagggctaacacgaagagggcgaagaacttggccatggctgttggag

SEQ ID NO: 4221 - DNA, 850 bp, Artemisia annua
acaacattatctttacttcacaaccctcttaaccaaatggcaacttcagcaatccaacaagcagcatttgctggtcagtcggctatgaagccgcaaaacgagctcgtaaggaagattggtggcttcaatggtggacgctacactatgcgcagaactgttaaaagtgctccacagagcatttggtacggaccagaccgccccaagtacttgggcccattctcagagcaaaccccatcatacttgactggtgaattccctggtgactacgggtgggacactgctggactatcagctgaccccgagacattcgccaagaaccgtgagcttgaggtgatccactctaggtgggccatgcttggtgcactcgggtgcgtattccctgaggtgctttcaaagaatggtgttaaattcggtgaagccgtttggttcaaggcaggatcacaaattttctctgaaggtgggctcgactacctcggaaaccccaacttgatccatgcccagagcattttagccatctgggcatcacaagttgtgcttatgggcctcattgaaggttaccgtgttggtggaggccccctcggtgaagggcttgacagcatttacccaggagggtcttttgacccacttggattggctgatgatccagaagcatttgctgagttgaaggtaaaggagctaaagaatggtcgattggcgatgttttccatgtttgggttctttgttcaggctatcgtaacaggaaagggtccaatcgagaacttatttgaccatcttgctgacccagcagctaacaatgcatgggcttatgccaccaactttgtacctggaaaatgagtttagtatatgtaaa

SEQ ID NO: 4222 - DNA, 986 bp, Artemisia annua
tactccgacggggaccctcttacaaactaccatctcttcaacagttcctttactccccttataaaaatggcaacctctgcaatccaacagtcagcattcgtcggtgagtcagcagtgaagccacaaaacgagcttgtcaggaagattggtagcttcaatggcggccgcttcaccatgcgccgcacagtcaaaagcgcaccacaaagcatttggtacggacctgaccgccccaagtacttgggcccattctctgagcagaccccatcatacttgaccggtgaattcccaggtgactacgggtgggacactgctggactatcagctgaccctgagacattcgccaagaatcgtgagcttgaagtgatccactcacggtgggccatgctcggtgcacttgggtgtgttttccccgagcttctttcaaagaatggtgtcaaattcggtgaagccgtctggttcaaggcaggatcccaaattttctcagaaggtgggctcgactacctcgggaaccccaacttgatccatgcccaaagcattttagccatttgggcttcacaagtagtccttatgggactcattgaaggctaccgtgttggtgggggtccacttggtgaagggcttgacagcatttacccaggagggtcttttgacccacttggtttggctgatgatccagaggcatttgctgaactgaaggttaaggagcttaaaaacggtcgattggcgatgttttccatgttcgggttctttgttcaggccatcgtaacaggaaagggcccaatcgagaacttgtttgaccatctcagtgatccagtagctaacaatgcttgggcttatgctaccaactttgtacctggaaaataagctaaatatatgtaaattcgatgattgttatgcaattttacaaggcagaggtggtgttgtcaaaaaaatgtatgtatgtttgtatgtatgcgtgtaagctttatatgtagagatcttccaca

SEQ ID NO: 4223 - DNA, 1074 bp, Cleome gynandra
cattgcttctaccgttaagattctcgtgtttgcgtttgcgatccgacgctactaaaatggccgccacatctgcgattcagaaaaccgcgtttgccggccaaacggcccttaaacagccaaacgagctcgtccgcaaggttggcgtttacggtggcggccgcgttaccatgcgccgtaccgtcaagagtgctcctcaaagcatctggtacggaccggatcgtcccaagtacttaggaccattctccgagaacactccatcgtacctaactggagagtaccccggagactacggttgggatacggctgggctatcggcggatcccgagacattcgcaaagaatcgtgagctcgaagtaatccactgcagatgggcaatgctcggcgccttaggctgcctcttcccggagattctctccaagaacggagtgaaattcggagaagccgtgtggttcaaggcaggttcacagattttctcagaaggggggcttgattacttgggaaaccctaacctaatccacgcacaaagcattttagccatatgggcatgccaagtggtgctcatggggttcgttgaaggctaccgtgtaggcggtggccctctgggtgaaggactcgacccgatttacccgggaggagccttcgaccccttaaatttggcagaagatcctgaagcatttgcggaattgaaagtgaaagagataaagaatggtcgacttgctatgttttcaatgtttggattctttgttcaagccattgttacagggaaaggaccagtggagaacttgttcgatcatgttgcggatcctgtcgcgaacaatgcttgggcttatgctactaacttcgtacccggaaagtgaaaatgaactcgcacttgatgtgtttgtgtcatgaagtgttgattatggtttcaagtcattgttgtactttgttatattataatatatgattccgagttatggactttcctttcttttacctcttttggtgttacaaatcttaatattttatggttctaacttctaatggtgtttagccttttaaatgttgaaatagagttagagtcaataaactaag

SEQ ID NO: 4224 - DNA, 1099 bp, Gossypium hirsutum
agactacaataaccatcggcaaacaaaccaagtcaacctaaagccttaggcaccatggcaacctctgctatccaacaatctgctttcgttggccagaccgctttgaagcagtccaatgagctcttacgcaaagtcggagctttcgatggtggtcgtgttaccatgcgcagaactgtgaaaagtgcccctaccagcatctggtatggccctgaccgcccaaagtacttgggtccattctcagaccaaatcccatcatacctgacaggtgaattccctggtgactatgggtgggacactgctgggttatcagctgacccagagacatttgctaagaaccgtgagcttgaagtgatccactgcagatgggcaatgcttggtgcccttggttgtgtcttccctgaaattctttcaaagaatggagttaagttcggagaggcagtttggttcaaagctggatctcaaatattctccgagggtggccttgactatcttggcaacccaaaccttatccatgctcagagcattcttgcaatctgggcttgccaagttgtgctcatgggatttgttgaaggatacagagttggagggggaccacttggtgaaggactggacccaatttacccaggtggtgctttcgacccacttggactggctgatgatcctgatgcgttcgcagaattgaaggttaaggagatcaagaatggccgccttgcaatgttctccatgtttggattctttgtccaggctattgtcacaggaaagggtcccattgagaacctccttgaccaccttgccgatccggtggccaacaacgcatgggcttatgccactaactttgtccccggaaaatgaacttagattatagatatgtctctgaaagctgtaacattaactgctatgtagcatctgttgctgtgtactgatgtaattcactgctagtcttttgagctgttgtatcattaaatccatatcctttttccctgaaatagcacctttcttgaaatgagatgagatcataaagcaaatgttttattttgtagtaagaggctggttcagttagttgatataaataaagcgcaagaaacatatctagccattt

SEQ ID NO: 4225 - DNA, 978 bp, Gossypium hirsutum
gtcaacctaaagccttaggaaccatggcaacctctgctatccaacaatctgcttttgttggccagaccgctttgaagcagtccaatgagctcttacgcaaagtcggagctttcaatggtggtcgtgttaccatgcgcagaactgtgaaaagtgcccctaccagcatctggtatggccctgaccgcccaaagtacttgggtccattctcagaccaaatcccatcatacctgacaggtgaattccctggtaactatgggtgggacactgctgggttatcagctgaccctgagacatttgctaagaaccgtgagcttgaagtgatccactgcagatgggcaatgcttggtgcccttggttgtgtcttccctgaaattctttcaaagaatggagttaagttcggagaggcagtttggttcaaagctggatctcaaatattctccgagggcggccttgactatcttggcaacccaaaccttatccatgctcagagcattcttgcaatctgggcttgccaagttgtgctcatgggatttgttgaaggatacagagttggtgggggaccacttggtgaaggactggacccaatttacccaggtggtgctttcgacccacttggactggctgatgatcctgatgcgtttgcagaattgaaggttaaggagatcaagaatggccgccttgcaatgttctccatgtttggattctttgtccaggctattgtcacaggaaagggtcccattgagaacctctttgaccaccttgccgatccggtggccaacaatgcatgggcttatgccactaactttgtccccggaaaatgaacttagattatagatacgtctctgaaagctgtaacattaattgctatgtagcatctgttgctgtgtactgatgtaattcactgctagtcttttgagctgttgtatcattaaatccatatcctttttccctgaaatagcaactttcttgaaatgagat

SEQ ID NO: 4226 - DNA, 1020 bp, Euonymus alatus
ctaaagcaaagtctgattctatcatggcaacctctgcgatccaacaatccgctttcgccggccaaactgccttgaagcagccaaatgagttcgttaggagggttggttccttcggaggcggccgcatttcgatgcgccggaccgtcaagagcgctccacagagcatctggtatgggccggaccgtccgaagtacttgggtccattctcggagcaaactccttcgtacctcaccggagaattccccggcgactatgggtgggacactgccggattatctgccgatccagaaacatttgccaagaaccgtgaactggaagtgattcacagcagatgggccatgcttggtgctctgggctgcgtcttccccgaaatcctttcaaagaacggcgtaaagttcggcgaggcagtctggttcaaggctggagcccaaatcttctccgaaggtgggcttgactaccttggcaacccaaacctcattcacgcccaaagcattctcgctatctgggcttcccaggttgtgttaatgggatttgttgaagggtacagaattggtggcggcccacttggtgaaggactggatccgctttacccaggtggagcatttgacccattaggccttgcggatgatccagaagcctttgcggaattgaaagttaaggagctcaagaatggacggcttgcaatgttttccatgtttggattctttgttcaggctatcgtgaccgggaagggaccgattgagaacctttccgatcatattgcagatccggtggccaataacgcttgggcttatgccaccaactttgtccccggaaaatgaagatactcatcagctgctattattatatgaagtttaatgttctagtgaacattaattagtgtacaatcttagtttgtgctttgtgtttaagatcagcgctgttcgttacatcattaactttctaatgctggcataaactgcttatctagcaactgttttttttgggtgagtatgaatgacattatacaagctttctctt

SEQ ID NO: 4227 - DNA, 1051 bp, Euonymus alatus
cggccggggacagtccaccaactaaagcaaagtctgagtctatcatggcaacctctgcgatccaacaatccgcattcgccggccaaactgccttgaagcagccaaatgagttcgttaggagggttggttccttcggaggcggccgcatttcgatgcgccggaccgtcaagagcgctccacagagcatctggtatgggccggaccgtccgaagtacttgggtccattctcggagcaaactccttcgtacctcaccggagaattccccggcgactatgggtgggacactgccggattatctgccgatccagaaacatttgccaagaaccgtgaactggaagtgattcacagcagatgggccatgcttggtgctctgggctgcgtcttccccgaaatcctttcaaagaacggcgtaaagttcggcgaggcagtctggttcaaggccggagcccaaatcttctcagaaggtgggcttgactaccttggcaacccaaacctcattcacgcccaaagcattctcgcgatctgggcttcccaggttgtattaatgggctttgttgaagggtacagaattggtggcggcccacttggtgaaggactggacccgctttacccaggtggagcatttgacccattaggccttgcggatgatccagaagcctttgcggaattgaaggttaaggagctcaagaatggacggcttgcaatgttttccatgtttggattctttgttcaggctatcgtgaccgggaagggaccgattgagaatctttccgatcatattgcagatccggtggccaataacgcttgggcttatgccaccaactttgtccccggaaaatgaagatactcatcagctgctattattatatgaagttgaatgttctagtgaacattaattagtgtacaatcttagtttgtgctttctgttaaagatcagcgctgttcgttacatatttaactttctaatgctggcgtaaagtgctcatctagcaactgtttttttgggtaagtatgaacgacattatacaagctttctcttagaaaaaaaaa

SEQ ID NO: 4228 - DNA, 976 bp, Fraxinus spp
agaaactcacaagcaaaaaacaatggcaacttcagcaatccaacaatctgcatttgcaggccagacaaccttgaagtcccagaatcagctcatcagaaaggttggcaaccttggaggtggccgcttcaccatgagacgtaccgttaaaagtgctccccagagtatttggtatggaccagaccgcccaaagtacttgggtccattctctgagcaaactccatcatacctgactggtgaattccctggtgactatggttgggacacagctggactatctgcagaccctgagacatttgccaagaaccgtgagcttgaggtgatccactgccgttgggccatgctcggcgcattgggctgcgttttcccagaaatccttgccaagaacggtgtcaagttcggtgaggctgtttggttcaaggctggagctcagatcttctcagaaggtggtcttgactaccttggaaacccaaacctcgtccatgcccaaagtatccttgctatctgggcttgtcaagttgtgcttatgggatttgttgaaggatacagaattggtgggggaccactcggtgaaggactcgacaaaatctaccccggtggagccttcgacccacttggattggcagatgatcctgaggcatttgctgagttgaaggtaaaagaaatcaagaatggacgattggctatgttctcaatgttcgggttctttgtccaggccattgttactggaaagggcccaattgagaacctcgtcgaccatgttgctgacccagttgccaacaatgcatgggcatatgccacgaactttgtacctggaaaatgaaatttcattagtatacacatctcatgcataacaaaactgaaagtttgtctactcgatgaagttctgtagcttctgcggaattgagctgattgatgttatgtttcatgtagacaccaatttacctcttaactctataattacagcactctttttttc

SEQ ID NO: 4229 - DNA, 862 bp, Gossypium raimondii
agactacaataaccatcggcaaacaaaccaagtcaacctaaagccttaggcaccatggcaacctctgctatccaacaatctgctttcgttggccagaccgctttgaagcagtccaatgagctcttacgcaaagtcggagctttcgatggtggtcgtgttaccatgcgcagaactgtgaaaagtgcccctaccagcatctggtatggccctgaccgcccaaagtacttgggtccattctcagaccaaatcccatcatacctgacaggtgaattccctggtgactatgggtgggacactgctgggttatcagctgacccagagacatttgctaagaaccgtgagcttgaagtgatccactgcagatgggcaatgcttggtgcccttggttgtgtcttccctgaaattctttcaaagaatggagttaagttcggagaggcagtttggttcaaagctggatctcaaatattctccgagggtggccttgactatcttggcaacccaaaccttatccatgctcagagcattcttgcaatctgggcttgccaagttgtgctcatgggatttgttgaaggatacagagttggagggggaccacttggtgaaggactggacccaatttacccaggtggtgctttcgacccacttggactggctgatgatcctgatgcgttcgcagaattgaaggttaaggagatcaagaatggccgccttgcaatgttctccatgtttggattctttgtccaggctattgtcacaggaaagggtcccattgagaacctccttgaccaccttgccgatccggtggccaacaacgcatgggcttatgccactaactttgtccccggaaaatgaacttagatta

SEQ ID NO: 4230 - DNA, 1241 bp, Humulus lupulus
acaaacagagcttacagagagtcactaagcttcacatacacggctacaatggccacctctgctattcaacagtcggccttcgccggccagaccgctctcaagcagtccaacgagctcgtcaggaaggtcggcgccagcagtggtggccgtgccactatgaggcgtactgttaaaagtgctccccagagcatctggtatggcccagatcgtcccaagtacttgggacccttctcagaacaaatcccatcatacctgaatggtgaattcccaggtgactatggatgggacacagctggattatcagctgacccggagactttcgccagaaaccgtgagcttgaggtcatccacagtagatgggccatgcttggggcacttggatgtgtcttccctgagcttctgtccaagaatggtgtcaagttcggcgaggcagtatggttcaaggccggctcacagatcttctcagagggtgggctcgactacctcggcaacccaaaccttgtccatgctcagagcatcctagccatctgggctacccaggttgtcctcatgggctttgtggagggctacagagttggcggtggcccacttggagagggcttggacccagtctaccctggtggagcctttgacccactgggcctggctgatgacccagatgcatttgctgagctgaaggtgaaggagctcaagaatggaaggttggctatgttctccatgtttgggttctttgttcaggccattgttactggcaagggcccaattgagaatctcgttgaccatcttgctgacccagtaaccaacaatgcttgggcttatgccacaaactttgtccctggaaagtgagaaaataaatccaacccagataatgtttaattagttatatgctcttttttcttttagttgtaagatttacctaaaaactttttgtgttctggtcgaagcttttttctctgctgctactccatttgtactgatcatttaagttttcactagcagaaagaaactgtttctccttgaataattgttgtatgtatatggtttgttatgtgctcgaaatgattgctggtactaattaaggagtaattaatcaaattaagaagattttgtttcttataatagggacacacaaattatgacttgaccggttcttgtgaagactgcctcagattgttctcaaaatgttctctttgctttcaacagctatacataaacaagttaaaatattatctaatggatga

SEQ ID NO: 4231 - DNA, 1197 bp, Mimulus guttatus
ccaccatcgagcacaacaaacaaaatcaattagcaacaaaaagaaaaaaaaaaacaaaaaaaaaaaatggcaacttcagcaattcaacaatctgcattcagtgggaagactgctttgaagccacaaaatgagctgatcaggaagatcggcaacgtcggcggcggccgcttcaccatgagacgtaccgtcaagagcgcccctcagagcatatggtacggagaagacaggcccaagtacttgggcccattctccgagcagaccccatcgtacctcaccggtgaattccccggtgactacggatgggacactgctgggctctcggcagatcccgagacattcgccaagaaccgtgagctggaggtgatccacagtaggtgggccatgctcggcgctctgggatgcgtcttcccagaggttctatcaaagaacggtgtcaaatttggagaggcagtgtggttcaaggccgggtcacagatcttctccgaaggtgggctcgactatttgggaaaccctaacctcgtccacgcacagagcattttggccatatgggccacccaagttgtgctaatgggctttgttgagggttacagagttggagggggcccactaggagaggggctcgacaaggtgtacccgggcgggtcttttgacccgttgggtctagccgaggacccggaagcctttgctgagttgaaggttaaggaactcaagaacgggagattggctatgttttccatgtttgggttctttgtccaagcgattgtcaccggaaagggtccgattgagaacctttttgaccatcttgccgaccccgttgcaaacaatgcttgggccttcgccactaactttgtgcccggaaaatgagagtgaacacaagatttgcttttgatgaagttgtaaagtgtgggatttaatttgcttttgatgtaatagtggaatggttggactttcaatttaatgtatatttggcatcttttttccttacatcttgttgcacggtttattctatgctacaccgggtagatctttagcatttataagcacacaaacacacacacacatctatattggtgtgtgtagatcaacggtaaaaaatcacccgaaccttcatcaggtgtagcatagaaataacccttgctacactagatggaactgcattctttttgcatgccatactatagtaggaaactaaatctt

SEQ ID NO: 4232 - DNA, 872 bp, Parthenium argentatum
tcacaacacacaatggcaacctctgcaatccaacagtcagcattcgcgggccaggcggcactaaagccacaaaacgagctcgtccggaagacaggcagcgtcaatgggggccgcttcaccatgcgccgcaccgtcaaaagtgcaccacaaagcatttggtatgggccggaccgccccaagtacttgggcccgttctctgagcaaaccccatcatacctaaccggtgaattccctggtgactacggttgggacaccgctggattatctgctgaccccgagacttttgccaagaaccgtgagctcgaggtgatccactctcggtgggccatgctcggcgcactagggtgcgtgttccctgagattcttgcaaagaatggtgtcaaattcggtgaagcagtttggttcaaggcgggatcccagattttttctgaaggtgggcttgactacctcgggaacccgaacttgatccatgcccagagcattttagccatttgggcatcacaggttgttctcatggggctcatcgaaggataccgtgttggtggtggcccgcttggtgaagggctcgataagatttacccaggggggtcatttgacccgcttggattggctgatgatccagaagcatttgctgagttgaaggttaaggagcttaaaaacggacggttggctatgttttccatgttcggatttttcgttcaagccattgtgacaggaaaaggcccgatcgagaacttgtttgaccattttagcgacccagtagctaacaatgcatgggcttacgctaccaactttgtacctggaaaatgagttcaatcagtgtagatttgacgatcgttatccaatattacaagtaaaaagctttcgcgttt

SEQ ID NO: 4233 - DNA, 1049 bp, Lippia dulcis
cacctcacgccgaggtggtcttcttgtaatccacaaaaacatctcgtttcaatatataaacaagcataatcacaccagctccaacatcatcgcacagagtagcagcagcactgcatcatcaagaagtaagcaaagaaaatggcgacttcagctttccaacaatccgcatttgccggtcagacagccttgaagccacagaacgacatcgtcaggaagatcggcaatgtcggcggcagccgcatcgtcatgagacgtaccgtcaagagcgcccccgaaagcatctggtacgggccggacagacccaagtacttgggcccattctccgagcagaccccgtcgtacctcactggagaattccccggcgactatggctgggacaccgccggcctctccgcggaccccgagaccttcgccaagaaccgtgagctcgaggtgatccactgccgctgggccatgctcggcgcattgggctgcgtcttccccgagatcctcgccaggaacggcgtcaagttcggcgaggccgtctggttcaaggccgggtcccaaatcttctctgaaggcgggctcgattacctgggcaacccgaacctgatccatgctcagagcatcttggcaatctgggcctgtcaggttgtgttgatggggttcgtggagggatacagggtcggcggcggccccctcggggagggcctcgacaagatctaccccggcggggctttcgacccattgggcctggccgatgacccggaggcgtttgctgagttgaaggtgaaggagatcaagaatgggagattggcaatgttttccatgtttgggttctttgtgcaggccattgttacggggaaaggcccgattgagaacctgtatgaccacgttgctgatcctgttgccaacaatgcatgggcctatgccacaaactttgtgcctggaaaatgagtgaagtgaatgaacactgatttgtacgtggagttgtgatttggatgtaatgggagtggtatgttgagcggtaaaggtgttgtaattggcaaattgcttgttaatgtaaccaa

SEQ ID NO: 4234 - DNA, 1365 bp, Primula obconica
gggccctcaactcaattacgcaaaatgctccgatgaacattacgaagcttgtttgtgttgtctccatctttccagcagcaacatactttctgcatcattacggccgaaaaagcttctacatacataccatttcacagagctaatcaaaggttattagtacaaaataagctctattgagatggcaacctcggcgatccaacagtcagcatttgccggccagactggattgaaggctcagaatgagcttgtccgaaaagtcgggagcttcggtggtggccgtgccactatgcgcagaactgtcaaaagtacctctcagagcatctggtacggggaggatcgcccaaagtacttgggcccattctccgagcaaaccccatcatacttaacaggcgagttccctggtgactacggatgggacactgctgggctatcagctgacccagagacctttgctaagaaccgcgagcttgaggtgattcactccaggtgggccatgctcggggcattgggttgtgtctttcccgagattctcgctaaaaacggcgtcaaatttggtgaagcgatctggttcaaggccggatcacaaatcttctctgagggagggcttgattaccttgggaaccctaacctcgtccacgctcaaagcatccttgccatctgggccagccaggtcgtcctcatgggcttcgtggaggggtaccgtgttggaggtggcccacttggcgaaggacttgataaggtctaccctggtgggtcattcgacccgttgggcttggccgatgacccagaggcgtttgcagagttgaaggtgaaggagctcaagaacggacgattggctatgttttcaatgtttgggttctttgtgcaggctattgtgacggggaagggaccagtcgagaacctgtatgaccacttggcggatcctgtggccaacaatgcttgggcgtttgccactaactttgtacctggaaagtgaaaattttaatttgtgagagtgatccgtatcgatgtaacattagaagcacaaaaatgttaatgagtgtattttctcaatcatgggcttttctcctccgctgtacttccaactttataccaatgtagagagtatggtttcctctacgttttacttagatgcatatgaagcatctcgaatgtttaaagaaattgctaaatctgagaagcgatgaccacaccatgtgcaaagaaacttggaacatcttacccaactcttttaaaaatttaatttaacacatatgtagagtaaaattatcatgcaccttaggaagaaatattagtctagcaaccaaaaatgatgttttttacgcaaattgtacacatatttcttagtaatcagcgagttccgag

SEQ ID NO: 4235 - DNA, 1098 bp, Primula obconica
caaacttaccatttcagacaacaactaatcaaagggtattagtgcaaaagaagctctattgagatggcaacctcggcgatccaacagtcagcatttgccggccagactggattgaaggctcagaatgagcttgtccgaaaggtcgggagcttcggtggtggccgtgccactatgcgccgaactgtcaaaagtacctctcagagcatctggtacggagaagatcgtccaaagtacttaggcccattctctgagcaaaccccatcatacttaacaggtgagttccctggtgactacggatgggacactgctgggctatcagctgacccagagacctttgctaagaaccgcgagcttgaggtgattcactccaggtgggccatgctcggggctttgggttgtgtctttcccgagcttcttgctaaaaacggcgtcaaattcggcgaagcggtctggttcaaggccgggtcacagatcttctctgagggagggcttgattaccttgggaaccctaaccttgtccacgctcaaagcatcctcgccatctgggcctgccaggtcgtcctcatgggcttcgtggagggttaccgcattgggggtggcccacttggcgaagggctcgataaggtctaccctggtgggtcattcgacccattgggcttggctgatgacccagaggcctttgcagagttgaaggtgaaggagctcaaaaacggacgattggctatgttttcgatgtttgggttttttgtgcaggctattgtgacggggaagggaccagtcgagaacctgtatgaccacttggcggatcctgtggctaacaacgcttgggcctttgccactaactttgtacctggaaagtgaaaatgttaccttatgagagtgatcagtggctgctaatgtaatgttacccgcacaaaattgttaataagattatttttgtaatcatggggttatctccttcttcacttttaattttggccccaccatataatctagggaaaatcctcacttagtacatactctaagagttaatgtcaaaaaaaacggggttaaaatctgtttaccaattaggtacgtactcttatataccaattattt

SEQ ID NO: 4236 - DNA, 999 bp, Primula obconica
atcttatccatgaaactcgtgttattgagattcgtgtcacccattacgccgaaaacaagcttctacatacataccatttcacagagctaatcaaaggctatataagtacaaaataagctctattgagatggcaacctcggcgatccaacagtcagcatttgccggccagactggattgaaggctcagaatgagcttgtccgaaaagtcgggagcttcggtggtggccgtgccactatgcgcagaactgtcaaaagtacctctcagagcatctggtacggggaggatcgcccaaagtacttgggcccgttctccgagcaaaccccttcatacttaacaggcgagttccctggtgactacggatgggacactgctgggctatcagctgacccagagacctttgctaagaaccgcgagcttgaggtgattcactccaggtgggccatgctcggggcattgggttgtgtctttcccgagattctcgctaaaaacggcgtcaaatttggtgaagcgatctggttcaaggccggatcacaaatcttctctgagggagggcttgattaccttgggaaccctaacctcgtccacgctcaaagcatccttgccatctgggccagccaggtcgtcctcatgggcttcgtggaggggtaccgtgttggaggtggcccacttggcgaaggacttgataaggtctaccctggtgggtcattcgacccgttgggcttggccgatgacccagaggcgtttgcagagttgaaggtgaaggagctcaagaacggacgattggctatgttttcaatgtttgggttctttgtgcaggctattgtgacggggaagggaccagtcgagaacctgtatgaccacttggcggatcctgtggccaacaatgcttgggcgtttgccactaactttgtacctggaaagtgaaaagtttaatttgtgagagtgatccgtatcgatgtaacattagaagcacaaaaatgttaatgagtttattttct

SEQ ID NO: 4237 - DNA, 1035 bp, Primula obconica
atacataccatttcacagagctaatcaaaggttattagtacaaaataagctctattgagatggcaacctcggcgatccaacagtcagcatttgccggccagactggattgaaggctcagaatgagcttgtccgaaaagtcgggagcttcggtggtggccgtgccactatgcgcagaactgtcaaaagtacctctcagagcatctggtacggggaggatcgcccaaagtacttgggcccattctccgagcaaaccccatcatacttaacaggcgagttccctggtgactacggatgggacactgctgggctatcagctgacccagagacctttgctaagaaccgcgagcttgaggtgattcactccaggtgggccatgctcggggcattgggttgtgtctttcccgagattctcgctaaaaacggcgtcaaatttggtgaagcgatctggttcaaggccggatcacaaatcttctctgagggagggcttgattaccttgggaaccctaacctcgtccacgctcaaagcatccttgccatctgggccagccaggtcgtcctcatgggcttcgtggaggggtaccgtgttggaggtggcccacttggcgaaggacttgataaggtctaccctggtgggtcattcgacccgttgggcttggccgatgacccagaggcgtttgcagagttgaaggtgaaggagctcaagaacggacgattggctatgttttcaatgtttgggttctttgtgcaggctattgtgacggggaagggaccagtcgagaacctgtatgaccacttggcggatcctgtggccaacaatgcttgggcgtttgccactaactttgtacctggaaagtgaaaagtttaatttgtgagagtgatccgtatcgatgtaacattagaagcacaaaaatgttaatgagtttattttctcaatcatgggcttttctcctccgctgtacttccaactttataccaatgtagagagtatggtttcctctacgttttacttagatgcatatgaagcatctcaaatg

SEQ ID NO: 4238 - DNA, 973 bp, Nicotiana tabacum
ggccattacggccggggatatcaaactcaacagaaaagaaaaaaagaagcttctttagttcaccaattaaaaaaatggccacttctgcaattcaacaatctgcatttgttggccggacagtggctaaatcacaaaatgagcttgttaggaaaattggcagctttggcggaggccgtgctaccatgagacgtactgttaaaagtgctcctcaaagcatctggtatggagaagaccgtccaaagtatttgggcccattctctgagcaaactccatcttaccttactggtgaatttcctggtgactacggatgggacactgctggactctcagctgacccagagacattcgccagaaaccgtgaacttgaggtgatccactgccgttgggccatgcttggtgcattgggttgtgtcttccctgaaattctttcaaagaacggtgttaaattcggtgaagccgtttggttcaaggcaggagcccaaatcttttcagaaggtggactcgactacctcggcaacccaaacctcgtccatgcccagagcatcctcgccatttgggcttgccaagttgtcctaatgggcttgattgaaggatacagggttggtggaggcccacttggtgaaggtcttgacaagatctacccaggaggtgccttcgacccacttggccttgctgatgatcccgaggcttttgctgagttgaaggttaaggaaatcaagaacggacgattggcaatgttttcaatgttcggattctttgttcaggctattgttacaggaaaaggcccaatcgagaacctttacgaccacattaatgacccagtcgccaacaatgcttgggcttttgccaccaactttgtacccggaaagtgaaatgtttagtctgtgttatcttgcttgtaaaagattgggctgtttaacttgctgatgtttatgcagaaaatagtgaatatttcagtggtcttttatcattt

SEQ ID NO: 4239 - DNA, 1196 bp, Nicotiana benthamiana
agaaaatctcaccaacagatgttcgtaaagccacgtggcagaacaaaggcctctatctggtttggaagaatcacaagggaaatcccaaaacaaagcaagaaccaattagcagttgctgaggtgtcatcttgtaatcctaaaaatccattaattttgcataaatagcccccaccttacttcttcccttcatatcaaactcagaagaaaaagaaaaaaagaagcttctttagctcaccaattaaacaaatggccacttctgcaattcaagaatctgcatttgttggccggacagtggctaaatcacaaaatgagcttgttaggaaaattggcagctttggcggaggccgtgctaccatgagacgtactgttaaaagcgctcctcaaagcatctggtatggagaagaccgtccaaaatatttgggcccattctctgagcaaactccatcttaccttactggtgaatttcccggtgattacggatgggatactgctggactctcagctgacccaaagacatttgccaaaaaccgtgaacttgaggtgatccattgccgttgggccatgcttggtgctttgggttgtgtcttccctgaaattctatcaaagaatggtgttaaattcggtgaagctgtttggttcaaggcaggagcccaaatcttttcagaaggtggacttgactacctcggcaacccaaaccttgtccacgcccagagcatccttgccatttgggcttgccaagttgtcctagtgggcttgattgaaggatacagggttggtggaggcccacttggtgaaggtcttgacaagatctatccgggaggtgccttcgacccacttggccttgctgatgatcccgaggcatttgctgagttgaaggttaaggaaatcaagaacggacgattggcaatgttttcaatgttcggattctttgttcaagctattgttaccgggaaaggcccaatcgagaaccttttcgaccacattaatgacccagtagccaacaatgcttgggcttttgctaccaactttgtacccggaaagtgaaatgtttagtgtgtgttatctgtaaaaatttgggctaatgaagttttctgcttgtaaaagattgagctgttccgactatttaacttgctgatgtttatgcagaaaatagtgaatatttcagtgttcttttatcattttgttaagaggtcatt

SEQ ID NO: 4240 - DNA, 3425 bp, Ricinus communis
ctacatcccctgcctttgacacatccctcaggataaacttaaagcaaaaggagttgaaaaactgaaaggcatcataaacatcaccaagtgaagcagccagcagccatggcaacctctgcaatccaacaatctgcatttgctgggcagacagctttgaagccatcaaatgagctcgttcgcaaggtcggatcagttggtggtggccgcatcaccatgcgccggactgtcaagagtgctccccaaagtatttggtatggcccagaccgcccaaagtacttgggaccattctctgagcaaactccatcatacctgacgggtgaattccctggtgactatggttgggatactgctggtctatcagcagatcctgagacatttgccaagaaccgtgagcttgaggtgatccactgcagatgggccatgcttggtgcacttggatgtgtctttcccgaaatccttgcaaagaatggtgtcaagtttggcgaagcagtttggtttaaggctggcgcccaaatcttctctgagggtggccttgactaccttggcaaccccaaccttatccatgctcagagcattcttgcaatctgggcttgccaggttgtgcttatgggatttgttgaaggatacagagttggtggaggaccacttggtgaaggacttgaccccatttaccctggtggtgcctttgaccctctaggactggctgatgatcctgaagcatttgctgagttgaaggtgaaggagatcaagaatggacgcttggcgatgttttccatgtttggattcttcgttcagctattgtcactggaaagggacctattgagaacctcttcgatcatgttgctgacccagtggccaacaatgcatgggcttacgccactaacttcgttcccggaaagtgaaaaggatcagatatatgcctttggttgtaacattactcagtccttgtccttttattgaaatagtcatgttctggagtccatcaatactcatgtactagtagcggaaactgattatgtggaaagtattgtatcactagaatatccaactcctttgtgcttaaccatgtgtttggttggaatgtaccataaatttgatgattttagccaaagcatgcttgcttacaacggtaaaagcagtattctagagatatgcaacagcaattccaatgctgcctgggcagggggaaagagaaagacctggactaaatatgatcaagatcgtaatttggagttccaaggtattcttctctctccctctgcaaacaacacaacataagaaggtaaacaattgacattaactaaatcgttgacaagatagggaagattttctgaagctctatcacatgccaaattgatttaatttttatgttctcaacactaccaaactatatatacatgaatcttacctgtaaactttgcagcttactaaaagataaaatctgagcaattgacacaagcagttgctgatattctccagtgtatcaatggctatgaggacatcctgattgcctgatatttccaatctcagaagcagaaaccaattctccaattccattaagccgcagcagtcaccagaaatccttgcaggaacatattccatttttgaaatgatggaaacggctattatctctcacaataatttcatggttatagattttagatagaagtttagtcacagcatggcaatcactacaaacccgaaggttcttcatgatgcggataggactcccagcatctacattaatgagaccaaaagcaatagccaacctctcactgtggtcttgcaattctgcttccttggcttcctcttcttcaatgcatagcaaaacttggcttgtgtcagggacatgtccctcgagttccagtttctttcccatctctgtcaacttaaaacataactcttctgtttggggatgtgatttatcacccaccacaaactcatgaagcttgcctctatgctctatagaactacatcccgggtcctttctaatccctctcttcttcataatttctctaacctgtgaaaccctgtcccaaagaccactggcagcataaatatttgagagaacaacataacatccaatagtctccggagccaccttaatcaaatgactagctgcatactcaccaatatctgtgtttccatatatcctagaaccactaagtaaactcatccaaataaacttgtttggtgtcatgggcatattctcaatgatgttctttgcctcttcaagacacccagctcgacataaaatatccacaaaacaaccatagtgttcaattgagggttcaattccataatcatataccatcatgtcaaaatacttccggccatcttcaaccaatcctgcatggctacaagcattcaatacacctataaaagttatagcatgaggcctcattccagtcctgcacatttcatgaaaaaattccagagcattgtcagccatgccatgcattcctaagcctacaattatagcagtccaatgtcccaatttcttcttggttatcaactgaaaaacagataaggcgctctcaatgttcccacacttggaatacatatttatcaatgatgtagcaagcacaccatctaattgaaaaccatttttaaccatatacgaatgcatccattttcccgtgctaagactagctaaccctgaaaccgcagaaaaagtactgactaatgtagcatgattaggtgtaaaatctctttccaacatagtcaggaacaaatctaaagcttccttaaacctttcattcaaatcataaccagctaccatcgaattccaggaaatcaaattcttctcaggcatcttatcaaacaattcagacgccaacacgaaatccccagctttcatgtaaccattaatcatagcattccaggataccaaattcctactaggcatcttatcaaataactctctagcaacatctactttcccacatttagagaacccatcaatcaaaacagtccaagaaaataagtctctctcaggcatttcctcaaacaatttcattcccaactcaacctgcccacatttaacatacccatcaattaaagaattccaagaaactaaatctttatcatccattgacaaaaacactttctttgcactgtcaatatctttacactttgaatacatattaaccaaactactcgatacaaacttatttaaaccaaacccaagttttaagaccaacccatgaatctgtttcccttctttagtggcatgtaaccttgcacagcccttaattacacagggcagggtaaaaccatcagggttaaattcatgaagcaattgagaaaagagggtaatagcatcgtgtgataattggttttgaatgtagcatttgataagaatattgtagagaaccaaagcgggttcttggattttattgaagatagataaaacatattcgaga

SEQ ID NO: 4241 - DNA, 3501 bp, Ricinus communis
catagccaatagggaactggtgatgtgtagatttcctaatccacaacatcttctcattttcaatataacccctacactacatcccctgcctttgacacatccctcaggataaacttaaagcaaaaggagttgaaaaactgaaaggcatcataaacatcaccaagtgaagcagccagcagccatggcaacctctgcaatccaacaatctgcatttgctgggcagacagctttgaagccatcaaatgagctcgttcgcaaggtcggatcagttggtggtggccgcatcaccatgcgccggactgtcaagagtgctccccaaagtatttggtatggcccagaccgcccaaagtacttgggaccattctctgagcaaactccatcatacctgacgggtgaattccctggtgactatggttgggatactgctggtctatcagcagatcctgagacatttgccaagaaccgtgagcttgaggtgatccactgcagatgggccatgcttggtgcacttggatgtgtctttcccgaaatccttgcaaagaatggtgtcaagtttggcgaagcagtttggtttaaggctggcgcccaaatcttctctgagggtggccttgactaccttggcaaccccaaccttatccatgctcagagcattcttgcaatctgggcttgccaggttgtgcttatgggatttgttgaaggatacagagttggtggaggaccacttggtgaaggacttgaccccatttaccctggtggtgcctttgaccctctaggactggctgatgatcctgaagcatttgctgagttgaaggtgaaggagatcaagaatggacgcttggcgatgttttccatgtttggattcttcgttcagctattgtcactggaaagggacctattgagaacctcttcgatcatgttgctgacccagtggccaacaatgcatgggcttacgccactaacttcgttcccggaaagtgaaaaggatcagatatatgcctttggttgtaacattactcagtccttgtccttttattgaaatagtcatgttctggagtccatcaatactcatgtactagtagcggaaactgattatgtggaaagtattgtatcactagaatatccaactcctttgtgcttaaccatgtgtttggttggaatgtaccataaatttgatgattttagccaaagcatgcttgcttacaacggtaaaagcagtattctagagatatgcaacagcaattccaatgctgcctgggcagggggaaagagaaagacctggactaaatatgatcaagatcgtaatttggagttccaaggtattcttctctctccctctgcaaacaacacaacataagaaggtaaacaattgacattaactaaatcgttgacaagatagggaagattttctgaagctctatcacatgccaaattgatttaatttttatgttctcaacactaccaaactatatatacatgaatcttacctgtaaactttgcagcttactaaaagataaaatctgagcaattgacacaagcagttgctgatattctccagtgtatcaatggctatgaggacatcctgattgcctgatatttccaatctcagaagcagaaaccaattctccaattccattaagccgcagcagtcaccagaaatccttgcaggaacatattccatttttgaaatgatggaaacggctattatctctcacaataatttcatggttatagattttagatagaagtttagtcacagcatggcaatcactacaaacccgaaggttcttcatgatgcggataggactcccagcatctacattaatgagaccaaaagcaatagccaacctctcactgtggtcttgcaattctgcttccttggcttcctcttcttcaatgcatagcaaaacttggcttgtgtcagggacatgtccctcgagttccagtttctttcccatctctgtcaacttaaaacataactcttctgtttggggatgtgatttatcacccaccacaaactcatgaagcttgcctctatgctctatagaactacatcccgggtcctttctaatccctctcttcttcataatttctctaacctgtgaaaccctgtcccaaagaccactggcagcataaatatttgagagaacaacataacatccaatagtctccggagccaccttaatcaaatgactagctgcatactcaccaatatctgtgtttccatatatcctagaaccactaagtaaactcatccaaataaacttgtttggtgtcatgggcatattctcaatgatgttctttgcctcttcaagacacccagctcgacataaaatatccacaaaacaaccatagtgttcaattgagggttcaattccataatcatataccatcatgtcaaaatacttccggccatcttcaaccaatcctgcatggctacaagcattcaatacacctataaaagttatagcatgaggcctcattccagtcctgcacatttcatgaaaaaattccagagcattgtcagccatgccatgcattcctaagcctacaattatagcagtccaatgtcccaatttcttcttggttatcaactgaaaaacagataaggcgctctcaatgttcccacacttggaatacatatttatcaatgatgtagcaagcacaccatctaattgaaaaccatttttaaccatatacgaatgcatccattttcccgtgctaagactagctaaccctgaaaccgcagaaaaagtactgactaatgtagcatgattaggtgtaaaatctctttccaacatagtcaggaacaaatctaaagcttccttaaacctttcattcaaatcataaccagctaccatcgaattccaggaaatcaaattcttctcaggcatcttatcaaacaattcagacgccaacacgaaatccccagctttcatgtaaccattaatcatagcattccaggataccaaattcctactaggcatcttatcaaataactctctagcaacatctactttcccacatttagagaacccatcaatcaaaacagtccaagaaaataagtctctctcaggcatttcctcaaacaatttcattcccaactcaacctgcccacatttaacatacccatcaattaaagaattccaagaaactaaatctttatcatccattgacaaaaacactttctttgcactgtcaatatctttacactttgaatacatattaaccaaactactcgatacaaacttatttaaaccaaacccaagttttaagaccaacccatgaatctgtttcccttctttagtggcatgtaaccttgcacagcccttaattacacagggcagggtaaaaccatcagggttaaattcatgaagcaattgagaaaagagggtaatagcatcgtgtgataattggttttgaatgtagcatttgataagaatattgtagagaaccaaagcgggttcttggattttattgaagatagataaaacatattcgaga

SEQ ID NO: 4242 - DNA, 903 bp, Flaveria ramosissima
ggatcaacacacccttcacaaacagtcatctcttcagtcttcacagccccaaatggcaacctctgcaatccaacagtcagcattcaccagccagccggcattgaagccgcaaaacgagctcgtcaagaagaccggcggcttcaatggcggccgcttcaccatgcgccgcaccgttaaaagcgcgccacaaagcatttggtatggaccggaccgccccaagtacttgggcccattctctgagcaaaccccgtcatacctaaccggtgaattccctggtgactatggttgggacactgctggattgtcagctgacccagagacatttgccaagaaccgtgagctcgaggtgatccactctaggtgggccatgcttggcgcactggggtgcgtgtttcccgagattcttgaaaagaatggtgtcaaattcggtgaagcggtctggttcaaggcgggttcccaaattttctcagaaggcgggcttgactacctcgggaacccaaacttgatccatgcccagagcattttagctatctgggcttctcaagttgttctcatgggcctcattgaaggataccgggttggtggcggcccacttggtgaagggcttgacaagatttacccaggaggctcatttgacccacttggattggctgatgacccagatgcatttgcggagttgaaggttaaggagcttaagaacggacgattggctatgttttccatgtttgggttttcgttcaagccattgtaaccggaaagggcccgatcgagaacttgtttgaccatcttagtgacccggtggctaacaacgcatgggcgtacgctaccaactttgtgcccggaaaatgagttgtatacctgtaaaccaaaaataatggttatgcaataatattacaagcttgt

SEQ ID NO: 4243 - DNA, 952 bp, Flaveria ramosissima
tcaacacacccttcaacaaacagtcatctcttcagtcttcacagcctcaaatggcaacctctgcaatccaacagtcagcattcaccagccagccggcattgaagccgcaaaacgagctcgccaagaagaccggcggcttcaatggcggccgcttcaccatgcgccgcaccgttaaaagcgcgccacaaagcatttggtatggaccggaccgccccaagtacttgggcccattctctgagcaaaccccatcaatacctaactggtgaattccctggtgactacggttgggacactgctggattgtcagctgaccccgagacatttgccaagaaccgtgagctcgaggtgatccactctaggtgggccatgcttggcgcactcgggtgcgtgttccctgagattcttgaaaagaacggtgtcaaattcggtgaagcggtctggttcaaggcgggttcccaaattttctcagaaggcgggcttgactacctagggaacccaaacttgatccatgcccagagcattttagctatctgggcttctcaagttgttctcatgggcctcattgaaggataccgggttggtggcggcccactaggtgaagggcttgacaagatttacccaggaggctcatttgacccacttggattggctgatgacccagatgcatttgcggaattgaaggttaaggagcttaagaacggacgattggctatgttttccatgtttgggtttttcgttcaagccattgtaaccggaaagggcccgatcgagaacttgtttgaccatcttagtgacccggtggctaacaacgcatgggcgtacgctaccaactttgtgcccggaaaatgagttgtatacctgtaaaccaaaaataatggttatgcaataatattacaagcttgtgtttttgtcaagaaatatttatgaatgtatgtatgtatacatatacctg

SEQ ID NO: 4244 - DNA, 985 bp, Flaveria ramosissima
aacctctacaccatcatcacacccttcaacaaacagtcatctcttcagtcttcacagccccaaatggcaacctctgcaatccaacagtcagcattcaccagccagccggcattgaagccgcaaaacgagctcgtcaagaacggcggcttcaatggcggccgcttcaccatgcgccgcacggttaaaagtgcgccacaaagcatttggtatggaccggaccgcccgaagtacttgggcccattctctgagcaaaccccatcatacctaactggtgaattcccaggtgattatggctgggacactgctggattgtgagctgacccagagacatttgccaagaaccgtgagctcgaggtgattcactctaggtgggccatgcttggcgcactggggtgtgtgttccccgagattcttgaaaagaacggtgtcaaattcggtgaagcggtctggttcaaggcgggttcccaaattttctcagaaggtgggcttgactacctcgggaacccaaacttgattcatgcccagagcattttagctatctgggcttctcaagttgttctcatgggcctcattgaaggataccgggttggaggcggcccacttggtgaagggcttgataaaatttacccgggagggtcatttgacccacttggattggctgatgacccggatgcatttgcggagttgaaggttaaggagcttaagaacggccgattggctatgttctccatgttcgggtttttcgttcaagccattgtaaccggaaagggcccgatcgagaacttgtttgaccatcttagtgacccggtggctaacaacgcatgggcgtatgctaccaactttgtgcctggaaaatgagttgtatacctgtaaaccaaaaataatggttatgcaataatattacaagcttgtgtttttgtcaagaaatatttatgtacgtttgtatgtatacatatacctgccaaaagaaaacatggtttgttag

SEQ ID NO: 4245 - DNA, 1028 bp, Artemisia annua
agtactccgacggggaccttcaacaaacaacattatctttacttcacaaccctcttaaccaaatggcaacttcagcaatccaacaagcagcatttgctgcccagtcggctttgaagccgcaaaatgagctcgtaaggaaggttggtggcttcaatggtggacgctacactatgcgcagaactgttaaaagtgctccacagagcatttggtacggaccagaccgccccaagtacttgggcccattctcagagcaaaccccatcatacttgactggtgaattccctggtgactacgggtgggacactgctggactatcagctgaccccgagacattcgccaagaaccgtgagcttgaggtgatccactctaggtgggccatgctcggtgcactcgggtgcgtgttccccgaggttctttcaaagaatggagtcaaattcggtgaagctgtctggttcaaggcaggttctcaaattttctctgaaggtgggctcgactacctcggaaaccccaacttgatccatgcccagagcattttagccatctgggcatcacaagttgtgcttatgggcctcattgaaggttaccgtgttggtggaggcccgctcggtgaagggcttgacagcatttacccaggagggtcttttgacccacttggattggctgatgacccagaagcatttgctgagttgaaggtaaaggagctaaagaatggtcgattggcgatgttttccatgtttgggttctttgttcaggccatcgtaacaggaaagggtccaatcgagaacttatttgaccatcttgctgacccagcagctaacaatgcatgggcttatgccaccaactttgtacctggaaaatgagtttagtatatgtaaattcgatgaacattatgcaatattaaagtagaggttgtgttgtcgagaaacatatatgtgtgtatgtatttatatatgtggcattcctgtgacaagaaccatggtttgtttgcaaaacaagctccaatgaaaaataaaaggaatggtgaaagt

SEQ ID NO: 4246 - DNA, 1215 bp, Beta vulgaris
tatccagcaacaaaatcttgcaatcctagatggccaaaaatcagcctctcttatcagttatcactcaaaaatccacgaggaaaatctacacatcaggatgatgaccaataggatagtagtgatgtgtatttttcctcacccacatcttaattcataacccacattactatataaaatcccactcttggcccttaagaattacaatcacttgaaggcaaccaccagcttacataacccacaccagcaaaccagaaaaacagaaaaacaaaaaaaaacgtagaaggcatggcaacctcaactatccaacaatctgcatttgctgggcagaccatcttgaagccccagaatgagctcgtccgcaagttcggtggcaacggaggccgtgcttcgatgcgtcgcactgtcaagagcgcccctcaaagcatatggtacggtcctgaccgtcccaagtatttgggtcccttctcagagcagaccccatcataccttactggagagttccctggtgactacggttgggacactgctggactatcagcagaccctgaaaccttcgctaagaaccgtgagctcgaggtgatccactctaggtgggcaatgcttggtgccctgggctgtgtattccctgaaatcctgtctaaaaacggtgtcaaattcggcgaagctgtgtggtttaaggctggatcacaaatcttccaggaaggtggacttgactacctaggcaacccaaacctgatccatgcccaaagcatccttgctatctgggctagccaagtagtccttatgggtttgatcgagggctaccgtgttggtggtgggccattgggtgaagggctcgacaagctctacccaggtggagcttttgacccacttggtttggcagatgatccagaggcctttgctgagctcaaggttaaggagctcaagaacggaagattggctatgttctccatgttcgggttcttcgtgcaagctattgttactggaaagggtcccattgagaacctctcagaccaccttgctgacccagtggctaacaatgcctgggcctttgccaccaacttcgttcctggaaagtgaaaagtaactaggatgtatgtataatcacttaatgaggaatagtgtgaacaaatgtatgttttcgagttatggctgtgaactttgagttgtgcagatgatgcaaccttgtatttgctgaagccgtggaatgtaagg

SEQ ID NO: 4247 - DNA, 1245 bp, Vaccinium corymbosum
acgctcgaaaacaaaaaggaaaccaaattaaacggaaccgggaatacttgaaaacagcttcttcactctctcacacatttaagggaaacaacagcaagcaacaaaaagaagccttccctgaatccatggccacctctgcaatccaacagtcggcctttttaggcagccgggcggcttcgaagcggcgtgtcaaaaaggtcagcggcttcactgccggccgcatcatgatgcgaaggaccgtaaaaagtgttccccaaagcatatggtatggaccggaccgcccaaagtacttgggcccattctcggagcaaaccccatcttacttgactggagaattcccaggtgactacgggtgggacactgctgggctttcagccgatccagaaacatttgccaagaaccgcgaacttgaagtgatccacagccgttgggccatgctcggtgcattgggctgtgtcttccccgaaatcctcgcaaaaaacggtgttaagttcggagagtccgtttggttcaaggccggagcccaaattttctccgaaggtgggcttgactaccttggcaaccctaacctaatccacgcccagagcatccttgcgatctgggcctgccaagtggtgctcatgggcttcgtcgaggggtaccgggttggcggaggcccacttggggaaggtctcgataagatctaccctggaggggcctttgacccacttgggctcgccgatgacccagaagcctttgcggagttgaaggtgaaagagctcaagaatggacggctcgcgatgttttcgatgtttgggttctttgtccaggccattgttactggaaagggcccaattgaaaacctcttcgaccaccttgctgatccagtggccaacaatgcttgggcttatgccactaacttcgtacccggaaagtgaaaagagtaaagtgtgagatgggcctggcccaatttgagctgtaaaaatttctaatgcttctttatgtgttcttgaagttctctgcttgtggatttgattgcctctgatgtattatcattgccagcagaaactgcttattgtgagactacttctatgtttttatctgtgttcagctcctttttctaatgtattaataccgaacataactgtgtctagaacagtctgatagacaggtgcccacaggcatcgaatgattctggacgtagttgtttccggagttgtgcgcgtagacttttcgatttatggaacatagtatggaatttgaagt

SEQ ID NO: 4248 - DNA, 1134 bp, Carpinus betulus
ttctccacaccctctcactcgcagcatagagaagaagcactcaaccaccaagaaagcatcacataaaccatggcaacatccgccatccaacggtcagcattcgccggccagaccgccttgaagcagtccaatgagctcgtccgcaaggctggcagcttcggtggccgcgtcaccatgaggcgcaccatcaaaagtactccacagagcatctggtatggtccagaccgcccaaagtacttgggcccattctccgagcaaaccccatcatacctgaccggtgaattccccggcgactatggctgggacactgctggcttgtcagcagatcccgagacatttgccaggaaccgtgagcttgaggtgatccacagccgatgggccatgctcggagctcttggctgcgtcttccctgagctcctctcgaagaatggcatcaagttcggcgaggcagtctggttcaaggccggttctcagatcttctccgagggtggccttgactatctcggcaacccgaacttgattcatgcacagagcatcctggcaatctgggccgttcaggttgtgctcatggggttcatcgaagggtacagggttggcggaggaccactcggcgaaggactcgacccgatctacccgggtggcgcatttgacccgcttggccttgctgatgacccggaagcatttgcggagttgaaggtgaaggaactgaagaacgggcggctggcaatgttctccatgttcggtttcttcgttcaggcgattgtcaccggaaagggacccattgaaaacctctccgaccaccttgctgaccctgtggccaacaatgcatgggcttacgccaccaactttgtccccggaaaatgaagaaacctaaacagaatataaatgtggcttcggctgtgacattactcaatcttcttgccttcgttgttgtccttgctattccatctgtactgatgtactattattactagtacttaaactgcttgaacttatattaatgttggttggattttgtattacatatttacttgatattccctccaaccaaagcatacacaacaacagatgacaattcatattcgggtagttatatcaagtcatacttataagattatacagttaattatagtc

SEQ ID NO: 4249 - DNA, 809 bp, Triticum aestivum
catggcaacctcaactatccaacaatctgcatttgctgggcagaccatcttgaagccccagaatgagctcgtccgcaagttcggtggcaacggaggccgtgcttcgatgcgtcgcactgtcaagagcgcccctcaaagcatatggtacggtcctgaccgtcccaagtatttgggtcccttctcagagcagaccccatcataccttactggagagttccctggtgactacggttgggacactgctggactatcagcagaccctgaaaccttcgctaagaaccgtgagctcgaggtgatccactctaggtgggcaatgcttggtgccctgggatgtgtattccctgaaatcctgtctaaaaacggtgtcaaattcggcgaagctgtgtggtttaaggctggatcacaaatcttccaggaaggtggacttgactacctaggcaacccaaacctgatccatgcccaaagcatccttgctatctgggctagccaagtagtccttatgggtttgatcgagggctaccgtgttggtggtgggccattgggtgaagggctcgacaagctctacccaggtggagcttttgacccacttggtttggcagatgatccagaggcctttgctgagctcaaggttaaggagctcaagaacggaagattggctatgttctccatgttcgggttcttcgtgcaagctattgttactggaaagggtcccattgagaacctctcagaccaccttgctgacccagtggctaacaatgcctgggcctttgccaccaacttcgttcctggaaagtgaaaagtaactagga

SEQ ID NO: 4250 - DNA, 1124 bp, Vaccinium corymbosum
ccctctcctcgtgtcgtcgttcggtacgtacgtacgtacgaacgaagacgtagtagtatacacgcagatgccttacgcgggatcttgaaaacagcttcttcactctctcacatttaagggaaacaacagcaagcaacaaaagaagccttccctgaatccatggccacctctgccatccaacagtcggcctttttaggcagccgggcggcttcaaagcggcgtgtcaaaaaggtcagcggcttcactgccggccgcatcatgatgcgaaggaccgtaaaaaagtgttccccaaagcatatggtatggaccggaccgcccaaagtacttgggcccattctcggagcaaaccccatcttacttgactggagaattcccaggtgactacgggtgggacactgctgggctttcagccgatccagaaacatttgccaagaaccgcgaacttgaagtgatccacagccgttgggccatgctcggtgcattgggctgtgtcttccccgaaatcctcgcaaagaacggtgttaagttcggagagtccgtctggttcaaggccggagcccaaattttctccgaaggtgggcttgactaccttggcaaccctaacctaatccacgcccaaagcatccttgcgatctgggccagccaagtggtgctcatgggcttcgtcgaggggtaccgggttggcggaggcccacttggggaaggtctcgataagatctaccctggtggggcctttgacccacttgggctcgccgatgacccagaagcctttgcggagttgaaggtgaaggagctcaagaatggacggcttgcgatgttttcgatgtttgggttctttgtccaggccattgttactggaaagggcccaattgaaaacctcttcgaccacgttgctgatccagtggccaacaatgcttgggcttatgccactaacttcgtacccggaaagtgaaaaaagtaaagtgtgagatgggcctggcccaatttgagctgtaaaaatttctaatgcttctttatgtgtttttgaagttctctgcttgtggatttgattgcctctgatgtaatatcattgccagcagaaatttgtatttatttgttgtagtacttactttcttattgttttt

SEQ ID NO: 4251 - DNA, 895 bp, Leymus cinereus x Leymus triticoides
  misc_feature (57)..(57): n is a, c, g, or t
  misc_feature (75)..(75): n is a, c, g, or t
  misc_feature (84)..(84): n is a, c, g, or t
  misc_feature (148)..(148): n is a, c, g, or t
  misc_feature (156)..(156): n is a, c, g, or t
  misc_feature (162)..(162): n is a, c, g, or t
  misc_feature (168)..(168): n is a, c, g, or t
  misc_feature (201)..(201): n is a, c, g, or t
  misc_feature (204)..(204): n is a, c, g, or t
  misc_feature (228)..(228): n is a, c, g, or t
  misc_feature (231)..(231): n is a, c, g, or t
  misc_feature (252)..(252): n is a, c, g, or t
  misc_feature (297)..(297): n is a, c, g, or t
  misc_feature (821)..(821): n is a, c, g, or t
atcaccatgcgccggaccgtcaagagcgcgccccagagcatctggtacggccctgancgtcccaagtacctgggnccattctcngagcagaccccgtcgtacctgaccggcgagttccccggcgactacggatgggacaccgcgggantgtcggcngacccngagacnttcgccaagaacagggagctggaggtgatccantcncggtgggcgatgctcggcgccctnggntgcgtgttcccggagatcctntccaagaacggcatcaagttcggcgaggccgtgtggttcaaggcnggcgcccagatcttctccgagggcggcctcgattacctgggcaaccccaacctggtgcacgcgcagagcattctcgccatctgggcggttcaggtggtgctcatgggcttcatcgagggttaccgtgttggtggcggccccctcggtgagggcctggacatcatctacccgggcggcgccttcgacccacttggccttgccgacgaccccgacaccgccgccgagctcaaggtcaaggagctcaagaacggccgcctcgccatgttctccatgttcggcttcttcgtgcaggccatcgtcaccggaaaggggcctgttgagaacctcttcgaccacgtcgccgacccagtcaacaacaacgcgtgggccttcgccaccaacttcgcccccggaagttaaatgtgtttagccatccgtctgtccatcggacgagatatgcatgtgtacttgtacgtcgtggatcaacgtgtagctgcacgtactttgtgtgtttatttgtaccatgatcgagcgagcgagatgcnctctcgctagctgtgcgccatgtaaattaattaagcacaaggtgtgcaagagcaaatggatggaagaattgtgt

SEQ ID NO: 4252 - DNA, 987 bp, Flaveria ramosissima
caacgggctgttcttagccttcgagcaagtaccacgtcggacattgcaaataggataatcatgcgggcaacaactgtagtgatcctcacagcaggaagcaccctcaacaatctatcatcaattcacaacccccttactcaaatggcgacctctgcaatccaacagtcagcattcgccggctccgcggcgttgaagccacaaaacgagctcgtcaagaagaccggcggcttcaacggcggccgtttcaccatgcgccgaaccgtcaaaagtgcaccacaaagcatatggtatgggccggacaggcccaaatacttgggcccgttttcggagcaaaccccatcatacttaacaggtgaattccctggtgattatgggtgggacacagctggattatcagctgatcccgagacatttgccaagaaccgtgagctcgaggtgatccactcgaggtgggccatgctcggtgcactcgggtgcgtgttccccgagattcttgaaaagaacggtgtcaaattcggtgaagcggtctggttcaaggcgggttctcagatattctcagaaggtgggcttgactatctcgggaacccaaacttgatccatgctcaaagcatcttagctatttgggcttgtcaagttgttctcatgggcctcattgaagggtaccgtgttggtggaggcccattgggtgaagggcttgacaaggtttacccaggtgggtcttttgacccacttggattggctgatgacccggatgcatttgctgagttgaaggttaaggagcttaagaacggtcgattggctatgttttcgatgtttgggttcttcgttcaagccattgttaccggaaaaggcccgatcgagaacctgtttgatcatgttagtgatccggtggctaacaacgcttgggcttatgccaccaactttgttcctggaaatgagtttgaatagtgtaaatttgatgatgattatgaagtaatatcacaagtt

SEQ ID NO: 4253 - DNA, 881 bp, Quercus alba
aaaaacacagagaagaagcttagcgtactaaacgatggcaacttccaccatccaacgatctgcgtttgccgggcacacccacaccgctttgaagcagtccaatgacttcatccgtaaggttggcggctttggcggtggccgtgttaccatgaggcgcacagtaaagagtgctccacaaagcatttggtatggcccagaccgcccaaagtacttgggaccattctctgagcaaactccatcataccttactggtgaattccctggtgactatggctgggacactgctggattatcagcagaccctgagacatttgctaggaaccgtgagctggaggtaatccacagccgatgggccatgcttggagctttgggctgtgtgttccctgaaatcctttcaaagaatggtgtcaagtttggtgaagcagtttggttcaaggctggtgcacagattttctctgaaggtggtcttgattatcttggcaacccaaacctcattcatgcacaaagcatcttggcaatctgggctgttcaagttgtgcttatgggcttcattgaaggatacagagttggtggaggaccactcggtgaaggacttgaccccatttaccctggtggcgcctttgacccgcttggactggctgatgatcctgaagcattcgcagaattgaaggtgaaggaactaaagatgggagttggcaatgttctccatgtttggtttctttgttcaggctattgttactggaaagggtccaattgagaacctgtttgaccatgttgctgacccagtcgccaacaatgcatgggcctacgccactaactttgtccctggaaaatgaagaaactctgttgtaatttgactccttaatcttcttgtttgtgat

SEQ ID NO: 4254 - DNA, 1063 bp, Malus domestica
tgaacttaatgtttcaatgttgtttttctcttgtgtattgctagttggaagcatcctccatttgtttcctggtttagatatactctattactgcaaagtgcaaagcatgcatctattgacaggaatgcttgaatgtgcagcacaattagacaaattaaacaaaggagctcggtggttttactgggtacagcgatttcaatacaagcagtttctagtaaaattaaatcggaaacagccatggatttaggtttcttcactttccagggacaaagttggtggcgaaagcccatgcgttgttggccactggatcagcaatgtggtcaaagaggttctcgactgggccctttcctgtgacaatagcctgaacaaagaatccaaacatcgaggtcatagccagacgcccgttcttaagttccttcaccttcagttcagcaaaagcttcaggatcatcagcaagtccgagtggatcaaaggcacctcctgggtaaagtgggtcaagtccttcaccgagtggtcctccaccaactctgtatccctcaatgaatcccatgagcacaacctggacagcccagatagccaagatgctctgagcatggataaggtttgggttgccaaggtagtcaaggccgccctcggagaagatttgagatccagccttgaaccaaactgcctcgccgaacttgaccccattctttgacaagatttctgggaagacgcatcccagtgcaccaagcatggcccatctggagtggatcacctcaagctcacggttcttggcaaatgtctcggggtctgcagatagtccagcagtgtcccatccgtagtcaccggggaattcaccggtcaagtatgatggagtttgctcggagaacggtcccaagtacttcggccggtctgggccgtgcttaccatatgctctggggagcacttttgactgtgcgccgcatggagaagcggccgccaccaaggccgccgatcttccggacgagctcattcgactgcttcaaaacagtctggccagcaaatgctgatcgttggatagcagaggttgccatggcttgct

SEQ ID NO: 4255 - DNA, 1026 bp, Amsonia hubrichtii
attaaacaagttgtcgatcgacaagtagaaaattcatggcaacctcaggtattcaacaatctgcatttgctgggcaaactgtactgaagctccagaatgagctcatcagaaaggttggaagcctcggtgctgggcgtttcaccatgagaagaactgtcaaaagtgctccgcaaagcatctggtatggaccagatcgtcccaagtacttgggcccattctcagagcaaactccatcatatctcactggtgaattccccggtgattatggatgggacactgctgggctttcagctgatccagagacatttgccaagaaccgtgagctagaggtaatccactgccgttgggcaatgcttggcgctttgggctgcgtcttccccgaaatcctggccaagaacggtgtcaaattcggtgaggcagtatggttcaaggcgggagcccaaatcttctctgagggtggccttgactatcttggcaacccaaacctcatccacgcccaaagcatcctggccatctgggcagttcaagttgttcttatgggtttgattgaaggatacagagttggaggtggccctctaggtgaaggactcgacaagatctacccaggaggagcctttgacccattgggcttggctgatgatccagaggcatttgcagaattgaaggtgaaggagatcaagaatggtagactggcaatgttctccatgtttggattctttgtgcaggctattgttactggaaaaggcccaattgagaatctctttgaccatgttgctgaccctgtggccaacaatgcctgggcatatgccacaaacttcgtacctggaaaatgaaaaattctgaatctgtaaaatgttgatgttatattatcttaccacttgaatatgttgagacccttttttcttttcacgggcctataaattgttttcttcttggttctaacaaaaaaaacctacatgcacccattgtacgccaaagggtattgttggtattttacccaaacccacaatcaccttttgtacatta

SEQ ID NO: 4256 - DNA, 934 bp, Cirsium arvense
caacctcagcaatccaacactcggcttttgccggccaaccggcgttgaaaccgcaaaacgaccttatcaggaaaaccggcaccttcaacggcggccgctacaccatgcgtcgtacagtcaaaagtgcaccacaaagcatctggtacggaccggaccgcccaaagtacttgggcccattctccgagcaaaccccatcatacctaaccggtgagttccccggtgactacggctgggacaccgccggattatcggctgaccccgagacattcgccaagaaccgtgagcttgaagtgatccactctcggtgggcgatgcttggtgcactcggctgcgtcttccccgagcttctctcaaagaacggtgtcaaattcggtgaagccgtctggttcaaagccggttcccaaatcttctcagaaggcggactcgactacctcggaaaccctaacttggtccatgcacaaagcatcctagccatctgggcttcccaagtggtcctcatgggtctcatcgaagggtaccgtgttggtggtggcccacttggcgaggggctcgataagatttaccctggaggagcttttgacccacttggacttgctgatgatccagaagcgtttgctgaattgaaggttaaggagcttaagaacggtcggttggccatgttttccatgttcggattcttcgttcaagccatcgtaaccggaaagggtccgattgagaacctttctgaccatcttagcgatccagtagctaacaacgcctgggcttacgctaccaactttgtgcccggaaaatgagttgaaaacctgtaaatttgataaatcgttatgcaagattataagcaggagctgtgtgttgtcaatgaactatgtagcattttatatatcaagcttcggtttttattctcgggcagtttttcaaattttagcgtatatgt

SEQ ID NO: 4257 - DNA, 975 bp, Coffea canephora
cggccgggggatcctactctaccaaagtccaaaatcccttgaacatcacaaaagctcaattcatctcgaaaatcaaagtaatggcaacttcaggcatccaacagtctgcatttgctggtcagacagctttgaagcctcagaatgagcttctgaggaaggttgggagctttggaggtggccgtttttccatgagacgtacggtcaaaagtgcaccccaaagcatttggtatggacctgataggcccaagtacttgggcccattctctgaacaaactccatcatacctgactggtgagttccctggtgattacggatgggacactgctgggctttcagctgacccagagacatttgccaagaaccgtgagttagaagtgatccactgtagatgggctatgcttggtgctttgggttgcgtcttcccggaaatcctctcgaagaatggtgtcaaatttggtgaagctgtctggttcaaggctggtgcccaaatcttctctgaaggtggacttgattatcttggcaacccaaacctcatccacgcccaaagcatccttgcaatctgggccagccaagtcgtacttatgggcttaatagaaggatacagagttggtggagggccacttggtgaaggactagacaagatctatccaggaggagcttttgacccattgggtttggctgatgatcctgatgcatttgctgagttgaaggtgaaagagatcaagaatggacgattggcaatgttctcgatgttcggcttctttgtccaagccattgttactggaaaaggcccaattcagaacctcatagaccatttggccgaccctgttaccaacaatgcttgggcatatgccacaaactttgtgcccggaaagtgaaggaacaaaggctgaacttgtccgtgtaactctaatcaaaagctattcatatataagaagttctttgcttgtggatttgagcaatattgacatgata

SEQ ID NO: 4258 - DNA, 896 bp, Euonymus alatus
cacaatcacagtccaccagcagaaaagcgaaatttgatactaccatgacaacctctgcaatccaacaatccgcattcgcaggccaaactgcgttgaagcagccaaatgaattcgtcaggagggttggttccttcggaggaggccgcatttcgatgcgccggaccgtcaagagcgctccccagagcatctggtatgggccagaccgtccaaaatacttgggtccattctctgagcaaactccttcgtaccttaaaggagaattccccggcgactacgggtgggacactgccggattatctgccgatccggaaacatttgccaagaaccgcgaactcgaagtgatccacagcagatgggccatgcttggtgctctgggctgcgtcttccccgaaatcctttcaaagaacggtgtcaagtttggcgaggcagtttggttcaaggccgggtcccaaatcttctccgaaggtgggcttgactaccttggcaacccaaacctaattcacgcccaaagtattctagcaatctgggctagccaggttgtgctaatgggctttgttgaagggtacagaattggtggcggcccactcggtgaaggattggacccactttatccaggtggtgcgtttgacccattgggcctggccgatgacccagaagcttttgcagagttgaaggtgaaggaactcaagaatggtcgacttgcaatgttttccatgtttggattcttcgttcaagctattgtgactgggaagggaccgattgagaatctgtacgatcatattgcggatccagtggccaacaatgcttgggcttatgccactaactttgtccccggaaaatgaagatattgattaggtaattgttattgtgacatattattgtacaatcttggtttg

SEQ ID NO: 4259 - DNA, 980 bp, Euonymus alatus
attacggccggggacggtccactatctaaagcaaagtctgagtctatcatggcaacctctgcgatccaacaatccgctttcgccggccaaactgccttgaagcagccaaatgagttcgttaggagggttggttccttcggaggcggccgcatttcgatgcgccggaccgtcaagagcgctccacagagcatctggtatgggccggaccgtccgaagtacttgggtccattctcggagcaaactccttcgtacctcaaaggagaattccccggcgactatgggtgggacactgccggattatctgccgatccagaaacatttgccaagaaccgtgaactggaagtgattcacagcagatgggccatgcttggtgctctgggctgcgtcttccccgaaatcctttcaaagaacggtgtaaagttcggcgaggcagtctggttcaaggccggagcccaaatcttctcagaaggtgggcttgactaccttggcaacccaaacctcattcacgcccaaagcattctcgcgatctgggcttcccaggttgtgttaatgggctttgttgaagggtacagaattggtggcggcccacttggtgaaggactggacccgctttacccaggtggagcatttgacccattaggccttgcggatgatccagaagcctttgcggaattgaaggttaaggagctcaagaatggacggcttgcaatgttttccatgtttggattctttgttcaggctatcgttaccgggaagggaccgattgagaatctttccgatcatattgcagatccggtggccaataacgcttgggcttatgccaccaactttgtccccggaaaatgaagatactcaacagctgctattattatattaagtttaatgttctagtgaacattaattagtgtacaatcttagtttgtgctttgtgttaaagatcagcgctgttcgttacatatttaactttctaatgctggcgc

SEQ ID NO: 4260 - DNA, 1022 bp, Euonymus alatus
gtccaccaactaaagcaaagtctgagtctatcatggcaacctctgcgatccaacaatccgcattcgccggccaaactgccttgaagcagccaaatgagttcattaggagggttggttccttcgaaggcggccgcatatcgatgcgccggaccgtcaagagcgctccacagagcatctggtatgggccggaccgtccgaagtacttgggtccattctcggagcaaactccttcgtacctcaccggagaattccccggcgactatgggtgggacactgccggattatctgccgatccagaaacatttgccaagaaccgtgaactggaagtgattcacagcagatgggccatgcttggtgctctgggctgcgtcttccccgaaatcctttcaaagaacggtgtaaagttcggcgaggcagtctggttcaaggccggagcccaaatcttctcagaaggtgggcttgactaccttggcaacccaaacctcattcacgcccaaagcattctcgctatctgggcttcccaggttgtgttaatgggatttgttgaagggtacagaattggtggcggcccacttggtgaaggactggacccgctttacccaggtggagcatttgacccattaggccttgcggatgatccagaagcctttgcggaattgaaggttaaggagctcaagaatggacggcttgcaatgttttccatgtttggattctttgttcaggctatcgtgaccgggaagggaccgattgagaatctttccgatcatattgcagatccggtggccaataacgcttgggcttatgccaccaactttgtccccggaaaatgaagatactcaacagctgctattattatattaagtttaatgttctagtgaacattaattagtgtacaatcttagtttgtgctttgtgttaaagatcagcgctgttcgttacatatttaactttctaatgctggcgtaaagtgcttatctagcaactgttttttttgggtaagtatgaatgacattatacaagct

SEQ ID NO: 4261 - DNA, 1166 bp, Panax ginseng
gttttgtggtttttacaggcaaagcgcgccattgtgtctggtaccccgggaaattcggccattacggccgggggcaataagctcctccttgttcaccagcaccacttgctttcatcaataagcatggcaacctcagcaatccaacagtctgcattcgccggccagacggctttgaagccgcagaatgagctggtcaggaagattggcagcttgggaggtggccgcatcaccatgaggcgtaccgtcagaagtgctccagatagcatatggtacggacctgaccgcccaaagtacttgggcccattctccgagcaaactccatcatacctgaccggtgaattccctggagactatgggtgggacactgctggactttcagctgacccagagacatttgccaagaaccgtgagctcgaagtgatccacagcagatgggccatgcttggtgcactaggctgtgtcttccctgaaattcttgcaaggaatggtgtcaaattcggcgaggcagtttggttcaaggccggagcccaaatcttctccgaaggtggccttgactatcttggcaacccaaaccttgtccatgcccagagcatcctggctatctgggccagccaagttgtgctcatgggatttgtggaaggataccgagttggtggaggtccacttggtgaaggacttgacaaaatttacccgggaggttcttttgacccacttggattggctgatgatcctgaagcatttgctgaattgaaggttaaggagcttaagaacggacgattggcaatgttttctatgtttggattctttgtccaggccattgtcaccggaaagggcccaattgagaacctctacgaccaccttgctgacccagtagccaacaatgcatgggcttatgccactaactttgtacccggaaagtgaaactatcaaattctcttctctctcggctgtaatattaaacttgtttggtgacatccaacttctgtaatctttacctgttccctcaagtaatatagcaagcagagatgcttatctgggcaaaccacaccccctcttaaacacaaagagatctaaacaatcttccccccacacaaattacatagtaaaaaaaaattgtcgggcggcttggggcccaatcgacttttagacttcgaacaaaccttatg

SEQ ID NO: 4262 - DNA, 967 bp, Ipomoea batatas
acttcatccattcgcaactgcataccatcaactccactagaaactagctaagaagagcagaagaatcatcaatggcgagttgcggtatccaacaatcagcatttgctgggcaggctgccttgaagtcccagaccgatctcctccgcaaggtcggcagctccggcagtggtcgcttctccatgaggcgtaccgtcaaaagtgctccccagagtatctggtatggcccggaccgccccaagtacttgggcccattctcggagcaaactccgtcatacctcaccggcgagttccccggcgactacgggtgggacaccgcggggctttcagccgacccagagaccttcgcgaggaaccgggagctggaggtgatccactcgcggtgggccatgctgggcgctctgggctgcgtcttcccagaaatcctctccaagaacggcgtgaagttcggcgaggcggtttggttcaaggcgggagcccagatcttctcggagggcgggttggactacttgggcaacccgaacctgatccacgcccagagcatcctggccatctgggcttgccaggtggtgctgatggggttcgtggagggatacagagtgggcggcggcccgctcggcgaggggctcgacaaggtgtaccccggcggcgcgtctgacccgctgggattggcggatgacccggaggcgttcgcggagctgaaagtgaaggaattgaagaacgggcgtttggctatgttctccatgttcgggttcttcgtgcaggccattgttaccgggaagggcccgattgagaacctcttcgaccacgttgctgacccagtagctaacaatgcttgggcctatgctacaaactttgtacccggaaagtgaaattactgatgactgatgtcacttaattacctcttctgtatgtgaatttacctttctgttcctgttaaagtaatgcaaaactccactatcttgtacgg

SEQ ID NO: 4263 - DNA, 992 bp, Nicotiana benthamiana
atatcaaactcaacagaaaagaaaaaaagaagcttctttagctcaccaattaaaaaaatggctacttctgcaattcaacagtctgcatttgttggccggacagtggctaaatcacaaaatgagcttgttaggaaaattggcagctttggcggaggccgtgctaccatgagacgtactgttaaaagtgctcctcaaagcatctggtatggagaagaccgtccaaaatatttgggaccattctctgagcaaactccatcatacctcactggtgagtttccgggtgattacgggtgggacactgctggactctcagctgacccagaaacattcgcaagaaaccgtgaacttgaagtgatccattgtcgttgggccatgcttggtgctttgggttgtgtcttccctgaaatcctttcaaagaacggtgttcaattcggtgaagcagtttggttcaaggcaggagcccaaatcttttcagaaggtggactcgactaccttggcaacccaaacctcgtgcatgcccagagcatcctcgccatttgggcttgccaagttgtcctaatgggcttgattgaaggatacagagttggtggaggcccacttggtgaaggtcttgacaagatctatccaggaggtgccttcgacccacttggcctagctgatgatcccgaggcttttgctgagttgaaggttaaggaaatcaagaatggacgattggctatgttttcaatgttcggattctttgttcaggctattgttacaggaaaaggcccaatcgagaacctttacgaccacattaatgacccagtagccaacaatgcttgggcttttgctaccaactttgtacccggaaagtgaaatgttttgtctgtgttatatgtaaaaatttgggctaatgaagttttctgcttgtaaaagattgggctgttcctactatttaacatgctgatgtttctgcagaaaatactgaatatttcagtgttcttttaccattt

SEQ ID NO: 4264 - DNA, 957 bp, Nicotiana benthamiana
  misc_feature (5)..(5): n is a, c, g, or t
  misc_feature (13)..(14): n is a, c, g, or t
ttacngccggggnnctcaacagaaaagaaaaaaagaagcttctttagctcaccaattaaaaaaatggctacttctgcaattcaacagtctgcatttgttggccggacagtggctaaatcacaaaatgagcttgttaggaaaattggcagctttggcggaggccgtgctaccatgagacgtactgttaaaagtgctcctcaaagcatctggtatggagaagaccgtccaaaatatttgggaccattctctgagcaaactccatcatacctcactggtgagtttccgggtgattacgggtgggacactgctggactctcagctgacccagaaacattcgcaagaaaccgtgaacttgaagtgatccattgtcgttgggccatgcttggtgctttgggttgtgtcttccctgaaatcctttcaaagaacggtgttcaattcggtgaagcagtttggttcaaggcaggagcccaaatcttttcagaaggtggactcgactaccttggcaacccaaacctcgtgcatgcccagagcatcctcgccatttgggcttgccaagttgtcctaatgggcttgattgaaggatacagagttggtggaggcccacttggtgaaggtcttgacaagatctatccaggaggtgccttcgacccacttggcctagctgatgatcccgaggcttttgctgagttgaaggttaaggaaatcaagaatggacgattggctatgttttcaatgttcggattctttgttcaggctattgttacaggaaaaggcccaatcgagaacctttacgaccacattaatgacccagtagccaacaatgcttgggcttttgctaccaactttgtacccggaaagtgaaatgttttgtctgtgttatatgtaaaaatttgggctaatgaagttttctgcttgtaaaagattgggctgttcctactatttaacatgctgatgttt

SEQ ID NO: 4265 - DNA, 974 bp, Nicotiana benthamiana
  misc_feature (155)..(155): n is a, c, g, or t
gaaaagaaaaaaagaagcttctttagctcaccaattaaacaaatggccacttctgcaattcaagaatctgcatttgttggccggacagtggctaaatcacaaaatgagcttgttaggaaaattggcagctttggcggaggccgtgctaccatganacgtactgttaaaagcgctcctcaaagcatctggtatggagaagaccgtccaaaatatttgggcccattctctgagcaaactccatcttaccttactggtgaatttcccggtgattacggatgggatactgctggactctcagctgacccaaagacatttgccaaaaaccgtgaacttgaggtgatccattgccgttgggccatgcttggtgctttgggttgtgtcttccctgaaattctatcaaagaatggtgttaaattcggtgaagctgtttggttcaaggcaggagcccaaatcttttcagaaggtggacttgactacctcggcaacccaaaccttgtccacgcccagagcatccttgccatttgggcttgccaagttgtcctagtgggcttgattgaaggatacagggttggtggaggcccacttggtgaaggtcttgacaagatctatccgggaggtgccttcgacccacttggccttgctgatgatcccgaggcatttgctgagttgaaggttaaggaaatcaagaacggacgattggcaatgttttcaatgttcggattctttgttcaagctattgttaccgggaaaggcccaatcgagaaccttttcgaccacattaatgacccagtagccaacaatgcttgggcttttgctaccaactttgtacccggaaagtgaaatgtttagtgtgtgttatctgtaaaaatttgggctaatgaagttttctgcttgtaaaagattgagctgttccgactatttaacttgctgatgtttatgcagaaaatagtgaatatttcagtgttcttttatca

SEQ ID NO: 4266 - DNA, 1440 bp, Capsicum annuum
aatagtagacgtaaaacaactatattacgcagcattaattgttatctgataaggcaaatgcaaaaattcccatctcacagcatatacagtgcaccataaaactaaagttcctccagactagcataaaaaggaaatggaagaactcccaagacttgtgttttaccatctttatgatcccaccacagtccgtaccatcaccaataatctctactcaaacattataaaagaatatccatttatggtgcacgtgttacaatgaacacttcatgtaacagaaagaacatccccagagacgaggaatcccagaaaaccatgcagcaactgcgataaatatttgcagaagacatggcattataggaaacctcagtccatatcgaggaattccatcctctttctcattgagcctttcagatctgtaggtaaaagaagagcttttgttctctctattagcaaattaaggaaaatggccacatctgcaattcaacaatcagcatttgttggacaggcagttggtaaatcacagaatgagcttgttaagaaaattggcagcttcaatggaggccgttttaccatgaggcgtactgtcaaaagtgctcctcaaagcatctggtacggagaagaccgcccaaagtacttgggcccattctctgagcaaaccccatcatacctcactggtgaattcccaggtgactacggatgggacactgctggactctcggctgatccagagacgtttgccagaaaccgtgagcttgaggtgatccactgccgttgggccatgcttggtgctttgggctgtgtcttccctgaaatcctttccaagaacggtgtcaaatttggtgaggctgtttggttcaaagctggatcccaaatcttctcagaaggtggacttgactacctcggcaacccaaaccttatccacgcccaaagcatcctcgccatttgggcctgccaagttgttctcatgggctttgttgaaggatacagggttggtggaggcccacttggtgagggtcttgacaagatctacccaggaggtgcctttgacccacttggtctggctgatgatcccgaggcttttgctgaattgaaggtcaaggaaatcaagaatggacgcttggcaatgttctccatgtttggattctttgttcaggccattgttactggaaagggcccaattgagaacctctttgaccacattaatgacccagtcgccaacaacgcttgggcttacgccacaaactttgttcccggaaagtgaagtaattagggctatgtaatctgtaaactttgggctaatgaagttttatgcttgtcaaagattgccttgtaccttgatgctctatttaacatgctctgatatttaccaacatatagtaatgtttctcactgttctagttttgttttttgtacccctaaatataatcttcccttttagtt

SEQ ID NO: 4267 - DNA, 1034 bp, Pteridium aquilinum
aagcaaacagaaccaagttaagcttaaagcctcagccctcaggcatcaccatggcaacctccgctatccaacaatcagctttcgctggccagaccgctttgaagcagtccaatgagctcgtccgcaaggtcggtgtcttcggtggcggtcgtgttaccatgcgcagaactgtgaaaagtgctcccgccagcatctggtatggccctgaccgcccaaagtacttgggtccattctctgaccaaatcccatcatacctaactggagaattccctggtgactacgggtgggacaccgctggattatcagctgacccagagacatttgctaagaaccgtgagcttgaggtgatccactgcagatgggctatgcttggtgcccttggctgcgtcttccctgaaattctttcaaggaacggtgtcaagtttggagaggcagtttggttcaaggctggatctcaaatcttctccgagggtggccttgactaccttggcaacccaaaccttatccatgctcagagcattcttgcaatctgggcttgccaagttgtgctcatgggatttgttgaaggatacagagtcggtggtggaccactcggtgaaggacttgacccaatttacccaggtggtacttttgacccacttggattggctgatgatcctgatgccttcgcagagttgaaggttaaggagatcaagaatggccgcctggcaatgttctccatgtttggattcttcgtccaggctattgtcaccggaaagggtcccattgagaaccttttcgaccaccttgctgatccggcgaccaacaatgcatgggcttatgccactaactttgtccccggaaaatgaacaacttagatagatcaatggtatgtctttgaaagctgtaaaattaatcactacgtggcatgtgttgaatatctcgactgcagatgtaatttaactgcttatctttggggctattgtataattaaaatttcagatcttttgtgcgtgaaatagtatatctttgactttcttaagatcaaaaaagaa

SEQ ID NO: 4268 - DNA, 927 bp, Euphorbia esula
  misc_feature (11)..(12): n is a, c, g, or t
  misc_feature (14)..(16): n is a, c, g, or t
cttaaatttannannntaaaagcaaatggcaacttctggaatccaacaatctgcatttgccggtcagattgctctgaagccatctaatgaccttctccgaaaggtcggcaacttaggcggtgctcgcgttgttatgcgtaggactgtcaagagcgctcccgagagcatttggtacggcccagaccgcccaaagtacttgggaccattttccgaacaaactccatcatacctaaccggagaattccccggagactacggatgggacacagccggattatcagcagaccccgaaacattcgccaagaaccgtgaacttgaagttatccactgcagatgggctatgcttggagctctcggctgtgtcttcccggaaatcctctcaaagaacggtgtaaagttcggcgaagcagtctggttcaaggcaggatctcaaatcttttccgaaggtggtctagattatctcggaaaccctaatcttattcacgcccagagcattctagcaatttgggcatgccaggttgttttgatggggttcgtggaagggtacagagttggaggaggacctttgggtgaagggcttgacccgctttatcccggaggtgcttttgatccactaggattggccgatgatccggaagcatttgcagaattgaaggtgaaagagattaagaatggaagattggcaatgttttctatgtttggattctttgttcaggctattgttactggaaaaggacctgttgagaatctttatgaccacgttgctgatcccgtcgctaataatgcttgggcttttgccactaactttgtacccggaaaatgaactatgtaatataaatgtaatgtaatgcttttgtggagattttaaatctttttgtatgttcgtcttctcattattatgttatgtggagaggaagtatttgtgtc

SEQ ID NO: 4269 - DNA, 1139 bp, Fragaria vesca
aaacatcttcatttcagagcctaaacaacaacagtacactccccatttcagagagaaagactagtcatggcaacctctgctatccagcaatccgcctttgccggccagactgctttgaagccatcgaatgagctcgtccgaaagatcggcagcctcggtggtggccgtatctccatgaggcgcactgtcaaaagtgccccagaaagcatttggtatggtcctgaccgcccaaaatacttgggtccattctccgagcaaacaccatcctacttgaccggtgaattccccggtgactacggatgggacactgctgggctatccgcagaccccgagacctttgccaagaaccgtgagctcgaggtgatccactgtcgatgggccatgcttggtgcattgggctgcgtcttcccagaagtcttgtccaagaacggagtcaagttcggcgaggctgtttggtttaaggccgggtctcagatcttctccgagggcggcctggactacctcggcaacccaaacctcgtccacgctcagagcatcttggcaatctgggccgtccaggttgtcctcatgggcttcattgagggatacagagtcggtggaggcccattgggtgagggtcttgacccactttacccgggaggtgcctttgacccacttggactagctgatgatccagaagcctttgctgagctgaaggtgaaggaaatcaagaatggaaggctagctatgacttccatgtttggtttctttgttcaggcaattgttaccggaaaggggccgatcgagaacctttacgaccatgttgctgacccagtggccaacaatgcatgggcttacgccaccaacttcgtccccggaaagtgaagaggaaacctagaatcatctatggtgtttttttcatctgtaacatcacccaaaattgttagctatgttgaggttgtctttctctggactccgttattagttctgatgtactttactagtagaaatcccttgtatggaaatcattgtgccgagtaaaatatcccagctcttgtgcttgaactcattgtttgtctaaaatgtgctgcacattcattcacatgtgcatgtcaactaatgcaatttttgactataatgtgtaggtaattcgtaaatct

SEQ ID NO: 4270 - DNA, 1079 bp, Solanum lycopersicum
agaaaatctcacccaacagatatctcaactccacgtggcagaacagaggcctctatatgccatgattgaaatccaaatactaaaccataaccaatcagcaactgcttagttgtacgtcttgtaatcctcaaaaatccattaaatttgcatatatataaaccccacttctccttcttcctttcatatcatcagaaagaaacaaaaaagcttcagcaaattcaaaaaaaaaaagtaaaaaaaaatggccacttgtgcaattcaacaatcagcctttgttggtcaagcagttggtaaatctcaaaatgaatttattaggaaagttggcaacttcggtgaaggccgtattaccatgagacgcactgttaaaagcgctcctcaaagcatctggtacggagaagaccgtcctaagtacttgggcccattttcggagcaaacaccatcctacttaactggggaatttccaggtgattacggatgggacactgctggactctcagctgaccccgagacatttgctagaaaccgtgagcttgaggtgattcattgccgttgggctatgcttggtgctttaggttgtgttttccccgaaatcctttcgaagaacggtgttaaattcggtgaagctgtttggttcaaggctggatctcaaattttctccgaaggtgggcttgactaccttggaaacccaaaccttgtccatgctcaaagcattcttgctatttgggcttgccaagttgttcttatgggctttgttgaaggatacagagttggtggaggcccacttggtgagggccttgacaagatctacccaggaggtgcctttgacccacttggccttgctgatgatcctgaggcttttgctgaattgaaggtgaaggaaattaagaatggacgtttagctatgttttctatgtttggattctttgttcaagctattgttactggaaagggtccaattgagaacctctctgaccacattaacgaccctgtggctaacaacgcttgggcttacgccacaaactttgtacccggaaagtgaaagtaatttgggctaattaatgaaagttttatgcttgtga

SEQ ID NO: 4271 - DNA, 876 bp, Flaveria ramosissima
cttcagtcttcacagcctcaaatggcaacctctgcaatccaacagtcagcattcaccagccagccggcattgaagccgcaaaacgagctcgccaagaagaccggcggcttcaatggcggccgcttcaccatgcgccgcaccgttaaaagcgcgccacaaagcatttggtatggaccggaccgccccaagtacttgggcccattctctgagcaaaccccatcatacctaactggtgaattccctggtgactatggttgggacactgctggattgtcagctgaccccgagacatttgccaagaaccgtgagctcgaggtgatccactctaggtgggccatgcttggcgcactcgggtgcgtgttccctgagattcttgaaaagaacggtgtcaaatttggtgaagcggtctggttcaaggcgggttcccaaattttctcagaaggcgggcttgactacctagggaacccaaacttgatccatgcccagagcattttagctatctgggcttctcaagttgttctcatgggcctcattgaaggatatcgggttggaggtggcccacttggtgaagggcttgacaagatttacccaggaggctcatttgacccacttggattggctgatgacccagatgcatttgcggagttgaaggttaaggagcttaagaacggacgattggctatgttttccatgtttgggttttcgttcaagccattgtaaccggaaagggcccgatcgagaacttgtttgaccatcttagtgacccggtggctaacaacgcatgggcatacgctaccaactttgtgcccggaaaatgagttgtatacctgtaaaccaaaataatggttatgcaataatattacaagcttgtgtttt

SEQ ID NO: 4272 - DNA, 825 bp, Flaveria ramosissima
aagagccatatcttcactcttcacaacacctaatggcaacctctgcaatccaacagtcagcattcgccggccagccggcactgaagccgcaaaacgagctcgtcaagaagacaggcggcttcaacggtgggcgcttcaccatgcgccgcaccgttaaaagcgcgccacaaagcatttggtacggaccggaccgccccaagtacttgggcccattctctgagcaaaccccatcatacctaactggtgaattcccaggtgactatggttgggacaccgctggattgtcagctgaccctgagacattcgccaaaaaccgtgagctcgaggtgatccactctaggtgggccatgctcggtgcacttgggtgcgtgttccccgagattcttgaaaagaacggtgtcaaattcggtgaagcggtctggttcaaggcgggttcccaaattttctcagaaggtgggcttgactaccttgggaacccgaacttaatccatgcccagagcattttagccatctgggcttctcaagttgttctcatgggcctcattgaaggataccgggtcggtggcggcccacttggtgaagggcttgacaagatttatccaggagggtcatttgaccctctcggattggctgatgacccagatgcatttgcggagttgaaggttaaggagcttaagaacggccgattggctatgttttcgatgtttgggttttcgttcaagccattgtaaccggaaagggaccgatcgagaacttgtttgaccatcttagcgacccggtggctaacaacgcatgggcgtatgccaccaactttgtgcccggaaa

SEQ ID NO: 4273 - DNA, 1108 bp, Primula obconica
agacttctacatacataccatttcacagagctaatcaaaggctatataagtacaaaataagctctattgagatggcaacctcggcgatccaacagtcagcatttgccggccagactggattgaaggctcagaatgagcttgtccgaaaagtcgggagcttcggtggtggccgtgccactatgcgcagaactgtcaaaagtacctctcagagcatctggtacggggaggatcgcccaaagtacttgggcccgttctccgagcaaaccccttcatacttaacaggcgagttccctggtgactacggatgggacactgctgggctatcagctgacccagagacctttgctaagaaccgcgagcttgaggtgattcactccaggtgggccatgctcgggggcattgggttgtgtctttcccgagattctcgctaaaaacggcgtcaaatttggtgaagcgatctggttcaaggccggatcacaaatcttctctgagggagggcttgattaccttgggaaccctaacctcgtccacgctcaaagcatccttgccatctgggccagccaggtcgtcctcatgggcttcgtggaggggtaccgtgttggaggtggcccacttggcgaaggacttgataaggtctaccctggtgggtcattcgacccgttgggcttggccgatgacccagaggcgtttgcagagttgaaggtgaaggagctcaagaacggacgattggctatgttttcaatgtttgggttctttgtgcaggctattgtgacggggaagggaccagtcgagaacctgtatgaccacttggcggatcctgtggccaacaatgcttgggcgtttgccactaactttgtacctggaaagtgaaaattttaatttgtgagagtgatccgtatcgatgtaacattagaagcacaaaaatgttaatgagtgtattttctcaatcatgggcttttctcctccgctgtacttccaactttataccaatgtagagagtatggtttcctctacgttttacttagatgcatatgaagcatctcgaatgtttaaagaaattgctaaatctgagaagcgatgaccacaccatgtgcaaagaaacttggaa

SEQ ID NO: 4274 - DNA, 1084 bp, Nicotiana benthamiana
atagagtaagttttttcttagttaaagcttagcatcagcacaaagaagataaaagaaaattgttcaaatggctacttctgcaattcaacaatctgcaattgctggacagacagctcttaagtcacagaacgagctcattaggaagattggtagctttaatggtggacgtgccactatgcgacgtacggttagaagtgccccacagagcatttggtatggagaagatagaccaaagtacttgggaccattctcagagcaaactccatcttacttgactggtgagtttccgggtgattatgggtgggataccgcgggactttcagctgacccagaaacattcgccaggaaccgtgagcttgaggtgatccattgccgttgggccatgcttggtgctttgggttgtgtcttccctgaaatcctttccaagaatggtgttaaatttggtgaggcagtttggttcaaggctggatctcaaatcttctcagaaggcggtcttgactaccttggtaacccaaaccttattcatgcacagagcattcttgctatttgggcatcccaagttgtgctcatgggtttaattgaaggatacagagttggtggaggcccacttggtgaaggtcttgacaagatctatccgggaggagcttttgacccactagggctcgctgatgatcccgaggcatttgctgaattgaaggtgaaggaaataaagaacggccgattggctatgttctcaatgtttggatttttcgttcaagccattgtcacaggaaagggaccaattgaaaaccttttcgaccatattgctgaccctgttgcaaacaacgcttgggcttttgccactaactttgtacccggaaaatgaaatgaatagcctgtaatatgtaagatttgtggagctagctgtttcatattcttgatgtaatatgagcttgctaatactaatgcaaactggtctagtcatatacctctcgttaagatagtcacttaaagatttccatggtagaagaagcactttttaggtaccttaatgctatataaagtaaccatatttcagcgagttcttcttagtactaatttgcac

SEQ ID NO: 4275 - DNA, 947 bp, Nicotiana benthamiana
ttcggcacgaggcttagttaaagcttagcatcagcacaaagaagataaaagaaaattgttcaaatggctacttctgcaattcaacaatctgcaattgctggacagacagctcttaagtcacagaacgagctcattaggaagattggtagctttaatggtggacgtgccactatgcgacgtacggttagaagtgccccacagagcatttggtatggagaagacagaccaaagtacttgggaccattctccgagcaaactccttcttacttgactggtgagtttccaggtgattatgggtgggacaccgctggactttcagctgaccctgaaacattcgccaggaaccgtgagcttgaggtgatccattgccgttgggccatgcttggtgctttgggttgtgtcttccctgaaatcctttccaagaatggtgttaaatttggtgaggcagtttggttcaaggctggatctcaaatcttctcagaaggcggtcttgactaccttggtaacccaaaccttattcatgcacagagcattcttgctatttgggcatcccaagttgtgctcatgggtttaattgaaggatacagagttggtggaggcccacttggtgaaggtcttgacaagatctatccgggaggagcttttgacccactagggctcgctgatgatcccgaggcatttgctgaattgaaggtgaaggaaataaagaacggccgattggctatgttctcaatgtttggatttttcgttcaagccattgtcacaggaaagggaccaattgaaaaccttttcgaccatattgctgaccctgttgcaaacaacgcttgggcttttgccactaactttgtacccggaaaatgaaatgaatagcctgtaatatgtaagatttgtggagctagctgtttcatattcttgatgtaatatgagcttgctaatactaatgcaaa

SEQ ID NO: 4276 - DNA, 874 bp, Flaveria ramosissima
accatcaacacacccttcaacaaacagtcatctcttcagtcttcacagccccaaatggcaacctctgcaatccaacagtcagcattcaccagccagccggcattgaagccgcaaaacgagctcgtcaagaagaccggcggcttcaatggcggccgcttcaccatgcgccgcaccgttaaaagcgcgccacaaagcatttggtatggaccggaccgccccaagtacttgggcccattctctgagcaaaccccatcatacctaactggtgaattccctggtgactatggttgggacactgctggattgtcagctgaccccgagacatttgccaagaaccgtgagctcgaggtgatccactctaggtgggccatgcttggcgcacgtcgggtgcgtgttccccgagattcttgaaaagaacggtgtcaaattcggtgaagcggtctggttcaaggcgggttccaatttctcagaaggcgggcttgactacctcgggaacccaaacttgatccatgcccagagcattttagctatctgggcttctcaagttgttctcatgggcctcattgaaggataccgggttggtggcggcccacttggtgaagggcttgacaagatttacccaggaggctcatttgacccacttggattggctgatgacccagatgcatttgcggagttgaaggttaaggagcttaagaacggacgattggctatgttttccatgtttgggtttttcgttcaagccattgtaaccggaaagggcccgatcgagaacttgtttgaccatcttagtgacccggtggctaacaacgcatgggcgtacgctaccaactttgtgcccggaaaaaagagttgtatacctgtaaaccaaaaa

SEQ ID NO: 4277 - DNA, 839 bp, Gossypium raimondii
tctaatctaaaagctctcaggcattaccatggcaacctctgctatccaacaatctgctttcgctggccaaacagctttgaagcagtccaatgagctcgtctgcaaggtcggtgccgtcggtggtggtcgcgtttccatgcgtagaaccgtcaaaagtgctccaaccagcataggtatggccctgaccgcccaaagtacttgggtccattctctgaccaaatcccatcatacctgaccggtgaattccctggggactacgggtgggacactgctggattatcagctgacccagagacatttgccaagaaccgtgagcttgaggtgatccactgtaggtgggctatgcttggtgcccttggctgtgttttccctgaaattctttcaaagaatggtgtcaagttcggagaggcggtttggttcaaggctggttcccaaatcttctccgagggtggccttgactatcttggcaacccaaacctcatccatgctcagagtattcttgctatctgggcttgccaagttgtgctcatgggatttgttgaagggtacagagttggtggtggaccactcggtgaaggactcgacccaatttacccaggtggtgcttttgacccgcttggattggctgatgaccctgatgccttcgcggaattgaaggttaaagagatcaagaacggccgcctggcaatgttctccatgtttgggttcttcgtccaggctattgtcactggaaagggtcccatcgagaaccttttcgatcaccttgctgatccggtggccaacaatgcttgggcttatgccacaaactttgtccccggaaaatgaacaacttagatgaa

SEQ ID NO: 4278 - DNA, 1175 bp, Amborella trichopoda
tatataagcagtggtatcaacgcagagtacgtatgacccccatctaacactaggccgcaacatctggctgtttttagctcttgctctcattagaattcaatggcggcttcggcaattcaaagctcgagctttgctgggcaaaccgtgctgaagccgcagagtgagcttgccaagaaggttggagcctatggaggccgcatcttcatgcgtaggactgtgaagagcgtaccacaaagcatctggtacggccccgaccgcccgaagtacctgggccccttctccgaacagaccccctcatacctgacaggtgagttcccaggagactacggatgggacaccgcaggcctctcggcagacccagaaaccttcgccaaaaaccgagaactggaggtgatccactgccggtgggccatgctcggcgccctcggctgtgtcttccctgaactcctcgcaaggaatggcgtcaagttcggggaatcagtctggttcaaggccggctcccaaattttctccgagggcggcctcgactacctcggaaatccgaatctcatccatgcacagagcatactggccatttgggcttgtcaggttgtccttatgggatttgttgaggggtacagggtcggtggtggcccactaggtgagggcctggatgcaatttacccaggtggggcctttgatccattgggcttggctgatgacccggaggcttttgctgagctcaaggtgaaggagatcaagaatgggaggttagccatgttctctatgtttgggttctttgtgcaagccattgtgactggaaagggaccaattgagaacttgtttgaccatcttgctgacccagtggctaacaatgcttgggcctatgccaccaactttgtgcctggcaagtgaggagtgggctcggttgtcggtcctgtgttgtaaaccctgtggcttttgtggtcgctggttgagccctttgttgtagttatactactgtaattggataatattatcatgccgtttggactctccctttggaccatgaacccctctctctctctctcgagctgggcatcttttctttttctatacgtctcttgttttcactttcttttaactaaggaaaaacttagatgctaccttataacgtagcaatacggatgcccctcaaaaatccatagaaaaccttt

SEQ ID NO: 4279 - DNA, 988 bp, Arnica chamissonis
cacagcaatggccacctctgcaatccaacagtcagcattcgccggccaggcggcgttaaagccacaaaacgagctcgtaaggaagaccggcagcttcaacggtggccgcttcaccatgcgccgaaccgtgaaaagtgctccacaaagcatctggtacggaccagaccgccccaagtacttgggcccattctctgagcaaaccccatcatatctaaccggtgaattcccaggtgactacgggtgggacaccgccggattatccgccgaccccgagacatttgccaagaaccgggagctcgaggttatccactctcggtgggccatgctcggggcactcgggtgtgtgttccccgagcttctcgcaaagaacggtgtcaagttcggtgaagcggtctggttcaaggcgggatcccagattttctcggaaggcggactcgactatcttggaaacccaaacttgatccatgctcagagcatcttagccatctgggcttctcaggttgttctcatgggcctcattgaagggtaccgtgtcggtgggggcccactgggtgaagggctcgacgcgatttacccgggagggtcttttgacccacttggattggctgatgatcccgaagcatttgctgagttgaaggttaaggagctgaagaacggtcgattggctatgttttccatgtttgggttctttgttcaggccattgtaaccggaaaaggcccgatcgagaacctttcggatcatctcagtgacccagtggctaacaacgcttgggcttatgccaccaactttgtgcccggaaaatgagctagaatactgtaaattcgataatggttatgcagtaatattacatgtttctggctaatttagttaatatcttgtttaatcaaattaagtttcatggattgtgaatttgaacaagaagactaggaataaagatatagttaatgtttttaatatgtatcatttctagttttattatgtagtttt

SEQ ID NO: 4280 - DNA, 909 bp, Arnica chamissonis
gtctcttgcagaaatgccctaaggtttagggcgccgtgtacatcacacgcccctcaacaaacagccatctcttcacaaccaccaatggcaacctccgcaatccaacagtccgcattcgccggccagccagcgctgaagccacaaaacgagctcgtcaggaaaaccggcggcttcaacggcggccgcttcaccatgcgccggacggttaaaagcgcgccacaaagcatttggtatgggccggaccggcccaagtacttgggcccgttctctgagcaaaccccatcatacctaaccggtgaattccccggtgactacggttgggacaccgccggattatcggcagaccccgagacatttgccaagaaccgtgagctcgaggtgatccactcccggtgggccatgcttggcgcactggggtgcgtgttccccgagcttcttgcaaagaacggtgtcaaattcggtgaagcggtctggttcaaggcgggttcccagattttctcggaaggtgggctcgactaccttgggaacccgaacttgatccatgcccagagcattttagccatctgggcttctcaagttgttctgatgggcctcattgaagggtaccgggttggtggaggcccacttggtgaagggctcgaccagatttacccaggcggatcttttgacccgcttgggttggctgatgacccggaagcatttgctgagttgaaggttaaggagcttaagaacggtcgattggctatgttttccatgtttgggtttttcgttcaagccattgtgaccggaaagggcccgattgagaacttgtttgaccatcttagtgacccggtagctaacaacgcatgggcttatgcgaccaactttgtgcctggaaaatgagttgaatacttgtaaattggatggtgg

SEQ ID NO: 4281 - DNA, 1092 bp, Artemisia annua
atcaacgcagtactccgacgggagagtggttcaacgcagtactccgacggggaccctcttacaaactaccatctcttcaaacattcccttaaagaaatggcaacctctgcaatccaacagtcagcattcgttggcgagtcagcattgaagccacaaaacgagcttgtcaggaagaccggcagcttcaatggtggccgattcaccatgcgtcgcactgtaaaaagtgctccacaaagcatttggtacggacctgaccgccctaagtacttgggcccattttccgagcaaaccccatcatacttgactggtgaattccctggtgactacgggtgggacactgctggactatcagctgaccccgagactttcgccaagaaccgtgaacttgaggtgatccactctaggtgggccatgctcggtgcactcgggtgcgtgttccccgagcttctatcaaagaacggtgtcaaattcggtgaagctgtctggttcaaggcaggttcccaaattttctcagaaggtggccttgactacctcgggaacccgaacttgatccatgcccagagcattttagccatctgggcttctcaagtagtgcttatgggcctcattgaagggtaccgcattggtggggggccacttggcgaagggcttgacagtatttacccgggagggtcttttgacccacttggattggctgatgatccagaggcatttgctgagttaaaggttaaggagctaaagaatggccgattagccatgttttccatgtttgggttctttgttcaggccatcgtaacaggaaagggcccaatcgagaacttatctgaccatcttagtgacccagtagctaacaatgcatgggcttatgctacaaactttgtacctggaaaatgagttgcataaatgtaaattcgaactgttacaaaatctcaaatattacaactagacgtgtattggtgatccaaatttaagattttcatgacatggtgcttatgtatactcatctacatagtcagcaggtatacatatgttgaagtctattcttatcaagttctcataccatcaaaatccatcataaacatttaacctgaa

SEQ ID NO: 4282 - DNA, 978 bp, Brassica juncea
agtacgcgggggaactcacactctctcttcaatccttctacttaagaaaaagcaacaagacttggatcagaaatggccacgtcagcaatccagcaatcctccttcgctggccaaacggccctcaagccctccaacgatctcctccgtaaggtcggtgtctccaatggcggtcgcgtgacaatgcgccgcaccgttaagtctactcctcaaagcatctggtacggaccagaccgtcccaagtacttgggaccgttctccgagaacacaccatcatacctaactggagaataccccggagactacggctgggacaccgccgggctttccgctgacccagagacattcgctaagaaccgtgagcttgaagtcatccacagcagatgggctatgttgggagctctcggctgcacattccctgagattctctccaagaacggagtcaaattcggagaagccgtgtggttcaaggcaggatcccagatcttctcagaaggaggtcttgattacctcggaaaccctaacttgatccacgcgcaaagcatcttagccatatgggcttgtcaagttgtgctcatgggtttcattgaaggctacagaatcggaggtggtcctctcggagaaggccttgacccgctttaccctggaggtgcgtttgacccattgaatttggcagaggatccagaggccttcgctgagttgaaggtgaaggagctcaagaacggacgtcttgccatgttctcaatgtttggattctttgttcaagccattgttactggtaaaggtcccatcgagaacttgtttgatcatttagcagatcctgtggctaacaacgcctggtcttacgctaccaactttgtccccggaaagtaatattatcgtatggatttgctttcaccatcttttctgctttgtaaaatcgttaatgtattaattattcgtgtttatgtgaatttgatacttagtgagtggttcttttct

SEQ ID NO: 4283 - DNA, 965 bp, Brassica oleracea
gaactcacactctctcttcaatccttctagttaagaagacttggataagaaatggccacgtcagcaatccagcaatcctccttcgctggccaaacggccctcaagccctccaacgatctcctccgcaaggttggtgtctccggcggcggccgcgtcaccatgcgccgcaccgtcaagtccactcctcagagcatctggtacggaccagaccgtcccaagtacttgggaccgttctccgagaacacaccatcctacctaaccggagaataccccggagactacggctgggacaccgccgggctctccgctgacccagagacattcgctaagaaccgtgagctcgaagtaatccacagcagatgggcaatgctgggagctctaggctgcacattccccgagattctctccaagaacggagtcaaattcggagaagccgtgtggttcaaggcaggatcccagatcttctcagaaggaggcctcgattacctaggaaaccctaacttgatccacgcgcaaagcatcttagccatctgggcttgtcaagttgtgctcatgggcttcatcgaagggtacagaatcggaggtggtcctctcggagaaggtcttgacccgctttaccctggaggtgcgttcgacccgttgaatctggcggaggacccagaggccttcgctgagttgaaggttaaggagctcaagaacggacgtcttgccatgttctcgatgtttggattctttgttcaagccattgttactggtaaaggtcccatcgagaacttgtttgatcacttggcggatcctgtggctaacaacgcctggtcttacgctaccaactttgtccccggaaagtaattaattatcgtatggatttgctttaccgtcttatctactttctcaaacccattaatgtattgttcgtgtttatgtacttagtgactggctcttttcattgaatggatatttggaat

SEQ ID NO: 4284 - DNA, 1018 bp, Fagus grandifolia
ctggaccttggctgtcactcagttaggcttcacaccaactaagctttcaacattcgaaaaaaagaaaagaaaaaaaaaagaagaagcttatcttaaaccatggcaacctccaccatccaacaatcagcattcgccggccagactgctttgaagcagtccaatgagctcatccgtaaggctggtggctttggcggtggccgcgttaccatgcggcgcacaatcaagagtgttccacaaagcatatggtatggcccagaccgccctaagtacttgggaccattctcagagcaaactcccacatacctgactggtgaattccctggtgactatggctgggacactgctggtttatcagcagaccctgagacctttgcaaagaaccgtgagctcgaggtgatccacagccgatgggccatgcttggagctctgggctgtgtcttccctgaagtcctttcaaagaatggtgtcaagtttggtgaggcagtttggttcaaggctggtgcacagatcttctccgagggtggtcttgattatcttggcaacccaaacctgatccatgctcaaagcatcctggcaatctgggcttgtcaggttgtgctcatggggttcattgaaggatacagggttggtggaggaccactcggtgaaggacttgaccccatttacccaggcggtgcttttgacccacttggacttgctgatgatcctgaagcattcgcggaattgaaggtgaaggaactcaagaatgggaggctggcaatgttctccatgtttggtttctttgttcaggctattgttactggaaagggcccaattgagaacctgtccgaccatattgctgaccccgtcgccaacaatgcatgggcttacgccactaactttgtccctggaaaatgaagaaatcacctaaacttgatgtctcttcggctgtaactttactcttcagtcttcttgcttgtgttgaagttctcttgttgttcatgtgtactgatgctactagaatcactgccttttcttt

SEQ ID NO: 4285 - DNA, 1719 bp, Brassica napus
ttttttcgatgcaatgatgacaatacttttttttttgtcatctatattattacgaggctaaagcccataaaccgaccgaagttatacaaatacaaagtccataaatctcggctagcaacaaaacgaacattaaacaaagaggcccataaattccaaacaaaataaagcccaacgcaatccattcaacccacatccatgcgttaacctttagcgtgttacctgaatcaagagcaccatcgaacttcatgactagaaagtgaccggcgtaatttcaaatccgctaatccaccgggaacgaacctgaaataggatcccgcagtaataaacacatatttaggcaattgtatccgagacagaagccaaaagccagccttacaatgctaaagtagccaccataagccagagtcgaagcccgatacacggaagccaggtcgccggagaagataaccggccgttttaaagaaataagagttcttctcactaaaagaacgcaaaggacaaaaggcagtgaagatgataggaagacctatgacctctgatgcctcgcttggaaggttgtctgaccagatccgagaaaacttaagcatccacatctgaaccggctgagtacaaccaccgcgtaccagaaactagataggaaccgacataaacaaaccaatccaaacgcgactcaccagaaaatcacaatcttcatgcctcctaaatcagaacaaaagacagtaacccaccctctcacggcgccagcaaagatcgtcggacaccggagagggaagatctcgatctacttttttctctgcttttacactctctcttcaatccttctagttaagaagacttggataagaaatggccacgtcagcaatccagcaatcctccttcgctggccaaacggccctcaagccctccaacgatctcctccgcaaggtcggtgtctccggcggcggccgcgtcaccatgcgccgcaccgtcaagtccactcctcagagcatctggtacggaccagaccgtcccaagtatttgggaccgttctccgagaacacaccatcctacctaactggagaataccccggagactacggctgggacaccgccgggctctccgctgacccagagacattcgctaagaaccgtgagctcgaagtaatccacagcagatgggcaatgctgggagctctaggctgcacattccccgagattctctccaagaacggagtcaaattcggagaagccgtgtggttcaaggcaggatcccagatcttctcagaaggaggcctcgattacctcggaaaccctaacttgatccacgcgcaaagcatcctagccatctgggcttgtcaagttgttctcatgggcttcatcgaagggtacagaatcggaggtggtcctctcggagaaggtcttgacccgctttaccccggaggtgcgttcgacccgttgaatctggcggaggacccagaggccttcgctgagttgaaggttaaggagctcaagaacggacgtcttgccatgttctcgatgtttggattctttgttcaagccattgttactggtaaaggtcccatcgagaacttgtttgatcacttggcagatcctgtggctaacaacgcctggtcttacgctaccaactttgtccctggaaagtgattaattatcgtatggatttgcttcaccgtcttatctactttgtaaaacccattaatgtattgttcgtgtttatgt

SEQ ID NO: 4286 - DNA, 1007 bp, Gossypium hirsutum
cgatcggcaaacaaaaccaagtctaatctaaaagctctcaggcatcaccatggcaacctctgctatccaacaatctgctttcgctggccaaacagctttgaagcagtccaatgagctcgtctgcaagatcggtgccgtcggtggtggtcgcgtttccatgcgtagaaccgtcaaaagtgctccaaccagcatctggtatggccctgaccgcccaaagtacttgggtccattctctgaccaaatcccatcatacctgaccggtgaattccctggggactacgggtgggacactgctggattatcagctgacccagagacatttgccaagaaccgtgagcttgaggtgatccactgtaggtgggctatgcttggtgcccttggctgtgttttccctgaaattctttcaaagaatggtgtcaagttcggagaggcggtttggttcaaggctggttcccaaatcttctccgagggtggccttgactatctcggcaacccaaacctcatccatgctcagagtattcttgctatctgggcttgccaagttgtgctcatgggatttgttgaagggtacagagttggtggtggaccactcggtgaaggactcgacccaatttacccaggtggtgcttttgacccgcttggattggctgatgaccctgatgccttcgcggaattgaaggttaaggagatcaagaacggccgcctggcaatgttctccatgtttgggttcttcgtccaggctattgtcactggaaagggtcccatcgagaaccttttcgaccaccttgctgatccggtggccaacaatgcttgggcttatgccactaactttgtccccggaaaatgaacaacttagatggagtcatagtcatagatgtgtctttgaaagctgtaatgttaatcactgttcactatgaatgtggtttcgctacttatctttggagcttttgtatcattaatgctttgatcttttgtaattgaaatagtattttcttgatatcactaaa

SEQ ID NO: 4287 - DNA, 1192 bp, Eucalyptus grandis
ccgctctgtcctcgggaaaaatcaggaggagaaatccgaatccgacctcaggaccaatgggacgacgctgacgtgtacatatcctgatccaggaaatcttctccatcccaatataaccctttgtgctctcctcctaccatcagcaccaactgctctcctcttgccattcgttctgagcccaagtcacgatctcccagtgacgagaaatggcgaccaccgtgatccaacagtccgcattcgccggccagactgccttgaaacagtctagtgagctcgtccgcaaggtcggcaacttcgccggcggccgcgccaccatgcgccgcactgtcaagagtgttcctcagagcatttggtacggaccggaccgcccgaaatacttgggccctttctcggagcagaccccgtcctacttgactggtgaattccccggtgactatggctgggacactgctggtttgtctgcagaccccgagacgttcgccaagaaccgtgagcttgaagtcatccattgcaggtgggccatgctcggtgccctcgggtgcgtcttccccgagatcctccagaagaatggtgtcaagttcggcgaggccgtctggttcaaggctggagcgcagatcttctctgaaggcggtcttgactacttgggcaaccccaacctcatccatgcacagagcatccttgccatctgggcctgccaggttgtcctcatgggattaattgaaggataccgggttggaggaggacctcttggcgaaggccttgacccactttaccccggtggagcattcgaccctctaggattggcagatgatcctgatgcattcgctgagttgaaggtgaaggagatcaagaatggaaggcttgcaatgttctcgatgtttggattctttgttcaggccattgtaactggaaagggcccaattgagaacctcttcgaccaccttgccgatcccgcagccaacaatgcttgggcttatgccaccaactttgtccctggaaaatgaatttgaattgagggcttgctgaagtgtaaacgatgttggtttcctggaacttgttgtgttggggcctcgttagaactgatgtaactttactggccggaagatgcttgagacaatgtattagcagactttcagctctactgtgcttcaagaaaaatataatttggactgattgccttgtttaatttggt

SEQ ID NO: 4288 - DNA, 1245 bp, Gossypium raimondii
ggggaattgatttagatatctatcaaaagaatcttgtaaatcatatgtggcataacagtagcctcaaatctgttgaaagaaaatctaacatgggggaatccacatccaatagattgctgctgacatgtacatttcctgattcacataaatcgccacaacgatcggcaaacaaaaccaagtctaatctaaaagctctcaggcatcaccatggcaacctctgctatccaacaatctgctttcgctggccaaacagctttgaagcagtccaatgagctcgtctgcaagatcggtgccgtcggtggtggtcgcgtttccatgcgtagaaccgtcaaaagtgctccaaccagcatctggtatggccctgaccgcccaaagtacttgggtccattctctgaccaaatcccatcatacctgaccggtgaattccctggggactacgggtgggacactgctggattatcagctgacccagagacatttgccaagaaccgtgagcttgaggtgatccactgtaggtgggctatgcttggtgcccttggctgtgttttccctgaaattctttcaaagaatggtgtcaagttcggagaggcggtttggttcaaggctggttcccaaatcttctccgagggtggccttgactatctcggcaacccaaacctcatccatgctcagagtattcttgctatctgggcttgccaagttgtgctcatgggatttgttgaagggtacagagttggtggtggaccactcggtgaaggactcgacccaatttacccaggtggtgcttttgacccgcttggattggctgatgaccctgatgccttcgcggaattgaaggttaaggagatcaagaacggccgcctggcaatgttctccatgtttgggttcttcgtccaggctattgtcactggaaagggtcccatcgagaaccttttcgaccaccttgctgatccggtggccaacaatgcttgggcttatgccactaactttgtccccggaaaatgaacaacttagatggagtcatagtcatagatgtgtctttgaaagctgtaatgttaatcactgttcactatgaatgtggtttcgctacttatctttggagcttttgtatcattaatgctttgatcttttgtaattgaaatagtattttcttgatatcactaaagcatctgtggcacatatctatattaatcatttaatttccaaaaaaaataaaatcctagtcatttaccttaacacactgaa

SEQ ID NO: 4289 - DNA, 965 bp, Ipomoea nil
acttcatccattcgcaactgcataccatcaactccaacagaaagctaagaagagcagaagaatcatcatcaatggcgagttgcggtatccaacaatcagcatttgctgggcagagtgccttgaagtcccagaccgatctcctccgcaaggtcggcagctccggcagtgctcgcttcaccatgaggcgtaccgtcaaaagtgctccccagagcatctggtatggcccggaccgccccaagtacttgggcccattctcggagcaaactccgtcataccttaccggcgagttccccggcgactacgggtgggacactgccgggctttcagcggacccagagaccttcgccaggaaccgcgagctggaggtgatccactcccggtgggccatgctgggcgctctgggctgcgtgttcccggaaatcctgtcgaagaacggcgtgaagttcggcgaggcggtgtggttcaaggcgggagcccagatcttctcggagggcggattggactacttgggcaacccaaacctgatccacgcccagagcatcctggccatctgggcttcccaggtggtgctgatggggttcgtggagggatacagagtcggcggcggcccgctcggagaggggctggacaaggtgtaccccggcggcgccttcgacccactggggttggccgatgacccggaggcgttcgcggagctgaaagtgaaggaactgaagaacgggcgtttggctatgttctccatgttcgggttcttcgtgcaggccattgttaccggaaagggcccgattgagaacctcttcgaccacgttgctgacccggtagctaacaatgcttgggcttatgctacaaactttgtacccggaaagtgaaatcactgatgatcatgagtgatgtcattacttaattacctcttctgcatgtgaatttacctttctgttcctgttaaagtaatgcaaaatcccact

SEQ ID NO: 4290 - DNA, 1118 bp, Lotus japonicus
aaacacactagctagcaccaaaggaaacactaccaaagtgcaagaagcataacataaccatggccacctctgctatccagcaatcagcattcactggccagactgctttgaagcagggaaatgagctcctccgcaaggctggtggctttggcaaaggtcgctttaccatgcgtcgtactgtgaagagtgctcctcagagcatttggtatggccctgaccgtcccaagtacttgggtcctttctctgagcaaattccatcatacctgactggtgaattccctggtgactacggatgggacacagctggattatcagctgaccccgaaaccttcgccaagaaccgtgagctcgaggtgattcacagcagatgggccatgcttggtgccttgggatgcaccttcccagaaatccttgaaaggaatggtgtcaaattcggtgaggcagtgtggttcaaggctggtgcccagatcttctctgagggtggccttgactatttaggcaacccaaacctgatccatgctcagagcatccttgcaatctgggctactcaggttgtgctcatgggattaattgaaggctacagggttggtggaggaccccttggtgaaggactagacccactttacccaggtggtgcctttgacccacttggtttggctgatgaccctgatgcatttgcagagttgaaggtgaaggaactcaagaacggtcgattggcaatgttctccatgtttggcttctttgttcaggccattgttactggcaagggccctattcagaacctttacgaccatgttgctgaccctgttgccaacaatgcttgggcttttgccactaacttcgtccctggacaatgagggtaccaagatatgccttttcagctgcaatcttctgctcccattttcagttctgttgtgtttaacttcattttcactgatgtaactacacgagccgaagaagaatctgtatgagaacgattgcatgttagacatgaatgagtccctaatattatcaactcttatgcatggattcatgatattgactgggttttttttttgaagggtgatatttactgggttgtcttgcacaaacttagtcatggttttctatttttccca

SEQ ID NO: 4291 - DNA, 1025 bp, Tropaeolum majus
catccacacaaattcaattaagagttcaagaacaaaagaaactgtagaaaagttaaaaaaaaaaacttagagaaaacaaatggctgcaacctctgctattcaacaatctgcattttctggccagacagcattgaagcaatccaatgagcttctcacaaaggtgggtgctttaggtgagggacgaattactatgcggcgaaccgtaagaagtactcctcaaagcatttggtatggtgctgatcgcccaaagtacttgggtccattctcggagcaaactccatcgtacctgaccggtgaatttcctggcgactatggatgggacacagctggattatcagctgacccagagacatttgcgaagaaccgtgagctagaggttatccacagcagatgggcaatgcttggtgcacttggttgtgtcttccctgaaatcctttccaagaacggtgttaccttcggtgaggcggtttggttcaaagctggatctcaaatcttctctgaaggtggtcttgattatctcggaaacccgaaccttgttcatgctcagagcattttagcaatctgggctactcaggttgtgctcatgggatttgttgagggatacagagttggtggaggacctttgggagagggacttgacccattataccctggtggtgcttttgatcctcttggattagctgatgatcctgaggcattcgcggagttgaaagtgaaggagctgaagaatggacgcttggctatgttctcgatgtttggattcttcgttcaggctatagttactggaaagggtcctattgagaacctctctgaccacattgctgatccagtagccaacaatgcgtgggcttttgcgactaactttgttcccgggaaatgaagaaacctgtaatagtttgttcttattccattgttacattccgtaatcccattctcgtgtctatgtttggaacttcgttgatgatgtaatttacatgtagaaactgtgtgataaagctatttgatcataaatcaggagatttcgt

SEQ ID NO: 4292 - DNA, 924 bp, Plantago ovata
gcagaagtcacttgagtaaccaaatatacacagctacaatggcaacttctgcaattcagaactccgcatttgccggtcagaccgtcctgaagccgcagagtgagttcatgagaaaggtcggctacctcggtgagggccgtatgaccatgagacgtaccgtcaagagtgctccacaaagcatttggtatggcccagaccgccccaaatacttgggcccattctcagagcagactccatcatacctaactggtgagtttcccggtgactacggatgggacactgctggactctcagctgatccagagacattcgccaagaaccgtgagcttgaagtgatccactccaggtgggccatgcttggtgctttgggctgcatcttcccggaaatcctctccaagaacggcgtcaagtttggtgaggctgtttggtttaaggctggatcccagatcttctccgaaggtgggcttgattacttgggcaacccgaatctcatccacgcacaaagcattcttgcgatattgggctctcaggttgtgcttatgggcttgattgaaggatacagaattggaggaggcccattgggagagggacttgacaagctctacccaggtggtgcattcgacccattgggcttggccgaagaccctgacgcattcgctgagttgaaggttaaggaattgaagaacggtcgactggccatgttctcaatgttcggattcttcgtccaggctattgttaccggaaagggccctatcgaaaacctcttcgaccatgttgcggatccagttgccaacaatgcttgggcttatgccactaactttgtcccaggaaaatgagaaatgcacttgtaacaaattaaggcctgttttgtgttgttttgtaaattgagttcactctaatgtatgggtcattgctttgttgttc

SEQ ID NO: 4293 - DNA, 1015 bp, Platanus occidentalis
tgcaaataagctgctgcttctgataccaaaccacaaaacagagaagaagaacaagcagaaataagcacttgagagtcatggcaacctctgcaatccaaggttcagcattcaccggccagactgttttgaagcagcagaatgagcttgttcggaaggtcggtgtctccggcggccgcatctccatgcgccgcaccgtaaagagtgttgcccagagcatgtggtatggcccagaccgcccaaagtacttgggaccattctctgagcaaactccatcatacctgactggtgaattccccggtgattatggctgggacaccgccgggttgtcagctgacccggaaacatttgccaagaaccgtgagcttgaggtgatccactgccgctgggccatgcttggtgcacttggttgcgtcttccctgaaatccttgcaaagaatggggtcaaatttggtgaagcagtatggttcaaagccgggtcacagatcttctctgaaggcgggcttgactaccttggcaacccgaacctcatccatgcccaaagcatccttgcaatctgggcttgccaagttgtcctcatgggcttcgttgagggatacagagttggtggcggtccgcttggggaaggtttggatgcaatttatcccggcggcgcattcgacccactcggattggctgatgaccctgaggcttttgcagaacttaaggtgaaggagatcaagaatggaaggctggccatgttctctatgtttggcttctttgttcaggctattgtcaccggaaagggcccaattgagaacctttatgaccacgttgccgatccggtggccaacaatgcatgggcttatgccactaactttgtccccggaaagtgagtcactggcgtttgctcctttgcacacctgtatcattattcagtctttctaagttagttctactgattcctggctgtggatttgataaagaaatatgtaattttactaataaatgaatgcttaccttggaactgctttgcttt

SEQ ID NO: 4294 - DNA, 946 bp, Raphanus sativus
ggaactcacactctctcttcaatccttctagttaagaaagacttggataagaaatggccacgtcagcaatccagcaatcctccttcgcaggccaaacggccctcaagccctccaacgatctcctccgcaaggtcggtgtctccgacggcggccgcgtgaccatgcgccgcaccgttaagtctactcctcaaagcatttggtacggaccagaccgtcccaagtacttgggaccgttctccgagaacacaccgtcctacctaaccggagaataccccggagactacggctgggacaccgcgggactttccgctgacccagagacattcgctaagaaccgtgagctcgaagtaatccacagcagatgggcaatgttgggagctctaggctgcacgttccccgagatcctctccaagaacggagtcaaattcggagaagccgtgtggttcaaggcaggatcccagatcttctcagaaggaggtcttgactacctcggaaaccctaacttgatccacgcgcaaagcatcttagccatctgggcttgtcaagttgtgctcatgggtttgatagaagggtacagaatcggaggtggtcctctcggagaaggtcttgacccgctttaccccggaggtgcgttcgacccgttgaatttggcagaggacccggaggccttcgctgagttgaaggttaaggagctcaagaacggacgtcttgccatgttctccatgtttggattctttgttcaagcaattgttactggtaaaggtcccatcgagaacttgtttgatcacttggcagatcctgtggctaacaacgcctggtctttcgctaccaactttgtccccggaaagtgatttatctatcttatggatttgcttcaccgtcttatcttactttgtaaaagcatcaatgtattgttcgtgttttatgtgaatttggtacttagtca

SEQ ID NO: 4295 - DNA, 1040 bp, Rosa hybrid cultivar
catcttcatttcatagcctaaacaacaccaccctcatctcagagagaaacacatagtcatggcaacctctgctatccagcaatccgcctttgccggccagactgctttgaagccatcgaatgagctcgtccgaaagattggcggccttggtggtggccgtatctccatgaggcgcactgtcaaaagtgccccagaaagcatatggtacggtccagaccgcccaaaatacttgggaccattctccgagcaaactccttcctacttgaccggagaattccccggtgactatggatgggacactgctgggctatccgcagaccccgaaacctttgctaagaaccgtgagctcgaggtgatccactgccgatgggccatgcttggtgcattgggctgcgtcttcccagaagtcttgtccaagaacggtgtcaagttcggcgaggctgtttggttcaaggccgggtctcaaatcttctccgagggtggcctggactacctcggcaacccaaacctcgtccacgcccagagcatcctggcaatctgggccgtccaggttgtcctcatgggcttcattgagggatacagaattggtggaggcccacttggtgagggtcttgacccactttacccaggaggtgcctttgacccacttggattggctgatgacccagaagcctttgctgagcttaaggtgaaggaaatcaagaatggaagactggcaatgacctccatgtttggtttctttgttcaggcaattgttaccggaaaggggccaattgagaacctctatgaccacgttgctgatcccgtggccaacaatgcatgggcatacgctaccaacttcgtccccggaaagtgaagaggaaacctagaatgatcaatggttgctttcatctgtaacattacccaaatttgttagctttgttgaggttgtctttctgtggactccattactagttctgtaatttactagtacaaattctttgtacggaaatcactgtgtccagtaaaaatacccagctcttgtgcttaaaaaaaaaaaa

SEQ ID NO: 4296 - DNA, 935 bp, Glycine max
tcaacaaaacaaccatcatcatggccacctctgctattcagcaatcagcattcgcaggtcaaactgctctgaagcagctcaatgagttggtccgcaagaccggtggcgccggcaaaggtcgcaccaacatgcgccgtaccgtcaagagtgctcctcagagcatttggtatggccctgatcgtcccaagtacctgggtccattctcagagcagattccgtcatacctgaccggagaattccccggtgactacggatgggacactgctggactatcagctgacccggaaaccttcgccaggaaccgggagctggaggtgattcacagcagatgggccatgcttggtgcacttggctgcaccttcccagagatccttgagaagaatggtgtgaaattcggcgaggccgtgtggttcaaggctggttcacagatcttctcggagggaggacttgactacttgggcaacccaaacctgatccatgctcaaagcatccttgccatctgggctgttcaggttgtgctcatgggttttgttgaaggttacagagttggtggaggaccccttggtgaaggacttgaccctatctaccctggtggtgcatttgaccctcttggtctggctgatgaccctgatgcattcgctgagttgaaggtcaaggaactcaagaacggtcgcttggctatgttctccatgtttggtttctttgttcaggccattgtcactggcaagggccctattcagaacctttacgaccatgttgctgatcctgttgccaacaatgcttgggcttatgccactaactttgtccctggacaatgagcattgcaattcaatgcaatcttctgctcccattttctctaatgtaactacacctgtgtaccagaagaatctgtatgagaaccattatattatatatattagaaatttctgtcccta

SEQ ID NO: 4297 - DNA, 1084 bp, Glycine max
agccttgttcattctcaacaaaacaaccatcatcatggccacctctgctattcagcaatcagcattcgcaggtcaaactgctctgaagcagctcaatgagttggtccgcaagaccggtggcgccggcaaaggtcgcaccaacatgcgccgtaccgtcaagagtgctcctcagagcatttggtatggccctgatcgtcccaagtacctgggtccattctcagagcagattccgtcatacctgaccggagaattccccggtgactacggatgggacactgctggactatcagctgacccggaaaccttcgccaggaaccgggagctggaggtgattcacagcagatgggccatgcttggtgcacttggctgcaccttcccagagatccttgagaagaatggtgtgaaattcggcgaggccgtgtggttcaaggctggttcacagatcttctcggagggaggacttgactacttgggcaacccaaacctgatccatgctcaaagcatccttgccatctgggctgttcaggttgtgctcatgggttttgttgaaggttacagagttggtggaggaccccttggtgaaggacttgaccctatctaccctggtggtgcatttgaccctcttggtctggctgatgaccctgatgcattcgctgagttgaaggtcaaggaactcaagaacggtcgcttggctatgttctccatgtttggtttctttgttcaggccattgtcactggcaagggccctattcagaacctttacgaccatgttgctgatcctgttgccaacaatgcttgggcttatgccactaactttgtccctggacaatgagcattgcaattcaatgcaatcttctgctcccattttctctaatgtaactacacctgtgtaccagaagaatctgtatgagaaccattatattatatatattagaaatttctgtccctaaaaaatatcaactcttacgcttcaattcataatattgattgttttgtgttgttgttatatatggttttctattcttcccatgatactgatgatatgaaccacctttccctaaagtttgattagttcaaacattga

SEQ ID NO: 4298 - DNA, 1138 bp, Tragopogon dubius
tacgcgggaccctcaacaaacaaaaacaaccaccggaaaatggcaacatccgccatccaacagtcagcattcgccggccaagtggcattgaagccacaaaacgagctcacccgaaaaactgccaccttcaatggcggccgctacaccatgcgtcgtaccgtcaaaagtgcaccacaaagcatttggtacgggccagaccgtccaaagtacttaggcccattctctgagcaaaccccatcatacctaaccggtgaattccccggtgactacggttgggacactgcagggctttcggctgaccccgagacatttgccaagaaccgtgagctcgaggtgatccactcgcggtgggccatgcttggcgcactcggatgcatcttccctgagcttctttccaagaacggtgtgaaatttggagaagcggtctggtttaaggccggttcccaaattttctcggaaggtggtcttgactaccttggaaaccctaatttgatccatgctcaaagcattcttgctatttgggcatcacaagttgtcctcatggggttgattgaagggtatagagttggtgggggcccacttggtgaagggcttgatagtatttaccctggtggggcatttgacccacttggattggctgatgacccggaagcgtttgcagagttaaaggttaaggagctcaagaacggtcggttggcgatgttttcgatgtttgggttttttgttcaagctattgtgaccggaaagggcccgattgagaacttgttcgaccatctcaatgacccagttgctaacaatgcctgggcttatgctaccaactttgtccccggaaagtgagttgaacacttgtaaattcgataattgttatgcaatattacaagcgggacccgtgttatcgagaaaatctttcgtttcgtattttcatctttgtttattaataaatatctctagagttatgttattatatcatgtttatccacaagctaaaccaacccaatttcgataaagacaaaaggaaacaattagaaaaagggtttaaaatgataaacgcgtaatgaagtatttgtaagttcattttgtgaacaaatattttagtcatttacattccgatagcattgtattaaatgtatagtatttg

SEQ ID NO: 4299 - DNA, 1192 bp, Zamia vazquezii
atcctccgaatacattgcaagagtcgtgagagcgccatggcgtgcgtgacgtcagcctcggccatccaaagcgcgacgctcgcggggcagacggcgctgaagccccgcgacgagctagcgaggagggtcggcacgtccgagggtcgaatcaccatgcgcagaaccgtcaaatccgctcctcagagcatctggtacggaccggatcggcccaagtacctgggaccgttctcggagcagacgccgtcgtatctgacgggggagttcccgggggactacggatgggacacggcgggcctgtcggcggacccggagacgttcgcgaggaaccgagagctggaggtgatccacgcccgatgggccatgctcggcgccctcggctgcgtcttcccggagattctggccaggaacggcgtcaaattcggggaggcggtgtggttcaaggccggggcgcagatattctccgagggcgggctggactacctgggcaaccccaatctggtgcacgcgcagagcattctggccatctgggcggtgcaggtggtgctgatggggttcgtggaggggtacaggggtcgggggcggacccctcggggaggggctggatccgctctacccgggcggcgccttcgacccgctggggttggccgacgaccccgacaccttcgcggagctgaaggtgaaggagctcaagaacgggcggttggccatgttctccatgttcggcttttacgtgcaggccatcgtcaccggcaagggccccatagagaatctctacgatcacctcgccgaccccaccgccaacaacgcctgggcctacgccaccaacttcgtccccggcaagtgacccaaatttcgcccaataatgaataaatgatatgcacgggaccgtcgccagaggccgagtttagagattttgcatttggacggggactctccccccctaggtaccctaatttgttggcttcctgctatttttgtgtcgttcaggcaaggcgtaggatgaacctcgctcgccttgtaataggctttgagggtgttactatcttttaattgaaataactctgtaagaagatgttattctgttttagctgaaacataactttgtaagccccttctctagatatttgattacatatttacttctacagtttctcatagaattttaataataagatgtgcaaaataagaaaaa

SEQ ID NO: 4300 - DNA, 933 bp, Panicum virgatum
ggcgccggcgccgacgccggcggccgcatcaccatgcgccgcaccgtgaagagcgctccccagagcatctggtacgggcccgaccgccccaagtacctgggccccttctccgagcagacgccgtcgtacctgaccggcgagttccccggcgactacgggtgggacaccgcggggctctccgccgacccggagaccttcgcgcgcaaccgcgagctggaggtgatccactcgcggtgggcgatgctgggcgcgctggggtgcgtgttcccggagatcctggccaagaacggcgtcaagttcggcgaggcggtgtggttcaaggccggcgcgcagatcttctccgagggcgggctggactacctgggcaaccccaacctggtgcacgcgcagagcatcctggccatctgggcgtgccaggtggtgctcatgggcttcgtcgagggctaccgcgtcggcggcgggccgctcggggaggggctcgacaaggtgtacccgggcggcgccttcgacccgctggggctcgccgacgacccggacaccgccgcggagctcaaggtgaaggagctcaagaacggccgcctcgccatgttctccatgttcggattcttcgtgcaggccatcgtcaccggcaagggccccatcgagaacctcttcgaccacgtcgccgaccccgtcgccaacaacgcctgggcctacgccaccaacttcgtcccgggcaactgatcaatctgctctgcttgtaggcgtgtagtagttgcacgcgccggcgtatgctccgtgtgctctcgtcagattcagattcagatcatcagcagctgcgtctgcctgcacgtgatgtaaacttgtaaactacgcacggagatgcatgtgtaagatcaatggtgtacgtgtaccataccattcatgagtggatcttcttgtcactcatccatc

SEQ ID NO: 4301 - DNA, 857 bp, Triticum aestivum
gctagcccttataccccgttcgtcgtttagggcccttttagggtccgtaacggtaccgttacctacggaaagtccaagttggtaatccaacgacacgagtaccgggaagtacacaccatccaccagttcatctcactgagctcgcaggcagccccagccaccagcgaaatggccgcgtcggcgctgcaccagacgaccagcttcctcggcaccgccccgcggcgcgatgacctcgtccgcagcgtcggcgactttggcggccgcatcaccatgcgccggaccgtcaagagcgcgccccagagcatctggtacggccctgaccgtcccaagtacctgggcccgttctccgagcagaccccgtcgtacctgaccggcgagttccccggcgactacgggtgggacaccgccggattgtctgctgaccccgagacgttcgccaagaacagggagctggaggtgatccactcgcggtgggcgatgctcggcgccctcgggtgcgtgttcccggagatcctgtccaagaacggcatcaagttcggcgaggccgtgtggttcaaggccggcgcccagatcttctccgagggcggcctcgactacctgggcaaccccaacctggtgcacgcgcagagcatcctcgccatctgggcggtgcaggtggtgctcatgggcttcatcgagggctaccgtgttggtggcgggcccctcggcgagggcctcgatatcatctacccaggcggcgccttcgacccacttggcctcgccgacgaccctgaccaccgccgccgagctcaaggtgaaggagctcaagaacggccgcctcgccatgttctccatgttcggcttcttcgtgcaggcca

SEQ ID NO: 4302 - DNA, 1011 bp, Triphysaria pusilla
aagtagaaaaatggcaacatcatctgcatttgctggccagaccgctctgaagccacagaatgagctcatccgaaaagtcggcaacctcggcgccaccggtggccgcttcaccatgaggcgtaccgttaagagtgctccccagagcatctggtatggaccagacaggcccaagtacttgggcccattctccgagcaaaccccatcttacctaaccggtgaattccccggtgactatggctgggacacagctgggctttcagctgacccagaaacattcgccaaaaaccgtgagctagaagtgatccacagccgttgggccatgctcggggcactgggctgtgttttccctgaaatcctatccaagaacgggatcaaatttggtgaagccgtgtggttcaaggccggatcacaaatcttctcagaaggtgggctggactatttgggcaacccaaacctgatccacgcccagagcatcttggccatctgggccacccaggttgttctcatgggctttattgaaggatacagagttggtggaggcccacttggggaagggctagacaagctctaccccggtggttcattcgacccgttgggcctggctgatgacccggaggcatttgctgagttgaaggttaaggaactgaagaatggaagattggcaatgttctcaatgtttggattctttgtgcaggccattgtgactggaaagggcccagttgagaatttgtacgaccatcttgctgatccagtggccaacaatgcgtgggcctttgccacaaactttgcgcctggtaaatgagagggaatttttatggagttaaatttgagattaaaatgtctatcagcatgaatgttaccagcactcaattaagtttgatcatctatctaattttatattaagttgtttattcacattccaatttaagctgtatatgtgattatgaattaaaaattaaatctattttaaattaaaaaaatatatatttacaataccaaaaaaaaaaaaaa

SEQ ID NO: 4303 - DNA, 1067 bp, Triticum aestivum
ccgtacgaacgcgaactggtatcaacgccagtacccggggacccgaaaccaccgacacccgatcctaccagttccatctcgactcgagctcgcaggcagccccagccaccagcgaaatggccgcgtcggcgctgcaccagacgaccagcttcctcggcaccgccccgcggcgtgatgacctcgtccgcagcgtcggcgacttcggcggccgcatcaccatgcgccggaccgtcaagagcgcgccccagagcatctggtacggccctgaccgtcccaagtacctgggcccgttctccgagcagaccccgtcgtacctgaccggcgagttccccggcgactacgggtgggacaccgccggattgtcggctgacccagagaccttcgccaagaaccgggagctggaggtgatccactcacggtgggcgatgctcggcgccctggggtgcgtgttcccggagatcctgtccaagaacggcatcaagttcggcgaggccgtgtggttcaaggccggtgcccagatcttctccgagggcggcctcgactacctgggcaaccccaacctggtgcacgcgcagagcatcctcgccatctgggcggttcaggtggtgctcatgggcttcatcgagggttaccgcgttggtggcggccccctcggcgagggcctcgacatcatctacccaggcggcgccttcgacccacttggcctcgccgacgaccccgacaccgcagctgagctcaaggtcaaggagctcaagaacggccgcctcgccatgttctccatgttcggcttcttcgtgcaggccatcgtcaccggaaaggggcccgtagagaacctcttcgaccacgtcgccgacccggtcaccacaacgcgtgggccttcgccaccaacttcgcccccggaagctaaatgtgttaagccatctgtccgtccatcggacgagatatgcatgtgtacttgtacgtcgtggatcaacgtgtagctgcacgtactttgtgtgtttatttgtaccatgatcgagcgagcgagatgacctctcgctggctgcgcgcaatgtaaattaattaag

SEQ ID NO: 4304 - DNA, 894 bp, Flaveria ramosissima
accctcaacaatctatcatcaattcacaacccccttactcaaatggcgacctctgcaatccaacagtcagcattcgccggctccgcggcgttgaagccacaaaacgagctcgtcaagaagaccggcggcttcaacggcggccgtttcaccatgcgccgaaccgtcaaaagtgcaccacaaagcatatggtatgggccggacaggcccaaatacttgggcccgttttcggagcaaaccccatcatacttaacaggtgaattccctggtgattatgggtgggacacagctggattatcagctgatcccgagacatttgccaagaaccgtgagctcgaggtgatccactcgaggtgggccatgctcggtgcactcgggtgcgtgttccccgagattcttgaaaagaacggtgtcaaattcggtgaagcggtctggttcaaggcggttctcaggatagtctcagaaggtggcttgactatctcgggaacccaaacttgatccatgctcaaagcatcttagctatttgggcttgtcaagttgttctcatgggcctcattgaagggtaccgtgttggtggaggcccattgggtgaagggcttgacaaggtttacccaggtgggtcttttgacccacttggattggctgatgacccggatgcatttgctgagttgaaggttaaggagcttaagaacggtcgattggctatgttttcgatgtttgggttcttcgttcaagccattgttaccggaaaaggcccgatcgagaacctgtttgatcatgttagtgatccggtggctaacaacgcttgggcttatgccaccaactttgttcctggaaaatgagtttgaatagtgtaaatttgatgatgattatgaagtaatatcacaagtttcggct

SEQ ID NO: 4305 - DNA, 1182 bp, Brassica juncea
actcaactcttcaatccttctagttaagacttggataagaaatggccacgtcagcaatccagcaatcctccttcgctggccaaactgccctcaagccctccaatgatctcctccgcaaggtcggtgtctccggcggcggccgcgtgaccatgcgccgcacagtcaagtccactcctcaaagcatctggtacggaccagaccgtcccaagtacttgggaccgttctccgagaacacaccatcctacctaaccggagaataccccggagactacggctgggacaccgccgggctctccgctgacccagagacattcgctaagaaccgtgagctcgaagtaatccacagcagatgggcaatgctgggagctctaggctgcacattccccgagattctctccaagaacggagtcaaattcggagaagccgtgtggttcaaggcaggatcccagatcttctcagaaggaggcctcgattacctcggaaaccctaacttgatccacgcgcaaagcatcttagccatatgggcttgtcaagttgtgctcatgggcctcatcgaagggtacagaatcggaggtggtcctctcggagaaggtcttgacccgctttaccctggaggtgcgttcgacccgttgaatctggcggaggacccagaggccttcgctgagttgaaggtgaaggagctcaagaacgggcgtcttgctatgttctcgatgtttggattctttgttcaagccattgttactggtaaaggtcccatcgagaacttgtttgatcatttggcggatcctgtggctaacaacgcctggtcttacgctaccaactttgtccccggaaagtaatttaattattgtatggatttgcttcactatcttatctactttgtaaaacccgttaatgtattgttcgtgtctatttacttagtgactggctcttttcattgaatggatatttggcatatgaatgaataaaaacaagacttcttattgcacaaaaagcaacatagccaccaagaagataataggtaggaactggattttgaagatcttacatagccaaatttatttatatcttactccgtaattaatcagtttcgcttggcgatgaacaaaccccacttctgttcaccacttgagctcctgagtagctttgagttccacccacctactatatcctcatagtcca

SEQ ID NO: 4306 - DNA, 864 bp, Brassica juncea
agtacgcggggaactcacactctctcttcaatccttctagctaagaaaagcaacaacacttggatcagaaatggccacgtcagcaatccagcaatcctccttcgctggccaaacggccctcaagacctccaacgaactcctccgcaaggtcggtgtctccggcggcggtcgcgtgaccatgcgccgaaccgtcaagtccactcctcaaagcatctggtacggaccagaccgtcccaagtacttgggaccgttctccgagaacacaccatcctacctaaccggagaataccccggagactacggctgggacaccgcagggctttccgctgacccagagacattcgccaagaaccgtgagctcgaagtcatccacagcagatgggcgatgctgggagctctcggctgcacattccccgagattctctccaagaacggagtcaaattcggagaagccgtgtggttcaaggcaggatcccagatcttctcggaaggaggcctcgattacctcggaaaccctaacttgatccacgcgcaaagcatcttggccatctgggcttgccaagttgtgctcatgggcttcatcgaagggtacagaatcggaggtgggcctttaggagaaggtctcgaccctctttaccctggaggcgcgttcgacccgttgaatctggcggaggacccagaggccttcgctgagttgaaggtgaaggagctcaagaacggacgtctcgccatgttctccatgtttggattctttgttcaggccattgtgactggtaaaggtcccatcgagaacttgtttgatcacttggctgatcctgtggctaacaacgcctggtcttacgccaccaactttgtccccggaaa

SEQ ID NO: 4307 - DNA, 1436 bp, Brassica rapa
ccagaacctctacattctcctccaaggaccaagcgaatctaaatccaactctttttaaccaatcagatgtcgctgacgtgtacatctgatcatcccttctctgttataaaacccatttggtttcactcctttctcaactcacactcaactcttcaatccttctagctaagacttggataagaaatggccacgtcagcaatccagcaatcctccttcgctggccaaacggccctcaagccctccaacgatctcctccgcaaggtcggtgtctccggcggcggccgcgtgaccatgcgccgcaccgtcaagtccactcctcaaagcatctggtacggaccagaccgtcccaagtacttgggaccgttctccgagaacacaccatcctacctaaccggagaataccccggagactacggctgggacaccgccgggctctccgctgacccggagacattcgctaagaaccgtgagctcgaagtaatccacagcagatgggcaatgctgggagctctaggctgcacattccccgagattctctccaagaacggagtcaaattcggagaagccgtgtggttcaaggcaggatcccagatcttctcagaaggaggcctcgattacctcggaaaccctaacttgatccacgcgcaaagcatcttagccatatgggcttgtcaagttgtgctcatgggcctcatcgaagggtacagaatcggaggtggtcctctcggtgaaggtcttgacccgctttaccctggaggtgcgttcgacccgttgaatctggcagaggacccagaggccttcgctgagttgaaggtgaaggagctcaagaacgggcgtcttgccatgttctcgatgtttggattctttgttcaagccattgttactggtaaaggccccatcgagaacttgtttgatcatttggcggatcctgtggctaacaacgcctggtcttacgctaccaactttgtccccggaaagtaattaattatcgtatggatttgcttcaccgttttatctactttgtaaaacccattaatgtattgttcgtgtttatgtacttagtgactggctcttttcattgaatggatatttggcatatgaatgaataaaaaacaagactcaaatcttattgcacaactaaccaacgcaggtccgtaattatatccagccaatgcacattgcttgtcgccaacttaacatcttagactttcatatagtaggcagtaggcagttccatctttgtggtactcaagtcctttcagttgtggcagcttaatggattgatgcatcacatatccattcattgttcggtttcctctgttatggagtttgttcctctcccaatttcatcatctactttatgtggttttgttgcagggagtgtaatgttgtagtttagagatacttctaacactgaagttctaatcaaaaacttt

SEQ ID NO: 4308 - DNA, 1010 bp, Musa acuminata
atcgcggcatcagcactcgacttcagtccgggaaggcttcctcatcggtactccaatggctacctccgcgctccagcaatcggctttcgccggccagaccgctctgaagcagcagaacgagctcgtccgcagggtcggctcctccagaggccgcttcttcatgcgccgcacgacggcgagcacccccaagagcatctggtacgggccggaccgtcccaagtacttggggcccttctcggagcagacgccatcgtacctgacgggcgagttcccgggcgactacgggtgggacacggcggggctgtcggcggacccggagacgttcgcgaagaaccgggagctggaggtgatccacgggcggtgggcgatgctgggggcgctggggtgcgtcttcccggagatcctggccaagaacggcgtcaagttcggggaggcggtgtggttcaaggccggggcgcagatcttctcggagggcggcctcgactacctgggcaaccccaacctgatccacgcgcagagcatcctcgccatctgggcctgccaggtggtgctgatgggcttcgtggagggctaccgcgtcggcggcggcccgctgggtgagggcctcgacgccatctaccccggcggcgccttcgaccccctgggcctggccgacgaccccgacgcgttcgcggagctcaaggtgaaggagatcaagaacggccgccttgccatgttctccatgttcggcttcttcgtgcaggccatcgtgaccggcaagggccccatcgagaacctctacgaccacctcgccgaccccgtcgccaacaacgcctgggcctacgccaccaacttcgtccccggcaagtgatcatctcccgctgccttcccgcgtgcattgacgtcgtcgttgtcggtcgtcttcctctaaaatggtgggtgtaacgggacatgaagggaggctgcaatcgagccatcatgtgttgtgttgtactgtaatattgatattattagttaatggtcgacttagt

SEQ ID NO: 4309 - DNA, 945 bp, Flaveria ramosissima
tgcaatccaacagtcagcattcgccggccagccggcgctaaagccacaaaacgagctcgtcaagaagactggtggcttcaatggcggccgcttcaccatgcgccgcaccgttaaaagcgcgccacaaagcatttggtatggaccggaccgccccaagtacctaggcccattctctgagcaaaccccgtcatacctaactggtgaattcccaggtgactatggttgggacactgctggattgtcagctgaccccgagacatttgccaagaaccgtgagctcgaggtgatccactctaggtgggccatgctcggcgcactcgggtgcgtgttccccgagattcttgaaaagaatggtgtcaaattcggtgaagcagtctggttcaaggcgggttcccaaattttctcagaaggtgggcttgactacctaggaaacccaaacttgatccatgcccagagcattttagccatctgggctactcaagttgttctcatgggcctcattgaaggatacagggttggaggcggcccacttggtgaagggcttgacaagatttacccaggagggtcatttgacccacttggattggctgatgaccctgatgcatttgcggagttgaaggttaaggagcttaagaacggccgattggctatgttttcgatgtttgggtttttcgttcaagccattgtaactggaaagggcccgatcgagaacttgtttgaccatcttagtgaccctgtggctaacaacgcatgggcgtatgccaccaactttgtgcccggaaaatgagttgaatacctgtaaaccaaaaacaatggttatgcaataatattacaagattgtgtttttgtcaagaaaagattatgtatgtttgtatgtatacatacacctgccacagaaaaacaatggtttgctagaaatatgaagttacaagcctttgaaataca

SEQ ID NO: 4310 - DNA, 1155 bp, Elaeis guineensis
agccaatggcttggggcgggcgtggcagcggcctcatccactacctcctacatccctcccattaaatatctcctcgcatatcactggtggcgccactagacttccctcctaccttatcctatcaaaaactctcctctgtaatggcttctgcctccgcgttccaacgctccgctttcgctggtcagactgcgctgaagcggcagaatgagctcgtccagaaggttggcgtcttcgaaggccggatctcgatgcgccgcaccgtaaagagtgctccccagagcatgtggtatggaccggaccgacccaaatacttgggtccgttctcagagcaaacaccttcgtacctgacaggggagttcccaggggactacgggtgggacacggcggggctgtccgccgatccggagacattcgccaagaatcgagagttggaggtgattcactgtcgatgggccatgctgggcgccctgggctgcgtatttcctgaaatcctagccaagaatggcgtcaagttcggtgaggccgtttggttcaaggccggggcccagatcttttctgagggtggccttgactaccttggcaaccccaacctcattcatgctcagagcatcctcgccatctgggcctgccaggtcgtcctcatgggctttgtcgagggctaccgtgtcgggggcggcccattgggccaaggcctcgacgccatctaccctggcggcgccttcgaccccctcggcctggccgatgaccctgaagcatttgctgagctcaaggtgaaggagatcaagaacggccgcctcgccatgttctctatgttcggcttttttgtgcaggccatcgtcaccggtaagggccccatagaaaacctcttcgaccatcttgcagacccggctgccaacaatgcttgggcctacgccaccaacttcgttcctggcaagtgattcactaatgaaataagatgcttgctaccactcttctgctactcccttctattttagactctactagtggtgtgacaacgagtcaaatatatatatttatatatctgtatctatgtatattaaccactgaggttcgctctgcttgctgtaattcaatctttgtagcagttgcttgctctcttgagtgtgagttttatgcgcaaagacggaaaaaaaa

SEQ ID NO: 4311 - DNA, 971 bp, Allium cepa
gaatggcagcctctgcaattcaacggtctgcgtttgctggccaaactgctcttaagagctcgaacgaactagcccgcaaagttggatctgcaggcaatggccgcttcacaatgcgccgtactgttaaaagtgctccacaaagcatctggtatggacctgataggcccaaataccttggcccattctcggagcaaaccccatcttatctaacgggtgaatttcccggggactacggatgggacaccgcaggactatcggctgacccagagacgtttgccaagaaccgggagcttgaagtgatccactgcagatgggcaatgctcggtgctttgggttgcgtctttcccgaagttctatccaagaacggtgtcaagttcggtgaggccgtttggttcaaggctggctcccaaatcttttccgaaggcggattggactacttaggcaaccccaacttggttcatgcccaaagcattcttgcaatctgggcagttcaggttgttcttatgggattcatagagggatatagagtgggaggagggccactaggagagggactcgattcactttacccaggcggcacatttgaccctttaggtctggccgacgaccctgaggcttttgcagagttgaaagtgaaagagatcaaaaatggtcgcttggctatgacctcgatgttcggattctttgttcaagcgattgttactgggaaaggacccgtcgagaacttgttggaccatttggataacccggctgcaaacaatgcttgggcctatgctactaactttgtacccgggaaataaggagcttgtaatcatgtgcaacgtgtattagtacgaagttgatgatcaaggagtttttgttgtgtgatgattttgatgttgaatgaaaattatccgtgtgacgtgacataataataactactaaaagatccactgtacattaaaccataattaccataacaaagtcagcaa

SEQ ID NO: 4312 - DNA, 932 bp, Solanum tuberosum
tgcaaaattagcatcatctcaaagaagagaaaaaagagaggataaaatggctacttctgcaattcaacaatctgcatttgctggccaaacagcacttaagtcacaaaatgaatttattaggaaaattggtagcttcgaaggtggacgtgtcaccatgagacgtactgtcaaaagtgcaccacaaagcatatggtatggagaagacaggccaaagtacttgggaccattttctgagcaaacaccatcatacttgactggtgagttccctggtgactacggatgggacactgctggactctcagctgaccctgagacatttgctaggaaccgtgagcttgaggtgatccattgtcgttgggccatgcttggtgctttgggatgtgttttccctgaaattttgtctaagaatggtgttacattcggtgaagctgtttggttcaaggctggatctcaaattttctccgaaggtggtcttgactaccttggtaacccaaaccttatccatgctcagagcattcttgccatttgggcatcccaagttgtgttaatgggctttgtggaaggttacagagttggtggaggcccattaggtgaaggcctcgacaagatctacccggggggtgcctttgaccctcttggccttgctgatgatcccgaggcatttgctgagttgaaggtcaaggaaatcaagaatggacgattggctatgttctcgatgtttggtttctttgttcaagctattgttactggaaagggtccaattgagaacctttccgaccacattgctgatccagttgccaacaatgcttgggcttacgccacaaactttgtacccggaaaatgaatttagtactctcttaactgtaaaaattgtggggctactgcatgtcttttatgtactatgaactttgctataatatttatatgcaaaa

SEQ ID NO: 4313 - DNA, 2213 bp, Sarracenia psittacina
ttgcttactcttcttcacactatcacagaccaaccagcccattgggaatctttcatctacaacaagaagctccacagtcatggcaacctctgctatccaaaggtcagccctcatcggccagacggctctgaagccccagaatgagctcatcaggaaggttggcagctttggtggtggccgcgtcaccatgagacgcaccgtcaaaagcgttccccaaagcatatggtatggcccagaccgcccgaagtacttaggcccattctccgagcaaacaccatcatacttgacgggcgaattccccggtgactacggatgggacacagccgggctgtcagcagaccccgagacatttgccaagaaccgtgagcttgaagtgatccacagccgctgggccatgcttggtgcactcggcatcgtgttccctgaaatccttgccaagaatggtgtcaagttcggcgaggccgtttggttcaaggccggagcccaaattttctccgaaggcggccttgattacctaggcaacccaaatctcatccatgcccagagcatcctcgcgatctgggcttcccaagtagtgctcatgggctttgttgaggggtaccgggttgcggggggcccacttggtgaaggacttgacaaaatctaccctggaggagcatttgacccacttggactggctgatgatccagaagcatttgcagagctgaaggtgaaggagctcaagaatggaagactggcaatgttttcggtatttggattctttgtccaggccattgtcactggaaaaggcccaattgagaacctcaccgaccaccttgctgatcctgtggccaacaatgcatgggcttatgccactaacttcgtacctggaaaatgaagtatgaagattcgtgtaattgaatttctcactaaaacttctcgatgtaattgaatttctctgcttgaggactggaccagaaactatgtaatattacttgcagaaaatgcttatccactatctatattgtcattttttaagattgtaacttgtcactaaaatagaaaaaaaataataaaaataattgtagcttgtaacagaaattgtaagtgtttgataagatcaatgcttataactaaaattaacgacatgaagctaaaaacaaaacctaaaaactttgccaatcaccctccgtatacacaaggctcaccacaaagaagcagattgccaatcaccctcagtatacacaaggctcaccactaagaagcaaattcacatgttcactctcccgaaactgccaacaagaaaatccagtctatagagaacacaatcttaagatatatttacagacttgacaccacaataacttacagactaccatgcttgaaaccaaggaacatgagttgaagagtagtgagctatctcaaacagataattgtcaaaggatagtgtgataaggtaaagagaccaatatcactttacagatacaaacaaggaagagtaaaccagaagaggaaaatgaaaatgacagccatgagaaggattgggtacaaaacttgtgaggaagtggagatctgatccaaccaatgtctacaatgcttcgggataactgaaaaaacctttagaattttctaaatccctccgagcttccaactcaggcccgattgatggatccagcccgatcctgcacggccattctctctgatgcatcggccaaagatttgagattgcagttgattagggccttaacgaagtagcatgtatcgtctttggtgtttccatcaggtacatccaccacaaatgactcgattacaagcgtccccggtctcccatcaattatctctggatggacagtgatgattgaagagtagttcttcagcctgtgatcaccaccaacaatcctgattccaaggatgtgctcctcatcatcaaggagttccaacctttcagtgcttgtggtggccggaagccctgacttcacattcacctgtctgaggcttccaatattaagttcaccctgcatgatacatctgctgacaaagggtttatactgttgtggctgatcgaacctcctcaccaatgaccaaacaagatcaacgggggctttgatgtgcttgacaagagccgaagtgcattgattctcgttgggctcgtgcttgtggtgcctccttatgtactgaatctccatgatttctccgcgaccataaaaaacaactctctctctctctatctctct

SEQ ID NO: 4314 - DNA, 966 bp, Solanum phureja
cttcatattgcaaaattagcatcatctcaaagaagagaaaaaagagaggataaaaatggctacttctgcaattcaacaatctgcatttgctggccaaacagcactaaagtcacaaaatgaatttattaggacaattggtagcttcgaaggtggacgtgtcaccatgagacgtactgtcaaaagtgcaccacaaagcatatggtatggagaagacaggccaaagtacttgggaccattttctgagcaaacaccttcatacttgactggtgagttccctggtgactacggatgggacactgctggactctcagctgaccctgagacatttgctaggaaccgtgagcttgaggtgatccattgtcgttgggccatgcttggtgctttgggatgtgttttccctgaaattttgtctaagaatggtgttacattcggtgaagctgtttggttcaaggctggatctcaaattttctccgaaggcggtcttgactaccttggtaacccaaaccttatccatgctcagagcattcttgccatttgggcatctcaagttgtgttaatgggctttgtggaaggatacagagttggtggaggcccattaggtgaaggcctcgacaagatctacccggggggtgcctttgaccctcttggccttgctgatgatcccgaggcatttgctgagttgaaggtcaaggaaatcaagaatgggcgattggctatgttctcgatgtttggtttctttgttcaagctattgttactggaaagggtccaattgagaacctttccgaccacattgctgatccagttgccaacaatgcttgggcttacgccacaaactttgtacccggaaaatgaatttagtactctcttatctgtaaaaattgtggggctactgcatgtcttttatgtactatgaacttgctataatgtttatatgcaaaagccaagattacatattcttcaaaact

SEQ ID NO: 4315 - DNA, 961 bp, Solanum lycopersicum
atatatagttcatttcttcatattgcaaaaaaaataaaaaaatggctacttctgcaattcaacattctgcatttgctggccaaacagcacttaagtcacaaaatgaatttattaggaaaattggtagctttgaaggtggacgtgtcaccatgcgacgtactgtcaaaagtgcaccacaaagcatatggtatggagaagataggccaaagtacttgggaccattttctgagcaaacaccatcatacttgactggtgagtttccaggtgactatggatgggacactgctggactctcagctgaccctgagacatttgcaaggaaccgtgagcttgaggtgatacattgtcgttgggctatgcttggtgctttggggtgtgttttccctgaaatattgtctaagaatggtgttacatttggtgaagctgtttggttcaaggctggatctcaaattttctccgaaggcggtcttgactaccttggtaacccaaaccttatccatgctcagagcatacttgccatttgggcatcacaagttgtgttaatgggctttgttgaaggatatagagttggtggaggtccattaggtgaaggcctcgacaagatctacccggggggtgcttttgacccactgggccttgctgatgatcccgaggcatttgctgagttgaaggtcaaggaaatcaagaatggacgattagctatgttctcgatgtttggtttctttgttcaagctattgttactggaaaaggtccaattgagaacctttccgaccacattgctgatccagttgccaacaatgcttgggcttacgccacaaactttgtacccggaaaatgaacttagtacactcttttatctgtaaaaattgtgaagctactgcatgtcttttatgtaatcatatatatgcaaaagccaagactacataatcttcaaatttaatcactctgctcatttcaatt

SEQ ID NO: 4316 - DNA, 816 bp, Flaveria ramosissima
cggcggcgttgaagccacaaaacgagctcgtcaggaagaccggcggcttcaacggcggccgcttcaccatgcgccgaaccgtcaaaagtgcaccacaaagcatttggtatgggccggacaggcccaagtacttgggcccattctcggagcaaaccccatcttacctgactggcgaattcccaggtgactatgggtgggacacagctggattatcagctgaccccgagacatttgccaagaaccgtgagctcgaggtgatccactctcggtgggccatgctcggcgcactcgggtgcgtattccccgagattctcgaaaagaacggtgtcaaattcggtgaagcggtctggttcaaggcgggttcccaaatattctcagaaggtgggcttgactaccttgggaacccgaacttgatccatgctcagagcatcttagctatctgggcttgtcaggttgttctcatgggcctcattgaagggtaccgggttggtggaggcccattgggcgaagggcttgataagatttacccaggtgggtcttttgacccacttggattggctgatgacccggatgcatttgctgagttgaaggttaaggagcttaagaacggtcgattggctatgttttcgatgtttgggttcttcgttcaagccattgttaccggaaaaggcccgatcgagaacctgtatgatcatgttagcgatccggtggctaacaacgcttgggcttatgccaccaactttgttcctggaaaatgagtttgattagtgtaaatttgatgatgattatgaagtaatatcacaagttttcggctaa

SEQ ID NO: 4317 - DNA, 847 bp, Brassica juncea
gaactcacactctctctccgatccttctagctaagaaaagcaacaacacttggatcagaaatggccacgtcagcaatccagcaatcctccttcgctggccaaacggccctcaagacctccaacgatctcctccgcaaggtcggtgtctctggcggcggtcgcgtgaccatgcgccgcaccgttaagtccactcctcaaagcatctggtacggaccagaccgtcccaagtacttgggaccgttctccgagaacacaccatcgtacctaaccggagaataccccggagactacggctgggacaccgccgggctttccgctgatccagagacattcgccaagaaccgtgagctcgaagtcatccacagcagatgggcgatgctgggagctctcggctgcacattccccgagattctctccaagaacggagtcaaattcggagaagccgtgtggttcaaggcaggttcccagatcttctcggaaggaggtctcgattacctcgggaaccctaacttgatccacgcgcaaagcatcttagccatctgggcttgccaagttgtgctcatgggcttcatcgaagggtacagaatcggaggtgggcctttaggagaaggtctcgacccgctttaccctggaggcgcgttcgacccgttgaatctggcggaggacccagaggccttcgctgagttgaaggtgaaggagctcaagaacggacgtctcgccatgttctccatgtttggattctttgttcaggccattgttactggtaaaggtcccatcgagaacttgtttgatcacttggctgatcctgtggctaacaacgcctggtcttacgctaccaactttgttc

SEQ ID NO: 4318 - DNA, 933 bp, Brassica juncea
atctcatcttaactttgcctgtttctctctttcatttgtgttcttgtttggagttaaagatataaaagaatggctacttcagctatccaacactcctcttttgctggccaaacggccctcaagccctccaacgatctcctccgcaaagttggagcttccaacggtggccgcgtggtcatgcgtcgtaccgtcaagtctactcctcagagcatctggtacggaccagaccgtcccaagtacttaggtccattctcagagaacacaccgtcgtacctaaccggtgaataccccggagactacggctgggacaccgccggtctctctgccgaccctgaaacctttgcgaagaaccgtgagctcgaagtaatccacagcagatgggcaatgctaggcgctttgggctgcaccttcccagagattctctccaaaaacggagtcaaattcggtgaagccgtgtggttcaaggcaggttcccagatcttctcagaaggcggacttgactacctcggaaaccctaacttgatccacgcgcaaagcattttagctatttgggcatctcaagttgtgctaatgggtttaatcgaagggtacagaatcggaggtgggccccttggtgaaggtcttgacccgctttacccgggtggggcgtttgacccgttgaacttggccgaggatccagaggcgttctcggagttgaaagtgaaggagctcaagaacggtcggcttgccatgttctctatgtttggattctttgtccaagccattgttactggtaaaggtccgattgagaacttgtttgatcatgttgcggaccctgtggctaacaatgcctgggcttacgccaccaactttgttcccggaaaatagaatttgatcggattaatcatgtaattttttttatcttcaatttttaatgcatggaaaatatttaaa

SEQ ID NO: 4319 - DNA, 1217 bp, Brassica rapa
gacatgtccatatgctaatctccatcaagataaacacctttggatctctattataaaatcgaacaaacataacataacaccaaccatctcatcttaactttgcctgtttctctctttcatttgtgttcttgtttggagttaaagatataaaagaatggctacttcagctatccaacactcctcttttgctggccaaacggccctcaagccctccaacgatctcctccgcaaagtcggagcttccaacggtggccgcgtggtcatgcgtcgtaccgtcaagtctactcctcagagcatctggtacggaccagaccgtcccaagtacttaggtccattctcagagaacacaccgtcgtacctaaccggtgaataccccggagactacggctgggacaccgccggtctctccgccgaccctgaaacctttgccaagaaccgtgagctcgaagtaatccacagcagatgggcaatgctaggcgctttgggctgcaccttcccagagattctctccaaaaacggagtcaaattcggtgaagccgtgtggttcaaggcaggttcccagatcttctcagaaggaggacttgactacctcggaaaccctaacttgatccacgcgcaaagcattttagctatttgggcatctcaagttgtgctaatgggtttaatcgaagggtacagaatcggaggtgggccccttggtgaaggtcttgacccgctttacccgggtggggcgtttgacccgttgaacttggccgaggatccagaggcgttctcggagttgaaagtgaaggagctcaagaacggtcggcttgccatgttctctatgtttggattctttgtccaagctattgttactggtaaaggtccgattgagaacttgtttgatcatgttgcggaccctgtggctaacaatgcctgggcttacgccaccaactttgttcccggaaaatagaatttgatcggattaatcatgtaatttttttttatcttcaatttttaatgcatggaaaatatttaaatctcttgctttaatgtgcgtggtgaaagaaatatataaacctaccaaacaaaacactgcatgaacattcaaaatgtgtgccgtttgtagattctaacaccattttcgtatcgacaaaagcaagtgtccaaaaacaaagatctactaacacaaagaccgactgttctcggaaggccaaaagtaacaatacacatttttt

SEQ ID NO: 4320 - DNA, 1375 bp, Brassica napus
gccacgtcagcaatccagcaatcctccttcgctggccaaacggccctcaaaccctccaacgatctcctccgcaaggtcggtgtctccggcggcggccgcgtgaccatgcgccgcacagtcaagtccactcctcaaagcatctggtacggaccagaccgtcccaagtacttgggaccgttctccgagaacacaccatcctacctaaccggagaataccccggagactacggctgggacacagccgggctttccgctgacccggagacattcgctaagaaccgtgagctcgaagtaatccacagcagatgggcaatgctgggagctctaggctgcacattccccgagattctctccaagaacggagtcaaattcggagaagccgtgtggttcaaggcaggatcccagatcttctcagaaggaggtctcgattacctcggaaaccctaacttgatccacgcgcaaagcatcttagccatatgggcttgtcaagttgtgctcatgggtctcatcgaagggtacagaatcggaggtggtcctctcggagaaggtcttgacccgctttaccctggaggtgcgttcgaccctttgaatctggcggaggacccagaggccttcgctgagttgaaggtgaaggagctcaagaacgggcgtcttgccatgttctcgatgtttggattctttgttcaagccattgttactggtaaaggtcccatcgagaacttgtttgatcatttggcggatcctgtggctaacaacgcctggtcttacgctaccaactttgtccccggaaagtaatttaattattgtatggatttgcttcaccgttttatctactttgtaaaacccattaatgtattgttcgtgtttatgtacttagtgactggttcggttcttttcattgaatggttagttatttggaacaaaaaaaaaaaaaaaaaaccgtgaagagagcagcaatgtgtagtttgtcgacgagcctactgttaccggcaaggctcaaaccgcggttattcagacaaacggagtaaccgcagctaactcactccgttgtctaccaatggaagatcgaagatgaacgagccaaaggtcatttcgttcccatgacaagattgttggaccagcgaatcttcgaatcatcaaagttgaaagtattgtttgtaggggttgatgagaacgaagcatccaccaatgctccctagaacttacaccctcactcgacagtgacattactgactaaactaactttagctatctctcactccaattaataactcgtacagttagcgaagggtagggacaaattaagactatacagagaagaggtggtagacagagtaggaagaaagtagaaagggaaactgtacgcttactaccg

SEQ ID NO: 4321 - DNA, 1018 bp, Cleome spinosa
agcgttcactcactttgcagaatcttagatttgttctagcgtttgcgtttacaatggcggccacgtctgcgattcagaaaaccgcgtttgcagggcaaacggcccttaaccagtccaacgagttcctccgcaaggtcggcgtttccagcggcggccgcgttaccatgcgccgtaccgtcaagagtgctcctcaaagcatttggtacggaccggaccgcccaaagtacttgggacccttttccgagaacacaccgtcgtacctaacgggagaatatcccggagattacggctgggacacggctgggctctcggcagatcccgagaccttcgccaagaaccgcgagctagaagtaatccactgcagatgggcaatgctcggagccctaggctgtgtcttccctgagatcctctccaagaacggagtcaagttcggagaagccgtgtggttcaaggcaggttctcagatcttctcggaaggaggccttgattacctcggaaaccctaacctaatccatgcccagagcattctagccatctgggcatgccaggtcgtgcttatgggcttcgtcgaaggctaccgagttggaggtggccctctgggcgaagggctcgaccccctttacccgggaggagccttcgatccgctgaacctggcagaggaccccgaggctttcgctgaattgaaagtgaaagagatcaagaacggccggcttgccatgttctccatgttcggattctttgttcaggccatcgtcacgggtaaaggacccatcgagaacttgtatgatcatgtcgctgatcctgtcgccaacaatgcttgggcttatgctacaaactttgttcccggcaaatgaactgaaccgtcatgatctcttaaagcttaactgtattgtccccatgaagtgttgttgacggtgttttatgttattgtactttgctatatatatgagtactcgctgtggagttcctttcctcatgctgtttggtgtcagatctgaatatatcttatcgtttcagc

SEQ ID NO: 4322 - DNA, 1069 bp, Curcuma longa
actccacctcagtcgagctccggcggtgaaattcatggctacatcggcagtgcaccactcggcattcgccggccagaccgtgctccgccagcagagcgagctggcgcgcaaggctggcgccgccaacaaaggccgcttctacatgcgccgcaccgtcgccaccgctcccaagagcatctggtatgggccggacaggcccaagtacttgggcccgttctcggagcagacccccaagtacctgacaggggagttccccggcgactacggctgggacaccgccggcctctccgcggacccagagaccttcgccaagaaccgcgagctggaggtgatccacagccggtgggccatgctgggcgccctcggatgcgtcttcccggagattctctccaagaacggggtcaagttcggcgaggcggtgtggttcaaggcggggtcgcagatcttctcggagggcggactggactatctgggaaaccctaatttggttcacgcgcagagcatcctcgcgatctgggcctcgcaggtggtgctgatggggctggcggaggggtaccgcgtgggcggcggcccactgggggaggggctcgaccccatctaccccggcggcgccttcgacccgctgggcctggccgacgacccggacgcgttctcggagctgaaggtgaaggagctcaagaacgggaggctggcgatgttctccatgttcgggttcttcgtgcaggcgatcgtgactgggaaagggccgatcgagaacctcctcgatcacatcgccgaccccgtcaacaacaacgcctgggcgtacgccaccaacttcgtccccggcaagtgagaggatcgatttgctttcgccttcgtcgcttgctgcttccccttcgaagtcttctactcctccgtgtaacagctatgtggatggaacagttatatgctttgtatactgcttcaagtatataacgccgttttatatccgggttttaatcgctatggatgaaaacgatatatcgtctttctgtttctctcgttataccaacgagatgaagtgaatctcaaatagactgaagcaatcaaa

SEQ ID NO: 4323 - DNA, 904 bp, Euphorbia peplus
aaatcaaaaaattaaagcaatggcaacttctggaatccaacaatctgcatttgccggtcagattgctctgaagccatccaatgaccttctcagaaaggtcggcaacttaggcggtgctcgtgttgttatgcgcaggaccgtcaagagcgctcccgagagcatttggtacggaccagaccgcccaaagtacttgggaccattctccgaacaaaccccatcataccttaccggtgaattccccggtgactacggatgggacacagccggattatcagcagaccccgaaacattcgccaagaaccgtgaacttgaagtaatccactgcagatgggcaatgctcggggctctcggctgtgtcttccccgaactcctctcaaagaacggtgtgaccttcggggaagcagtctggttcaaagcaggatctcaaatcttttccgaaggtggtctagattaccttggaaaccctaacctgattcacgctcagagcatcctagcaatctgggcatgccaggttgttctgatggggttcgtggaagggtacagaattggaggaggaccattgggtgaagggcttgacccgctatatcccgggggtgcttttgatccactaggattggcagatgatccagaagcatttgcagaattgaaggtgaaagagattaagaatggaagattggcaatgttctctatgtttggattctttgtgcaggctattgtgactggaaaaggacctgttgagaatctgtatgaccacgttgctgatcccgtcgctaataatgcttgggcctttgccactaactttgtacccggaaaataaactatgtaatgtaatatattgtaatgcttgtgttgagatttgaaatcccttaggatgttcatcatctcattatgttttgtggaaagg

SEQ ID NO: 4324 - DNA, 1023 bp, Linum usitatissimum
atagcagcaacaagacacaacagaagcttcaactctttcctttttagcaatggcagcaacctctgggttccaacaatctgcattcgctggccagactaccctcaatcggtccaatgagcgtaccagaaaggttgctgctctcggtggcagccgcttcaacatgcgccgtactgtcaagagtgctccccaaagcatttggtacggagcagaccgtcccaagtacttgggtccattctcagagcagacaccatcatacctgacaggagagttcccaggtgactacggatgggacactgctggtctatcagcagacccagagacattcgccaagaaccgtgagcttgaggttatccactgcaggtgggctatgcttggtgcacttggttgtgtcttcccagaaatcctttccaagaacggagtcaagttcggtgaggcagtctggttcaaggctggagctcagatcttctccgaaggaggtctggattacctcggaaacccgaacttggtccatgctcagagcatccttgcaatctgggcttgccaggttgtgctcatgggattcgttgaaggttacagagttggtggaggacctctcggagaagggcttgacccactttatcctggtggctccttcgacccacttggcctggcagatgatcctgaggcctttgctgagttgaaggtcaaggagatcaagaatggccgcctcgctatgttctccatgtttggcttcttcgtccaggccattgttactggcaaaggtcccgttgagaacctttatgaccacattgctgaccctgtagccaacaatgcttgggctttcgccaccaactttgtccccggcaagtgagcgcaccgcaccttctatctttgtaatggcttccctaagagatagagctctgcaactactttctggaactctttttgtaaacttaagcaaatccatggaatggaactttccttttctacgcaattgtgtcgggtgcaaactccattaaatgcttagctgcatactctgcgact

SEQ ID NO: 4325 - DNA, 1085 bp, Zingiber officinale
gcaccagtctcgtccttaaccacaacaactagaactccacctcggtcgagctccggcggtaaaattcatggctacatctgcagtgcagcactcggcattcgccggccagaccgtgctccggcagcagagcgagctagcgcgcaaggctggcgccgccaacaaaggccggttctacatgcgccgcaccgtcgccagcgctcccaagagcatctggtatgggccagacaggcccaagtacttgggcccgttttcggagcagacgccctcgtacctgacaggggagttccccggcgactacggctgggacaccgccggcctctccgcggacccagagaccttcgccaagaaccgcgagctggaggtgatccactgccggtgggccatgatgggcgccctcggatgcgtcttcccggagatcctctccaagaacggggtcaagttcggcgaggcggtgtggttcaaggcggggtcgcagatcttctcggagggcggactggactatctgggaaaccctaatttggtgcacgcgcagagcatcctcgcgatctgggcctcgcaggtggtgctgatggggctggcggaggggtaccgcgtgggcggcggcccgctgggggaggggctcgaccccatctaccccggcggcgccttcgacccgctgggcctggctgacgacccggacgcgttcgcggagctgaaggtgaaggaggtcaagaacgggaggctggcgatgttctccatgttcgggttcttcgtgcaggcgatcgtgacagggaaggggccgatcgagaacctcctcgatcacatcgccgaccccgtcaacaacaacgcctgggcgtacgccaccaatttcgtccccggcaagtgagagggtcgattaggtttcgccttcgccgctcgttcgctcgctcgctgcttccccttctagtcttcaatttcttctactcgtccgtgtaacagtgtgccgatggaacagaagtatataacgccgttttatatctgggttttaatcgctgtggatgaaaacgatatttcgtctttctgtttccttgttaaaccaacgcgattaaatgaactgtgaatctcaa

SEQ ID NO: 4326 - DNA, 896 bp, Capsicum annuum
ctgcaattcaacattctgcatttactggccaaacagcacttaagtcacagaatgaatttgttaggaaaattggtagcttcggtggtggacgtatcaccatgagacgtactgtcaaaagtgccccacaaagcatttggtatggagaagacaggccaaagtacttgggaccattctctgagcaaacaccatcatacttgactggtgagttccctggtgactacggctgggacactgctggactctcagccgatcctgagacattcgctaggaaccgtgagcttgaggtgatccactgtcgatgggccatgcttggtgctttgggctgtgtcttccctgaaatcttgtccaagaatggtgtcacattcggtgaggcggtttggttcaaggctggatctcaaattttctcagaaggcggtcttgactaccttggtaacccaaaccttatccatgcacagagtattcttgctatttgggcagcccaagttgtgctcatgggcttggttgaaggatacagagttggtggagggccatttggtgaaggccttgacaagatctacccaggaggtgcctttgacccactcggcctggctgatgatcccgaggcatttgctgagctgaaggtcaaggaaatcaagaacgggcgattggccatgttttcaatgtttggtttctttgttcaagctattgttaccggaaagggtccaattgagaaccttttcgaccatgtggctgatccagtcgccaacaatgcttgggcttacgctacaaactttgtacccggaaaatgaatttagtactcgctaatctataaaaattgtgggactactgcatggttttatgtactatatatgaacttgttagtaatatatatgcaaaagcaaatattacatattttt

SEQ ID NO: 4327 - DNA, 891 bp, Phalaenopsis aphrodite
gtaatcctaagtttccaaaccacagctttcgccgctcatctctgctctctaatggccatctctgctattcaaggctccgccttcactggccagaccgccctcaagcagcccaacgagctcttccggaaggtaggttcagtcggcaatggcggccggatcaccatgcgccgcactgttaagagtgtacctcagagtatctggtacggcccagataggcccaagtacttgggccccttctccgaacaaacgccctcctatctaaccggtgaattccccggcgactacgggtgggacactgccggtctctccgccgatcccgaaaccttcgctaaaaaccgcgagctggaggtgatccatagtagatgggccatgctcggcgcactgggctgcgttttccccgagctcctctccagaaacggggtgaagttcggcgaagccgtctggttcaaggccggggcccaaatcttctcagaaggaggcctggactacctcggcaatccgaacctcatccatgcccagagcatcctagctatatgggcttctcaagtcatcctcatgggcttcgtcgaggcatatcgtgttggaggaggcccgcttggggaggggctggataagatctaccctggcggggccttcgacccattgggccttgcggatgacccggaggccttcgcggagctgaaagtgaaggaactgaagaacgggcggctggccatgttttcaatgttcgggtttttcgtgcaggctattgtgactgggaagggacctattgagaacttgtatgaccacctggctgacccaacgactaataatgcttgggcctatgcaaccaactttgtgcctggaaaatgagtgtttttttttttgttggtgtttgatttcagtgtgatt

SEQ ID NO: 4328 - DNA, 943 bp, Phalaenopsis aphrodite
gtaatcctaagtttccaaaccacagctttcgccgctcatctctgctctctaatggccatctctgctattcaaggctccgccttcactggccagaccgccctcaagcagcccaacgagctcttccggaaggtaggttcagtcggcaatggcggccggatcaccatgcgccgcactgttaagagtgtacctcagagtatctggtacggcccagataggcccaagtacttgggccccttctccgaacaaacgccctcctatctaaccggtgaattccccggcgactacgggtgggacactgccggtctctccgccgatcccgaaaccttcgctaaaaaccgcgagctggaggtgatccatagtagatgggccatgctcggcgcactgggctgcgttttccccgagctcctctccagaaacggggtgaagttcggcgaagccgtctggttcaaggccggggcccaaatcttctcagaaggaggcctggactacctcggcaatccgaacctcatccatgcccagagcatcctagctatatgggcttctcaagtcatcctcatgggcttcgtcgaggcatatcgtgttggaggaggcccgcttggggaggggctggataagatctaccctggcggggccttcgacccattgggccttgcggatgacccggaggccttcgcggagctgaaagtgaaggaactgaagaacgggcggctggccatgttttcaatgttcgggtttttcgtgcaggctattgtgactgggaagggacctattgagaacttgtatgaccacctggctgacccaacgactaataatgcttgggcctatgcaaccaactttgtgcctgggaaatgagtgttttttttttgttggtgtttgatttcagtgtgatttaatgaaatgggagcattttcttcttcgtatcttcttaaggatatgctattat

SEQ ID NO: 4329 - DNA, 866 bp, Phalaenopsis aphrodite
ctaatggccatctctgctattcaaggctctgccttcgctggccagaccgccctcaagcagcccaacgagctcttccggaaggtaggttcagtcggcaatggcggccggatcaccatgcgccgcactgttaagagtgtacctcagagtatctggtacggcccagataggcccaagtacttgggccccttctccgaacaaactccctcctatctaaccggcgaattccccggcgactacgggtgggacacagccgggctctcagccgatccagaaaccttcgctaaaaaccgcgagctggaggtgatccatagcagatgggccatgctcggcgcactgggctgcgttttccccgagctcctctccagaaacggggtgaagttcggcgaagccgtctggttcaaggccggggcccaaatcttctcagaaggaggcctggactacctcggcaatccgaacctcatccatgcccagagcatcctggctatatgggcttctcaagtcattctcatgggcttcgtcgaggcatatcgtgttggaggaggcccgcttggggaggggctggataagatctatcctggtggggccttcgacccattgggacttgcggatgatccggaggcctttgcggagctgaaagtgaaggaactgaagaacgggcggctggccatgttttcgatgttcgggtttttcgtgcaggctattgtgacggggaagggacctattgagaacctgtatgaccacctggctgacccaacgactaataatgcttgggcctatgcaaccaactttgtgcctggaaaatgagtgtttttttttggttggtgtatgatttcagtgtgacttaatgaaatgggagcattttcttc

SEQ ID NO: 4330 - DNA, 1112 bp, Cajanus cajan
gttgctgagttgtgcatatcctcatccacaatatcaacgtggcctctcacacacacttgtataaacctttgtacaaagcctcattcattcttcacaactcacaacacaagacatactctttcttgaagcacccatggccacctctgctatccagcaatcagcattcgctggtcagactgctctcaagcaggtcaatgagttcgtccgcaagaccggtggctccggcaaaggccgcactaacatgcgccgtaccgtgaagagtgctcctcagagcatttggtatggtcctgaccgtcccaagtacttgggaccattctctgaccagattccatcctacctgaccggcgaattccccggcgactacggctgggacaccgccgggttatccgccgacccggagaccttcgcgaggaaccgtgagctggaggtgatccacagcagatgggccatgcttggtgcccttggatgcaccttcccagagatcctcgagaagaacggtgtcaagtttggtgaggcagtgtggttcaaggctggtgcacaaatcttctctgagggaggccttgactacttgggcaacccaaacctcatccatgcccaaagcatccttgccatctgggccgtccaggttgtgctcatgggctttgttgaaggctacagagttggtggcgggcctcttggtgaaggccttgaccccatctaccctggtggggcctttgaccctcttggcctcgctgatgaccctgatgcgtttgctgagttgaaggttaaggaactcaagaatggtcgcttggccatgttctccatgtttggcttcttcgttcaggccattgtcactggcaagggccccattcagaacctcttcgaccatgttgctgatcctgttgccaacaatgcttgggcttatgccactaactttgtccctggacaatgaggattcaggatgccaacaacattatgcaatcttctgcttttcatcttccgcttttaactaatgtaactacatcagcagaagaatctgtgtcagaatcactatatattagaaatttgggtccccagaaattcagaatattaatcattgagttgtcttattctatggttttctatttttccca

SEQ ID NO: 4331 - DNA, 773 bp, Silene vulgaris
ctgctatccaacaatcagcattcgccggccagaccgccttgaagcagtccaatgagcttgtccgcaaggttggatatgtcggaggcggcagattcaccatgaggaggacggtcaaatctactccccagagcatctggtacggtccagatcgcccaaagtacttgggaccattctctgagcaaacaccatcatacctgactggtgaattccccggtgactatggctgggacactgctggtttatccgcggaccccgagacattcgccaagaaccgtgagcttgaggtgattcacagcagatgggcaatgcttggcgctcttggctgtgtcttccctgaaatcctttccaagaatggtgtgaagttcggtgaggctgtttggttcaaggctggtgctcaaatcttctccgaaggtggtcttgactatctcggaaaccctaacctcattcatgctcagagcattttggcaatctgggcttcccaggttgtgctgatggggtttgttgaaggatacagaattggtggaggacctcttggtgaaggacttgacccactttaccccggtggtgcttttgacccacttggattggctgatgatcctgaccaattcgctgagttgaaggttaaggagctcaagaatgggcgcctggctatgttctccatgtttggattctttgttcaggctattgtcaccggaaagggtcccattgagaacctcgtcgatcacgttgctgatccagtggccaacaatgcgtgggcttatgctactaacttt

SEQ ID NO: 4332 - DNA, 1080 bp, Glycine max
gttgctgagttgtgcatatcctcatccacagtatcatacgatcttctataaacctttgtagtagctttcttcattctccacaacacagaacaaaaacaaagaaaaaaaaaaacccttagccaacacaaccatcatggccacctctgctattcagcaatcagcattcactggtcaaactgctctgaagcagctcaatgagttcgtccgcaagaccggtggcgccggcaaaggtcgcactaacatgcgccgcaccgtcaagagtgctcctcagagcatttggtatggccctgaccgtcccaagtacttgggtccattctcggagcagattccatcatacctgaccggagaattccctggtgactacggatgggacactgctggattatcagctgacccggaaaccttcgccaggaaccgggagctggaggtgattcacagcagatgggcaatgcttggtgcccttggctgcaccttcccagagatccttgagaagaatggtgtcaaattcggcgaggccgtgtggttcaaggccggtgcacagatcttctcagagggaggccttgactacttgggcaacccaaacctgatccatgctcagagcatccttgctatctgggctgttcaggttgtgctcatggggtttgttgaaggttacagagttggtggaggaccacttggtgaaggacttgacccaatctaccctggtggtgcttttgaccctcttggtctggctgatgaccctgatgcattcgctgagttgaaggtcaaggaactcaagaacggtcgcttggctatgttctccatgtttggtttctttgttcaggctattgtcactggcaagggccctattcagaacctttacgaccacgttgctgatcctgttgccaacaatgcttgggcttatgccactaactttgtccctggacaatgaggatgcctacatgcaatgcaatcttctgctcccttttgcagttcccttgtgtttaactccattttcactaatgtaactacacctgtgtagcagaaaaatctgtatgagaaccattatatttttatatattagaaatttgggtccccaga

SEQ ID NO: 4333 - DNA, 1322 bp, Glycine max
taagagccactatagcatgacaaaatatcagcatgagaatccacatccaaatccacgaccaatgaggtgttgctgagttgtgcatatcctcatccacagtatcatacgatcttctataaacctttgtagtagctttcttcattctccacaacacagaacaaaaacaaagaaaaaaaaaaacccttagccaacacaaccatcatggccacctctgctattcagcaatcagcattcactggtcaaactgctctgaagcagctcaatgagttcgtccgcaagaccggtggcgccggcaaaggtcgcactaacatgcgccgcaccgtcaagagtgctcctcagagcatttggtatggccctgaccgtcccaagtacttgggtccattctcggagcagattccatcatacctgaccggagaattccctggtgactacggatgggacactgctggattatcagctgacccggaaaccttcgccaggaaccgggagctggaggtgattcacagcagatgggcaatgcttggtgcccttggctgcaccttcccagagatccttgagaagaatggtgtcaaattcggcgaggccgtgtggttcaaggccggtgcacagatcttctcagagggaggccttgactacttgggcaacccaaacctgatccatgctcagagcatccttgctatctgggctgttcaggttgtgctcatggggtttgttgaaggttacagagttggtggaggaccacttggtgaaggacttgacccaatctaccctggtggtgcttttgaccctcttggtctggctgatgaccctgatgcattcgctgagttgaaggtcaaggaactcaagaacggtcgcttggctatgttctccatgtttggtttctttgttcaggctattgtcactggcaagggccctattcagaacctttacgaccacgttgctgatcctgttgccaacaatgcttgggcttatgccactaactttgtccctggacaatgaggatgcctacatgcaatgcaatcttctgctcccttttgcagttcccttgtgtttaactccattttcactaatgtaactacacctgtgtagcagaaaaatctgtatgagaaccattatatttttatatattagaaatttgggtccccagaaaatatcaactcttacgtttggaattcaagttaactagttcaaacgttgaaaccatgttcaaggaatctatctattagtgatgtacgtgccttgtacaccatccaattcaaagccatgattaaaaccataaacgaatgaatccatcttccattaccaacaacatccaaagccca

SEQ ID NO: 4334 - DNA, 1335 bp, Eutrema parvulum
aagaatcgacattaaacataaacatctctcacttatttcttcttcatctgtgtttttgtttggagttaaaagataagaaaaagaatggctacatcagcaatccaacactcctccttcgccggccaaacggccctgaagccctccaacgatctccttcgtaaagtcggagcgtccaacggcggtggccgcgtcgtcatgcgtcgtaccgtcaagtctactcctcagagcatctggtatggaccagaccgtcccaagtacttaggaccattctcggagaacacaccgtcatacctaaccggagaataccccggagactacggctgggacacggccggtctctccgccgacccagaaaccttcgcaaagaaccgtgaactcgaagtaatccacagtagatgggcaatgttaggcgctttaggctgcatctttccagagattctctccaaaaacggtgtcaaattcggtgaagccgtgtggttcaaggcaggatctcagatattctcagaaggagggcttgattacctcggaaaccctaacttgatccacgcgcaaagcatattagctatatgggctgctcaagttgtgctgatgggattgattgaagggtacagaatcggaggtggacctcttggtgaaggtcttgaccctctttacccgggtggggcgtttgacccgttgaacttagctgaggatccagaagcgttttcggagttgaaagtgaaggagctcaagaacggtcgtcttgcaatgttctcgatgtttggattctttgttcaagccattgtcactggaaaaggtccgatcgagaatctgttcgatcacgttgcagaccctgtggctaacaatgcctgggctttcgccaccaatttcgttcccggaaaatagaatttgaccggatgaaatttatgtattttattttcaaacattgaatgaatggaaatattcgatgttctcacttggtgaaagaaattctcgttagctttgaagtctttgtcttgtgttgtgtcatttgatcttagaaacttgtgaaacggccaagacattagcatcctgtcagtatccaaattcatcgattttcgatctaattttttctacaattgttctgtaataaatggtaaaactagaacacgtaatagagttccaagattccaatcatagcaaaaaagaagaaaaatataaatctaccaaaaaaacattgcataaagttgcaaaatgtgtgccgtttgtagattccacaccatttttcgtctcgacttaagcaagtgtccacgtccaactatgtatgtacaacagaagacgaaactgttatagaagattataactgaaaaaaccaaa

SEQ ID NO: 4335 - DNA, 936 bp, Vinca minor
aatttaccaaaaagaatagtaaattttgatcatggcagcctcaggtattcaacaatctgcatttgctgggcagactcttctgaagtcccagaatgagctcatcagaaaggttggaaacgttggtggtggccgttttaccatgaggagaactgtaaaaagtgctccacaaagcatttggtatggagcagatcgtcccaagtacttgggcccattctccgaacaaaccccatcatatctcactggcgaattccctggtgattacggatgggacactgctggactttccgccgatccagagacattcgccaagaaccgcgagctggaagtgatccactgccgctgggcaatgctaggagctttgggatgtgtcttccccgaaatcctttccaagaacggtgtcaagtttggcgaggcagtttggttcaaggccggatctcaaatcttctccgagggtggtctcgactacctcggcaacccaaacctcatccatgcacaaagcatccttgccatttgggcttctcaagttgttctcatgggcttgattgaaggatacagagtcggaggaggcccgctcggcgaaggactcgacaagatctacccaggaggatcttttgacccattgggattagctgatgatccagaggcctttgcagagttgaaggtgaaagagatcaagaatggtagattggcaatgttctcaatgtttggatactttgttcaagctattgttactggaaaaggcccaattgagaatctttatgaccatcttgctgacccagttgccaacaatgcttgggcttatgccacaaactttgtacctggaaagtgagaaaaaaaacccttcaaactttcctcttgtgaatttggaaaaaacaattgatgtaattttcaatggatgatcccataattttatctctgatgacttgaatgttactt

SEQ ID NO: 4336 - DNA, 853 bp, Flaveria ramosissima
tctcttcagtcttcacagcctcaaatggcaacctctgcaatccaacagtcagcattcaccagccagccggcattgaagccgcaaaacgagctcgtcaagaagaccggcggcttcaatggcggtcgcttcaccatgcgccgcaccgttaaaagcgcgccacaaagcatttggtatggaccggaccgccccaagtacttgggcccattctctgagcaaaccccatcatacctaactggtgaattccctggtgactatggttgggacactgctggattgtcagctgaccccgagacatttgccaagaaccgtgagctcgaggtgatccactctaggtgggccgatgcttggcgcactcggtgcgtgttccctgagattcttgaaagaacggtgtcaaattcggtgaagcggtctggttcaaggcgggttccaaatttctcagaaggcgggcttgactacctagggaacccaaacttgatccatgcccagagcattttagctatctgggcttctcaagttgttctcatgggcctcattgaggatatcgggttggtggtggcccacttggtgaagggcttgacaagatttacccaggaggctcatttgacccacttggattggctgatgacccagatgcatttgcggagttgaaggttaaggagcttaagaacggccgattggctatgtttccatgtttgggtttttcgttcaagccattgtaactggaaagggcccgatcgagaacttgtttgaccatcttagtgaccctgtggctaacaacgcatgggcgtatgccacctaactttgtgcccggaaaatgagttgaatacctgtaaaccaaaaacaatggtatatt

SEQ ID NO: 4337 - DNA, 1079 bp, Platanus occidentalis
acaccaaacagcaaaacagagaagcaaaagaagaaccaccaacaggaaagaagcactagggagtcatggccacctctgcaatccaaagctcagcattcaccggccagacggctttgaagcagcagaatgagcttgtccggaaggtcggcgtctccggcggtcgcatctccatgcgccgcactgtaaagagtgttgcccagagcatgtggtacggcccagaccgcccaaagtatttgggcccattctctgagcaaactccatcatacctgactggtgaattccctggtgactacgggtgggacaccgctgggttgtcagcagacccggagacatttgcgaagaaccgtgagctcgaggtgatccactgccgatgggccatgctcggtgcacttggttgtgtcttccctgaaattcttgctaagaatggtgtcaaattcggtgaggcagtatggttcaaagccggggcccagatcttctctgaaggtgggcttgactaccttggcaacccaaacctggtccatgctcaaagcatccttgcaatctgggcttgccaagttgttctcatgggctttgttgagggatacagagttggtgggggcccacttgggaaggtttggatgcaatttacccgggtggggcatttgacccgcttggattggctgatgatccagaggcttttgccgaattgaaggtgaaggagatcaagaacggaaggctggcgatgttctccatgtttggtttctttgttcaggctattgtcactggaaagggtccaattgagaacctctttgaccacctcgcagacccggcggccaacaatgcatgggcttatgctaccaactttgtccccggaaagtaaaagtgactagaatgtatcccggctatatcactatttaggattgtgtttgggtttgggtttgttctactgattcctagctgtggatttgatcattaaatatgtaatttactagtagaaatgtgcttaacttgtattgctactaaagagtcagaaacactaaatctacagctttaatcttatagtcttactgttttcaataactatgggtgtgataatgatt

SEQ ID NO: 4338 - DNA, 1177 bp, Podocarpus macrophillus
caatttccatatatggaggtaatttatgatagaaacactggggcattgcaggaggctacaacacactgcttatctgaatcattatcttcctacaaaccaatattctgcaacaatggctgcagcatcagcgtttcagatgtcaagttttgcagggaaatctcttttttctcctcagaacgagctcgtcagaaaggtgggcacttcacagggccgagtcttcatgcgtaggacagtcaagagcgccccgcagagcatttggtatgggccggatcgtcccaagtacttgggtcccttctcggagcaaactccctcgtacctaactggcgaattccctggtgactacggatgggatactgctggtttatccgccgacccagaaactttcgccaagaatagagagctggaagtcatccactgcagatgggcaatgctgggcgccctgggctgtgtcttcccagaaattcttgccaaaaatggtgtcaaatttggcgaagctgtgtggttcaaggctggcgcccagatcttctctgaaggtggtctggattatctggggaatcccaatcttatccacgcccagagcattcttgctatatgggcatgccaggtggtgctgatggggctcattgagggctacagagttggaggcggaccccttggagaagggttggaccctctctacccgggtggtgcgtttgatccgttgggcttggctgatgatcccgagcaattcgcagagctgaaggtgaaggagatcaagaatgggagattggccatgttttcgatgtttggattcttcgtgcaggcgattgtcactggtaaagggccgatcgagaacctgttcgatcatctggccgatccagctgccaacaatgcatgggcctatgctacaaattttgtacccgggaaatgaagtgcccaacctcaagctgtaccatagtctcaaggatccagcttttatcattactgtgtgaataaagatttggatggggcagtgttgtttcaggagctatcattattcttgttttaataataatagtggtataagaaggttgttaaagcttgtttttctctccttttggtcgttgaggaatggaagtggtaggacaacattttctagggtagatttgtaaagtgaaggtgcatgaatgtactttagttttcacacataaggataaga

SEQ ID NO: 4339 - DNA, 1065 bp, Tamarix hispida
ggggatcgctcaaccacaaatatagggagcatcttcagctcagagaaaacacagcacagtcgatcggcatcacatcttttacaggacagaagagaacatggcaacctcagcaatccaacaatctgcattcgcaggtcagaccatcctgaagcaacaaactgagctcctgcgcaaggtaggtggcaacggtggccgtgtttccatgaggagaacagtcaaaagtgctccagaaagcatctggtacggtccagaccgtcccaagtatttgggtcctttctcggagcaaactccatcgtaccttactggtgaattcccaggagactatggatgggacactgctggattgtcagctgaccctgagacattcgccaggaaccgtgagcttgaagttattcactgcaggtgggcgatgcttggtgccctgggctgtgtgttcccggaaatcctttccaagaatggtgtgaaatttggtgaggcagtatggttcaaggctggtgctcaaatcttccaagagggtgggttggactaccttggcaacccaaatctgatccatgcccaaagcattctggcaatctgggcttgccaagttgtgcttatgggtcttgttgagggatacagagtttctggaggtccattgggtgaaggacttgaccagatctatccaggcggagctttcgacccacttggactggcagatgaccccgaagccttcgctgagctcaaagtcaaggagatcaagaatggaaggcttgcaatgttctccatgtttggtttctttgtccaggcaattgtcaccggaaaggggccagttgagaacctcttcgaccatgttgctgacccagttgcaaacaatgcatgggcatatgccacaaacttcgtccctgggaagtgaacagtataaggtagatcatattagtccctgcagtaacctgctttttatatttcgctccctttaactttgttcatggaatagaatgagtttactctaagcgtctgaggtccgtacttgttgcagcgaagagataagtaaaattctgcccttttaacaagctcagctaaaaaaaa

SEQ ID NO: 4340 - DNA, 1156 bp, Phaseolus vulgaris
ctcatccacaacccttctataaacatttctactaaccttcttcattctccacaacacactcacaaaaccacagaaagaagaacctttgccaacacaacagagccatggccacctctgctttccagcaatcagcattcgctggtcaaacagctctgaagcaggtcaatgaattcgtccgcaagaccggtggctccggcaaaggtcgcaccaacatgcgccgtaccgtcaagagtgctcctcagagcatctggtatggccctgaccgtcccaagtacttgggaccattctctgagcagattccatcatacctgactggtgaattccctggtgactacggatgggacacagctggattatcagctgaccctgaaacctttgccaggaaccgtgagttggaggtgattcacagcagatgggccatgcttggtgctctgggatgcaccttcccagagatccttgagaagaatggtgtgaaattcggtgaggcagtgtggttcaaggctggtgcacagatcttctctgagggagggcttgactatttggggaacccaaacctggtccatgctcagagcattcttgccatctgggctgttcaggttgtgctgatggggtttgttgaagggtacagagttggtggaggacctcttggtgaaggcctagaccctgtctaccctggaggttcctttgaccctcttggtcttgctgatgaccctgatgcatttgctgagttgaaggtcaaggaactcaagaatggtagattggccatgttctccatgtttggtttctttgttcaggccattgtcactggcaagggccctattcagaacctctacgaccatgttgctgaccctgttgccaacaatgcttgggcttatgccaccaactttgtccctggacaatgatcatgtctttttagatgcaatgcaatcttctgctcctgaagaatctgcatgagaacaattatatatatccctgaaatatcaaactcttgacttgtgttgttatatggttttctattttccacataacctgaactgaacaaacttttcctaaatgttaattagttcaaacattgaaaccatgttgaaggaatctatcagtgatgtaccaagaacaccatccaacgattaagaacataaaagaatgaatccgcatc

SEQ ID NO: 4341 - DNA, 2167 bp, Arabidopsis lyrata
ttataaaacacaattggtttcaccatctcaccataactcaacactctctcttatctcctttcctttcattgtagtttaagaaaagattacgataatggcaacatcagctatccagcaatcctccttcgccggccaaacggccctcaagccctccaacgacctcctccgcaaggctggtgtttccggtggtggccgtgtgaccatgcgtcgtaccgtcaagtctactcctcaaagcatctggtatggaccagaccgtcccaagtacttgggtccattctcggagaacacaccgtcgtacttaaccggagaataccccggagactacggctgggacaccgctggactctcggctgacccggagacattcgctaagaaccgtgagcttgaagtaatccacagcagatgggctatgttgggtgctcttggatgcacattccctgagattctctccaagaacggtgttaaattcggagaagccgtgtggttcaaggcaggttctcagatcttctcagaaggaggtcttgattaccttggaaaccctaacttgatccacgcgcaaagcatcttagccatctgggctgttcaagttgtgctcatgggtttcattgaaggttacagaatcggaggtggaccactcggagaagggcttgacccactttacccaggaggtgcgtttgacccattgaacttggcagaggatccagaggccttctctgagctgaaggtgaaggagctcaagaacggtcgtcttgccatgttctctatgtttggattctttgtccaagccattgttactggtaaaggtcccattgagaacttgtttgatcatttggctgatcctgtggctaacaacgcctggtcttacgctactaactttgtccccggaaagtaattatcttatgtatttgcttcataatctctgtgctttgtaaactcgtgaatgtgtaatattaatgttttatgtgaatttggtttggttttttttattcattgcacatttgggtttggaaagtgccaaaatcacatgacaggttcatgtaatatcttagtaaaattatctggaccatacaaaacaaatgtgcaaatgagtggttgacaaaatttgtgtaaaataaatacagctaaaatcgattaaatacaacatttcgaacaatgaacaattgcatttttttatataaagttagctgaaagcattttgagctaagaatgtaagtctattcaccactaatacacctaagttgcgaaaacctgagctcaattttctccaactctagtgctatatcattagaattctcattcttcatcacgagaggctctatgatcttattaacatctccacgcaagaagcaatgcctcaacaatgtgaaagcgttttttctcttgtcagtctccgccgcaaaacaactcatcacaaagagttttgcatcacaaggaatatctttcggaatcaatggcatgtaacctttcttgagatcttccaagtcatagtttttatcccaccatggtctctattcccagtgtacatctccaacaccacacatcctaacgaccataaatccaaacctctccttgtctcgcccgtagaaatggattccggcgacatatatatcggtgttcccgcaaaaggatgactaggaagccaccagttgttatctccctctcttttggacaacccgaaatcagaaatctttaactcgaaactcgggaaaacgaggatgttttcgggtttgagatcgcagtgaacatagccgtgtccatgaataactgctaaaccctcaagaatcatacgcgtaaaccttctgatcaaaggatcaggcaatttcatttccttgaatctgctcataaaatttctcaagcttcctccagatgcgtactccatgtgaatcttgaactctacgtcaccgtcgtcggtgattctctcttctactttggtcccatagcattggacgattcttgaacatcctttgaattcggacaagatctgaaactctttgtagagagtgtcagcgtgaatgatgttggaggttttcacggcggcgtaaagcgtttcaccgtcgcggcgtccattgtacttgatgagactcaccgaaccggacgaaccttttccgagaaccttgttgagttctaactctgccctcaactttggaacagacagatcaattctcat

SEQ ID NO: 4342 - DNA, 872 bp, Arabidopsis lyrata
ttatttctttgtgtttttgtttggagtttaaaaaaaaaaagaatggcaacttcagcaatccaacactcctctttcgccggccaaacggccctgaagccatccaacgatctcattcgtaaggtcggagcctccaacggtggaggccgtgtcgtcatgcgacgtaccgtcaagtctactcctcagagcatctggtacggaccagaccgtcccaaatacctaggaccattctcggaaaacacaccatcatacctaaccggagaataccctggagactacggctgggacaccgccggtctgtcagccgatccagaaacattcgcaaagaaccgtgagcttgaagtaatccacagtagatgggcaatgttgggtgcattaggctgcacattcccagaaattctctccaaaaacggagtcaaatttggtgaagccgtgtggttcaaggcaggatcacagatcttctcagaaggaggacttgattacctcggaaaccctaacttgatccacgcgcaaagcatattagctatatgggcttgtcaagttgtgctaatgggattcattgaaggttacagaatcggaggtgggcctcttggtgaaggacttgacccactttaccctggcggagcgtttgacccgttgaacttagcggaggatccagaggcgttctcggaattgaaggtgaaggagctcaaaaacggtcgtcttgcgatgttcccaatgtttggattctttgttcaagccattgttaccggtaaaggtccgatagagaatctgttcgatcacattgcagaccctgtggctaacaacgcttgggcttacgccaccaactttgtccccggaaaatagagtttgatcggataatttatgtaaattat

SEQ ID NO: 4343 - DNA, 1063 bp, Arabidopsis thaliana
tcgataactcacactctctcttcaatcctttcctttcattgtagttaaacaaagattacgattatggccacatcagctatccaacaatcctccttcgccggccaaacggctctcaagccctccagcgacctcatccaaaaggtgggcgtcttgggcggtggccgtgtgaccatgcgtcgtaccgtcaagtctactccccaaagcatctggtatggaccagaccgtcccaagtacttgggaccattctcggagaacacaccgtcttacttaactggagaataccccggagactacggctgggacaccgctggactctcggctgacccggagacattcgctaagaaccgtgagcttgaagtaatccacagcagatgggctatgttgggtgctctcggatgcacattccctgaaattctctccaagaacggtgttaaattcggagaagccgtgtggttcaaggcaggctctcagattttctcagaaggaggtcttgattacctcggaaaccctaacttgatccacgcgcaaagcatcttagccatctgggctgttcaagttgtgctcatggggttcattgaaggctacagaatcggaggtggaccactcggagaaggacttgacccgctttatcccggaggtgcgttcgacccattgaacttggctgaggatccagaggctttctctgagctgaaggtgaaggagctcaagaacggtcgtcttgccatgttctctatgtttggattctttgtccaagccattgttactggtaaaggtcccattgagaacttatttgatcatttggctgatcctgtggctaacaacgcctggtcttacgctactaactttgtccccggaaagtaattatcttatgtatttgcttcataatctctctgctttgtaaactcgtgattgtgtaatattgacgtttgatgtgaatttggcacttaatgatgtttcttgggacttgattttttttatttattggcaagagtcaaaatcacatgacaggttcatataagctgagcgaatattagatttacctggaccatacataaacaatttt

SEQ ID NO: 4344 - DNA, 1168 bp, Arabidopsis thaliana
gttataaaaccatattggtttcaccatctcatccataactcacactctctcttatctcctttcctttcattgtagttaacgaaaagattacgataatggcaacatcagctatccagcaatcctccttcgccggccaaacggctctcaagccctccaacgaactcctccgcaaggttggtgtatccggtggtggccgtgtgaccatgcgtcgtaccgtcaagtctactcctcaaagcatctggtacggaccagaccgtcccaagtacttaggaccattctcggagaatacaccgtcctacctaaccggagaataccccggagactacggctgggacaccgctggactctcggctgacccggagacattcgctaagaaccgtgagcttgaagtaatccacagcagatgggctatgttgggtgctctcggatgcacattccctgagattctctccaagaacggtgttaaattcggagaagccgtgtggttcaaggcaggttctcagattttctcagaaggaggtcttgattacctcggaaaccctaacttgatccacgcgcaaagcatcttagccatctgggctgttcaagttgtgctcatggggttcattgaaggctacagaatcggaggtggacctctcggagaagggcttgacccgctttaccccggaggtgcgttcgacccattgaacttggctgaggatccagaggctttctctgagctgaaggtgaaggagcttaagaacggtcgtcttgccatgttctctatgtttggattctttgtccaagccattgttactggtaaaggtcccattgagaacttatttgatcatttggctgatcctgtggctaacaacgcctggtcttacgctactaactttgtccccggaaattaattatcttatgtatttgcttcataatctctctgctttgtaaagtcgtgaatgtacttattggtgttttatgtgagtttggtacttaatgatttttattttgtgggtacttttttttgaatcgtgatgaaagattttgtttcacagatgcaggtgagtttgttttggcaccagaaaaaacctttaatgaaccacaccaccctgttatgttctctgttattatccgtaaaagtaggcctggacacggaacggatattcgaaaaaattatgatatttgt

SEQ ID NO: 4345 - DNA, 951 bp, Arabidopsis thaliana
catctcattctcacttacttcttttctttttttgtgttcttgtttagaagaagcaatggccacttcagcaatccaacactcttctttcgctggccaaacgaccctaaagccatccaacgatctcctccgcaaaatcggagcctccaatggcggtggccgcatcatcatgcgtcgtaccgtcaagtctactcctcagagcatctggtacggaccagaccgtcccaaatacctaggaccattttccgaaaacacaccatcatacctaaccggagaataccctggagactacggttgggacaccgctggtctctcagccgatccagaaacattcgcaaagaatcgtgagctcgaagtgatccacagtagatgggcaatgttgggagctttaggctgcaccttccctgaaattctctcaaaaaacggagtcaaattcggtgaagccgtgtggttcaaggcaggatctcaaatcttctcagaaggagggcttgactacctcggaaaccctaacttgatccacgcgcaaagcatattagctatatgggcgtgtcaagttgtgctaatgggattcattgaagggtacagaatcggaggtggtcctcttggggaagggcttgacccgctttacccgggcggggccttcgacccgttgaacttagcggaggatccagaagcgttttcagagttgaaagtgaaggagcttaaaaacggtcgtcttgctatgttctcaatgtttggattctttgtccaagccatagttaccggtaaaggtccgatcgaaaatctgttcgatcacattgcagaccctgtggctaacaatgcttgggcttacgccaccaacttcgtccccggaaaatagagtttgatcggataatttatgtaaattatatcttttaaacatttatcaatgcattaaagttatccctatatttgatacatcggttccattttttt

SEQ ID NO: 4346 - DNA, 1288 bp, Brassica juncea
tctttgcttcatttgtgtttctgtttggagttgagataatatataagaatggctacgtcagcaatccagcactcctctttcgctggccaaacggctctaaagccctccaacgatctcctccgcaaagtaggagcttcgaacggcggtggccgcgtcgtcatgcgtcgtaccgtcaagtctactcctcagagcatctggtacggaccagaccgtcccaagtacttaggaccattctcggagaacacaccatcgtacctaaccggagaataccccggagactacggttgggacacagccggtctctcagctgacccagaaacattcgcaaagaaccgtgagctcgaagtaatccacagcagatgggcaatgctaggagcattaggctgcaccttcccagagattctctccaaaaacggtgtcaaatttggtgaagccgtgtggttcaaggcaggttctcagatcttctcagaaggagggcttgattacctcgggaaccctaacttgatccacgcgcaaagcattttagctatctgggcttctcaagttgtgttgatgggtttgattgaagggtacagaatcggaggtggacctcttggtgaaggccttgacccgctttacccgggtggggcgtttgacccgttgaacttagccgaggatccggaggcgttttcggaattgaaggtgaaggagctcaagaacggtcgtcttgcaatgttctcgatgtttggattctttgtccaagctattgttactggtaaaggtccgatagagaatctgttcgatcatgttgcggaccctgtggctaacaatgcgtgggcttacgccaccaacttcgttcccggaaaatagaactggatcagacaaatttgtgtgttttatctttaaaatttagtgcatggacatatttggtctgttggtttaatgttcttggattggtgaaagaaattctcaagccttcttttgtgtcattaatctagaaatgtgttactatccaaatccatcgagtttcaatctcattgttctacaattggtctttgataaatgttaaaactagaacaaataatatagttccaagattccgatcctagcaaacaataatgatataaatctagctaacaaaacattgcgtaaatttccaagatgctttgccgtttgtagattccacactatttttcgtctcaactaaagcagtctccaagtacacatgtgtatatacaacagaagtcgaactgttatagaaactaagaactgaaaaccaaagaccaaaccactgttcttggaaggccaa

SEQ ID NO: 4347 - DNA, 1044 bp, Brassica juncea
agtacgcggggatctcatcttaactttgcctgtttctctctttcatttgtgttcttgtttggagttaaagatataaaagaatggctacttcagctatccaacactcctcttttgctggccaaacggccctcaagccctccaacgatctcctccgcaaagttggagcttccaacggtggccgcgtggtcatgcgtcgtaccgtcaagtctactcctcagagcatctggtacggaccagaccgtcccaagtacttaggtccattctcagagaacacaccgtcgtacctaaccggagaataccccggagactacggctgggacaccgccggtctctccgccgatccagaaaccttcgcaaagaaccgtgagctggaagtaatccacagcagatgggcaatgctaggcgctttaggttgcacattcccagagattctctccaaaaacggagtcaaattcggtgaagccgtgtggttcaaggcagggtctcagatcttctcagaaggagggcttgattacctcggcaaccctaacttgatccacgcgcaaagcatattagcaatctgggcttctcaagttgtgctgatgggtttaatcgaagggtacagaatcggaggtggacctcttggtgaagggcttgacccgctttacccgggtggggcgtttgacccgttgaacttagcggaggatccggaggcgttttcggaattgaaagtgaaggagcttaaaaacggtcggcttgctatgttctccatgtttgggttctttgtccaagccattgtcaccggcaaaggaccaatcgagaatctgtttgaccatcttgcggaccctgtggctaacaatgcctgggcttacgccaccaacttcgtccccggaaaatagaatattatctgataatgtatgtttttaaaacaattaatgtatgtctgttggtttgatgttctgtcttaatgaaagaaatcatcgttagcttgaggcccttgtcttgtattgatctagaaaatttgcgaactgctcagacatacatcatcgaatttcaatctcattt

SEQ ID NO: 4348 - DNA, 1001 bp, Brassica juncea
tcttcatttgtgtgtttgcttggagttagagataaacaagaatggccacatcagcaatccaacactcctcttttgccggccaaacggccctgaagccctccaacgatctcctccgcaaagtcggagcttccaacggtggtggtcgcgtcgtcatgcgccgtaccgtcaagtctactcctcagagcatctggtacggaccagaccgtcccaagtacttaggaccattctcagagaacacaccatcgtacctaaccggagaataccccggagactacggctgggacaccgccggtctctccgccgaccctgaaacctttgccaagaaccgtgagctcgaagtaatccacagcagatgggcaatgctaggcgctttgggctgcaccttcccagagattctctccaaaaacggagtcaaattcggtgaagccgtgtggttcaaggcaggttcccagatcttctcagaaggaggacttgactacctcggaaaccctaacttgatccacgcgcaaagcattttagctatttgggcatctcaagttgtgctaatgggtttaatcgaagggtacagaatcggaggtgggccccttggtgaaggtcttgacccgctttacccgggtggggcgtttgacccgttgaacttggccgaggatccagaggcgttctcggagttgaaagtgaaggagctcaagaacggtcggcttgccatgttctctatgtttggattctttgtccaagccattgttactggtaaaggtccgattgagaacttgtttgatcatgttgcggaccctgtggctaacaatgcctgggcttacgccaccaactttgttcccggaaaatagaatttgatcggattaatcatgtaattttttttatcttcaatttttaatgcggatgccttgtcttctcttgtgtcattgatccagagatttgttaactcagacattactatccttctacaattgctctttgataaatatgataaaactagaacaaataaa

SEQ ID NO: 4349 - DNA, 1065 bp, Brassica juncea
ttgcggggatctcatctcatctcatctcatatttgcttattttctctctttacttgtgtttctgtttggagttgagataaacaagaatggccacatcagcaatccagcactcctctttcgccggccaaacggccctgaagccatccaacgatctcctccgcaaagtgggaccttccaacggcggtggtcgcgtcgtcatgcgccgtaccgtcaagtctactcctcagagcatctggtacggaccagaccgtcccaagtacttaggaccattctcagagaacacaccatcttacctaaccggagaataccccggagactacggctgggacaccgctggtctctcagccgaccctgaaacctttgccaagaaccgtgagctcgaagtaatccacagcagatgggcaatgctaggtgctttaggctgcacattcccagagattctctccaaaaacggagtcaaattcggtgaagccgtgtggttcaaggcaggatctcagatcttctcagaaggagggcttgactacctcggaaaccctaacttgatccacgcgcaaagcattttagctatctgggcttctcaagttgtgctaatgggcttaatcgaagggtacagaattggaggtggacctcttggtgaagggcttgacccgctttacccgggtggggcgtttgacccgttgaacttggccgaggatccggaagcattttcggaattgaaagtgaaggagcttaaaaatggtcggcttgccatgttctccatgtttggattctttgtccaagccattgttactggtaaaggtccgatcgagaacctgtttgatcatgttgcggaccctgtggctaacaatgcatgggcttacgctaccaacttcgttcccggaaaatagaatttgatttggatatatttatgtaactttcaacatttcatgcatgcaaaatatttagcctgtttgttggtttgatgtacttggtgaaaaacattctcgttagctgttagctaccttgtcttatgtcattttgatatagttccaagattcagatcctagcaaaaacactgcatgatac

SEQ ID NO: 4350 - DNA, 941 bp, Brassica juncea
gtttatttctctctttgtttctgtttggagttgagataaacaagaatggccacatcagcaatccagcactcctctttcgccggacaaacggctttgaagccctccaacgatctcctccgcaaagtcggagcttccaacggaggtggtcgcgtcgtcatgcgccgtaccgtcaagtctactcctcagagcatctggtacggaccagaccgtcccaagtacttaggaccattctcagagaacacaccatcgtaccttaccggtgaataccccggagactacggttgggacaccgccggtctctcagccgatccagaaaccttcgcgaagaaccgtgagctggaggtaatccacagcagatgggcaatgctcggcgctttaggttgcacattcccagagattctctccaaaaacggagtcaaattcggtgaagccgtgtggttcaaggcagggtctcagatcttctcagaaggagggcttgattacctcggaaaccctaacttgatccacgcgcaaagcatattagctatctgggcttctcaagttgtgctgatggggttgatcgaagggtacagaatcggaggtggacctcttggtgaagggcttgacccgctttaccctggtggggcgtttgacccgttgaacttagcggaggatccggaggcgttttcggaattgaaagtgaaggagctaaagaacggtcggcttgccatgttctccatgtttgggttctttgtccaagccattgtcactggtaaaggaccgatcgagaatctgtttgaccatgttgcggaccctgtggctaacaatgcctgggcttacgccaccaactttgtccccggaaaatagaatattatcagataatgtatgtttttaatacaattaatgtatgtctgttggtttgatgttctgtcttaatgaaagaaatcatcgttagcttgagg

SEQ ID NO: 4351 - DNA, 1027 bp, Brassica juncea
atctcatctcatctcatatttgcttatttctctcttcacttgtgtttctgtttggagttgagataaacaagaatggccacatcagcaatccagcactcctctttcgccggccaaacggccctgaagccatccaacgatctcctccgcaaagtgggagcttccaacggcggtggtcgcgtcgtcatgcgccgtaccgtcaagtctactcctcagagcatctggtacggaccagaccgtcccaagtacttaggaccattctcagagaacacaccatcttacctaaccggagaataccccggagactacggctgggacaccgctggtctctcagccgacccagagacctttgcaaagaaccgtgagctggaagtaatccacagcagatgggcaatgctaggcgctttaggttgcaccttcccagagattctttccaaaaacggagtcaaattcggtgaagccgtgtggttcaaggcagggtctcagatcttctcagaaggagggcttgattatcttggaaaccctaacttgatccacgcgcaaagcatattagcaatctgggcttctcaagttgtgttgatggggttaatcgaaggttacagaattggaggtggacctcttggtgaagggcttgacccgctttacccgggtggggcgtttgacccgttgaacttagcggaggatccggaggccttttcggaattgaaagtgaaggagctcaagaatggtcggcttgccatgttctccatgtttggattctttgtccaagccattgtcactggtaaaggaccgatcgagaatctgttcgatcatgttgcggaccctgtggctaacaatgcatgggcttacgccaccaacttcgtccccggaaaatagaatattatcagctgctaatgtatgtttttaaaatagtgaaatatatgtctatcggtttgatgttctgtcttaatgaaagaaatcatcagcttgaggccctttgtcttgcgttgatctataaaatttgtgaacggctcagacatagataatcgaa

SEQ ID NO: 4352 - DNA, 916 bp, Brassica juncea
atctttgcttatttccctctttcatttgtgttcttgtctgaagttaaaagatcaaaaagaatggcgacgtcagctattcaacactcctcttttgctggccagactgccctcaagccgtccaacgatctcatccgcaaagtcggagcttccaacggcggtggccgcgtagtcatgcgtcgtaccgtcaagtctactcctcagagcatctggtatggaccagaccgtcccaagtacttaggtccattttcagagaacacaccatcatacctaaccggagaataccccggagactacggctgggacaccgccggtctctctgccgacccagaaaccttcgccaagaaccgtgagctcgaagtaatccacagcagatgggcaatgctaggtgctttaggctgcacattcccagagattctctccaaaaacggagtcaaattcggtgaagccgtgtggttcaaggcaggatctcagatcttctcagaaggagggcttgactacctcggaaaccctaacttgatccacgcgcaaagcattttagctatctgggcttctcaagttgtgctaatgggcttaatcgaagggtacagaattggaggtggacctcttggtgaagggcttgacccgctttacccgggtggggcgtttgacccgttgaacttggccgaggatccagaggcgttctcggagttgaaagtgaaggagctcaagaatggtcggcttgccatgttctccatgtttggattctttgtccaagccattgttactggtaaaggtccgatcgagaacctgtttgatcatgttgcggaccctgtggctaacaatgcatgggcttacgctaccaacttcgttcccggaaaataggatttgatttggatatatttatgtaactttcaacatttcatgcatgcaaaatatt

SEQ ID NO: 4353 - DNA, 891 bp, Brassica juncea
atctcatctttgcttcatttgtgtttctgtttggagtttagataaaaaaaaaaagaatggctacgtcagcaatccagcactcctctttcgccggccaaacggccctgaagccctccaacgatctcctccgcaaagtaggagcttccaacggcggtggccgcgtcgtcatgcgtcgtaccgtcaagtctactcctcagagcatctggtacggaccagaccgtcccaagtacttaggaccattctcggagaacacaccatcatacctaacgggagaataccccggagactacggttgggacacagctggtctctccgctgacccagaaacctttgcaaagaaccgtgagctcgaagtaatccacagcagatgggcaatgctaggagcattaggctgcaccttcccagagattctctccaaaaacggtgtcaaattcggtgaagccgtgtggttcaaggcaggatctcagatcttctcagaaggagggcttgattacctcggaaaccctaacttgatccacgcgcaaagcattttagctatctgggcttctcaagttgtgttgatgggtttgattgaaggatacagaatcggaggtggacctctaggtgaaggacttgacccgctttacccgggtggggcgtttgacccgttgaacttagccgaggatccagaggcgttttcggaattgaaggtgaaagagctaaagaacggtcgtcttgcaatgttctccatgtttggattctttgttcaagctattgttactggtaaaggtccgatcgagaatttgtttgatcatgttgcggaccctgtggctaacaatgcttgggcttacgccaccaacttcgttcccggaaaatagaatttgatcagatatattttatgtattttaaaaa

SEQ ID NO: 4354 - DNA, 1298 bp, Brassica rapa
aaaatcaacaagaacaccaacaacaacatctcatctcatctttgcttcatttgtgtttctgtttggagttgatataatatataagaatggctacgtcagcaatccagcactcctctttcgccggccaaacggccctgaagccctccaacgatctcctccgcaaagtaggagcttcgaacggcggtggccgcgtcgtcatgcgtcgtaccgtcaagtctactcctcagagcatctggtacggaccagaccgtcccaagtacttaggaccattctcggagaacacaccatcgtacctaaccggagaataccccggagactacggttgggacacagccggtctctcagctgacccagaaacattcgcaaagaaccgtgagctcgaagtaatccacagcagatgggcaatgctaggagcattaggctgcaccttcccagagattctctccaaaaacggtgtcaaatttggtgaagccgtgtggttcaaggcaggttctcagatcttctcagaaggagggcttgattacctcgggaaccctaacttgatccacgcgcaaagcattttagctatctgggcttctcaagttgtgttgatgggtttgattgaagggtacagaatcggaggtggacctcttggtgaaggccttgacccgctttacccgggtggggcgtttgacccgttgaacttagccgaggatccggaggcgttttcggaattgaaggtgaaggagctcaagaacggtcgtcttgcaatgttctcgatgtttggattctttgtccaagctattgttactggtaaaggtccgatagagaatctgttcgatcatgttgcggaccctgtggctaacaatgcgtgggcttacgccaccaacttcgttcccggaaaatagaactggatcagacaaatttgtgtgttttatctttaaaatttagtgcatggacatatttggtctgttggtttaatgttcttggattggtgaaagaaattctcaagccttcttttgtgtcattaatctagaaatgtgttactatccaaatccatcgagtttcaatctcattgttctacaattggtctttgataaatgttaaaactagaacaaataatatagttccaagattccgatcctagcaaacaataatgatataaatctagctaacaaaacattgcgtaaatttccaagatgctttgccgtttgtagattccacactatttttcgtctcaactaaagcagtctccaagtacacatgtgtatatacaacagaagtcgaactgttatagaaactaagaactgaaaaccaaa

SEQ ID NO: 4355 - DNA, 2125 bp, Brassica rapa
gtcgctgacatgtccatcttgtgatctccctcagaatgaccaccttcggatctctattataaaatcgaaatgacataacataacaacaatcatctcatctttgtttatttctctcttcatttgtatctttgtttggagttgagataaacaagaatggccacatcagcaatccagcactcctctttcgccggacaaacggctttgaagccttccaacgatctcctccgcaaagtaggagcttccaacggtggtggtcgcgttgtcatgcgccgtaccgtcaagtctactcctcagagcatctggtacggaccagaccgtcccaagtacttaggaccattctcagagaacacaccatcgtacctaaccggagaataccccggagactacggctgggacaccgccggtctctccgccgatccagaaaccttcgcaaagaaccgtgagctggaagtaatccacagcagatgggcaatgctcggcgctttaggatgcaccttcccagagattctctccaaaaacggagtcaaattcggtgaagccgtgtggttcaaggcagggtctcagatcttctcagaaggagggcttgattacctcggcaaccctaacttgatccacgcgcaaagcatattagcaatctgggcttctcaagttgtgctgatgggtttaatcgaagggtacagaatcggaggtggacctcttggtgaagggcttgacccgctttacccgggtggggcgtttgacccgttgaacttagcggaggatccggaggcgttttcggaattgaaagtgaaggagcttaaaaacggtcggcttgctatgttctccatgtttggattctttgtccaagccatcgtcactggtaaaggaccgatcgagaatctgtttgatcatgttgcggaccctgtcgctaataatgcctgggcttacgccaccaacttcgtccccggaaaatagaatattatctgataatgtatgtttttaaaacaattaatgtatgtctgttggtttgatgttctgtcttaatgaaagaaatcatcgttagcttgaggcccttgtcttgaattgatctagaaaatttgcgaactgctcagacatacatcatcgaatttcaatctcatttctctacatctgttgtttaatgaaagcatatagtttctaggattcaaacctgtgatattaccaaagaatgaaagcatatagtttctaggattcaaacctgtgatattaccaaagaaaacattgcataaacttcaaaaatgcgtgccgttttatagattccacaccgctcttcgactcgactaaagcaagtcacgaagtccaactatgtatgtacaacacaagtcaagattgttatagaagctaataaaagaggaaaacaaagacctgctgatacaaagacccaaccactgttcttggaaggccaaatgtaacaatacacttctactatccacataaaggaggaaaaaactataaatatatcttttgctaccaacaaatattaacgtctcactgattggctaaaaagcctaaaagatcactataccagattcaccaacaaataaagattatgtttctgagacaaaagattacctcactgacagtcttcttgcccagcttaaccattcatctgttcttcatcactttctggcgctgcaactttttcagctccctcgttggactcgctattacttttattgctgccattgtcttgttcattcaatgtattgtcgtctccagagacatttgtgctctttggttcttctgtagaagaggatttgacttcatcttctggtttcgggtcattagaaacagaagcagcggacttgtttttgctgctaaggtggtcactagaaacagagggattattcttgtcattgctacttttattctctttcttgatttgacgtgttacccacacgagctgcaacgtgtgttcttgccaagactttgcattagcaaacgctttctctgctgcgctgcgtttcacaaatgtcacacaggctgcaaggcttttgttatgtgtttcatcctgatccttgccactatcagccgatgcattgtcttcgagttccacttttgagacctcgccataagaagagaaatgttcttttaagacagcaaccta

SEQ ID NO: 4356 - DNA, 1158 bp, Phaseolus vulgaris
tcctcatccacaacccttctataaacatttctactaaccttcttcattctccacaacacactcacaaaaccacagaaagaagaacctttgccaacacaacagagccatggccacctctgctttccagcaatcagcattcgctggtcaaacagctctgaagcaggtcaatgaattcgtccgcaagaccggtggctccggcaaaggtcgcaccaacatgcgccgtaccgtcaagagtgctcctcagagcatctggtatggccctgaccgtcccaagtacttgggaccattctctgagcagattccatcatacctgactggtgaattccctggtgactacggatgggacacagctggattatcagctgaccctgaaacctttgccaggaaccgtgagttggaggtgattcacagcagatgggccatgcttggtgctctgggatgcaccttcccagagatccttgagaagaatggtgtgaaattcggtgaggcagtgtggttcaaggctggtgcacagatcttctctgagggagggcttgactatttggggaacccaaacctggtccatgctcagagcattcttgccatctgggctgttcaggttgtgctgatggggtttgttgaagggtacagagttggtggaggacctcttggtgaaggcctagaccctgtctaccctggaggttcctttgaccctcttggtcttgctgatgaccctgatgcatttgctgagttgaaggtcaaggaactcaagaatggtagattggccatgttctccatgtttggtttctttgttcaggccattgtcactggcaagggccctattcagaacctctacgaccatgttgctgaccctgttgccaacaatgcttgggcttatgccaccaactttgtccctggacaatgatcatgtctttttagatgcaatgcaatcttctgctcctgaagaatctgcatgagaacaattatatatatccctgaaatatcaaactcttgacttgtgttgttatatggttttctattttccacataacctgaactgaacaaacttttcctaaatgttaattagttcaaacattgaaaccatgttgaaggaatctatcagtgatgtaccaagaacaccatccaacgattaagaacataaaagaatgaatccgcatc

SEQ ID NO: 4357 - DNA, 939 bp, Brassica napus
atctcatctttgcttcatttgtgtttctgtttggagttaagataagaatggctacgtcagcaatccagcactcctctttcgccggccaaacggccctgaagccctccaacgatctcctccgcaaagtaggagcttccaacggcggtggccgcgtcgtcatgcgtcgtaccgtcaagtctactcctcagagcatctggtatggaccagaccgtcccaagtacttaggaccattctcggagaacacaccatcatacctaactggtgaataccccggagactacggttgggacacagctggtctctccgctgacccagaaacattcgcaaagaaccgtgagctcgaagtaatccacagcagatgggcaatgctaggagcattaggctgcaccttcccagagattctctccaaaaacggagtcaagttcggtgaagccgtgtggttcaaggcaggttctcagatcttctcagaaggagggcttgattacctcggaaaccctaacttgatccacgcgcaaagcattttagctatctgggcttctcaagttgtgttgatgggtttgattgaagggtacagaatcggaggtggacctcttggtgaaggtcttgacccgctttacccgggtggggcgtttgacccgttgaacttagccgaggacccggaagcgttttctgaattgaaggtgaaggagctcaagaacggtcgtcttgcaatgttctccatgtttggattctttgtccaagctattgtaactggtaaaggtccgatcgagaatctgttcgatcatgttgcggaccctgtggctaacaatgcctgggcttacgccaccaacttcgctcccgtaaaatagaactgtatcagacaaatttgtgtttttatctttaaaatttagtgcatgggcatatttggtctgttggtttactgttcttggattggtgaaa

SEQ ID NO: 4358 - DNA, 965 bp, Brassica napus
gtttggagttgagataatatataagaatggctacgtcagcaatccagcactcctctttcgccggccaaacggccctgaagccctccaacgatctcctccgcaaagtaggagcttccaacggcggtggccgcgtcgtcatgcgtcgtaccgtcaagtctactcctcagagcatctggtacggaccagaccgtcccaagtacttaggaccattctcggagaacacaccatcatacctaacaggagaataccccggagactacggttgggacacagctggtctctccgctgacccagaaacattcgcaaagaaccgtgagctcgaagtaatccacagcagatgggcaatgctaggagcattaggctgcaccttccctgagattctctccaaaaacggagtcaaatttggtgaagccgtgtggttcaaggcaggttctcagatcttctcagaaggaggacttgattacctcgggaaccctaacttgatccacgcgcaaagcattttagctatctgggcttctcaagttgtgttgatgggtttgattgaagggtacagaatcggaggtggacctcttggtgaaggccttgacccgctttacccgggtggggcgtttgacccgttgaacttagccgaggatccggaggcgttttcggaattgaaagtaaaggagctaaagaacggtcgtcttgcaatgttctccatgtttggattctttgtccaagctattgttactggtaaaggtccgatcgagaatctgttcgatcatgttgcggaccctgtggctaacaatgcgtgggcttacgccaccaacttcgttcccggaaaatagaactggatcagacaaatttgtgtttttatctttaaaatttagtgcatggacatatttggtctgttggtttaatgttcttgggttggtgaaagaaatcctcaattcttttgtgtcattaatctagaaatgtgttaactg

SEQ ID NO: 4359 - DNA, 1724 bp, Brassica napus
gtgagagagctgcatataaacttactaacaattaccacaccaaaattcacataacaacaataacaacaaaatataacacgagaaaattattaagatgaaccccattaaaaattaaaaccaaacatagtcacatccacatgagttttgtttttttcacattttaagtttccacaacttacaaatcataactttgtttcccagtgaacttaacttcaatgggactaacatttttcccaatagatctcatgttctgaccaacaccttcccttcccgcattcgccttctccggataaaccccatctttaggatgaagatactgaacctcaccgttagggaacaccctgtagaactggtagttaatcttgtacttggacctaagcctcgtccccaaggccaagcactgctctttcctcgccagcttcagcaagttcggaccttccctcatgatcgccgcgcctcccgtcggcatctcgaagatctgctccttcggcgagttccacgtgatgacgtagaactcctccacctgggccttgcggagaagaccgcccgtgcttcccgcgaagatcggagacggcgtgttcgggtctagctgcggcggcgtgaatcccaccggagcttcttctttcacggcggcggcgggggcggcggcggcggagtctgctttctcggcgcggattgcggttttggggaaggagagggatcttggacggtgggatgtcgtgaaaaggtggagcttttttacgccggaggtagcggcggttgttacggcggagctaaagagtcccgaggcttgagctgccattttttttttgtctttgcttgtttttctctttcatttgtgttcttgtttggagttaagatataaaagaatggctacttcagctatccaacactcctcttttactggccaaacggccctgaagccctccaacgatctcctacgcaaagtcggagcttccaacggtggtggccgcgtcgtcatgcgtcgtaccgtcaagtctactcctcagagcatctggtatggaccagaccgtcccaagtacttaggtccattctcagagaacacaccgtcatacctaaccggtgaataccccggagattacggctgggacaccgccggtctctcggccgaccctgaaacctttgccaagaaccgtgagctcgaagttatccacagcagatgggcaatgctaggcgctttaggctgcaccttcccagagattctctccaaaaacggagtcaaattcggcgaagccgtatggttcaaggcaggatctcagatcttctccgaaggaggacttgactacctcggaaaccctaacttgatccacgcgcaaagcattttagctatttgggcatctcaagttgtgctaatgggtttaatcgaagggtacagaatcggaggtgggccccttggtgaaggtcttgacccgctttacccgggtggggcgtttgacccgttgaacttagctgaggatccagaggcgttctcggaattgaaagtgaaggagctaaagaacggtcggcttgccatgttctccatgtttggattctttgtccaagctattgttactggtaaaggtccgattgagaacttgtttgatcatgttgcggaccctgtggctaacaatgcatgggcttacgccaccaactttgttcccggaaaatgaatttgattcggattaatttctgttatttttgttatcttctacttaattattaat

SEQ ID NO: 4360 - DNA, 1106 bp, Vigna unguiculata
atggcccctctcacccttctataaacaattgcagaacccttcttcattctccacaacacactcacaaaaccaaagaaagaagagacctttgccaacacaacacagccatggccaccactgctttccagcaatcagcattcgctggtcaaactgctctcaagcaggtcaatgagttcgtccgcaagaccggtggctccggcaaaggtcgcaccagcatgcgccgcaccgtcaagagtgctcctcagagcatctggtatggccctgaccgtcccaagtacttgggtccattctctgagcagattccatcatacctgactggtgaattccccggtgactacggatgggacacagctggattatcagctgacccagaaacctttgccaggaaccgtgagttggaggtgattcacagcagatgggccatgcttggtgctctgggatgcaccttccctgagattcttgagaagaacggtgtgaaattcggtgaggcagtgtggttcaaggctggtgcacagatcttctctgagggaggacttgactatttggggaacccaaacctgatccatgctcagagcattcttgccatctgggctgtgcaggttgtgcttatggggtttgttgaaggttacagagttggaggaggacctcttggtgaagggctagaccctatctaccctggtggtgcctttgaccctcttggtcttgctgatgaccctgatgcattcgcggagttgaaggtcaaggaactcaagaatggtcgcttggctatgttctccatgtttggtttctttgttcaggccattgtcactggcaagggccctattcagaacctttacgaccatgttgctgaccctgttgccaacaatgcttgggcttatgccaccaactttacccctggacaatgagcatgtcaacttgttgtgccttcttagatgcaatgcaatgcaatgcaagcttctgctcatgtttgcagtttttcccttgtgtttaactcaaatttcgctgatgtaactacacagtgtgtagcagaagaatctgtatgagaacagttatatattacaaatttggatccctgaaatatcaaactcttgactagtgtgtgttaa

SEQ ID NO: 4361 - DNA, 1002 bp, Linum usitatissimum
gcaacaacagaagcttcaactctttccttttagccatggcagcaacctctgggttccaacaatctgcattcgctggccaaattaccctcaacaggtccaatgagcgtaccagaaaggttgcttctctcgctggcagccgcttcaacatgcgccgtactgtcaagagtgctccccaaagcatctggtacggagcagaccgtcccaagtacttgggtccattctcggagcagactccatcatacctgacaggagagttcccaggtgactacggatgggacactgctggtctatcagcagacccagagacattcgccaagaaccgtgagcttgaggttatccactgcaggtgggctatgcttggtgcgcttggttgtgtcttccccgaaatcctttccaagaatggggtcaagttcggtgaggcagtctggttcaaggctggagctcagatcttctccgagggaggtctggattacctaggaaacccgaacctggtccacgctcagagcatccttgcaatctgggcttgccaggttgtgctcatgggattcgttgaaggttacagagttggtggaggacctctcggagaagggcttgacccactttaccctggtggctccttcgacccacttggcttggcagatgatcctgaggcctttgctgagttgaaggtcaaggagatcaagaatggccgcctcgctatgttctccatgtttggcttcttcgtccaagccattgttaccggcaaaggtcccgttgagaacctttatgaccacattgctgaccctgtagccaacaatgcttgggctttcgccaccaactttgtccccggcaaatgagcgcaccacaccttctatctttgtaatggcttccctaagagatagagttctgttactactttctggaagtctttttgtaatcatttgaacttgaacaaatccatggaatggaactttcctttttcacgcaattgtgtcgggtgcaaactccattaaatgcttagct

SEQ ID NO: 4362 - DNA, 1225 bp, Arachis hypogaea
tcctcatccaccacccttctataaacctttctactctcaaccttcactctccacaacaacaagaaaagaaaacaaaagaattcataacataaccatggccacctctgccatccagcaatctgcattcaccggccaaactgccttgaagcaaggaaatgaacttctccgcaagattggtggcgccggcaaaggccgcattaacatgcgtcgtaccgtgaagagtacccctcaaagcatttggtatggacctgaccgtcccaagtacttgggtccattctccgaccaaatcccctcatacttgaccggagaattccccggtgactacggatgggacactgccggattatctgcagacccagagacctttgcaaggaaccgtgagctggaagtgattcacagcagatgggccatgcttggtgcacttggatgcacattcccagaaatccttgaaaagaatggtgtcaagtttggtgaggctgtttggttcaaggctggagcacagatcttctcagagggtggccttgactacttggggaacccgaatttgatccatgctcagagcattcttgcaatctgggctgtccaggttgtgctcatgggatttgttgaaggctacagagttggtggagggcctcttggtgaaggactagacccaatttaccctggtggtgcctttgatcctcttggtttggccgatgaccccgaagcattcgccgagttaaaggtgaaggaactcaagaatggccggttggctatgttctccatgtttggtttctttgttcaggccattgttactggcaagggacctattcagaacctgtttgaccatgttgctgaccctgttgccaacaatgcttgggcttatgccactaactttgtccctggacaataaataaggataacttgtgtctgttatgctgaaatcttctgctagttctcattgacattgatgtaattgagcagaagaatctgtatgatgagaacaatgatatattagatatgtcagctcttatgcatggttttgtaatactgattggaatgtgttagtttacatggtttctacttatatgtgaataacttagatatcaacagaaattcaaggactcctaaaagtgataatctgactaaatttagagttttaagctattaaacttccttttctgtgttttatagttaaatggctatcaattctactcaaagaaaataacaagggaagaatgtcatc

SEQ ID NO: 4363 - DNA, 1958 bp, Primula obconica
ataagcagagtgattctctcccactctctccctctctaaattttcttatccagcaacgcgtgaaatttaaaaaagataaaagtaaaactcaagtatggaaggtacagtgttcactccggctctagagggaatgaaatttgtcaagtctgaagaaggagaaatgcttactaagcctttcttggaagtgtgcaagcaaataatacctgttatagaaaagtttggagctgccatggcacttgtgaaatctgatattggtggtaatatcacgaggctggaaaacaaatacttgtccaacccagcagaatttaatctcttgtacagtatggtgcaagtggaggttgcagctaagactgcaaaaggttcgtctagctgtacaaacggtcttctttggctcacaagggccatggatttccttgtggcattgttcagaaacttagttgatcatcatgattggaccatgtcacaagcttgttccgactcttatagcaaaacactgaaaaaatggcatggctggattgccagctcaagttttacggttgcaatgaagcttgctcctgataggaagaaattcatggatgtcgtagggggaaagggcgatattaacgctgatatggagaagttttgcactaccttttctcccttccttgaagagaatcacaaattcttggctagtgttagcatggacgacctgaaagcttcttgatcagattttaaacccgttcttttctatattgaaagtaagaagattgtttcttgaacttcttacagtaacaaaatattactccgtatcatccaaatcaaactttttacttggctttttaacacatttgtatcatgttaaacttaatttctgccgaattggaatcgttctggtgcttttactgcccattacgccgaaaacaagcttcttcaccattcacaaaacagaaaagcaaagggtatttttagcacaaagatttattaaaaatggcaacctctgcgatccaacggtcagcattctccggccagacggcattgaagggacagaatgagcttgtcagaaaggtcggtagcttcggtggtggccgcgtcaccatgcgccggactgtcaagagtacctctcaaagcatctggtacggagcagacaggccaaagtacctaggcccattctcggagcaaaccccatcatacttgactggtgagttccctggtgattatggatgggacactgctgggctctcagctgacccagagacctttgctaagaaccgcgagctagaagtaatccactccaggtgggccatgcttggagccttaggttgtgtctttccggaacttctcgcgaaaaacggtgtcacatttggcgaatcagtgtggttcaaggcaggagcacagatcttctcagagggcggacttgactaccttgggaatcccaacctcatccacgcccaaagcatcctcgccatctgggccagccaggtagttctcatgggcttcgttgagggttaccggatcggtgggggcccacttggcgaagggctggacaagatttacccaggtgggtctttcgacccattgggattggctgatgacccagaggcgtttgcagagctgaaggtgaaggagctcaagaatggacgattggctatgttttctatgttcgggttctttgtgcaggctattgttaccgggaagggcccgattgagaacttgtacgatcacttggcagatcctgtggccaacaatgcttgggcttatgccaccaactttgtgcctggaaattgaagattgaatttgtgagagtgatcagtagtaatgtaatatttctatttacagcacaaaatgttgaatgaggtttggaatttaaactatttcgttggtctctttttacttttatgtctaaggacaaaaactacgattgtttcactttttcacatggatgcattcgaagcatctcggcaaataatcagatagaaatt

SEQ ID NO: 4364 - DNA, 1007 bp, Raphanus sativus
catctcatctttgcttatttctctcctttgtttttctgtttggagttaagataacaaaaaaagaatggctacatcagcaatccaacactcctctttcgccggtcaaacggctttgaagccctataacgatctcctccgcaaagtaggtgcttccaacggtggtggacgcgtcgtcatgcgccgtaccgtcaagtctactcctcagagcatctggtacggaccagaccgtcccaagtacttaggaccattctcggagaacacaccatcatacctaaccggtgagtaccccggagactacggttgggacaccgctggtctctccgctgacccagaaacctttgcaaagaaccgtgagctcgaagtaatccacagcagatgggcaatgttaggagctttaggctgcacattcccagagattctctccaaaaacggtgtcaaattcggtgaagccgtgtggttcaaggcaggttctcagatcttctcagaaggagggcttgattacctcggaaaccctaacttgatccatgcgcaaagcattttagctatctgggcttctcaagttgtgcttatgggcttaatcgaagggtacagaatcggaggtggacctcttggtgaaggtcttgacccgctttacccgggtggggcgtttgacccgttgaacttagccgaggacccggaggcattttcagaattgaaagtgaaggagctcaagaatggtcgtcttgcaatgttctcaatgtttggattctttgtgcaagctattgttactggtaaaggtccaatagagaatctgttcgatcatgttgcggaccctgtggctaacaatgcttgggcttacgccaccaacttcgttcccggcaaatagaattgattcgaataaatatatgtaatttctttgtgacgacaaaaacaaaaaatgtaatttcgttgcttggtggaataaattctccaagtcttctgttgtgtcattaagcaagaaatatgttcgttcactgctcagagtccca

SEQ ID NO: 4365 - DNA, 980 bp, Tabernaemontana elegans
taactcttcatggcaacctctggcattcaacaatcagcatttgctgggcaaactgcccttaagccccagaatgagctggtcaggaagattggaagccttggtgctggccgtttcaccatgaggagaactgtcagaagtgctccaccaagcatttggtatggcccagatcgtcccaagtacctgggcccattctcagagcaaactccacgatatctgactggtgaattccccggtgactacggatgggacactgctgggctttcagctgatccagagacattcgccaagaaccgtgagctagaagtgatccactgccgttgggcaatgcttggcgctttgggctgcgttttccccgaaatcctttccaggaacggcgtcaagttcggtgaggctatatggttcaaggcgggctctcagatcttctccgagggtggcctcgactatcttggcaacccaaaccttatccatgcccaaagcatcctcgccatctgggccacccaagttgttcttatgggcttgattgagggatacagagttggtggaggccctctcggtgaaggactcgacaagatctacccaggaggtgcatttgacccattggggttggctgatgatccagaggcatttgcagaattgaaggtgaaggagatcaagaatggccgattggccatgttctctatgtttggattctttgtgcaggctattgttaccggcaagggcccaattgagaatctttatgaccatcttgctgaccctgtgaccaacaatgcctgggcttatgccacaaactttgtacctggaaaatgagaaactcacagcctgtgagtctggaaaatattgatgtaatattcagcgggtgatgccacaaactcatcctatgacttgaatgttaagacccctttacttgtcacatgcgccaaaacatacgagaatgaatggctgaatgcttctttcttttaatttcttggaattggtaaata

SEQ ID NO: 4366 - DNA, 1044 bp, Eutrema parvulum
ccaagaaaatctaaatccaaacatctcagccaatcagaagtcgctgacgtgtacatctgatcatcctccaaacgtgaacactttctctattataaaacccaaagtggtggttatcaccatctgatcatttcaactcacactctctcttcaatatttggctaagaagaaaatggccacgtcagcaatccagcaatcttccttctccggccaaacggccctcaagccctccaacgacctcctccgtaaggtcggtgtctccggcggtggccgtgtgactatgcgtcgcaccgtcaagtctactcctcagagcatctggtatggaccagaccgtcccaagtacttgggaccgttctcggagaacacaccgtcttatctaaccggagaataccccggagactacggctgggacaccgccgggctatctgctgatccggagacattcgctaagaaccgtgagcttgaagtgatccacagcagatgggcaatgttgggagctctcgggtgcacattccctgagattctctccaagaacggagtcaaattcggagaagccgtttggttcaaggcaggatctcagatcttctcagaaggaggtcttgattaccttgggaaccctaacttgatccacgcgcaaagcatcttagccatatgggcttgtcaagttgtgcttatgggtttaatcgaaggctacagaatcggaggtggtcctctcggagaagttcttgacccactttaccccggaggtgccttcgacccattgaatttggcagaggacccagaggccttctctgagttgaaggttaaagagctcaagaacggtcgtcttgcgatgttctcaatgtttggattcttttttcaagccattgttactggtaaaggtcccattgagaacttgtttgatcacttagcagatcctgtggctaacaacgcctggtctttcgctactaactttgtccccggaaagtaattatcttatggatttgcttcacaatctatctactttgtaaaaccagtaatgtattactcgagaacttctttgtaaat

SEQ ID NO: 4367 - DNA, 1413 bp, Trigonella foenum-graecum
atgtgatggggttgcactgtagcaccatcccaaatgcccaatccaaaccctcttccaagtttctgtttttgttctcaactttggtggacctaatttccttggctcacattcacctctccaaaacatctaagcaaccagatcattgcatccacatggcacaaagagagccacaatatcaatacaaaatataagcttgggaatccacatacaaattcaccaccaataagatgttgatgacttgtgcatatcctaatccacaatatcttatgatttccaccgtggccactcccaacacttctataaacctttgtatcctttcttcattcttcacaacaacactagcttatagcactaaagagaacaaacaccaaaaacctcaacgccctcatggccacctctgcaatccaacaatcagcattcactggcaagactggtttgagacagagaaatgagttcatcaggaaagctggtaactttggtcaaagtcgcttcaccatgcgtcgtactgtgaagagtgctcctgaaagcatttggtatggccctgaccgtcccaagtacttgggtccattctcagaacaaattccatcatacttgactggtgaatttcctggtgactatggatgggacacagctggattatcagctgaccctgaaacctttgcaaggaaccgtgagcttgaagtaattcacagcagatgggctatgcttggtgcattgggatgtactttccctgaaatccttgaaaagaatggtgttaaatttggtgaggcagtgtggtttaaggctggtgcccagatcttctctgagggtggtcttgactatttgggcaacccaaacctgatccatgctcagagcattcttgcaatctgggctactcaggttgtgctcatgggatttgttgaaggctacagagttggtggaggaccacttggtgaaggactagacccactttaccctggtggtgcttttgaccctcttggtcttgctgatgaccctgatgcatttgcagagttgaaggtcaaggaactcaagaacggacggttggctatgttctccatgtttggtttctttgttcaagccattgttactggcaagggccctgttcagaacctttacgaccatattgctgacccagtcgccaacaatgcatgggcatatgctactaacttcgtccccggacaatgagaatgccaagatgtggctgcctcttcagctgaaacttctgcttttatttgcatttctgttgtatttaactcctattttcaccaatgtaactacacaagcagaagaacctgtatgtggctgattatatgttagaaatatggatcccaaaaaatgtcaactcttgtgcatgaattcagaatattgattgagctgtgttagtcatatgtttttattttatttcccgtaacc

SEQ ID NO: 4368 - DNA, 953 bp, Vinca minor
gaagagaatttctctaagaaatttaccaaaaagaatagtaaattttgatcatggcaacctcaggtattcaacaatctgcatttgcagggcagactcttctgaagtcccagaatgagctcatcagaaaggttggaaacgttggtggtggccgttttaccatgaggagaactgtcaaaagttctccacaaagcatttggtatgggccagatcgccccaagtacttgggcccattctctgagcaaactccatcatatctcactggtgaattccctggcgattacggatgggacactgctgggctttcagctgacccagagacattcgccaagaaccgcgagctagaagtgatccattgccgatgggcaatgcttggagctttaggttgtgtcttccccgaaatcctttccaggaacggcgtcaagtttggcgaggctgtttggttcaaggccggatctcaaatcttctccgagggtggtctcgactacctcggaaacccaaacctaatccatgcccaaagcattcttgcaatttgggccagccaagttgttctaatggggttgattgaaggatacagagtcgggggaggccctctcggagaaggactcgacaaggtatacccgggtggagctttcgacccgttgggcttagctgatgatccagaggcatttgctgagttgaaagtgaaggagatcaagaatggtagattggcaatgttctcaatgtttggatactttgttcaagctattgttactggaaaaggcccaattgagaatctttttgatcatattgctgacccagtcgctaacaatgcttgggcttatgccacaaactttgtacctggaaagtgataaattcttccaaatttcatcttgtgaatctttaaaaatgtttatgtaattttcagtggatatgatcccataatctttatctgatggcttgaatattactctctc

SEQ ID NO: 4369 - DNA, 955 bp, Bruguiera gymnorhiza
ctcgaaaaaaaggcaactagcagggattcaattctcgtagtcatggcaacctcttcaatccaacattcagcatttgctggacagaccgtcttaaggcactcaaatgagctcgcccgcaaagttggttcctttgggggtggccgtgtcgccatgcgccggactgtgaagagcgctccccaaagcatctggtatggcccagaccgcccaaagtacttgggtccattctctgagcaaaccccatcgtacctgactggagaattccctggtgactacggttgggacactgctggtttatctgcagatcctgagacatttgccaggaaccgtgagcttgaggtgatccactgcagatgggccatgcttggtgcacttggctgtgtcttcccagaaatcctctcaaagaacggtgtcaagtttggtgaggcagtttggttcaaggctggtgcttcaaattttctccgagggtggccttgaataacttgggcaaccccaacctcatccatgctcagagcatcctagcaatttgggctacccaggttgtgctcatgggattcgttgaaggttacagagttggaggaggaccactcggagaaggacttgaccccatttatcctggtggtgcctttgatcctctaggactggctgatgatcctgaagcattcgctgaattgaaggttaaagagattaagaatggtcgccttgcaatgttctcaatgtttggattcttcgttcaggctattgtcactggaaagggtcctattgagaacctctttgatcatattgctgatccagtggcaaacaacgcatgggcttatgccaccaactttgtccctggcaaatgaaaagaaactgtcaaaaaaaaatgccttctagcttgtaagttgtaacaccactctgtcctggtgctttatttgaaatctacaatgtggactctatcagttctttgttctaaaaa

SEQ ID NO: 4370 - DNA, 845 bp, Euphorbia peplus
aatggcaacttctggaatccaacaatctgcatttgccggtcagattgctctgaagccatctaatgaccttctccgaaaggtcggcaacttaggcggtgctcgcgttgttatgcgtaggactgtcaagagcgctcccgagagcatttggtacggcccaaaccgcccaaagtacttgggaccattttccgaacaaactccatcatacctaaccggagaattccccggagactacggatgggacacagccggattatcagcagaccccgaaacattcgccaagaaccgtgaacttgaagtatccactgcaaatgggctatgcttggagctctcggctgtgtcttcccggaaatcctctcaaagaacggtgtaaagttcggcgaagcagtctggttcaaggcaggatctcaaatcttttccgaaggtggtctaaattatctcggaaaccctaatcttattcacgcccagagcatcctagcaatttgggcatgccaggttgttttgatggggttcgtggaagggtacagagttggaggaggacctttgggtgaagggcttgacccgctttatcccggaggtgcttttgatccactaggattggccgatgatccggaagcatttgcagaattgaaggtgaaagagattaagaatggaagattggcaatgttttctatgtttggattctttgttcaggctattgttactggaaaaggacctgttgagaatctttatgaccacgttgctgatcccgtcgctaataatgcttgggcttttgccactaactttgtacccggaaaatgaactatgtaatataatgtaatgtaatgcttttgtggagattttaaatc

SEQ ID NO: 4371 - DNA, 866 bp, Flaveria ramosissima
tatcatcaattcacaacccccttactcgaatggcgacctccttgcaatccaacagtcagcattcgccggctccgcggcgttgaagccacaaaacgaactcgtcaagagaccggcggcttcaacggcggccgcttcaccatgcgccgaaccgtcaaaagtgcaccacaaagcatatggtatgggccggacaggcccaagtacttgggccctttctcggagcaaaccccatcttacctaactggtgaatttcctggtgattatggatgggacacagctggactatccgctgatcccgaaacatttgccaagaaccgtgagctcgaggtgatccactctcgtgggccatgctcggcgcactcgggtgcgtgttaccccgagatctgaaaagaacggtgtcaaattcggtgaagcggtctggttcaaggcaggttcccaaatattctcggaaggtgggcttgactatctcgggaacccaacttgatccatgctcagagcatcttagctatctgggcttgtcaggttgttctcatgggcctcattgaagggtaccgtgttggtggaggcccattgggtgaagggcttgataaggtttacccaggtgggtctttcgacccacttggattggccgatgatccggatgcatttgctgagttgaaggttaaggagcttaagaacggtcgattggctatgtttcgatgtttgggttcttcgttcaagccattgttaccggaaaaggcccgatcgagaacctgtttgatcatgttagtgatccggtggctaacaacgcttgggcttatgccaccaactttgttcctggaaaatgagtttgaatagtgtaaatttgatgatgattatgaagtaatatc

SEQ ID NO: 4372 - DNA, 1026 bp, Distylium racemosum
ggaatctcacacttctttcgcctacatcgccatggcggcatcagcctttcagatctcgagcttctcgggcaaagccctgctgtctccgcagaacgagctcctccgcaaggtcggcacgtcccagggtcgagtcttcatgcgccgcaccatcaaaagcgcccctcagagcatgtggtatgggccggaccgccccaaatatctaggtccattttcggagcaaaccccgtcatacttgaccggagaattccccggcgactacgggtgggacacggcagggctttcggcggacccagagaccttcgccaaaaatagagagctggaagtgatccactgccgctgggccatgctgggcgcgctgggatgcgttttccctgagattttggcgaaaagcggggtcaaatttggcgaagccgtctggttcaaggcgggcgcccaaattttttccgagggggggctggactacctggggaacccgaacctgatccacgctcagagcattctggccatctgggcgtgccaggtggtgctgatggggctgatcgagggatatagagtgggaggcggaccccttggggaggggttggaccctctgtaccctgggggtgccttcgacccgttgggcctggcggacgaccccgaggccttcgcggagctgaaagtgaaggagattaagaacggcaggctcgccatgttctctatgttcggtttcttcgtgcaggccattgtcaccgggaagggcccaatcgagaatttgtttgatcacttggctgatcccgccaccaacaatgcctgggcatacgccaccaattttgttcccggcaagtgaaagttgagcttgggaattttggcgccgttgtattatactctttcttcttctgcttgtcgtttttcttttgcagcttctgttattgtgtgaataaaggatttcgatctttctccaacacaagaacaacttatctctggatctgaaatgagatcgtataaatgtaatggtcgcactggggtgaatcggaggatatctagctg

SEQ ID NO: 4373 - DNA, 852 bp, Secale cereale
tgcgccggaccgtcaagagcgcgccccacgagcatctggtacggccctgaccgtcccaagtacctgggcccgttctccgagcagaccccgtcgtacctgaccggcgagttccccggcgactacgggtgggacaccgcggggctgtcggccgacccagagaccttcgccaagaaccgggagctggaggtgatccactcgcggtgggcgatgctcggcgccctggggtgcgtgttcccggagatcctgtccaagaacggcatcaagttcggcgaggcagtgtggttcaaggccggcgcccagatcttctccgagggcggcctcgactacctgggcaaccccaacctggtgcacgcgcagagcatcctggccatctgggcggttcaggtggtgctcatgggcttcatcgagggctaccgcgttggcggcggcccctcggcgagggcctcgacatcatctacccgggcggcgccttcgacccgcttggcctcgccgacgaccccgacaccgccgccgagctcaaggtgaaggagctcaagaacggccgcctcgccatgttctccatgttcggcttcttcgtgcaggccatcgtcaccgggaaggggcccgttgagaacctcttcgaccacgtcgccgacccagtcaacaacaacgcctgggccttcgccaccaacttcgcccccggaagctaaatgtgtttagccatcggacgagatatgcatgtgtacttgtacgtcgtggatcaacgtgtagctgcacgtactttgtgtgtttatttgtaccatgatcgagcgagcgagaggtcctctcgctggctgtgcgcaatgtaaattaattaagcacgaggtgcacgag

SEQ ID NO: 4374 - DNA, 917 bp, Pseudoroegneria spicata
atcaccatgcgccggtaccgtcaagagcgcgccccagagcatctggtacggccctgaccgccccaagtacctgggcccattctccgagcagaccccgtcgtacttgaccggcgagttccccggtgactacgggtgggacaccgcggggctgtcggccgacccggagacgttcgccaagaacagggagctggaggtgatccactcacggtgggccatgctcggcgccctcgggtgtgtgttccccgagatcctgtccaagaacggcatcaagttcggcgaggccgtgtggttcaaggccggcgcccagatcttctccgagggcggcctcgactacctaggcaaccccaacctggtgcacgcgcagagcatcctcgccatctgggcagttcaggtggtgctcatgggcttcatcgagggttaccgtgttggtggcggccccctgggtgagggactcgacatcatctacccgggtggcgccttcgacccacttggcctcgccgacgaccccgacaccgccgccgagctcaaggtcaaggagctcaagaacggccgcctcgccatgttctccatgttcggcttcttcgtgcaggccatcgtcaccggaaaggggccagttgagaacctcttcgaccacgtcgccgacccagtcaacaacaacgcgtgggccttcgccaccaacttcgcccccggaagctaaatgtgttaagcagccatccgtccgtccatcgaacgagatatgcatgtgtacttgtacgtcgtggatcaacgtgtagctgcacgtactttgtgtgtttatttgtaccatgatcgagcgagcgagatgccctctcgctggctgtgcgcaatgtaaattaattaagcacagggtgtgcacgagcaaatggatgaaagaatcgtgtatcattggtaaaaaaaaa

SEQ ID NO: 4375 - DNA, 1179 bp, Brassica juncea
ggcttacttatccatctgctaatctccctcaacacgaccaccttgggatctctattataaaatcgaaatgacataacatcacaccaaccatctcttctttgcttatttatctcttcatttgtgtgtttgcttggagttagagataaacaagaatggccacatcagcaatccaacactcctcttttgccggccaaacggccctgaagccctccaacgatctcctccgcaaagtcggagcttccaacggtggtggtcgcgtcgtcatgcgccgtaccgtcaagtctactcctcagagcatctggtacggaccagaccgtcccaagtacttaggaccattctcagagaacacaccatcgtacctaaccggagaataccccggagactacggttgggacacggccggtctctctgccgacccagaaacatttgcaaagaaccgtgagctcgaagtaatccacagcagatgggcaatgctaggcgctttaggttgcacattcccagagattctctctaagaacggtgttaaatttggtgaagccgtgtggttcaaggcagggtctcagatcttctcggaaggagggcttgactacctcggaaaccctaacttgatccacgcgcaaagcatattagctatctgggcttctcaagttgtgctgatggggttaatcgaagggtacagaatcggaggtggacctcttggtgaagggcttgacccgctttacccgggtggggcgtttgacccgttgaacttagctgaggatccagaagcattttcagaactgaaagtgaaggagctcaaaaacggtcggcttgccatgttctccatgtttggattctttgtccaagccattgtcactggtaaaggaccgatcgagaatctgttcgaccatcttgcggaccctgtggctaacaatgcatgggcttacgccaccaacttcgttcccggaaaatagaatactatcagctaatgtatgtttttaaaacagttatggaaatatgtctgttggtttgatgttctgtctcaatgaaagaaatgattgttagcttgaggcccttgtattgtgttcatcaagaaaatttgtgaacggctcagacttaaatcatcgaatttcaaactcatttctctacatatgctgtttaattgaatattaaaacgagaacaaagcatatagttctagg

SEQ ID NO: 4376 - DNA, 971 bp, Brassica juncea
ctctttgtttgtgtctctatttgaagttgagataacaaaaaaggaatggcaacctcagcaatccagcactcctctttcgccggacaaacggctttgaagccctccaacgatctcctccgcaaagtaggagcttccaacggtggtggtcgcgtcgtcatgcgccgtaccgtcaagtctactcctcagagcatctggtacggaccagaccgtcccaagtacttaggaccattctcagagaacacaccatcttacctaaccggagaataccccggagactacggttgggacaccgctggtctctcagccgacccagaaacctttgcaaagaaccgtgagctggaagtaatccacagcagatgggcaatgctaggcgctttaggttgcaccttcccagagattctttccaaaaacggagttaaattcggtgaagccgtgtggttcaaggcagggtctcagatcttctcagaaggagggcttgattatctcggaaaccctaacttgatccacgcgcaaagcatattagctatctgggcttctcaagttgtgttgatggggttaatcgaaggttacagaattggaggtggacctcttggtgaagggcttgacccgctttacccgggtggggcgtttgacccgttgaacttagcggaggacccggaggccttttcggaattgaaagtgaaggagctcaagaacggtcggcttgccatgttctccatgtttggattctttgtccaagccattgtcactggtaaaggtccgatagagaatctgttagatcatgttgcggaccctgtggctaacaatgcatgggcttacgccaccaacttcgtccccggaaaatagaatattatcagctgctaatgtatgtttttaaaatagtgaaatatatgtctatcggtttgatgttctgtcttaatcatcagcttgaggcccttcgtcttgcgttgatctataaaatttgtgaacgg

SEQ ID NO: 4377 - DNA, 1254 bp, Brassica napus
gttgagataaacaagaatggccacatcagtaatccagcactcctctttcgccggacaaacggctttgaagccctccaacgatctcctccgcaaagtcggagcttccaacggaggtggtcgcgtcgtcatgcgccgtaccgtcaagtctactcctcagagcatctggtacggaccagaccgtcccaagtacttaggaccattctcagagaacacaccatcgtaccttaccggtgaataccccggagactacggttgggacaccgccggtctctcagccgacccagaaaccttcgcgaagaaccgtgagctggaggtaatccacagcagatgggcaatgctcggcgctttaggttgcacattcccagagattctctccaaaaacggagtcaaattcggtgaagccgtgtggttcaaggcagggtctcagatcttctcagaaggagggcttgattacctcggaaaccctaacttgatccacgcgcaaagcatattagctatctgggcttctcaagttgtgctgatggggttgatcgaagggtacagaattggaggtggacctcttggtgaagggcttgacccgctttaccctggaggggcgtttgacccgttgaacttagcggaggatccggaggcgttttcggaattgaaagtgaaggagctaaagaacggtcggcttgccatgttctccatgtttgggttctttgtccaagccattgtcactggtaaaggaccgatcgagaatctgtttgaccatgttgcggaccctgtggctaacaatgcctgggcttacgccaccaactttgtccccggaaaatagaatattatcagataatgtatgtttttaatacaattaatgtatgtctgttggtttgatgttctgtcttaatgaaagaaatcatcgttagcttgaggcccttgtcttgtgttgtgaactgctcagacataaatcatcgaatttcaatctcatttctctacatctgttgtttaatgaaagcatatagtttctaggattccaaacctgtgaaattaccaaagaaaacattgcataaacttcaaaaatgcgtgccgttttatagattccacaccattcttcgactcgactaaagcaagtctcgaagtccaactcactgacagtcttcttgcccagcttaaccattcatctgttcttcattactttctggcgctgcaactttttcagctccctcgatgaactcgctattacttttattgttgtcattgtcgctttctttggcc

SEQ ID NO: 4378 - DNA, 1028 bp, Brassica napus
ctgtctgtatagtggggaagtagatttaaattaattaatggtaaattaatatctgatgtgatatgtctgtctattgagaatatattgtctcggtgtcgtttagttctttggattatatttgctcgttgttgttgatcttcatctttgtttatttctctcttgtttctgtttggagttgagataaacaagaatggccacatcagtaatccagcactcctctttcgccggacaaacggctttgaagccctccaacgatctcctccgcaaagtcggagcttccaacggaggtggtcgcgtcgtcatgcgccgtaccgtcaagtctactcctcagagcatctggtacggaccagaccgtcccaagtacttaggaccattctcagagaacacaccatcgtaccttaccggtgaataccccggagactacggttgggacaccgccggtctctcagccgacccagaaaccttcgcgaagaaccgtgagctggaggtaatccacagcagatgggcaatgctcggcgctttaggttgcacattcccagagattctctccaaaaacggagtcaaattcggtgaagccgtgtggttcaaggcagggtctcagatcttctcagaaggagggcttgattacctcggaaaccctaacttgatccacgcgcaaagcatattagctatctgggcttctcaagttgtgctgatggggttgatcgaagggtacagaattggaggtggacctcttggtgaagggcttgacccgctttaccctggaggggcgtttgacccgttgaacttagcggaggatccggaggcgttttcggaattgaaagtgaaggagctaaagaacggtcggcttgccatgttctccatgtttgggttctttgtccaagccattgtcactggtaaaggaccgatcgagaatctgtttgaccatgttgcggaccctgtggctaacaatgcctgggcttacgccaccaactttgtccccggaaaatagaatattatcagataatgtatgtttttaatacaattaa

SEQ ID NO: 4379 - DNA, 853 bp, Phalaenopsis aphrodite
cgtaatcctaagtttccaaaccacagctttcgccgctcatctctgctctctaatggccatctctgctattcaaggctccgccttcactggccagaccgccctcaagcagcccaacgagctcttccggaaggtaggttcagtcggcaatggcggccggatcaccatgcgccgcactgttaagagtgtacctcagagtatctggtacggcccagataggcccaagtacttgggccccttctccgaacaaacgccctcctatctaaccggtgaattccccggcgactacgggtgggacactgccggtctctccgccgatcccgaaccttcgctaaaaccgcgagctggaggtgatccatagtagatgggccatgctcggcgcactgggctgcgttttccccgagctcctctccagaaacggggtgaagttcggcgaagccgtctggttcaaggccggggcccaaatcttctcagaaggaggcctggactacctcggcaatccgaacctcatccatgcccagagcatcctagctatatgggcttctcaagtcatcctcatgggcttcgtcgaggcatatcgtgttggaggaggcccgcttggggaggggctggataagatctaccctggcggggccttcgacccattgggccttgcggatgacccggaggccttcgcggagctgaaagtgaaggaactgaagaacgggcggctggccatgttttcaatgttcgggtttttcgtgcaggctattgtgactgggaagggacctattgagaacttgtatgaccacctggctgacccaacgactaataatgcttgggcctatgcaaccaactttgtgcctggaaatgagtg

SEQ ID NO: 4380 - DNA, 964 bp, Acacia harpophylla
gaccacaacacacaccaacatcatatcatataagtatcatcatcgccgccatggccacctctgctatccatcatgccgccttcttcggccagactgggttgaagcagctcaatgagctcgtccgcaaggccggtggccccgaagtaggccgtttcaccatgcgccgcgccgtcaagagtgctcctcagagcatctggtatggccctgaccgtcccaagtacttgggccccttctccgaccaaatcccgtcatacctgactggcgaattccccggcgactacggatgggacaccgctgggttgtccgcagaccccgagaccttcgccagaaaccgcgagctggaggtgattcactgcagatgggcgatgcttggcgcactgggatgcgtgttccctgaaatcctggagaagaacggcgtcaagttcggggaggctgtgtggttcaaggctggtgcccagatcttctctgagggcagtcttgactatctcggcaaccctaacctcatccacgctcagagcatcctagcaatctgggcttgccaggttgtgttgatggggttcgtggaagggtacagggttggtggagggcctcttggagaggggcttgacccgatctacccgggtggggcttttgacccgcttggattggctgacgacccggacgcatttgcagagctgaaggtgaaagagataaagaatgggcgattggccatgttctccatgttcggcttcttcgtgcaggccattgtgaccggcaagggtcctattcagaacctttttgaccatgtcgccgaccctgttgccaacaatgcctgggcttatgccactaacttcgtccctggacaatgaacattttgtaacattccctctttcttctgctgctgctgttaaactactcatgtaattacacttgcagaagaatctgtaccacatcttacaagtatgaatgcatattgttcatctaa

SEQ ID NO: 4381 - DNA, 843 bp, Brassica napus
ctttgcctgtttctctctttcatttgtgttcttgtttggagttaaagatataaaagaatggctacttcagctatccaacactcctcttttgctggccaaacggccctcaagccctccaacgatctcctccgcaaagtcggagcttccaacggtggccgcgtggtcatgcgtcgtaccgtcaagtctactcctcagagcatctggtacggaccagaccgtcccaagtacttaggtccattctcagagaacacaccgtcgtacctaaccggtgaataccccggagactacggctgggacaccgccggtctctccgccgaccctgaaacctttgccaagaaccgtgagctcgaagttatccacagcagatgggcaatgctaggcgctttgggctgcaccttcccagagattctctccaaaaacggagtcaaattcggtgaagccgtgtggttcaaggcaggatctcagatcttctcagaaggaggacttgactacctcggaaaccctaacttgatccacgcgcaaagcattttagctatttgggcatctcaagttgtgctaatgggtttaatcgaagggtacagaatcggaggtgggccccttggtgaaggtcttgacccgctttacccgggtggggcgtttgacccgttgaacttggccgaggatccagaggcgttctcggagttgaaagtgaaggagctcaagaacggtcggcttgccatgttctctatgtttggattctttgtccaagccattgttactggtaaaggtccgattgagaacttgtttgatcatgttgcggaccctgtggctaacaatgcctgggcttacgccaccaactttgtt

SEQ ID NO: 4382 - DNA, 1097 bp, Trifolium pratense
ttaacactaaagagaacaacagcaagaaacctcaaagccctcatggccacctctgctatccaacaatcagcattcactggtaagactggtttgagacaaggaaatgagttcatcaggagagctggtaactttggcccagctcgcctcaccatgcgtcgtactgtgaagagtgctcctgaaagcatttggtatggccctgacagacccaagtacttgggtccattctcagaacaaattccatcatacctgactggtgaattccctggtgactacggatgggacacagctggattatcagctgaccctgaaacttttgcaaagaaccgtgagcttgaagtaattcacagcagatgggctatgcttggagcattgggatgtaccttccctgaaatccttgaaaagaatggtgttaaattcggcgaggcagtctggtttaaggctggtgcccagatcttctctgagggtggccttgactatttgggcaacccaaacttgatccatgctcagagcattcttgcaatctgggctactcaggttgtgctcatgggattcgttgaaggttacagaattggtggaggaccacttggtgaaggattagacccactttaccctggtggtgcctttgaccctcttggtcttgctgatgaccctgatgcatttgcagagttgaaggtgaaggaactcaagaacggccgattggctatgttctccatgtttggtttctttgttcaagccattgttaccggcaagggacctgttcagaacctttacgaccatcttgctgaccctgtcgccaacaacgcatgggcatatgctactaacttcgtccccggacaataagaatgccaagatatggctgcctcttcagctgcaatcttctgctctcatttgcatttgtgttgagtttaacttttattttcaccaatgtaattacacaagcagaacctgtatgtggctgattatatgttagaaatatggatcctaagaaatgtcaactcttgtgcatgaattcagaatattgattgagctgtgttagtcatatgcttttatgtaatctcccataataattagtttaaataatgcaaccagttcaacta

SEQ ID NO: 4383 - DNA, 1321 bp, Medicago truncatula
tatcactacaaaatataagcttgggaatccacatactaattcaccaccaataagatgttgctgacttgtgcatatcctaatctacaatatcttatgatttccaccgtggccactcccaacacttctataaacctttgtatcctttcttcattcttcacaacaacactagcttataacactaaagagaacaaacatcaagaaacctcaacgccctcatggccacctctgcaatccaacaatcagcattcactggaaagactggtttgaaacaaggaaatgagttcatcaggaaagctggtagctttggccaaagtcgcttcaccatgcgtcgtactgtgaagagtgctcctgaaagcatttggtatggcccagaccgtcccaagtacttgggtccattctctgaacaaattccatcatacttgactggtgaatttcctggtgattatggatgggacacagctggattatcagctgaccctgaaacctttgcaaggaaccgtgagcttgaagtaattcacagcagatgggccatgcttggtgcattgggatgtaccttccctgagatccttgagaagaacggtgttaaattcggtgaggctgtgtggtttaaggctggtgcccagatcttctctgagggtggccttgactatttgggcaacccaaacctgatccatgctcagagcattcttgcaatctgggctactcaggttgtgctcatgggatttgttgaaggctacagagttggtggaggaccacttggtgaaggactggacccactttaccctggtggtgcctttgaccctcttggtcttgctgatgaccccgatgcattcgcagagttgaaggtcaaggaactcaagaacggccgattggctatgttctccatgtttggtttctttgttcaagccattgttactggcaagggccccgttcagaacctttacgaccatgttgctgaccctgttgccaacaacgcatgggcatacgctactaacttcgtccccggacaatgagaacgccaagacatggcggcctcttgagctgaatcttctgcttttatttgcatttctgttgtatttaactcctattttcaccaatgtaactacacaagcagaagaacctgtatgtggctgattatatgttagaaatatggatcccaagaaatgtcaactcttgtgcatgagttcagaatatttattgggctgtcttagtcatgtttttaattaattttccgtaacctatatctcttattttatgttaattagtacaaacaagacaacaaaagacctaagccaaaaataaaatcatcaactacttaaag

SEQ ID NO: 4384 - DNA, 1157 bp, Pisum sativum
ggacaacaacatttgctagtagcatcgaagagaacaacatcaaagtgcaaggagtctcaacgccctcatggccacctctgctatccaacaatcagctttcactggtaagactggtttgaggcagggaaatgaattcatcaggaaagctggaaactttggccaagctcgctttaccatgcgtcgtactgtgaagagtgctcctgaaagcatttggtatggtcctgaccgtcccaagtacttgggtccattctctgaacaaattccatcctacctgactggtgaatttcctggtgactatggatgggacacagctggattatcagctgaccctgaaacatttgcaaggaaccgtgagcttgaagtaattcacagcagatgggctatgcttggtgcattgggatgtaccttccccgaactccttgaaaagaatggtgttaaattcggcgaggcagtgtggttcaaagccggttcccagatctttgcggagggtggccttgactatttgggcaacccaaacctgattcatgctcagagcattcttgcaatctgggctactcaggttgtgctcatgggatttgttgaaggctacagagttggaggaggacccctcggcgaaggactagacccactttaccctggtggtgcttttgaccctcttggccttgctgatgaccctgattcatttgcagagttgaaggtcaaggaactcaagaatggtcggctggctatgttctccatgtttggtttctttgttcaagccattgttactggcaagggccctattcagaacctttatgaccatgttgctgaccctgtcgcgaacaacgcatgggcttttgctactaactttgtccccggacaatgagaatgttgtctcttcagctacaatcttctgctcccattttcatttctgttgtgtttaactcccattttcatcaatgtaaattactctagcagaagaacctgtatgtggctgattatatgttagaaatatggatccaaagaaatatgtttttatcaaactcttgtgcatgagtttaacatgttgattggactgtgttaatttcccataacctataccacccttccttttagcactatgcttagacagaagctcagtttcatgcagaattcaaactttctatcatctgtttggc

SEQ ID NO: 4385 - DNA, 883 bp, Tamarix hispida
gtgagcgaggaaggggatcggactcaggaagggaaaccacacggcacgctcgtcacattttattcaggagaagagacatggcaacctcagcagtccaacaatctacattcgctggtcagtccgtcctgaagcaacaaaatgagcttgtgcgcaaggtcggcggtaacggtggtcgtgtttccatgaggagaaccgtgaaaagtgttccagaaagtatctggtacggcccagaccgtcccaagtacttgggtcctttctcagagcaaaccccatcatatctaaccggcgaattcccaggagactacggctgggacaccgctggactgtccgctgatccagagacctttgcgaggaaccgtgagcttgaggttattcactgcaggtgggcaatgttaggtgcccttggctgtgtgttccccgaaatcctctccaagaatggagtcaaattcggcgaggcggtgtggttcaaggctggagcacaaatcttccaagaaggcggattggactacctcggcaacccaaacctgatccacgcacaaagcatcctcgcaatctgggcttgtcaagtcgtgcttatgggtctcgtcgaaggatacagagtttctggaggtcccttgcgagaagggctcgacaaaatctatccaggtggagcttaagacccacttggattagcagatgatcctgaagcatttgctgagctaaaagtgaaggagattaagaatggtaggcttgcaatgttctctatgtttggattctttgtccaggcaattgtaaccggaaaggggcccgtagagaacctcttcgatcaccttgctgatccggttgcaaacaatgcatggtcttacgccacaaactttgtccctgggaagtgaacatcataaag

SEQ ID NO: 4386 - DNA, 1291 bp, Conyza canadensis
aagcgacattgaagccgcaaaacgagcttgtcaagaagaccggcagcttcaatggaggccgcttcaccatgcgccgcaccgtcaagagtgccccacaaagcatttggtatggcccggaccgcccaaagtacttaggcccgttctcggagcaaactccatcatacctaaccggtgaattcccaggtgactacgggtgggacactgcaggattatcagctgaccccgaaacatttgccaagaaccgtgagctcgaggtgatccactctcgatgggccatgcttggtgcactcgggtgcgtattccccgaggttctttcgaaaaacggagtcaaattcggtgaagccgtctggttcaaggccggttcccagattttctcagaaggtgggctcgactaccttggaaacccgaacttggtccatgctcagagcattttagccatctgggcatcacaagtggttctcatgggtctcattgaagggtaccgagttggcggtggaccactaggcgaagggctagacaaggtttatccaggtgggtcttttgacccacttggattggctgatgacccagaagcgtttgctgagttgaaagtcaaggagcttaagaacggtcgattagctatgttttcgatgtttgggttctttgttcaagccattgtaacaggaaagggaccattggagaacctggctgaccaccttgctgacccagttgccaacaatgcctggtcttatgccacaaactttgtccccggaaagtaaatgtaatctaatttgatgtaaaatgatatgtgaattaatatatattgtatttgaggatttatttgtgttcagggacttgcggtcacgggaaaatggataatatcataaaacacaaattactagttgtactaaacctgcggaattttgagctaacagcaatggtcaaacatgcagaattagatgatgcttttaatggttactttatccaagtcatatgagatacatttaactcgcaaattaaagaaaggaaggagaacatatctgcctgatctaatgtgcttcgatcaaccaatctgcccatgttgccacctatggctgtgatttgaatgctttaaaccacttcattcacctcatcatttgccactttcaactgcaatggataaagtgcttttagcgagcaattgaaaaacttacacacacgacatctggaaacaagtactcaagcaaacgcctgctttagttatagcagccaaagaatttagaaaacacaccacatagctaatagtcacatcttattgacaaaatactttttt

SEQ ID NO: 4387 - DNA, 960 bp, Tropaeolum majus
cccacacaaattcagctaagagttcaagaacaaaagaaactaaaaaacttggagaggaaacaatggctgcaacctctgctattcaacaatctgcattttctggccagacagcattgaagcagtccaatgagcttctcataaaggttggcgctttaggtgacggacggattaccatgcggcggactgttagaagtactcctcaaagcatttggtatggcgctgaccgcccgaagtacttgggtccattctcggaacagactccatcgtacctgaccggtgaatttcctggcgactatggatgggacacagctggattatcagctgacccggagacatttgccaagaaccgtgagctagaagttatccacagcagatgggcaatgcttggtgcccttggttgtgtcttccctgaaatcctttccaagaacggtgttaccttcggtgaggcggtttggttcaaagctggatctcaaatcttctctgaaggtggtcttgattatctcgggaacccgaaccttgttcatgctcagagcattttagcaatctgggctactcaggttgtgctcatgggatttgttgagggctacagagttggtggaggacctttgggcgaaggacttgacccattataccctggtggtgcttttgatcctcttggattagctgatgatcctgaggcattcgcggaattgaaagtgaaggagctgaagaacggtcgcttggctatgttctcgatgtttggattcttcgttcaggctatagttactggaaaaggtcctattgagaacctctctgaccacattgctgatccagtagccaacaacgcctgggcttttgcgactaactttgttcccgggaatgaggaaaacccaatttgattttaatttcttcaattccattgttttaggacactttggttttgtacttgaaagtctcatattgtaaaccctgatgttaata

SEQ ID NO: 4388 - DNA, 838 bp, Flaveria ramosissima
agccacaaacgagctcgtcagagaccggtagctcacggcggccgctcaccatgcgccgaaccgtcaagagtgcaccacaaagcatatggtatgggccggataggcccaagtacttgggcccttctcggaacaaaccccatcatacctaactggagtaatttcctggtgattatgggtgggacacagctggattatcagctgatcccgagacatttgccaagaaccgtgagcttgaagtgatccactctcggtgggccatgctcggtgcacttgggtgcgtgttccccgagatcttgcaaagaacggtgtcaaattcggtgaagcggtctggttcaaggcaggctcccaaataattctcagaaggtgggcttgactacctcgggaaccccaacttgatccatgctcagagcatcttagctatctgggcttgtcaggttgttctcatgggcctcattgaagggtatcgtgttggtggaggcccgttgggtgaagggctcgacaagatttacccgggtgggtcttttgacccacttggtttggctgatgatccggatgcttttgctgaattgaaggttaaggagcttaagaatgggcgattggctatgttttcgtatgtttgggttcttcgttcaggccatcgttaccggaaaaggcccgatcgagaacttgtttgatcatgtcagcgatccggtggctaacaacgcttgggcttatgccaccaactttgttcctggaaaatagagtttgattagtgtaattttgtatgatgattattaagtaatatcacaagtttccggctagtttgttatctaatgtttcaataccataaagtcgatag

SEQ ID NO: 4389 - DNA, 978 bp, Brassica juncea
gatctcatctcatctcatctcatctttgcttcatttgtgtttctgtttggagtttagataacaaaaaaaaagaatggctacgtcagcaatccagcactcctctttcgccggccaaacggccctgaagccctccaacgatctcctccgcaaagtaggagcttccaacggcggtggccgcgtcgtcatgcgtcgtaccgtcaagtctactcctcagagcatctggtacggaccagaccgtcccaagtacttaggtccattctcagagaacacaccatcatacctaaccggagaataccccggagactacggctgggacaccgccggtctctctgccaaccccgaaaccttcgccaagaaccgtgagctcgaagtaatccacagcagatgggcaatgctaggtgctttaggctgcacattcccagagattctctccaaaaacggagtcaaatttggtgaagccgtgtggttcaaggcaggttctcagatcttctcagaaggagggcttgattacctcgggaaccctaacttgatccacgcgcaaagcattttagctatctgggcttctcaagttgtgttgatgggtttgattgaagggtacagaatcggaggtggacctcttggtgaaggccttgacccgctttacccgggtggggcgtttgacccgttgaacttagccgaggatccggaggcgttttctgaattgaaggtgaaggagctcaagaacggtcgtcttgcaatgttctcgatgtttggattctttgtccaagctattgttactggtaaaggtccgatagagaatctgttcgatcatgttgcggaccctgtggctagcaatgcgtgggcttacgccaccaacttcgttcccggaaaatagaactggatcagacaaatttgtgtgttttatctttaaaatttagtgcatggacatgtttggtctgttggtttaatgttcttggattggtgaaagaaattctcaag

SEQ ID NO: 4390 - DNA, 912 bp, Phalaenopsis aphrodite
gtaatcctaagtttccaaaccacagctttcgccgctcatctctgctctctaatggccatctctgctattcaaggctccgccttcactggccagaccgccctcaagcagcccaacgagctcttccggaaggtaggttcagtcggcaatggcggccggatcaccatgcgccgcactgttaagagtgtacctcagagtatctggtacggcccagataggcccaagtacttgggccccttctccgaacaaacgccctcctatctaaccggtgaattccccggcgactacgggtgggacactgccggtctctccgccgatcccgaaaccttcgctaaaaaccgcgagctggaggtgatccatagtagatgggccatgctcggcgcactgggctgcgttttcccgagctcctctccagaacggggtgaagttcggcgaagccgtctggttcaaggccggggcccaaatcttctcagaaggaggcctggactacctcggcaatccgaacctcatccatgcccagagcatcctagctatatgggcttctcaagtcatcctcatgggcttcgtcgaggcatatcgtgttggaggaggcccgcttggggagggggctggataagatctaccctgcgggggccttcgacccattgggccttgcggatgacccggaggccttcgcggagctgaaagtgaaggaactgaagaacgggcggctggccatgttttcaatgtcgggtttttcgtgcaggctattgtgactgggaagggacctattgagaacttgtatgaccacctggctgacccaacgactaataatgcttgggcctatgcaaccaactttgtgcctgggaaatgagtgtttttttttttgttggtgtttgatttcagtgtgatttaatgaaatagggaagacaatta

SEQ ID NO: 4391 - DNA, 1201 bp, Eutrema halophilum
gacatatccatctgcaaatctccttcaagataaactctttcggatctctattataaaaaaaaaacgaaaacccatttcatctgcataacaccaacatcacatcatctcagattcaaagaatggccacgtcagcaatccaacactcttcattcgccggccaaacggccctcaagccctccaacgatctcctccgcaaagttggagcttccaacggcggtggccgcgtcgtcatgcgccgtaccgtcaagtctactcctcagagcatttggtacggaccagaccgtcccaagtacttaggaccattctcagaaaacacaccgtcgtacctaaccggagaataccccggagactacggttgggacaccgccggtctatccgccgacccagaaacgtttgcaaagaaccgtgagctcgaagtgatccacagtagatgggcaatgctaggcgctttaggctgcaccttcccagagattctctccaaaaacggagtcaagttcggtgaagccgtgtggttcaaggcaggatctcagatcttctccgaaggaggacttgattacctcggaaaccctaacttgatccacgcgcaaagcatcttagccatatgggcttctcaagttgtgttgatgggcttaattgaagggtacagaatcggaggtgggcctcttggtgaagggcttgacccactttaccccggtggagcgtttgacccattgaacttagcggaggatccagaggcgttttcggaattgaaagtgaaggagctcaagaacggtcgtcttgcaatgttctctatgtttggattctttgttcaagccattgttactggtaaaggtccgatcgagaatctcttcgatcatcttgcggaccctgtggctaacaatgcctggtcttacgccaccaacttcgtccctggaaaatagaatttgatttgaaaaatttatgtatatcttatctctttaaacatgtaatgcatgaaactgtttgagtctgttggttcaaagttattgcttgatcaaagaaattctcatcagctttgaggctcttgtctcgtttgtcattttgaacaagaaatttgtgaacggctgtgtcactatcgagattcacgaatttccttctttttttttcctaagagaatcatcgactttcaatctcgtttttctacaatagacttaaataaatttgaaaattaaaagaaataata

SEQ ID NO: 4392 - DNA, 1051 bp, Brassica rapa
tgtcgatacgaaaatggtgttagaatctacaaacggcacacattttgaatgttcatgcagtgttttgtttggtaggtttatatatttctttcaccacgcacattaaagcaagagatttaaatattttccatgcattaaaaattgaagataaaaaaaaattacatgattaatccgatcaaattctattttccgggaacaaagttggtggcgtaagcccaggcattgttagccacagggtccgcaacatgatcaaacaagttctcaatcggacctttaccagtaacaatagcttggacaaagaatccaaacatagagaacatggcaagccgaccgttcttgagctccttcactttcaactccgagaacgcctctggatcctcggccaagttcaacgggtcaaacgccccacccgggtaaagcgggtcaagaccttcaccaaggggcccacctccgattctgtacccttcgattaaacccattagcacaacttgagatgcccaaatagctaaaatgctttgcgcgtggatcaagttagggtttccgaggtagtcaagtcctccttctgagaagatctgggaacctgccttgaaccacacggcttcaccgaatttgactccgtttttggagagaatctctgggaaggtgcagcccaaagcgcctagcattgcccatctgctgtggattacttcgagctcacggttcttggcaaaggtttcagggtcggcggagagaccggcggtgtcccagccgtagtctccggggtattcaccggttaggtacgacggtgtgttctctgagaatggacctaagtacttgggacggtctggtccgaaccagatgctctgaggagtagacttgacggtacgacgcatgaccacgcggccaccgttggaagctccgactttgcggaggagatcgttggagggcttgagggccgtttggccagcaaaagaggagtgttggatagctgaagtagccattcttttatatctttaactccaaacaagaacacaaatgaaagagagaaacaggcaaagttaagatgagatgg

SEQ ID NO: 4393 - DNA, 850 bp, Flaveria ramosissima
ctctgcaatccaacagtcagcattcgccggccagccggcactgaagccgcaaaacgagctcgtcaagaagacaggcggcttcaacggtgggcgcttcaccatgcgccgcaccgttaaaagcgcgccacaaagcatttggtacggaccggaccgccccaagtacttgggcccattctctgagcaaaccccatcatacctaactggtgaattcccaggtgactatggttgggacaccgctggattgtcagctgaccctgagacattcgccaaaaccgtgagctcgaggtgatccactctaggtgggccatgctcggtgcacttgggtgcgtgttccccgagattcttgaaagaacggtgtcaaattcggtgaagcggtctggttcaaggcgggttcccaattttctcagaaggtggcttgactacctgggaacccgaacttaatccatgcccagagcattttagccatctgggcttctcaagttgttctcatgggcctcattgaaggataccgggtcggtggcggcccacttggtgaagggcttgacaagatttatccaggagggtcatttgaccctctcggattggctgatgacccagatgcatttgcggagttgaaggttaaggagcttaagaacggccgattggctatgttttcgatgtttgggtttttcgttcaagccattgtaaccggaaagggaccgatcgagaacttgtttgaccatcttagcgacccggtggctaacaacgcatgggcgtatgccaccaactttgtgcccggaaaatgagttgaatgcctgtaaaccaaaataatggtcaataatattacaagtttgtgtttttgttaagaaac

SEQ ID NO: 4394 - DNA, 1188 bp, Cicer arietinum
tagctagtagcaacaaagggaacaaacaacacaatcatggccacctctgctatccaacaatcagcattcactggcaagactggtttgaggcagggaaatgagttcatccggaaggctggtagctttggccaaggtcggtttaccatgcgtcgtactgtcaagagtactcctgagagcatctggtatggccctgaccgtcccaaatacttgggtcccttctctgaacaaattccatcatacttgactggtgaatttcctggtgactatggatgggacacagctggattatcagctgaccctgaaacctttgcaaggaaccgtgagctggaagtaattcacagcagatgggctatgcttggtgcattgggatgtaccttccctgaaatccttgaaaagaatggtgttaaatttggtgaggcagtgtggtttaaggccggtgcccaaattttctccgaaggtggtcttgactatttgggcaacccaaatctgattcatgctcagagcattcttgcaatctgggctactcaggttgtgctcatgggatttgttgaaggctacagggttggtggaggaccacttggtgaaggactagacccactttaccctggcggtgcctttgacccacttggtctggctgatgaccctgatgcatttgcagaattgaaggtgaaggaaatcaagaatggtcggttggccatgacctccatgtttggtttctttgttcaggccattgttactggcaaaggccctattcagaacctttacgaccatgttgctgaccctgtcgccaataatgcgtgggcttttgctactaactttgtccctggacaatgagaatgccatataatgcctgttttgtcagatgcaatcttctgctctcatttgcatttctgttgtgtttaactcccattttcaccaatgtaactacatgagcagaagaacctgtatgttgttgattatatattagaaatatggattccaagaaatatcaaatcttgtgcacgaatttagcatagtgatggggcctatgtttgtcatactatatttttattcccaataacctagacaacccttcctttaaagttaattagttcaaataatgcaaccaagttcaaggcgtcggccgactttttttattcatctactagtttaaaaaaattaaccgctacttaaaggtaatcacacaaa

SEQ ID NO: 4395 - DNA, 1231 bp, Cicer arietinum
cttgcctcccacgactcttatgatttccaccgtgtttactctctacgcttctataaaccattgcagcctttccttattcttcacaacactcactagctagtagcaacaaagggaacaaacaacacaatcatggccacctctgctatccaacaatcagcattcactggcaagactggtttgaggcagggaaatgagttcatccggaaggctggtagctttggccaaggtcggtttaccatgcgtcgtactgtcaagagtactcctgagagcatctggtatggccctgaccgtcccaaatacttgggtcccttctctgaacaaattccatcatacttgactggtgaatttcctggtgactatggatgggacacagctggattatcagctgaccctgaaacctttgcaaggaaccgtgagctggaagtaattcacagcagatgggctatgcttggtgcattgggatgtaccttccctgaaatccttgaaaagaatggtgttaaatttggtgaggcagtgtggtttaaggccggtgcccaaattttctccgaaggtggtcttgactatttgggcaacccaaatctgattcatgctcagagcattcttgcaatctgggctactcaggttgtgctcatgggatttgttgaaggctacagggttggtggaggaccacttggtgaaggactagacccactttaccctggcggtgcctttgacccacttggtctggctgatgaccctgatgcatttgcagaattgaaggtgaaggaaatcaagaatggtcggttggccatgacctccatgtttggtttctttgttcaggccattgttactggcaaaggccctattcagaacctttacgaccatgttgctgaccctgtcgccaataatgcgtgggcttttgctactaactttgtccctggacaatgagaatgccatataatgcctgttttttcagatgcaatcttctgctctcatttgcatttctgttgtgtttaactcccattttcaccaatgtaactacatgagcagaagaacctgtatgttgttgattatatattagaaatatggattccaagaaatatcaaatcttgtgcacgaatttagcatagtgatggggcctatgtttgtcatactatatttttattcccaataacctagacaacccttcctttaaagttaattagttcaaataatgcaaccaagttcaaggcgtcggcgacagtcgtcgtgt

SEQ ID NO: 4396 - DNA, 944 bp, Zostera marina
caaaaaactattcgttctcttccattttgaagctcaaggaatggccacctctgcgattcatcaatctgtctttgttggtcagacaaccttgaagcaacaaaatgaacttgtccgcaaagttggagtcttcgagagtcgcatatctatgcgccgcacagtgaagagcactcccgacagcgtttggtacggcgcagaccgtcccaagtacttgggtccattctctgagcaaactccatcatacctaactggtgaattcccaggtgactacggttgggacacagccggtctatcagcggacccagagaccttcgcaaagaaccgtgaacttgaggtgatccattgcagatgggccatgttgggcgccttaggttgtgtctttccagagcttctatcaaagaacggagttaaattcggtgaagccgtttggttcaaagctggatctcaaatcttctcagatggtgggcttgactacttaggcaatcctaacttggtccatgctcaaagcatcttggccatatgggcttgccaagttgttttgatgggctttatcgaaggataccgcgttggtggaggtccacttggagatggtcttgacccactttacccaggaggctcattcgacccattgggcttagctgatgacccagaggccttcaccgaattgaaggtcaaagaggttaagaacggacggttggctatgttctcgatgttcggatatttcgtccaagctattgtgaccggtaaaggtccaattgagaacctatacgaccaccttgccgacccagtcgccaacaatgcttgggcctttgctacaaacttctcccccgaaaactaaatataacaatctccatatataattgcatgtaaactttgtttgtttgttgattcttttggattctcgtaattttcgaaaaattttaaccaaactaacttaaatatcaatg

SEQ ID NO: 4397 - DNA, 996 bp, Zostera marina
acaccagtccgtttgaaaatcaaagaacacagcaaaaaactattcgttctcttccattttgaagcttaaggaatggccacctctgcgattcatcaatctgtctttgttggtcagacaaccttgaagcaacaaaatgaacttgtccgcaaagttggagtcttcgagagtcgcatatctatgcgccgcacagtgaagagcactcccgacagcgtttggtacggcgcagaccgtcccaagtacttgggtccattctctgagcaaactccatcatacctaactggtgaattcccaggtgactacggttgggacacagccggtctatcagcggacccagagaccttcgcaaagaaccgtgaacttgaggtgatccattgcagatgggccatgttgggcgccttaggttgtgtctttccagagcttctatcaaagaacggagttaaattcggtgaagccgtttggttcaaagctggatctcaaatcttctcagatggtgggcttgactacttaggcaatcctaacttggtccatgctcaaagcatcttggccatatgggcttgccaagttgttttgatgggctttatcgaaggataccgcgttggtggaggtccacttggagatggtcttgacccactttacccaggaggctcattcgacccattgggcttagctgatgacccagaggccttcaccgaattgaaggtcaaagaggttaagaacggacggttggctatgttctcgatgttcggatatttcgtccaagctattgtgaccggtaaaggtccaattgagaacctatacgaccaccttgccgacccagtcgccaacaatgcttgggcctttgctacaaacttctcccccgcaaactaaatataacaatctccatatataatttgcatgtaaactttgtttgtttgtttgatcttttggattctcgaatttttcgaaaagttttaaccaaacaacttaaatatcaatgtgagtgagatttgtaaacaa

SEQ ID NO: 4398 - DNA, 917 bp, Zostera marina
ccgtttgaaaaatcaaagaacacagcaaaaaactattcgttctcttccattttgaagctcaaggaatggccacctctgcgattcatcaatctgtctttgttggtcagacaaccttgaagcaacaaaatgaacttgtccgcaaagttggagtcttcgagagtcgcatatctatgcgccgcacagtgaagagcactcccgacagcgtttggtacggcgcagaccgtcccaagtacttgggtccattctctgagcaaactccatcatacctaactggtgaattcccaggtgactacggttgggacacagccggtctatcagcggacccagagaccttcgcaaagaaccgtgaacttgaggtgatccattgcagatgggccatgttgggcgccttaggttgtgtctttccagagcttctatcaaagaacggagttaaattcggtgaagccgtttggttcaaagctggatctcaaatcttctcagatggtgggcttgactacttaggcaatcctaacttggtccatgctcaaagcatcttggccatatgggcttgccaagttgttttgatgggctttatcgaaggataccgcgttggtggaggtccacttggagatggtcttgacccactttacccaggaggctcattcgacccattgggcttagctgatgacccagaggccttcaccgaattgaaggtcaaagaggttaagaacggacggttggctatgttctcgatgttcggatatttcgtccaagctattgtgaccggtaaaggtccaattgagaacctatacgaccaccttgccgacccagtcgccaacaatgcttgggcctttgctacaaacttctcccccgcaaactaaatataacaatctccatatataatttgcatgtaaactttgtttgtttgtttgatcttt

SEQ ID NO: 4399 - DNA, 1084 bp, Zostera marina
acacagcaaaaaactattcgttctcttccattttgaagctcaaggaatggccacctctgcgattcatcaatctgtctttgttggtcagacaaccttgaagcaacaaaatgaacttgtccgcaaagttggagtcttcgagagtcgcatatctatgcgccgcacagtgaagagcactcccgacagcgtttggtacggcgcagaccgtcccaagtacttgggtccattctctgagcaaactccatcatacctaactggtgaattcccaggtgactacggttgggacacagccggtctatcagcggacccagagaccttcgcaaagaaccgtgaacttgaggtgatccattgcagatgggccatgttgggcgccttaggttgtgtctttccagagcttctatcaaagaacggagttaaattcggtgaagccgtttggttcaaagctggatctcaaatcttctcagatggtgggcttgactacttaggcaatcctaacttggtccatgctcaaagcatcttggccatatgggcttgccaagttgttttgatgggctttatcgaaggataccgcgttggtggaggtccacttggagatggtcttgacccactttacccaggaggctcattcgacccattgggcttagctgatgacccagaggccttcaccgaattgaaggtcaaagaggttaagaacggacggttggctatgttctcgatgttcggatatttcgtccaagctattgtgaccggtaaaggtccaattgagaacctatacgaccaccttgccgacccagtcgccaacaatgcttgggcctttgctacaaacttctcccccgcaaactaaatataacaatctccatatataatttgcatgtaaactttgtttgtttgtttgatcttttggattctcgaattttcgaaaagttttaaccaaacaacttaaatatcaatgtgagtgagatttgtaaacaatgtgtttgttgtttgaaaattggaataaatgagttttattcagacaattttgatgtctttcttgctcgtttgactggtagaggatcgagcgtataaaagaatcttcttttgaacg

SEQ ID NO: 4400 - DNA, 1102 bp, Zostera marina
cctctccctcgtgctcgttcgcgagtctcaagaagacaggtaggttcttaacgacgacaggtaatacgggtacgggtacctaactacgttttccgtttaaagtaacacaacacacgacaaaaaactaattcgttctcttccattttgaagctcaaggaatggccacctctgcgattcatcaatctgtctttgttggtcagacaaccttgaagcaacaaaatgaacttgtccgcaaagttggagtcttcgagagtcgcatatctatgcgccgcacagtgaagagcactcccgacagcgtttggtacggcgcagaccgtcccaagtacttgggtccattctctgagcaaactccatcatacctaactggtgaattcccaggtgactacggttgggacacagccggtctatcagcggacccagagaccttcgcaaagaaccgtgaacttgaggtgatccattgcagatgggccatgttgggcgccttaggttgtgtctttccagagcttctatcaaagaacggagttaaattcggtgaagccgtttggttcaaagctggatctcaaatcttctcagatggtgggcttgactacttaggcaatcctaacttggtccatgctcaaagcatcttggccatatgggcttgccaagttgttttgatgggctttatcgaaggataccgcgttggtggaggtccacttggagatggtcttgacccactttacccaggaggctcattcgacccattgggcttagctgatgacccagaggccttcaccgaattgaaggtcaaagaggttaagaacggacggttggctatgttctcgatgttcggatatttcgtccaagctattgtgaccggtaaaggtccaattgagaacctatacgaccaccttgccgacccagtcgccaacaatgcttgggcctttgctacaaatttctcccccgcaaactaaatataacaatctccatatataatttgcatgtaaactttgtttgtttgtttgatcttttggattctcgaattttcgaaaagttttaaccaaacaacttaaatatcaatgtgagtgagatttgtaaacaatgtgtttgttgtttgaaaatt

SEQ ID NO: 4401 - DNA, 1037 bp, Zostera marina
ccctacctccctgtgctcgtcgcagtccagaccgtgtctacacgcagatcggagggaagaacacagcaaaaactattcgttctcttccattttgaagcttaaggaatggccacctctgcgattcatcaatctgtctttgttggtcagacaaccttgaagcaacaaaatgaacttgtccgcaaagttggagtcttcgagagtcgcatatctatgcgccgcacagtgaagagcactcccgacagcgtttggtacggcgcagaccgtcccaagtacttgggtccattctctgagcaaactccatcatacctaactggtgaattcccaggtgactacggttgggacacagccggtctatcagcagacccagagaccttcgcaaagaaccgtgaacttgaggtgatccattgcagatgggccatgttgggcgccttaggttgtgtctttccagagcttctatcaaagaacggagttaaattcggtgaagccgtttggttcaaagctggatctcaaatcttctcagatggtgggcttgactacttaggcaatcctaacttggtccatgctcaaagcatcttggccatatgggcttgccaagttgttttgatgggctttatcgaaggataccgcgttggtggaggtccacttggagatggtcttgacccactttacccaggaggctcattcgacccattgggcttagctgatgacccagaggccttcaccgaattgaaggtcaaagaggttaagaacggacggttggctatgttctcgatgttcggatatttcgtccaagctattgtgaccggtaaaggtccaattgagaacctatacgaccaccttgccgacccagtcgccaacaatgcttgggcctttgctacaaacttctcccccgcaaactaaatataacaatctccatatataatttgcatgtaaactttgtttgtttgtttgatcttttggattctcgaattttcgaaaagttttaaccaaacaacttaaatatcaatgtgagtgagtatttgtaaacaatgtgtttt

SEQ ID NO: 4402 - DNA, 1075 bp, Zostera marina
cctacttaccccttcccgttcggttggcctttcgggttcgacgtatcacaagacagggtagtctaacgaccacgagtaacgtcggaaggaacaacaggaaagaaaaaactattcgttctcttccattttgaagctcaaggaatggccacctctgcgattcatcaatctgtctttgttggtcagacaaccttgaagcaacaaaatgaacttgtccgcaaagttggagtcttcgagagtcgcatatctatgcgccgcacagtgaagagcactcccgacagcgtttggtacggcgcagaccgtcccaagtacttgggtccattctctgagcaaactccatcatacctaactggtgaattcccaggtgactacggttgggacacagccggtctatcagcggacccagagaccttcgcaaagaaccgtgaacttgaggtgatccattgcagatgggccatgttgggcgccttaggttgtgtctttccagagcttctatcaaagaacggagttaaattcggtgaagccgtttggttcaaagctggatctcaaatcttctcagatggtgggcttgactacttaggcaatcctaacttggtccatgctcaaagcatcttggccatatgggcttgccaagttgttttgatgggctttatcgaaggataccgcgttggtggaggtccacttggagatggtcttgacccactttacccaggaggctcattcgacccattgggcttagctgatgacccagaggccttcaccgaattgaaggtcaaagaggttaagaacggacggttggctatgttctcgatgttcggatatttcgtccaagctattgtgaccggtaaaggtccaattgagaacctatacgaccaccttgccgacccagtcgccaacaatgcttgggcctttgctacaaacttctcccccgcaaactaaatataacaatctccatatataatttgcatgtaaactttgtttgtttgtttgattcttttggattctcgtaattttcgaaaagttttaaccaaactaacttaaatatcaatgtgagtgagtatttgtaaacaatgtgttt

SEQ ID NO: 4403 - DNA, 1019 bp, Zostera marina
acaccagtccgtttgaaaatcaaagaacacagcaaaaaactattcgttctcttccattttgaagcttaaggaatggccacctctgcgattcatcaatctgtctttgttggtcagacaaccttgaagcaacaaaatgaacttgtccgcaaagttggagtcttcgagagtcgcatatctatgcgccgcacagtgaagagcactcccgacagcgtttggtacggcgcagaccgtcccaagtacttgggtccattctctgagcaaactccatcatacctaactggtgaattcccaggtgactacggttgggacacagccggtctatcagcagacccagagaccttcgcaaagaaccgtgaacttgaggtgatccattgcagatgggccatgttgggcgccttaggttgtgtctttccagagcttctatcaaagaacggagttaaattcggtgaagccgtttggttcaaagctggatctcaaatcttctcagatggtgggcttgactacttaggcaatcctaacttggtccatgctcaaagcatcttggccatatgggcttgccaagttgttttgatgggctttatcgaaggataccgcgttggtggaggtccacttggagatggtcttgacccactttacccaggaggctcattcgacccattgggcttagctgatgacccagaggccttcaccgaattgaaggtcaaagaggttaagaacggacggttggctatgttctcgatgttcggatatttcgtccaagctattgtgaccggtaaaggtccaattgagaacctatacgaccaccttgccgacccagtcgccaacaatgcttgggcctttgctacaaacttctcccccgcaaactaaatataacaatctccatatataatttgcatgtaaactttgtttgtttgtttgatcttttggattctcgaattttcgaaaagttttaacccaaacaacttaaatatcaatgtgagtgagatttgtaaacaatgtgtttgttgtttgaaaattgg

SEQ ID NO: 4404 - DNA, 1029 bp, Zostera marina
cgggaagaacacagcaaaaactaaattcgttctcttccattttgaagctcaaggaatggccacctctgcgattcatcaatctgtctttgttggtcagacaaccttgaagcaacaaaatgaacttgtccgcaaagttggagtcttcgagagtcgcatatctatgcgccgcacagtgaagagcactcccgacagcgtttggtacggcgcagaccgtcccaagtacttgggtccattctctgagcaaactccatcatacctaactggtgaattcccaggtgactacggttgggacacagccggtctatcagcggacccagagaccttcgcaaagaaccgtgaacttgaggtgatccattgcagatgggccatgttgggcgccttaggttgtgtctttccagagcttctatcaaagaacggagttaaattcggtgaagccgtttggttcaaagctggatctcaaatcttctcagatggtgggcttgactacttaggcaatcctaacttggtccatgctcaaagcatcttggccatatgggcttgccaagttgttttgatgggctttatcgaaggataccgcgttggtggaggtccacttggagatggtcttgacccactttacccaggaggctcattcgacccattgggcttagctgatgacccagaggccttcaccgaattgaaggtcaaagaggttaagaacggacggttggctatgttctcgatgttcggatatttcgtccaagctattgtgaccggtaaaggtccaattgagaacctatacgaccaccttgccgacccagtcgccaacaatgcttgggcctttgctacaaacttctcccccgcaaactaaatataacaatctccatatataatttgcatgtaaactttgtttgtttgtttgatcttttggattctcgaattttcgaaaagttttaaccaaacaacttaaatatcaatgtgagtgagatttgtaaaactagttagttgtttgtttgtttagtaaaattggaataatgtatttatacaagt

SEQ ID NO: 4405 - DNA, 1010 bp, Zostera marina
acacagcaaaaaactattcgttctcttccattttgaagcttaaggaatggccacctctgcgattcatcaatctgtctttgttggtcagacaaccttgaagcaacaaaatgaacttgtccgcaaagttggagtcttcgagagtcgcatatctatgcgccgcacagtgaagagcactcccgacagcgtttggtacggcgcagaccgtcccaagtacttgggtccattctctgagcaaactccatcatacctaactggtgaattcccaggtgactacggttgggacacagccggtctatcagcggacccagagaccttcgcaaagaaccgtgaacttgaggtgatccattgcagatgggccatgttgggcgccttaggttgtgtctttccagagcttctatcaaagaacggagttaaattcggtgaagccgtttggttcaaagctggatctcaaatcttctcagatggtgggcttgactacttaggcaatcctaacttggtccatgctcaaagcatcttggccatatgggcttgccaagttgttttgatgggctttatcgaaggataccgcgttggtggaggtccacttggagatggtcttgacccactttacccaggaggctcattcgacccattgggcttagctgatgacccagaggccttcaccgaattgaaggtcaaagaggttaagaacggacggttggctatgttctcgatgttcggatatttcgtccaagctattgtgaccggtaaaggtccaattgagaacctatacgaccaccttgccgacccagtcgccaacaatgcttgggcctttgctacaaacttctcccccgcaaactaaatataacaatctccatatataatttgcatgtaaactttgtttgtttgtttgatcttttggattctcgaattttcgtaaaagttttaaccaaacaacttaaatatcaatgtgagtgagatttgtaaacaatgtgtttgttgtttgaaaattggaataaatgagttttatt

SEQ ID NO: 4406 - DNA, 1043 bp, Zostera marina
cgtcctcctgtgctcgtgaggtcgcaagaggggggtgacacgcagatcggagggaaagaacacagcaaaaaactattcgttctcttccattttgaagctcaaggaatggccacctctgcgattcatcaatctgtctttgttggtcagacaaccttgaagcaacaaaatgaacttgtccgcaaagttggagtcttcgagagtcgcatatctatgcgccgcacagtgaagagcactcccgacagcgtttggtacggcgcagaccgtcccaagtacttgggtccattctctgagcaaactccatcatacctaactggtgaattcccaggtgactacggttgggacacagccggtctatcagcggacccagagaccttcgcaaagaaccgtgaacttgaggtgatccattgcagatgggccatgttgggcgccttaggttgtgtctttccagagcttctatcaaagaacggagttaaattcggtgaagccgtttggttcaaagctggatctcaaatcttctcagatggtgggcttgactacttaggcaatcctaacttggtccatgctcaaagcatcttggccatatgggcttgccaagttgttttgatgggctttatcgaaggataccgcgttggtggaggtccacttggagatggtcttgacccactttacccaggaggctcattcgacccattgggcttagctgatgacccagaggccttcaccgaattgaaggtcaaagaggttaagaacggacggttggctatgttctcgatgttcggatatttcgtccaagctattgtgaccggtaaaggtccaattgagaacctatacgaccaccttgccgacccagtcgccaacaatgcttgggcctttgctacaaacttctcccccgcaaactaaatataacaatctccatatataatttgcatgtaaactttgtttgtttgtttgatcttttggattctcgaattttcgaaaagttttaaccaaacaacttaaatatcaatgtgagtgagatttggtaaacaatgtgtttgttgttt

SEQ ID NO: 4407 - DNA, 994 bp, Zostera marina
aaaaaactattcgttctcttccattttgaagctcaaggaatggccacctctgcgattcatcaatctgtctttgttggtcagacaaccttgaagcaacaaaatgaacttgtccgcaaagttggagtcttcgagagtcgcatatctatgcgccgcacagtgaagagcactcccgacagcgtttggtacggcgcagaccgtcccaagtacttgggtccattctctgagcaaactccatcatacctaactggtgaattcccaggtgactacggttgggacacagccggtctatcagcggacccagagaccttcgcaaagaaccgtgaacttgaggtgatccattgcagatgggccatgttgggcgccttaggttgtgtctttccagagcttctatcaaagaacggagttaaattcggtgaagccgtttggttcaaagctggatctcaaatcttctcagatggtgggcttgactacttaggcaatcctaacttggtccatgctcaaagcatcttggccatatgggcttgccaagttgtcttgatgggctttatcgaaggataccgcgttggtggaggtccacttggagatggtcttgacccactttacccaggaggctcattcgacccattgggcttagctgatgacccagaggccttcaccgaattgaaggtcaaagaggttaagaacggacggttggctatgttctcgatgttcggatatttcgtccaagctattgtgaccggtaaaggtccaattgagaacctatacgaccaccttgccgacccagtcgccaacaatgcttgggcctttgctacaaacttctcccccgcaaactaaatataacaatctccatatataatttgcatgtaaactttgtttgtttgtttgatcttttggattctcgaattttcgaaaagttttaaccaaacaacttaaatatcaatgtgagtgagatttgtaaacaatgtgtttgttgtttgaaaattggaataaatga

SEQ ID NO: 4408 - DNA, 1043 bp, Zostera marina
ccgtagaagacgagtcggtaagtctaacgacgacgaagtacgacggaacgacaagctaaaaaactattcgttctcttccattttgaagcttaaggaatggccacctctgcgattcatcaatctgtctttgttggtcagacaaccttgaagcaacaaaatgaacttgtccgcaaagttggagtcttcgagagtcgcatatctatgcgccgcacagtgaagagcactcccgacagcgtttggtacggcgcagaccgtcccaagtacttgggtccattctctgagcaaactccatcatacctaactggtgaattcccaggtgactacggttgggacacagccggtctatcagcggacccagagaccttcgcaaagaaccgtgaacttgaggtgatccattgcagatgggccatgttgggcgccttaggttgtgtctttccagagcttctatcaaagaacggagttaaattcggtgaagccgtttggttcaaagctggatctcaaatcttctcagatggtgggcttgactacttaggcaatcctaacttggtccatgctcaaagcatcttggccatatgggcttgccaagttgttttgatgggctttatcgaaggataccgcgttggtggaggtccacttggagatggtcttgacccactttacccaggaggctcattcgacccattgggcttagctgatgacccagaggccttcaccgaattgaaggtcaaagaggttaagaacggacggttggctatgttctcgatgttcggatatttcgtccaagctattgtgaccggtaaaggtccaattgagaacctatacgaccaccttgccgacccagtcgccaacaatgcttgggcctttgctacaaacttctcccccgcaaactaaatataacaatctccatatataatttgcatgtaaactttgtttgtttgtttgattcttttggattctacgtaaattttcgaaaagttttaaccaaacaacttaaatatcagtgtgagtgagatttgtaaacaatgtgtttgttgtttagaaaa

SEQ ID NO: 4409 - DNA, 884 bp, Zostera marina
gaacacagcaaaaaactattcgttctcttccattttgaagcttaaggaatggccacctctgcgattcatcaatctgtctttgttggtcagacaaccttgaagcaacaaaatgaacttgtccgcaaagttggagtcttcgagagtcgcatatctatgcgccgcacagtgaagagcactcccgacagcgtttggtacggcgcagaccgtcccaagtacttgggtccattctctgagcaaactccatcatacctaactggtgaattcccaggtgactacggttgggacacagccggtctatcagcggacccagagaccttcgcaaagaaccgtgaacttgaggtgatccattgcagatgggccatgttgggcgccttaggttgtgtctttccagagcttctatcaaagaacggagttaaattcggtgaagccgtttggttcaaagctggatctcaaatcttctcagatggtgggcttgactacttaggcaatcctaacttggtccatgctcaaagcatcttggccatatgggcttgccaagttgttttgatgggctttatcgaaggataccgcgttggtggaggtccacttggagatggtcttgacccactttacccaggaggctcattcgacccattgggcttagctgatgacccagaggccttcaccgaattgaaggtcaaagaggttaagaacggacggttggctatgttctcgatgttcggatatttcgtccaagctattgtgaccggtaaaggtccaattgagaacctatacgaccaccttgccgacccagtcgccaacaatgcttgggcctttgctacaaacttctcccccgcaaactaaatataacaatctccatatataatttgcatgtaaactttgtt

SEQ ID NO: 4410 - DNA, 1004 bp, Zostera marina
aagaacacagcaaaaactaattcgttctcttccattttgaagctcaaggaatggccacctctgcgattcatcaatctgtctttgttggtcagacaaccttgaagcaacaaaatgaacttgtccgcaaagttggagtcttcgagagtcgcatatctatgcgccgcacagtgaagagcactcccgacagcgtttggtacggcgcagaccgtcccaagtacttgggtccattctctgagcaaactccatcatacctaactggtgaattcccaggtgactacggttgggacacagccggtctatcagcggacccagagaccttcgcaaagaaccgtgaacttgaggtgatccattgcagatgggccatgttgggcgccttaggttgtgtctttccagagcttctatcaaagaacggagttaaattcggtgaagccgtttggttcaaagctggatctcaaatcttctcagatggtgggcttgactacttaggcaatcctaacttggtccatgctcaaagcatcttggccatatgggcttgccaagttgttttgatgggctttatcgaaggataccgcgttggtggaggtccacttggagatggtcttgacccactttacccaggaggctcattcgacccattgggcttagctgatgacccagaggccttcaccgaattgaaggtcaaagaggttaagaacggacggttggctatgttctcgatgttcggatatttcgtccaagctattgtgaccggtaaaggtccaattgagaacctatacgaccaccttgccgacccagtcgccaacaatgcttgggcctttgctacaaacttctcccccgcaaactaaatataacaatctccatatataatttgcatgtaaactttgtttgtttgtttgatcttttggattctcgaatttttcgaaaagtttttaaccaaaacaacttaaatatcaatgtgagtgagatttgtaaacaatgtgtttgttgtttagaaaattggaaat

SEQ ID NO: 4411 - DNA, 1218 bp, Cicer arietinum
agcaacaaagggaacaaacaacacaatcatggccacctctgctatccaacaatcagcattcactggcaagactggtttgaggcagggaaatgagttcatccggaaggctggtagctttggccaaggtcggtttaccatgcgtcgtactgtcaagagtactcctgagagcatctggtatggccctgaccgtcccaaatacttgggtcccttctctgaacaaattccatcatacttgactggtgaatttcctggtgactatggatgggacacagctggattatcagctgaccctgaaacctttgcaaggaaccgtgagctggaagtaattcacagcagatgggctatgcttggtgcattgggatgtaccttccctgaaatccttgaaaagaatggtgttaaatttggtgaggcagtgtggtttaaggccggtgcccaaattttctccgaaggtggtcttgactatttgggcaacccaaatctgattcatgctcagagcattcttgcaatctgggctactcaggttgtgctcatgggatttgttgaaggctacagggttggtggaggaccacttggtgaaggactagacccactttaccctggcggtgcctttgacccacttggtctggctgatgaccctgatgcatttgcagaattgaaggtgaaggaaatcaagaatggtcggttggccatgacctccatgtttggtttctttgttcaggccattgttactggcaaaggccctattcagaacctttacgaccatgttgctgaccctgtcgccaataatgcgtgggcttttgctactaactttgtccctggacaatgagaatgccatataatgcctgttttgtcagatgcaatcttctgctctcatttgcatttctgttgtgtttaactcccattttcaccaatgtaactacatgagcagaagaacctgtatgttgttgattatatattagaaatatggattccaagaaatatcaaatcttgtgcacgaatttagcatagtgatggggcctatgtttgtcatactatatttttattcccaataacctagacaacccttcctttaaagttaattagttcaaataatgcaaccaagttcaaggcgtcggccgactttttttatcatctactgtttaaaaaaaaatcagctacttaaaggtaatcacacaaagacgcctgctatttagaatgaattagtttgcacgcaaataa

SEQ ID NO: 4412 - DNA, 1071 bp, Pinus taeda
gacacttggtctgagcatttttctcattctcacgttaaacatggcaacagcttcagccatacaaagctcaagcttggccggccagaccctcctgaggccgcagcagaatgagctcgtcaagaaagtgggcgcgtcgcaagctcgaatcaccatgcgtagaaccgtaaggagcgcccctgagagcatttggtatggacctgaccgccccaagtacctcggccccttctcggaacagacgccgtcgtatctcaccggagaatttcccggagactacgggtgggacacagccgggctctctgccgatcccgagaccttcgccaaaaacagagagctggaggtgatccactccagatgggccatgttgggggcgctgggctgcgttttcccggagctgttggccaaaaacggggtgaaatttggggaagccgtgtggttcaaggccggggcgcagatattctcagagggaggcctcgactacctggggaaccctaatttgattcacgcacagagcatactcgccatctgggcctgccaggttgtgctcatgggattgattgaaggatacagagtgggaggaggaccccttggggaggggttggaccctctgtacccagggggtgccttcgacccactgggactggccgacgacccggaggctttcgcggagctaaaggtgaaggagataaagaacgggcggctggccatgttctccatgttcggcttcttcgtgcaggcaatcgtgaccgggaagggcccagttgaaaatctctacgaccacttggcggaccccgttgccaacaatgcctgggcctacgccaccaatttcgttcccggcaaataagttaaagtgacggaaaataaaggaggcctggaatctctgtatcaatatttgacggcttttcctgttaataatccaattcacattaaactagacgtggcttgtctagtttttatgtgtttagctttcggctgaaatcgtttattattttttgttttgtaaagaaaatggaaatagtaatataaatttgggtcctaatgacgaaatgaaaccataaatcaaaagaaaagatg

SEQ ID NO: 4413 - DNA, 1151 bp, Pseudotsuga menziesii
tgaggctgttgccatggtgaatatgacaatgagaacaaacgctcatcactgatacaaactgaccttggtccgagcatttttctcattgtcatattcaccatggcaacagcctcagccatccaaagttcaagcttggcaggacagaccctcctgaggccgcagcagaatgagctcgtcaggaaggtgggcgcgtcgcaggctcgaatcaccatgcgaagaaccgtcagaagcgcccctgagagcatttggtatggacctgatcgccccaagtacctgggccccttttcggaacagacgccgtcgtatctcaccggagaatttcccggggattacgggtgggacaccgccggactctcggccgacccagagaccttcgctaaaaatagagagctggaggtgatccacagcagatgggcgatgttgggagcgctcggctgtgttttcccggagctgttggccaaaaacggggtcaaatttggagaagccgtgtggtttaaggccggggcgcagatattctcggagggaggcctcgactacctgggaaaccccaacctgatccacgcgcagagcattctagccatctgggccttccaagttgtgctcatgggattgattgaaggatacagagtgggaggaggaccccttggggaggggttggacccattgtacccagggggtgccttcgacccactagggttggccgacgacccagaggccttcgcggagctgaaggtgaaggagctaaagaacgggcggctggcgatgttctccatgttcggcttcttcgtgcaggcaatcgtgaccggcaagggccccatcgaaaacctattcgaccacttggcagaccccactgccaacaatgcctgggcctatgccaccaatttcgttcccggcaagtgaagtgactaaaaataaaagaggaaggctgtaatctgttatctgtgcattattaatttgaaaatggcctttcgcgtcaataaacgactgtatttaactagataatacctggtaagtaattgtaatggctgtatttaactagataatacctgttaagcaattgtaatggtttttctggtttgtagttgttattttgtctttttttcatcgattaatgtttattgagaccaactttggtctatcttggatcttaa

SEQ ID NO: 4414 - DNA, 1158 bp, Silene vulgaris
gatgataaccaataagaataagctgaaatgtgtaatgctcatccacaacataacccattaactaaccttataagcacacccacccagtgtcttcagaaaagtaagcacaaacaaaaacagcaacagtcataataatacagcagcagaagaaactcataaaagaaaggttaaggcatggccacctccaccatccaacaatctggatttgtagggcagaccatcttgaagcctcagaacgagctcgttcgtaaggtcggtggtaatggtggccgcgtctccatgcgccgtactatcaagagtgctcctgaaagcatctggtacggtccagaccgtcccaagtacttgggcccattctcagagcaaaccccatcataccttacaggtgaattccccggtgattacggctgggacactgctggactctcagctgacccagagacattcgccaagaaccgtgagcttgaagtgatccactgcaggtgggccatgcttggggccctcggatgtgttttccccgagctcctggctaagaatggggtcaaattcggagaggcggtctggttcaaagcaggttctcaaatattccaagagggcggtctcgactaccttggcaacccaaacctggttcatgctcagagcatcctagctatctgggcctgccaggttgttctcatgggtgcagttgaagggtaccgcgttggtggtggaccattgggtgaagggcttgaccagctttacccaggaggagcatttgacccacttgggctcgcggaggatccagaggcctttgcagagttgaaggtcaaggaaattaagaatggaaggttggctatgttctccatgttcggatactttgttcaggccattgttactggcaagggacccgtcgagaacctatacgaccatcttgctgaccctgtggctaacaatgcttgggcatacgccaccaacttcgtccctggcaagtgagaacaatttactatgtaaaatcacttaggctactttattgtgaatcatcaactatgtatgtcagtatgtgagttggacaatgtgcttctagtaagaatatgcaaatttatggtggttctcgcggttgcctcagtttatccgatatccaatgtatctgtatcttaacttctaatcgaaattttagttaac

SEQ ID NO: 4415 - DNA, 1017 bp, Zostera marina
ggggaaagaacacagcaaaaaaaaactattcgttctcttccattttgaagctcaaggaatggccacctctgcgattcatcaatctgtctttgttggtcagacaaccttgaagcaacaaaatgaacttgtccgcaaagttggagtcttcgagagtcgcatatctatgcgccgcacagtgaagagcactcccgacagcgtttggtacggcgcagaccgtcccaagtacttgggtccattctctgagcaaactccatcatacctaactggtgaattcccaggtgactacggttgggacacagccggtctatcagcggacccagagaccttcgcaaagaaccgtgaacttgaggtgatccattgcagatgggccatgttgggcgccttaggttgtgtctttccagagcttctatcaaagaacggagttaaattcggtgaagccgtttggttcaaagctggatctcaaatcttctcagatggtgggcttgactacttaggcaatcctaacttggtccatgctcaaagcatcttggccatatgggcttgccaagttgttttgatgggctttatcgaaggataccgcgttggtggaggtccacttggagatggtcttgacccactttacccaggaggctcattcgacccattgggcttagctgatgacccagaggccttcaccgaattgaaggtcaaagaggttaagaacggacggttggctatgttctcgatgttcggatatttcgtccaagctattgtgaccggtaaaggtccaattgagaacctatacgaccaccttgccgacccagtcgccaacaatgcttgggcctttgctacaaacttctcccccgcaaactaaatataacaatctccatatataatttgcatgtaaactttgtttgtttgtttgatcttttggattctcgaattttcgaaaagttttaaccaaacaacttaaatatcaatgtgagtgagatttgtaaacaatgtgtttgttgtttgaaaattggaataaatgagttt

SEQ ID NO: 4416 - DNA, 1663 bp, Cicer arietinum
atcaattttctagaaatcaactgtaaattttatttttaaaaaatgtaatgagcaatggggttgcactatagcaccagccaaaatgtccaaaccactcttccaagtttcagtttttgtttctcaagtttggtggacctaattttccttggctcacattcaccctctccaaaacatctaagcaagcaaaattatgtatccacatggcacaaagagagccacattattagtacaaaatatcaggttgagaatccacatccaaaatcaccaccaatgagatgttgctgactagtgcatatcctaatccacaacatcttatgatttccaccgtgtttactctctacgcttctataaaccattgcagcctttccttattcttcacaacactcactagctagtagcaacaaagggaacaaacaacacaatcatggccacctctgctatccaacaatcagcattcactggcaagactggtttgaggcagggaaatgagttcatccggaaggctggtagctttggccaaggtcggtttaccatgcgtcgtactgtcaagagtactcctgagagcatctggtatggccctgaccgtcccaaatacttgggtcccttctctgaacaaattccatcatacttgactggtgaatttcctggtgactatggatgggacacagctggattatcagctgaccctgaaacctttgcaaggaaccgtgagctggaagtaattcacagcagatgggctatgcttggtgcattgggatgtaccttccctgaaatccttgaaaagaatggtgttaaatttggtgaggcagtgtggtttaaggccggtgcccaaattttctccgaaggtggtcttgactatttgggcaacccaaatctgattcatgctcagagcattcttgcaatctgggctactcaggttgtgctcatgggatttgttgaaggctacagggttggtggaggaccacttggtgaaggactagacccactttaccctggcggtgcctttgacccacttggtctggctgatgaccctgatgcatttgcagaattgaaggtgaaggaaatcaagaatggtcggttggccatgacctccatgtttggtttctttgttcaggccattgttactggcaaaggccctattcagaacctttacgaccatgttgctgaccctgtcgccaataatgcgtgggcttttgctactaactttgtccctggacaatgagaatgccatataatgcctgttttgtcagatgcaatcttctgctctcatttgcatttctgttgtgtttaactcccattttcaccaatgtaactacatgagcagaagaacctgtatgttgttgattatatattagaaatatggattccaagaaatatcaaatcttgtgcacgaatttagcatagtgatggggcctatgtttgtcatactatatttttattcccaataacctagacaacccttcctttaaagttaattagttcaaataatgcaaccaagttcaaggcgtcggccgacttttttttatcatctactgcttaaaaaaaaatcagctacttaaaggtaatcacacaaagacgcctgctatttagaatgaattagtttgcacgcgaataaggcatcatgaatgcataccttttagcatttcacatgcacaaaactgag

SEQ ID NO: 4417 - DNA, 995 bp, Zostera marina
gttctcttccattttgaagctcaaggaatggccacctctgcgattcatcaatctgtctttgttggtcagacaaccttgaagcaacaaaatgaacttgtccgcaaagttggagtcttcgagagtcgcatatctatgcgccgcacagtgaagagcactcccgacagcgtttggtacggcgcagaccgtcccaagtacttggggtccattctctgagcaaactccatcatacctaacctggtgaattcccaggtgactacggttgggacacagccggtctatcagcggacccagagaccttcgcaaagaaccgtgaacttgaggtgatccattgcagatgggccatgttgggcgccttaggttgtgtctttccagagcttctatcaaagaacggagttaaattcggtgaagccgtttggttcaaagctggatctcaaatcttctcagatggtgggcttgactacttaggcaatcctaacttggtccatgctcaaagcatcttggccatatgggcttgccaagttgttttgatgggctttatcgaaggataccgcgttggtggaggtccacttggagatggtcttgacccactttacccaggaggctcattcgacccattgggcttagctgatgacccagaggccttcaccgaattgaaggtcaaagaggttaagaacggacggttggctatgttctcgatgttcggatatttcgtccaagctattgtgaccggtaaaggtccaattgagaacctatacgaccaccttgccgacccagtcgccaacaatgcttgggcctttgctacaaacttctcccccgcaaactaaatataacaatctccatatataatttgcatgtaaactttgtttgtttgtttgatcttttggattctcgaattttcgaaaagttttaaccaaacaacttaaatatcaatgtgagtgagatttgtaaacaatgtgtttgttgtttagtaaaattggaaataaatgtaagtttta

SEQ ID NO: 4418 - DNA, 881 bp, Tripterygium wilfordii
cgttcggagggttggttccttcggaggcggccgcatttcgatgcgccggaccgtcaagagcgctccccagagcatctggtatgggccggaccgtccaaagtatttgggcccattctcggagcaaactccttcgtacctcaccggagaatttcccggcgactacgggtgggacactgccggattatccgccgatccagaaacatttgccaagaaccgtgaactcgaagtgatccactccagatgggccatgcttggtgctctgggctgcgtcttccccgaaatcctctcgaagaacggtgtcaagttcggctaggcggtttggttcaaggccggatctcagatcttctccgaaggtgggctcgactaccttggcaacccaaacctcattcacgcccaaagcattctagcaatctgggcttcccaggttgtattaatgggctttggctaagggtacagaattggtggcggcccacttggtgaaggacttgacctactttatccaggtggtgcgtttgacccattgggcctggcggatgacccagaagcctttgcagagttgaaggttaaggagctcaagaatgggcgacttgcaatgttttcaatgtttggatttttcgttcaagctattgtgactgggaagggacccattgagaacctgttcgatcatgttgcggatccggtggccaacgatgcttgggcttatgccaccaactttgtccccggaaaatgaagatattgattagctactaggaactctaaactttattgtaacattattgtacaatcttggttttgtgattgtgttgaaaattagtgctgttgattacatcattgtcctcggaatgtttacaaggtaagatatatcgatggacttgcacaat

SEQ ID NO: 4419 - DNA, 970 bp, Raphanus sativus
catctcttctttgcttattcatctcttcatttgtgtgtttgcttgggagttagagaaatacaagaaatggccacatcagcaatccaacactcctcttttgccggccaaacggccctgaagtcctccaacgatctcctccgcaaagtcggagctgcttccaacggtggtggtcgcgtcgtcatgcgccgtaccgtcaagtctactcctcagagcatctggtacggaccagaccgtcccaagtacttaggaccattctcagagaacacaccatcatacctaaccggagagtaccccggagactacggctgggacaccgccggtctctcggccgacccagaaacatttgcaaagaaccgtgagcttgaagtaatccacagcagatgggcaatgctcggcgctttaggttgcacattcccagagatcctctccaaaaacggtgttaaattcggtgaagccgtgtggttcaaggcagggtctcagatcttctcagaaggagggcttgattacctcgggaaccctaacttgatccacgcgcaaagcatattagctatctgggcttctcaagttgtgctgatggggttaatcgaagggtacagaatcggtggtggacctcttggtgaagggcttgacccgctttacccgggtggggcgtttgacccgttgaacttagctgagatcctgaggcgttttccgaattgaaagtgaaggaacttaagaacggtcgccttgccatgttctccatgtttggtttctttgtccaggccattgtcactggtaaaggaccaattgagaatctgtttgaccatgttgcggaccctgtggctaacaatgcctgggcttacgccaccaacttcgtccccggaaaatagaatattatcagctaatgtaatgtttttaaaacaattaatgtatgggaaatatgtgtcggttgatttgatgttccgtcttaataaaagaaatcatcgtaagc

SEQ ID NO: 4420 - DNA, 1000 bp, Brassica rapa
agtaacacatttctagattaatgacacaaaagaaggcttgagaatttctttcaccaatccaagaacattaaaccaacagaccaaatatgtccatgcactaaattttaaagataaaacacacaaatttgtctgatccagttctattttccgggaacgaagttggtggcgtaagcccacgcattgttagccacagggtccgcaacatgatcgaacagattctctatcggacctttaccagtaacaatagcttggacaaagaatccaaacatcgagaacattgcaagacgaccgttcttgagctccttcaccttcaattccgaaaacgcctccggatcctcggctaagttcaacgggtcaaacgccccacccgggtaaagcgggtcaaggccttcaccaagaggtccacctccgattctgtacccttcaatcaaacccatcaacacaacttgagaagcccagatagctaaaatgctttgcgcgtggatcaagttagggttcccgaggtaatcaagccctccttctgagaagatctgagaacctgccttgaaccacacggcttcaccaaatttgacaccgtttttggagagaatctctgggaaggtgcagcctaatgctcctagcattgcccatctgctgtggattacttcgagctcacggttctttgcgaatgtttctgggtcagctgagagaccggctgtgtcccaaccgtagtctccggggtattctccggttaggtacgatggtgtgttctccgagaatggtcctaagtacttgggacggtctggtccaaccagatgctctgaggagtagacttgacggtacgacgcatgacgacgcggccaccgccgttcgaagctcctactttgcggaggagatcgttggagggcttcagggccgtttggccggcgaaagaggagtgctggattgctgacgtagccattcttatatattatatcaactccaaacagaaacacaaatgaagcaaagatgagatgagatg

SEQ ID NO: 4421 - DNA, 2227 bp, Brassica napus
ccatcaatcatcgccgaactgtcaaaccgttcaatcaccgctaacctctcaagtctccgaggttagctttaggtggtacattaccagccaatgtattcgtgttccctgtaatggatccgacaatgatgagacgctttgaagggtaatcagatttcttcaagtcatcaagcaacaacctcgagagaagaaagtgtcccaaatgattagtcgcaacgctgagctcaaacccttctgcactgtaagtaggctctttagccgtcgggaaatagacagcagcgttgcagaccaaaacatcgagaggcatctccgatctcctgaagttatcaacgaactgtctcacgctgtctaacgaagctaagtctagatgcatcaccgtgtagctgtctttaggcatccctgcggacttggcggctctttcggctttgaggaagtccctgcacgccattatcacgtgccatttccctgtctcggcaagagctttggccgtggccagacctaaccctgacgaagctcccgtgaccaccacgttacctttcctcaaggtcttcttgccgtcaactgaagattttgtgatggatgggctggaagttgcagcgtttgggctcttatcgctacatttctcacgctaagttctctcttgaatcttaatgaggaagaaccatgttcggtaatggaggcaccaaagagactcgagtccttgaagtatgctgaagttccactcaccgcacctgaaaaccaaagagacagaccaaaccagcaccttccccaagagaaatgtcagggacacgccttagatcaagcctccaaaactggatgggaccgcacgcgccgccacagagcacaagaccgcaattgtcaaattcacaaatcctaactccacgcgccactaccacggagaacccaaagcagataaccttagaccagagccaatggcctcaccggaagagacaccacgagatcaactgacaagcccaaagaaaccaggagagggcaagagagccaagaccaaggaaacactcccccggactcgaaaccgaacccaccaccggaacagacctgcgagaagcgctcgccctagccgagaaggaggaaagaggggcgtaaagaaagcggccgccgtcttcaacactcagatctggaccccagaccgagcttccgccaccttcaacgaccaaagagacctcgagcccccagctttctcaaccttgccgtgcttccaaagaccaagaccgacagatctgaaccgcggtgacggccaaatcccagaacaacgagcatatcggtagagatggagcgaaggtgagaggcgaggagaagacaacacaaaaaagaaggggtggagaccgacgactaacggcgtcggccgccgaaatcatttatatctagttctttcttcatttgtatctttgtttggagttgagataaacaagaatggccacatcagcaatccagcactcctctttcgccggacaaacggctttgaagccttccaacgatctcctccgcaaagtaggagcttccaacggtggtggtcgcgttgtcatgcgccgtaccgtcaagtctactcctcagagcatctggtacggaccagaccgtcccaagtacttaggaccattctcagagaacacaccatcgtacctaaccggagaataccccggagactacggctgggacaccgccggtctctccgccgatccagaaaccttcgcaaagaaccgtgagctggaagtaatccacagcagatgggcaatgctcggcgctttaggatgcaccttcccagagattctctccaaaacggagtcaaattcggtgaagccgtgtggttcaaggcagggtctcagatcttctcagaaggagggcttgattacctcggcaaccctaacttgatccacgcgcaaagcatattagcaatctgggcttctcaagttgtgctgatgggtttaatcgaagggtacagaatcggaggtggacctcttggtgaagggcttgacccgctttacccgggtggggcgtttgacccgttgaacttagcggaggatccggaggcgttttcggaattgaaagtgaaggagcttaaaaacggtcggcttgctatgttctccatgtttggattctttgtccaagccatcgtcactggtaaaggaccgatcgagaatctgtttgatcatgttgcggaccctgtcgctaataatgcctgggcttacgccaccaacttcgtccccggaaa

SEQ ID NO: 4422 - DNA, 1388 bp, Brassica napus
cgatggagctttacgccgacacagtccccgagacggccgagaacttccgtgctctctgcaccggcgagagaggaatcggcaaatccggaaagccactccactacagggctcggctttccaccgcgtgatccccaagttcatgtgccaaggaggagatttcaccgccgggaacggaacgggaggagagtcgatctacggcatgaagttcaaagacgagaactttgtcaagaagcacaccggtccgggtattctctccatggctaacgctggttcgaacacgaacggatctcatctcatctttgcttcattttgtgtttctgtttggagttgagataatatataagaatggctacgtcagcaatccagcactcctctttcgccggccaaacggccctgaagccctccaacgatctcctccgcaaagtaggagcttccaacggcggtggccgcgtcgtcatgcgtcgtaccgtcaagtctactcctcagagcatctggtacggaccagaccgtcccaagtacttaggaccattctcggagaacacaccatcatacctaacaggagaataccccggagactacggttgggacacagctggtctctccgctgacccagaaacattcgcaaagaaccgtgagctcgaagtaatccacagcagatgggcaatgctaggagcattaggctgcaccttccctgagattctctccaaaaacggtgtcaaatttggtgaagccgtgtggttcaaggcaggttctcagatcttctcagaaggagggcttgattacctcgggaaccctaacttgatccacgcgcaaagcattttagctatctgggcttctcaagttgtgttgatgggtttgattgaagggtacagaatcggaggtggacctcttggtgaaggccttgacccgctttacccgggtggggcttttgacccgttgaacttagccgaggatccagaggcattttcggaattgaaagtaaggagctaaagaacggtcgtctagcaatgttctcgatgtttggattctttgtccaagctattgttactggtaaaggtccgatcgagaatctgttcgatcatgttgcggaccctgtggctaacaatgcctgggcttacgccaccaacttcgttcccggaaaatagaactggatcagacaaatttgtgtttttatctttaaaatttagtgcatggacatatttggtctgttggtttaatgttcttggactggtgaaagaaattctcaagccttcttttgtgtcattaatctagaaatgtgttaactgctcagacatcagagtcgtgttactatccaaattcatcgagtttcagtgtcattgttctacaaattggtctttgataaatgctaaaactagaacaaataatac

SEQ ID NO: 4423 - DNA, 1072 bp, Cicer arietinum
gggggggcggcggcctatacccctcgtgtgccttagcctcccacgactctagctagtagcaacaaagggaacaaacaacacaatcatggccacctctgctatccaacaatcagcattcactggcaagactggtttgaggcagggaaatgagttcatccggaaggctggtagctttggccaaggtcggtttaccatgcgtcgtactgtgaagagtactcctgagagcatctggtatggccctgaccgtcccaaatacttgggtcccttctctgaacaaattccatcatacttgactggtgaatttcctggtgactatggatgggacacagctggattatcagctgaccctgaaacctttgcaaggaaccgtgagctggaagtaattcacagcagatgggctatgcttggtgcattgggatgtaccttccctgaaatccttgaaaagaatggtgttaaatttggtgaggcagtgtggtttaaggccggtgctcaaattttctccgaaggtggtcttgactatttgggcaacccaaatctgattcattctcagagcattcttgcaatctgggctactcaggttgtgctcatgggatttgttgaaggctacagggttggtggaggaccacttggtgaaggactagacccactttaccctggcggtgcctttgacccacttggtctggctgatgaccctgatgcatttgcagaattgaaggtgaaggaaatcaagaatggtcggttggccatgacctccatgtttggtttctttgttcaggccattgttactggcaaaggccctattcagaacctttacgaccatgttgctgaccctgtcgccaataatgcgtgggcttttgctactaactttgtccctggacaatgagaatgccatataatgcctgttttttcagatgcaatcttctgctctcatttgcatttctgttgtgtttaactcccattttcaccaatgtaactacatgagcagaagaacctgtatgttgttgattatatattagaaatatggattccaagaaatatcaaatcttgtgcacgaatttagcatagtgatggg

SEQ ID NO: 4424 - DNA, 1150 bp, Cicer arietinum
gggggggccatcccctgggtgccttgagagacgccgaccacaccacgacactagcagttagacacaaagggaacaaacaacacaatcatggccacctctgctatccaacaatcagcattcactggcaagactggtttgaggcagggaaatgagttcatccggaaggctggtagctttggccaaggtcggtttaccatgcgtcgtactgtgaagagtactcctgagagcatctggtatggccctgaccgtcccaaatacttgggtcccttctctgaacaaattccatcatacttgactggtgaatttcctggtgactatggatgggacacagctggattatcagctgaccctgaaacctttgcaaggaaccgtgagctggaagtaattcacagcagatgggctatgcttggtgcattgggatgtaccttccctgaaatccttgaaaagaatggtgttaaatttggtgaggcagtgtggtttaaggccggtgctcaaattttctccgaaggtggtcttgactatttgggcaacccaaatctgattcattctcagagcattcttgcaatctgggctactcaggttgtgctcatgggatttgttgaaggctacagggttggtggaggaccacttggtgaaggactagacccactttaccctggcggtgcctttgacccacttggtctggctgatgaccctgatgcatttgcagaattgaaggtgaaggaaatcaagaatggtcggttggccatgacctccatgtttggtttctttgttcaggccattgttactggcaaaggccctattcagaacctttacgaccatgttgctgaccctgtcgccaataatgcgtgggcttttgctactaactttgtccctggacaatgagaatgccatataatgcctgttttttcagatgcaatcttctgctctcatttgcatttctgttgtgtttaactcccattttcaccaatgtaactacatgagcagaagaacctgtatgttgttgattatatattagaaatatggattccaagaaatatcaaatcttgtgcacgaatttagcatagtgatggggcctatgtttgtcatactatatttttattcccaataacctagacaacccttcctttaaagttaattagttcaaata

SEQ ID NO: 4425 - DNA, 1184 bp, Aquilegia formosa
aacaagctccattactactttattagtatatatcaaattctaattaaataaggtaaataatctttctgggtaccatggcaacatctgtagcatttgccgggcagatagctttgaagccacagaacgagcttgttcgcaaagttggcaaccttggaaatggtcgtttctctatgcgacgtactgtcaagagtgctccacaaagcatttggtacggtccagaccgcccgaaatacttgggaccattttccgagcaaactccatcatacctaactggtgaattcccaggtgactatgggtgggacactgctggattatcagcagatccagagacctttgctaagaatcgtgagctcgaggtgatccacagccgatgggctatgcttggagcacttggatgtgtgtttcctgaaattctatcaaagaatggtatcaaatttggtgaagcagtgtggttcaaagctggttcacaaatctttgcagagggtggacttgactatcttggtaaccctaaccttgtacatgctcaaagcatccttgcaatctgggcttcccaagttgtattgatgggcttaatagaaggatacagagttggtggaggcccacttggagagggattggatagtctatacccaggtggtgcatttgatccccttggattagctgatgaccctgattcatttgctgaattgaaggtaaaggaacttaagaatggaagacttgccatgacctcgatgttcggtttctttgttcaagccattgtcactggaaaaggtccaattgagaacctttacgaccaccttgccgacccagcaaccaacaacgcatgggcttatgctactaactttgtccctggaaagtgaaactgaaaacatgttaaccaggcttgcttgcggcagcatggttatgttgttgggcactaattgtatgcatgagaatgagttgttgaatttgaatgaatgaacctgtaatataattttcccttcaaaattcatgattgcagattcaattattggtgttatatataattatatatatacatgtttctgctaactccctagccaatccctatatagttgagacaaagcattctaaatttctaacacaattaacatactgtaaaagttattgaccatcatcatcatcatagggtagaaagtagaaaccacaagctagctagttaaagg

SEQ ID NO: 4426 - DNA, 1184 bp, Picea glauca
ttaattaaattaatcccccccccccccccggggcataacttcacaactgaagctcatcacttgcttcctgaccttggtcttaccatttttctcatcgtcacgctcgccatggcaacagcctcagccatccaaatctcaagcttggcaggacagaccctcctgaggccgcagcagaatgagctcgtcagtaaggtgggcgcgtcgcaggctcgaatcaccatgcgaagaaccgtcaggagcgcccctgagagcatttggtatggacctgaccgccccaagtacctgggccccttctcggaacagacgccgtcgtatctcaccggcgaatttcccggcgactacgggtgggacaccgccgggctctctgccgaccctgagaccttcgccaaaaacagagagctggaggtgatccacagcagatgggccatgttgggggcgctcggctgcgttttcccggagctgttggccaaaaccggggtgaaatttggggaagccgtgtggttcaaggccggggcgcagatattctcggagggaggcctcgactacctggggaaccctaacctgattcacgcgcagagcattctggccatctgggccttccaggttgtgctcatgggcttgattgagggatacagagtttgggggaggaccccttggggaggggttggaccctctgtacccagggggggccttcgatccactggggctggccgatgacccggaagcgtttgcggagctgaaggtgaaggagctaaagaacgggcggctggccatgttctccatgttcggcttcttcgtgcaggcaatcgtaaccggcaagggccccatcgaaaatctcttcgaccacttggcggatcccgcaaacaacaacgcctgggcctacgccaccaatttcgttcccggcaagtgaagtgaactgacggaaaataaaagatggctgtaattctgcatcatacatctgacagactttcctgttaataatccaattttctttcaacgagatgttactcggtttcctaaagttaggcttttgaaccggttttttctggttcgcggctgctactatgctcaatatttttacacttcttgtaatctcaactgtaatctagttacttcctcttctcttttatatagaggtgatgcaacaacaccttactctatcttctggattgaggttactgtat

SEQ ID NO: 4427 - DNA, 869 bp, Zostera marina
agaacacagcaaaaactattcgttctcttccattttgaagctcaaggaatggccacctctgcgattcatcaatctgtctttgttggtcagacaaccttgaagcaacaaaatgaacttgtccgcaaagttggagtcttcgagagtcgcatatctatgcgccgcacagtgaagagcactcccgacagcgtttggtacggcgcagaccgtcccaagtacttgggtccattctctgagcaaactccatcatacctaactggtgaattcccaggtgactacggttgggacacagccggtctatcagcggacccagagaccttcgcaaagaaccgtgaacttgaggtgatccattgcagatgggccatgttgggcgccttaggttgtgtctttccagagcttctatcaaagaacggagttaaattcggtgaagccgtttggttcaaagctggatctcaaatcttctcagatggtgggcttgactacttaggcaatcctaacttggtccatgctcaaagcatcttggccatatgggcttgccaagttgttttgatgggctttatcgaaggataccgcgttggtggaggtccacttggagatggtcttgacccactttacccaggaggctcattcgacccattgggcttagctgatgacccagaggccttcaccgaattgaaggtcaaagaggttaagaacggacggttggctatgttctcgatgttcggatatttcgtccaagctattgtgaccggtaaagtccaattgagaacctatacgaccaccttgccgacccagtcgccaacaatgcttgggcctttgctacaaacttccccccgacaaactaaatataacaatctccatatataattgat

SEQ ID NO: 4428 - DNA, 1002 bp, Zostera marina
gaacacagcaaaaaactattcgttctcttccattttgaagctcaaggaatggccacctctgcgattcatcaatctgtctttgttggtcagacaaccttgaagcaacaaaatgaacttgtccgcaaagttggagtcttcgagagtcgcatatctatgcgccgcacagtgaagagcactcccgacagcgtttggtacggcgcagaccgtccaagtacttgggtccattctctgagcaaactccatcatacctaactggtgaattcccaggtgactacggttgggacacagccggtctatcagcggacccagagaccttcgcaaagaaccgtgaacttgaggtgatccattgcagatgggccatgttgggcgccttaggttgtgtctttccagagcttctatcaaagaacggagttaaattcggtgaagccgtttggttcaaagctggatctcaaatcttctcagatggtgggcttgactacttaggcaatcctaacttggtccatgctcaaagcatcttggccatatgggcttgccaagttgttttgatgggctttatcgaaggataccgcgttggtggaggtccacttggagatggtcttgacccacttttacccaggaggctcattcgacccattgggcttagctgatgacccagaggccttcaccgaattgaaggtcaaagaggttaagaacggacggttggctatgttctcgatgttcggatatttcgtccaagctattgtgaccggtaaaggtccaattgagaacctatacgaccaccttgccgacccagtcgccaacaatgcttgggcctttgctacaaacttctccccgcaaactaaatataacaatctccatatataatttgcatgtaaactttgtttgtttgtttgatcttttggattctcgaattttcgaaaagttttaaccaaacaacttaaatatcagtgtgagtgagatttgtaaacaatgtgtttgttgtttgaaaattggaataaatga

SEQ ID NO: 4429 - DNA, 931 bp, Zostera marina
attcgttctcttccattttgaagcttaaggaatggccacctctgcgattcatcaatctgtctttgttggtcagacaaccttgaagcaacaaaatgaacttgtccgcaaagttggagtcttcgagagtcgcatatctatgcgccgcacagtgaagagcactcccgacagcgtttggtacggcgcagaccgtcccaagtacttgggtccattctctgagcaaactccatcatacctaactggtgaattcccaggtgactacggttgggacacagccggtctatcagcagacccagagaccttcgcaaagaaccgtgaacttgaggtgatccattgcagatgggccatgttgggcgccttaggttgtgtctttccagagcttctatcaaagaacggagttaaattcggtgaagccgtttggttcaaagctggatctcaaatcttctcagatggtggcttgactacttaggcaatcctaacttggtccatgctcaaagcatcttggccatatgggcttgccaagttgttttgatgggctttatcgaaggataccgcgttggtggaggtccacttggagatggtcttgacccactttacccaggaggctcattcgacccattgggcttagctgatgacccagaggccttcaccgaattgaaggtcaaagaggttaagaacggacggttggctatgttctcgatgttcggatatttcgtccaagctattgtgaccggtaaaggtccaattgagaacctatacgaccaccttgccgacccagtcgccaacaatgcttgggcctttgctacaaacttctccccgcaaactaaatataacaatctccatatataatttgcatgtaaactttgtttgtttgtttgattcttttggattctcgtaattttcgaaaaagtttttaaccaaataacttaaatat

SEQ ID NO: 4430 - DNA, 944 bp, Zostera marina
ctattcgttctcttccattttgaagcttaaggaatggccacctctgcgattcatcaatctgtctttgttggtcagacaaccttgaagcaacaaaatgaacttgtccgcaaagttggagtcttcgagagtcgcatatctatgcgccgcacagtgaagagcactcccgacagcgtttggtacggcgcagaccgtcccaagtacttgggtccattctctgagcaaactccatcatacctaactggtgaattcccaggtgactacggttgggacacagccggtctatcagcggacccagagaccttcgcaaagaaccgtgaacttgaggtgatccattgcagatgggccatgttgggcgccttaggttgtgtctttccagagcttctatcaaagaacggagttaaattcggtgaagccgtttggttcaaagctggatctcaaatcttctcagatggtgggcttgactacttaggcaatcctaacttggtccatgctcaaagcatcttggccatatgggcttgccaagttgttttgatgggctttatcgaaggataccgcgttggtggaggtccacttggagatggtcttgacccactttacccaggaggctcattcgacccattgggcttagctgatgacccagaggccttcaccgaattgaaggtcaaagaggttaagaacggacggttggctatgttctcgatgttcggatatttcgtccaagctattgtgaccggtaaagtccaattgagaacctatacgaccaccttgccgacccagtcgccaacaatgcttgggcctttgctacaaatttctcccccgcaaactaaatataacaatctccatatataatttgcatgtaaactttgtttgtttgtttgattcttttggattctcgaaattttcgaaaaagttttaaccaaaacaacttaaatattcaatgtgag

SEQ ID NO: 4431 - DNA, 1123 bp, Mesembryanthemum crystallinum
gctgcaggaattcggcacgaaggcaaacccagtacagcacaaagagcgtaataacccaccagcaaaagcagagagtaaactagagaagtcatggccacctctaccatccaacaatctgcttttgctgggcagaccgtgttgaagtcccagaacgagctcgttcgcaaggtcggtggcaatggaggccgtgtcgccatgcgccgtacaatcaagagcgcccctgagagcatgtggtacggcgaggaccgtcccaagtatttgggcccattctctgagcaaaccccatcataccttaccggtgagttcccaggtgactacggttgggacactgctggactctccgctgacccagagacattcgccaagaaccgtgagctcgaggtgatccactgcagatgggccatgcttggagccctaggctgtgtattccccgagctcctagccaagaacggtgtcaagttcggtgaggcagtatggttcaaggctggagcccaaatcttcagcgagggcgggcttgactaccttggcaacccgaaccttatccacgcccagagcatcctcgctatctgggcctctcaagtggtcctcatgggcttgatcgagggctacagagtcggtggtggtccattgggtgaggggctcgaccaactctaccctggtggagcttttgacccacttggcctagctgacgacccagaggccttcgctgagcttaaggtgaaggagatcaagaacggtcgtttggccatgttctccatgttcgggttctttgtccaggccattgtgactggcaagggcccaatcgagaacctgtacgaccaccttgccgaccccgttgccaacaatgcttgggctttcgccaccaactttgtccccggaaagtgaagaaattaaacaaaaatgcatctatgttgatgtatgtatgatgaaccaatgtaatctatttgctttttgtgctagcttgttgggagtgtaaatgaagaggggggatgaattttatgtaatttcgcattcaactcatgaagtcatgttaatgagctgatgatgtatatctctcctttttatttgtagctatcaacaaggtctgttttggtgtactcattagtttccagttttgccttta

SEQ ID NO: 4432 - DNA, 966 bp, Epimedium sagittatum
agagatcaagcactttcagccttcaatattgtactgttacaaagctaagaagcctttggggtatcatggcagcctctggattccaatactccgcactctctggtaggtctcttgtgaccaccaagaatgagttcgttcgcaagatcggcggattcagaagcaaaattgtcatgcgccgcacagtcaagagtactccacaaagcatctggtacggagcagaccgccccaagtacttgggcccattctccgagcagactccatcctacttgaccggtgaattcccaggtgactacgggtgggacactgcagggttgtcagctgatcccgagacgttcgccaagaaccgtgagctcgaagtgatccactgccgatgggccatgcttggtgccctcggctgtgtcttccctgagattctttccaagaacggagtcaagtttggtgaggcggtgtggttcaaggccggagctcagatcttctcagaaggtggacttgactaccttggcaacccaaacctggtccatgctcagagcattcttgctatctgggcttcacaggttgttcttatgggtttcattgaagggtacagagttggcggagggccactcggtgagggactagattccctttacccaggtggtgcattcgacccactcggattggctgatgatccagaggcctttgctgaactaaaggtgaaggagatcaagaatggacgccttgctatgacctctatgttcgggttcttcgttcaagccattgtcactggaaagggaccaattgagaacctattcgaccacattgctgatccaactgtcaacaatgcatgggcttatgccacaaactttgtccccggaaagtgaaaatgatcacatattgtatcttgtcgtttgtgaataagattctgtatgcttcttggtttattttgcaagtccttcctaattcagtttcatcaatgcaaagcggctt

SEQ ID NO: 4433 - DNA, 976 bp, Linum usitatissimum
ctaccctcaatcggtccaatgagcgtaccagaaaggttgctgctctcggtggcagccgcttcaacatgcgccgtactgtcaagagtgctccccaaagcatttggtacggagcagaccgtcccaagtacttgggtccattctcagagcagacaccatcatacctgacaggagagttcccaggtgactacggatgggacactgctggtctatcagcagacccagagacattcgccaagaaccgtgagcttgaggttatccactgcaggtgggctatgcttggtgcacttggttgtgtcttcccagaaatcctttccaagaacggagtcaagttcggtgaggcagtctggttcaaggctggagctcagatcttctccgaaggaggtctggattacctcggaaacccgaacttggtccatgctcagagcatccttgcaatctgggcttgccaggttgtgctcatgggattcgttgaaggttacagagttggtggaggacctctcggagaagggcttgacccactttatcctggtggctccttcgacccacttggcctggcagatgatcctgaggcctttgctgagttgaaggtcaaggagatcaagaatggccgcctcgctatgttctccatgtttggcttcttcgtccaggccattgttactggcaaaggtcccgttgagaacctttatgaccacattgctgaccctgtagccaacaatgcttgggctttcgccaccaactttgtccccggcaagtgagcgcaccgccccttctatctttgtaatggcttccctaagagatagagctctgcaactactttctggaactctttttgtaaacttaagcaaatccatggaatggaactttccttttttacgcaattgtgtcgggtgcaaactctattaaatgcttagctgcatactctgcgacatctacgtttgcataaatcttagaaccactaagcaaactcatccagagc

SEQ ID NO: 4434 - DNA, 817 bp, Senecio madagascariensis
ttcaaaagcaaattaaaaaatggcaacaatccaacactcagctttcgccggccagtcggcattgaagccacaaaacgaacttgctaagaaagttggcggcttcaatggtggccgctttaccatgcgtcgtactgttaaaagtgcaccacaaagcatttggtatggaccagaccgcccaaagtacttgggcccattctctgagcaaactccatcgtatttgactggtgaattcccaggtgactacggttgggacacagcaggactatctgctgaccccgagacttttgccaagaaccgtgagcttgaagtgatccactctcggtgggctatgcttggtgcactcgggtgcattttccccgagcttctttcaaagaacggtgtcaaattcggtgaagccgtttggttcaaggcaggttcacagattttctctgaaggtggacttgactacctcggaaacccgaaccttgtccatgcccagagcattttagccatctgggctacacaagtagtcctcatggggctcattgaaggataccgagttggtgggggtccacttggtgaagggcttgacagtatttacccaggtgggtcttttgacccacttggattggctgacgatcccgaagcatttgctgagttgaaggttaaggagcttaagaacggtcgattggccatgttttccatgtttgggtttttcgttcaggccattgtaacaggaaagggcccaatcgaaaacttgtttgaccatcttagtgatccagcagctaacaatgcatgggcttatgctaccaactttgtacctcggccgcgaccacgc

SEQ ID NO: 4435 - DNA, 1214 bp, Cedrus atlantica
ataagttcacaacagaagctcattactcatactacctgacgttggtctcaacgttttttctatcgtcaccttcaccatggcgacagcctcagctatccacagctcaagcttggcaggccagagcctcctcaggtcgcaagggaatgagctcgttaagaaggcaggcatgtcgcaggctcgaatcaccatgcgaagaaccgtcaggagcgcccctgagagcatttggtatggacctgaccgccccaagtacctgggccccttctcggaacagacaccgtcgtatctcaccggagaattcccgggcgactacgggtgggacactgccggactctcggccgacccggagacctttgccaaaaatagagagctggaggtgatccactgcagatgggccatgttgggagcgctgggctgcgttttcccagagctgttggccaaaaacggggtcaaatttggggaagccgtgtggttcaaggccggggcgcagatattctcggagggaggtctcgactacctggggaaccccaacctgatccacgcgcagagcattctggccatctgggcgtgccaggttgtgctgatgggattgattgaggggtacagagtgggaggaggaccccttggggaggggttggatcctctgtacccagggggttcgtttgacccactggggctggccgacgacccggaggccttcgcggagctgaaggtgaaggagataaagaacgggcgactggccatgttctccatgttcggcttctttgtgcaggcaatcgtgacgggcaagggccccatcgaaaatctattcgatcacttggcggatcccactgctaacaatgcgtgggcctatgccaccaatttcgttcccggcaagtgaagtgaggtgacggtaaataaaagatggctgtaatctctgtattctagttctggcggactttcctgttaattatccgattttctttcaactagatgttacttggtttctttgagttaggctcttgcagccgggttttctgcttcgcggttgctactctgcttaaaattgtctactttatataatttctactgtgattgccttcttttccatgatcgagtgacttcttgtatctgcatttagatgacgcactctatgtgacgatagacgttactctatttgtaagagaagataggagaacgaagatactatttgacaaggaagctactattaaattgga

SEQ ID NO: 4436 - DNA, 820 bp, Euphorbia peplus
atctgcatttgccggtcagattgctctgaagccatctaatgaccttctccgaaaggtcggcaacttaggcggtgctcgcgttgttatgcgtaggactgtcaagagcgctccggagagcatttggtacggcccagaccgcccaaagtacttgggaccattttccgaacaaactccatcatacctaaccggagaattccccggagactatggatgggactcagccggattatcagcagaccccgaaacattcgccaagaaccgtgaacttgaagttatccactgcagatgggctatgcttggagctctcggctgtgtcttcccggaaatcctctcaaagaacggtgtaaagttcggcgaagcagtctggttcaaggcaggatctcaaatcttttccgaaggtggtctagattatctcggaaaccctaatcttattcccctgagcattctagcaatttgggcatgccaggttgttttgatggggttcgtggaagggtacagagttggaggaggacctttgggtgaagggcttgacccgctttatcccggaggtgcttttgatccactaggattggccgatgatccggaagcatttgcagaattgaaggtgaaagagattaagaatggaagattggcaatgttctctatgtttggattctttgttcaggctattgttactggaaaaggacctgttgagaatctttatgaccacgttgctgatcccgtcgctaataatgcttgggcttttgccactaactttgtacccggaaaatgaactatgtaatataaatgtaatgtaatgcttttgtggagattttaaatc

SEQ ID NO: 4437 - DNA, 1363 bp, Pinus pinaster
catggcaactgcctcagccatccaaagctcaagcttggcaggacagactctcctgaggccgcagcagaatgagctcgtcgggaaggtaggcgcgtcgcaggctcgaatcaccatgcgaagaaccgtcaggagcgcccctgagagtatttggtatggacctgaccgccccaaatacctgggacccttctccgaacagacgccatcgtatctcaccggagaatttcccggcgactacgggtgggacacagccgggctctctgccgaccccgagaccttcgctaaaaacagagagctggaggtgatccactgcagatgggccatgttgggggcgctgggctgcgttttcccggagctgttggccaaaaacggtgtgaaatttggggaagccgtgtggttcaaggccggggcgcagatattctcggagggaggcctcgattacctggggaaccctaacctgatccacgcgcagagcattctggccatctgggcgtgccaggttgtgctcatgggattgattgagggatacagagttgggggaggaccccttggtgaggggttggaccctctgtaccctgggggagccttcgatccactggggctggccgacgacccggaggcgttcgcggagctgaaggtgaaggagattaagaacgggcggctggccatgttctccatgttcggcttcttcgtgcaggcaattgtgaccgggaagggccccattgaaaatctgttcgaccacttggcagaccccactgccaacaatgcctgggcctacgccaccaatttcgttcccggcaagtaaagtaacggaaaataaaagatggctgtaatctctgtatcatacatccgacagactttcttgttaataagccaatgttccttcaacggtttttcttagttcgcgcttactttttatcacttcttgtattctgaaccatgagtggcctttcggtttctcctaaagcctcaatgatccatttagttactcttattttagaggtaggtgatgcaacgtcatggtctttctttcattttctttggatttaggttattgcatctttttaaattaactagaaaaaaatgttaggtaaaaagtcattttcgctgtaagttagactagactacactaatctagaaatataattgaacaaggttcaaatgcccatcactgtcaaagtaggtgcatggtgataagaaatgaaaccacgagtgaagtggtgcgaaatgaaacgacgaatgaagtgttacaggaaggcaaacttgctctcatatccatcaatatgttgattatttttatgagtatgaaagcaaggcacgtgggtatgtttattattttattgagtattataatttgaagagttga

SEQ ID NO: 4438 - DNA, 871 bp, Phalaenopsis aphrodite
aaggctccgccttcactggccagaccgccctcaagcagcccaacgagctcttccggaaggtaggttcagtcggcaatggcggccggatcaccatgcgccgcactgttaagagtgtacctcagagtatctggtacggcccagataggcccaagtacttgggccccttctccgaacaaacgccctcctatctaaccggtgaattccccggcgactacgggtgggacactgccggtctctccgccgatcccgaaaccttcgctaaaaaccgcgagctggaggtgatccatagtagatgggccatgctcggcgcactgggctgcgttttccccgagctcctctccagaaacggggtgaagttcggcgaagccgtctggttcaaggccggggcccaaatcttctcagaaggaggcctggactacctcggcaatccgaacctcatccatgcccagagcatcctagctatatgggcttctcaagtcatcctcatgggcttcgtcgaggcatatcgtgttggaggaggcccgcttggggaggggctggataagatctaccctggcggggccttcgacccattgggccttgcggatgacccggaggccttcgcggagctgaaagtgaaggaactgaagaacgggcggctggccatgttttcaatgttcgggtttttcgtgcaggctattgtgactgggaagggacctattgagaacttgtatgaccacctggctgacccaacgactaataatgcttgggcctatgcaaccaactttgtgcctgggaaatgagtgtttttttttttttggtgtttgatttcagtgtgatttaatgaaatgggagcattttcttcttcgtatcttcttaaggatatgctatt

SEQ ID NO: 4439 - DNA, 944 bp, Papaver somniferum
agaaaacataacaaagaacaggtgaacaacaaagaagcactagaaaaagagagtcatggccacctctgccattcaaaggtctgcattcgctggtcaaactgctttgaagcaacaaaatgagttcatccgcaaagttggcaatgtcgaaggtggtcgtatctccatgcgacgcactgtaaaaagcattcaatcaagcatgtggtatggaccagacagacccaagtacttgggaccattctcagaacagaccccatcttacctcactggtgaattcccaggtgactacggttgggacacagccgggttatctgctgacccagagacatttgcaaagaaccgcgaactcgaagtgatccactgcaggtgggctatgttgggtgccctaggatgcgtcttccctgaggttctctcaaagaacggtatcaacttcggcgaggcagtatggttcaaagctggatcacagatcttctccgagggaggtttggactaccttggaaaccccaacttggtacatgcccaaagcattcttgcaatctgggctactcaggttgtgctaatggggtttgtggagggatacagagttggtggtggtccacttggagaaggactagacaaactttaccccggtggatcttttgaccctctaggattagctgatgacccagagtcattctctgaattgaaggtaaaggaaatcaagaatggaagacttgctatgttctctatgtttgggtatttcgttcaggctattgttaccggaaagggtccaattgaaaacctttatgaccacatcgccgatcctgttgcaaacaatgcatgggcttacgctactaactttgctcctggaaaatgaatgtaatttttcctagggtgtatcaaggtttcaggcttgttaagtcttctgttgttatttgtgtgtaaattgtttatgaatagtaagcagt

SEQ ID NO: 4440 - DNA, 1203 bp, Papaver somniferum
acactattgctgtacagaagtacacgtaatggaccctacgcacctaaagacccctaggaccattacagtaagaagaatacacgtactaagtagttaatacttgaaagacgttaaaagacagtagaagtattaatccgatctttagttgtttttagctgaattccaatattcggtaccactacagacgatagctccaaacactaagaatagaacatctccatctctgctaatcgatctcacagaaacacagaagatttacaattgagaacaggtgaagaacaaagaagcactagaaaagagagtcatggccacctctgccattcaaaggtctgcattcgctggtcaaactgctttgaagcaacaaaatgagttcatccgcaaagttggcaatgtcgaaggtggtcgtatctccatgcgccgcactgtaaaaagcattcaatcaagcatgtggtatggaccagacagacccaagtacttgggaccattctcagaacagaccccatcttacctcactggtgaatttccaggtgactacggttgggacacagccgggttatctgctgacccagagacatttgcaaagaaccgtgaactcgaagtgatccactgcaggtgggctatgttgggtgccctaggatgcgtcttccctgaggttctctcaaagaacggtatcaacttcggcgaggcagtatggttcaaagctggatcacagatcttctctgagggaggtttggactaccttggaaaccctaacttggtacatgcccaaagtattcttgcaatctgggctactcaagttgtgctaatggggtttgttgagggatacagagttggtggtggtccacttggagaaggactagacaaactttaccccggtggatcttttgaccctctaggattagctgatgacccagagtcattctctgaattgaaggtaaaggaaatcaagaatggaagacttgctatgttctctatgtttgggtatttcgttcaggctattgttaccggaaagggtccaattgaaaacctatatgaccacatcgccgatcctgttgcaaacaatgcatgggcttatgctactaactttgctcctggaaaatgaatgtaatttttcctagggtgtatcaaggtttcaggcttgttaagtcttctgttgttatttgtgtgtaaattgtttatgaatagtaagcagttgttatcaaa

SEQ ID NO: 4441 - DNA, 1019 bp, Papaver somniferum
gttacgatctgggatttctctgaacggaacttaatttgctgacgatgatcgaactgttcgcgttttcacttcatcatcgccgaaaacaaaagaaaaagaacgactgaagagaaaaagagagtcatggccacctctgccattcaaaggtctgcattcgctggtcaaactgctttgaagcaacaaaatgagttcatccgcaaagttggcaatgtcgaaggtggtcgtatctccatgcgccgcactgtaaaaagcattcaatcaagcatgtggtatggaccagacagacccaagtacttgggaccattctcagaacagaccccatcttacctcactggtgaatttccaggtgactacggttgggacacagccgggttatctgctgacccagagacatttgcaaagaaccgtgaactcgaagtgatccactgcaggtgggctatgttgggtgccctaggatgcgtcttccctgaggttctctcaaagaacggtatcaacttcggcgaggcagtatggttcaaagctggatcacagatcttctctgagggaggtttggactaccttggaaaccctaacttggtacatgcccaaagcattcttgcaatctgggctactcaagttgtgctaatggggtttgttgagggatacagagttggtggtggtccactcggagaaggactagacaaactttaccccggtggatcttttgaccctctaggattagctgatgacccagagtcattctctgaattgaaggtaaaggaaatcaagaatggaagacttgctatgttctctatgtttgggtatttcgttcaggctattgttaccggaaagggtccaattgaaaacctttatgaccacatcgccgatcctgttgcaaacaatgcatgggcttatgctactaactttgctcctggaaaatgaatgtaatttttcctagggtgtatcaaggtttcaggcttgttaagtcttctgttgttatttgtgtgtaaattgtttatgaatagtaagcagttgttata

SEQ ID NO: 4442 - DNA, 988 bp, Papaver somniferum
aaagagagtcatggccacctccgccattcaaaggtctgcattcgctggtcaaactgctttgaagcaacaaaatgagttcatccgcaaagttggcaatgtcgaaggtggtcgtatctccatgcgccgcactgtaaaaagcattcaatcaagcatgtggtatggaccagacagacccaagtacttgggaccattctcagaacagaccccatcttacctcactggtgaatttccaggtgactacggttgggacacagccgggttatctgctgacccagagacatttgcaaagaaccgtgaactcgaagtgatccactgcaggtgggctatgttgggtgccctaggatgtgtcttccctgaggttctctcaaagaacggtatcaacttcggcgaggcagtatggttcaaagctggatcacagatcttctctgagggaggtttggactaccttggaaaccctaacttggtacatgcccaaagcattcttgcaatctgggctactcaagttgtgctaatggggtttgttgagggatacagagttggtggtggtccacttggagaaggactagacaaactttaccccggtggatcttttgaccctctaggattagctgatgacccagagtcattctctgaattgaaggtaaaggaaatcaagaatggaagacttgctatgttctctatgtttgggtatttcgttcaggctattgttaccggaaagggtccaattgaaaacctttatgaccacatcgccgatcctgttgcaaacaatgcatgggcttacgctactaactttgctcctggaaaatgaatgtaatttttcctagggtgtatcaaggtttcaggcatgttaagtcttctgttgttatttgtgtgtaaattgtttatgaatagtaagcagtcatcaaatttctagtgttttgtgctgcataggatatagtacttataacacaaatgggatgacaaaagaaaaacaaaaatatgtaactac

SEQ ID NO: 4443 - DNA, 1193 bp, Picea glauca
ggtctcagcatttttctcatcgtcacgttcaccatggcagcagcctcagccatccagagctcgagcttggcaggccagaccctcctgaggccgcagcataatgagctcgttaggaaggtgggcatgtcgcaggcccgaatcaccatgcgaagaaccgtaaggagcgctcctgagagcatttggtatggacctgaccgccccaagtacctgggccccttctcggaacagacaccgtcgtatctcactggagaatttcccggcgactacgggtgggacaccgccgggctctcggccgaccctgagaccttcgcgaaaaacagagagctggaggtgatccactgcagatgggccatgttgggggcgctcggatgcgttttcccggagctgttggccaaaaacggggtcaaatttggggaagcagtgtggttcaaggccggggcgcagatattctcggagggaggcctcgactacctggggaaccccaacctgatccacgcacagagtatactcgccatctgggcctcccaggtcgtgctcatgggattgattgaaggatacagagttgggggaggacccctcggggaggggttggaccctctatacccagggggggccttcgacccactggggctggcagacgacccggagtcgttcgcggagctgaaggtgaaggagataaagaacgggcggctggctatgttctccatgttcggcttcttcgtgcaggcaatcgtgaccggtaagggccccatcgaaaatctctacgaccacttggcagaccccactgccaacaatgcctgggcctacgccaccaatttcgttcccggcaagtgaagggaagtgacagaaaataaaaataaaaaggctgtaatctgtgtatcatacatttgacggccttcgtgtcaataaactttctttcaaatagatggtctgtgtgtgtagctttttcgttaagctcttgtaaaggtttttttctggtttgtgattgttattttgctacctccccttttccactacaaacgttgtaaaatgccacggccaaagggttgcaacgaaccaacttatcactagttagtaaaataactagcacagccaactcgctgttggtgaacgccgaaaggcttatggctggtaaaactccccgcttattcaatgaaacccgcttaattttataggctgggctttagtcatca

SEQ ID NO: 4444 - DNA, 1069 bp, Cicer arietinum
ctagtagcaacaaaagggaacaaacaacacaatcatggccacctctgctatccaacaatcagcattcactggcaagactggtttgaggcagggaaatgagttcatccggaaggctggtagctttggccaaggtcggtttaccatgcgtcgtactgtcaagagtactcctgagagcatctggtatggccctgaccgtcccaaatacttgggtcccttctctgaacaaattccatcatacttgactggtgaatttcctggtgactatggatgggacacagctggattatcagctgaccctgaaacctttgcaaggaaccgtgagctggaagtaattcacagcagatgggctatgcttggtgcattgggatgtaccttccctgaaatccttgaaaagaatggtgttaaatttggtgaggcagtgtggtttaaggccggtgcccaaattttctccgaaggtggtcttgactatttgggcaacccaaatctgattcatgctcagagcattcttgcaatctgggctactcaggttgtgctcatgggagtttgttgaaggctacagggttggtggaggaccacttggtgaaggactagacccactttaccctggcggtgcctttgacccacttggtctggctgatgaccctgatgcatttgcagaattgaaggtgaaggaaatcaagaatggtcggttggccatgacctccatgtttggttcttttgttcaggccattgttactggcaaaggccctattcagaacctttacgaccatgttgctgaccctgtcgccaataatgcgtgggcttttgctactaactttgtccctggacaatgagaatgccatataatgcctgttttgtcagatgcaatcttctgctctcatttgcatttctgttgtgtttaactcccattttcaccaatgtaactacatgagcagaagaacctgtatgttgttgattatatattagaaatatggattccaagaaatatcaaatcttgtgcacgaatttagcatagtgatggggcctatgtttgtcatactatatttttattcccaataacctagacaac

SEQ ID NO: 4445 - DNA, 1271 bp, Picea glauca
cgagcggcataacttcacaactgaagctcatcacttgcttcctgaccttggtcttaccatttttctcatcgtcacgctcgccatggcaacagcctcagccatccaaatctcaagcttggcaggacagaccctcctgaggccgcagcagaatgagctcgtcagtaaggtgggcgcgtcgcaggctcgaatcaccatgcgaagaaccgtcaggagcgcccctgagagcatttggtatggacctgaccgccccaagtacctgggccccttctcggaacagacgccgtcgtatctcaccggcgaatttcccggcgactacgggtgggacaccgccgggctctctgccgaccctgagaccttcgccaaaaacagagagctggaggtgatccacagcagatgggccatgttgggggcgctcggctgcgttttcccggagctgttggccaaaaccggggtgaaatttggggaagccgtgtggttcaaggccggggcgcagatattctcggagggaggcctcgactacctggggaaccccaacctgatccacgcgcagagcattctggccatctgggccttccaggttgtgctcatgggcttgattgagggatacagagttcgggggaggaccccttggggaggggttggaccctctgtacccagggggggccttcgatccactggggctggccgatgacccggaagcgtttgcggagctgaaggtgaaggagctaaagaacgggcggctggccatgttctccatgttcggcttcttcgtgcaggcaatcgtaaccggcaagggccccatcgaaaatctcttcgaccacttggcggatcccgcaaccaacaacgcctgggcctacgccaccaatttcgttcccggcaagtgaagtgaactgacggaaaataaaagatggctgtaattctgcatcatacatctgacagactttcctgttaagaatccaattttctttcaacgagatgttactcggtttcctaaagttaggcttttgaaccggttttttctggttcgcggctgctactatgctcaatatttttacacttcttgtaatctcaactgtaatccagttacttcctcttctctttcatatagaggtgatgcaacaacaccttactctatcttctggattgaggttactgtatcatggtcacgtgaaacacaaatattgttagtattacaacatctatttctatttctaaatattagttgtaaaacatgtattttaattggaaggatttgattttgattgtgattt

SEQ ID NO: 4446 - DNA, 1001 bp, Zostera marina
aaagaacacagcaaaaactattcgttctcttccattttgaagctcaaggaatggccacctctgcgattcatcaatctgtctttgttggtcagacaaccttgaagcaacaaaatgaacttgtccgcaaagttggagtcttcgagagtcgcatatctatgcgccgcacagtgaagagcactcccgacagcgtttggacggcgcagaccgtccaagtacttgggtccattctctgagcaaactccatcatacctaactggtgaattcccaggtgactacggttgggacacagccggtctatcagcggacccagagaccttcgcaaagaaccgtgaacttgaggtgatccattgcagatgggccatgttgggcgccttaggttgtgtctttccagagcttctatcaaagaacggagttaaattcggtgaagccgtttggttcaaagctggatctcaaatcttctcagatggtgggcttgactacttaggcaatcctaacttggtccatgctcaaagcatcttggccatatgggcttgccaagttgttttgatgggctttatcgaaggataccgcgttggtggaggtccacttggagatggtcttgacccactttacccaggaggctcattcgacccattgggcttagctgatgacccagaggccttcaccgaattgaaggtcaaagaggttaagaacggacggttggctatgttctcgatgttcggatatttcgtccaagctattgtgaccggtaaaggtccaattgagaacctatacgaccaccttgccgacccagtcgccaacaatgcttgggcctttgctacaaacttctcccccgcaaactaaatataacaatctccatatataatttgcatgtaaactttgtttgttgtttgatcttttggattctcgaattttcgaaaagttttaaccaaacaacttaaatatcaatgtgagtgagatttgtaaacaatgtgtttgttgtttgaaaattggaataaatg

SEQ ID NO: 4447 - DNA, 1004 bp, Zostera marina
aaaaactattcgttctcttccattttgaagctcaaggaatggccacctctgcgattcatcaatctgtctttgttggtcagacaaccttgaagcaacaaaatgaacttgtccgcaaagttggagtcttcgagagtcgcatatctatgcgccgcacagtgaagagcactcccgacagcgtttggtacggcgcagaccgtcccaagtacttgggtccattctctgagcaaactccatcatacctaactggtgaattcccaggtgactacggttgggacacagccggtctatcagcggacccagagaccttcgcaaagaaccgtgaacttgaggtgatccattgcagatgggccatgttgggcgccttaggttgtgtctttcagagcttctatcaaagaacggagttaaattcggtgaagtccgtttggttcaaagctggatctcaaatcttctcagatggtgggcttgactacttaggcaatcctaacttggtccatgctcaaagcatcttggccatatgggcttgccaagttgttttgatgggctttatcgaaggataccgcgttggtggaggtccacttggagatggtcttgacccactttacccaggaggctcattcgacccattgggcttagctgatgacccagaggccttcaccgaattgaaggtcaaagaggttaagaacggacggttggctatgttctcgatgttcggatatttcgtccaagctattgtgaccggtaaaggtccaattgagaacctatacgaccaccttgccgacccagtcgccaacaatgcttgggcctttgctacaaacttctcccccgcaaactaaatataacaatctccatatataatttgcatgtaaactttgtttgtttgtttgatcttttggattctacgaattttcgaaaagttttaaccaaacaacttaaatatcagtgtgagtgagatttgtaaacaatgtgtttgttgtttagaaaattggaataaatgagttttattc

SEQ ID NO: 4448 - DNA, 899 bp, Zostera marina
ctattcgttctcttccattttgaagctcaaggaatggccacctctgcgattcatcaatctgtctttgttggtcagacaaccttgaagcaacaaaatgaacttgtccgcaaagttggagtcttcgagagtcgcatatctatgcgccgcacagtgaagagcactcccgacagcgtttggacggcgcagaccgtcccaagtactgggtccattctctgagcaaactccatcatacctaactggtgaattcccaggtgactacggttgggacacagccggtctatcagcggacccagagaccttcgcaaagaaccgtgaacttgaggtgatccattgcagatgggccatgttgggcgccttaggttgtgtctttccagagcttctatcaaagaacggagttaaattcggtgaagccgtttggttcaaagctggatctcaaatcttctcagatggtgggcttgactacttaggcaatcctaacttggtccatgctcaaagcatcttggccatatgggcttgccaagttgttttgatgggctttatcgaaggataccgcgttggtggaggtccacttggagatggtcttgacccactttacccaggaggctcattcgacccattgggcttagctgatgacccagaggccttcaccgaattgaaggtcaaagaggttaagaacggacggttggctatgttctcgatgttcggatatttcgtccaagctattgtgaccggtaaaggtccaattgagaacctatacgaccaccttgccgacccagtcgccaacaatgcttgggcctttgctacaaacttctcccccgcaaactaaatataacaatctccatatataatttgcatgtaaactttgtttgtttgtttgatcttttggattctcgaatttt

SEQ ID NO: 4449 - DNA, 1065 bp, Zostera marina
ttcggggtacttattttaaaagcacaccagtccgtttgaaaaatcaaagaacacagcaaaaaagaaactattcgttctcttccattttgaagctcaaggaatggccacctctgcgattcatcaatctgtctttgttggtcagacaaccttgaagcaacaaaatgaacttgtccgcaaagttggagtcttcgagagtcgcatatctatgcgccgcacagtgaagagcactcccgacagcgtttggacggcgcagaccgtcccaagtacttgggccattctctgagcaaactccatcatacctaactggtgaattcccaggtgactacggttgggacacagccggtctatcagcggacccagagaccttcgcaaagaaccgtgaacttgaggtgatccattgcagatgggccatgttgggcgccttaggttgtgtctttccagagcttctatcaaagaacggagttaaattcggtgaagccgtttggttcaaagctggatctcaaatcttctcagatggtgggcttgactacttaggcaatcctaacttggtccatgctcaaagcatcttggccatatgggcttgccaagttgttttgatgggctttatcgaaggataccgcgttggtggaggtccacttggagatggtcttgacccactttacccaggaggctcattcgacccattgggcttagctgatgacccagaggccttcaccgaattgaaggtcaaagaggttaagaacggacggttggctatgttctcgatgttcggatatttcgtccaagctattgtgaccggtaaaggtccaattgagaacctatacgaccaccttgccgacccagtcgccaacaatgcttgggcctttgctacaaacttctcccccgcaaactaaatataacaatctccatatataatttgcatgtaaactttgtttgtttgtttgatcttttggattctcgaattttcgtaaaagttttaaccaaacaacttaaatatcaatgtgagtgagatttgtaaacaatgtgtttgttgtttagaaaaatttggaaataaatgtagtttta

SEQ ID NO: 4450 - DNA, 876 bp, Taxus baccata
ctctcactgatttctttctctgtgtaacaatggcggctgcctttcaattgtcaagcatggggagcttcgcggggcagtcacttttccagccaaagaatgagttcgccagatatttggccatttcagtgggcagcttcgagtctcgcattaacatgcgtagaaccatcaagagcaccccacagagcttgtggtatggaccagaccgccccaagtacttgggccccttttcagaacaaactccctcttacttaactggcgagttcccaggtgactacggttgggacaccgcagggctatccgctgatcctgaaacatttgcaaaaaatagggaactcgaggtcattcactcccgttgggccatgttgggagccttgggttgcgtattccctgaaatcttagcaaaaaacggagtcaaatttggtgaagctgtctggttcaaagcaggttcccaaatttttagcgaaggtggccttgactacttgggcaaccccaatctcattcacgcccagagcatattggccatttgggcatcccaggtagtgttgatggggttgatcgaaggatatagagtgggaggtggaccccttggtgaggggttggatcctctatatcctggtggggcatttgatccgttggggttggcagatgaccctgaggcctttgcagagcttaaggtgaaggagcttaagaatgggcggttggctatgttttccatgtttggattttttgtgcaggccattgtgacagggaaggggcctattgaaaacttgtatgatcatttggcagatcctgctactaacaatgcttgggcttatgctaccaatttcgttcctggaaagtgatttaatccaggaaaagccaaatttagggaatttg

SEQ ID NO: 4451 - DNA, 845 bp, Flaveria ramosissima
ggtggcttcaatggcggccgcttcaccatgcgccgcaccgttaaaagcgcgccacaaagcattggtatggaccggaccgccccaagtacctggccccattctctgagcaaaccccgtcatacttaactggtgaattcccaggtgactatggttgggacactgctggattgtcagctgaccccgagacatttgccaagaaccgtgagctcgaggtgatccactctaggtgggccatgctcggcgcactcgggtgcgtgttccccgagattcttgaaaagaacggtgttaaattcggtgaagcggtctggttcaaggcgggttcccaaattttctcagaaggtgggcttgactacctaggaaacccaaacttgatccatgcccagagcattttagccatctgggctactcaagttgttctcatgggcctcattgaaggatacagggttggaggcggcccacttggtgaagggcttgacaagatttacccaggagggtcatttgacccacttggattggctgatgaccctgatgcatttgcggagttgaaggttaaggagcttaagaacggccgattggctatgttttcgatgtttgggtttttcgttcaagccattgtaactggaaagggcccgatcgagaacttgtttgaccatcttagcgacccggtggctaacaacgcatgggcgtatgctaccaactttgtgcccggaaaatgagttgtatacctgtaaaccaaaaataatggttatgcaataatattacaagcttgtgtttttgtcaagaaatatttatgtatgtttgtatgtatacatatacctgccaaaagaaaaacaatggtttgttag

SEQ ID NO: 4452 - DNA, 962 bp, Valeriana officinalis
aaaaatactgttgtgtgtaatacaattccagcagcatcgagatggcaacctctgcaatccagcaatctgccttactttgaagccacaaaatgagttcgtccgcaagtaggctcatttggacccagcagattcaccatgaggcgtaccgtcaaaagcgcaccgcagagcatctggtacggacctgaccgtcccaagtacttgggcccattctccgagcaaactccgtcatacttgaccggtgaattccccggcgactacggatgggacaccgcggggctatcagccgacccagagaccttcgcgaagaaccgtgagctggaagtgatccacagcagatgggcgatgctgggagcattgggatgcgtgttcccagagatcttatcgaagaacggagtcaagttcggcgaggcagtctggttcaaggccggatcccaaatcttctcggaaggaggtctggactacctgggaaacccaaacttggttcacgcgcaaagcattctagcgatctgggcgagccaggtggttctgatgggtttgatcgaggggtaccgcgtgggtgggggcccactaggcgagggactcgattcgctatacccgggcggggcattcgacccgttggggcttgcggacgacccggagtctttcgctgagttgaaggtcaaggaattgaagaacgggagattggctatgttctccatgttcggcttcttcgtacaggcaatcgtaaccggaaagggacccgttgagaacttgtacgaccatgttgctgaccccgttgccaacaacgcctgggctttcgccactaacttcgtacccggaaagtagtagtgattcatgcccaactcaacttatatataagttagttgtatttcgatcttgtttcttcttcttgtcttgtaattggtggttggtttggtatgtatttcaatcttgagtgtttgtactactactccgtctagcta

SEQ ID NO: 4453 - DNA, 816 bp, Cichorium intybus
cttgaagccacaaaacgaactctcaagaaaaccgcaccttcaatggcggccgcttcaccatgcgccgcaccgtcaaaagtgcaccacaaagcatttgtacggcccagaccgcccaaaatacttgggcccgttctccgagcaaaccccatcatacctaaccggtgaattccctggtgactacgggtgggacaccgcgggactctcagctgaccccgagacatttgccaagaaccgtgagctcgaggtgatccactctcggtgggccatgctcggtgcactcgggtgcgtcttccctgagattctttccaagaacggtgtcacgttcggggaagcagtctggttcaaggctggttcccaaatattctcagaaggcggtcttgactaccttggaaaccctaacttgatccatgcccaaagcattcttgctatttgggcttctcaagtcgttctcatggggctcattgaaggataccgcgttggtggtggcccacttggtgaagggctcgacaagatttaccccggtgggtcttttgacccgcttggattggcagatgacccggaagcatttgctgagttgaaggttaaggaacttaagaacggtcgattggcaatgttttccatgtttggattctttgttcaagccattgttacagggaaaggcccgatcgagaacttgtctgaccatcttagtgacccggttgctaacaatgcttgggcttatgctaccaactttgtgcccggaaaatgagttgaatgaatacgtataaaattgatcattattatgcaatatcaataaactctagcatttaatatccc

SEQ ID NO: 4454 - DNA, 775 bp, Flaveria ramosissima
agaagaccggtagcttcaatggcggccgctcaccatgcgccgaaccgtcaagagcgcaccacaaagcattggtatggccggacaggccaagtatttggcccgttctcggagcaaacccatcatacctaaccggagaattccctggtgattatgggtgggacacagctggattatcagctgatcccgagacatttgccaagaaccgtgagcttgaagtgatccactctcggtgggccatgcttggtgcactcgggtgcgtgttccccgagattcttgcaaagaacggtgtcaaattcggtgaagcagtctggttcaaggcgggctcccagatattctcagaaggtgggcttgactacctcgggaacccaaatttgatccatgctcagagcatcttagctatctgggcttgtcaggttgttctcatgggcctcattgaaggtaccgcgttggtggaggcccattgggtgaagggctcgacaagatttacccaggtgggtcttttgacccacttggtttggctgatgatccggatgcttttgctgaattgaaggttaaggagcttaagaatgggcgattggctatgttttcgatgtttgggttcttcgttcaggccatcgttaccggaaaaggcccgatcgagaacttgtttgatcatgtcagcgatccggtggctaacaacgcttgggcttatgccaccaactttgttcctggaaaatgagtttgattagtgttaattttgatgatgattattaagtaatatcacaagttccggact

SEQ ID NO: 4455 - DNA, 1040 bp, Flaveria ramosissima
aactttcgtcccgggaccgtcccggtccccggcccgtttcgttaaaggccgtacaaaaccggaaacggactaccgtccaacgtaaagaacccgggtaacgcgttcctaacggacggcccggccgttcgaccactgacgccgaaccgtaccaacgaagtagcaccacaaagcatatggtatgggccggataggcccaagtacttgggccctttctcggaacaaaccccatcatacctaactggagaatttcctggtgattatgggtgggacacagctggattatcagctgatcccgagacatttgccaagaaccgtgagcttgaagtgatccactctcggtgggccatgctcggtgcacttgggtgcgtgttccccgagattcttgcaaagaacggtgtcaaattcggtgaagcggtctggttcaaggcaggctcccaaatattctcagaaggtgggcttgactacctcgggaaccccaacttgatccatgctcagagcatcttagctatctgggcttgtcaggttgttctcatgggcctcattgaagggtatcgtgttggtggaggcccgttgggtgaagggctcgacaagatttacccgggtgggtcttttgacccacttggtttggctgatgatccggatgcttttgctgaattgaaggttaaggagcttaagaatgggcgattggctatgttttcgatgtttgggttcttcgttcaggccatcgttaccggaaaaggcccgatcgagaacttgtttgatcatgtcagcgatccggtggctaacaacgcttgggcttatgccaccaactttgttcctggaaaatgagtttgattagtgtaattttgatgatgattattaagtaatatcacaagtttccggctagttttgttatctaatgtttcaataccataaagtcgatagttcttagttataaacaaaaaaaaaaaaagaaaaaaaaagtaaactacttagcgttagataccactagtcttactagagaactgaccaagacacacgagggagtagagggggggggg

SEQ ID NO: 4456 - DNA, 4681 bp, Brassica rapa
cgctcgctcagcagctcttcaaaccctaacgccgagaccagtcgatatcggcgacgtgattctctctggtttctcctcgtaatcctgtaaacccgacggcgaagaatctccgccgcggatttagtcttcattggcgatccctcctccgaagatgtccgtccattgcttttgatttaggtcatcggacctgaatccgatttgttgctctgaagaagagcaaacgagtcatctgctaagctatttcgtgagaatctgtaagattcgttttccctttcggagattgttttgtttcggaagctctctaggttcgtttaaaccctaatttcacgctgctcgttgttactagaatggacttagcttaatccgttagggctttcgagttgttgcgaacattagatcgttttgtatgcgagagacgagaagctctgcgttatccatggagatttcagtttcctctccaaagcagagcgtgttatcttcatcggattgtatgagcgaccctgaggaggagcacgagatcagcgaggaggaggatgacgacgatcgcaaccataagcatcgtaagaaagaagagacgagttctcagtccttggagcaaggctcttcagatcaggctttctcgcgtccctacaggagaaactataaacattttgagaatggcaatgaacatgagaaacggtctctaggagcaggaggatcaggacaccgtgtacagtttgataaccaaagatcaagatcaaaccctggtagaggtagaggaagttatggttcttggagtcagcgtgattccaggtttaatcatcctgttgatctctcatctcatatggttccggggatgtttggagggagggggatagctgctcaaaccgcaccttggcctgggtttggaatgcttcctggagttcccaatggtggcttggatggtttccatcacttgcaagggcctctaggaccgccgttgaatggtccactcaacatggggattcctcggcagcgatgcagagattttgaggaacgtgggttctgcctcagaggggatatgtgtcccatggagcatggaatcaatcgtatcgttgttgatgatgttcagagtctatcacagttcaaccttcccgtttctgtccctggtgcacctcatatggcagcttcttccaaaccagtgcctgcacagtttgggggtgctaatttcatgaatacgaaaggagctcatgggaagactaacgagactggaatggctgttgatggtatgggttatggtgatgcatatcctagtgcaggtggaactgattcttacgatcctgatcaacctttgtggaataacagtgctggtgaaacttcaggggcattatctgctctaaattctcatgggattgatgagaatgtcgctccaatggatgacaataaccaagatggccctgtaaatacatatggtattcgagaatcaagaaacaataatcagtcgggttggggcagagtgcgtaatagtcaagcaaatctcaaagagaaaggtgatactgtattaaattcatcagctggtcctgaaggtcaatcgaaggagatctcagttagtttatcccgccaaaacaatgttgggggaagtgtcgcaaaagctgttgattcatcaaacgcttcaaacgatgcagtgaataatacaagaacaccaatgcaaaaggcaatgcggactctatttgtgaatggtgttccccacgagagcaacagaagggacctcattctcgcccattttcagaaatttgggaaagttattgacattcacatcccagtaaatagcaaccgagcatttgttcaattctcaaaacgcgaagaggctgagtccgctctcagggcacctgatgctgttatgggtaaccgctttatcaaactttggtgggcaaatagagatagtatacctgataatggcctgtccagtgggaatggtgcttttatgaagggtcgtgtcgtgggtgcttctggaggacagaaccagattcctatctctgcagcatcgaaaagcaaccatgtatctcttactgcgaaagggcctgccttccaccctggtggagctccatcatcatctcaacagcctaagcctgtgggggtcactagtggtcccaaggttatgccgcttcagcagaaaaaagcagacactcttgagcagttgaaagagacacttcggaaaaagcaggaaatgctggatcaaaagcgtaacgagttatgcaaaaagttggcgactcttcaaaaacaagaaacgggtgttaaagacgaggaagcagatgagccagatgctaagcgcgttaaggtggacacagcctcgaactccggtactgcaatcccatcaccaaaaacagagtcattgactgagaagaaagggcctatcaagaaaccactttctattgctagaccaagcacagaaacgccatcgcccgatttgaaaaacttaaagcaaagaccgtattcgtataccacaagtttgaacactcctatggtaaataggtataagttggacaaccgcacgactaccatcaaagttgtccctcctttgccaaccgggctagccgatgttgctgtcttaaaagaacatttctcttcttatggcgaggtctcaaaagtggaactcgaagacaatgcatcggctgatagtggcaaggatcaggatgaaacacataacaaaagccttgcagcctgtgtgacatttgtgaaacgcagcgcagcagagaaagcgtttgctaatgcaaagtcttggcaagaacacacgttgcagctcgtgtgggtaacacgtcaaatcaagaaagagaataaaagtagcaatgacaagaataatccctctgtttctagtgaccaccttagcagcaaaaacaagtccgctgcttctgtttctaatgacccgaaaccagaagatgaagtcaaatcctcttctacagaagaaccaaagagcacaaatgtctctggagacgacaatacattgaatgaacaagacaatggcagcaataaaagtaatagcgagtccaacgagggagctgaaaaagttgcagcgccagaaagtgatgaagaacagatgaatggttaagctgggcaagaagactgtcagtgaggtaatcttttgtctcagaaacataatctttatttgttggtgaatctggtatagtgatcttttaggctttttagccaatcagtgagacgttaatatttgttggtagcaaaagatatatttatagttttttcctcctttatgtggatagtagaagtgtattgttacatttggccttccaagaacagtggttgggtctttgtatcagcaggtctttgttttcctcttttattagcttctataacaatcttgacttgtgttgtacatacatagttggacttcgtgacttgctttagtcgagtcgaagagcggtgtggaatctataaaacggcacgcatttttgaagtttatgcaatgttttctttggtaatatcacaggtttgaatcctagaaactatatgctttcattctttggtaatatcacaggtttgaatcctagaaactatatgctttcattaaacaacagatgtagagaaatgagattgaaattcgatgatgtatgtctgagcagttcgcaaattttctagatcaattcaagacaagggcctcaagctaacgatgatttctttcattaagacagaacatcaaaccaacagacatacattaattgttttaaaaacatacattatcagataatattctattttccggggacgaagttggtggcgtaagcccaggcattattagcgacagggtccgcaacatgatcaaacagattctcgatcggtcctttaccagtgacgatggcttggacaaagaatccaaacatggagaacatagcaagccgaccgtttttaagctccttcactttcaattccgaaaacgcctccggatcctccgctaagttcaacgggtcaaacgccccacccgggtaaagcgggtcaagcccttcaccaagaggtccacctccgattctgtacccttcgattaaacccatcagcacaacttgagaagcccagattgctaatatgctttgcgcgtggatcaagttagggttgccgaggtaatcaagccctccttctgagaagatctgagaccctgccttgaaccacacggcttcaccgaatttgactccgtttttggagagaatctctgggaaggtgcatcctaaagcgccgagcattgcccatctgctgtggattacttccagctcacggttctttgcgaaggtttctggatcggcggagagaccggcggtgtcccagccgtagtctccggggtattctccggttaggtacgatggtgtgttctctgagaatggtcctaagtacttgggacggtctggtccgaaccagatgctctgaggagtagacttgacggtactacgcatgacgacgcggccccaccaccgttggaagctcctactttgcggaggagatcgttggaaggcttcaaagccgtttgtccggcgaaagaggagtgctggattgctgatgtggccattcttgtttatctcaactccaaacaaagatacaaatgaagagagaaataaacaaagatgagatgattgttgttatgttatgtcatttcgattttataatagagatccgaaggtggtcattctgagggagatcacaagatggacatgtcagcgac

SEQ ID NO: 4457 - DNA, 989 bp, Abies balsamea
agttatagtacctgacattggtctcagcatttttctcatcgtcacagtaataaccatggcaactgcctcagccatccacagctcaagcttggcaggccagaccctcctcaggccgcagcagaatgagctcgtcaagaaggtgggcacgtcgcaggctcgaatcaccatgagaagaaccgtcaggagcgcccctgagagtatttggtatggacctgaccgccctaagtacctgggccccttctcggaacagacgccgtcgtatctcactggagaatttcctggagattacgggtgggataccgccgggctctcggccgacccggagaccttcgccaaaaatagagagctggaggtaattcactgcagatgggccatgttgggggcgctcggctgcgttttcccggagctgttggccaaaaccggggtcaaatttggggaagccgtgtggttcaaggccggggcgcagatattctcggagggaggcctcgactacctggggaaccctaatctgatccacgcgcagagcattctggccatctgggcgttccaggttgtgctcatgggattgattgagggttacagagtggggggaggaccccttggggagggattggaccctctgtacccaggaggggccttcgacccactggggttggccgacgacccggaggccttcgctgagctgaaggtaaaggagataaagaacgggcggctggccatgttctcaatgttcggcttcttcgtgcaggcaatcgtgaccggtaagggccctatcgaaaatctctacgaccacttggcagatcccacagccaacaatgcgtgggcatatgccaccaatttcgttcccggcaagtgaagtgaagtgacggtaaataaaagatggctgtaatctctgtaccatacatctttgacggcctttcctgttaataagctggtgttctttcaacgagttgttactcgatttctctaagctcttgctatggtttctc

SEQ ID NO: 4458 - DNA, 805 bp, Brassica juncea
ccaacactcctcttctactggccaaacggccctgaagccctccaacgatctcctacgcaaagtcggagcttccagcggtggtggccgcgtcgtcatgcgtcgtaccgtcaagtctactcctcagagcatctggtatggaccagaccgtcccaagtacttaggtccattctcagagaacacaccgtcatacctaaccggtgaataccccggagattacggctgggacaccgccggtctctccgccgaccctgaaacctttgccaagaaccgtgagctcgaagttatccacagcagatgggcaatgctaggcgctttaggctgcaccttcccagagattctctccaaaaacggagtcaaattcggtgaagccgtatggttcaaggcaggatctcagatcttctcagaaggaggacttgactacctcggaaaccctaacttgatccacgcgcaaagcattttagctatttgggcatctcaagttgtgctaatgggtttaatcgaagggtacagaatcggaggtgggccccttggtgaaggtcttgacccgctttacccgggtggggcgtttgacccgttgaacttagctgaggatccagaggcgttctcggaattgaaagtgaaggagctaaagaacggtcggcttgccatgttctccatgtttggattctttgtccaagctattgttactggtaaaggtccgattgagaacttgtttgatcatgttgcggaccctgtggctaacaatgcatgggcttacgccaccaactttgttcccggaaaatagaatttgattggattaatttat

SEQ ID NO: 4459 - DNA, 1255 bp, Cedrus atlantica
tcacaacagaagctcattactcatactacctgacgttggtctcaacgtttttttcatcgtcaccttcaccatggcgacagcctcagctatccacagctcaagcttggcaggccagagcctcctcaggtcgccagggaatgagctcgttaagaaggcaggcacgtcgcaggctcgaatcaccatgcgaagaaccgtcaggagcgcccctgagagcatttggtatggacctgaccgccccaagtacctgggccccttctcggaacagacaccgtcgtatctcaccggagaattcccgggcgactacgggtgggacactgccggactctcggccgacccggagacctttgccaaaaatagagagctggaggtgatccactgcagatgggccatgttgggagcgctgggctgcgttttcccagagctgttggccaaaaccggggtcaaatttggggaagccgtgtggttcaaggccggggcgcagatattctcggagggaggtctcgactacctggggaaccccaacctgatccacgcgcagagcattctggccatctgggcgtgccaggttgtgctgatgggattgattgaggggtacagagtgggaggaggaccccttggggaggggttggatcctctgtacccagggggttcgtttgacccactggggctggccgacgacccggaggccttcgcggagctgaaggtgaaggagataaagaacgggcgactggccatgttctccatgttcggcttctttgtgcaggcaatcgtgacgggcaagggccccatcgaaaatctattcgatcacttggcggatcccactgctaacaatgcgtgggcctatgccaccaatttcgttcccggcaagtgaagtgaggtgacggtaaatagaagatggctgtaatctctgtattatagttctggcggactttcctgttaattatccgattttctttcaactagatgttacttggtttctttgagttaggctcttgcagccgggttttctgcttcgcggttgctactctgcttaaaattgtctaatttatataatttctactgtgattgccttcttttccatgatcgagtgacttcttgtatctgcatttagatgacgcactctatgtgatgatagacgttactctatttgtaagagaagataggagaacgaagctactatttgacaaagaagctactattaaattggaccaatgatttttacattgttttgaaatggaatattgtcttgattatg

SEQ ID NO: 4460 - DNA, 1076 bp, Artemisia annua
ttccatttttaccaagatattgttgaaatgtatacatgatattttttatgtgtgcgtgtaaaagataatagttttggtaaatgttacctcaaagagaattctcaattggcaaaactcacgtgtttgcaatccattttggaacctcttgcaacccagttttaaacagtggtatcaacgcagtactcgacggggaccctcttacaaatcaacaactctacagcattccttcaatccccttagaaatggcaacctctgcaatgcaacagtcagcctttgtaggtgagtcggcattgaagccgcagaatgagcttgttaagaagaccggcagcttcaatggcggccgcttcaccatgcgccgcactgtcaaaagtgcaccacaaagcattcgccccaagtacttgggcccattctctgagcaaaccccatcatacctgactggcgagttccctggtgactatggctgggacactgctggactatcagcagaccccgagacattcgcaaagaatcgtgagcttgaagtgatccactcacggtgggccatgctcggtgcacttgggtgtgttttcccagagcttctttcaaagaatggtgtcaaatttggtgaagctgtctggttcaaggcaggatcccaaattttctcagaaggtgggctcgactacctcgggaacccaaacttgatccatgcccaaagcattttagccttcacaagtagtccttatgggactcattgaaggctaccgtgttggtgggggtccgcttggtgaagggcttgacagtatttacccaggagggtcttttgacccacttggtttggctgatgacccagaggcatttgctgaactgaaggttaaggagcttaaaaacggtcgattggcgatgttttccatgttcgggttctttgttcaggccatcgtaacaggaaagggcccaatcgagaacttgtttgaccatctcagtgatccagtagctaacaatgcttgggcttatgctaccaactttgtacctggaaaataagctaaatatatgtaaattcgatgattgttatgcaattttacaaggcagaggtggtgttg

SEQ ID NO: 4461 - DNA, 1253 bp, Picea glauca
ttcacaactgaagctcatcacttgcttcctgaccttggtcttaccatttttctcatcgtcacgctcaccatggcaacagcctcagccatccaaatctcaagcttggcaggacagaccctcctgaggccgcagcagaatgagctcgtcagtaaggtgggcgcgtcgcaggctcgaatcaccatgcgaagaaccgtcaggagcgcccctgagagcatttggtatggacctgaccgccccaagtacctgggccccttctcggaacagacgccgtcgtatctcactggcgaatttcccggcgactacgggtgggacaccgccgggctctctgccgaccctgagaccttcgccaaaaacagagagctggaggtgatccacagcagatgggccatgttgggggcgctcggctgcgttttcccggagctgttggccaaaaccggggtgaaatttggggaagccgtgtggttcaaggccggtgcgcagatattctcggagggaggcctcgactacctggggaaccccaacctgatccacgcgcagagcattctggccatctgggccttccaggttgtgctcatgggcttgattgagggatacagagttgggggaggaccccttgggaggggttggaccctctgtacccagggggggccttcgatccactggggctggccgatgacccggaagcgtttgcggagctgaaggtgaaggagctaaagaacgggcggctggccatgttctccatgttcggcttcttcgtgcaggcaatcgtaaccggcaagggccccatcgaaaatctcttcgaccacttggcggatcccgcaaccaacaacgcctgggcctacgccaccaatttcgttcccggcaagtgaagtgaactgacggaaaataaaagatggctgtaattctgcatcatacatctgacagactttcctgttaagaatccaattttctttcaacgagatgttactcggtttcctaaagttaggctttgaaccggttttttctggtttcgcggctgctactatgctcaatatttttacacctcttgtaatctcaactgtaatctagttacttcctcttctcttttatatagaggtgatgcaacaacaccttactcttcttctggattgaggttactgtatacgtgaaacacaaatattgttagtattacaacatgtatgtctatttctaaatattagtattagttgtaaaacatgtattttaatttggaaggatttgattttgattgttaa

SEQ ID NO: 4462 - DNA, 917 bp, Cedrus atlantica
cttggtctgagcatttttctcatcgtcacgttcaccatggcaacagcctcagcaatccaaagctcgagcttggcaggccagaccctcctgaggccgcagcagaatgagctcgtcaagaaggtgggcacgtcgcaggctcgaatcaccatgcgaagaaccgtcaggagcgcccctgagagcatttggtatggacctgaccgacccaagtacctgggccccttctcggaacagacaccgtcgtatctcactggagaatttcctggcgactacgggtgggacaccgccgggctctcagccgacccggagacctttgccaaaaatagagagctggaggtgatccactgcagatgggccatgttgggggcgctgggctgtgttttcccggagctgttggccaaaaacggagtcaaatttggggaagccgtatggttcaaggccggtgcgcagatattctcggagggaggcctcgactacctggggaaccccaacctgatccacgcacagagcattctagccatctgggcatgccaggttgtgttgatgggattgattgaagggtacagagtagggggaggaccccttggggaagggttggaccctctgtacccagggggagccttcgacccactggggctggctgacgacccagaggccttcgcggagctgaaagtgaaagagataaagaacgggcggctggcaatgttctccatgttcggcttctttgtacaggcaatcgtcaccggtaaggggcctatcgaaaatctctacgaccacttggcggatcccactgccaacaatgcatgggcctacgccactaatttcgttcccggcaagtgaagtgaagtgacagaaaataaaagagggctgtaatctgtgtatcatacctttgacagcctttctggttaataatccgattt

SEQ ID NO: 4463 - DNA, 1085 bp, Cedrus atlantica
tcgtcacgttcactatggcaacagcttcagccatccaaagttcaaccttggcaggccagaccctcctgaagccgcagcagaatgagctcgttaagaaagtgggcacgtcgcaggctcgaatcaccatgcgaagaaccgtcaggagcgcccctgagagcatttggtatggacctgaccgccccaagtacctgggccccttctcggaacagacaccgtcgtatctcaccggagaattccctggcgactacgggtgggacactgccgggctctcggccgacccggagaccttcgccaaaaatagagaactagaggttatccactgcagatgggccatgttgggggcgctgggctgcgttttcccggagctattggccaaaaacggggtcaaatttggggaagccgtgtggttcaaggccggggcgcagatattctcagagggaggtcttgactacttgggaaaccccaacctgatccacgcgcaaagcattctggctatctgggcgtgccaggttgtgctgatgggattgattgaggggtacagagtgggaggaggaccccttggggaggggttggaccctctgtacccagggggggccttcgaccctctgggcctggccgacgacccggaggccttcgcggagctgaaggtgaaggagataaagaacggacggctggccatgttctccatgttcggcttcttcgtgcaggcaatcgtcaccggcaaggggcccatcgaaaatctcttcgaccacttggcagaccccgctgccaacaatgcctgggcctacgctaccaatttcgttcccggcaagtgaagtgaagtgacggtaataaaagatggttgtagtctgtgtattctacatttgacagcctttcctgttaataatccgattttctttcaacctgatgtcactcaatctgttcagcttaggctcttgcaacggttctttctgtttgggttgaggaagggaaattgttaaattcttaataataatcttaaactggttccccacacacatttgagtaagtgtggcaatcggtatttcttatttgtatcaattttaagctttaatattttaaagtcc

SEQ ID NO: 4464 - DNA, 952 bp, Cedrus atlantica
aagctcatcacgcatactacttgaccttggtctgagcatttttctcatcgtcacgttcaccatggcaacagcctcagcaatccaaagctcgagcttggcaggccagaccctcctgaggccgcagcagaatgagctcgtcaagaaggtgggcacgtcgcaggctcgaatcaccatgcgaagaaccgtcaggagcgcccctgagagcatttggtatggacctgaccgacccaagtacctgggccccttctcggaacagacaccgtcgtatctcactggagaatttcctggcgactacgggtgggacaccgccgggctctcagccgacccggagacctttgccaaaaatagagagctggaggtgatccactgcagatgggccatgttgggggcgctgggctgtgttttcccggagctgttggccaaaaacggagtcaaatttggggaagccgtatggttcaaggccggtgcgcagatattctcggagggaggcctcgactacctggggaaccccaacctgatccacgcacagagcattctagccatctgggcgtgccaggttgtgttgatgggattgattgaagggtacagagtagggggaggaccccttggggaagggttggaccctctgtacccagggggagccttcgacccactggggctggctgacgacccagaggccttcgcggagctgaaagtgaaagagataaagaacgggcggctggcaatgttctccatgttcggcttctttgtacaggcaatcgtcaccggtaaggggcctatcgaaaatctctacgaccacttggcggatcccactgccaacaatgcgtgggcctacgccactaatttcgttcccggcaagtgaagtgaagtgaagtgacagaaaataaaagagggctgtaatctgtgtatcatacctttgacagcctttctggttaataatccgattttcttt

SEQ ID NO: 4465 - DNA, 1025 bp, Pinus pinaster
gctcattactcgtattacctgactttggtctgagcatttttctcgtcgtcacgttcaccatggcaacagcttcagccatccaaagctcaagcttggcaggccagaccctcttaaggccgcagcagaatgagctcgtcaagaaggtgggcacgtcgcaggctcgaatcaccatgcgaagaaccgtaaggagcgcccccgagagcatttggtatggacctgaccgccccaagtacctaggccccttctcggaacagacgccgtcatatctcaccggagaatttcccggcgactacgggtgggacactgccggcctctcggcggatccagagaccttcgcaaaaaacagagagctggaggtaatccactgcagatgggccatgttgggagcgctcggctgcgttttcccggagctgttggccaaaaatggggtgaaatttggggaagctgtgtggttcaaggccggggcgcagatattctcagagggaggccttgactacctggggaaccccaacctgatccacgcgcagagcattctagccatctgggcctgccaggttgttctcatgggattgattgaaggatacagagtgggaggaggaccccttggagaggggttggaccctctgtacccagggggtgccttcgacccactggggctggccgacgaccccgaggccttcgcggagctgaaggtgaaggagattaagaacggtcggctggccatgttctccatgttcggtttcttcgttcaggcaatcgtgaccgggaagggtcccattgaaaatctctacgaccacttggcggaccccactgccaacaatgcctgggcctacgccaccaatttcgttcctggcaagtgaagggaagtgacggaaaataaagaggcctgtgatctatgtatcaatcatttgacagccttagtgttaataaaatattttctttcagctggatgtatttgtcggtgatctttgttaataaaatattttctttgttcgtgatctttactaaaaaaacaaaaagtaaaa

SEQ ID NO: 4466 - DNA, 1158 bp, Pinus taeda
aattgaaacctcatcacttgctacctgacctcagtttttttcattgtctcgctcaccatggcaacagcttcagccatccagagctcaagcttcgcaggccagaccctcctgaggccgcagcagaatgagcttgtcaagaaggtgggcacgtcgcaggctcgaatcaccatgcgaagaaccgtcaggagcgcccctgagagcatatggtatggacctgaccgccccaagttcctgggccccttctcggaacagacgccatcgtatctcaccggagaatttcccggcgactacgggtgggacacggccgggctctctgccgatcccgagaccttcgccaaaaacagagagctggaggtgatccacagcagatgggccatgttgggggcgctgggctgcgttttcccggagctgttggctaaaaccggtgtgaaatttggggaagccgtgtggttcaaggccggggcgcagatattctcagagggaggcctcgactacttggggaaccctaacctgatccatgcgcagagcattctagccatctgggcgttccaggttgtgctcatgggattgattgagggatacagagttgggggaggaccccttggtgagggattggaccctctgtacccagggggagccttcgacccacttgggctggccgacgacccggaggcgttcgcggagctgaaggtgaaggagattaagaacgggcggctggccatgttctccatgttcggcttcttcgtgcaggcaattgtgaccgggaagggccccattgaaaatctctacgaccacttggcggaccccgttgccaacaatgcctgggcctatgccaccaatttcgttcctggcaagtaaagtaacggaaaataaaagatggctgtaatctctgtatcatacatccgacagactttcttgttaacaagccgatgttccttcaacggttttttctagttcgcggttgtttttttatcacttcttgtattctgaaccatgagtggcctttcggtttctcctaaagcctcaatgatccagttagttactcttattttagcggtttctcctaaagcctcaatgatccagttagttactcttattttagagggaggtgatgcaacttcatagtctttctttcatttttggatttaggttattata

SEQ ID NO: 4467 - DNA, 970 bp, Pinus taeda
gctcattactcgcattacctgactttggtctgagcatttttctcgtcgtcacgttcaccatggcaacagcttcagccatccaaagctcaagcttggcaggccagaccctcctaaggccgcagcagaatgagctcgtcaagaaagtgggcacggcgcaggctcgaatcaccatgcgaagaaccgtaaggagcgctcccgagagcatttggtatggacctgaccgccccaagtacctaggccccttctcggaagggacgccgtcatatctcaccggagaatttcccggcgactacgggtgggacactgccggcctgtcggcggatccagagaccttcgcaaaaaacagagagctggaggtgatccacagcagatgggccatgttgggagcgctcggctgcgttttcccggagctgttggccaaaaatggggtgaaatttggggaagctgtgtggttcaaggccggggcgcagatattctcagagggaggccttgactacctggggaaccccaacctgatccacgcgcagagcattctagccatctgggcctgccaggttgttctcatgggattgattgaaggatacagagtgggaggaggaccccttggagaggggttggaccctctgtacccagggggtgccttcgacccactggggctggccgacgaccccgaggccttcgcggagctgaaggtgaaggagattaagaacggtcggctggccatgttctccatgttcggtttcttcgttcaggcaatcgtgaccgggaagggccccattgaaaatctctacgaccacttggcggaccccgctgccaacaatgcctgggcctacgccaccaatttcgttcctggcaagtgaagggaagtgacggaaaataaaagaggcctgtgatctgtgcattaatcatttgacagccttagtgttaataaaatatgttctttcagctggatgtatttgttggtgatctt

SEQ ID NO: 4468 - DNA, 1159 bp, Papaver somniferum
ccctatacccctagtcgtagccttaggcaagtacgtacggggtaaaaaaaacataacaaagaagaacaaaaaaatcatggccaccactgcaatccaaaggtctgcattcactggtcaaactgctttgaagcagcaaaatgagttcattcgcaaagttggcaatgtcgaaggtggtcgtatctccatgcgccgtaccgtaaaaagcatccaatcaagcatgtggtacggaccagacagacccaagtatttgggaccattctcagaacaaaccccatcttacctcactggtgaattcccaggtgactatggttgggacacagccggattatctgctgacccagagacattcgctaagaaccgtgaactcgaagtgatccactgcagatgggctatgttgggtgccttaggctgcgtcttccctgaagttctttcaaagaacggtatcaatttcggagaagctgtatggttcaaagctggctcacagattttctctgaaggtggtttggattaccttggcaaccctaacttggtacatgcccaaagcatccttgcaatctgggctactcaagttgtactaatggggtttgttgaaggatacagagtcggtggtggtccacttggagaaggactagacaaactttaccctggtggatcttttgaccctctaggattagctgatgatccagagtccttttctgaattgaaggtaaaggaaatcaagaatgggagacttgctatgttctcaatgttcggatatttcgttcaggctattgttactggaaagggtccaattgaaaacctttatgaccacatcgccgatcctgttgcaaacaatgcatgggcttatgctactaactttgctcctggaaaatgaatgtaattttctaggggtgtatcaatgtttcaggcttgttaagttttctgaagttccttgggtgtacatttgaatattagcagttatcgaatcttcagtgttttctattgcataagatacatcacttgttatgcaaatgggatgccaaaagaataaacaaactgcataactgcggaacaaaatactgcaggtaaattcttatgcactccataatatccgcaaatccaagttttagtctggctgtggcggtagtttcataattaaggaaataaaagcacagaagtt

SEQ ID NO: 4469 - DNA, 1361 bp, Pseudotsuga menziesii
ttggtctcaccatttttctcattgtcacgttcgccatggcaacaacctcagccatccaaagcgcaagcttggcaggccagaccctcctgaggccgcagcagaatgagctcgtcaggaaagtgggcgcgtcgcaggctcgaatcaccatgcgaagaaccgtcaggagcgcccctgagagcatttggtatggacctgaccgccccaagttcctgggccccttctccgaacagacgccgtcgtatctcaccggagaattccccggcgactacgggtgggacaccgccgggctttcggcagatccagaaaccttcgccagaaacagagaactggaagtgatacactccagatgggccatgttaggagcgctgggctgcgttttcccggagctgttggccaaaaacggggtcaaatttggggaagccgtgtggttcaaggccggggcgcagattttctcggagggaggcctcgactatctcggaaaccctaacctgatccacgcgcagagcattctggctatcttggcgtcccaagttgtgctcatgggattaattgagggatacagagttgggggaggaccccttggggaggggttggaccctctgtaccctgggggttccttcgacccattggggctggccgacgacccggaggcattcgcggagctgaaggtgaaggagttaaagaacgggcgtctggccatgttctccatgttcggcttcttcgtgcaggcaatcgtgaccggcaagggccctatcgaaaatctcttcgatcacttggcggatccggttgccaacaacgcctgggcctatgctaccaatttcgttcccggcaagtgaagtaaatgacggaaaataaaagacggctgaaatatgtgtatcataatgcatttgatgcactgttgacggcctctcctgtgaataatccgtttttcttttgacgagatgttatttcgtcttgctttttgtgtttagttttttttgtttcggtgaaatcacaagtaatacggataggggtgcagtaatcatgaataaaatttatatcgttagaatgtgtgcaataattatgaaataaaatggatattgttagactcttgtaatccaaattatgtaccaagagaaagagacataacgtaaggaaatggtcgaaatgttgtaatgtaaggatatggtcgaaatgtaacggtgttggatgaggttgggctcttttggctcaaaaaatgttgtaatctttttcacaaattatgtaaaagtccaacaaaagaacacatttccaaattatgtaatgttcaaggacagaatagatggatatggttgaaatgtggcccaccttgagcagaccatagcaatatttgacgtccaact

SEQ ID NO: 4470 - DNA, 1027 bp, Picea glauca
aaaagctcatcactcatattacctgaccttggtctgagcatttttctcatcgtcacgttcaccatggcagcagcctcagccatccaaagctcaagcttggcaggccagaccctcctaaggccgcatcagaatgagctcgtcaagaaggtgggcgcgtcgcaagctcgaatcaccatgcgtagaaccgtcaggagcgcccctgagagcatttggtatggacctgaccgccccaagtacctgggccccttctcggaacagacgccgtcgtacctcaccggagaatttcccggcgactacgggtgggacaccgccgggctctctgccgacccggagaccttcgccaaaaacagagagctggaggtgatccactgcagatgggccatgttgggggcgctcggctgcgttttcccggagctgttggccaaaaccggggtgaaatttggggaagccgtgtggttcaaggccggggcgcagatattctcggagggaggcctcgactacctggggaaccccaatctgatccacgcacagagcatactcgccatctgggcctcccaggttgtgctcatgggcttgattgaaggatacagagttggaggaggaccccttggggaggggttggaccctctgtaccctggaggggccttcgatccactggggctggccgatgacccagaagcgttcgcggagctgaaggtgaaggagataaagaacgggcggctggccatgttctccatgttcggcttcttcgtgcaggcaatcgtgaccggtaagggccctattgaaaatctcttcgaccacttggcggaccccactgccaacaatgcctgggcctacgccaccaatttcgttcccggcaaatgaagtgaagtgtcggaaaataaaagaggcctgtaatctctgtatcatacatttgacggcctttcctgttaataatcagcgtttctttcaacgaaaaaaaaaaaaaaatactctgtcgttagaactaaccactgtcttctagagactcgaccgaaggccaacacgg

SEQ ID NO: 4471 - DNA, 886 bp, Zostera marina
tcgggtaagaacacagcaaaaaactattcgttctcttccattttgaagctcaaggaatggccacctctgcgattcatcaatctgtctttgttggtcagacaaccttgaagcaacaaaatgaacttgtccgcaaagttggagtcttcgagagtcgcatatctatgcgccgcacagtgaagagcactcccgacagcgtttggtacggcgcagaccgtcccaagtacttgggtccattctctgagcaaactccatcatacctaactggtgaattcccaggtgactacggttgggacacagccggtctatcagcggacccagagaccttcgcaaagaaccgtgaacttgaggtgatccattgcagatgggccatgttgggcgccttaggttgtgtcttccaggagcttctatcaaagaacggagttaaattaggtgaaagcgtttggttcaaagctggatctcaaatcttctcagatggtgggcttgactacttaggcaatcctaacttggtccatgctcaaagcatcttggccatatgggcttgccaagttgttttgatgggctttatcgaaggataccgcgttggtggaggtccacttggagatggtcttgacccactttacccaggaggctcattcgacccattgggcttagctgatgacccagaggccttcaccgaattgaaggtcaaagaggttaagaacggacggttggctatgttctcgatgttcggatatttcgtccaagctattgtgaccggtaaaggtccaattgagaacctatacgaccaccttgccgacccagtcgccaacaatgcttgggcctttgctacaaacttctcccccgaaaaactaaatataacaatctccatatataatttgcatgtaaa

SEQ ID NO: 4472 - DNA, 1176 bp, Vaccinium corymbosum
tcactctctcacacatttaagggaacaacagcaagcaacaaaaagaagccttccctgaatccatggccacctctgcaatccaacagtcggcctttttaggcagccgggcggcttcgaagcggcgtgtcaaaaaggtcagcggcttcactgccggccgcatcatgatgcgaaggaccgtaaaagtgttccccaaagcatatggtatggaccggaccgcccaagtacttggcccattctcggagcaaaccccatcttacttgactggagaattcccaggtgactacgggtgggacactgctgggctttcagccgatccagaaacatttgccaagaaccgcgaacttgaagtgatccacagccgttgggccatgctcggtgcattgggctgtgtcttccccgaaatcctcgcaaaaaacggtgttaagttcggagagtccgtttggttcaaggccggagcccaaattttctccgaaggtgggcttgactaccttggcaaccctaacctaatccacgcccagagcatccttgcgatctgggcctgccaagtggtgctcatgggcttcgtcgaggggtaccgggttggcggaggcccacttggggaaggtctcgataagatctaccctggaggggcctttgacccacttgggctcgccgatgacccagaagcctttgcggagttgaaggtgaaagagctcaagaatggacggctcgcgatgttttcgatgtttgggttctttgtccaggccattgttactggaaagggcccaattgaaaacctcttcgaccaccttgctgatccagtggccaacaatgcttgggcttatgccactaacttcgtacccggaaagtgaaaagagtaaagtgtgagatgggcctggcccaatttgagctgtaaaaatttctaatgcttctttatgtgttcttgaagttctctgcttgtggatttgattgcctctgatgtattatcattgccagcagaaactgcttattgtgagactacttctatgtttttatctgtgttcagctcctttttctaatgtattaataccgaacataactgtgtctagaacagtctgatagacaggtgcccacaggcatcgaatgattctggacgtagttgtttccggagttgtgcgcgtagacttttcgatttatggaacatagtatggaatttga

SEQ ID NO: 4473 - DNA, 1118 bp, Cephalotaxus harringtonia
aactctgtactattcaatacaattctgtgtgtgttacctacaggctgcaatggcggttgcctttcaagtgacaagcttcttcgcaaggcagccattattccagggagacagtgggttcgccagacagctagcggttcaagtcggcagcttcgagtctcgcattaacatgcgtagaaccgtcaagagcctcccgcagagtttgtggtatggagcagaccgccccaagtatcttggccccttctctgagcaaacaccctcatacctgaccggcgagttcccaggtgactacggttgggacacagctgggctatccgctgacccagaaaccttcgccaaaaatagagagctcgaagtcattcattgccgctgggccatgctcggcgccttgggctgcgtcttccctgaaatcttagccaaaaacggggtcaaattcggcgaagccgtctggttcaaagcaggatcccaaatatttagcgaaggcggcctcgactatttgggaaatcctaatctcattcacgcccagagcatattggccatttgggcatgtcaggtagttttgatggggttgatcgagggttacagagtgggaggcggaccccttggtgaggggttggatccagtttatcccggcggggcgtttgatccgttggggttggcagacgaccctgaggcctttgcagagctcaaggtgaaggagattaagaatgggagattggctatgttttctatgttcgggttttttgtgcaggccatcgtgacaggaaaggggcctattgaaaacttgtttgatcatttggcagatccttctactaacaatgcctgggcttatgctaccaatttcgttcctggcaagtgatttactcatggttaagccagatcaaataaatttgtgggaaatattgtatcatagtatgttaaaatttgcatgttaataaaggatttgggttgtatgatgttacaatgccttttttcttttctcttttttgcagctatggaaaaaaacatccattctgaactaaaggatattctgcaaaatgaaaatatgttgtcaacttaaaggatatttcacaaaccatcaccatgtgaatgtaatttaataaattatgcttgtcaatttt

SEQ ID NO: 4474 - DNA, 1241 bp, Epimedium sagittatum
caggtggaagaagagatggaggaggcgttggtggtgatcaagcaccttcagccttcaatactgtactgttacaaagctaagaagcctttgggggtatcatggcagcctctggattccaatactccgcactctctggtaggtctcttgtgacctccaagaatgagttcactcgcaagatcgggggcttcagaagcaaaattgtcatgcgccgcacagtcaagagtactccacaaagcatctggtacggagaagaccgccccaagtacttgggcccattctccgagcagactccatcctacttgaccggtgaattcccaggtgactacgggtgggacactgcagggttgtcagctgatcccgagacgttcgccaagaaccgtgagctcgaagtgatccactgccgatgggccatgcttggtgccctcggctgtgtcttccctgagattctttccaagaacggagtcaagtttggtgaggcagtgtggttcaaggccggagctcagattttctcagaaggtggacttgactaccttggcaacccaaaccttgtccatgctcagagcattcttgcgatctgggcttcacaggttgttcttatgggtttgatcgaagggtacagagttggcggagggccactcggtgagggactagattccctttacccaggtggtgcattcgacccactcggattggctgatgatccagaggcctttgctgaactaaaggtgaaggagatcaagaatggacgccttgctatgacctctatgttcgggttcttcgttcaagccattgtcactggaaagggaccaattgagaacctattcgaccacattgctgatccaactgtcaacaatgcatgggcttatgccacaaactttgtccccggaaagtgaaaatgatcacatattgtatcttgtcgtttgtgaataagattctgtatgcttcttggtttattttgcaagtccttcctaattcagtttcatcaatgcaaagcggcttattaaaaaaaaaaaaaaaaaaaaaaaaacaagcgccgccggcctcgcatagacaagcgagtgaaccaagagcggacgcgtaccggaccgggtaacgggtccgggaaggcctacgtttcgttcctttaggtacctaaaagggaaacctaaaagggaactacgtaaggtaacgttacgggttaaggtccgttcggcctaccgtccaacttcgtacgttttcgggtttttacggttacggtagta

SEQ ID NO: 4475 - DNA, 999 bp, Papaver somniferum
tgaaaacaaagaataggaagaacaacaaagaagcactaaataataatggccacatctgcaattcaacaatctgcaattgctggtcaaacagctttgaagcagcagaatgagttcatctgcaaggttgggaacattgatggcggtcgcatctacatgcgccgtaccgtgaaaagtattcaacaaagcatgtggtatggtcctgacagacccaagtacttgggcccattctcagagcaaaccccatcgtacctcactggtgaattcccgggtgactatggttgggacacagctgggttatcagctgacccagaaacatttgctaagaaccgcgagctcgaagtgatccactgcagatgggccatgttgggtgccctaggttgtgtcttccctgaggttctctcaaagaacggtatcaacttcggcgaggcagtatggtttaaagctggatcgcagatcttttctgagggtggtttggactaccttggaaaccctaacttagtacatgcccaaagcatccttgcaatctgggctactcaagttgtgctaatggggtttgttgagggatacagagttggtggtggtccacttggagaaggattagacaagctttaccccggtggatcatttgaccctctaggattagctgatgacccagagtccttttctgaattgaaggtaaaggagatcaagaatggaagacttgctatgttctccatgtttgggtattttgttcaggctattgttacaggaaagggtcctatagaaaacctttatgaccatgttgccgatcctgttgcaaacaacgcatgggcttatgctacaaactttgttcccggaaaatgaatgtagcgttttctaggtgtatcattacttcaggattgttatgtttgctgtagttccttggctgtacattgtaattttctctagtagctagaatctatatataactacttttcgtgttactcagttggtatctgttttatgaatactaggagagcc

SEQ ID NO: 4476 - DNA, 963 bp, Zostera marina
aaggaatggccacctctgcgattcatcaatctgtccttgtggcagacaaccttgaagcacaaaatgaacttgtccgcaaagttggagtcttgagagtcgcatatctatgcgccgcacagtgaagagcactcccgacagcgtttggtacggcgcagaccgtcccaagtacttgggtccattctctgagcaaactccatcatacctaactggtgaattcccaggtgactacggttgggacacagccggtctatcagcggacccagagaccttcgcaaagaaccgtgaacttgaggtgatccattgcagatggggcccatgttgggcgccttaggttgtgtctttccagagcttctattcaaagaacggagttaaattcggtgaagccgtttggttcaaaagctggatctcaaatcttctcagatggtgggcttgactacttaggcaatcctaacttggtccatgctcaaagcatcttggccatatgggcttgccaagttgttttgatgggctttatcgaaggataccgcgttggtggaggtccacttggagatggtcttgacccacttttacccaggaggctcattcgacccattgggcttagctgatgacccagaggccttcaccgaattgaaggtcaaagaggttaagaacggacggttggctatgttctcgatgttcggatatttcgtccaagctattgtgaccggtaaaggtccaattgagaacctatacgaccaccttgccgacccagtcgccaacaatgcttgggcctttgctacaaacttcctcccccgcaaactaaatataacaatctccatatataatttgcatgttaaactttttgttctttgattctttggattctagtaattttacgaaaatttttaaacccaaactaaactttaaatatacaatgtgagtgagtaatttgaaaacaattgttagtttgttgtttagaaaatt

SEQ ID NO: 4477 - DNA, 1091 bp, Cycas rumphii
  misc_feature (1033)..(1033): n is a, c, g, or t
aggctccgccctcttctgtacacacattcttctcttgtcattgtatttctgattcaaatcgttgtggaagatcgagatggcaaccgtaacgtcggcctcggccatccagagctcgactcttgcagggcagacgctgctgaagccccagaatgagctgctcaagaaggtcggaacgtccgagggtcgaatcaccatgcggagaaccgtcaagactgctcctcagagcatatggtacggaccggaccggcccaagtacttgggtcccttctcagagcagactccctcgtatttaaccggagagttcccgggcgactatgggtgggacaccgcagggttatctgcggacccggaaaccttcgctaaaaatagagagctggaagtaattcattcgagatgggcgatgctgggtgcattggggtgcgtattcccggagattttggcgaggaatggggttaaatttggggaggcggtgtggttcaaggcgggggcacagatattctcggagggaggtctggactacctggggaacccaaatctggttcatgcgcagagcatattggccatctgggcggtccaagtggtgctgatgggatttgtggaggggtacagaattggaggaggacccctgggggaggggttggatccgctttatccaggtggcgcttttgatccattgggtctggccgatgaccctgaagcgtttgctgagcttaaagtgaaggagctgaagaatgggagattggccatgttctccatgttcggattctatgtccaagcgattgtaacgggcaaaggacccattgaaaatctgttcgaccatttggcggatcccaccgccaacaatgcctgggcttatgccactaatttcgtccctggcaaatgaacccactcttctcttcttctcatttgttcgacctcattttgtggatatacagaatatgtacactgcttcctgcttcccaatgcatcgtatcatgtctgtttcccttttattaaaataaataaataacaaaagcccttatttagtgttcanatccgagagagaggttctcacatacaaatggagagacccatgatggatgatgtactca

SEQ ID NO: 4478 - DNA, 799 bp, Flaveria ramosissima
acggcggccgcttcaccatgcgccgaaccgtcaagagtgcaccacaaagcatatggtatgggccggataggcctaagtacttgggcccgttctcagaacaaaccccatcatacctaaccggagaattccctggtgattatgggtgggacacagcgggattatcagctgatcccgagacatttgccaagaaccgtgagcttgaagtgatccactctcggtgggccatgctcggcgcactcgggtgcgtgttccctgagattcttgcaaagaacggtgtcaaattcggtgaagcagtctggttcaaggcgggctcccagatattctcagaaggtgggcttgactacctcgggaaccccaacttgatccatgctcagagcatcttagctatctgggcttgtcaggttgttctcatgggcctcattgaagggtaccgtgttggtggaggcccattgggtgaagggctcgacaagatttacccaggtgggtcttttgacccacttggtttggctgatgatccggatgcttttgctgaattgaaggttaaggagcttaagaacggacgattggctatgttttcgatgttcggattcttcgttcaggccatcgttaccggaaaaggcccgatcgagaacttgttcgatcatgtcagcgatccggtggctaacaacgcttgggcttatgccaccaactttgttcctggaaaatgagtttgattagtgtaattttgatgatgattattaagtaatatcacacgtttccggctaatttgttatttaatctttcaatattttaaagtcgc

SEQ ID NO: 4479 - DNA, 817 bp, Flaveria ramosissima
agaagaccggtagcttcaatggcggccgcttcaccatgcgccgaaccgtcaagagcgcaccacaaagcatttggtatgggccggacaggcccaagtacttgggcccgttctcggagcaaaccccatcatacctaaccggagaatttcctggtgattatgggtgggacacagctggattatctgctgatcccgagacatttgccaagaaccgtgagcttgaagtgatccactctcggtgggccatgctcggcgcactcgggtgcgtgttccccgagattcttgcaaagaacggtgtcaaattcggtgaagcggtctggttcaaggcgggctcccagatattctcagaaggtgggcttgactacctcgggaacccaaacttgatccatgctcagagcatcttagctatctgggcttgtcaggttgttcttatgggcctcattgaagggtaccgcgttggtggaggcccattgggtgaagggctcgacaagatttacccaggtgggtcttttgacccgcttggtttggctgatgacccggatgcatttgctgagttgaaggttaaggagcttaagaacggacgattggctatgttttcgatgttcgggttcttcgttcaggccatcgttactggaaaaggcccgatcgagaacttgtttgatcatgtcagcgatccggtggctaacaacgcttgggcttatgccaccaactttgttcctggaaaatgagtttgattagtgtaaatttgatgatgattatgaagtaatatcacaagtttccggctaattttgttatttaatgtttcaatactttatagtcg

SEQ ID NO: 4480 - DNA, 1208 bp, Silene vulgaris
ctgatccacaacatatcccttaattccatttataagcaaacataatttttctgcaataattataacttacaagcacaaacatacagagtaatacttgcaggaaggaaagaaaggcatggccacctctaccatccaacaatcagcatttgctgggcagaccatcttaaagccacagaacgagctcgttcgcaaggtcggtggaaatggtggtcgtgtctccatgcgccgcactattaagagtgctcccgaaagcatctggtatggtccagaccgtcccaagtacttaggccccttctcagagcaaaccccatcataccttacaggtgaattccccggtgattacggttgggacactgctggactctcagctgacccagaaacattcgctaagaaccgtgagctagaggtgatccactgcagatgggcaatgcttggtgcccttggatgcgttttccccgagctcctggctaagaacggagtcaaatttggagaggcagtttggttcaaggcagggtctcagatattccaagagggtggtcttgactaccttggcaacccaaacctggtccatgctcagagcattctagccatctgggcttgccaagttgtcctcatgggcgctgtcgaagggtaccgtgttggtggcggcccactgggcgaagggcttgaccagctttaccctggtggagctttcgacccactagggctcgcggaggacccagaggcctttgctgagttgaaggtcaaggagataaaaaatggaagattggctatgttctccatgtttggtttctttgttcaggccattgttaccggcaagggacccgttgagaatctctacgaccatcttgccgatcctgtggctaacaatgcttgggcttatgccactaactttgtcctttcttcaaccaaattgtcataacattaattagacagataactttcaccaaacgctttcaccggttcaccccacctcagtttgatttaacacctgaatgaagcggattacgcgaacgaggcacatgcaggcaacttgcggcaaccagagaatgataatgaaggagaagcaactacaactacccttaaggaacagcagaatctctccctcgtgagagcttatcttgaatctcgtgatccgtcatctaaggttttccctttcaaccacatcattgcattatctttcgtcctcatattgcattattttcctg

SEQ ID NO: 4481 - DNA, 1039 bp, Eutrema halophilum
aatctcgatagtgacacagccgttcacaaatttcttgttcaaaatgacaaacgagacaagagcctcaaagctgatgagaatttctttgatcaagcaataactttgaaccaacagactcaaacagtttcatgcattacatgtttaaagagataagatatacataaatttttcaaatcaaattctattttccagggacgaagttggtggcgtaagaccaggcattgttagccacagggtccgcaagatgatcgaagagattctcgatcggacctttaccagtaacaatggcttgaacaaagaatccaaacatagagaacattgcaagacgaccgttcttgagctccttcactttcaattccgaaaacgcctctggatcctccgctaagttcaatgggtcaaacgctccaccggggtaaagtgggtcaagcccttcaccaagaggcccacctccgattctgtacccttcaattaagcccatcaacacaacttgagaagcccatatggctaagatgctttgcgcgtggatcaagttagggtttccgaggtaatcaagtcctccttcggagaagatctgagatcctgccttgaaccacacggcttcaccgaacttgactccgtttttggagagaatctctgggaaggtgcagcctaaagcgcctagcattgcccatctactgtggatcacttcgagctcacggttctttgcaaacgtttctgggtcggcggatagaccggcggtgtcccaaccgtagtctccggggtattctccggttaggtacgacggtgtgttttctgagaatggtcctaagtacttgggacggtctggtccgatggaaccaaatgctctgaggagtagacttgacggtacggcgcatgacgacgcggccaccgccgttggaagctccaactttgcggaggagatcgttggagggcttgagggccgtttggccggcgaatgaagagtgttggattgctgacgtggccattctttgaatctgagatgatgtgatgttggtgttatgcagatgaaatgggtttt

SEQ ID NO: 4482 - DNA, 1258 bp, Abies balsamea
gataacgcatactacctgaccttggtctgagcatttttctcatcgtcgcgttcatcatggcaacagcctcagccatccacagctcaagcttggcaggccagaccctcctcaggccgcagcagaatgaactcgttagcaaggtgggctcgtcgcaggctcgaatcactatgcgaagaaccgtcaggagcgcccctgagagcatttggtatggacctgaccgccccaagttcctgggccccttctcggaacagacgccgtcgtatctcaccggagaatttccgggcgactacgggtgggacaccgctgggctctcggccgacccggagaccttcgccaaaaatagagaactggaggtgatccactgcagatgggccatgttgggggcgctaggctgcgttttcccggagctgttggccaaaagcggggtcaaatttggggaagccgtgtggttcaaggccggtgcgcagatattctcggagggaggactcgactacctaggaaaccccaacctgatccacgcgcagagcattctggccgtctgggcgtcccaggttgtgctcatgggattgattgaggggtacagagttggtggaggaccgcttggagaggggttggaccctctgtacccaggaggggccttcgacccactgggactggccgacgaccccgaggccttcgctgagctgaaggtgaaggagataaagaacgggcgattggccatgttctcaatgttcggcttcttcgtgcaggcaatcgtcaccggtaaggggccaatcgaaaatctcttcgaccacttggcggaccctactgccaacaatgcgtgggcatatgccaccaatttcgttcccggcaagtgaagtgaagtgacggaaaataaaagacggctgtgatctgtatatcatacatttgacggcctttctgtcaataaaagaacttcttgcttggtcttggttcttggtccttgtctttgtgtctagctttttgttaagctcttgtaactgtttttttctagtttgtggttgttatttttctaccttgttacctacccttgcccaatgccaatagggttgttaggaacgaccaattggggagtgtcaatggtctaaaagaataggctattaggcattggatcaaattctcgaaggtatgaaaagtacgcctttgaaagtacaaaggtgaaaccaagaaatctaagtgtgttgtatagaaatgaaatggaatacgatggaaaaatgagaaataaatatgtattcttctt

SEQ ID NO: 4483 - DNA, 929 bp, Brassica juncea
ctcctctttcgccggacaaacggctttgaagccctccaacgatctcctccgcaaagtaggagcttccaacggtggtggtcgcgttgtcatgcgccgtaccgtcaagtctactcctcagagcatctggtacggaccagaccgtcccaagtacttaggaccattctcagagaacacaccatcttacctaaccggagaataccccggagactatggttgggacaccgccggtctctccgccgatccagaaaccttcgcaaagaaccgtgagcttgaagtaatccacagcagatgggcaatgctaggcgctttaggctgcaccttcccagagattctctccaaaaacggagtcaaattcggtgaagccgtgtggtttaaggcaggttctcagatcttctcagaaggagggcttgattacctcggaaaccctaacttgatccacgcgcaaagcattttagctatttgggcttctcaagttgtgttgatgggattgattgaagggtacagaatcggaggtggacctcttggtgaaggacttgacccgctttacccgggtggagcttttgacccgttgaacttagccgaggatccagaggcgttttcggagttgaaagtgaaggagctcaagaacggtcgtcttgcaatgttctcgatgtttggattctttgtgcaagccattgtgactggtaaaggtccaatcgagaatctgttcgatcatcttgcggaccctgtggctaacaatgcatgggcttacgccaccaacttcgttcccggaaaatagaatttgatcgttttatgtattttttttctttatatagtaatgcatggaatttaagtatgttggtctgatgttcttgaaaaaaaatcttgttagctttctgaggctcttgtcttgtgtcatttgatccataaacttgtaaacgctcatagat

SEQ ID NO: 4484 - DNA, 884 bp, Papaver somniferum
acagagaagccctaattaccatggccacatctgcaatccaacgctcctcaattgctggtcaaactgctctgaagcagcagaatgagctcatacgcaaggtcggaaacattgacggtggtcgcatctccatgcgtcgtaccgtgaaaaacattcaacaaagcatgtggtatggtcctgacagacctaagtacttaggcccattctcagagcaaaccccatcatacctcactggtgaattccccggtgactatggttgggacacagccgggttatcagctgacccagaaacatttgctaagaaccgtgagcttgaagtgatccactgcagatgggccatgttgggtgccctaggttgtgtcttccctgaggttctctcaaagaacggtatcaactttggtgaggcggtatggttcaaagccgggtcacagatcttctctgagggaggtttggactacctcggaaaccctaacttggtacatgcccaaagcatccttgcaatctgggctactcaagttgttctaatggggtttgttgagggatacagagttggtggtggtccacttggagaaggacaagacaaactttaccctggtggatcttttgaccctctagggttagctgatgacccagagtccttttctgagttgaaggtaaaggagatcaagaatggaagacttgctatgttctccatgtttgggtattttgttcaagctattgttacaggaaagggtccaattgaaaacctttatgaccatgttgccgatcctgttgcaaacaatgcatgggcttatgctactaaacttttctcctgggaaaatgaatgttatacttctggggtgtataaggcttgctaagtcttctgtagttgtgtgtatatggtaatt

SEQ ID NO: 4485 - DNA, 1270 bp, Picea glauca
cggtcaccttggtctgagcatttttctcatcgtcacgttcaccatggcagcagcctcagccatccagagctcgagcttggcaggccagaccctcctgaggccgcagcataatgagctcgttaggaaggtgggcatgtcgcaggcccgaatcaccatgcgaagaaccgtaaggagcgcccctgagagcatttggtatggacctgaccgccccaagtacctgggccccttctcggaacagacgccgtcgtacctcaccggagaatttcccggcgactacgggtgggacaccgccgggctctctgccgacccggagaccttcgcgaaaaacagagagctggaggtgatccactgcagatgggccatgttgggggcgctcggctgcgttttcccggagctgttggccaaaaccggagtcaagtttggggaagcagtgtggttcaaagccggggcgcagatattctcggagggaggcctcgactacctggggaaccccaatctgatccacgcacagagcatactcgccatctgggcctcccaggttgtgctcatgggcttgattgaaggatacagagttgggggaggaccccttggggagggttggaccctctgtaccctggaggggccttcgatccactggggctggccgatgacccagaagcgttcgcggagctgaaggtgaaggagataaagaacgggcggctggccatgttctccatgttcggcttcttcgtgcaggcaatcgtgaccggtaagggccccatcgaaaatctctacgaccacttggcagaccccactgccaacaatgcctgggcctacgccaccaatttcgttcccggcaagtgaagggaagtgacggaaaataaaaaaaggctgtaatctgtgtgtcatacatttgacggccttcgtgtcaataaacgattttctttcaaatagatggtctgtgtgtagttttttcgttaagctccggtaaaggttttttctggtttgtgattgttattttccactacaaacattgtaaaatgccacggccaaagggttgcaacgaaccaacttatcactagttagtaaaataactagcacagccaactcgctgttggtgaacgccgaaaggcttatggctggtaaaactccccgtttattccatgaaacccgcttaattttataggctgggctatagtcatcagctcgaaatttctgttcgcctttacaaatcattcggatttcatattatgtcaggcgttgtattcaattgctgtgcagatgaataatg

SEQ ID NO: 4486 - DNA, 910 bp, Flaveria ramosissima
caacaatctatcatcaattcactttccccttactcaaatggcgacctctgcaatccaacagtcagcattcgccggctccgcggcgttgaagccacaaacgagctcgtcaagaagaccggtagcttcaatggcggccgcttcaccatgcgccgaactgtcaagagtgcaccacaaagcatatggtatgggccggacaggcccaagtacttgggcccattctcggagcaaaccccatcatacctaaccggagaatttcctggtgattatgggtgggacacagctggattatctgctgatcccgagacatttgccaagaaccgtgagcttgaagtgatccactctcggtgggccatgctcggcgcactcgggtgcgtgttccccgagattcttgcaaagaacggtgtcaaattcggtgaagcggtctggttcaaggcgggctcccagatattctcagaaggtgggcttgactacctcgggaacccaaacttgatccatgctcagagcatcttagctatctgggcttgtcaggttgttcttatgggcctcattgaagggtaccgcgttggtggaggcccattgggtgaagggctcgacaagatttacccaggtgggtcttttgacccgcttggtttggctgatgacccggatgcatttgctgagttgaaggttaaggagcttaagaacggacgattggctatgttttcgatgttcgggttcttcgttcaggccatcgttactggaaaaggcccgatcgagaacttgtttgatcatgtcagcgatccggtggctaacaacgcttgggcttatgccaccaactttgttcctggaaaatgagtttgattagtgtaaatttgatgatgattatgaagtaatatcacaagtttccggctaattttgttatttaatgttt

SEQ ID NO: 4487 - DNA, 967 bp, Pinus pinaster
aacaaaggctcatcactcgtactacctgacactaggtctgagcatttttctcattctcatgttaaacatggcaacagcctcagccatacaaagctcaagcttggccggccagaccctgctgaggccgcagcagaatgagttcgtcaagaaagtgggcgcgtcgcaggctcgaatcaccatgcgtagaaccgtaaggagcgcccctgagagcatttggtatggacctgaccgccccaagtacctcggccccttctcggaacagacgccgtcatatcttaccggagaatttcccggagactacgggtgggacaccgccgggctctcggccgaccccgagaccttcgccaaaaatagagagctggaggtgatccactgcagatgggccatgttgggggcgctcggctgcgttttcccggagctgttggccaaaaacggggtgaaatttggggaagccgtgtggttcaaggccggggcgcagatattctcagagggaggcctcgactacctggggaaccctaacctgattcacgcacagagcatactcgccatctgggcctgccaggttgtgctcatgggattgattgaaggatacagagtgggaggaggaccccttggggaggggttggaccctctgtacccagggggtgccttcgacccactggggctggccgatgacccggaggcgttcgcggagctgaaggtgaaggagattaagaacgggcggctggcgatgttctccatgttcggcttcttcgtgcaggcaattgtgactgggaagggcccaattgaaaatctgtacgaccacttggcggaccccactgccaacaatgcctgggcctacgccaccaatttcgttcccggcaaataagttaaagtgacggaaaataaaggaggcctggaatctctgtatcaatatttgacggttttccttttaataatccaattcacattaaactagacgtggctt

SEQ ID NO: 4488 - DNA, 1220 bp, Papaver somniferum
gccaatagagagctgctgacatggaaatttcctcatccacgctatctcccccttcttctacttaatacctttctagtctttctctttaattcagcaattcatactctaaaattcgaaaaaaaggaacaggtagagtaacagagaagccctaaataacatggctacatctgcaatccaacgctccgcaattgctggtcaaactgctttgaagcagcagaatgagctcatccgcagggtcggaaacattgacggtggtcgcatctccatgcgtcgtaccgtgaaaagcattcaacaaagcatgtggtatggtcctgatagacctaagtacttaggcccattctcggagaaaaccccatcatacctcactggtgaattccctggtgactatggttgggacacagccgggttatcagctgacccagaaacatttgctaagaaccgtgagctcgaagtgatccactgcagatggggcatgttgggtgccctaggttgtctcttccctgagattctctcaaagaacggtatcaactttggtgaggcggtatggttcaaagccgggtcacagatcttctccgagggaggtttggactaccttggaaaccgcaacttggtacatgcccaaagcatccttgcaatctgggctactcaagttgttctaatggggtttgttgagggatacagagttggtggtggtccacttggagaaggactagacaaactttaccccggtggatcttttgaccctctagggttagctgatgacccagagtccttttctgaattgaaggtaaaggagatcaagaatggaagacttgctatgttctccatgtttgggtattttgttcaggctattgttacaggaaagggtccaattgaaaacctttatgaccatgttgccgatcctgttgcaaacaatgcatgggcttatgctactaacttttctcctggaaaatgaatgttatactttctggggtgtataaggcttgctaagtcttctgtagttgtgtgtatatggtaatttgtatttgtaactaaaattgatctattcttattttgttcttaattaagttgcacattcgtgtttataaaacttgcacgaaaaatcaaatattttgtttttattgctttgccatagttggccatgcaaatattcttagaaagtactcgtgtttattgttacaatcctacaacaaaattctgaaaattaagttttaaaaaaa

SEQ ID NO: 4489 - DNA, 959 bp, Papaver somniferum
taaagaagaaacaaaaaaaatacatggccaccactgcaatccaaaggtctgcattcgctggtcaaactgctttgaagcagcaaaatgagttcattcgcaaagttggcaatgtcgaaggtggtcgtatctccatgcgccgtaccgtaaaaagcatccaatcaagcatgtggttcggaccagacagacccaagtatttgggaccattctcagaacaaaccccatcttacctcactggtgaattcccaggtgactatggttgggacacagccgggttatctgctgatccagagacattcgctaagaaccgtgaactcgaagtgatccactgcagatgggctatgttgggtgccttaggttgcgtcttccctgaagttctttcaaagaacggtatcaatttcggagaagctgtatggttcaaagctggctcacagatcttctctgaaggtggtttggactaccttggaaaccctaacttggtacatgcccaaagcatccttgcaatctgggctactcaagttgtgctaatggggtttgttgaaggatacagagtcggtggtggtccacttggagaaggactagacaaactttaccctggtggatcttttgaccctctaggattagctgatgatccagagtccttttctgaattaaaggtaaaggaaatcaagaatggaagacttgctatgttctctatgtttgggtatttcgttcaggctattgttactggaaagggtccaattgaaaacctttacgaccacatcgccgatcctgttgcaaacaatgcatgggcttacgctactaactttgctcctggaaaatgaatgtaatctttcttgggtgtatcattgtttcaggcttgttatgtcttctgtagttctttgggtgtgcattgtttgaatattagcagttaccgaatctttagtgttttgcataagatacaacacttgttatatgcaaat

SEQ ID NO: 4490 - DNA, 910 bp, Papaver somniferum
ggtagagcaacagagaagccctaataaccatggctacatctgcaatccaacgctccgcagttgctggtcaaactgctctgaagcagcagaatgagctcatacgcaaggtcggaaacattgacagtggtcgcatctccatgcatcgtaccgtgaaaagcattcaacaaagcatgtggtacggtcctgatagacctaagtacttaggcccattctcagagcaaaccccatcatacctcactggtgaattccccggtgactacggttgggacacagccgggttatcagctgacccagaaacatttgctaagaaccgtgagcttgaagtgatccactgcagatgggccatgttgggtgccctaggttgtgtcttccctgaggttctcttaaagaatggtatcaactttggtgaggcggtatggttcaaagccgggtcacagatcttctctgagggaggtttggactaccttggaaaccctaacttggtacatgcccaaagcatccttgcaatctgggctactcaagttgttctaatggggtttgttgagggatacagagttggtggtggtccacttggagaaggactggacaaactttaccccggtggatcttttgaccctctagggatagctgatgacccagagtccttttctgagttgaaggtaaaggagatcaagaatggaagacttgctatgttctccatgtttgggtattttgttcaagctattgttacaggaaagggtccaattgaaaacctttatgaccatgttgctgatcctgttgcaaacaatgcatgggcttatgctactaactttgctcctggaaaatgaatgttatactttctggggtgtacaagttttaaggcttgctaagtcttctgtagttccttgtgtgtatatggtaatttttgctt

SEQ ID NO: 4491 - DNA, 976 bp, Picea glauca
cgagaacaaaagctcatcactcatattaactgaccttggtctgagcatttttctcatcgtcacgttcaccatggcaacagcctcagccatccaaagctcaagcttggcaggccagaccctcctaaggccgcatcagaatgagctcgtcaagaaggtgggcgcgtcgcaagctcgaatcaccatgcgtagaaccgtcaggagcgcccctgagagcatttggtatggacctgaccgccccaagtacctgggccccttctcggaacagacgccgtcgtacctcaccggagaatttcccggcgactacgggtgggacaccgctgggctctctgccgacccggagaccttcgccaaaaacagagagctggaggtgatccactgcagatgggccatgttgggggcgctcggctgcgttttcccggagctgttggccaaaaccggggtgaaatttggggaagccgtgtggttcaaggccggggcgcagatattctcggagggaggcctcgactacctggggaaccccaatctgatccacgcacagagcatactcgccatctgggcctcccaggttgtgctcatgggcttgattgaaggatacagagttggaggaggaccccttggggaggggttggaccctctgtaccctggaggggccttcgatccactggggctggccgatgacccagaagcgttcgcggagctgaaggtgaaggagataaagaacgggcggctggccatgttctccatgttcggcttcttcgtgcaggcaatcgtgaccggtaagggccctattgaaaatctcttcgaccacttggcggaccccactgccaacaatgcctgggcctacgccaccaatttcgttcccggcaaatgaagtgaagtgtcggaaaataaaagaggcctgtaatctctgtatcatacatttgacggcctttcctgttaataatcagcgtttctttcaacaaaaaaaaaaaaaaaa

SEQ ID NO: 4492 - DNA, 984 bp, Picea glauca
aaaagctcatcactcatattacctgaccttggtctgagcatttttctcatcgtcacgttcaccatggcaacagcctcagccatccaaagctcaagcttggcaggccagaccctcctaaggccgcatcagaatgagctcgtcaagaaggtgggcgcgtcgcaagctcgaatcaccatgcgtagaaccgtcaggagcgcccctgagagcatttggtatggacctgaccgccccaagtacctgggccccttctcggaacagacgccgtcgtacctcaccggagaatttcccggcgactacgggtgggacaccgccgggctctctgccgacccggagaccttcgcgaaaaacagagagctggaggtgatccacagcagatgggccatgttgggggcgctcggctgcgttttcccggagctgttggccaaaaccggagtcaagtttggggaagcagtgtggttcaaggccggggcgcagatattctcggagggaggcctcgactacctggggaaccccaatctgatccacgcacagagcatactcgccatctgggcctcccaggttgtgctcatgggcttgattgaaggatacagagttggaggaggaccccttggggaggggttggaccctctgtaccctggaggggccttcgatccactggggctggccgatgacccagaagcgttcgcggagctgaaggtgaaggagataaagaacgggcggctggccatgttctccatgttcggcttcttcgtgcaggcaatcgtgaccggtaagggccctattgaaaatctctacgaccacttggcggaccccactgccaacaatgcctgggcctacgccaccaatttcgttcccggcaaatgaagtgaagtgtcggaaaataaaagaggcctgtaatctctgtatcatacatttgacggcctttcctgttaataatcagcgtttctttcaacgagatgttacttggtcttgcttttttgtgtt

SEQ ID NO: 4493 - DNA, 951 bp, Picea glauca
aaaagctcatcactcatattacctgaccttggtctgagcatttttctcatcgtcacgttcaccatggcagcagcctcagccatccaaagctcaagcttggcaggccagaccctcctaaggccgcatcagaatgagctcgtcaagaaggtgggcgcgtcgcaagctcgaatcaccatgcgtagaaccgtcaggagcgcccctgagagcatttggtatggacctgaccgccccaagtacctgggccccttctcggaacagacgccgtcgtacctcaccggagaatttcccggcgactacgggtgggacaccgctgggctctctgccgacccggagaccttcgccaaaaacagagagctggaggtgatccactgcagatgggccatgttgggggcgctcggctgcgttttcccggagctgttggccaaaaccggggtgaaatttggggaagccgtgtggttcaaggccggggcgcagatattctcggagggaggcctcgactacctggggaaccccaatttgatccacgcacagagcatactcgccatctgggcctcccaggttgtgctcatgggcttgattgaaggatacagagttggaggaggaccccttggggaggggttggaccctctgtaccctggaggggccttcgatccactggggctggccgatgacccagaagcgttcgcggagctgaaggtgaaggagataaagaacgggcggctggccatgttctccatgttcggcttcttcgtgcaggcaatcgtgaccggtaagggccctattgaaaattttttcgaccacttggcggaccccactgccaacaatgcctgggcctacgccaccaatttcgttcccggcaaatgaagtgaagtgtcggaaaataaaagaggcctgtaatctctgtatcatacatttgacggcctttcctgttaataatcagcgtttctttca

SEQ ID NO: 4494 - DNA, 951 bp, Zostera marina
aagctcaaggaatggccacctctgcgattcatcaatctgtctttgttggtcagacaaccttgaagcaacaaaatgaacttgtccgcaaagttggagtcttcgagagtcgcatatctatgcgccgcacagtgaagagcactcccgacagcgtttggtacggcgcagaccgtcccaagtacttgggtccattctctgagcaaactccatcatacctaactggtgaattcccaggtgactacggttgggacacagccggtctatcagcggaccccagagaccttcgcaaagaaccgtgaacttgaggtgatccattgcagatgggccatgttgggcgccttaggttgtgtcttccagagcttctatcaaagaacggagttaattcggtgaagccgtttggttcaaagctggatctcaaatcttctcagatggtgggcttgactacttaggcaatcctaacttggtccatgctcaaagcatcttggccatatgggggcttgccaagttgttttgatgggctttatcgaaggataccgcgttggtggaggtccacttggagatggtcttgacccacttttacccaggaggctcattcgacccattgggcttagctgatgacccagaggccttcaccgaattgaaggtcaaagaggttaagaacggacggttggctaatgttctcgatgttcggatatttcgtccaagctattgtgaccggtaaaggtccaattgagaacctatacgaccaccttgccgacccagtcgccaacaatgcttgggcctttgctacaacttctcccccgaaaacctaaatataacaatctccatatataatttgcatgtaaacttgttgttgttgatctttggattctcgaatttcgaaagtttaaccaaactaacctaaatatcaatgtagagtgagattgtaacaatgtgtttgttgtttgtaaattg

SEQ ID NO: 4495 - DNA, 932 bp, Zostera marina
attttgaagctcaaggaatggccacctctgcgattcatcaatctgtctttgttggtcagacaaccttgaagcaacaaaatgaacttgtccgcaaagttggagtcttcgagagtcgcatatctatgcgccgcacagtgaagagcactcccgacagcgtttggacggcgcagaccgtcccaagtacttgggtccattctctgagcaaactccatcatacctaactggtgaattcccaggtgactacggttgggacacagccggtctaccagcggacccagagaccttcgcaaagaaccgtgaacttgaggtgatccattgcagatgggccatgttggggcgccttaggttgtgtcttttccagagcttctatcaaagaacggcgttaaattcggtgaagccgtttggttcaaagctggatctcaaatcttctcagatggtgggcttgactacttaggcaatcctaacttggtccatgctcaaagcatcttggccatatgggcttgccaagttgttttgatgggctttatcgaaggataccgcgttggtggaggtccacttggagatggtcttgacccactttacccaggaggctcattcgacccattgggcttagctgatgacccagaggccttcaccgaattgaaggtcaaaagaggttaagaacggacggttggctatgttctcgatgttcggatatttcgtccaagctattgtgaccggtaaaggtccaaattgagaacctatacgaccaccttgccgacccagtcgccaacaatgcttgggcctttgctcaaaacttatccccccgcaaactaaatataacaatctccatatataatttgcatgtaaactttgtttgtttgtttgatcttttggattctcgaattttcgaaaagttttaaccaaaacaacttaaatatcaatgtgagtga

SEQ ID NO: 4496 - DNA, 875 bp, Zostera marina
ctattcgttctcttccattttgaagctcaaggaatggccacctctgcgattcatcaatctgtctttgttggtcagacaaccttgaagcaacaaaatgaacttgtccgcaaagttggagtcttcgagagtcgcatatctatgcgccgcacagtgaagagcactcccgacagcgtttggacggcgcagaccgtccaagtacttgggtccattctctgagcaaactccatcatacctaactggtgaattcccaggtgactacggttgggacacagccggtctatcagcggacccagagaccttcgcaaagaaccgtgaacttgaggtgatccattgcagatgggccatgttggcgccttaggttgtgtctttccagagcttctatcaaagaacggagttaaattcggtagaagccgtttggttcaagctggatctcaaatcttctcagatggtgggcttgactacttaggcaatcctaacttggtccatgctcaaagcatcttggccatatgggcttgccaagttgttttgatgggctttatcgaaggataccgcgttggtggaggtccacttggagatggtcttgacccactttacccaggaggctcattcgacccattgggcttagctgatgacccagaggccttcaccgaattgaaggtcaaagaggttaagaacggacggttggctatgttctcgatgttcggatatttcgtccaagctattgtgaccggtaaaggtccaattgagaacctatacgaccaccttgccgacccagtcgccaacaatgcttgggcctttgctacaaacttctccccgcaaactaaatataacaatctccatatataatttgcatgtaaactttgtttgtttgtttg

SEQ ID NO: 4497 - DNA, 909 bp, Linum usitatissimum
acaggtccaatgagcgtaccagaaaggttgcttctctcgctggcagccgcttcaacatgcgccgtactgtcaagagtgctccccaaagcatctggtacggagcagaccgtcccaagtacttgggtccattctcggagcagactccatcatacctgacaggagagttcccaggtgactacggatgggacactgctggtctatcagcagacccagagacattcgccaagaaccgtgagcttgaggttatccactgcaggtgggctatgcttggtgcgcttggttgtgtcttccccgaaatcctttccaagaatggggtcaagttcggtgaggcagtctggttcaaggctggagctcagatcttctccgagggaggtctggattacctaggaaacccgaacctggtccacgctcagagcatccttgcaatctgggcttgccaggttgtgctcatgggattcgttgaaggttacagagttggtggaggacctctcggagaagggcttgacccactttaccctggtggctccttcgacccacttggcttggcagatgatcctgaggcctttgctgagttgaaggtcaaggagatcaagaatggccgcctcgctatgttctccatgtttggcttcttcgtccaagccattgttaccggcaaaggtcccgttgagaacctttatgaccacattgctgaccctgtagccaacaatgcttgggctttcgcccccaactttgtccccggcaaatgagcgcaccaccccttctatctttgtaatggcttccctaagagatagagttctgttactactttctggaagtctttttgtaatcatttgaacttgaacaaatccatggaatggaactttcctttttcacgcaattgtgtcgggtgcaaactccattaaatgctta

SEQ ID NO: 4498 - DNA, 968 bp, Sequoia sempervirens
acaactctctaattgtctgtgttacaatggctgccgcatttcagctgtcaagcttagggagcttcgcagggcagcccctttgccaaccaaagagtgaattcgccaggcaaattggcatctcagttggcaatttcgagtctcgcgttaacatgcgtagaaccgttaagaccgccccgcagagtctctggtatggaccagatcgccccaagtacttgggccccttctcagaacaaacaccttcatatctaactggggagttcccaggcgattatggttgggacactgcaggcctatccgcagacccagaaacatttgctaaaaatagagagttggaagtcatccattgtcgttgggctatgctaggcgccttgggttgtgtcttccctgaaattttatctaaaaatggggtcaaatttggagaagcagtgtggttcaaagcaggatcccaaatatttagtgaaggtggccttgactatttgggcaaccccaatctcatccatgcacaaagcatattagccatttgggcatcccaggtagtgttgatgggtttgattgagggatatagagttggtggtggaccactcggtgaggggttggatcctctttatcctggtggtgcatttgatccattggggttggcagatgatcccgaggcctttgcagagcttaaggtaaaggagattaagaatgggaggttggctatgttttctatgtttgggttttttgtgcaggctattgtgacaggaaaggggccaattgagaacttgtatgatcatttggcagatccttctactaataatgcttgggcttatgctaccaattttgttcctggcaaatgatttactcaatcaaacttaaaaatggtttttgggaacattgtatcataatatatgtatttatatattatgttaataaaggtttgaattgaatgttatattatcacttattttcaatatttttaatataag

SEQ ID NO: 4499 - DNA, 764 bp, Flaveria ramosissima
accggtagctcatggcggcgctcaccatgcgccgaaccgtcaagagcgcaccacaaagcatttcggtatggcggacaggcccaagtacttgggcccgttctcggagcaaaccccatcatacctaaccggagaattccctggtgatttatgggtggggacacagctggattatcagctgatcccgagacattttgccaagaaccgggagcttgaaagtgatccactctcggtgggccatgcttggtgcactcgggtgcgtgttcccccgagattcttgcaaagaacggtgtcaaattcggtgaagcagtctggttcaaggcgggctcccagatattctcagaaggtgggcttgactacctcgggaacccgaacttgatccatgctcagagcatcttagctatctgggcttgtcaggttgttcttatgggccttattgaagggtaccgtgttggtggaggcccattgggtgaagggcttgacaagatttatccaggtgggtcttttgacccgcttggtttggctgatgacccggatgcttttgctgagttgaaggttaaggagcttaagaacggacgattggctatgttttcaatgttcgggttcttcgttcaggccatcgttactggaaaaggccgatcgagaacttgtttgatcatgtcagcgatccggtgctaacaacgcttgggcttatgccaccaactttgttcctggaaatgagtttgattagtgtaatttgatgatgattagtgaagtaatatctacaa

SEQ ID NO: 4500 - DNA, 808 bp, Flaveria ramosissima
tcaatggcgggcgcttcaccatgcgccgcaccgttaaaagcgcaccacaaagcatttggtatggaccggaccgccccaagtacttgggcccattctctgagcaaaccccgtcatacctaactggtgaattccctggtgactatggttgggacactgctggattgtcagctgaccccgagacatttgccaagaaccgtgagctcgaggtgatccactctaggtgggccatgcttggcgcactcgggtgcgtgttccctgagattcttgaaaagaacggtgtcaaattcggtgaagcggtctggttcaaggcggttcccaatttttctcagaaggcgggcttgactacctagggaacccaaacttgatccatgcccagagcattttagctatctgggcttctcaagttgttctcatgggcctcattgaaggatatcgggttggaggtggcccacttggtgaagggcttgacaagatttacccaggagggtcatttgacccacttggattggctgatgacccagatgcatttgcggagttgaaggttaaggagcttaagaacggacgattggctatgttttccatgtttgggttttcgttcaagccattgtaaccggaaagggcccgatcgagaacttgtttgaccatcttagtgacccggtggctaacaacgcatgggcatacgctaccaactttgtgcccggaaaatgagttgtatacctgtaaaccaaaataatggttatgcaataatattacaagcttgtgttttgtcaagatatatttatgaatgtatgtatgtatacatatacct

SEQ ID NO: 4501 - DNA, 1568 bp, Quercus alba
gcacaaatttatcactcaaggatgcatttctcagtttcgttactagtacaacaaaaggataaagagaaaagagaaattttagtaaaattgatgaaagatccaccaccataaagctcacatgctctagaaaccacataactgctaaaacatcacattaaaaaaaaacatgtaaatagcttctcagttggtaagatccatgatggcagtaactatgtctccatctgcagccttcaatgccttcacagcctttgacctagtgactcctgcctgtgtcatcaccaactctatgtccttgggttccactccagtctcatctacttcttcatcatcttgagccacagccgaagtctcaggtttggaaatcacattgctgagatcaggagccttaaactgctctgcagcctgagtctgtagttgagagctcaaatcctcgatctttgcctccccaaagattacatacgtgtctgaagttggactcttgaaaacatcgggttttgagatgacaaacaatatattcttgctctttttgacagtgactcggctaacacccgggataggtttcatcaagaatcttgttgtagtaaatcatggcaagctccaccattcaacgatcagcattcgccggccagaccgctttgaagcagtccaatgagcttgtccgtaaggttgggagctttgccggtggccgcgttaccatgaggcgaacagtgaagagtgctccacaaagcatatggtatggcccagaccgcccaaagtacttgggaccattctctgagcagactccctcataccttactggtgaattccctggtgactatggctgggacactgctggattatccgcagaccctgagacatttgctaggaaccgtgagctggaggtaatccacagccgatgggccatgcttggagctttgggctgtgtgttccctgaagtcctttcaaagaatggtgtcaagtttggtgaagcagtttggttcaaggctggtgcacagattttctctgaaggtggtcttgattatcttggcaacccaaacctcattcatgcacaaagcatcttggcaatctgggctgttcaagttgtgcttatgggcttcattgaaggatacagagttggtggaggacccacttggactggctgatgatcctgaagcattcgcagaattgaaggtgaaggaactaaagaatgggaggttggcaatgttctccatgtttggtttctttgttcaggctattgttactggaaagggtccaattgagaacctgtttgaccatgttgctgacccagtcgccaacaatgcatgggcctacgccactaactttgtccctggaaaatgaagaaacttaaatagttctactagtaactttactcatcaatcttcatgcttgtgttcaacttctctcttgctgtgttcatctatattgtatcgatgctaccacaaactgcttttcttcaaactatatattattgtatcacttctaaagtacaagacatttggtcttttgtgcttgaacttacattaatgttggtagatatgtgtgttataatttgaatattctctatctca

SEQ ID NO: 4502 - DNA, 1309 bp, Picea glauca
ttaattaaattaatcccccccccccccgagaacaaaagctcatcactcatattacctgaccttggtctgagcatttttctcatcgtcacgttcaccatggcaacagcctcagccatccaaagctcaagcttggcaggccagaccctcctaaggccgcatcagaatgagctcgtcaagaaggtgggcgcgtcgcaagctcgaatcaccatgcgtagaaccgtcaggagcgcccctgagagcatttggtatggacctgaccgccccaagtacctgggccccttctcggaacagacgccgtcgtacctcaccggagaatttcccggcgactacgggtgggacaccgccgggctctctgccgacccggagaccttcgcgaaaaacagagagctggaggtgatccacagcagatgggccatgttgggggcgctcggctgcgttttcccggagctgttggccaaaaccggagtcaagtttggggaagcagtgtggttcaaggccggggcgcagatattctcagagggaggcctcgactacctggggaaccccaatctgatccacgcacagagcatactcgccatctgggcctcccaggttgtgctcatgggcttgattgaaggatacagagttgggggaggaccccttggggagggttggaccctctgtaccctggaggggccttcgatccactggggctggccgatgacccagaagcgttcgcggagctgaaggtgaaggagataaagaacgggcggctggccatgttctccatgttcggcttcttcgtgcaggcaatcgtgaccggtaagggccccatcgaaaatctctacgaccacttggcagaccccactgccaacaatgcctgggcctacgccaccaatttcgttcccggcaagtgaagggaagtgacggaaaataaaaaaaggcctgtaatctgtgtgtcatacatttgacggccttcgtgtcaataaacgattttctttcaaatagatggtctgtgtgtagttttttcgttaagctccggtaaaggttttttctggtttgtgattgttattttccactacaaacattgtaaaatgccacggccaaagggttgcaacgaaccaacttatcactagttagtaaaataactagcacagccaactcgctgttggtgaacgccgaaaggcttatggctggtaaaactccccgtttattccatgaaacccgcttaattttataggctgggctatagtcatcagctcgaaatttctgttcgcctttacaaatcattcggatttcatattatgtcaggcgttgtattcaattgctg

SEQ ID NO: 4503 - DNA, 1355 bp, Picea glauca
cttggtctgagcatttttctcatcgtcacgttcaccatggcatcagcctcagccatccagagctcgagcttggcaggccagaccctcctgaggccgcagcataatgagctcgttaggaaggtgggcatgtcgcaggcccgaatcaccatgcgaagaaccgtaaggagcgctcctgagagcatttggtatggacctgaccgccccaagtacctgggccccttctcggaacagacaccgtcgtatctcactggagaatttcccggcgactacgggtgggacaccgccgggctctcggccgaccctgagaccttcgcgaaaaacagagagctggaggtgatccactgcagatgggccatgttgggggcgctcggatgcgttttcccggagctgttggccaaaaacggggtcaaatttggggaagcagtgtggttcaaggccggggcgcagatattctcggagggaggcctcgactacctggggaaccccaactgatccacgcacagagtatactcgccatctgggcctcccaggtcgtgctcatgggattgattgaaggatacagagttgggggagacccctcggggaggggttggaccctctatacccagggggggccttcgacccactggggctggcagacgacccggagtcgttcgcggagctgaaggtgaaggagataaagaacgggcggctggctatgttctccatgttcggcttcttcgtgcaggcaatcgtgaccggtaagggccccatcgaaaatctctacgaccacttggcagaccccactgccaacaatgcctgggcctacgccaccaatttcgttcccggcaagtgaagggaagtgacagaaaataaaaaaaaggctgtcatctgtgtatcatacatttgacggccttcgtgtcaataaacgattttctttcaactagatggtctgtgtgtgtagctttttcgttaagctcttgtaaaggtttttttctggtttgtgattgttattttgctacctccccttttccactacaaacattgtaaaatgccacggccaaagggttgcaacgaaccaacttatcactagttagtaaaataactagcacagccaactcgctgttggtgaacatcgaaaggcttatggcgggtaaaactctccgcttattcaatgaaacctgcttaatcttataggctgggctttagtcatcagctcgaaattcctgttagcttttacaaatcattcgaatttcatactcggtcaggcgttgtattcaattgctgtgtagattaataatgattgaagaataatctatttagtgtaaacttggcacaaatttaaaaagttaatagtgaagtaaatttgtaatttc

SEQ ID NO: 4504 - DNA, 809 bp, Flaveria ramosissima
ccggcgtccgcggcgtgtaagacgcaaacgagcgtcgtcaacgaagaccggagctcatgcggcgctcacactgcgccgaaccgtcaagagcgcacacaagactattggtatgggccggacgactacgccaacgtacttgggcccgttctcggaggaaccccatcatactaaccggagaatccccggtgattatgggtgggacacagctggattgtctgctgatcccgaggcatttgccaagaaccgtgagcttgaagtgatccactctcggtgggccatgctcggcgcactcgggtgcgtgttccccgagattcttgcaaagaacggtgtcaaatttggtgaagcagtctggtttagggcgggctcccaaatattctcagaaggtgggcttgactacctcgggaacccgaacttgatccatgctcagagcatcttagctatctgggcttgtcaggttgttcttatgggcctcattgaagggtaccgcgttggtggaggcccattgggtgaagggcttgacaagatttatccaggtgggtctttttgacccgcttggtttggctgatgacccggatgcatttgctgagttgaaggttaaggagcttaagaacggacgattggctatgttttcgatgttcgggttcttcgttcaggccatcgttactggaaaaggcccgatcgagaacttgtttgatcatgtcagcgatccggtcgctaacaacgcttgggcttatgccaccaactttgttcctggaaatgagtttgattagtgtaaatttgatgatgattatgaagtaatatcacaagtt

SEQ ID NO: 4505 - DNA, 901 bp, Ambrosia trifida
cctagcgagggggccacgtatcacgacacgagtacgcggggatcaacacacaccttcaactatctattcacagccccactggcacctctgcaatccaacagtcagcattcgccggccaggctgtgttgaagccacaaaatgaggttgtcaggaagaccggcaccttcaatggtggccgctacaccatgcgccgaaccgtcaaaagcgcaccacaaagcatttggtacggacctgaccgtcccaagtacttgggcccattctctgagcaaaccccatcatacctaactggtgaattccctggtgactacgggtgggacaccgctggattatccgctgaccccgagacattcgccaagaaccgtgagctcgaggtgatccactctaggtgggccatgctcggcgcactcgggtgcgtgttccccgaggttctttcaaagaacggtgtcaaattcggtgaagccgtctggttcaaggccggttcccaaattttctccgaaggcgggctcgactacctagggaacccaaacttgatccatgcccaaagcatcttagccatctgggcttctcaagttgtgctaatgggcctcattgaaggataccgtgttggtggcggcccactcggtgaagggcttgacaaaatctacccaggtgggtcttttgacccacttgggttggctgatgacccagacgcgtttgctgagttgaaggttaaggagcttaagaacggtcggttggctatgttttcgatgtttgggttctttgttcaggccattgtaacaggaaagggcccaattgaaaacttgtttgaccatcttagtgacccagtagctaacaatgcatgggcctatgctaccaactttgttcctggaaaataagttgaatgattgtaattttataatgg

SEQ ID NO: 4506 - DNA, 1024 bp, Quercus alba
ctctgctcgctgctctgctgattcatgataactcgacggatcgcacggccagaccgctttgaagcagtccaatgagcttgtccgtaaggttgggagctttgccggtggccgcgttaccatgaggcgaacagtgaagagtgctccacaaagcatatggtatggcccagaccgcccaaagtacttgggaccattctctgagcagactccctcataccttactggtgaattccctggtgactatggctgggacactgctggattatccgcagaccctgagacatttgctaggaaccgtgagctggaggtaatccacagccgatgggccatgcttggagctttgggctgtgtgttccctgaagtcctttcaaagaatggtgtcaagtttggtgaagcagtttggttcaaggctggtgcacagattttctctgaaggtggtcttgattatcttggcaacccaaacctcattcatgcacaaagcatcttggcaatctgggctgttcaagttgtgcttatgggcttcattgaaggatacagagttggtggaggaccactcggtgaaggacttgaccccatttaccctggtggcgcctttgacccacttggactggctgatgatcctgaagcattcgcagaattgaaggtgaaggaactaaagaatgggaggttggcaatgttctccatgtttggtttctttgttcaggctattgttactggaaagggtccaattgagaacctgtttgaccatgttgctgacccagtcgccaacaatgcatgggcctacgccactaactttgtccctggaaaatgaagaaacttaaatgttctactgtaactttactcatcaatcttcttgcttgtgttcaacttctctcttgctgtgttcatctatattgtatcgatgctaccacaaactgcttttcttcaaactatatattattgtatcacttctaaagtacaagacatttggtcttttgtgcttgaacttacattaatgttggtagatatgtgtgttataatttgaata

SEQ ID NO: 4507 - DNA, 965 bp, Selaginella moellendorffii
caaacgctcagcctccatcgccctcgctgtgcttgctctattcttcgtcttcctttcttcgtcttaaccttagatatggcggcgtcggcttcggcgatcagcagctcctccttctccggccagactgcgctcaagagccccaatgagctctccaggaaggtcggaaatctgggagaggcacgcaccgtgatgaggcgaaccagggccagcactcccgatagcatttggtatggtccagaccgaccaaagttcctcggccccttctccgagcagacaccctcctacctcaccggcgagtttcctggcgactacggctgggataccgcgggtctctcggccgaccccgagacgttcgccaaaaaccgggagctcgaagtcatccactcccgctgggccatgctcggagctctcggctgcgtcacccccgagcttctcgccaagaacggcatcaagtttggcgaggctgtgtggttcaaggccggctcgcagatcttcaaggaaggtggcctcgactacctgggaaatcccaacctcgtccacgcacagagcatccttgccatctgggccagccaagttatcctcatgggagccgtcgaaggctacagagttggaggtggaccgctcggcgagggactggacaagatctaccccggaggtgcgtttgatccgctcggactcgctgacgacccggatactttcgctgagctcaaggtgaaggagttgaagaacggcagactggcgatgttctccatgtttggtttcttcactcaggccattgttacaggcaagggacccatcgagaacttgctcgaccaccttgacaaccccaccgtcaacaatgcctgggcgtatgcaaccaacttcactcccggatcttagacgcttcaatttgcaaagaaaaaaaagaaaaagatgttgttccgagatcactgtaaaccagaataaaacatgcttacttcttgtca

SEQ ID NO: 4508 - DNA, 1020 bp, Zostera marina
cataccctccgtcgttggcttcggtcgagtacgtctcagacagggtagtgtaacgacgagtagcggaggaacacagcaaaaaaaaactattcgttctcttccattttgaagcttaaggaatggccacctctgcgattcatcaatctgtctttgttggtcagacaaccttgaagcaacaaaatgaacttgtccgcaaagttggagtcttcgagagtcgcatatctatgcgccgcacagtgaagagcactcccgacagcgtttggtacggcgcagaccgtcccaagtacttgggtccattctctgagcaaactccatcatacctaactggtgaattcccaggtgactacggttgggacacagccggtctatcagcagacccagagaccttcgcaaagaaccgtgaacttgaggtgatccattgcagatgggccatgttgggcgccttaggttgtgtctttccagagcttctatcaaagaacggagttaaattcggtgaagccgtttggttcaaagctggatctcaaatcttctcagatggtgggcttgactacttaggcaatcctaacttggtccatgctcaaagcatcttggccatatgggcttgccaagttgttttgatgggctttatcgaaggataccgcgttggtggaggtccacttggagatggtcttgacccactttacccaggaggctcattcgacccattgggcttagctgatgacccagaggccttcaccgaattgaaggtcaaagaggttaagaacggacggttggctatgttctcgatgttcggatatttcgtccaagctattgtgaccggtaaaggtccaattgagaacctatacgaccaccttgccgacccagtcgccaacaatgcttgggcctttgctacaaacttctccccgcaaactaaatataacaatctccatatataatttgcatgtaaactttgtttgtttgtttgattcttttggattctcgtaattttcgaaaagttttaaccaaactaacttaaatata

SEQ ID NO: 4509 - DNA, 937 bp, Zostera marina
gaacacagcaaaagaaaaactattcgttctcttccattttgaagcttaaggaatggccacctctgcgattcatcaatctgtctttgttggtcagacaaccttgaagcaacaaaatgaacttgtccgcaaagttggagtcttcgagagtcgcatatctatgcgccgcacagtgaagagcactcccgacagcgtttggtacggcgcagaccgtcccaagtacttgggtccattctctgagcaaactccatcatacctaactggtgaattcccaggtgactacggttgggacacagccggtctatcagcggacccagagaccttcgcaaagaaccgtgaacttgaggtgatccattgcagatgggccatgttgggcgccttaggttgtgtctttccagagcttctatcaaagaacggagttaaattcggtgaagccgtttggttcaaagctggatctcaaatcttctcagatggtgggcttgactacttaggcaatcctaacttggtccatgctcaaagcatcttggccatatgggcttgccaagttgttttgatgggctttatcgaaggataccgcgttggtggaggtccacttggagatggtcttgacccactttacccaggaggctcattcgacccattgggcttagctgatgacccagaggccttcaccgaattgaaggtcaaagaggttaagaacggacggttggctatgttctcgatgttcggatatttcgtccaagctattgtgaccggtaaaggtccaattgagaacctatacgaccaccttgccgacccagtcgccaacaatgcttgggcctttgctacaaacttctccccgcaaactaaatataacaatctccatatataatttgcatgtaaactttgtttgtttgtttgatcttttggattctcgaattttcgaaaagttttaaccaaa

SEQ ID NO: 4510 - DNA, 988 bp, Zostera marina
ccccccctctccttaccttcccgttcggttcggttcggtccgttcggtcgtacgtactacgaagaagacgtagtaggtacgtacaacgacgaaggacggtaacggaacgggaaacgaacaacaacaaactaaaaaacctattcgttctcttccattttgaagcttaaggaatggccacctctgcgattcatcaatctgtctttgttggtcagacaaccttgaagcaacaaaatgaacttgtccgcaaagttggagtcttcgagagtcgcatatctatgcgccgcacagtgaagagcactcccgacagcgtttggtacggcgcagaccgtcccaagtacttgggtccattctctgagcaaactccatcatacctaactggtgaattcccaggtgactacggttgggacacagccggtctatcagcagacccagagaccttcgcaaagaaccgtgaacttgaggtgatccattgcagatgggccatgttgggcgccttaggttgtgtctttccagagcttctatcaaagaacggagttaaattcggtgaagccgtttggttcaaagctggatctcaaatcttctcagatggtgggcttgactacttaggcaatcctaacttggtccatgctcaaagcatcttggccatatgggcttgccaagttgttttgatgggctttatcgaaggataccgcgttggtggaggtccacttggagatggtcttgacccactttacccaggaggctcattcgacccattgggcttagctgatgacccagaggccttcaccgaattgaaggtcaaagaggttaagaacggacggttggctatgttctcgatgttcggatatttcgtccaagctattgtgaccggtaaaggtccaattgagaacctatacgaccaccttgccgacccagtcgccaacaatgcttgggcctttgctacaaacttctccccgaaaactaaatataacaatctccatatataatt

SEQ ID NO: 4511 - DNA, 800 bp, Centaurea maculosa
  misc_feature (744)..(744): n is a, c, g, or t
gggtaagagaaagcagagcaagcaacttagaggcagcattaacaaagaagagtcatgacagcctctgcaatccaacagtctgcatttgctggccagaccgccttgaagcaaccaaatgatcttgtccggaaggttggttcctttggtggtggtcgtgttaccatgcgcaggactgtgaaaagtgctccccaaagcatatggtatggtccagaccgcccaaagttcttgggtccattctctgagcaaaccccatcatacctgaccggtgaattccctggtgattatggatgggacactgctggtttgtctgcagatcctgagacatttgccaagaacagtgagcttgaggtgatccacagcagatgggccatgcttggtgcacttggatgtgtctttcctgaaattcttgcaaagaatggtgtcaagttcggtgagtcagtttggttcaaggctggagctcaaatcttctcagagggtggccttgattaccttggcaaccccaacctcatccatgctcagagcatcctcgccatctgggcttcccaggttgtgcttatgggattcgttgaagggtacagagtgggtggagggccacttggcgaaggacttgaccccctttatcctggcggtgcctttgacccacttggcctcgctgatgatcctgatgcatttgcagagttgaaggtgaaggaactcaagaacggccgcctcgcaatgttctcaatgtttggattcttcgttcangccattgtcactggaaagggtcctgttgagaaccttttggatcaccttgccgatcc

SEQ ID NO: 4512 - DNA, 1026 bp, Papaver somniferum
agagcaacagagaagccctaaataacatggctacatctgcaatccaacgctccgcaattgctggtcaaactgctttgaagcagcagaatgagctcatccgcaaggtcggaaacattgacggtggtcgcatctccatgcgccgtaccgtgaaaagcattcaacaaagcatgtggtatggtcctgatagacctaagtacttgggcccattcttggagcaaaccccatcatacctcactagtgaattccctggtgactgtggttgggacacagccgggttatcatctgacccagaaacatttgctaagaaccgtgagctcgaagtgatccactgcagatgggccatgttgggtgccctaggttgtgtcttccctgaggttctctcaaagaatggtatcaactttggtgaggcggtatggttcaaagccgggtcacagatcttctctgaaggaggtttggactaccttggaaaccctaactgggtacatgcccaaagcgtccttgcaatctgggctactcaagttgttctaatggggtttgttgagggatacagagttggtggtggtccacttggagaaggactagacaaactttaccccggtggatcttttgaccctctagggttagctgatgacccagagtccttttctgaattgaaggtaaaggagatcaagaatggaagacttgctatgttctccatgtttgggtattttgttcaggctattgttacaggaaaaggtccaattgaaaacctttatgaccatgttgccgatcctgttgcaaacaatgcatgggcttatgctactaactttgctcctgggaaatgaatgttatactttctggggtgtataagttttaaggcttgctaagtcttctgtagttccttgtgtgtataactgtatatggtaatttttgcttgtaactaaaattgatctattcttgttttctcttaactaagttgcgtattcgtgtttataaaacttgcaataaaaatcaaatcttttgtttttattgcttcgccaaaaaaaa

SEQ ID NO: 4513 - DNA, 770 bp, Senecio madagascariensis
gaaatggcaagctcgtcaatccaacagtcggcattcgccggtcagtcagcagtgaagccgcaaaatgagctcctcaggaagattggtggctttaatggcggccgcttcaccatgcgccgtactgtcaaaagtgcaccacaaagcatttggtacggagcagaccgccccaagtacttgggcccgttctcagagcaaactccatcatacctgaccggtgaattccctggtgactacgggtgggacaccgcggggttatctgctgacccagagacatttgccaagaaccgggaacttgaagtgatccactctcggtgggccatgcttggtgcactcgggtgcgtgttccccgagcttctttcaaagaatggtgtcaaatttggcgaagccgtttggttcaaggcaggttcacagattttttcagaaggtgggctcgactacctagggaacccgaacttggaccatgctcagagcattttagccatctgggcttcacaggttgtcctcatggggctcattgaagggtaccgtgttggtggggggccacttggtgaagggctagacagtatttacccaggtgggtcttttgacccacttggattggctgatgacccagaagcatttgccgagttgaaggttaaggagcttaagaacggtcgattagcgatgtttttcatgtttggggtctttgttcaagccattgtaccgggaaaggccccaattgaaaacttgtttgaccatgtaagtgatccggtagcaaacaatgcatgggc

SEQ ID NO: 4514 - DNA, 949 bp, Picea glauca
ctcatcggtcaccttggtctgagcatttttctcatcgtcacgttcaccatggcagcagcctcagccatccagagctcgagcttggcaggccagaccctcctgaggccgcagcataatgagctcgttaggaaggtgggcatgtcgcaggcccgaatcaccatgcgaagaaccgtaaggagcgcccctgagagcatttggtatggacctgaccgccccaagtacctgggccccttctcggaacagacgccgtcgtacctcaccggagaatttcccggcgactacgggtgggacaccgccgggctctctgccgacccggagaccttcgcgaaaaacagagagctggaggtgatccactgcagatgggccatgttgggggcgctcggctgcgttttcccggagctgttggccaaaaccggagtcaagtttggggaagcagtgtggttcaaagccggggcgcagatattctcggagggaggcctcgactacctggggaaccccaatctgatccacgcacagagcatactcgccatctgggcctcccaggttgtgctcatgggcttgattgaaggatacagagttggggaggaccccttgggagggttggaccctctgtaccctggaggggccttcgatccactggggctggccgatgacccagaagcgttcgcggagctgaaggtgaaggagataaagaacgggcggctggccatgttctccatgttcggcttcttcgtgcaggcaatcgtgaccggtaagggccccatcgaaaatctctacgaccacttggcagaccccactgccaacaatgcctgggcctacgccaccaatttcgttcccggcaaatgaagtgaagtgtcggaaaataaaagaggcctgtaatctctgtatcatacatttgacggcctttcctgttaataatcagcgtttctttcaacgagatgttacttgg

SEQ ID NO: 4515 - DNA, 935 bp, Sequoia sempervirens
tctctaattgtctgtgttacaatggctgccgcgtttcagctgtcaagcttagggagcttcgcagggcagcccctttgccaaccaaagagtgaattcgccaggcaaattggcatctcagttggcaatttcgagtctcgcgttaacatgcgtagaaccattaagaccgctccacagagtctctggtatggaccagatcgccccaagtacttgggccccttctcagaacaaacaccttcatatctaactggggagttcccaggtgattatggttgggacactgcaggcctatccgcagacccagaaacatttgctaaaaatagagagttggaagtcatacattgtcgttgggctatgctaggcgccttgggttgtgtcttccctgaaattttatctaaaaatggggtcaaatttggagaagcagtgtggttcaaagcaggatcccaaatatttagtgaaggtggccttgactatttgggcaaccccaatctcatccatgcacaaagcatattagccatttgggcatcccaggtagtgttgatgggtttgattgagggatatagagttggtggtggaccactcggtgaggggttggatcctctttatcctggtggtgcatttgatccattggggttggcagatgatcccgaggcctttgcagagcttaaggtaaaggagattaagaatgggaggttggctatgttttctatgtttgggtttttgtgcaggctattgtgacaggaaaggggccaattgagaacttgtatgatcatttggcagatccttctactaataatgcttgggcttatgctaccaattttgttcctggcaaatgatttactcaatcaaactttaaaatggtttttgggaacattgtatcataatatatgtatttatatattatgttaataaaggtttgaattgaatgttatattatc

SEQ ID NO: 4516 - DNA, 1535 bp, Mimulus guttatus
cttattcctcaccaccatcgagcacaacaaacaaaatcaattagcaacaaaaagaaaaaaaaaaacaaaaaaaaaaaaaggcaacttcagcaattcaacaatctgcattcagtgggaagactgctttgaagccacaaaatgagctgatcaggaagatcggcaacgtcggcggcggccgcttcaccatgagacgtaccgtcaagagcgcccctcagagcatatggtacggagaagacaggcccaagtacttgggcccattctccgagcagaccccatcgtacctcaccggtgaattccccggtgactacggatgggacactgctgggctctcggcagatcccgagacattcgccaagaaccgtgagctggaggtgatccacagtaggtgggccatgctcggcgctctgggatgcgtcttcccagaggttctatcaaagaacggtgtcaaatttggagaggcagtgtggttcaaggccgggtcacagatcttctccgaaggtgggctcgactatttgggaaaccctaacctcgtccacgcacagagcattttggccatatgggccacccaagttgtgctaatgggctttgttgagggttacagagttggagggggcccactaggagaggggctcgacaaggtgtacccgggcgggtcttttgacccgttgggtctagccgaggacccggaagcctttgctgagttgaaggttaaggaactcaagaacgggagattggctatgttttccatgtttgggttctttgtccaagcgattgtcaccggaaagggtccgattgagaacctttttgaccatcttgccgaccccgttgcaaacaatgcttgggccttcgccactaactttgtgcccggaaaatgagagtgaacacaagatttgcttttgatgaagttgtaaagtgtgggatttaatttgcttttgatgtaatagtggaatggttggactttcaatttaatgtatatttggcatcttttttccttacatcttgttgcacggtttattctatgctacaccgggtagatctttagcatttataagcacacaaacacacacacacatctatattggtgtgtgtagatcaacggtaaaaaatcacccgaaccttcatcaggtgtagcatagaaataacccttgctacactagatggaactgcattctttttgcatgccatactatagtaggaaactaaatctttaagggataaccaacttcaaatggaacgagtgaaaccgatttgtaggaaggccaaccgagtgaagctcttttttatggccgtgcggtgaagtgaaattgtattgtatgttagttagagaggttgacgaactactacgatctatagattccccatctatatccaatcccaacgagaatagaagccgggtcgcttccggaacttggcagacttgtgcttcaaatccagaaacactttcttatagattgcattctcaatctcatatgtactcatgtttacaaggttacatttgatttaagcatgaatgttggattagcatttaagatttc

SEQ ID NO: 4517 - DNA, 923 bp, Picea glauca
tcagccatccaaatctcaagcttggcaggacagaccctcctgaggccgcagcagaatgagctcgtcagtaaggtgggcgcgtcgcaggctcgaatcaccatgcgaagaaccgtcaggagcgcccctgagagcatttggtatggacctgaccgccccaagtacctgggccccttctcggaacagacgccgtcgtatctcaccggcgaatttcccggcgactacgggtgggacaccgccgggctctctgccgaccctgagaccttcgccaaaacagagagctggaggtgatccacagcagatgggccatgttggggcgctcggctgcgttttcccggagctgttggccaaaaccggagtcaagtttggggaagcagtgtggttcaaggccggggcgcagatattctcggagggaggcctcgactacctggggaaccccaatctgatccacgcacagagcatactcgccatctgggcctcccaggttgtgctcatgggcttgattgaaggatacagagttcggggaggaccccttggggaggggttggaccctctgtaccctggaggggccttcgatccactggggctggccgatgacccagaagcgttcgcggagctgaaggtgaaggagataaagaacgggcggctggccatgttctccatgttcggcttcttcgtgcaggcaatcgtgaccggtaagggccccatcgaaaatctctacgaccacttggcagaccccactgccaacaatgcctgggcctacgccaccaatttcgttcccggcaaatgaagtgaagtgtcggaaaataaaagaggcctgtaatctctgtatcatacatttgacggcctttactgttaataatcagcgtttctttcaacgagatgttacttggtcttgcttttggtgtttagtttgtttttggtct

SEQ ID NO: 4518 - DNA, 948 bp, Picea glauca
tctcatcactcatattacctaaccttgttctaaacatttttctcatcctcaccttcaccatgacaacagcctcagccatccaaagctcaagcttggcaggccagaccctcctaaggccgcatcagaatgagctcgtcaagaaggtgggcgcgtcgcaagctcgaatcaccatgcgtagaaccgtcaggagcgcccctgagagcatttggtatggacctgaccgccccaagtacctgggccccttctcggaacagacgccgtcgtacctcaccggagaatttcccggcgactacgggtgggacaccgccgggctctctgccgacccggagaccttcgcgaaaaacagagagctggaggtgatccacagcagatgggccatgttgggggcgctcggctgcgttttcccggagctgttggccaaaaccggagtcaagtttggggaagcagtgtggttcaaggccggggcgcagatattctcggagggaggcctcgactacctggggaaccccaatctgatccacgcacagagcatactcgccatctgggcctcccaggttgtgctcatgggcttgattgaaggatacagagttggggaggaccccttgggagggttggaccctctgtaccctggaggggccttcgatccactggggctggccgatgacccagaagcgttcgcggagctgaaggtgaaggagataaagaacgggcggctggccatgttctccatgttcggcttcttcgtacaggcaatcgtgaccggtaagggccccatcgaaaatctctacgaccacttggcagaccccactgccaacaatgcctgggcctacgccaccaatttcgttcccggcaaatgaagtgaagtgtcggaaaataaaagaggcctgtaatctctgtatcatacatttgacggcctttactgttaataatcagcgtttctttcaacga

SEQ ID NO: 4519 - DNA, 951 bp, Cicer arietinum
gtagcaacaaagggaacaaacaacacaatcatggccacctctgctatccaacaatcagcattcactggcaagactggtttgaggcagggaaatgagttcatccggaaggctggtagctttggccaaggtcggtttaccatgcgtcgtactgtcaagagtactcctgagagcatctggtatggccctgaccgtcccaaatacttgggtcccttctctgaacaaattccatcatacttgactggtgaatttcctggtgactatggatgggacacagctggattatcagctgaccctgaaacctttgcaaggaaccgtgagctggaagtaattcacagcagatgggctatgcttggtgcattgggatgtaccttccctgaaatccttgaaaagaatggtgttaaatttggtgaggcagtgtggtttaaggccggtgcccaaattttctccgaaggtggtcttgactatttgggcaacccaaatctgattcatgctcagagcattcttgcaatctgggctactcaggttgtgctcatgggatttgttgaaggctacagggttggtggaggaccacttggtgaaggactagacccactttaccctggcggtgcctttgacccacttggtctggctgattgaccctgatgcatttgctagaattgaaggtgaaggaaatcaagaatggtcggttggccatgacctaccatgtttggttctttgttcaggccattgttactggctaaaggccctattcagaacctttacgaccatgttgctgaccctgtcgcctaataatgcgtgggctttttgcgtactaactttgtcccttggtacaatgtagaattgccactattaatgcctagttttgtttcagatggcaaatcttctgctctcatttgcatttctgttgtgtttaactcccattttcaccaatgcaactacatgagcagaaga

SEQ ID NO: 4520 - DNA, 890 bp, Artemisia annua
aagcaggggtatcaacgcagtactccaacgggaggtttcaacgcagtactccgacgggaccctcttacaaactaccatctcttcaacagttcctttactcccccttataaaaatggcaacctctgcaatccaacagtcagcattcgtcggtgagtcagcagtgaagccgcaaaacgagctcgtcaagaagatcggtagcttcaatggcggccgcttcaccatgcgtcgcacagtcaaaagcgcaccacaaagcatttggtacggacctgaccgcccaaaccccatcatacttgactggtgaatttcctggtgactacgggtgggacactgctggactatcagcagaccctgagacattcgccaagaaccgtgaacttgaggtgatccactctaggtgggccatgctcggtgcactcgggtgcgtgttccccgagcttctatcaaagaacggtgtcaaattcggtgaagctgtctggttcaaggcaggctcccaaattttctcggaaggtggactcgactacctcggcaaccccaacttgatccacgcccagagcattttagccatctgggcatcacaggttgtgctcatggggttaattgaagggtacagggttggtggtggcccacttggtgaaggactcgacagtatttacccaggagggtcttttgacccacttggattggctgatgatccagaagcatttgctgagttgaaggttaaggagcttaagaatggacggttagctatgttttccatgttggattcttcgttcaggccattgtaaccggaaagggcccaattgagaacttatctgaccatcttagtgacccagtagctaacaatgcatgggcatacgctaccaactttgtgcccggaaaatgagttaaat

SEQ ID NO: 4521 - DNA, 1040 bp, Cedrus atlantica
gaaagctgatccctcatattacctgaccctggtctgatcaattttctcatcgtcacgtttatgatggcaacagcctcagccatccaaagctcaagcttggcaggccagaccctcctgaggccgcagcagaatgagctcgtcaagaaggtgggcatgtcgcaggctcgaatcaccatgcgaagaaccgtcaggagcgcccctgagagcatctggtatggacctgaccgccccaagttcctgggccccttctcggaacagacgccgtcgtatctcactggagaatttccaggtgactacggttgggacaccgccgggctctcggccgacccggagaccttcgccaaaaatagagagctggaggtgatccactgcagatgggccatgttgggggcgctgggctgcgttttcccggagctgttggccaaaacggtgttcaatttggtgaagccgtgtggttcaaggccggtgcgcagatattctcggagggaggcctcgactacctgggtaaccccaacctgatccacgcgcagagcattctggccatcttggggtgccaggttgtgctgatgggattgattgaggggtacagagtggggggaggacctcttggggaggggttggaccctctgtacccagggggggccttcgacccattgggcctggccgacgatccggaggccttcgcggagctgaaagtgaaggagataaagaacgggcggctggccatgttctccatgtttggcttctttgtgcaggcaatcgttactggcaaggggcccatcgaaaatctcttcgaccacttggcggaccccgctaccaacaatgcctgggcctacgccaccaatttcgttcctggcaagtgaagtaacagataataaaagatggctgtaatctttgtatcatacggttgacgccttaaaacgatttacgagatgttacttggtctttctctttgtgtttagtttttccgtagttattgtcaaacggtttttctggtttgtggttttacgtacagcaatgatgttaaacatagactagaa

SEQ ID NO: 4522 - DNA, 971 bp, Adiantum capillus-veneris
gagcaagggaaagtaggatcctcggagattgtgagtgcggagagagagggaaggcaggcatggcaacgatgacctctgcgtctgccatcagcagctccacattcgctgggcagactgcgttgaagtcacagagcgagctgtccaagagggttggcaatgtggatgctcgcgtgacaatgaggaggacagtgaagagcaccccagagagcatctggtatggccccgaccgccccaagtacttgggccccttctctgaggctaccccatcctacctgaccggcgagtttccgggtgactacggctgggacacggccggtttgtctgcagacccagagacattctccaagaacagggagctcgaggtgattcacgcgagatgggcaatgctcggcgccctggggtgtgtgacccccgagttgctagccaagaacggggtgaaattcggagaggcagtgtggttcaaggccggctcccagatcttcgccgacggcggtcttgactacctgggcaaccccagccttgtgcacgctcagagcattctggccatctgggcctgccaagtggttctcatgggtgccgttgaaggctacagagtgggcggcggccctcttggagagggcctagaccctgtctacccaggcggtgccttcgaccccttgggtctggctgacgaccccgactccttcgctgagctgaaggttaaggaaatcaagaacggccggctggccatgttctccatgttcggcttcttcgtccaggccatcgtcacaggcaagggcccgatcgagaacttgtccgaccatttggccgaccccactgtcaacaacgcatgggcttacgccaccaacttcacacccggcaagtgagaggcagcacccctattttccgcactcccccatctcccactagctactgtaaacatttgagaataactgtaactaaatttactcttgtctctattttaccgttcc

SEQ ID NO: 4523 - DNA, 1059 bp, Pinus taeda
gagaataacagctcatcactcgtattacctgactttggtctgagcatttttctcgtcgtcacgttcaccatggcaacagcttcagccatccaaagctcaagcttggcaggccagaccctcctaaggccgcagcagaatgagctcgtcaagaaagtgggcacgtcgcaggctcgaatcaccatgcgaagaaccgtaaggagcgcccccgagagcatttggtatggacctgaccgccccaagtacctaggccccttctcggaacagacgccgtcatatctcaccggagaatttcccggcgactacgggtgggacactgccggcctctcggcggatccagagaccttcgcaaaaaacagagagctggaggtgatccactgcagatgggccatgttgggagcgctcggctgcgttttcccggagctgttggccaaaaatggggtgaaatttggggaagctgtgtggttcaaggccggggcgcagatattctcagagggaggccttgactatctggggaaccccaacctgatccacgcgcagagcattctagccatctgggcctgccaggttgttctcatgggattgattgaaggatacagagtgggaggaggaccacttggagaggggttggaccctctgtacccagggggtgccttcgacccactggggctggccgacgacccagaggccttcgcggagctgaaggtgaaggagattaagaacggtcggctggccatgttctccatgttcggtttcttcgttcgtgaccgggaagggccccattgaaaatctctacgaccacttggcggaccccgctgccaacaatgcctgggcctacgccaccaatttcgttcctggcaagtgaagggaagtgacggaaaataaaagaggcctgtgatctgtgcattaatcatttgacagccttagtgttaataaaatattttctttcacctggatgtatttgttggtgatctttgtattttgttttttatgagttaagctcttataatggtttttttgaggattgggatggttattttggcagtagtttaaatatattgt

SEQ ID NO: 4524 - DNA, 998 bp, Pteridium aquilinum
agagagagagagagaaagagagagagagagagagagaagggagaagggagaagggggcacgtgtgttgccatggccaccatgacctctgcttcttctcttagcagctctacatttgcagggcagactgttctgaaatctcagagtgagctctccaagcgagttggcaatgtggatgcacgcgtcactatgaggaggactgtcaagagcacacccgagagtatctggtatggtcctgaccgccccaagttcctcggccccttttctgaggcaaccccctcgtacctgaccggagagttccctggtgactacgggtgggacaccgccgggctttctgcagaccccgaaacattcgccaagaacagggaactggaggtgatccactcaagatgggctatgttgggtgctttgggatgcgtgaccccggagctcctggcaaagaatggtgtcaagtttggggaggcggtgtggttcaaagcgggatcgcagatctttgcagatgggggtttggactacctgggcaaccccaacttggtacatgctcagagcatattggctatatgggcttgccaagtggtattgatgggagctgtggagggttacagagtcggaggaggcccccttggagagggtcttgaccctgtctaccccggcggagcttttgatcctctcggtttggccgaagacccagatagctttgctgagttgaaggtgaaggagattaagaatggcaggcttgctatgttctctatgtttgggttctttgtgcaagccattgtcacaggtaagggtcctatcgagaacttatcggaccacctcgcagaccccgcagtcaacaatgcttgggcatatgcaaccaacttcactcccggaaagtgaagaatttcatacagcttctgcctccttttgtgtgcggagaagagaactggttcaatctacttctgaggttacctgaatgtgatacacttatgaaaatgtcaaatataaaagttctctgcca

SEQ ID NO: 4525 - DNA, 739 bp, Cenchrus ciliaris
gaacacacaatcagcaagcgccgccgtcgtgctcgctcaccggacacgcagaacgaagatggccgcgtcggcgctccaccagaccaccagcttcctcggccaggccctggtctcccgccccgccgccgccgatgccggcggccgcatcaccatgcgccgcaccgtcaagagcgctccccagagcatctggtacggccccgaccgccccaagtaccttggcccgttctccgagcagacgccgtcgtacctgaccggcgagttccccggcgactacgggtgggacacggcggggctctccgccgaccctgagaccttcgcgcgcaaccgcgagctggaggtgatccactcccggtgggcgatgctcggcgcgctcgggtgcgtgttcccggagatcctggccaagaacggcgtcaagttcggcgaggccgtctggttcaaggccggcgcgcagatcttctccgagggcgggctggactacctgggcaacccgaacctggtgcacgcgcagagcatcctggccatctgggcctgccaggtggtgctcatgggcttcgtcgagggctaccgcgtcggcggcgggccgctcggggagggcctcgacaaggtgtaccccggcggcgcgttcgacccgctgggcctcgccgacgaccccgacaccgccgccgagctcaaggtgaaggagctcaagaacggccgcctcgccatgttctccatgttcggattcttcgtgcaggccatc

SEQ ID NO: 4526 - DNA, 1002 bp, Pteridium aquilinum
tcatcaactatcttgctagctcatcctgtgttagttggtctgcgagaagaagcgtctgagagagaggaggaggcatggcaaccatgacctctgcggccttgagcagctctacattcgcagggcagactgccttgaagtcccagagcgagctctctaagagagttggcaatgtggaggcccgtgtttccatgagaaggacagtgaagagcacccccgagagcatctggtatggcgctgaccgccccaagttcttgggccccttctccgaggctaccccttcatacctcactggtgagttccctggtgactatggttgggacactgctgggctctcagctgaccctgagacattcgccaagaacagggaactggaggtgattcacgcaaggtgggcaatgctgggtgcgttgggctgcgtaacaccggagttgctggcgaagaacggtgtgaagttcggagaggcagtatggttcaaggcaggttcacagatctttgctgaggggggtttggactacttgggcaaccctaacttggtacacgcacagagcattttggcaatttgggcatgccaagtagtgttgatgggagctgtcgagggttacagagttggagggggtcctcttggagatgggctagatcccatttacccaggaggtgcttttgacccccttgggcttgctgaggatcctgatagctttgcagagctgaaggtgaaggagatcaagaatggaagacttgccatgttctccatgtttgggttttttgttcaagctattgtgaccggcaagggccccatcgaaaacctctcggatcatcttgcagacccagctgtcaacaatgcttgggcctatgccactaacttcacccctggcaagtgatacatgcagtgtttttctcttcccctgtaatgaactcctgtcactgagctaaacgtatacgctgactgaggttttaatgtagatgtgaaatgcatttggtgcatattccggctcttgaatgact

SEQ ID NO: 4527 - DNA, 801 bp, Euphorbia peplus
tcggcaacttaggcggtgctcgtgttgttatgcgcaggaccgtcaagagcgctcccgagagcatttggtacggaccagaccgcccaaagtacttgggaccattctccgaacaaaccccatcataccttaccggtgaattccccggtgactacggatgggacacagccggattatcagcagaccccgaaacattcgccaagaaccgtgaacttgaagtaatccactgcagatgggcaattgcctcggggctctcggctgtgtccttccccgaactcctctcaaagaacggtgtgaccttcggggaagcagtctggttacaaagcaggatctcaaatcttttccgaaggtggtctagattaccttggaaaccctaacctgattcacgctcagagcatcctagcaatctgggcatgccaggttgttctgatggggttcgtggaagggtacagaattggaggaggaccattgggtgaagggctttgacccgctatatcccgggggtgcttttgatccactaggattggcagatgatccagaagcatttgcagaattgaaggtgaaagagattaagaatggaagattggcaatgttctctatgtttggattctttgtgcaggctattgtgactggaaaaggacctgttgagaatctgtatgaccacgttgctgatcccgtcgctaataatgcttgggcctttgccactaactttgtacccggaaaataaactatgtaatgtaatatattgtaatgcttgtgttgagatttgaaatcccttaggatgttcatcatctcattatgttt

SEQ ID NO: 4528 - DNA, 836 bp, Euphorbia peplus
gtcggcaacttaggcggtgctcgtgttgttatgcgcaggaccgtcaagagcgctcccgagagcatttggtacggaccagaccgcccaaagtacttgggaccattctccgaacaaaccccatcataccttaccggtgaacttccccggtgactacggatgggacacagccggattatcagcacgaccccgaaacattcgccaagaaccgtgaacttgaagtaatccactgcagatgggcaatgcgtcgggctctcggctgtgtcttccccgaactcctctcaaagaacggtgtgaccttcgggaagcagtctggttcaaaagcaggatctcaaatcttttccgaaggtggtctagattaccttggaaaccctaacctgattcacgctcagagcatcctagcaatctgggcatgccaggttgttctgatggggttcgtggaagggtacagaattggaggaggaccatttgggtgaagggcttcgacccgctatatcccgggggtggcttttgatccactaggattggcagatgatccagaagcatttgcagaattgaaggttgaaagagattaagaatggaagattggcaatgttctctatgtttgggattctttgtgcaggctattgtgactggaaaaaggacctgttgagaatctgtatgaccacgttgctgatcccgtcgctaataatgcttggggcctttgccactaactttgtacccggaaaataaactatgtaatgtaatatattgtaatgcttgtgttgagatttgaaatcccttaggatgttcatcatctcattatgttttgtggaaaggaagtatttatgtctagtatt

SEQ ID NO: 4529 - DNA, 743 bp, Artemisia annua
ttcaccatgcgtcgcacagtcaaaagcgcaccacaaagcatttggtacggacctgaccgccccaagtacttgggcccattctctgagcagaccccatcatacttgaccggtgaattccctggtgactacgggtgggacactgctggactatcagcagaccctgagacattcgccaagaaccgtgagcttgaggtgatccactcgcggtgggccatgctcggtgcacttgggtgcgttttccccgaactcctttcaaagaacggcgtcaaattcggtgaagccgtctggttcaaggcaggttcccaaattttctcggaaggtggactcgactacctcggcaaccccaacttgatccatgcccagagcattttagccatctgggcatcacaggttgtgctcatggggttaattgaagggtacagggttggtggtggcccacttggtgaaggacttgacagtatttacccaggagggtcttttgacccacttggattggctgatgatccagaagcatttgctgagttgaaggttaaggagcttaagaatggacggttagctatgttttccatgtttggattcttcgttcaggccattgtaaccggaaagggcccaattgagaacttatctgaccatcttagtgacccagtagctaacaatgcatgggcatacgctaccaactttgtgcccggaaaatgagttaaatagatgtaaattaatgatcgttatgcaatattacaagcaaa

SEQ ID NO: 4530 - DNA, 978 bp, Zostera marina
attcgttctcttccattttgaagctcaaggaatggccacctctgcgattcatcaatctgtctttgttggtcagacaaccttgaagcaacaaatgaacttgtccgcaaagttggagtcttcgagagtgcatatctatgcgccgcacagtgaagagcatccgacagcgtttggtacggcgcagacgtcccaagtacttgggtccattctctgagcaaactccatcatacctaactggtgaattcccaggtgactacggttgggacacagccggtctatcagcggacccagagaccttcgcaaagaaccgttgaactttgtaggttgtattccgtttgtctagatgggccatgttgggcgcctttaggttgtgtctttccagagcttctatcaaagaacggagttaaattcggtgaagccgtttggttcaaagctggatctcaaatcttctcagatggtgggcttgactacttaggcaatcctaacttggtccatgctcaaagcatcttggccatatgggcttgccaagttgttttgatgggctttatcgaaggataccgcgttggtggaggtccacttggagatggtcttgacccactttacccaggaggctcattcgacccattgggcttagctgatgacccagaggccttcaccgaattgaaggtcaaagaggttaagaacggacggttggctatgttctcgatgttcggatatttcgtccaagctattgtgaccggtaaaggtccaattgagaacctatacgaccaccttgccgacccagtcgccaacaatgcttgggcctttgctacaaacttctcccccgcaaactaaatataacaatctccatatataatttgcatgtaaactttgtttgtttgtttgatcttttggattctcgaattttcgaaaagttttaaccaaacaacttaaatatcaatgtgagtgagatttgtaaacaatgtgtttgttgtttgaaaa

SEQ ID NO: 4531 - DNA, 819 bp, Brassica napus
actcttcaatccttctagttaagacttggataagaaatggccacgtcagcaatccagcaatcctccttcgctggccaaacggccctcaaaccctccaacgatctcctccgcaaggtcggtgtctccggcggcggccgcgtgaccatgcgccgcacagtcaagtccactcctcaaagcatctggtacggaccagaccgtcccaagtacttgggaccgttctccgagaacacaccatcctacctaaccggagaataccccggagactacggctgggacaccgccgggctctccgctgacccggagacattcgctaagaaccgtgagctcgaagtaatccacagcagatgggcaatgctgggagctctaggctgcacattccccgagattctctccaagaacggagtcaaattcggagaagccgtgtggttcaaggcaggatcccagatcttctcagaaggaggcctcgattacctcggaaaccctaacttgatccacgcgcaaagcatcttagccatatgggcttgtcaagttgtgctcatgggcctcatcgaagggtacagaatcggaggtggtcctgtcggtgaaggtcttcgacccgtctttacccgtggaggtgcgttcgacccgttgaatcgtggcggaggacccagaggccttcgctgagttgaaggttaaggagctcaagaacggacgtcttgccatgttctcgatgtttggattctttgttcaagccattgttactggtaaaggtcccatcgagaacttgtttgatcacttggcagatcctgtggctaacaacgcctggtcttacgctaccaa

SEQ ID NO: 4532 - DNA, 852 bp, Cicer arietinum
gagacgccgaccacacctagtatacaaacaacacaatcatggccacctctgctatccaacaatcagcattcactggcaagactggtttgaggcagggaaatgagttcatccggaaggctggtagctttggccaaggtcggtttaccatgcgtcgtactgtcaagagtactcctgagagcatctggtatggccctgaccgtcccaaatacttgggtcccttctctgaacaaattccatcatacttgactggtgaatttcctggtgactatggatgggacacagctggattatcagctgaccctgaaacctttgcaaggaccgtgagctggaagtaattcacagcagatgggctatgcttggtgcattgggatgtaccttccctgaaatccttgaaattggtgaggcagtgtggtttaaggccggtgcccaaattttctccgaaggtggtcttgactatttgggcaacccaaatctgattcatgctcagagcattcttgcaatctgggctactcaggttgtgctcatgggatttgttgaaggctacagggttggtggaggaccacttggtgaaggactagacccactttaccctggcggtgcctttgacccacttggtctggctgatgaccctgatgcatttgcagaattgaaggtgaaggaaatcaagaatggtcggttggccatgacctccatgtttggtttctttgttcaggccattgttactggcaaaggccctattcagaacctttacgaccatgttgctgaccctgtcgccaataatgcgtgggcttttgctactaactttgtccctggacaatgagaatgccatataatgcctgttttgtcagatgc

SEQ ID NO: 4533 - DNA, 851 bp, Cynara scolymus
  misc_feature (678)..(678): n is a, c, g, or t
  misc_feature (736)..(736): n is a, c, g, or t
cttaccttctctaaccctttcaagcttcaaacacttcccttgtagcaatggcaacctctgcaatccaacactcggctttcgccggccagccggcgttgaaaccgcaaaacgacctcatcaagaagaccggcaccttcaccggaggccgcttcaccatgcgccgtaccgtcaaaagcacaccacaaagcatttggtacggaccagaccgcccaaagtacttgggcccattctctgagcaaaccccatcgtacctgaccggtgagttccccggtgactacggctgggacacagcaggattatcggctgatcccgagacgtttgccaagaaccgtgagcttgaggtgatccactctcggtgggcaatgcttggtgcacttggctgtgtcttccccgagcttctctcaaagaatggtgtcaaattcggcgaagcagtctggttcaaggccggatcccagattttctcggaaggcgggctcgattacctcggaaaccccaatttggttcatgcccagagtatcctagccatctgggcgtcccaagtcgtcctcatggggctcatcgaagggtaccgtgttggtggtggcccacttggcgaaggactcgacaagatttaccccggaggggcttttgacccacttggacttgctgacgatccagaagcgtttgctgagttgaaangtaaggagctcaagaacggtcgattggcgatgttttcatgttcggattcctcgttcangccattgtaacccggaagggcccgattgagaacccttttgacatcttagcgatcccgtagctacaacgctggggctacgctaccactttgtgccccgaaatgagtggaacactgt

SEQ ID NO: 4534 - DNA, 926 bp, Zostera marina
ctattcgttctcttccattttgaagcttaaggaatggccacctctgcgattcatcaatctgtctttgttggtcagacaaccttgaagcaacaaaatgaacttgtccgcaaagttggagtcttcgagagtcgcatatctatgcgccgcacagtgaagagcactcccgacagcgtttggtacggcgcagaccgtcccaagtacttgggtccattctctgagcaaactccatcatacctaactggtgaattcccaggtgactacggttgggacacagccggtctatcagcggacccagagaccttcgcaaagaaccgtgaacttgaggtgatccattgcagatgggccatgttgggcgccttaggttgtgtctttccagagcttctatcaaagaacggagttaaattcggtgaagccgtttggttcaaagctggatctcaaatcttctcagatggtgggcttgactacttaggcaatcctaacttggtccatgctcaaagcatcttggccatatgggcttgccaagttgtttgatgggctttatcgaaggataccgcgttggtggaggtccacttggagatggtcttgacccactttacccaggaggctcattcgacccattgggcttagctgatgacccagaggccttcaccgaattgaagtcaagaggttaagaacggacggttggctatgttctcgatgttcggatatttcgccaagctattgcgaccggtaaggtccaattgagaacctatacgaccaccttgccgaccagtcgccaacaatgcttggcctttgctacaaacttctccccgcaaactaaatataacaatctccatatataatttgcatgtaaactttgttgtttcttgatcttttggattcccgtaatttcgaaaagttttaaccaaactaacttaaatatacaa

SEQ ID NO: 4535 - DNA, 995 bp, Cryptomeria japonica
  misc_feature (935)..(935): n is a, c, g, or t
gacaatacagtactacaactctcctcaattcactccaacaacactagtctaattgtgtgtgtcttacaatggctgcctttcagatgtcaagcttagggagcttcgcagggcagccccttaatcaaccaaggaatgaattcgccaggcaaatgggcatcgcaatcggcaattttgagtctcgtgttaacatgcgtaggaccattaagagcgtcccacagagtctctggtatggaccagatcgccccaagtacttgggtcccttttcggaacaaacaccttcatatctaactggagagttccctggtgactatggttgggacaccgcaggcctatctgcagacccagaaacatttgccaaaaatagagaactagaagtcatccattgtcgatgggctatgttgggtgccttgggttgtgtcttcccagaaattttatccaaaactggcgtcaaatttggtgaagctgtgtggttcaaagcaggatcccaaatatttagtgaaggtggccttgactatttaggcaaccctaatcttatccatgcacaaagcatattagccatttgggcatcccaggtagtgttgatgggtttgattgaggggtatagagttggtggtggaccacttggtgaggggttggatcctctttatcctggtggagcatttgatccattgggtttggcagatgatcctgaggcctttgctgagctcaaggtaaaggagatcaagaatgggagattggctatgttttctatgtttggattttatgtgcaggctattgtaacaggaaagggaccaattgagaacttgtatgaccatttagcagatccttctaccaacaatgcttgggcttatgctaccaattttgttcctggcaaatgatttactcaagttttaacttgagaatagcttttgggagcaagttgtatcataatatgnatctatatattatgctaaataagatttaactgaataatacaatatcacatttttttttcc

SEQ ID NO: 4536 - DNA, 677 bp, Flaveria ramosissima
acagtcaagagtgcaccacaaagcatatggtagtgggccggacaggcccaagtacttgggcccattctcggagcaaaccccatcatacctaaccggagaatttcctggtgattatgggtgggacacagctggattatctgctgatcccgagacatttgccaagaaccgtgagcttgaagtgatccactctcggtgggccatgctcggcgcactcgggtgcgtgttccccgagattcttgcaaagaacggtgtcaaattcggtgaagcggtctggttcaaggcgggctcccagatattctcagaaggtgggcttgactacctcgggaacccaaacttgatccatgctcagagcatcttagctatctgggcttgtcaggttgttcttatgggcctcattgaagggtaccgcgttggtggaggcccattgggtgaagggctcgacaagatttacccaggtgggtcttttgacccgcttggtttggctgatgacccggatgcatttgctgagttgaaggttaaggagcttaagaacggacgattggctatgttttcgatgttcgggttcttcgttcaggccatcgttactggaaaggcccgatcgagaacttgtttgatcatgtcagcgatccggtggctaacaacgcttgggcttatgccaccaactttgttcctggaaa

SEQ ID NO: 4537 - DNA, 875 bp, Raphanus sativus
tctcctccgcaaagtcgagcttccaacggtggtggccgtgtcgtcatgcgtcgtaccgtcaagtctactcctcagagcatctggtatggaccagaccgtcccaagtacttaggtccattctcagagaacacaccatcatacctaaccggagaatacccaggagactacggctgggacactgccggtctctccgccgacccagaaaccttcgcaaagaaccgtgagctcgaagtaatccacagcagatgggcaatgctaggagctttaggctgcaccttcccagagattctctccaaaaacggagtcaaatttggtgaagccgtatggttcaaggcaggttcccagatcttctcagaaggaggacttgactacctcggaaaccctaacttgatccacgcgcaaagcatattagctatatgggcttctcaagttgtgctaatgggcttaatcgaagggtacagaatcggaggtgggcctcttggtgaaggtcttgacccgctttacccgggtggagcgtttgacccgttgaacttagctgaggatcctgaggcattctcagaattgaaagtgaaggagctcaagaacggtcggcttgcgatgttctccatgtttggattctttgtccaagcaattgttaccggtaaaggtccaattgagaacctgtttgatcatgttgcggaccctgtggccaacaatgcatgggcttacgccaccaactttgttcccggaaaatagagtttgatcggattaattcatgtaacttatttttatctgtcaacatttaatgcatggaaaatatttaagtctcttgatttgataatgccatcttggtgaaagaaatatataaaccattaaaattaaaccgtgttagagca

SEQ ID NO: 4538 - DNA, 890 bp, Cicer arietinum
cccctgtgtgccttgcctcccacgactaaacaacacaatcatggccacctctgctatccaacaatcagcattcactggcaagactggtttgaggcagggaaatgagttcatccggaaggctggtagctttggccaaggtcggtttaccatgcgtcgtactgtcaagagtactcctgagagcatctggtatggccctgaccgtcccaaatacttgggtcccttctctgaacaaattccatcatacttgactggtgaatttcctggtgactatggatgggacacagctggattatcagctgaccctgaaacctttgcaaggaaccgtgagctggaagtaattcacagcagatgggctatgcttggtgcattgggatgtaccttccctgaaatccttgaaaagaatggtgttaaatttggtgaggcagtgtggtttaaggccggtgcccaaattttctccgaaggtgtcttgactcatgctcagagcattcttgcaatctgggctactcaggttgtgctcatgggatttgttgaaggctacagggttggtggaggaccacttggtgaaggactagacccactttaccctggcggtgcctttgacccacttggtctggctgatgaccctgatgcatttgcagaattgaaggtgaaggaaatcaagaatggtcggttggccatgacctccatgtttggtttctttgttcaggccattgttactggcaaaggccctattcagaacctttacgaccatgttgctgaccctgtcgccaataatgcgtgggcttttgctactaactttgtccctggacaatgagaatgccatataatgcctgttttgtcagatgcaatcttctgctctcatttgcatttctgttgtgtttaactcccat

SEQ ID NO: 4539 - DNA, 954 bp, Zostera marina
attttgaagctcaaggaatggccacccctgcgattcatcaatctgtctttgttggtcagacaaccttgaagcaacaaaatgaacttgtccgcaaagttggagtcttcgagagtcgcatatctatgcgccgcacagtgaagagcactcccgacagcgtttggtacggcgcagaccgtcccaagtacttgggtccattctctgagcaaactccatcatacctaacctggtgaattcccaggtgactacggttggacacagccggtctatcagcggacccagagaccttcgcaaagaaccgtgaacttgaggtgatccattgcagatgggccatgttgggcgccttaggttgtgtctttccagagcttctatcaagaacggagttaaattcggtgaagccgtttggttcaaagctggatctcaaatcttctcagatggtgggcttgactacttaggcaatcctaacttggtccatgctcaagcatcttggccatatgggggttgccaagtgtttgatgggcgttatcgaaggataccgcgttggtggaggtccacttggagatggtcttgacccactttaccccagggaggcttcattcgacccattgggcttagctgatgacccagaggccttcaccgaattgaaggtcaaagaggttaagaacggacggttggctatgttctcgatgttcggatatttcgtccaagctattgtgaccggtaaaggtccaattgagaacctatacgaccaccttgccgacccagtcgccaacaatgcttgggcctttgctacaaacttctcccccgcaactaaatataacaatctccatatataatttgcatgtaaactttgtttgtttgtttgatcttttggattctcgaattttcgaaaagttttaaccaaacaacttaaatatcaatgtgagtgagatttgtaaacaatagtgtttgttgttt

SEQ ID NO: 4540 - DNA, 844 bp, Zostera marina
ccgcaaagttggagtcttcgagagtcgcatatctatgcgccgcacagtgaagagcactcccgacagcgtttggtacggcgcagaccgtcccaagtacttgggtccattctctgagcaaactccatcatacctaactggtgaattcccaggtgactacggttgggacacagccggtctatcagcggacccagagaccttcgcaaagaaccgtgaacttgaggtgatccattgcagatgggccatgttgggcgccttaggttgtgtctttccagagcttctatcaaagaacggagttaaattcggtgaagccgtttggttcaaagctggatctcaaatcttctcagatggtgggcttgactacttaggcaatcctaacttggtccatgctcaaagcatcttggccatatgggcttgccaagttgttttgatgggctttatcgaaggataccgcgttggtggaggtccacttggagatggtcttgacccactttacccaggaggctcattcgacccattgggcttagctgatgacccagaggccttcaccgaattgaaggtcaaagaggttaagaacggacggttggctatgttctcgatgttcggatatttcgtccaagctattgtgaccggtaaaggtccaattgagaacctatacgaccaccttgccgacccagtcgccaacaatgcttgggcctttgctacaaacttctcccccgcaaactaaatataacaatctccatatataatttgcatgtaaactttgtttgtttgtttgatcttttggattctcgaattttcgaaaagttttaaccaaacaacttaaatatcaatgtgagtgagattt

SEQ ID NO: 4541 - DNA, 750 bp, Phalaenopsis aphrodite
atcaccatgcgccgcactgttaagagtgtacctcagagtatctggtacggcccagataggcccaagtacttgggccccttctccgaacaaacgccctcctatctaaccggtgaattccccggcgactacgggtgggacactgccggtctctccgccgatcccgaaaccttcgctaaaaaccgcgagctggaggtgatccatagtagatgggccatgctcggcgcactgggctgcgttttccccgagctcctctccagaaacggggtgaagttcggcgaagccgtctggttcaaggccggggcccaaatcttctcagaaggaggcctggactacctcggcaatccgaacctcatccatgcccagagcatcctggctatatgggcttctcaagtcatcctcatgggcttcgtcgaggcatatcgtgttggaggaggcccgcttggggaggggctggataagatctaccctggcggggccttcgacccattgggccttgcggatgacccggaggccttcgcggagctgaaagtgaaggaactgaagaacgggcggctggccatgttttcaatgttcgggtttttcgtgcaggctattgtgacggggaagggacctattgagaacctgtatgaccacctggctgacccaacgactaataatgcttgggcctatgcaaccaactttgtgcctggaaaatgagtgttttttttttgttggtgtttgatttcagtgtgacttaatgaaatgggagca

SEQ ID NO: 4542 - DNA, 868 bp, Picea glauca
caggccagaccctcctaaggccgcatcagaatgagctcgtcaagaaggtgggcgcgtcgcaagctcgaatcaccatgcgtagaaccgtcaggagcgcccctgagagcatttggtatggacctgaccgccccaagtacctgggccccttctcggaacagacgccgtcgtacctcaccggagaatttcccggcgactacgggtgggacaccgctgggctctctgccgacccggagaccttcgccaaaaacagagagctggaggtgatccactgcagatgggccatgttgggggcgctcggctgcgttttcccggagctgttggccaaaaccggggtgaaatttggggaagccgtgtggttcaaggccggggcgcagatattctcggagggaggcctcgactacctggggaaccccaatctgatccacgcacagagcatactcgccatctgggcctcccaggttgtgctcatgggcttgattgaaggatacagagttggaggaggaccccttggggaggggttggaccctctgtaccctggaggggccttcgatccactggggctggccgatgacccagaagcgttcgcggagctgaaggtgaaggagataaagaacggggggctggccatgttttccatgttcggctttttcgtgcaggcaatcgtgaccggtaagggccctattgaaaattttttcgaccacttggcggaccccactgccaacaatgcctgggcctacgcccccaatttcgttcccggcaaatgaagtgaagtgtcggaaaataaaagaggcctgtaatttttgtatcatacatttgacggcctttcctgttaataatcagcgtttctttcaacgagatgttacttggt

SEQ ID NO: 4543 - DNA, 759 bp, Unknown
  Sequence found in Organisms: Euphorbia peplus, Euphorbia esula
aacagtcaagagtgctccacagagcatatggtatggaccagatcgcccaaaatacttgggaccattctctgaacaaacaccatcttacctgactggagagttccccggtgactatggatgggacacagccggtctatcagcagatcccgagacttttgcgaagaaccgtgagcttgaggtgatccactcccgatgggcgatgcttggtgcattaggttgtgtcttccctgaactccttgcaaagaatggtgtccagtttggtgaatcagtttggttcaaggctggttctcagatcttctctgagggtggtctagattaccttggcaacccaaacctcatccatgctcagagtatccttgcaatctgggctgtccaggttgtgctcatgggcttcgttgaaggttaccgggttggtggtggtccccttggtgaaggactggacccaatttacccaggaggcgccttcgacccactcggattggcagatgacccagatgcatttgctgagttgaaggtgaaggaactaaagaatggaaggctggcaatgttctccatgttcggattctttgtccaggctatcgtcacaggaaagggtcctattgagaatctctttgaccatgttgcagatcctgttgccaacaatgcatgggcttacgccaccaacttcgtccccggaaaatgaagaaacctgtaggaaacaactctttgttttaccacacttaagcatctcactcttcctgaaaatctcatattgatgta

SEQ ID NO: 4544 - DNA, 817 bp, Tropaeolum majus
agaacggttagaagtgttcctcaaagcatctggtatggccctgaccgcccaaaatacttgggtccattctcagagcaaacaccatcatacctcaccggagagttccctggtgactacggatgggacacagccggattatcagctgacccagaaacattcagcaagaatcgtgagctagaagttatccacagtagatgggcaatgcttggtgcactgggctgtgtttttccggagattctctcaaagaatggagtgaagttcggagaagctgtttggttcaaagctggatctcagatcttctcagaaggcggccttgattatctcggaaacccgaaccttgttcacgctcaaagcattttagcaatctgggctagccaggtagtgctgatgggattcattgagggatacagaattggaggtggaccattgggtgaaggacttgaccccttatacccaggtggtgcttttgacccacttggtttggctgatgatcctgaatcatttgctgagttgaaggttaaggaattgaagaatggacgtttggctatgttttcaatgtttggattcttcgttcaagctatagtcactggaaagggtcctgttgagaacctttttgaccaccttgctgatccagcaaccaacaatgcctgggcttatgccactaactttgtacctgggaaataaatcagggaaatctagaaactcttgacgggtttgtgtgttaatataactttatgtaacactgtgtttatgataaatcagatgctgtttttgttcctaagtaagtttatgacaactttgtttttgttataatagc

SEQ ID NO: 4545 - DNA, 830 bp, Cicer arietinum
cactcactagctagtagcaacaaagggaacaaacaacacaatcatggccacctctgctatccaacaatcagcattcactggcaagactggtttgaggcagggaaatgagttcatccggaaggctggtagctttggccaaggtcggtttaccatgcgtcgtactgtcaagagtactcctgagagcatctggtatggccctgaccgtcccaaatacttgggtcccttctctgaacaaattccatcatacttgactggtgaatttcctggtgactatggatgggacacagctggattatcagctgaccctgaaacctttgcaaggaaccgtgagctggaagtaattcacagcagatgggctatgcttggtgcattgggatgtaccttccctgaaatccttagaaaagaatggtgttaaatttggtgaggcagtgtggttaagggcggtgcctaatttctcgaaggtgtcttgactatttgggcaacccaatctgattcatgctcagagcattcttgcaatctgggctactcaggttgtgctcatgggatttgttgaaggctacagggttggtggaggaccacttgggtgaaggactagaccccacttttaccctggcggtgcctttgacccacttggtctggctgatgaccctgatgcatttgcagaattgaaggtgaaggaactcaagaatggtcggttggccatgacctccatgtttggtttctttgttcaggccattgttactggcaaaggccctattcagaacctttacgacccatgttgctgaccctgccgccaataatgcgtgggcttttagctactaactttgtcc

SEQ ID NO: 4546 - DNA, 771 bp, Flaveria ramosissima
catcctcaacaatctatcatcaattcactttccccttactcaaatggcgacctctgcaatccaacagtcagcattcgccggctccgcggcgttgaagccacaaaacgagctcgtcaagaagaccggtagcttcaatggcggccgcttcaccatgcgccgaactgtcaagagtgcaccacaaagcatatggtatgggccggacaggcccaagtacttgggcccattctcggagcaaaccccatcatacctaaccggagaatttcctggtgattatgggtgggacacagctggattatctgctgatcccgagacatttgccaagaaccgtgagcttgaagtgatccactctcggtgggccatgctcggcgcactcgggtgcgtgttccccgagattcttgcaaagaacggtgtcaaattcggtgaagcggtctggttcaaggcgggctcccagatattctcagaaggtgggcttgactacctcgggaacccaaacttgatccatgctcagagcatcttagctatctgggcttgtcaggttgttcttatgggcctcattgaagggtaccgcgttggtggaggcccattgggtgaagggctcgacaagatttacccaggtgggtcttttgacccacttggtttggctgatgacccggatgcatttgctgagttgaggttaaggagcttaagaacggacgattggctatgtttcgatgttcgggttcttcgttcaggccatcgttactggaaaggcccgatcgagaacttgtttga

SEQ ID NO: 4547 - DNA, 850 bp, Fragaria vesca
aaccccgctctctcctagttctaaacatcccaattcatagcctgatcaacaccatcccacctcaaacagaaaactagccatggcaacctctcaaatccagcagtcagcatttgccggccagaccgcattgaagcagtcgaatgagctcatcaaaaagattggaggccttggtggtggccccatcacaatgaggcgcactgttaagagtgcccccgaaagtatatggtatggtcctgaccgcccaaaatacttgggaccattctctgagcaaactccatcctacttgactggtgaattcccaggtgactacggatgggacactgctggactatctgcagaccccgagacatttgccaagaaccgtgagcttgaggtgcattgggctgcgtctttccagaagtcttgtccaaaaacagtgtcaagttcggtgaggctgtttggttcaaggccgggtcccaaatcttttccgagggcggcctggactacctcggcaacccaaaccttgtccacgcccacagcatcctggcaatctgggccgtccaggttgtcctcatgggcttcattgaggggtacagagtcggtggaggcccccttggtgagggtctggatccactttacccaggaggatcatttgacccacttggactagctgatgatcctgaagcctttgctgaactgaaggtgaaggaactgaaaaatgggcgggtagcaatgacctccatgtttggattctttgttcaggctattgtcactggaaagggtcctattgagaacctctatgaccatgttgctgatccaattgctaacaatgcatgggcttatgccacaaacttcgtccccggaaagtgaa

SEQ ID NO: 4548 - DNA, 871 bp, Zostera marina
ctattcgttctcttccattttgaagctcaaggaatggccacctctgcgattcatcaatctgtctttgttggtcagacaaccttgaagcaacaaaatgaacttgtccgcaaagttggagtcttcgagagtcgcatatctatgcgccgcacagtgaagagcactcccgacagcgtttggacggcgcagaccgtccaagtctggtccattctctgagcaaactccatcatacctaactggtgaattcccaggtgactacggttgggacacagccggtctatcagcggacccagagaccttcgcaaaagaccgtgaacttgaggtgatccattgcagatgggccatgttggcgcctaggttagtctttccagagcttctatcaaaagaacggagttaaattcggtgaagccgtttggttcaaagctggatctcaaatcttctcagatggtgggcttgactacttaggcaatcctaacttggtccatgctcaaagcatcttggccatatgggcttgccaagttgttttgatgggctttatcgaaggataccgcgttggtggaggtccacttggagatggtcttgacccacttttacccaggaggctcattcgacccattgggcttagctgatgacccagaggccttcaccgaattgaaggtcaaagaggttaagaacggacggttggctatgttctcgatgttcggatatttcgtccaagctattgtgaccggtaaaggtccaattgagaacctatacgaccaccttgccgacccagtcgccaacaatgcttgggcctttgctacaacttctccccgacaaactaaatataacaatctccatatataatttgcatgtaaactttgtttgtttgttt

SEQ ID NO: 4549 - DNA, 1932 bp, Hordeum vulgare
ggcggggccgcccctgcgagccgggccggcacggcggcatgcgcgccgccgtcttcgtcctagggatccaggcgttcgagatcatggcgatcgcggcggtggggaacaacctcatcacgtacgtgttcggggagatgcacttcccgctgtcggaggcggccaacgtggtgaccaacttcgtgggcaccatcttcctcctctccctcctcggcggcttcctctccgactcctacctcggctgcttctggaccatgctcaccttcggcttcgtcgagctctcgggcttcatactgctgtcagtgcaagcgcaccttccgcagctgaagccgccgccgtgcagcatggcgtccatggacggcagctgcgagcaggcccggggcttcaagtccagcatcttcttcgtcgcgctctacctggtggcgctcggcagcggctgcctcaaggccaacatgatcgcgcacggcggcgaccagttctccggcggggccgacaatgccaagagcctctccacctacttcaactccgcctacttcagcttctgcctcggcgagctcgtcgcgctcacggcgctcgtctgggtgcagacgcactccgggatggacgtcggcttcggcatctccgccgccgccatggccgccgggctcatcagcctggtgtccggcgcggccttctaccgcaacaaacctcctcagggcagcatcttcactcctattgcaagggtgttcgtcgctgccttcaccaagaggaagcaaatctgccctaccaatcctagcaacgccggaattggcgagccggcacgcctcgccggcagcttccgccacggcaacaaattcaggttcttggacaaggcgtgcgtcagggacgcggcgcagcagcagcagcagcagcagcaggggggcaacacgaagccggagagcccgtggcggctgtgcacggtgtccgaggtgcagcaggccaagaccctcctggccgtgacgcccatcttcgcctgcaccatcgtgttcaacaccgtgctcgcgcagctgcagaccttctcggtgcagcagggcaccgccatggacaccgtcctcgggggcaccttccgcgtcccgccggcgtcgctgcaggccatcccctacgccatgctcctcgtgctcgtcccggcgtacgagctcctgctcgtgccctccatgaagaggctgacggggacgcgctccgggatcaccccgctgcagcgcatcggggtcggcctcggcaccgtcgccttctccatggtcgccgccgccaccgtcgagcgccggcgccgcgacctcgcggcgtccgggacgcagatgcacgtgctgtggatcgtgccacagttcctcgtgttcggcgtgtcggagatgttcaccgccgtggggctcatcgagttcttctacaagcaggcatgcgccggcatgcagtccttcctcacggcgctcacctactgctcctacgccttcggcttctacctcagctccgtgctggtgacgacggtgaacagggtgacggcgaggcacggcggcgccggctggctcggagacaacgacctcaacaaggacaggctggacctcttctactggatgctcgccgtgctcagcgtgctcaacttcttctgctacctgctctgcgcaaggtggtacaactcgggtgccgacggctctgatgctgcctcggctcagattgcagcggaaggtgacgccaaggagatcagctgaagacatacatacttggacactgaaactgtatatgcgtatagatatatgttgaaatggatgaaatgtagtgatagttaagaaggtttcctttgataagggatagaaagtacattagcatatgtatgctagttctaccacaaagcatagtcttcagtaaacttatttcagacactgatggtcaaacatggaaatatgcaatggaatagtgaattaagca

SEQ ID NO: 4550 - DNA, 1929 bp, Setaria italica
gagggagaaacaagagaggctccagaggaaatggacgtggagagccgcgcgggggcgccggaggcggcggcggtcgccgtcgactggcgcggccgcccgtgccggccgcaccggcacggcggcatgcgcgccgccgtcttcgtcctagggatccaggggttcgagatcatggcgatcgcggcggtggggaacaaccttatcacgtacgtgttcggggagatgcacttcccgctgtcgcaggcggccaacgtggtcaccaacttcgtcggcaccatcttcttgctctccctcctcggagggttcctctccgactcctacctcggctgcttctggaccatgctcaccttcggcttcgtcgagctctcgggcttcatcctgctgtcgctgcaagcgcacctgccgcagctgaagccgccgccgtgcaacatggcgtccatggacgggagctgcgagaaggccagcggcttcaagtccaccgtcttcttcctcgcgctctacctggtggcgctcggcagcggctgcctcaagcccaacatgatcgcgcacggcgccgaccagttcgacaccgccgcgccgggcggcgccgggaggctctccacctacttcaactcggcctacttcagcttctgcgcgggcgagctcgtggccctcacggcgctggtctgggtccagacgcactccggcatggacgtcggcttcggcatctccgccgccgccatggccgccgggctcgtcagcctcgtttccggcgccgcactgtaccggaataagcccccgcagggcagcatcttcacccccattgcaagggttttcgttgccgcctacagcaagaggaagcaagtgtgcccttccagctccaattctgtcaacgccggagcatgcgagccggcacgcgccgccgccggcaacttccgccacggcaacaaattcaggttcctggacaaggcatgcatccgggtggcgccgcagggtcccaacacgaagccggagagcccgtggcgtctgtgcacggtggcggaggtgcagcaggccaagacgctcctcgccgtgacgcccatcttcgcgtgcaccatcgtcttcaacaccgtgctcgcgcagctgcagacgttctcggtgcagcaggggagcgccatggacaccacgctcccgccgggctcctccttccgcatcccgcccgcgtcgctgcaggccatcccctacgccatgctcctggcgctcgtcccggcctacgagctcctcctcgtcccgctcatgaagcgcgccacgggcacgcggtccgggatcaccccgctccagcgcatcggcgtcggcctcggcaccgtcgccttctccatggtcgccgcggcggccgtcgagcgccggcgccgcgacgccgccaccgcggggggccaccagatgtccgtcctctggatcgtgccgcagttcctcgtcttcggcgtgtcggagatgttcaccgccgtggggctcatcgagttcttctacaagcaggcgtgcgccggcggcatgcaggccttcctcacggcactcacctactgctcctacgcgttcgggttctacctcagctccctgctcgtgtcgctggtgaacagggtcacggccaggcaaggcggcggtggcggctggctcggcgacaacgacctgaacaaggacaggctggacctgttctactggatgctggccgctctcagcgtgctcaacttcttctgcttcttgctgtgcgcgaggtggtacaacgccggcgtggatggctctgatgcagctgcctctggtcaggtggcagcagagggtgccgatggcaaggagatcatctgaacaactcaagaacactgaaactgtatatccgtatagatgtatgtatacatatatacattcctactgaaatagtcatcagaaaattaatgagcagctagaattgcaaaatattaacac

SEQ ID NO: 4551 - DNA, 2585 bp, Oryza sativa
gagagagagagagtagtcgacgagacgacatggagggtaggcccagccgcactatctttctttgctagcttcgcttgcttgctgctcctttcggcagttcattcacaagagcagaagcgatctgtgctgctgctgctgctcatcatgtagcagaattaattaaaggggcttaattaattgctgggataatcacgatcggattcagcatcagcagcagcctataaataaagcctccagctcacaggtcgcaacttgccatataccacacctaagctagacagacagcaacaagaaagcagagagacagaggtagagaggcttagagagctattgacgtgcaattcttgtgcgcgttcgcggcaatggatgtggagagctgcgcgtcgtcgtcgccgccgccggatgccgccgtcgactggcgcggccggccgtgcgagccgcgccgccacggcggcatgcgcgccgccgtcttcgtgctagggatccaggcgttcgagatcatggcgatcgcggcggtggggaacaacctgataacgtacgtgttcggggagatgcacttcccgctgtcgcaggcggccaacgtggtgaccaacttcgtcggcaccatcttcctactctccctcctcggcggattcctctccgactcctacctcggctgcttctggaccatgctcatcttcggcttcgtcgagctctcgggtttcatacttctgtcggtgcaagctcacctgccgcagctgaagccgccgccgtgcaacatggcggccacggacggcggctgcgagcaggcaaggggcatcaaggcgagcatcttcttcgccgcgctctacctcgtggcgctcggcagcggctgcctcaagcccaacatgatcgcgcacggcgccgaccagttcgcggccgcggccggcggcggcggcgccgccgcggcggacaatgccaagaggctctcgacctacttcaattcggcctacttcagcttctgcgccggcgagctcgtcgcgctgacggcgctggtctgggtgcagacgcactccgggatggacgtcgggttcggcatctccgccgccgccatggcggccgggctcgtcagcctcgtctccggcgccgccttctaccggaacaagcctcctcagggcagcatcttcacgcccattgcaagggtgtttgttgccgcctacaccaagaggaagcaaatctgcccttccagctcctccgatcccgtcaatgccggcgtttgcgagccggcgcacctcgccggcggcagcttccgccacgccagcaagttcaggttcttggacaaggcgtgcatcagggcggcggagcaggggccgaacacgaagccggagagcccgtggcggctgtgcacggcggccgaggtgcggcaggccaagacgctcctcgccgtggcgcccatcttcgcgtgcaccatcgtcttcaacaccgtgctggcgcagctgcagacgttctcggtgcagcaggggagcgccatggacaccgcgctcggcggcgccggctcctcgttccgcatcccgccggcgtcgctgcaggccatcccctacgccatgctgctggcgctcgtcccggcgtacgagctcctcctcgtcccgctcatgaggcgcgccacaggggcgcggtccgggatcaccccgctccagcggatcggcgtgggcctctgcaccgtgccgctctccatggtcgccgccgccaccgtcgagcacaggcgccgcgacctgtccctgtccgccggcggcgcgccgccgcgggcgatgtccgtgctgtggatcgtgccgcagttcctcgtgttcggcgtgtcggagatgttcaccgccgtggggctcatcgagttcttctacaagcaggcgcgcggcgccggcatgcagtccttcctcacggcgctcacctactgctcctacgccttcggcttctacctcagctcggtgctcgtgtcgctcgtgaaccgtgtcacggcgagccgcggcggcggcggccatggcgggtggctcggcgacaacgacctggacaaggacaggctggacctcttctactggatgctcgccgtgctcagcgtgatcaacttcttctgctacctgctctgcgcgaggtggtacaactccggcggcgccgacgacggctgcgacgcctccgcctccgctcaggtcgccgccgaaggcgacggcaacggcaaggagatcatctgaagaaaaaaaaacatagaattataattctatgcgactgaaaactgtatatgcgtatagctgtaatgtatgtatgtatgtatgtatgtatgtatgtatgtatgtatgtatgtatacatgcacgaggaatagtggcaagaaatgaagaaaatgagtaatgctaggttgaaattataaggctctactttgataaggaataggaaatacattatgctttgccttggagacgaacgtagcaggagtactactatttagaaaaacttaatttgaccattaagcatgcagtgaaatgatgaattaagatttgtaagaaaaatatttgagacggcagctctttaaagagagtgaaaccaacaatttcagagttttcatgttcagtatgcaacaggc

SEQ ID NO: 4552 - DNA, 1698 bp, Secale cereale
aggcgttcgagatcatggcgatcgcggcggtggggaacaacctcatcacgtacgtgttcggggagatgcacttcccgctgtcggaggcggccaacgtggtgaccaacttcgtgggcaccatcttcctcctctccctcctcggcggcttcctctccgactcctacctcggctgcttctggaccatgctcaccttcggcttcgtcgagctctcgggcttcatactactgtcagtacaagcgcaccttccgcagctgaagccgccgccgtgcaacatggcgtccatggacggcagctgcgagcaggccaggggcttcaagtccagcatcttcttcgtcgcgctctacctggtggcgctcggcagcggctgcctcaagcccaacatgatcgcgcacggcggcgaccagttctccggctccggcggggccgacaatgccaagagcctctccacctacttcaactccgcctacttcagcttctgcctcggcgagctcgtcgcgctcacggcgctcgtctgggtgcagacgcactccgggatggacgtcggcttcggcatctccgccgccgccatggccgccgggctcatcagcctggtgtccggcgcggccttctaccggaacaaacctcctcagggcagcatcttcactcctattgcaagggtgttcgtcgcctccttctccaagaggaagcaaatctgccctaccaatcccggcaacgccggaattggcgagccggcgcgcctcgccggcagcttccgccacggcaacaaattcaggttcttggacaaggcgtgcgtcagggacgcggcgcagcagcagggggccaacacgaagccggagagcccgtggcggctgtgcacggtgtccgaggtgcagcaggccaagaccctcctggccgtgacgcccatcttcgcctgcaccatcgtgttcaacaccgtgctggcgcagctgcagaccttctcggtgcagcagggcagcgccatggacaccgtcctcgggggcgccttccgcgtcccgccggcgtcgctgcaggccatcccctacgcgatgctcctcctgctcgtcccggcgtacgagctcctgctcgtgcccttcatgaagcggctcacggggacgcgctccgggatcaccccgctgcagcgcatcggggtcggcctcggcaccgtcgccttctccatggtcgccgccgccaccgtcgagcgccggcgccgagacctgtcggcgtccggggcgcagatgtccgtgctgtggatcgtgccgcagttcctcgtgttcggcgtgtcggagatgttcaccgccgtggggctcatcgagttcttctacaagcaggcctgcgccggcatgcagtccttcctcacggcgctcacctactgctcctacgccttcggcttctacctcagctccgtgctggtgacgacggtgaacagggtgacggcgaggcacggcggcgccggctggctcggcgacaacgacctcaacaaggacaggctggacctcttctactggatgctcgctgcgctcagcgtgctcaacttcttctgctacctgatctgtgcaaggtggtacaattctggtgccgatggctctgatgctgcctcagctcagattgcagcagagggtgatgccaaggagatcagctgaagaccaactacatgcagactgaacctgtatatgcgtatagatatatgtagaaatgcatgaa

SEQ ID NO: 4553 - DNA, 3113 bp, Sorghum bicolor
cccgagtccaacaccgagacgacgaggttgggcgtcagagagctagcggagcatacagaggaggatccggggtatgctgtatgcacctggaaattcctatgtgaaagggagggtaggcccggccgcactacactacgctacccacctgccgcgcgcggctctctttcctttcggcgttcaaaagtggcgctggcgctggcgctgcgtgcgtgcgcggccgtgtgtagcgggttaccgagcagcagcagggcgcaggcctctgcagcccaaatcacatgcgcgcctgccctgcctcctcacctcatcacactgcatgccactgcctttccatgtcgtccgtccggcgtcctcctcttcttctataaataaagcccacccatcataggcaacctgacaacctgcatgcgccattgcctccgactccgagctcgctagtcgctaccaccacctaccacgcacgaggcacgaccacacggccggcggactgccttgttgactactagtactagttgacttgtgtcggacggatcggagatggacgtggagatgagctgcgcggcggcggtctccgtggactggcgtggccgcccgtgccggccgcggcggcacggcggcatgcgcgccgccgtcttcgtcctaggcatccaggcgttggagatcatgtcgatcgcggcggtggggaacaacctcatcacgtacgtgttcggggagatgcacttcccgctgtcgcaggcggccaacgtggtgaccaacttcgtcggcaccatcttcctcctcgccctcctcggcggcttcctctccgactcctacctcggctgcttctggaccatgctcatcttcggcttcgtcgagctctcgggcttcatactcctgtcactgcaagcgcacctgccgcagctgaagccgccgccgtgcaacatggcgtcgtccacggacgtcggcggcggcggctgcgagaaggccagtggcttcaagtccaccgtcttattcctggcgctgtacctggtggcgctgggcagcgggtgcctgaagcccaacatgatcgcgcacggcgcggaccagttcgacggcggcgccgcccggaggctgccgacctacttcaacgcggcctacttcagcttctgtgcgggcgagctggtcgcgctcacggcgctggtctgggtgcagacgcactccggcatggacgtcgggtttggtatctcggcggtcgccatggcggccgggctcgtctgcctcgtgtccggcgccgccttctaccggaataagcctccgcagggcagcatcttcacgcccattgcaagggtattcgtcgctgccttcaccaagaggaagcaagtctgcccttccaactccaattctgtcaacgccggagcttgcgagccggcacgcctcgccggcaacttccgccacagcaacaaattcaggttcctggacaaggcatgcatcccggtagcgccgcaggggccgaacacgaagccggagagcgcgtggcggctgtgcacggcggcgcaggtgcagcaggcgaagacgctcctcgccgtgacgcccatcttcgcgtgcaccatcatcttcaacaccgtgctcgcgcagctgcagaccttctcggtgcagcagggcagcgccatggacacggcgctcccgccgggctccgggtccttccgcatcccgccggcgtcgctgcaggccatcccgtacgccatgctgctggcgctcgtcccggcctacgagctcctcctcgtcccgctcatgaagcgcgtcacgggcacccggtccgggatcaccccgctccagcggatcggcgtcggcctgggcaccgtcgcgttctcgatggtcgcggcggccgacgtcgagcgcaggcgccgggtcgccgccgcggagggccgccagatgtccgtgctgtggatcgtgccgcagttcctcgtcttcggcgtgtccgagatgttcaccgccgtggggctcatcgagttcttctacaagcaggcgtgcgccgccggcatgcaggccttcctcacggcgctcacgtactgctcctacgcgttcgggttctacctcagctcggtgctcgtctcgctggtgaacagggtcacggcgaggcacggcggcggcgggtggctcggagacaacgacctgaacaaggataggctggacctcttctactggatgctcgccgcgctcagcgtgctcaacttcttcgtctacctgctctgtgcgaggtggtacaatgctggcgcggatggttgcgatgcacctgcctctgctggtcaggtggcgtcagaggttgatgatggcaaggagatcatctgaacaactcaacaagagattcagaaactgtatatctgtaattccgtctatagatgtatatgtatatatatacacatgcatgagaaatagtgaccaggaaatgagcactagttcagtaaaaaaagagagcactaggataaagctaagagctctgatttggcaaggaacagatcaataggatatacataggcaactttttctaatggacaaaacctctttttattactaattaattgatgttcaaaggctctccacgttaattctcacgtcacgagaccagttcgaagaaaaagaatcctaaaattcccatcaaaatcagaaagatctagctatggtaatctttacagggttgctagtgcccggacgtccgacgccagcaacacgtccaaacgctgaggctctcacccgcaccacacgaaaaaaaggaagtaggcagcgtccatacgcacgtcccagcctcccaggtagcgcttccccatcatgtcccattcctccaccgcatctcgttttctagttgcgcttctgactctgttcctcaaggcgctcttattgccattccccactgagctctcccttcctgttcccccactgcacccagttcctccacggcaccccgtcctccaccgtgccctgttccctcaatgggtcccgttccccatcgcgccccagtccctcgtccctaacacaacctgttcgcaagtgcaatataaaaatataaaaactacaacatcgtaaaaatatgtagtgtaacatcaacatcaaaaaacatgtacaacaacatcaaaaaatatgtattgcaacatcaaaaatta

SEQ ID NO: 4554 - DNA, 2337 bp, Panicum virgatum
tggtggtacgtgcgcgtagtgtggagcgggtcgccgggcagcagcccaatcacatgcctgctgcttcgtcctcctcctcggctcccctccgttgtcttcccccttgcttcctcctataaataacgcgccccggctgaccagcttgccatcgcctgcgcagcggatcgaccgtacctacctaccacacggccggattggactcgtgtctggcggaggagagggaagaaacaagctaagctaagatggatgtggagagccgcgcggcggagccggaggcggcggtcggcgccgtcgactggcgcggccgcccgtgccgcgcgcaccggcacggcggcatgcgcgccgccgtcttcgtcctagggatccaggcgttcgagatcatggcgatcgcggcggtggggaacaacctcatcacgtacgtgttcggggagatgcacttcccgctgccgcaggcggccaacgtggtcaccaacttcgtcggcaccatcttcctgctcgccctcctcggcggcttcctctccgactcctacctcggctgcttctggaccatcctcaccttcggcttcgtcgagctctcgggcttcatcctgctgtcgctgcaagcgcacctgccgcagctgaagccgccgccgtgcagcatggcggcgtccacgggcggcggctgcgagaaggcccggggcttcaaggccaccgtcttcttcctcgcgctctacctggtggcgctcggcagcggctgcctcaagcccaacatgatcgcgcacggcgccgaccagttcgacgccgccgcgccgggcggcgccggaaggctctccacctacttcaactcggcctacttcagcttctgcgcgggagagctcgtggccctcacggcgctggtctgggtgcagacgcactccgggatggacgtcggcttcggcatctccgcggccgccatggccgccgggctcgtcagcctcgtctccggcgccgcgctgtaccggaacaagcccccgcagggcagcatcttcactcccattgcaagagttttcgttgccgcctacagcaagaggaagcaagtgtgcccttccagctccaattctgtcaacgccggagcttgcgagccgtcacacctcgccggcaacttccgccacggcaacaagttcaggttcctggacaaggcatgcatccgggtagcaccgcaggggccgaacacgaagccggagagcccatggcggctgtgcacggtggcggaggtgcagcaggccaagacgctcctcgccgtgacgcccatcttcgcgtgcaccatcgtcttcaacaccgtgctcgcgcagctgcagaccttctcggtgcagcaggggagcgccatggatacctcgttcccgccgggctcctccttccgcatcccgccggcgtcgctgcagggcatcccctacgccatgctgctggcgctcgtcccggcctacgagctcctcctcgtgccgctcatgaagcgcgtcacgggcacgcgttccgggatcaccccgctccagcgcatcggcgtcggcctcggcaccgtcgccttctccatggtcgccgcggcggacgtcgagcgcaggcgccgcgacgccgccgcgaggggccaccggatgtccgtcctgtggatcgcgccgcagttcctcgtcttcggcgtgtcggagatgttcaccgccgtggggctcatcgagttcttctacaagcaggcgtgcgccggcatgcaggccttcctcacggcgctcacctactgctcctacgcgttcgggttctacctcagctccgtgctcgtctcgctggcgaaccgggtcacggccaggcacggcggcggcggcggctggctcggcgacaacgacctgaacaaggaccggctggacctgttctactggatgctcgccgcgctcagcgtgctcaacttcttctgcttcctgctgtgcgcgaggtggtacaatgccggcgtggatggctctgatgcagctgctgcctccggtcaggtggcagcagagggtgttgatggcaaggagatcatctgaacaactcaagagcactgaaactgtatatccgtatagatgtatgtatagaactacagaagcctaagaaatagtcaccagaaaatgaacactaggttaaaatcagggctctcattaaagtacaatacgctagttctgcagtgaatcatatatactagaaacacagcgcggcgttgccgcgccttggccagtagaattcagtgtttgcctctcggagtaagtgcaacacatggaagcttgcagtattgatagtgagaaaagattagtgcacaagcattggaatggataatatgcataaacaggaattcacaatttaaaa

SEQ ID NO: 4555 - DNA, 2377 bp, Panicum virgatum
tatgagggcgtcggtgtggacctccaaatttttccggcgatgacggggtaggcccggccgcactagggggcgaggcgaggcgagctacctgccgcgccggctcccctttcggcggcgttcagaagtggtacgtgcgcgtagtgtggaggaggggggccttgccgggcagcagcccaatcacatgcctgcttcctcctataaataacgcgccccggctgaccaactcgccattgccctgcgcagcggatcggagctcgccgcagccaccgtacctaccacacggccggatttgactcgtgtcgggcggaggaagcaagatggatgtggagagccgcgcggcggcgccggaggcggaggacgtcgccgtcgactggcgcggccagccgtgccgcgcgcaccggcacggcggcatgcgcgccgccatcttcgtcctagggatccaggcgttcgagatcatggcgatcgcggcggtggggaacaacctcatcacgtacgtgttcggggagatgcacttcccgctgccgcaggcggccaacgtggtgaccaacttcgtcggcaccatcttcctgctcgccctcctcggcggcgtcctctccgactcctacctcggctgcttctggaccatcctcaccttcggcttcgtcgagctctcgggcttcatcctgctgtcgctgcaagcgcacctgccgcagctgaagccgccgccgtgcagcatggtggcgtccgcgggcggcggctgcgagaaggcccggggcttcaaggccaccgtcttcttcctcgcgctctacctggtggcgctcggcagcggctgcctcaagcccaacatgatcgcgcacggcgccgaccagttcgacgccgccgcgccgggcggcgccgggaggctctccacctacttcaactcggcctacttcagcttctgcgccggcgagctcgtcgccctcacggcgctggtctgggtgcagacgcactccgggatggacgtcggcttcggcatctccgcggccgccatggccgccgggctcctcagcctcgtctccggcgccgccttgtaccggaacaagcccccgcggggcagcatcttcacccccattgcaagagttttcgttgccgcctacagcaagaggaagcaagtgtgcccatccagatccaattctgtcaatgccggaggagcttgcgagccggcacgcctcgccggcaacttccgccacaacaacaagttcaggttcctggacaaagcatgcatccgggtagcgcagcaggggcccaacacgaagccggagagcccgtggcggctgtgcacggtggcggaggtgcagcaggccaagacgctcctcgccgtgacgcccatcttcgcgtgcaccatcgtcttcaacaccgtgctggcgcagctgcagaccttctcggtgcagcaggggagcgccatggacacctcgctcctgccgggctcctccttccacatcccgccggcgtcgctgcagggcatcccctacgccatgatgctggcgctcgtcccggcctacgagctcctcctcgtgccgctcatgaagcgcgccacgggcacgcggtccgggatcaccccgctccagcgcatcggcgtcggcctcggcaccgtcgccttctccatggtcgccgcggcggacgtcgagcgcaggcgccgcggcgccgccgcggggggccaccggatgtccgtcctctggatcgtgccgcagttcctcgtcttcggcgtgtcggagatgttcaccgccgtggggctcatcgagttcttctacacgcaggcgtgcgccggcatgcaggccttcctcacggcgctcacctactgctcctacgcgttcggcttctacctcagctccgtgctcgtctcgctggtgaaccgggtcacggccaggcacggcgtcggcggctggctcggcgacaacgacctgaacaaggaccggctggacctgttctactggatgctcgccgcgctcagcgtgctcaacttcttctgcttcctgctgtgcgcgaggtggtacaacgccggcgtggatggctctgatgcggctgcagcctccggtcaggtggcagcagagggtgttgatggcaaggagatcatctgaacaactcaagagctagcactgaaactgtatatccgtatagatgtatgtatagaactacagaagcctaagaaatagtcaccagaaattgagcactaggacaaaatcagggctctcattaaagtacaatacgctagttctgcagtgaatcatatagcttcaggcaactttatcaggtgacttcattgtatgtgtagtaaaaaacgaaattcaggccggacaacggtaacatggttattagaaaatgaggaactgatacagattccagacttgcaacgaatact

SEQ ID NO: 4556 - DNA, 2060 bp, Zea mays
gagggagagaagagagcgcgcgcgcgagctgagggaatggatgtggagatgagctgcgcggcgccggaggcggcggccgtccccgtcgactggcgcggccgcccgtgccggccgcggcggcacggcggcatgcgcgccgccgtcttcgtcctaggcgtccaggcgttcgagatcatggcgatagcggcggtggggaacaacctcatcacctacgtgttcggggagatgcacttcccgctgtcgcaggcggccaacgtggtgaccaacttcgtcggcaccatcttcctcctcgccctcctcggcggcttcctctccgactcctacctcggctgcttctggaccatgctcatcttcggcttcgtcgagctctcgggcttcatactgctgtccctgcaagcgcacctgccgcagctgaagcccgcgccgtgcgacatgtcgtccacggacggcggctgcgagaaggcgagcggcttcaagtcgaccgtgttcttcctggcgctgtacctggtggcgctgggcagcggctgcctcaagcccaacatgatcgcgcacggcgcggaccagttcgacgccgccaccccgggcggcgccaacagcctgcccacctacttcaactcggcctacttcagcttctgcgcgggcgagctggtcgccctcacggcgctggtctgggtgcagacgcactccggcatggacgtcggcttcggcgtctccgcggtcgccatggcggcgggcctcgccagcctcgtcgccggcgccgccttctaccgcaataagcccccgcagggcagcatcttcgcgcccgttgcaagggttttcgtcgctgccttcaccaaaaggaagcaagtctgcccttccagctccaattctgtcaacgccggggcttgcgagccggcgcgcctcgccggcaacttccgccacaacaacaaattcaggttcctggacaaggcatgcgtcccggcagcgccgcaggggccgaacacgaagcccggagaagcgcgtggcggctgtgcacggtggccgaggtgcagcaggcaaagacgctcctcgccgtgacgcccatcttcgcgtgcaccatcgtcttcaacaccgtgctcgcgcagctgcagacgttctcggtgcagcagggcagcgccatggacacggcgctcccgccgggctcgggctcgttccgcatcccgcccgcgtcgctgcaggccatcccgtacgccctgctgctggcgctcgtcccggcctacgagctcctcctcgtcccgctcatgaagcgcctcacgggcacccggtccgggatcaccccgctccagcgcatcggcgtcggcctcgccaccctcgcgttctcgatggtcgcggcggccgacgtcgagcgcaggcgccgggacgccgccgcggagggccgccagatgtccgtcctgtggatcgtgccgcagttcctcgtcttcggcgtgtcggagatgttcaccgccgtggggctcatcgagttcttctacaagcaggcgtgcgccggcatgcaggccttcctcacggcgctcacgtactgttcctacgcgttcgggttctacctcagctcggtgctcgtctcgctggtcaacagggtcacggcgaggcacggtggcgctgggtggctcggagacaacaacctcaacaaggataggctggacctcttctactggatgctcgccgtgctcagcgtgctcaacttctgctgctacctgctctgtgccaggtggtacaatgctggcgcacagggttccgatgcagctgcctctggtctggtggcatctgaggttgatgatcgcaaggagatcatctgaacaactcaggaagagattgaaactgtatatgtctaattccatctatagactatagctgtatgtatacatgcatgcatgagaaatagtgaccagaaaatgagcactaggataaaattaagacctctcatttggatcaataggatgtatagtgttttaggcaacttttttaacggagaaaacctctttctattacgaattaagtagaggttcaacataatctccacgtcgattctcacgtcacgagacgag

SEQ ID NO: 4557 - DNA, 1628 bp, Setaria italica
gccggtcaccggtcaccaccacaccctccccacccccacacactgcgtgtgcatgcactgagctgagaagatgagaacttggcggattccccccgacagctacgtgtcacccgcgcgcgccaatggacaatcagccatggccatcgcttgacccggcctgcctctgcctggttgcccatccgcccagccatccttcttgatatactccagcgcaccgagtcgagccgggcacagccacgcaccaccaccagcgccatccacggaagaacgagcacggcggccctgctcatgcatggtgcagcctattagctccccgccgccggcgacgacgacctccaccacatgttgcatgagcagcaggcaccggcagtagcagccgcagccgcagcagcgccgccgccagtgccatcggcgccgagcagtagccacgacgaggacggcgatgggggcgagggcgccgcgacgacgttccgcgacatccacccgctgacccccgacccgccgacgccactaccccccgcgcgcacgggctccgccgcgtcctgggacaccgccagccaccgctcctactcctccgaggagcagtacatgacgatgagccgcgagttcaccgccatggtcgccgccggggcgaccatgcagaccggccccaacgccaacagcggcggcgggtacgacaacggcgccgccgaccagctcaccagcatcggcgaggacgagctggaggagaccaacccgctggccatcgtgccggacagccaccccatcgcgacgccggccaggtccagggcgtccggcctggaggtggtgcccgcggggccgccgcccccgccaccggcgcacgtggaggccagccaggtgaagaaggaggaggtggagaccaaggtctcggcgtggcagacggcggaggtggccaagatcaacaaccgcttcaagcgggaggaggtggtcatcaacggatgggagaccgagcaggtggagaaggcatccgcctggctcaagaagatcgagaggaagcttgacgagcagcgcgccaaggcgttggagaagacgcagaacgacatcgccaaggcgcggcgcaaggcggaggagaagcgggcgtcggcggaggccaagcggggcctcaagctggccaaggtgctggagctcgccaacttcatgaaggccgtcgggagggtgcccaccaagcgctccttcttctagccgccgacccggcactcgcctcgccgtcccttcagttctccatcactaccggtgtgctcaacccctgctgctttgctgctgctccatcgaggcatcgatcatcatagctactagctagtagcaagcttgtgtgacgatgtatgccgctgcatccgagaaccctaattgtaaaaaagatttgtatacgatgtactgtcgccgcccatgtgatgcctgtgatccaccatccatcgcagcgcagagcggccgttcttctcttttttgtttggcttgtatatcgatccatccgtatggtgtttgagtgatctgtttgcgtaaccgtgcaaacattcagaaacccaacactgcaagagcttattacttgtgcagagaataggaccacatcactgcaatacctcaatacctcattcgtgattttcttgcct

SEQ ID NO: 4558 - DNA, 2018 bp, Panicum virgatum
gtcagcatctttgcagtacaaaaaggatcttatccggctacagcaagccgatcagctgtggcgcgccactgttacgatcaccgcgaggattaggcctcctcggggacacgacgatttacaagaaatttacataaatcaagccggttctagtaggttttatcaaagaatcctccatttcaaaaaactctcagcctcgaccagagacagtctagtctagtagtagtgttgcaacttgcaaactggaattgaaagtgtccagttgcagtcaaagaacattcgggcaatctgtcgatccaactaaacaagcgcccagttgcagcttgtccccaaactccaggtgcacgggaagccaggagcaccccacctcgccggtccccggtcaccacatcactgtgtgtgtgcatgcactgagatgagaacttgggcgattccctcgacagctacgtgtcacccgcgcgcgccaatggacaaggcctgccggaccccatcccatcagccatcagccatcagccatggccatcgcttgacccggcggcttcgtgcctgcgcgcccatcctcccttcccttcttgatatacaccgcaccgagccgagccgggcacgggcaccacgcaccagcaccacggcagcacgaacgacgcgtcctgctcatatgcatggtgcagcctagctccccgccgccggcgaccaccaccaccacatgttgcatgagcagcaggcaccggcagtagcagcagcagcgccgccgccagtgccttcggcgcccagcaacgacggcggcgatgccgcgggcggggacgagagcgccgcgacgttccgcgacatccaccctctgacccccgacgtgccgacgccccccgcgcgcacgacctccgccgcgtcctgggacaccgccagccaccgctcctactcctccgacgagcagtacatgacgatgagccgcgagttcacggccatggtcgccgccggggcgaccatgcagaccggccccaacgccaacggcagcgccggcggcggctacgacaacggcgccgaccagctcaccagcatcggcgaggacgagctggaggagaccaacccactggccatagtaccggacagccaccccatcgcgacgccggcaagatccagggcgtccgggctggaggtggtgcccgcggggccgccgccccagccggcgcatgtggaggctagccaggtgaagaaggaggaggtggagacgaaggtcacggcgtggcagacggcggaggtggccaagatcaacaaccgcttcaagcgggaggaagtagtcatcaacggatgggagaccgagcaggtggagaaggcatccgcatggctcaagaagatcgagaggaagctggacgagcagcgcgccaaggcggtggagaagacgcagaacgacatcgccaaggcgcggcgcaaggcggaggagaagcgggcgtcggcggaggccaagcgggggctcaagctggccaaggttctggagctcgccaacttcatgaaggccgtcgggagggtgcccaccaagcgctccttcttctagctagccggcgacccgtgtctcctccatcaccgcctgttccagccggccctgtgcctgtgtgtcctgaacctgtttgttgcttctgctccatcacgcctagctactagcacgtttgtgtgacgatgtatgcttctgcatccgagaaccctaattgtaaaaaagatttgtacgctgtatacgatgtactgtcgccgccctgcgatgcctgtgatccatcacggcacagagtggcttttttcttctctttttgttggcttgtatttgtatatcgatccatccgtatggtgcttgagtgacttgtttgcgtaactgtgcaaacattcagaaccccaacactccaagagctgctacttgtgcagagaataaaatctcgtaagagaacaagtgagaaatcggaaggcagatctcctttttttctagcattaaacctgggccacatcactgcaatatgtgaaggaatcagtttggacaatac

SEQ ID NO: 4559 - DNA, 1313 bp, Panicum virgatum
gaacgacggccctgctcatgcatggtgcagcctagctccccgccgccggcgaccaccaccaccacatgttgcatgagcagcgggcaccggcagtagcagcagcagcagcgccgccgccagtgccttcggcgcccagcaacgacggcggcgatgccgcgggcggggacgagggcgccgcgacgttccgcgacatccaccctctgacccccgacgtgccgacgccccccgcgcgcacggcctccgcgtcctgggacaccgccagccaccgctcctactcctccgaagagcagtacatgacgatgagccgcgagttcacggccatggtcgccgccggggcgaccatgcagaccggccccaactccaacggcagcgccggcggaggcggctacgacaacggcgtcgaccagctgaccagcatcggcgaggacgagctggaggagaccaacccgctggccatcgtgccggacagccaccccatcgcgacgccggccaggtccagggcgtccgggctggaggtggtgcccgcggggcccccgcccccgccggcgcatgtggaggccagccaggtgaagaaggaggaggtggagaccaaggtcacggcgtggcagacggcggaggtggccaagatcaacaaccgcttcaagcgggaggaagtagtcatcaacggatgggagaccgagcaggtggagaaggcatccggatggctcaagaagatcgagaggaagctggacgagcagcgcgccaaggcggtggagaagacgcagaacgacatcgccaaggcgcggcgcaaggcggaggagaagcgggcgtcggcggaggccaagcgggggctcaagctggccaaggttctggagctcgccaacttcatgaaggccgtcgggagggtgcccaccaagcgctccttcttctagccggcgacccggcaggccttcgccgtccctgctccaccaccgcctgttctagccggccctgcgcctgtttgtcctgaacctgttgctgctgctgctccatcacgcctagctagtagcacgtttgtgtgacgatgtatgcttctgcatccgagaaccctaactgtaaaaaggatttgtacgctgtatacgatgtattgccgctgctttgtgatgcctgtgatccatcacggcacagagtggcttttttcttctcttttttgttggcttgtatatcggatccatccgtatggtgtttgagtgacttgtttgcgtaactgtgcaaacattcagaaccccaacactgcaagagctgctacttgtgcggagaataaaatctcgtaagagaacaagtgacaaatcgga

SEQ ID NO: 4560 - DNA, 2326 bp, Panicum virgatum
cggctacagcaagccgatcagctgtggcacgccactgttaagctcaccgcaaggaccaggagttagccgccctctggaacacgctagctagttttacaagaaatttacataaatcaagccgaatccagtaggatttagcaaagaatcctccatttcgaactcacaccctacgagcctaaccttgaccatagtctagtagtgttgcaacttgcaaactggaactgaaactgtccagttgcagtcaaggaacattcgggcaatctatcgatccaacaaaacaagcgcccagttgcagcttgtccccaatctccaggtgcacaggaagccaggacaggagcaccccaactcgccggtcaccggtcaccaccacaccccggaaggccggccccccatactctgtgtgactgtgtgcatgcactgagatgggaacttggccgattcccccgacagctacgtgtcacccgcgcgcgccaatggacaaggccttgtgccggacccccatcccatcagccatggccatcgcttgacccggccggcttcgtgcctgctcgcccatcctctcccttcttgatatacatacaccgcagtccgcaccgagcacgggcaccagcaccacggcagcacgaacgacggccctgctcgtgcatggtgcagcctagctccccgccgccggcgaccaccaccaccaccacatgttgcatgagcagcgggcaccggcagtagcagcagcagcagcgccgccgccagtgccttcggcgcccagcaacgacggcggcgatgccgcgggcggggacgagggcgccgcgacgttccgcgacatccaccctctgacccccgacgtgccgacgccccccgcgcgcacggcctccgcgtcctgggacaccgccagccaccgctcctactccaccgaagagcagtacatgacgatgagccgcgagttcacggccatggtcgccgccggggcgaccatgcagaccggccccaactccaacggcagcgccggtggaggcggctacgacaacggcgtcgaccagctgaccagcatcggcgaggacgagctggaggagaccaacccgttggccatcgtgccggacagccaccccatcgcgacgccggccaggtccagggcgtccgggctggaggtggtgcccgcggggcccccgcccccgccggcgcatgtggaggccagccaggtgaagaaggaggaggtggagaccaaggtcacggcgtggcagacggcggaggtggccaagatcaacaaccgcttcaagcgggaggaagtagtcatcaacggatgggagaccgagcaggtggagaaggcatccggatggctcaagaagatcgagaggaagctggacgagcagcgcgccaaggcggtggagaagacgcagaacgacatcgccaaggcgcggcgcaaggcggaggagaagcgggcgtcggcggaggccaagcgggggctcaagctggccaaggttctggagctcgccaacttcatgaaggccgtcgggagggtgcccaccaagcgctccttcttctagccggcgacccggcaggccttcgccgtccctgctccaccaccgcctgttctagccggccctgcgcctgtttgtcctgaacctgttgctgctgctgctccatcacgcctagctagtagcacgtttgtgtgacgatgtatgcttctgcatccgagaaccctaactgtaaaaaggatttgtacgctgtatacgatgtattgccgctgctttgtgatgcctgtgatccatcacggcacagaggggcttttttcttctcttttttgttggcttgtatatcggatccatccgtatggtgtttgagtgacttgtttgcgtaactgtgcaaacattcagaaccccaacactgcaagagctgctacttgtgcggagaataaaatctcgtaagagaacaagtgacaaatcggaaggcagatctcctttttttttctagcattaaacctgggccacttcaccgcggcaatatgtgaagggatcagtttggacatacggttttcttgcgtttcccctaccgtctgcatagaatcatcacaatgattggtgcattaacgtctgatcatcatcccgtatcatgatcagaagctactactgttcctacatgcctatttaggcatctttcaagaaccatcacaagttctcatgtctctgaacatggcattagctgtcaggctcaggcgtcatggcgaccgatgaagaacggcatggcgacttcgagaaccaggacagcgagctcctcctcgccctcgtctgcacgtcggccgatcaatcgatttacccttttcctcatgacaagg

SEQ ID NO: 4561 - DNA, 1440 bp, Panicum virgatum
catcgcttgacccggcggcttcgtgcctgctcgcccatcctcccttcccttcttgatatacaccgcaccgagccgagccgggcacgggcaccacgcaccagcaccacggcagcacgaacgacgcgtcctgctcatatgcatggtgcagcctagctccccgccgccggcgaccaccaccaccacatgttgcatgagcagcaggcaccggcagtagcagcagcagcgccgccgccagtgccttcggcgcccagcaacgacggcggcgatgccgcgggcggggacgagggcgccgcgacgttccgcgacatccaccctctgacccccgacgtgccgacgccccccgcgcgcacgacctccgccgcgtcctgggacaccgccagccaccgctcctactcctccgacgagcagtacatgacgatgagccgcgagttcacggccatggtcgccgccggggcgaccatgcagaccggccccaacgccaacggcagcgccgggcggccggctacgacaacggcaccgaccagctcaccagcatcggcgaggacgagctggaggagaccaacccactggccatagtaccggacagccaccccatcgcgacgccggcaagatccagggcgtccgggctggaggtggtgcccgcggggccgccgcccccgccggcgcatgtggaggctagccaggtgaagaaggaggaggtggagacgaaggtcacggcgtggcagacggcggaggtggccaaaatcaacaaccgcttcaagcgggaggaagtagtcatcaacggatgggagaccgagcaggtggagaaggcatccgcatggctcaagaagatcgagaggaagctggacgagcagcgcgccaaggcggtggagaagacgcagaacgacatcgccaaggcgcggcgcaaggcggaggagaagcgggcgtcggcggaggccaagcgggggctcaagctggccaaggttctggagctcgccaacttcatgaaggccgtcgggagggtgcccaccaagcgctccttcttctagctagccggcgacccgtgtctcctccatcaccgcctgttccagccggccctgtgcctgtgtgtcctgaacctgtttgttgctgctgctccatcacgcctagctagtagcacgtttgtgtgacgatgtatgcttctgcatccgagaaccctagttgtaaaaaagatttgtacgctgtatacgatgtactgtcgccgccctgcgatgcctgtgatccatcacggcacagagtggcctttttcttctctttttgttggcttgtatatcgatccatccgtatggtgcttgagggacttgtttgcgtaactgtgcaaacattcagaaccccaacactccaagagctgctacttgtgcagagaataaaatctcgtaagacaacaagtgagaaatcggaaggcagatttccttttttttt

SEQ ID NO: 4562 - DNA, 1360 bp, Pennisetum glaucum
acagccacgcaccaccagcgccatccacgggaagaacgagcactgcggcggcccctgctcatgcatggtgcagcctgttagctccccgccgccggcgacgacgacctccaccacatgttgcatgagcagcaggcaccggcagtagcagccgcagccgaagcagcagcgccgccgccagtgccgtcggcgccgagcagcagccacgacgaggacggcggcgatggtggtggggtcgagctcgccgcgacgacgttccgcgacatccaccctctgacacccgacccgccgacgccgaggccgccgccccccgtgcgcaccggctccgccgcatcctgggacaccgccagccaccgatcctactcctcctccgacgagcagtacatgacgatgagccgcgagttcacggccatggtcgccgccggggcgaccatgcagaccggccccaacgccagcggcggcggcggctacgacaacggctccgccgaccacctaaccagcatcggcgaggacgagctggaggagaccaacccgctggccatcgtgcccgacagccaccccatcgccacgccggcgaggtccagggcgtccgggctggaggtggtgcccgcggggccggcgccgccccagccgccggcgcacgtcgaggccagccaggtgaagaaggaggaggtggagaccaaggtcacggcgtggcagacggcggaggtggccaagatcaacaaccgcttcaagcgggaggaggtggtcatcaacggctgggagaccgagcaggtggagaaggcatccgcatggctcaagaagatcgagaggaagcttgacgagcagcgtgccaaggcgttggagaagacgcagaacgatatcgccaaggcgcggcgcaaggcggaggagaagcgggcgtcggcggaggccaagcggggcctcaagctggccaaggttctggagctcgccaacttcatgaaggccgtcgggagggtgcccaccaagcgctccttcttctagccgccgccgccgacccggcacctcgcctcgccgtcccttcagttctccatcaccgccggtgtgctcaacccctgttgcttttctgctgctccgacgaggcatcgatcatcgtagctacagtagctagtagcacgctctgtgtgtgtgacgatgtatgccgctgcatccgagaaccctaattgtaaaaaggatttgtgtacgccgccctgtgatatgatgcgtgcgatccaccatccatcgcagtgcagagcggccgtttcttcgctttttgcttggcttgtactgtatatcgatccatccgtacgctgtttgagtgatctgtttgcgtaactgtgcaaacattcagaaacccaacatttgc

SEQ ID NO: 4563 - DNA, 1310 bp, Solanum phureja
gtgacagcagagataataggtggaaaagttttttcaaaatacttcaactggtgctagcttctcttctctgtctcttcctggagacgaaaaaggtaggttttggaggtgtatagttatattgtctgattctgcaacatggacagtatgaacagctattggcaattcggggatgagcttcgaggacaatcaaaagtatcggaagatcatacatggacagcaggtgctgtaaaattggctgagcagttaaggtccaagggtgagcggaggaataaccttgacctttcgaaaggctcagctgaaagtaggtccagggattatcttggtttacaggaagataacaagtggggaaacctatacttcaacatgttgaatattgataccaagataactgacaatacgaccaagagctccttcaggaatgacatttacaacattaattctgtttgtccgaaatccaatgtcaacagcttgggaaatacgtcatttagcaagttcaatagtaaccacacgaatgacacttgcaactatggcaataacaacaacactgagagtatcaatgggaataatgctgttgacaaaaggtttaagactttgcctgctgctgagacactgcccaggaatgaggttcttggtgggtatatctttgtttgcaacaatgacacaatgcaggaagacttaaagcgccagctgtttggtctacctccaaggtacaaagattctgtgagggcaataactccagggttaccgttgttcctctacaattacactactcaccagttgcatggtatcttcgaggcagcaagttttggaggttctaacattgatccaactgcttgggaagataaaaagtgtagaggagagtcgaggttccctgctcaggtgaggatccgtgttaggaaacttggtaaggctttggaggaagatgcttttagaccagttctgcatcactatgatggacccaaattccgtcttgagctttctgtgcctgagactttggacttgctggatctctgtgaaaataccagtgcgtaagcgccagtctgaagtcatggatttattagcatacattataaactcgtgaatgttgtagtttatgtattagaaacgtgttctccacagatttccaaagcacaagttttggtgtaaagtctggctgagagagattctgaatagcagggttggctaatttagccaatgaagtgtgattttctttggagatgcttgaatatgagcttcccaaatttaatgttgtgttcttacaatgaattagagaagtaatgatcgggtgaaagattgaacgtcttttttca

SEQ ID NO: 4564 - DNA, 1260 bp, Solanum melongena
aaaaatacctggagctagtgtgctagcttctcttcgggagaaaaagattttggaggtgtatagttaaattgtctgattctgcaacatggagaagatgaacagctattggcaatttggggatgagcttcgaggacaatcaaaagtaccggaagatcatacatggacaacagctgctacaaaattggctgagcagatctggtccaagggtgaaaggaagaataaccttgacctttcgaaaggctcagctgaaaataggtccagggattatcttggtttacaggaagataataagtgggaaaacctaaacttcaacatgttaaattttgataccaagataactgagaatatgaccaagagttccatcaggaatggcatttacaacattaattctgtttgtccaaaacccaatgtcaacagcttgggaaatatgtcattaagcaagttcagtagcaaccagatgaatgtaccttgcgactatggcaataacaacaacactgagagcaccaatgggaataatgctgttgacaaaaggtttaagactttgcctgctgctgagatactacccagaaatgaggttcttggtgggtatatatttgtttgcaacaacgacacaatgcaggaagacttgaagcgccagctgtttggtctacctccaaggtacaaagattctgtgagggcaataacaccagggttaccgttgttcctctacaattacactactcaccagttgcatggtatcttcgaggcagcaagttttggaggttctaacattgatccaactgcttgggaagataaaaagtgtaaaggagagtcgaggttccctgctcaggtgaggagccgtgtcaggaaacttggtaagcccttggaggaagatgcttttagaccagttttgcatcactatgatggacccaaattccgtcttgagctctctgtgcctgagactttggacttgctagatctctgtgaaaaggccagtgcgtaagcgccagtctgaagtcatggattgattggcatattataaactcatgaatgtttagtttagtagtatttttcactgtatcagaaacgttgttctccaaagatttccaaagcacaagctttggtgtaaagtctggctgagagaagttctgaatagtagagttggctaatttagccaatgaagtgtgattttctttggagatgcttgaatataagcttcccaaatttagtgttgtgaacttgtgatcttacaatgaactgagagaagaaatgattgggtgg

SEQ ID NO: 4565 - DNA, 1193 bp, Triticum aestivum
caggccggcgatgtcccactcctccgccttcctcctcccctcctccgcaaccccagccgcctcagcggacgcgtacgcggtcgtcgtcctcaaccagcgcctgccccgcttcgcccctctcctctgggaccgcgcgcaggtgcgggtgtgcgccgacgggggcgctaatcgcgtgttcgacggcatgccggagctgctccccggccacgaccgcgacgatgtgcgctccagatacaaaccagatgtaatcaaaggggatatggattcagtgcgaccagaagtgaaggaatattattccaatttgggcaccaaaatagctgatcaatcacacgatcaggacaccaccgacttgcacaaatgtgtagcatttatcactgacaattctcctggctcagacaaatcgaatctatgcatccttgtcctcggagcactaggaggtaggtttgatcacgagatgggaaacatcaatgtactccatctcttcccaaacattaagatcgtcctcctatcagatgattgcctgatctttctgctcccaagaacgcacactcacaacatccacattgaacggtcagttgagggcccccactgtgggttgattcccgttggcgcaccttcgactagcaccacgaccaccggactccggtggaatttagataatactcatatgagcttcggtggattgattagcacatcgaacatagttgatgaggaccaggttatggtcacttcagattctgacctgatctggacaatatctctccggcactgagtttttcgatgcatttcctaattggacaatacttgtatgagctacggtcgattgattagcacatcgaacatcgttgatgaggaccaggttatatgcgcttcagattctgacctgatttggacaatatctctccggcaccgagcttatgctacacagaacgtttgagctatcgccaattgtatcatctaatttatgtctatgaccactacatccagcagtgacgtgatacattctggcgtgttagaatttcaaaccttgtaaattttcaatttgtaatttggtagctttggcaattaaatatatttgcccccgcatagaaaaaatggcggtgtgcctgtcaaaatatatatttgttaataggttgtgaaaatacagtggcgcagtttgtgggttactcgttcaagcaaacttctctttttac

SEQ ID NO: 4566 - DNA, 1881 bp, Secale cereale
tgcaacttcagcgagcacgctccctgtcccacacggagccacatcaccctcggcgcgctccgacggccgccatggatcccccgtcgccagcgacagcgaggccggcgatgtcccactcctccgccttcctcctcccctcctccgcaacccccgccggctccgcggacgcgtacgcggtcgtcgtcctcaaccaacgcctgccccgcttcgcccctctcctctgggaccgcgcgcaggtgcgggtatgcgccgacgggggcgctaatcgcgtgttcgacggcatgccggagctgctccccggccacgcccccgacgatgtgcgctccagatacaaaccagatgtaatcaaaggggatatggattcagtgcgaccagaagtgaaggaattttattctaatttgggcaccaatatagttgatcaatcacacgatcaggaaaccactgacttgcacaaatgtgtagcatttatcactgacaattcacctggccccgacaaatcgaatctatgcatccttgtcctcggagcactaggaggtaggtttgatcacgagatgggaaacatcaatgtactccatctcttcccaaacattaagatcgtcctcctatcagatgattgccttatctttctgctcccaagaacgcacactcacaacatccacattgaacggtcagttgagggcccgcactgtgggttgattcccattggcgcaccttcgactagcaccacgaccaccgggctccggtggaatttagataatacgcatatgagcttcggtgaattgattagcacatcgaacatcgttgatgaggaccgggttatggtcacttcagattctgacctgatctggacaatatcgctccggcattgagtttccgatgcattttctcgtcagacaatacttgtatgcgctacgatggattgattagcatgtcgaacatcgttgatgaggaccaggttatgatcgcttcagattctgacctgatttggacaatatctctctggcaccgagtttatgctacgcagaacgttggagctatcgccaattttatctcatctaatttatgtctatgacataaactctggtgtgttagaatttcaagccttgtaaaattttaatttgtaatccggtagttttggcaattaaatatatccccccccccccccccccccaaacaaagcgcagtgtgcgtgtaacaaatatatattaccttccttccgttactaatatagttcgttggagagtacttccactagtggtactacagtaacgaacgaacaaaggttgggtacataccgtacgcctaataaaatgttcgtactatatactacgttaccgtagttggtttaagtttagtaggtaagtaaacttaccttaaaaaacctttaaaaaaaactttagtttaaggtttaaacggggaaacggggagggtatttagttttaggttaagttaggttgtaaagtaaactacgtaggtgggcggttcggtttgggttagggttaccttcgttacgaagaacctaacttcttcgtttagtacacctacccgttcgtagttaccgtttcgttacgttccgtaggttagtttcgactattacttacttactttacgaggactctactaactaccctaaacgtacgaacccaacgaacgacccaacaaggacgacgacgtactacctaactacctaagtacgaccgaccgtccttacctagtggtaggtttacgttaagtacttccgttcggttacgtaggtaagtagtttaggtttttgtttagttttttagtttttttttaggttagggttagttttggttttgtttttggtttaggttagttaggttagtacgtagtattacttagatctacaagcgtagtacc

SEQ ID NO: 4567 - DNA, 1506 bp, Setaria italica
tcacgccagcacgccgcgcgcgacgacccttgaaggctcgagctttgacaccggacgcccgcgccgacgacccggccgaccatggctctcgctcccacgccacctccgccggcgccgcagcggccgacgatgcggcactcctcagcgttcctccttcctctgccgtcctcctcctcctcgcccgcgcctggcggcggccccgccgacgccagcgtcgcgctcgtcgtcctcaaccagccgctgccccgcttcgcgcccctcctctggtcccgcgcggcggtaagggtgtgcgcggacggcggcgccaaccgcgtcttcgacggcatgccggagctgctccccggccaggacgccgtcgaggtccgcgagaggtacaagccagatgtaatcaaaggggatatggactcagtacgaccagaagtgaaggaatattattccaacttgggcaccaaaattgttgatgagtcacacgatcaggacaccactgatttacacaagtgtatagcttttatagctaagaattcacctgttgcaggcaaatctaacatctgcatccttgtccttggtgccttaggaggcagatttgaccatgagatgggaaatatcaatgtgcttcatctcttcccaaacatcaatatcgtcctcctatcagatgattgtctgatctttctgcttccaagaacacacagccatgagatccacattgaacgatcaatcgaaggcccccactgtgggttgatcccaattggcatgccatcgacaagcaccaccaccaccggactccggtggaatttagataataacagtatgagctatggaggattgatcagcacgtcaaacatcgtggaggaggacaaggtgacagttacctctgattctgaccttatctggacaatatcgctccagaaatgaatattcagagtaggattatctgtaccaatccaaggttcctattttgtctcgtgtttcacaccacggagatgtacctgactaccacgagcagataggacaatatattccgttgccttcaatgttgcaaacctgatgtagagttaatatatgtaatttggcagttctggtaacaagatatggctgtgcttgcaaaaagttcaactatgtgtaatgggctgttgaaatatctgacgtgccaagaactggtttcccaaatactcatccaagcaatgctctcttcttcacagaatgaggtcaggggtgagattttcatatgaacactatgatactatatcatatatgttatgacgatctgatctcatccgaaaatcaataattacatttttttttccactgggacatttctcaaataatatcatcttggaaatttctttcgacatcaggaaaaaggccatgagattttctgccagggacatgaagaatacgagaacaatttccatctgaaactgaaacagagtcagttatccgaagttgcatgaccttgtgtatcttgtacatacatcatgcaaaagtattttcacaatgtataacttt

SEQ ID NO: 4568 - DNA, 1328 bp, Oryza sativa
cccattcaacacgccagctcgcacgaccgcgacgagcccacgactcgcaagtcgcaccctccccgaccccgatcggcgcgaagccacccacttccagccctcgccgtcgccgcgccgccgccgccgccgccatggccccgaggccggccatgtcccactcctccgccttcctgctgccctcgccgtccgcggcggcggcgggcgccgacgccgacggcgccgcctacgcgctcctcgtcctcaaccagcgcctgccccgcttcgcgccccgcctctgggaccgcgcgcaggtgcgggtgtgcgcggacggcggcgccaaccgggtgttcgacggcatgccggagctgtttcctggacaggaccccgacgaggttcgccgcagatacaaaccagatgtaatcaaaggagatctggactcagttcgaccagaagtgaaggaatattattccaatatgggtactcaaatagtcgatgagtcacatgatcaggacaccaccgatttacacaaatgtgtagcttttatcactgagaattcggccatccccaacaaatctaatctgtgtatctttgctcttggggcccttgggggaaggtttgaccacgagatgggaaacatcaacgtacttcatctcttcccaaacaacaggatcatactcctatcggatgattgcttgatctttctgctgccaagaacacacactcataacatccatattgaacggtctattgaggggccccactgtggattgattcccatcggcgcgccttcggccaccaccacaaccactgggcttcaatggaatttagataataccagcatgagctttggtggacttattagcacatcaaacattgtgagagaggagagtactgttgttacgatcacttcagattctgacctgatttggacaatatcgctccggcaccactcttgaaatacgtaacacaattgtatcatagttccaattttgtctcatctattttacgtcgttgagttctacccttagtagaagagtgaaaacatacatggcatctgatgtggctaaacctggtgaaatgttaatatgtaacttagaggacttggcacgtctctaaatatataccttgcactgtaattgcacaattttttttttttgtaaacatgtcaccaaattacctgtaatgtaaagaaccagttgtatttgttaagcaaactccatattttcgcttatttgtggttttgtattcaggaaattctacactgacaacacaagttcaaattttcgttcatttgtggttttgtactcaggaaattctacactggcaacgcatggtaagagtgaggcacg

SEQ ID NO: 4569 - DNA, 1076 bp, Panicum virgatum
ccccacgccctccttcccaccgaccaccaccgcccccgccgacgaccaccatgccgctgccggcgatgacccactcctccgccttcctcctccccgcctcgactactcccccgcccaacgacgccgccacgacctacgcgctcgtcgtcctcaaccagcgcctcccccgcttcgcgccactcctctgggcccgcgcgcgcctgcgcgtgtgcgcggacgggggcgccaaccgcgtcttcgacggcatgccggagctgctgccgggcgaggaccccgccgatgtccgcgccaggtacaagccagatgtaataaaaggggatatggactcaataaggccagaagtgaaggaatattattccaatttgggcacaaacatagttgatgaatcacatgatcaggacacaacggacttgcacaaatgtgtatcatttgtcacaagagagctccctgtcccagacaagtctaacctgtgtatacttgttcttggtgcacttggtggaaggttcgatcatgagatggggaatatcaatgtattataccgtttctcaaacaccaaaattgtcctcctgtcagatgactgttcaatctttctgctccccaagacgcatactcacgagatccatattgagaaatcggtcgaaggtcctcactgtggcttgattcccattggtggaccgtcaactagcaccacaacaactgggcttagatggaatttggataacaccagtatgagctatggtggactggtaagcacatctaacattgtggatgatgataaaataactgtgacttcagattctgatctgatttggacgatatcacttcggaattgagctgaagtagtgataatttagcatggttccatgcccaaattttgtcacctcagtgttatatgagttgagttgagttgagttcatattctgtaacgtagtgtgatgtttgtctcccactgcattttgcagctggattggtgtccatatgtgtcatgttctgggcttctggttcataattgagggttccactttatgaagtcctctactgaatgcctctgatctattcaactcaactgtttcggc

SEQ ID NO: 4570 - DNA, 1407 bp, Panicum virgatum
ccccaccaagccagcgagcgcgacgggacaaggaaaaaggcgaagctgacctctcgtttcgttccacgttggggcgcccttcctatccagcgggtcgttctggaagcccacctccccatcctgcctctctgcctgccttgcccgtccgtgtctcacatcacatgagaactgggagtctgggacttttggaagcccacctcaccacaccagattgcgggccggtcgcaactcttttcccatctgtccggctgtccccacgccctccttcccaccgaccaccaccgcccccgccgacgaccaccatgccgctgccggcgatgacccactcctccgccttcctcctccccgcctcgactactcccccgcccaacgacgccgccacgacctacgcgctcgtcgtcctcaaccagcgcctcccccgcttcgcgccactcctctgggcccgcgcgcgcctgcgcgtgtgcgcggacgggggcgccaaccgcgtcttcgacggcatgccggagctgctgccggtcgaggaccccgccgatgtccgcgccaggtacaagccagatgtaattaaaggggatatggactcaataaggccagaagtgaaggaatattattccaatttgggcacaaacatagttgatgaatcacatgatcaggacacaacggacttgcacaaatgtgtatcatttgtcacaagagagctccctgtcccagacaagtctaacctgtgtatacttgttcttggtgcacttggtggaaggttcgatcatgagatgggggaatatcaatgtattataccgtttctcaaacaccaaaattgtcctcctgtcagatgactgttcaatctttctgctccccaagatgcatactcacgagatccatattgagaaatcggtcgaaggtcctcactgtggcttgattcccattggtggaccgtcaactagcaccacaacaactgggcttagatggaatttggataacaccagtatgagctatggtggactggtaagcacatctaacattgtggatgatgataaaataactgtgacttcagattctgatctgatttggacgatatcacttcggaattgagctgaagtagtgataatttagcatggttccatgcccaaattttgtcacctcagtgttatatgagttgagttgagttgagttcatattctgtaacgtagtgtgatgtttgtctcccactgcattttgcagctggattggcgtccatatgtgtcatgttctgggcttctggttcataattgagggttccactttatgaagtcctcttctgaatgcccctgatctattcaactcaactgtttgcgcatcttatcaccaaatttttttagttcatgattgccaacatatatgtattctaagatgattttgttggaagtttttttg

SEQ ID NO: 4571 - DNA, 1084 bp, Setaria italica
gttctcgaaagcccctcacccagtttgcgggcgcagctcttttcccatctgtccccagttccctcgctcctcctctgccccacaccgaccaccaccacccccacctccgccgaccgccatgccgctgccggcgatgacccactcctccgccttcctcctccccgcctcgactcccccgtccaacgacgccgccacgacgacctacgcgctcgtcgtcctcaaccagcgcctcccccgcttcgcgccgctcatctgggcccgcgcgcgcgtgcgcgtgtgcgcggacgggggcgccaaccgcgtcttcgacggcatgccggagctgctgccgggcgaggaccccgccgaggttcgctccaggtacaagccagatgtaattaaaggggatatggattcaataaggccagaagtgaaggaatattattccaattcgggcacaaacatagttgatgaatcacatgatcaggacacaactgacttgcacaaatgtgtatcatttatcacaagagatctccctgtctcagacaagtctaacctgtgtattcttgttcttggtgcacttggaggaaggtttgatcatgagatggggaacatcaatgtattataccgcttctcaaacaccaagatcgtcctcctgtcagatgactgttcaatctttctgctccccaagacgtatacccatgagatccatattgagaaatcggtcgaaggtcctcactgtggtttgattcccattggcggaccgtccactagcaccacaacaaccgggcttcggtggaatttggataacaccagtatgagctatggtggattggtaagcacatctaacatcgtggatgacgataaagtaactgtgacctcagattctgatctgatttggacgatatctcttcggcattgagctgaatttgccataatttagcgtggttccatgcccaaattttgtcgcctcactgttacatggatcgaggtcatattctgtagcgtggtgtgctgtcttccgctgctttttgcagccggatagatgtcaatatatgtgtgaagttcttgttcataattgacggttccactttatgaaggcctc

SEQ ID NO: 4572 - DNA, 1188 bp, Sorghum bicolor
gcaaccccgactctgacttctcgttccacgttcgtcgttctcgaaggaaaaggagaaacttttgtgcctgcgcgtgctcttttcccctcgaatcaggagttgcgactgggagcttcggaagcctgccttttcccatcacgggcgcagcacagcagctcttttcccatctgtaccccccgccccgctaggccgctcctgctcctctgctccaccggtgaccgccatgccgctcccgacgatgacccactcctccgcgttcctcctcccgtcctcaaccgccccgtccaaccccagcggcggcgccgacacgaccacctacgcgctcgtcgtcctcaaccagcgcctcccccgcttcgcgccgctcctatggtcccgcgcgcgcctgcgcgtgtgcgcggacgggggcgccaaccgcgtcttcgacggcatgccggagctcctcccgggcgaggaccccgccgaggtccgcaccaggtacaagccagatgtaattaaaggggacatggactcaataaggccagaagtgaaggagtattattccaatttgggcacaaacatagttgatgaatcacatgatcaggacacaactgacttgcacaaatgtgtatcatttatcacaagcgatctccctgtcccagagaagtctaatctgtatattcttgttcttggtgcacttggtggaagattcgatcatgagatggggaacatcaatgtattataccgcttttcaaacatcaagatcatcctcctatcagatgactgttcaatctttctgctccccaagacacactctcacgagatccatattgagacatcggttgaaggtcctcactgtggtttgattcccatgggcggcccatcagatatcaccacaaccaccgggctccggtggaatttagataacacaagcatgaggtatggtggattgataagcacatctaacatcgtggatgaagataaagtaacggtgacttcagattctgatctgatctggacaatatcgcttcggaattgagctgaacatgcataattttgcatgattccatgcccaaattttgtcgcctcaaagttgcatgactgctgtaacgtggtgtgatattgttttcccctgcattttgcagctgcatatgtcattatgtccatatatgtgaacttattgttcataatttaaggaatccagcatctgcc

SEQ ID NO: 4573 - DNA, 1480 bp, Pseudoroegneria spicata
gcttcctctcctagccccttcgcccacccgccggaacccgtcgaaccaaaccctagcgaccgctcgccaccccggacggttcgccatcgtcgccatgccccgccgcagcaagagcagtgcccccatcgacctcgacgaagaggatgagtgcaagagcaagcgttctcgagcgagtataaggccagcaccgaagatgcctgggagctcaaatcgcattgcaagtagcagaagggacaaggaaaatcaagacaaactggatacccgtatcttcgatttatacatggagtatccccccccccacacacacacaatcttttttcaagaaaacaaataattggtcttcttggagaaatttgtatgcttatttgctgctataaatttgtgcatatagggacctttggaaacgtacagatgaagatcataagaatgcttacgcatatttggatccgttatggtttaacagttacgtcaatgggggcgccgaacagaaatcaagaattcttagatggacaaagaaactgaaaatattttcaagaaaatatgtgtttgtccctattgttcgttggggacattggaacctccttgtcctatgccactttgacgagacagactgctcagatgcaaaaaaaggaccacgaatgctgctgctggattcacttaacacaacagatccgaagaggttgggacctgatatcagaggattcattcatggtatttatgaaattgaagagcgggaagaaagcgcgcacttcataaaaaacatccgtcttgagtttcctaaggtgccacagcaaaatggggaggaatgtggtatatatgttctttactttatcaactgttttcttcaaaatagaaaattggcagaagttcttcagaataaaacactggaagaagatttcagccagctgtttgatgatggcacgtttgatccagaggaactagagaacttccgcaaggatgttcatgcattccaagtggaaaggagtactgaaaccggacagtaggtggattgtagcattgtgctgcatatatgtagttagttattataaggcagtggaaattttcatcttctctggtaacgaattccgaggaagcttgaaggtcgtggagaagctggtggtaatatacagcttatgcagcggagagaaagccgactccatggagcttcgtgacagttagcaggtgttatatgatctgtattgggcattctagaattgttgtgtgaccatcttttgtatgacaccatgagagttatctactttatggactggaatgatctcaatagtctcaacttgttttccctaagtcataagatagcagcatcccgtacaatgctggctaggggtaaaaaatcgtactccctctgtttcatattagttgtcgctgatttagtataactttgtactaaatttgtacgtgatgcttgctaggagtaaaaaaacgtacaatgcttgcataaggatttttctttttatgatca

SEQ ID NO: 4574 - DNA, 2913 bp, Triticum aestivum
aggtttctggtgattgtacattctttgattgcaaagatctgcctgcaattttagagcgtgaggaaataaccagtgtaccgattggatttcctattgcaaattgtgaagtttttcttgtgaagcatgctgggattgcagctgaaggtgaaatttgtgtcagtggagcatgtttattcaatggttatttagctgagtttctgaggagtaatcacactgaaggcagtgaaagttcaacatactacaaaacgggtgactatgctcgacggctgaaggctggtgaacttgttttccttgggagaaaggaccgttctgtaaaaaattatgggcagcgtttttcactagaagaggtagaatccaccttaaaggacatcctgctgtcagtggtgctgcagttactttccaaagtaaagggtctccagattataaggcatacctggtgtttaagaataaggatgaaattgtgaaagatagtgtgcagcatagagaagtaaattcttctcaagatgtcatggcatcaattcgaagttggctcatcaagaaggttccaccagctatgattccaagcttctttctccacgtgaagtccttacctttgacttcttcaggaaaggttgactatgtcaagttatcaagtttggattgtgcattggaaccatgtggaattgagcaaattaagactgaaagtggtccaattaatccatatttacaagttattaaaaaggcatttcgtgacgccctgcttgttgatgaagtttctgagtttgatgattttttcactttgggtggtaactcaatttctgccgcccatgcagcccacaagttggagattgacatgagattgctttatatctatccaaccccttctaagcttttgcatgcttcagttgtggagcatagtaatttggtttctcctactgatgaccctcagcctaagaagggcctgaacgtatctacaagcatacatggactatttgacccgtttgctgcaaatgcggatgatagttatcatggaggcaaagcacggataaatggaaagcgtgcacattatcaaattgcagggagttatggagatgaaacagatggccagcttaacaaatatccattctctcctgatgatagataccaggtaaacgacttctacttggatacatgcttgaaggacagaaacagtgttatggggagtcagtggatcttgaacttctgtttacacaagaagtggtctattgggcgttgcaacagatttatgcatgacgatgaagggaagctgcaacttgaagatgtttgctcatatgtttcatacaacaaaagaggttatcttcaggaactttggaacattcctttggattcatgtgttgatgcctcacctttgcttgtcctgaacaatgggatgataaacatatttattgggtcccattcacatttatttctctgcattgatggttgcaatggttcagtgaggtggagtgtcaaattggaaggacgtgtggagtgttctgctgctattactggtgatttttcagaggttgtggtcggatgttataaagggaaaatttactttcatgatatgttgactggtaaactatcttggacagttcaaacagatggggaggtaaaaatgcaactggttgttgacaggacaaggaatttaatatggtgtggctcttatgatcattatttatatgcactaaattacaaagatcgttgctgcgcttacaaagtatcttgtggtggaagcatctatggttctcctgctgtggacatggcacacgacaggatctatgttgcttgtacgagtggccttgtaactgcaatatcccttgaggttccatcattcagaatagtttggcaatatgaagccagggcagcaattttcagttctcttgccatcgatcatcaaagtggaaatgttgtttgttgcttggtgaacggtctggtgatcgcattgaactcacatggcactgttgtctggaaggcaactgttggtggtcctatttttgctagtgcatgtgtgtcatctgcccttccttctcaggtcctgataccttcccgtgatggaagcttatactcctttgatattacatctggtgatcttctttggtcatatgacgtcggcgacccaattactgcatctgcttttgttgatgaagtgttagcatcaacgccatctggagcatcagagagatttgcttgtatctgcacaagttctgggaaggtccgtgtccttgggattagagctgatgctgagcaggagaaagatggttactctgtgcaagagtttgcagccatggatcttcctggggacatcttctcgtcacccttgatggtgggtgggcgcatctttgttggctgcagagatgatcggctacattgtctctcaatcacctcacatccataatccattccagacatatccagtcgaactgttttgcgtagtggccaatataagaattattgatgtcctgagcagtttgatgttttgaacaatcaacaaagaagaaatgcagaagatagcggttcttgggttccaaaggttggatttccacgccgtaaatctttggttaagtgcttgatattcagtatcacaaatcagattacaaccttagtgcaaactgagtgtactgggttcaaaagcggaagcagagctataaacagccctcgctcctttgctgcggaaaatacaccttcaagcttggttagcgtactgataggtctctttttatgcatcagaattattgtttttcttttgttagaagatcagaattggtggtcgagagcaacgtgttcatgtgtacataagctagctgatgtatcaaggcagtgaagaaatatatgtaatgtgccaaatccacaagttttgatccatttcagtgatcaacaacatacggccggttccaagttccttgttcgaatgtt

SEQ ID NO: 4575 - DNA, 3245 bp, Triticum aestivum
agctttgttgaccatcttcaggagtttctttctgctgtgttgactagcacaacacttgtcattccccccaataattggagagccaatccagcatcattggccaacttgattaaggcatatcgtatatcaagggtgactatagttccgtcgctgatggagataatactacctaccctggagaaaaatatttcatgtggatataactctcttaagatcttggtatttagtggggagattctgtccttagtgctgtggaagagagttcgtgaaattctgccagagactactatcataaatttgtatggaacaacagaggtttctggtgattgtacattctttgattgcaaagatctgcctgcaattttagagcgtgaagaaataaccagtgtaccgattggatttcctattgctaattgtgaagtttttcttgtgaagcatgctgggattgcagctgaaggtgaaatttgtgttagtggagcatgtttattctatggttatttagctgagtttctgaggagtaatcacactgaaggcagtgaaagttcaaaatactacaaaacgggtgactatgctcgacggctgaaggctggtgaactgttttccttgggagaagggaccgttctgtaaaaaattacgggcagcgtttttcactagaagaggtagaatccaccttaaaggaacatcctgctgtcagtgatgctgcagttactttccaaagtaaagggtctccagattataaggcatacctggtgtttaagaataaggatgaaattgtgaaagatagcgtgcagtatagagaagtaaattcttctcaagatgtcatggcatcaattcgaagttggctcatcaagaaggttccaccagctatgattccaagcttctttctccacgtgaagtccttacctttgacttcttcaggaaaggttgactatgttaagttatcaagtttggaatgtgcattggaaccatgtggaattgagcaaattaagtctggaagtggtccagttaatccatatttacaagttattaaaaaggcattttgtgacgctctgcttgttgatgaagtttccgagtttgatgattttttcaccttgggtggtaactcaatttctgccgcccatgcagcccacaagttggagattgacatgagactgctttatatctatccaaccccttctaagcttttgcacgctttagttgtggagcatagtaatttggtttctcctactgatgagcctcagcctaagaagggcctgaacgtatctacaagcatacatggactatttgacctgagtgctgcaaatgcggatgatagttatcatggaggcaaagcacggataaatggaaagcgtgcacattatcaaattgcagagagttatggagatgaaacagatggccagcttaacaaatatccattctctcctgatgatagataccaggtaaacgacctctacttggatacatgcttgaaggacagaaacagtgtcatggggagtcagtggatcctgaacttctgtttacacaagaagtggactattgggcgttgcaacagatttatgcatgacgatgaagggaagctgcaacttgaagatgtttgcccacatgtttcatacaacaaaataggttatcttaaggaactttggaacattcctttggattcatgtgttgatgcctcacctttgcttgtcctgaacaatgggatgataaacatatttattgggtcccattcacatttatttctctgcatcgatggttgcaatggttcagtgaggtggagtgtcaaattggaaggacgtgtggagtgttctgctgctattactggtgatttttcagaggttgtggtcggatgttataaagggaaaatttactttcatgatatgttgactggtaaactatcttggacagttcaaacagatggagaggtaaaaatgcaaccagttgttgacaggacaaggagtttaatatggtgtggctcttatgatcatcatttatatgcactaaattacaaagatcgttgctgcgcttacaaagtatcttgtggtggaagcatctatggttctcctgctgtggacatggcacacgacaggatctatgttgcatgcacgagtggccttgtaactgcaatatcccttgaggttccatcattcagaatagtttggcaatatgaagctggggcagcaattttcagttctcttgccattgatcatcaaagtggaaatgttgtttgttgcttggtgaacggtctggtgatcgcattgaactcacatggcactgttgtctggaaggcaactgttggtggtcctatttttgctggtgcatgtgtgtcatctgcgcttccttctcaggtgctgataccttcccgtgatggaagtttatactcttttgatattacatctggtgatcttctttggtcatatgacgtcggcgacccaattactgcatctgcttttgttgatgaagtgttagcatcaacaccatctggagcatcagagagatttgcttgtatctgcacaagttctgggaaggtccgtgtccttgggattagagctgatgctgagcaggagaaagatggttactctgtgcaagagtttgcagccatggatcttcctggggacatattctcgtcacccttgatggtgggtgggcgcatctttgttggctgcagagatgatcggctacattgtctctcaatcacttcacatccataatccatttcagacatatccagtcgaactgttttgcgtagtggccaatataagaattattgatgtcctgagcagtttgatgttttgaacaatcaacaaagaagaaatgcagaagatactggttcttgggttccaaaggttggatttccgcgccgtaaatctttggttaagtgcttgatattcagtgtcacaatcacattacaaccttagtgcaaactgagtatactgggttcaaaagcggaagcagagttataaacagcccttgctcctttgctgcggaaaatacaccttcgagcttggttagcgtactgatagggctctttttatgcaacagaattttaggtttttagttagaagatgagaattgttggtcgagagcaacatgttgcatttgtacacacgctgatgtatcaaggcagtgtggaaatatatgtaatgtaccaaatccacaagttttgatcctgatcagtggtcaacaacatacagctggttccaggttcctcattcgaattgtttttatataccgttgaatttgttacc

SEQ ID NO: 4576 - DNA, 3429 bp, Triticum aestivum
gggggagatgagcttgtttggccgtgcgagcgcgagaggccgcgagagttctgctacgtgatgttcacgtctggttctactggaagacccaaaggcgtttgtggaacggagaaaggtcttctgaatcgctttttgtggatgcaaagaaggaatcctttgtgttcggacgatgtgttgttgtttaagacatctgtcagctttgttgaccatcttcaggaatttctttctgctgtgttgactagcacaacactggtcattccccccattgattggagagctaatccaacatcgttggccaacttgattaagacatatcgtatatcaaggatgactatagttccgtcgctaatggagatgatactacctaccatggagaaaaatatttcatgtggatataactctcttaagatcctggtatttagtggggagattctatccttagtgctgtggaagagagttcgtgaaattctgccagagactactgtcgtaaatctgtatggaacaacagaggtttctggtgattgtacattctttgattgcaaagatctccctgcaattttagagtgtgaagaaataaccagtgtaccgattggatttcctattgcaaattgtgaagttgttcttgtgacgcatgctgggatggcagatgaaggtgaaatttgtgtcagtggagcatgtttattcaatggttatttagctgagtttctgatgagtaatcacactgaaggcagtgaaagttcaacatactacaaaacaggtgattatgctcgacggctgaaggctggtgaacttgttttccttgggagaaaggaccgtacagtaaaaaattatgggcagcgtttttcactagaagaggtagaatccactttaaaggaacatcctgctgtcagtgatgctgcagttactttccaaagtaaagggtctccagattataaggcgtacctggtgtttaagaataaggatggaattgtgaaagacagcctgcagtatagagaagtaaattcttcccaagatatcatggcatcaattcgaagttggctcatcaagaaggttccaccagctatgattccaagcttctttctccacgtgaagtccttacctttgacttcttcaggaaaggttgactatgtcaagttatcaagtttggagtgtgcattggaaccatgtggaaatgagcaaattaagtctggaagtggtccagttaatccatatttacaagttattaaaaaggcattttgtgacaccctgcttgttgatgaagtttccgagtttgatgattttttcaccttgggtggtaactcaatttctgccgcccatgcagcccacaagttggagattgacatgcgactgctttatatctatccaaccccttctaagcttttgcacgctttagttgtggaggatagtaatttggtttctcctactgatgagcctcagcctaagaaggacctgaacgtatctacaagcatacatggactatttgacctgagtgctgcgaatgcggatgatagttatcatggaggcaaagcacagataaatggaaagcgtgcacattatcaaattgcagagagttatggagatgaaacagatggccagcttaataaatatccattctcttctgatgatagataccaggtaaacgacctctacttggatacaggcttgaaggacagaaacagtgtcatagggagtcagtggatcctgaacttctgtttacacaagaagtggtctattgggcgttgcaacagatttatgcatgacgatgaagggaagctgcaacttgaagatgtttgcttacatgtttcatacaacaaaagaggttatcttcaggaactttggaacattcctttggattcatgtgttgatgcctcacctttgcttgtcctgaacaatgggatgataaacatatttattgggtcccattcacatttatttctctgcatcgatggttgcaatggttcagtgaggtggagtgtcaaattggaaggacgtgtggagtgttctgctgctattactggtgatttttcagaggttgtggttggatgttataaagggaaaatttactttcatgatatgttgactggtaaactatcttggacagttcaaacagatggggaggtaaaaatgcaaccagttgttgacaggacaaggaatttaatatggtgtggctcttatgatcatcatttatatgcactaaattacaaagatcgttgctgcgcttacaaagtatcttgtggtggaagcatctatggttctcctgctgtggacatggcacacgacaggatctatgttgcatgcacgagtggccttgtaactgcaatatcccttgaggttccatcattcagaatagtttggcaatatgaagctggggcagcaattttcagttctcttgccattgatcatcaaagtggaaatgttgtttgttgcttggtgaacggtctggtgatcgcattgaactcacatggcactgttgtctggaaggcaactgttggtggtcctatttttgctggtgcatgtgtgtcatctgcccttccttctcaggtgctgatatcttcccgtgatggaagtttatactcttttgatattacatccggtgatcttctttggtcatatgacgtcggcgacccaattactgcatctgcttttgttgatgaagtgttagcatcaacgccatctggatcatcagagagatttgcttgtatctgcacaagttctgggaaggtccgtgtccttgggattagagctgatgctgagcaggagaaagatggttactctctgcaagagtttgcagccatggatcttcctggggacatcttctcgtcacccttgatggtgggtgggcgcatcttagttggctgcagagatgatcggctacattgtctctcaatcacctcacatccataatccattccagacatatccagtcgaactgttttgcgtagtggccaatataagaattattgatgtcctgagcagtttgatgttttgaacaatcaacaaagaagaaatgcagaagatagcggttcttgggttccaaaggttggatttccacgccgtaaatctttggttaagtgcttgatattcagtatcacaaatcagattacaaccttagtgcaaactgagtgtactgggttcaaaagcggaagcagagctataaacagccctcgctcctttgctgcggaaaatacaccttcaagcttggttagcgtactgatagggctctttttatgcaacagaattttaggtttttagttagaatcagaattgtttgtcgagagcaacattttgcatttgtacatacgctgatgtttcaaggcagtgtagaaatatatgtaatgtaccaaaaccactcctgatcagtgatcaacaacagacaactggttccaagttcctcgttcgaatgttcttatataccgttgaattgttcca

SEQ ID NO: 4577 - DNA, 3056 bp, Triticum aestivum
atataactctcttaagatcttggtatttagtggggagattctgtccttagtgctgtggaagagagttcgtgaaattctgccagagactactatcataaatttgtatggaacaacagaggtttctggtgattgtacattctttgattgcaaagatctgcctggaattttagagcgtgaagaaataaccagtgtaccgattggatttcctattgcaaattgtgaagtttttcttgtgacacatgctgggatagcagatgaaggtgaaatttgtgtcagtggagcatgtttattcaatggttacttagcagagtttctgagcagtaaccacactgaaggcagtgtaagttcaacatactacaaaacgggtgactacgctcgacggctgaaagctggtgaacttgttttccttgggagaaaggaccgcaccgtaaaaatttatgggcagcgtttttcactagaagaggtagaatccaccttaaaggaacatcctgctgtcagtgatgctgcacttactttccaaagtaaagggtctccagattataaggcatacctggtgtttaagaataaggatggaattgtgaaagacagcctgcagtatagagaagtaaattcttctcaagatatcatggcatcaattcgaagttggctcatcaagaaggttccaccagctatgattccaagcttctttctccacgtgaagtccttacctttgacttcttcaggaaaggttgactatgtcaagttatcaagtttggagtgtgcatcggaaccatgtggaattgcgcaaattaagtctggaagtggtctagttaatccatatttacaagttattaaaaaggcattttgtgacgccctgcttgttgatgaagtttccgagtttgatgattttttcaccttgggtggtaactcaatttctgccgcacatgcagcccacaagttggagattgacatgagactgctttatatctatccaaccccttttaagcttttggacgctttaattgtggatcatagtaatttggtttctcctactgatgagcctcagcctaagaaaggcctggacgtatctacaagcgtacatggactatttgacccgattgctgcaaatgcggatgatggttatcatggaggcaaagcacggataaatggaaagcgtgcacattatcaaattgcagggagttatggaaatgaaacagatggccagcttaacaaatatccattctctcctgatgacagatgccaggtaaacgatctctacttggatacatgcttgaaggacagaaacagtgtcatagggagtcagtggatcctgaacttctgtttacacaagaagtggtctattgggcgttgcaacagatttatgcatgacgatgaagggaagctgcaacttgaagatgtttgctcatatgtttcatacaacaaaagaggttatcttcaggaactttggaacattcctttggattcatgtgttgatgcctcacctttgcttgtcctgaacaatgggatgataaacatatttattgggtcccattcacatttatttctctgcatcgatggttgcaatggttcagtgaggtggagtgtcaaattggaaggacgtgtggagtgttctgctgctattactggtgatttttcagaggttgtggttggatgttataaagggaaaatttactttcatgatatgttgactggtaaactatcttggacagttcaaacagatggagaggtaaaaatgcaaccagttgttgacaggacaaggaatttaatatggtgtggctcttatgatcatcatttatatgcactaaattacaaagatcgttgctgcgcttacaaagtatcttgtggtggaagcatctatggttctcctgctgtggacatggcacacgacaggatctatgttgcatgtacgagtggccttgtaactgcaatatcccttgaggttccatcattcagaatagtttggcaatatgaagccggggcagcaattttcagttctcttgccatcgatcatcaaagtggaaatgttgtttgttgcttggtgaacggtctggtgatcgcattgaactcacatggcactgttgtctggaaggcaactgttggtggtcctatttttgctggtgcatgtgtgtcatctgcccttccttctcaggtcctgataccttcccgtgatggaagtttatactcttttgatattacatctggtgatcttctttggtcatatgacgtcggcgacccaattactgcatctgcttttgttgatgaagtgttagcatcaacaccatctggagcatcagagagatttgcttgtatctgcacaagttctgggaaggtccgtgtccttggtattagagctgatgctgagcaagagaaagatggttactctgtgcaagagtttgcagccatggatcttcctggggacatcttctcgtcacccttgatggtgggtgggcgcatctttgttggatgcagagatgatcggctacattgtctctcaatcactaatccatttaactgaagtgaataacacgtaatctagtttcccttgctacaccaagctgctcagcatcgtatcttcatcctgcggtggttcagcagcaagagatgcacagtacttagatattagacacatccagtcaaactgttttgcttagtggccaatagaagaattattggtgatgtcccgagcagcttgatgttttgaacaatctacagagaagaaatgcagaagataccggtgcttgggtttcaaaggttggatttccacgctgtaaatctttggttaagtgcttgatattcagtatcacaagcacattacaaccttactgcaaaccgagtgtactgggttcaaaagtggaagcagagctataaacagcccttgctccttcgctgcgaaaaatacaccttcaagcttggttagcatactgataggtctctttttatgcaacagaattttaggtttttagttagaatcagaattgttggtcgagagcaacattttgaatttgtacatacgctgatgtttcaaggcagtgtagaaatatatgtaatgtaccaaa

SEQ ID NO: 4578 - DNA, 3636 bp, Triticum aestivum
cggtgtttacgtcatgaagacgatgttctttaacggggtcgtggtcgtcttgtccctgttctgcgagttcgtacggcgacgatccggcacggggtttgtctggtggtagagggcgtggggtagggtggaggatgagctttttggtccgtgcgagcgcgagaggctgcgggacttctgctatgtgatgttcacttccggttctactggaagacccaaaggtgtttgtggaacggagaaaggtcttctgaatcgcttttgtggatgcaaagatggaatcctttatgttcagacgatgtgttgttgtttaagtacatctgtcagctttgttgaccatcttcaggagttctttctgctgtattgactagcacaacacttgtcattccccccaataattggagagccaatccagcatcattggccaacttgattaaggcatatcgtatatcaagggtgactatagttccgtcgctgatggagataatactacctaccctggagaaaaatatttcatatggatataactctcttaagatttggtatttagtggggagattctgtccttagtgctgtggaagagagttcgtgaaattctgccagagactactatcataaatttgtatggaacaacagaggtttctggtgattgtacattctttgattgcaaagatctgcctgcaattttagagcgtgaagaaataaccagtgtaccgattggatttcctattgctaattggaagtttttcttgtgaagcatgctgggattgcagctgaaggtgaaatttgtgtcagtggagcatgtttattcaatggttatttagctgagtttctgaggagtaatcacactgaaggcagtgaaagttcaaaatactacaaaacgggtgactatgctcgacggctgaaggctggtgaacttgttttccttgggagaaaggaccgttctgtaaaaatttatgggcagcgtttttcactagaagaggtagaatccaccttaaaggaacatcctgctgtcagtgatgctgcagttactttccaaagtaaagggtctccagattataaggcgtacctggtgtttaagaataaggatggaattgtgaaagacagcctgcagtatagagaagtaaattcttcccaagatatcatggcatcaattcgaagttggctcatcaagaaggttccaccagctatgattccaagcttctttctccacgtgaagtccttacctttgacttcttcaggaaaggttgactatgtcaagttatcaagtttggagtgtgcattggaaccatgtggaaatgagcaaattaagtctggaagtggtccagttaatccatatttacaagttattaaaaaggcattttgtgacaccctgcttgttgatgaagtttccgagtttgatgattttttcaccttgggtggtaactcaatttctgccgcccatgcagcccacaagttggagattgacatgcgactgctttatatctatccaaccccttctaagcttttgcacgctttagttgtggaggatagtaatttggtttctcctactgatgagcctcagcctaagaaggacctgaacgtatctacaagcatacatggactatttgacctgagtgctgcgaatgcggatgatagttatcatggaggcaaagcacggataaatggaaagcgtgcacattatcaaattgcagagagttatggagatgaaacagatggccagcttaacaaatatccattctctcctgatgacagatgccaggtaaacgacctctacttggatacatgcttgaaggacagaaacagtgtcatggggagtcagtggatcctgaacttctgtttacacaagaagtggactattggacgttgcaacagatttatgcatgacgatgaagggaagctgcaacttgaagatgtttgctcacatgtttcatacaacaaaagaggttatcttcaggaactttggaacattcctttggattcatgtgttgatgcctcacctttgcttgtcctgaacaatgggatgataaacatatttattgggtcccattcacatttatttctctgcatcgatggttgcaatggttcagtgaggtggagtgtcaaattggaaggacgtgtggagtgttctgctgctattactggtgatttttcagaggttgtggtcggatgttataaagggaaaatttactttcatgatatgttgactggtaaactatcttggacagttcaaacagatggagaggtaaaaatgcaaccagttgttgacaggacaaggaatttaatatggtgtggctcttatgatcatcatttatatgcactaaattacaaagatcgttgctgcgcttacaaagtatcttgtggtggaagcatctatggttctcctgctgtggacatggcacacgacaggatctatgttgcatgtacgagtggccttgtaactgcaatatcccttgaggttccatcattcagaatagtttggcaatatgaagctggggcagcaattttcagttctcttgccatcgatcatcaaagtggaaatgttgtttgttgcttggtgaacggtctggtgatcacattgaactcacatggcactgttgtctggaaggcaactgttggtggtcctatttttgctggtgcatgtgtgtcatctgcccttccttctcaggtgctgatatcttcccgtgatggaagtttatactcttttgatattacatccggtgatcttctttggtcatatgacgtcggcgacccaattactgcatctgcttttgttgatgaagtgttagcatcaacgccatctggatcaccagagagatttgcttgtatctgcacaagttctgggaaggtccgtgtccttgggattagagctgatgctgagcaggagaaagttggttactctgtgcaagagtttgcagccatggatcttcctggggacatcttctcgtcacccttgatggtgggcgggcgcatctttgttggctgcagagatgatcggctacattgtctctcaatcactaatccatttaactgaagtgaatagcacgtaatttagtttcccttgctacaccaagctgctcagcatcgtatcttcatcctgcggtggttcagcagcaagagatgcacagtacttagatattagacacatccagtcaaactgttttgcttagtggccaatagaagaattattggtgatgtcccgagcagcttgatgttttgaacaatcaacaaagaagaaatgcagaagataccggtgcttgggttccaaaggttggatttccacgccgtaaatctttggttaagtgcttgatattcagtatcacaatgacattacaaccttggtgctcaacgagtgtacttgattcaaaagcagaagcagagctataaacagccctcgctcctttgctgcagaaaatacaccttcaagcttggtcgacgtactgataggtctatttttatgcatcaggattattgtttttctgttaggaagatcagaattgtttgtcgagagcaacatgttgcatttgtatataagctgatgtatcaaggcagtgtagaaatatatgtaatgtaccaaatccacaagttttgatcctgaccagtgatcaacaacatacagccggttccaagttcctcgtttga

SEQ ID NO: 4579 - DNA, 2731 bp, Triticum aestivum
cagtgaaagttcaacatactacaaaacaggtgattatgctcgacggctgaaggctggtgaacttgtttccttgggagaaaggaccgtacagtaaaaattatgggcagcgttattcactagaagaggtagaatccatcttaaaggaacatcctgctgtcagtgatgctgcagttacttccaaagtaaagggtctccagattataatgcatacctggtgtttaagaataaggatgaaattgtgaaagacagcctgcagtatagagaagtaaattcttctcaagatatcatggcatcaattcgaagttggctcatcaagaaggttccaccagctatgattccaagcttctttctccacgtgaagtccttacctttgacttcttcaggaaaggttgactatgtcaagttatcaagtttggagtgtgcattggaaccatgtggaattgagcaaattaagtctggaagtggtccaattaatccatatttacaagttattaaaaaggcattttgtgacgccctgcttgttgatgaagtttccgagtttgatgattttttcaccttgggtggtaactcaatttctgcagcccatgcagcccacaagttggagattgacatgagactgctttatatctatccaaccccttctaagcttttgcacgctttagttgtggagcatagtaatttggtttctcctactgatgagcctcagcctaagaagggcctgaacgtatctacaagcatacagtggactatttgacccgtttgctgcaaatgcggatgatagttatcatggaggcaaagcacggataaatggaaagcgtgcacattatcaaattgcagggagttatggagatgaaacagatggccagcttaacaaatatccattctctcctgatgatagatgccaggtaaacgatctctacttggatacatgcttgatggacagaaacagtgtcatggggagtcagtggatcctgaacttctgtttacacaagaagtggtctattgggcgttgcaacagatttatgcatgacgatgaagggaagctgcaacttgaagatgtttgcttacatgtttcatacaacaaaagaggttatcttcaggaactttggaacattcctttggattcatgtgttgatgcctcacctttgcttgtcctgaacaatgggatgataaacatatttattgggtcccattcacatttatttctctgcatcgatggttgcaatggttcagtgaggtggagtgtcaaattggaaggacgtgtggagtgttctgctgctattactggtgatttttcagaggttgtggttggatgttataaagggaaaatttactttcatgatatgttgactggtaaactatcttggacagttcaaacagatggagaggtaaaaatgcaaccagttgttgacaggacaaggaatttaatatggtgtggctcttatgatcatcatttatatgcactaaattaccaagatcgttgctgcgcttacaaagtatcttgtggtggaagcatctatggttctcctgctgtggacatggcacacgacaggatctatgttgcttgtacgagtggccttgtaactgcaatatcccttgaggttccatcattcagaatagtttggcaatatgaagctggggcagcaattttcagttctcttgccatcgatcatcaaagtggaaatgttgtttgttgcttggtgaacggtctggtgatcgcattgaactcacatggcactgttgtttggaaggcaactgttggtggtcctatttttgctggtgcatgtgtgtcatgtgcccttccttctcaggtcctgataccttcccgtgatggaagtttatactcctttgatattacatctggtgatcttctttggtcatatgacgtcggcgacccaattactgcatctgcttttgttgatgaagtgttagcatcaaggccatctggagcatcagagagatttgcttgtatctgcacaagttctgggaaggtccgtgtccttgggattagagctgatgctgagcaggagaaagatggttactctctgcaagagtttgcagccatggatcttcctggggacatcttctcgtcacccttgatggtgggtgggcgcatcttagttggctgcagagatgatcggctacattgtctctcaatcacctcacatccataatccattccagacatatccagtcgaactgttttgcgtagtggccaatataagaattattgatgtcctgagcagtttgatgttttgaacaatcaacaaagaagaaatgcagaagatagcggttcttgggttccaaaggttggatttccacgccgtaaatctttggttaagtgcttgatattcagtatcacaaatcagattacaaccttagtgcaaactgagtgtactgggttcaaaagcggaagcagagctataaacagccctcgctcctttgctgcggaaaatacaccttcaagcttggttagcgtactgatagggctctttttatgcaacagaattttaggtttttagttagaatcagaattgtttgtcgagagcaacattttgcatttgtacatacgctgatgtttcaaggcagtgtagaaatatatgtaatgtaccaaaaccactcctgatcagtgatcaacaacagacaactggttccaagttcctcgttcgaatgttcttatataccgttgaattgttccagcattctgaagttatgaatttgtgaagaacac

SEQ ID NO: 4580 - DNA, 2803 bp, Triticum aestivum
acatgctgggatagcagatgaaggtgaaatttgtgtcagtggagcatgtttattcaatggttacttagcagagtttctgagcagtaaccacactgaaggcagtgtaatttcaacatactacaaaaacgggtgactacgctcgacggttgaaagctggtgaacttgttttccttgggagaaaggaccgcaccgtaaaaatttatgggcagcgttttcactagaagaggtaggatccaccttaaaggaacatcctgctgtcagtgatgctgcacttacttcaaagtaagggtctccagattataaggcatacctggtgtttaagaataaggatggaattgtgaaagacagcctgcagtatagagaagtaaattcttctcaagatatcatggcatcaattcgaagttggctcatcaagaaggttccaccagctatgattccaagcttctttctccacgtgaagtccttacctttgacttcttcaggaaaggttgactatgtcaagttatcaagtttggagtgtgcatcggaaccatgtggaattgcgcaaattaagtctggaagtggtctagttaatccatatttacaagttattaaaaaggcattttgtgacgccctgcttgttgatgaagtttccgagtttgatgattttttcaccttgggtggtaactcaatttctgccgcacatgcagcccacaagttggagattgacatgagactgctttatatctatccaaccccttttaagcttttggacgctttaattgtggatcatagtaatttggtttctcctactgatgagcctcagcctaagaaaggcctggacgtatctacaagcgtacatggactatttgacccgattgctgcaaatgcggatgatggttatcatggaggcaaagcacggataaatggaaagcgtgcacattatcaaattgcagggagttatggaaatgaaacagatggccagcttaacaaatatccattctctcctgatgacagatgccaggtaaacgatctctacttggatacatgcttgatggacagaaacagtgtcatggggagtcagtggatcctgaacttttgtttacacaagaagtggtctattggacgttgcaacagatttatgcatgacgatgaagggaagctgcaacttgaaggtgtttgctcatatgtttcatacaacaaagaggttatcttcaggaactttggaacattcctttggattcatgtgttgatgcctcacctttgcttgtcctgaacaatgggatgataaacatatttattgggtcccattcacatttatttctctgcatcgatggttgcaatggttcagtgaggtggagtgtcaaattggaaggacgtgtggagtgttctgctgctattactggtgatttttcagaggttgtggttggatgttataaagggaaaatttactttcatgatatgttgactggtaaactatcttggacagttcaaacagatggggaggtaaaatgcaaccagttgttgacaggacaaggaatttaatatggtgtggctcttatgatcatcatttatatgcactaaattacaaagatcgttgctgcgcttacaaagtatcttgtggtggaagcatctatggttctcctgctgtggacatggcacatgacaggatctatgttgcatgtacgagtggccttgtaactgcaatatcccttgaggttccatcattcagaatagtttggcaatatgaagccggggcagcaattttcagttctcttgccatcgatcatcaaagtggaaatgttgtttgttgcttggtgaacggtctggtgatcgcattgaactcaaatggcactgttgtctggaaggcaactgttggtggtcctatttttgctggtgcatgtgtgtcatctgcccttccttctcaggtcctgataccttcccgtgatggaagcttatactcttttgatattacatctggcgatcttctttggtcatatgacgtcggcgacccaattactgcatctgcttttgttgatgaagtgttatcatcaacgccatctggagcattagagagatttgcttgtatctgcacaagttctgggaaggtccgtgtccttgggattagtgctaatgctgcgcaggagaaagatggttactctgtgcaagagtttgcagccatggatcttcctggggacatcttctcgtcacccttgatggtgggtgggcgcatctttgttggctgcagagatgatcggctacattgtctctcaatcacctcacaaccataatccatttcagacatatctagtcgaactgttttgcttagtggccaatagaagaattattgatgatgtcccgagcagcttgatgttttggacaatgaacaaagaagaaatgcagaagatactggtgcttgggttccaaaggttggatttccacgccataaacctttggttaagtgctcgatattcagtatcacaatcagattacaaccttggtgctatcccgagtgtactgggttcaaaagcggaagcagagccataaacggccctcgctccttttctgcggaaaatacaccttcaagcttggtcgatgtactaatcagtctctttttatgcatcaggatgattgttttttcttaggaagatcagaattgtttgtcgagagcaacatgttgcatttgtacataagctgatgtatgaaggcagtgtagaaatatatgcaactttaaggaggtaaaaccctatgtcatgctcttgcctatattatgggtgtatcaaagtacagagttcatctacctcgagatcgtaagttggagacc

SEQ ID NO: 4581 - DNA, 3198 bp, Secale cereale
ggttagacatccgatgtcggcaagggtacgatgatggagaggttgggattggtggagatgagcttgcttggccgtgcgagcgggagaggcggcgggacttctgctatgtgatgttcacgtccggttctactggaagacccaaaggtgttttgtggaaccgagaaaggcatatcgtatatcaaggatgactatagttccgtcgctgatggagataatactacccaccctggagaaaaatgtttcatgtggatataactctcttaagatcttggtatttagtggggagattctgtccttagtgctttggaagagagttcatgaaattctgccagagactactatcataaatttgtatggaacaacagaggtttctggtgattgtacattctttgattgcaaagatctgcctggaattttagagcgtgaagaaataaccagtgtaccgattggattccctattgcaaattgtgaagtttttctcgtgacacatgctgggatagcagatgaaggtgaaatttgtgttagtggagcatgtttattcaatggttatttagctgagctgaggattaatcacactgaaggcagtggaagttcaacatactacaaaacgggtgactatgctcgacggctgaaggctggtgaacttgttttccttgggagaaaggaccgttctgtaaaaaattatgggcatcgtttttcactagaagaggtagaatccaccttaaaggaacatcctgctgtcagtgatgctgcagttactttccaaagtaaagggtctccagattataaggcatacctggtgtttaagaataaggatggaattgtgaaagacagcctgcagtctagagaagtaaattcttctcaagatatcatggcatcaattcgaagttggctcatcaagaaggttccaccagctatgattccaagcttctttctccacatgaagtccttacctttgacttcatcaggaaggttgactatgtcaagttatcaagtttggagtgtgcattggaaccatgtggaattgagcaaattaagtctggaagtggtccagttaatccatatttacaagttattaaaaaggcattttgtgacgccctgcttgttgatgaagtttccgagtttgatgattttttcaccttgggtggtaactcaatttctgccgcccatgcagcccacaagttggagattgacatgagactgctttatatctatcaaccccatcaaacttttgcacgctttagttgtggagcatagtaatttggtttctcctactgatgagcctcggcctaagaagggcctgaatgtatctacaaacatacatggactatttgacccgattgctgcaaatgcggatgatagttatcatggaggcaaagcacggataaatggaaagcgtgcacattatcaaatttcagggagttatggagatgaaacagatggccagcttaacaaatatccattctctcctgatgacagataccaggtaaacgacctctacttggatacatgcttgaaggacagaaacagtgtcatggggagtaagtggatcctgcacttttgttacacaagaagtggtctattgggcgttgcaacagatttatgcatgacgttgaagggaagctgcaacttgaagatgtttgctcatatgtttcatacaacaaaagaggttatcttcaggaactttggaacattcctttggattcatgtgttgatgcctcacctttgcttgtcctgaacatggatgataacatatttatggtccattcactatttatttctctgcattgatggttgcaatggttcagtgaggtggagccgtacaaactggaaggacgtgtggagtgttctgctgctatgactggtgattttttcagaggttgtggttggatgttataaaggaaatttactttcatgatatattgactggtaaactatcttggacagttcaaactgatggagaggtaaaaatgcaaccagttgttgacaggacaaggaatttaatatggtgtggctcttatgatcatcatttatatgcactaaattacaaagatcgttgttgcgcttacaaagtatcttgtggtggaagcatctatggttctcctgctgtggacatggcacacgacaggatctatgttgcatgtacgagtggccttgttactgcaatatcccttgaggttccatcattcagaacagtttggcaatatgaagccggggcagcaattttcagttctcttgccatcgatcatcaaagtggaaatgttgtttgttgcttggtgaatggtctggtgatcgcattgaactcacatggcactgttgtctggaaggcaactgttggtggtcctatttttgctggtgcatgtgtgtcatctgccctcccttctcaggtgctgataccttcccgggatggaagtttatactcttttgatattacatctggtgatcttctttggtcatatgacgtcggcgacccaattactgcatctgcttttgttgatgaagtgttagcatcaacgccatctgcagcatcagagagatttgcttgtatctgcacaagttctgggaaggtccgtgtccttgggattagagctgatactaagcaggggaaagatggttactctgtgcaagagtttgcagccatggatcttcctggggacatcttctcgtcacccttgatggtgggtgggcgcatctttgtgggatgcagagatgatcgactacattgtctctcagtcactaatccatttaaccaaagtgaatagcacgtaatttagtttcccttgccacaccaagctgctcagcatcgtgtcttaatccttatgtggttctgcagcaagagacttgttcttttggtaagatgcacagtacttagatatcagacatatccagtcgaactgttttgcttagtggccaatagaagcattagcggtgatgtcccgagcagcttgatgttttgaccaatcaaaaaagaagaaatgcagaagatactggtgcttgggttccaaaggttggatttccatgccgtaaatctttggtaatgtgctcgatattcagtatcacaatcggattacaaccttggtgctatcccgagtgtactgggttcaaaagcagaagcagagctataaacagccctcactcctttgctgcggaaaatacaccttcaagcttggtcgacgtactgataggtttctttttatg

SEQ ID NO: 4582 - DNA, 908 bp, Pseudoroegneria spicata
  misc_feature (3)..(5): n is a, c, g, or t
tcnnntttggtcatatgacgttggcgacccaattactgcatctgcttttgttgatgaagtgttagcatcgacgccatctggagcatcagagagatttgcttgtatctgcacaagttctgggaaggtccgtgtccttgggattagagctgatgctgagcaggagaaagatggttactctgtgcaagagtttgcagccatggatcttcctggggacatcttctcgtcacccttgatggtgggtgggcgcatcttcgtcggatgcagagatgatcgactacattgtctctcaatcactaatccattgaactgaagtgaataccacgtaatttagtttcccttgctacaccaagctgctcagcatcgtatcttcatcctgcggtggttctgcagcaagagacttgttcttttggtaagatgcacagtacttagatatcagacacatccagttgaactgttttgcttagtggccgatagaagaattattggtgatgtcccgagcagtttgatgttttgaacaatcaacaaagaagaaatgcagaagttccaaaggttggatttccacgccgtaaacaaagaagaaatgcagaagttccaaaggttggatttccacgccgtaaatctttggttaagtgcttgatattcagtatcacaatcacattacaaccttagtgcaaactgagtgtactgggttcaaaagcggaagcagggctataaacagccctcgctcctttgctgtggaaaatacaccttcaagcttggttagcgtactgataggtctctttctatgcaacagaattttggatttttagttagaagatcagaattgttggtggagagcaacatgttgcatttgtacatacgctgatgtatcaaggcagtgtagaaatatatgtaatgtaacaaatcca

SEQ ID NO: 4583 - DNA, 3300 bp, Triticum aestivum
tgtcagggagaggagagagtaaatgatagcagcgatgatgaggctgccgttcaacgggggacgacccagttggtcgaggaatgtcaggaagaggagagggtaaatgatagcagcgatgatgatgctgccgatcaacgtgggatgacccagttggttgaagactcggataaagagatgggtgatgatgctgacgatgagttgagccagggcactcaagtgcaaagtgacgatgagggcctgccaaataatgagacatatgtgaaggattatgccgaggattcggtagattctgatgcttccacggaagaagagggtgacacagtcagaagtttggaacgagggaaaaggcatgatttgaccaatggaacatttctccgaacggaaattgtagacaactctacctcgtgtaatgcgttctttggtgattgcccaggtcgtgggattgatgacgggtcttttggttatgtacagagccatgaaaaagacgggagtaaaagcaaaggcaggtgctcaacagcaaagaagctttttgctgacacaacgaacgaagagaatgaaatcaagagcaggtgttttgctggactaagctatctcggatcacaggagcctggtgagctatctcaagcaaatgctttggactttgtggaagggttgatctcaattaatggcggcatatcgtctcaagaaccaacaccaaaaaattagaaaaagcaaagccacctgtttcaattaagatgggaactttactattggctgagaaggttgaccggcatagaagttccagaggaaaggcagaagtctttgcatgggtggatagtcgcgaggatgatggcggaggtgattttttcaggaaaaacaaggatatcttgttgcaacaatcagctggcagagggaaatcaaacattcccaggccaaagaagtgctccacaaaaattgcacctcctgacaagaaaataatagagggatgcaaaaggagaacgaagtccaaaccttgtgagaagactgaaactttaccttcatcggattcgagactactaaaaagtgaggtgaagagtaagaaggcttctggaaaaaggactaagaaaaaccttttgaaagacttggatgatcatctatcaactgccaaacctattaaaagacagctggaaaaggtcagtgtggatttgcatgatgttggtcaggatactcaaatggctatcgaagctatagaagcactggcacaaagttcccctgctgaaaacttgtcagccgaagttgaacctccagtgaagagagatctgagagttgtatctaaagtagaaaaaagtaacccaaagagtgaccctcctagaaagagaaccagcagcgtccaggaaggtgtcacgacacgttctaaaagaataaaagtaactgagatgaaccaccaacctcagaaagacatgcgacaaaatttagaagatcgtgcaacaaaggcgaaacataagcaggcaaagccagtaccacagaagaataaagttacgaagatagtcgatggaaataagtatgacagtacacctattgctcatcgaacaaggcacactggtagaaataacctctatgagtctcctgagttatgttctaataagaacttaaagaaggccactgttggagaagtaagaaataatcatagtgaacatgtactcgagagaccgatgattagtgagagaaccacagaatatggttcgggttctgtgttaaaagaaaacacagagaatacatgtgcaaataatgctcagggtcttcagcaaagtactgatgcaagcatacggcataccagtgcaaatgttgctcagaaccttgaaccattaagagatgaaccaacaactcatgtcttccgcagagagccctcatctcaccccaaacagagaagaacacctactgcagttgtacaggcaaaggctcctgcagttaccgaggctgctacaggtcatgatgtgacaaggccatccaagaaaagacggatttttattagcagttcagaactgctaacgtatgcaaggagggagcgctccgattgcagatcaacttctttgctgtctagtattatcacacaatcatcagctgcttctcctgtacttgattcttcatcgggagttaacagcaaaacttctggttttagtagctctgatcggcgacaaaagaaatcacccggtgttaagaatgcaagcaactcaccaaaatgtaactctccagttccgaatagtgccctgaaaacatcttctaaagtggtaaacaaattgtcacctactttcagtcctctaaatccatcaaaagcttcaaataggagcttgttgaaatcctctgttgccaaagagctgctggagttagatcctgaaaatgctctaccaagtcgataccgaaaggattctagaagaaaagatatgacgagttgcagtattattttcagccatcatttggatgaggatgtgatcaagcgtcagaagaagatcttggcacgcttaggagcccatgaagcactttccgttgcagatgcaacacattttgtggcggatggtttttaccgcacaaagaatatgctggaggcagttacacgtggcaaactggtagtgacatcaatgtggcttgaaagttgtggagcagcaggctgttttgtaaacgataagaagtatattctgagggatgccaaaaaggaaaaggagatgggtttcagcatgcctatatcactggcctcagcttgcaagagtcctttgctgttggggaaaagagtgtttgtgacacaaaatgtgaagccaagtcgagaggtggtgactagcttggtttccgcatcttctgggcagccattggagaggatgggtaggtccataaggaaggaaaaggaagcaccagatgacctactggtcatctcatgtgaagaggactaccaaacatgcgctccactcatcgagaaaggtgttgatgttttcgatgcggagcttctgctgaacggtatggtcacccagaagctcgattacgagaggcaccgccttttcttggaccgtgtgaagcagacccgctcgacgaggtggctgaaagacggtgcccacgggcggtttgtgcccatatcgaagagttgataccatagcagtgtaaatgtatggtgtggtacagcccatgcctgttttatgcccatcctcgggttctagctcggttgtgattaaaatctgtaagttgtagggtgtttatatgtctctcggttgctttaaacctttgtttgcatgcatcttggtcacgcttgtagctgctcatgagttatgatggccagtttctaatggctgccttgat

SEQ ID NO: 4584 - DNA, 3199 bp, Triticum aestivum
agcgatgatgacgctgccgatcaacgtgggatgacccagttggttgaagactcggataaagagatgggtgatgatggtgatgatgagttgagccagggcactcaagtgcaaagtgacgatgatggcctgccaaataatgagacagatgtgaaggattatgccgaggattcggtagattctgatgcttccacggaagaagaagctgacacagtcagaagtttgggacgagggaaaaggcatgattcgaccaatggaacatttctccgaacggaaattgtagacaactctacctcgtgtaatgcgtcctttggtgattgcccaggtcgtgggattgatgacgggtcttttggttatgtacagagccatgaaaaagatgggagtaaaagcaaaggcaggtgctcaacagcaaagaagctttttgctgacacaacgaacgaagagaatgaaatcaagagcaggtgtttggctggactaagctatctcggatcacaggagcctggtgagctatctcaagcaaatgctttggactttgtggaagggttgatctcaattaatggcggcatatcgtctcaagaaccaacaccaaaaaaattagaaaaagcaaagccacctgtttcaattaagatgggaactttactattggctgagaaggttgaccggcatagaagttccagaggaaaggcagaagtctttgcatgggtggatagtcgcgaggatgatggcggaggtgattttttcaggaaaaacaaggatatcttgttgcaacaatcagctggcagagggaaatcaaacattcccaggccaaagaagtgctccacaaaaattgcacctcctgacaagaaaataatagagggacgcaaaaggagaacgaagtccaaaccttgtgagaagactgaaactttacctttatcggatttgagactactaaaaagtgaggtgaagagtaagaaggcttctggaaaaaggactaagaaaaaccttttgaaagacttggatgatcatctatcaactgccaaacctattaaaagacagcaggaaaaggtcagtgtggatttgcatgatgttggtcaggatactcaaatggctatcgaagctatagaagcactggcacaaagttcccctgctgaaaacttgtcagccgaagttgaacctccagtgaagagagatctgagagttgtatctaaagtagaaaaagtaacccaaagagtgaccctcctagaaagagaaccagcagcgtccaggaaggtgtcacgacacgttctaaaagaataaaagtaactgagatgaaccacaaacctcagaaagacgtgcgacaaaatttagaagatcgtgcaacaaagacgaaacataagcaggcaaagccagtaccacagaagaataaagttacgaagatagttgatggaaataagtatgacagtacacctattgctcatcgaacaaggcacactggtagaaataacctctatgagtctcctgagttatgttctaataagaacttaaagaaggccactgttggagaagtaagaaataaccatagtgaacatgtactcgagagaccgatgattagtgagagaaccgcagaatatggttcggattctgtgttaaaagaaaacacagagaatacatgtgcaaataatgctcagggtcttcagcaaagtactgatgcaagcatacggcataccggtgcaaatgttgctcagaaccttgaaccattaagagatgaaccaacaactcatgtcttccgcagagagccctcatctcaccccaaacagagaagaacacctactgcagtggtacaggcaaaggctcctgcagttaccgaggctgctacaggtcatgatgtacaaccagaagtgacaaggccatccaagaaaagacggatttttattagcagttcagaactgctaacgtatgcaaggagggagcgctctgattgcagatcaacttctttgctgtctagtattatcacacaatcatcagctgcttctcctgtacttgattcttcatcgggagttaacagcaaaacttctcgttttagtacctctgatcggcgacaaaagaaaccacccggtgttaaggatgcaagcaactcaccaaaatgtaactctccagttccgaatagtgccctgaaaacaccttctaaagtggtaaacaaattgtcgcctgctttcagtcctctaaatccatcgaaagcttcgaataggagcttgttgaaatcctctgttgccaaagagctgctggagttagatcctgaaaatgctctaccaagtcgataccgaaaggattctagaagaaaagatatgaccagttgcagtattattttcagccatcatttggatgaggatgtgatcaagcgtcagaagaagatcttggcacgcttaggagcccatgaagcactttccgttgcagatgcaacacattttgtggcggatggtttttaccgcacaaagaatatgctggaggcagttacacgtggcaaactggtagtgacatcaatgtggcttgaaagttgtggagcagcaggctgttttgtaaacgataagaagtatattctgagggatgccaaaaaggaaaaggagatgggtttcagcatgcctatatcactggcctcagcttgcaagagtcctctgctgttggggaaaagagtgtttgtgacacaaaatgtgaagccaagtcgggaggtggtgacaagcttggtttccgcatcttctgggcagccattggagaggatgggtaggtccataaggaaggaaaaggaagcaccagatgacctactggtcatctcatgtgaagaggactacgaaacatgcgctccactcgtcgagaaaggtgttgatgttttcgatgcggagcttctgctgaacggtatagtcacccagaagctcgattacgagagacaccgccttttcttggaccgtgtgaagcagacccgctcgacgaggtggctgaaagacggtgcccacgggcggtttgtgcccgtatcgaagagttgataccatagcagtgtaaatgtatggtgtggtacagcccatgcctgtttatgcccatcctcgagttctagctcggttgtgattaaaatctgtaagttgtagggtgtttatatgtgtctcggttgctttaaacctttgtttgcatgcatcttggtcacgcttgtagctgctcatgagttatgatggccagttctaatggctgccttgat

SEQ ID NO: 4585 - DNA, 1000 bp, Avena sativa
aaactaggttattgccgtaccatgttgttgccgactacgaggctgaagaagatgacaggatccttgacagtgacgcaactggccagattcttctcgcctgcagcaatgggatcataacattctggtaaagattgccgagttcacgacaacttttgagaagcaagtgttggcatacaacataatgaccaagaaaagggccattggcgagttccgatcggaggagcggctcatgctagagcaggctttgttacaggaggagaagcaggctacgatggaactaagagccgagatagaattgagggagaaagcaggccgtgaagctaagatgcgtatggcaatggctgagcatgctcgagtggaggcccaagcacactctgagatgattggccagggccctctgagggccaatgctgctgcatcccaaggcgacgatggccctagtcatgacatggcgcaagaacagggcgaagatggatgggaaaacgctgaaagggatgatgacgatgatccatctgaagattttctcaacgatgacaacgagccagagaatgggaactctgctatgcaagaagactggcgtagatcaggggagtttgatctgaactctaggtaagaccggtgaactggacttaagaaaaaggcttgatgatgcaccggctggtgcctggtaacctatctctagttctctggttgtatggtttgaagataatctatcccgtctttgttgctgtaaacttgcaactgcagactagtgagctactctggtgttcaacaatgtctatataaagttaagatggcctctgtatgttgtgaagtcttgtacgtagatgggtttccatgcacatgagcaaaggcagtgtaggtgccacaattaatttttctggacttgtaccgaacaaaattctgagctatcaggacgaatcttagggctcgtttggaagccatcatttcatttgatttggcagaaatgaaatgaaataatgctgttgtcatcaaaaaa

SEQ ID NO: 4586 - DNA, 4802 bp, Oryza sativa
gttttctcccaaaacgtacgcgtgttacagtgcagtgtaacggattttgcccgaaactgaagctccaccaccgtttcccccacagatctcactcctcgctgctcccccgccatggacgacgccgcgaaccccaccccgacttcctcctcctcctccgccgccgccgcagccgcggccgccgcggcgcagcaccagcagcttcagcgccagatcttcctcatgcagcaggcccaggcgcagtcgcagtcgcagggccacgccccgacgccgcagcagctgtcgcagcaggccatgtcccgcttcccctccaacatcgacgcccacctccgcccgctcggccccatccgcttccagcagcccccgcagccgcagccgcagccgcctcagcctccgccacagccgcaaccgcagcagcagcagccgcactccggggccccgtcgccgtcgcagtcgcaggcgtccccccagcagcagcagcagcagcaggcggcggcgatggcggcggctgcggcgagggtgcggagccccgaggtggagatggcgctgcaggacgcgatgcgggtgtgcaaccccgacatcaagacgcccttccagtccctcgaggacgccgtcaacaggtgggggaatcgcaccaaatttctctgcatcttttttttttcttatatacgttattatccacgatgttgctggtaatcctcatccatttgatttcgctgcgtcagctgaaattggggtgctttaatttttttttaactgtatactgatttaggctacgccttccggatgaatttgttgccaattcgggcttgaggcttgcccggatcgtttcccatttattgggtttcgatgattagaatttgggagcgtcttagaaattttagcattaatcttcattccttgttaaacacattagacaaaattgtcccaaaaggtgaatagtaggggcattaggggattggaggatcaggacaacattttggcctgtatgtcttttcttttccacagagcagattgttaatgctgtatgtggttcatgagtgaaactcgtggtccaatttaggaccagtttagcacgaattgcaggtgacatacttttcggcatatgtgcctctggttattttctattgatggggattttgtttatttaaggtgacatacttttagcttttggtcatataccaaccagtaattgcaagctggtttcttcgtgtagtaacttgagtgattttatggattgctttatcttagcagattgttatcttagatgttttaactccagttattcttaacccacataagatttttaactgttttagtcattcttaacttcttttccctgatccattccattttagtgactgaaaaattcttgtttcagcattttgctcaaaatgcttaatgagcatacaagcaaagaatgtagtcagagcaaccagaagttatgctgcataaacgaagttgaataaaccaaattgcattcagtattctttaagatagcaaattttcctccttgtttctatttggtgataaatgcaaaggtccataatacttttactagcttttccaaataatcgctgtccatggttgagtggaataaatggtatgcatctgctgttaaggtcaatactttatttagtaatattttctttggtagtagaaaactcttttattttgctcggatcttactatattgtataatgatttaggtagaactatggcagggcatattgtattgggaacatttataggaaccctattgcattccaagagatgtatgaagcacaacgaccaccctacaatgagagccttcctgttcattctttgcctcctgtcaaaaataagttttggaaattaacatggttttcaaaatgcaacaatgaccactaatttcttttgcaacgtatttataaaacctaactccattacaaaagtactttctgtaacaaatctacacatacaattttcatttttcttgcttacaatccaaatatttgaaaagatatacatgtatgaagttttgacttaggacatgtccaaattgacatatatttttcactggaaggggtataccttatatatctttgtatgatttcttagaaaaatatgactgcacctattagtgtgaacattttcgtgagaaaaagagttgcttctgggtgctggggccaatttatgtaccaacaagtttgttctgtatgaaactactctttatgagaaaaactgggaaaaaagattttaatgttaggatgtctgtgcaaaaattattaagtattatataaatatgttttgagaacacaaatattctaactgtctgtggacgataggactaactgcatacaattactacttgagttccttcaaatttttagtgcacatattaaccagatctttttctattatctttttatggtatagttgggcacacagtatacacgcttctagatttgtttccttttgatatatgtggttgcctctggcattcaaggtgttaaattcacagcaaccatttttcttccagaccataaaaagcttaatacttggaccataagtttaatagtgtaacctctgaaaattggttggctgcctgccacaggagttctatttgttaacatgcatgatggaaggcagatcagtcctagttttggtagtttttcaataacagggttgtaatcatctattttgttaaatataatttgcgttgtttaaaaacaatgggaattacagggtggcatatttccaattttaagaatctgggtggcatgaaacgccgtgttttgaagtggcgtgtaccacattttctgtttagatattaccatttttaccaatgttatagtcatgtttaaaatactaaatcggcactgttttgattagcggagcacataaaaaagattactaccttccattcggacccacacggttttgacccaaaaggtatctgcgtagtcacatccaactggcaagtttaggactggtgtatcctttccaaaaaagtttaggactggtttaacaaattttgcccgaaacaaaagccccaccatttcccccagatcttctcctctagccaatccacctccgcccccaccatggacgccgccgcgaactccaccccgacctcctcggcatccaccgtggcgcagaaccagctgcaccagcgccagatcttcctcatgcagcaggcccaggcccaggcgcaggcgcaggggcaagggcacacaccgacgctgcagcagctgtcgcagcaggccatgtccttcttcccctccaacatcgatgcccacctgcccctgcctggcccggactccaccccgacctcctcggcatccaccgtggctcagaaccagctgcaccagtgccagatcttcctcatgcagcaggcccaggcgcaggcgcaggcgcaggggcaagggtacacaccgacgccgcagcagctgtcgcagcaggccatgtccttcttcccctccaacatcgatgcccacctgcccctgcctggcccgatccgcttccagcaacccctgccccagcagccaccaccgccgcagcagcagatccactcctggggcccgtcgctgttgcagtcgtgggcgtccctccagcagcagcagcaggcggcagtggcagccgtggcaagggtgcagagccctgaggttgagatggctctgcaggacgtgatgcaggtgtgcaaccccgacatcaagacacccttccagtccatcgaggatgccgtgaacaggctactaccctaccatgtggttgctgactatgaggctgaagaagatgacagaatccttgacagtgatacaactggacagattccttcgcgcctgcagcaatgggatcataacattctggtcaaaattgctgagttcacaactacttttgagaaacaagttttggcgtacaatataatgaccaagaaaagagccatcggcgagttcagatcagaggagcggctcatgctggagcaggctttgttaatggaggaaaagcaagctatgatggggctaagagcagagatagaatcaagggagaaagcaggtcgtgaggctgctgaagctaagatgcgtatggcaatggctgaacaagctcgagcggaggcccaagcgcactcggagatgataggtcatggccctttgagggcccatgctgcagcgtcccaaggcgaagatggccctagtcatgagatgatgcaagagcaaggtgaagatggatggggaaatgctcaaagggacgatgaagatccatctgaagatttccttaatgatgaaaatgaacctgagaatgggaactctgatatgcaagaggactggcgcagatcaggagaactcgatctgaactctaggtaagattggtgagctggctgagattgtgggggaaaaataagaaccatgaaagtaggtgaaggcatgcgttacatctgccaataacttttatctctagttaagtacttaactggttgtatgatccgaggttaagttagctgcctttgtggctgtaagctcgtgattttaagctacctgttagctgccctgttgttaaacagcgtgcagaatgttgtgatagcctcttttgtttcacttcactctgtttttttaagatgcgttgttaggatgttggttttattcttagttacttctgattttctagttggtgctctccaaaatatcccctgttagtgcaacttgtgctaatgtaacttatctaactcaactcagcttgcgctaatgtagctattctaaatcaagtcacgtagttcaactaaaatgtttggtaggtgttatacccaggacatgtatatagcggag

SEQ ID NO: 4587 - DNA, 1362 bp, Setaria italica
ggcaccaccaccaccatggacgacggagggaaccccacccctccgccctccacctccacctccaccgccgcggccgcggccgccgccgccgcgcagcaccagcagctccagcgccagctcttcctgatgcaacagcaggcgcaggcgcagtcccacccgcagcagctgtcacagcaggccatgtcccgcttcccctccaacatcgacgcccacctccgccccctcggcccgctccgcttccaccagccccagcagcagcagccgcagccccagccgtcccagccgccccactcccaggggccctctcagtcgccatcgcagggggcgccgcagcaggcgtcgccccatcaccagcagcatcagcatcagcagcagcagcaggcggccgcgcaggcgcaggcacaggcgcaggcggccagggtccggagccccgagatggagatggcgctgcaggacgccatgcgggtgtgcaacccggacatcaagacccccttccagtccatcgaggacgccgtcaacaggttattgccttaccatgttgttgcggactatgaggctgaagaagatgacagaatccttgacagtgatgcaactggccagattccttctcgcctgcagcaatgggaccataacattctggtgaagattgccgagttcaccacaacgtttgagaaacaagttttggcatacaacataatgaccaagaaaagggccatcggtgagttcagatcagaggaacggctcatgctggagcaagccttgttacaggaggaaaaacaggctatgctgggactgagagcggagatggaatcgagggagaaagccggtcgcgaggcagccgaagctaagatgcgcatggcaatggagcatgctcgggctgaggcccaagcacactctgagatgatgaatcatggccccattcggggcagtgctgtggcttcacaaggggaggatggccctagtcgtggcatggaacaagaacacgctgaagatgggtggggaaatgctcagcgcgatgatgaagatccatctgaggatttcctcaacgatgagaacgaacccgagaatgggaactcagatgggcaagaggactggcgcagatctggggagcttgatctgaactctaggtaaggcaggtgaactggcacaggttgagtgaactagatcgtaattctaggtagggctagtattctgcagctgatggttttttatctatacttgtcttgttgtttgttttcaagatcatgtaaccttactttgtggccgtaaacatgccattttgaacaaagtaatttctctgtatttgacaatatctctgttcctcaacaaggtgccatattagtcaagtttacacccctgaga

SEQ ID NO: 4588 - DNA, 1369 bp, Zea mays
gagccacgcacctggtttcgtccccaaatctcactcaatccccagtcccgacacccatcctctccaccgaagtcaccaccgcatggacgacgccgcgaatcccacccctccaccatccacctccgccgcatccgcggcggccgcggcggcgcaacaccagcagctccagcgccaactcttcctaatgcagcaggcgcagtcccatccgcagcagctgtcgcagcaggccatgtcccgcttcccctccaacatcgacgctcacctccgccctctagggccgcttcgcttccaacagccccagccccagccccagccgtcccactcccagggtccatctcagtcgccgtcgcaggccacgcagcaggcgtcaccccagcagcagcagcagcaggcggcggcggcggcggcagcggcgcaggcacaagcacaggcccaggcccaggcggcacgggtacgaagccccgagatggagatggcgctgcaggacgccatgcgggtctgcaatccggacgtcaagacgcccttccagtccatcgaggacgctgtcaacaggttattaccttaccatgttgttgccgactatgaggctgaagaagatgacaggatccttgatagcgacacaacaggccagatcccttctcgcctgcagcaatgggaccataatattctggtgaagattgctgagttcacgacaacttttgacaagcaagtattggcatataacataatgaccaagaaaagggccatcggtgagttcaggtcggaggagcggctcatgctggagcaagccttattgcaggaggaaaagcaagctatgctgggactgagggcagagatggagtcgagagagaaagctggtcgcgaggctgccgaagtgaagatgcgtttggcaatggagcatgctcgtgctgaggcacaagctcactctgagatgatgaatcatggtcctataagggccagtgctgttgcttcgcaaggggaggatggtccgagtcatgacatggtgcaagaacatggcgaagatgggtggggaaattctcagagggatgatgaagatccatcggaggatttcctcaacgatgagaacgaacctgagaatgggaactcagatgggcaggaggactggcgcagatctggggagtttgatctcaactctaggtaaggcagttggatttccacatgaaggtttctaggtaggctacgacatgctggtattgtatctactattctattgttgtgttcggtgaagatgtctttgtggctgtaaacatggcattcgaacaattcagtttctttgtaatttgactagtaatatttacttgagcactcaatatgtgccatttccaacttggagaaaaaaaattacaat

SEQ ID NO: 4589 - DNA, 1157 bp, Saccharum officinarum
tcgcgcaacaccagcaggttcagagtcaactcttcttattgcagcaggcgcaatcccacccgcggtagctgtcgcagcaggccatgtcccgcttcccctccaacatcgacgctcacctccgccccctaggcccgcttcgcttccaacagcctcagcagccccagccgtcccactcccagggtccatcccagtcgccatcgcaggccacgcagcaggcgtccccccagcagcagcagcaggcagcggcggcggcggcggcgcaggcccaggcggcgcgggtacgaagccccgagatggagatggcgctgcatgacgccatgcgggtctgcaacccggacgtcaagacacccttccagtccatcgaggacgctgtcaacaggttattgccttaccatgttgttgccgactatgaggctgaagaagatgacagaatccttgatagtgatacaacaggccagattccttctcgcctgcagcaatgggaccataacattctagtgaagattgctgagttcacgacaacatttgacaagcaagtattggcatataacataatgacaaagaaaagggccattggtgagttcaggtcagaggagcggctcatgctggagcaagccttattacaggaggaaaagcaggctatgctgggactgagagcagagatggagtcgagagagaaagctggtcgcgaggctgctgaagtgaagatgcgcatggcaatggagcatgctcgtgctgaggcacaagctcactctgagacgatgaatcatggtcctataagggccagtgctgttgcttcgcaaggggatgatggtccaagtcatgacatggtgcaagaacatggtgaagatgagtggggaaattctcagagggatgatgaagatccatctgaggatttcctcaatgatgagaacgaacctgagaatgggaactcagatgggcaggaggactggcgcagatctagggagcttgatctgaactctaggtaaggcagttggatttgcacaggttgagtgaactacatgaaaaattctaggcaggctacggtatgctggtattatatctattgttctattgttgtttttggtgaagatgatttaaccggtctttctggctgtaaacatgccattcaaacaaattaggttctctgctgtttg

SEQ ID NO: 4590 - DNA, 1365 bp, Panicum virgatum
tccgccaccaccatggacgacggagggaaccccgcccctccgccctccacctccacctccaccgccgcgcagcaccagcagctccagcaccagctcttcctgatgcagcagcacgcccaggcgcaggcgcaggcgcaggtgcagccccacccgcagcagctgtcgcagcaggccatgtcccgtttcccctccaacatcgacgcccacctccgccccctcggcccgctccgcttccaccagccccagcagcagcagaagcagcagccgcagccgcagccgcagccccagccgccccactcgcaggggccctctcagtcgccgtcgcagggggcggcgcagcaggcgtcgccgcaccaccaccaccaccagcagcagcagcagcaggccgcggcggcgcaggcgcaggctcaggctcaggctcaggctcaggctcaggcggccagggtccggagccccgagatggagatggcgctgcaggacgccatgcgggtctgcaacccggacatcaagacccccttccagtccatcgaggacgccgtcaacaggttattgccttaccatgttgttgctgactatgaggctgaagaagatgatagaatccttgacagcgatacaactggccagattccttctcgcctgcagcaatgggaccataacattctggttaagattgccgagttcacaacaacttttgagaagcaagttttggcatacaacataatgaccaagaaaagggccattggcgagttcagatcggaggaacggctgatgctggagcaagccttgttacaggaggaaaagcaggctatgctgggactgagagcggagatggagatgagggagaaagctggtcgtgaggctgccgaagctaagatgcgtatggcgatggagcatgtgcgggctgaggcccaagcgcactctgagatgatgaatcatggtcctattcgggccagtgctgtggcttcacaaggggacgatggccctactcatggtatggaacaagaacagggtgatgacgggtgggaaaatgctcagagggatgatgaagatccatctgaggatttcctcaatgatgagaatgaacccgagaatgggaactcagatgggcaggagaactggcgcaggtctggggagcttgatctgaactctaggtaagacaggtgaactcgcacaggttgagtgaactaaaaattgaaattctaagtaggactaggatgctagtattttatctatagttcgcttgttgtttgtgttgaagataatgtagcctgtctttctagctgtaaacatgccatttcaaacaaattaacttttctagtatttgacagtatatcggttcctcaaatcatataaagtgcagcaacc

SEQ ID NO: 4591 - DNA, 922 bp, Panicum virgatum
tctgtagcctttctaaattataatatctccttttacattaacttcaatatgttatcttactcatataactattctgatcctgttaaattaggttattgccttaccatgttgttgctgactatgaggctgaagaagatgatagaatccttgacagcgatgcaactggccagattccttctcgcctgcagcaatgggaccataacattctggttaagattgccgagttcacaacaacttttgagaagcaagttttggcatacaacataatgaccaagaaaagggccattggcgagttcagatcggaggaacggctgatgctggagcaagccttgttacaggaggaaaagcaggctatgctgggactgagagcggagatggagatgagggagaaagttggtcgtgaggctgccgaagctaagatgcgtatggcgatgggagcatgtgcgggctgaggcccaagcgcactcagagatgatgaatcatggtcctattcgggccagtgctgtggcttcacaaggggacgatggccctactcatggtatagaacaagaacagggtgatgacgggtgggaaaatgctcagagggatgatgaagatccatctgaggatttcctcaatgatgagaatgaacccgagaatgggaactcagatgggcaagagaactggcgcaggtctggggagcttgatctgaactctaggtaagacaggtgaactggcacaggttgagtgaaccaaattgaaattctaggtaggacaaggatgctagtattttatctatagttcgcttgttgtttgtgttgaagataatgtagcctgtctttctagctgcaaacatgccatttcaaacaaattaacttgtctagtatttgacagtatatcggttcctcaaccatataaagtgctgcaaccaattcacagttta

SEQ ID NO: 4592 - DNA, 1243 bp, Sorghum bicolor
actttgttcaagaaacaaataacattacatagaaaatcataaaaagtacacatatgcatctagccattgagtcaacaatggtgctaagcaaatgctgaattgtaggctgcacttgtctgaagatatcatcatttctcactgtccaaattgaccagctcatggtgacaatgatctccatgaagaaatgaataagttgtgccattattatctcctgcctttgtaaactgtatgatctcttcattctccatatggtattttactcataccatttattccatttgtgttaaaactaggttattgccttaccatgttgttgccgactatgaggctgaagaagatgacagaatccttgatagtgatacaacaggccagattccttctcgtctgcagcaatgggatcataacattctggtgaagattgctgagttcacgacgacatttgacaagcaagtattggcatataacataatgacaaagaaaagggccattggtgagttcaggtcagaggagcggctcatgctagagcaagccttgttacaggaggaaaagcaggctatgctgggactaagagcagagatggagtcgagagagaaagctggtcgtgaggctgctgaagtgaagatgcgtatggcaatggagcatgctcgtgctgaggcacaagctcactctgagatgttgaatcatggtcctataagggccagtgttgttgcttctcaaggggacaatggtccgagtcatgaaatggtgcaagaacatggtgaagatgggtggagaaattctcagagggatgatgaagagccatctgaggatttcctcaatgatgagaacgaacctgagaatgggaactcagatgggcatgaggactggcgcagatctggggagcttgatctgaactctaggtaagccagttggatttgcacaggttgagtgaactacatgaaaattctaggaaggctacaatatgctggtattgtatctattgttcaactgttgtttttggtgaagatgatttaaccggcctttctggctgtaaacatgccattcaaacaaattagcttctctgctgtttcactatagcaatactagatggtagccatgcgttgctgcgggaacttgtagtattgagagggctaataattgatgaaatgagaaatagtaaaataataaagttacatatattctttttattagggtcagattccattttttgatattaaaggaattcactcaccacgtgtttgat

SEQ ID NO: 4593 - DNA, 1026 bp, Pennisetum glaucum
gcagcagcagcagcagcagcagcaggcggcggccgcgcaggcgcaggctcaggcgcaggcgcaggcggccagggtccggagccccgagatggagatggcgctgcaggacgccatgcgggtctgcaacccggacatcaagacccccttccagtccatcgaggacgccgtcaacaggttattgccttaccatgttgtagcggactatgaggctgaagaagatgacagaatccttgaaagtgatgcaactggtcagattccttctcgcctgcagcagtgggaccataacattctggtgaagatagctgagttcaccacaacgtttgagaaacaagttttggcatacaacataatgaccaagaaaagggccatcggcgagtttagatcagaggaacggctcatgctggagcaagccttgttacaggaggaaaaacatgctatgcttggactgagagtggagatggaatcgagagagaaagccggtcgcgaggcagctgaagctaagatgcgcatggcaatggagcatcatgctcgggctgaggcgcaagcacactctgagatgatgaatcatggcccgattcggggcagtgctgtggcttcacaaggggaggatggccctagtcgtggcatggaacaagaacaggctgaagatgggtggggaaatgctcagcgggatgatgaagatccatctgaggatttcctcaacgatgagaacgaacccgataatgggaactcagatgggcaagaggactggcgcagatctggggagcttgacctgaactctaggtaagacgtgcactggcacaggctccgtggactagatcgtaattctaggtagggctagtattctgcagctgatagtttttttatctatacttgtcttgttgtctgggtttaagatcatgtagcctgtctttgtggccgtaaacatgctattctgaacaaggtaacttctctgtatttgacaatatctctgttcctcaacaaagttctgacccaaaattagtaattcgtctactgattgacgat

SEQ ID NO: 4594 - DNA, 973 bp, Panicum virgatum
ggaactgattagattgaggtgtattgttaatatctgtagcctttctaaattatagtatctctttctgcattaataatgtcaatgtgttatcttacacatataatctattcttatcctgtgaaattaggttattgccttaccatgttgttgctgactatgaggctgaagaagatgatagaatccttgacagcgatacaactggccagattccttctcgcctgcagcaatgggaccataacattctggttaagattgctgagttcacaacaacttttgagaagcaagttttggcatacaacataatgacgaagaaaagggccattggtgagttcagatcggaggaacggctgatgctggagcaagccttgttacaagaggaaaagcaggctatgctgggactgagagcggagatggagatgagggagaaagccggtcgtgaggcttccgaagctaagatgcgtatggcgatggagcatgtgcgggctgaggcccaagcgcgttctgagatgatgaatcatggtcctattcgggccagtgctgtggcttcacaaggagacgatggccctactcatggcatggaacaagaacagggtgatgatgggtgggaaaatgctcagagggaggatgaagatccatctgaggatttcctcaatgatgagaatgtacccgagaatgggaactcagatgggcaggagaactggcgcaggtctggggagcttgatctgaactctaggtaagacaggtgaactcgcacaggttgagtgaactaaaaattgaaattctaagtaggactaggatgctggtattttatctatagttcccttgttgtttgtgttgaagataatgtagcctgtctttctagctgtaaacatgccatttcaaacaaattaacttttctagtatttgacagtatctccgttcctcaaatcatataaagtgcagcaaccagtttcacagtttatatgaatcgaac

SEQ ID NO: 4595 - DNA, 2439 bp, Oryza sativa
cgcagctgcagccctcgcagtcggcttgccgaactatcatattgttctcgctaatgccaatgggcatatgggctcatcgggtgtgcggccctgtcggaacacacccagcggggatggcccctttgccatccctatacccgctaacccgcttcacttctcacatcccaagcccaagataagaatttccctaaaaaaaaaaaaagccatgttctcgctactcagccgtgcgctctgcgccgcctcctcctcgccggcggcgccgcgggggagatctcttctcgccgcgctgctctccccgtcggctagccctctcgacccatgccggggccctgctgcgccggagccaccgaggcggcgggcgttccatggctcgccgagccccctggggttcaggtccacaccggcgtcgtggtccagcccggaggcgggggcggccgtcggtggggacgacgggctggaggtcgcgaggctggggatctcgccgtggatcgtggagaggctcgccgcacggggcatcaccaggctcttccccatccagagggctgtccttgatccagcaatgcaaggcaaagatatgattggacgtgcaagaactggaactgggaaaacgttggcttttggtattcctatcatggacaggattcttcgtcacaatgagaagaatgggagtggtagaaatcctttagccataattctcgcacctactagagaacttgctagacaagttgagaaggaatttaaggaatctgctcctttggactctctttgtgtctatggaggtgttcccatcagtcatcaaatgagagctcttaattatggtgttgatgttgtggttggaacaccaggtcgaattattgatcttttaagaagaggtgttttaaacctttctgagatccaattcgtggttctggatgaagctgaccagatgttggctgtgggttttgatgaagatgttgaggtgatcatggagaatttgccacagaaccgtcaaagtatgttgttctctgcaacaatgcccagttggattagaaaaatcacaagcaagtacttgaaagatccaatcattattgacctagttggtgatgaggaccagaaattacctgaaggaatctctctttattcaattgcctctgagcactatgggaagccatcaattcttggtccattgatcaaagagcatgctaatggtggaaaatgtattgtgtttactcaaactaaacgagaggcagatagattagcatatgctatgggcaggagctatgcatgtcaggcgcttcatggggatatttcacagaatcagagagaaaggacactatcaggatttcgagatggccgctttaatatcctagtagcaaccgatgttgctgctcgtggattagacatacccaatgttgatcttgttatacattacgaactcccaaacacctcggagttatttgttcacagatctggacgaactgcacgagcagggaagaaaggaagtgcaattttaatatacacaaatgatcaagctagagctgtaaggatcattgagcaagatataggatgcaaattcacagagcttccaaagattgaagttgcagatgaggcctcagacatgtttaatgttgtgagagacaatcgctctagattagctggaagcccaagaaccggtggctcctctttcggacgaggaggctatggtggttttggagaaggccgttcccggggctttggtgattttgatggctttggcagttcccctaatcgtggtgggagatcacgcgatgctggttcaagatatggcagtgggtttggagattttagacgaccctccaatgcctttggcaggtctagttccaagcagcctgatggattcggatttggtgactttggagaaggcaatttcagtagaaatggcaacagacgctctaggagttttgatgattcaggttcgacacggtacagcagacgccctaatggttttggaacatcagatttcggcagatcaggcgggttcgatgattccaactgatcacaggactccggtttgtatagttttgtggtttttgaccttcaatcttcttttctatgtcatgaatgagatcaccaatcgctttttctggcgcttggcctaagtagtctgttgttgtagccaaataagtagccttgcttgtgtattaggtttgttccaaaacatgtaatgtatatactctagcctgtaccttttggttatgcactctctcaacaaagtgtaagaaaattctgaaaatgaggaacctttcattatttatgtccatgtactccctgttgaattgcactttgacccctatcatctcgtttggtggtactttggcatccaaacatcttattgtgattgggaatggtatatgtttcagcttcaaccacgtacatgttgtttctctgtatgcttctaaactgcggcagattttttttttt

SEQ ID NO: 4596 - DNA, 2237 bp, Brachypodium distachyon
tcgactccaacccagaagctccgccctctcatctcaaccgccgccatgaactcgctgctccgccgcgcgctcaccgcctcccggtctgccgcgcagccgcggagaacgttcctcggcgtggccctcctctctcccccgcctgccagctctcccgactccccatgccgggctgcggttccgccgccgccgatgcggcgggcgttccacgcctcgccgagacccctggggttcagggccaccacccctgcgtcgtgtcccggcacggtcacggaggccggcgccggggaggacggcctggaggtcgcgaagctggggatctcgccgcggatcgtggagaggctcgccgcgcggggcatcaccaggctcttccccatccagagggctgttcttgaaccagcaatgcaagggaaggatatgattggtcgtgctcgaactggaactggaaaaaccttggcttttggcattcctattatggacaggattcttcgacacaatgagaagaatggaactggtaggaaccctttagctatcattttggcacctactagagaactcgctcgacaggttgagaaggaattcaaagaatctgctcccttagacaccctctgtgtctatggaggtgttcccatcaatcagcaaatgagaactcttaattatggcgttgacgttgtggtcgggactcctgggcgaattattgatcttttgagaaggggaaatttaaatctttcggagatccaatttgttgttctggatgaagctgatcagatgctagctgtgggttttgatgaagacgttgaggttatcatggagaagctgccacaaaaccgtcaaagcatgctgttctctgcaacaatgcctagctggatcagaaaactttcaaaccaatacttgaaagatccagtcataattgaccttgttggcgagtcggaccagaaattacctgaaggaatctctctttattcaattgcatctgagaactatgggaagtcatcaattcttggtacattgattaaagagcatgctaatggtgggaaatgcattgtttttacacaaactaaacgagaagcagatagattggcatactccatgggcaggagttatgcatgtcaggcgctccatggagatattacacaaaatcagagagaaaggacactgtcaggatttcgagagggtcgctttaacattctcgtagcaactgatgtcgcagcccgtgggttagacatacccaatgttgatctagtggtacattatgaaattccaaactcctcggagttatttgttcacaggtctgggcgaactgcacgagcagggaagaaaggcattgccattctaatgtacacatatgagcaaagtagagctgtaagggtcattgagcaagacattggatgcaggttcacagagcttccaaagatttcaggtacagctgaggctgcagacatgtttaacgtttcaagagatccccgctctagatcagctggaaccagaactgacggctcctttttcggacgtgaaagctacagtggcttcggcggacgctcttcccgtggcttcggtgatcctgacggctttggtggtgcccctgatggtgctgggtggtctcgtgacacgggctcaagatcccgtggcgggtttggagattctcgacgaccttctcgaccgttggatggctcttttggcaggtctagcttcaatcgctccggtggattcagcgactttggagaaggcaattttggcagaaatgataaccccgatttccgtcgcccgaggagtggtgatgactcaggctcttcccggttcggcagaagctccggtggtttcggcgcctcagattttggcaagccaggcagcttcaaggattgacagactgatcagagggctaaccggtgcttttcaaccactggtgtttcctttccatgaatgagcaataccactctgtcggttcttttgtatctagggttgtttcagaaacatgtttgctctgtcaatatttgtacgagtaatttttaggaagattttttttctttttgaaagcaaggaagaatgtttctgatgcatgtgcctgaatgcgtcactgtagcccaacaaagtaccctcttcatttcacaaaggttgacgtattttgtttcgttaggacaaacctttaaccaagaattaatatattaatatgtaagttatatgatacgaaatcatgatcattaccaagaacttttaagacgaatctattgatataaatttca

SEQ ID NO: 4597 - DNA, 2402 bp, Triticum aestivum
gtctcggctcgaccttccaacaccagcacgaggacgtctcatctcaaccgtcgccatgaactcgctgctccgccgcgcgctctctgcctcctcttcgccggcgcgtccgcagagagcgctcctatcggcgcttctctctcctccgccggccggctctccccagccatgtcgcccccccgcgccgcagccgctggagccaccgaagcagcgagcgttccacgcctctccgagacccctggggttcaggtccactacccccgctccgtggcccgggacggtctcggaggccggcgcggcagcgggggatgacgggctggaggtcgcgaggctggggatctcgccgcggatcgtggagagactcgccgcgcgtggcatcaacaggctcttccccatccagagagctgttcttgaaccagcaatgcaagggaaagacatgattggccgtgctcgaactggaactggaaaaaccttggcttttggcattcctatcatggacaggattcttcgtcacaatgagaagaatggaagtggtagaaatcctttagccatcatcttggcacctactcgagaactcgctcgacaagttgagaaggaatttagagaatctgctccattagacactctttgtgtctatggaggtgttcccatcagtcagcaaatgagaactctcaattatggtgttgacattgtggttggaactccagggcgtgttattgatcttttgagaagaggtgtcctaaacttatcagagatccaatttgtggttctggatgaagctgatcagatgctggctgtgggttttgatgaagctgttgaggtgatcatggagaagttgccacaaaaccggcaaagtatgctgttctctgcaacaatgcctagttggatcagaaaacttacaaaccagtacttaaaagatccagtcataattgaccttgttggtgactcagaacagaaattacctgaaggaatctctctttattcaattgtatctgagaactatgggaagtcctcgattcttggtccattgattaaagagcatgctgatggtgggaagtgcattatatttactcaaactaaacgagaagcagatagattggcatatgccatgggcaggagttatgcatgtcaggcgctgcatggagatatctcacaaaatcagagagaaaggacactctcaggatttcgagatggccgctttaacatccttgtagcaactgatgttgcagcccgtggattagacatacccaatgttgatctagtggtacactacgaaatcccaaactcgtcagagttatttgttcacagatctggacgaactgcacgagcagggaagaaaggcattgccattctaatgtacacatatgaacaaagtagaactgtaaaggtcatcgagcaggatataggatgcaggttcacagagcttcccaaggttgcagctacagatgaagctgcagacctgtttaatgttatgagagacactcgctctagatcagttggaaccagaagaagtggtggttcctctttcagccacgacggtggctttggcgaacgccactcccgtggctttggtgattttgacagctttggcggtacccctaatcgtgctgggtggtccggggatgcgggttcaagataccgtggcgggttcggggattctcgacgaccttctcaaccttccaatggctttggcaggtccagtgggtttggagattctcggcgaggtcctcaaccttctgatggttttggcaggtctagcttcaatcgcccgggtgggtttggcgaatttgaagaaggcaacagcagaagtggtcggttccccaggagatccgatgattcagacccttcacggtatggcagaagctccaatggttttggcacctctgatttcggcagaccaggcagcatcaaggattaaccatcggatcagaggatttaactgtgtacagctccgatgagcctttcgaccactcgtgtttttcttgcatgaatgagttcaccaatctctctgtgtagttcgttttgtatcttgggttgtttgagaagatgtatgctctgtgaatatttgtgatgtttttaggacagaataattgcgatgcatgcgcctggtgctcgttgtatttcatggggaaaaaactcatcttgtgcccctcatgaaagtttgggctgggcgccatttccctgaaatgtttggtcaggctcaggcaggtttctaagtttatactccctccgtatcaaaatataagacgctttgacattatcatagtgtcaaaaagcatcttatatttcgatatagagagagtatttgagtttgctgcacattctttgtaggaaacactgtcatcttatctgatctttgctgtttgtacagcttgatttgaggggcaggagaatccaaatttgtt

SEQ ID NO: 4598 - DNA, 2821 bp, Panicum virgatum
actggacgcgggcgtggcggcgggggaggacggcgggctggagatcgcgaagctgggcatctccgggcggatcgtcgagaggcttgccgcgcggggcatcactaggctcttccccatccagagggctgttcttgagccagcaatgcaaggaaaagacatgattggccgtgctcgaacaggaactgggaagaccttggcttttggtattcctattatggacaggattattagctacaatgagaagattggaagcagtaggaatcctttagccatagtcttggcaccaacaagagaacttgctcggcaggttgagaaggaatttagagaatctgctccattggacactctctgtgtctatggaggtgttcctatcaatcaacaaatgagagttcttaactatggtgttgacatagtggttggaactcccggtcgaattattgatcttttgagaagaggtgttttaaacctttcagagatccagtttgtggttctagatgaagctgatcagatgctggctgtgggtttcgatgaagatgttgaggtgatcatggagcagttgccacagaaccgtcagagtatgctgttctctgcaacaatgcctagttggataagaaaattttcaaacaagtacttaaaggatccagttataatcgaccttgttggtgactcagaccagaaattgccagaaggaatctctctctattccattgcctctgacaactttgggaagccatcaattcttggtccattgattaaagagcatgctaaaggtggaaaatgcattgtgtttactcaaactaaacgagaagcggatagattggcatatgttatgggcaggagttatccatgtcaggtgctacatggggatatttcacagaatcaaagagagaggacactctcaggatttcgcgatggccgcttcaatatccttgtggcaactgatgttgcagctcgtggattagacattcccaatgtcgatctagtggtacattatgagattccaaatacctcagagttgtttgttcacagatctgggagaactgcacgagcagggaagaaaggcagtgcaattttgatatacacgtatgagcaaactagagctgtaagggtcattgagcaagatataggatgcaggttcacagagcttccaaagatgccagttgcagatgaggctgcagacatgtttaatgtcatgagagatactcgctctagatcagttggaggcagaagaacgggtgggtcttttggccgtgaaagttttggtggcttcggagatcgccgctccagcggctttggtgattttggcagcaatggtggttcctttgatcgctgtggtgggttccgcgactctggtttgagatatcgcggtggttctggaggtttcagacgaccttccaatgagtttggcaggtctagtttcagtcgttctgatagatttggcgactttggacaaggggatttcagcaggcgtggctgacctgactttggccgttcctggagccctgatgattcaggctcctcacgttatgggagacaatccgctggctttgacacttcagatttcggcagcttcaaggattccaagcgatgagtggaacagtggttttcttgtacagttctgaaccttttctaactcctgttgttccttccatgcctgagagaacaagacaccgccttgttgcgcttttcgcctaatcatgagtagtttggttgtgtagggttttctccagaacaaatgttgtatttgtaatctgtgtatgtgcctgctgcctgctgtatgttttgattctgtttctttagtaatctgatgaaagtaaacattttttttctgttaatgtacctatgtactgtgttgcttgatctaaactttattatggaactatgactacaggtcaggaattgaatgataactctaagaattattttgttctcaagctaacacggaattcctctgtttcaggttgaatcttaccaacctgacttagagggcctaaaaggcaaaagtgcagggacttccgttttccggcccaatccacggcgatgctttggattgggttgggacaggtcagcagaaacgactgaacgagcgacgacgagacggcgataagattttgccaaaagctcagctgggagaccgcacggacggcggcaagagccaagaggacgaggctccagcaaggcggcccaccacggcttcaagccttcaacaggcggcgtcacgaccaacccagaggcttcacagcagcggcagcggatgtccgactccccacagctccagcactcgcctccccctcccgccccgccgccaccgccgccgccgccgccgccggaggccagcccaacacaagccgagtcagcggcagcaaatgcccagccccagctcaacctgattccggtgaagccgaggatgatcatcaagggcgtgctcgggcggtacgagcgctggaaccccgtgcacccgacagccggcaccttctggggcgtcgggctcggcctcggctgcggcgttggctggggcccgggattcgggcccgaggtgattgggtacgtcggcgccgggtgcggcgtggggttcagcgtcggcttcacgctcgccggcgtcggcattggcctgccgcagcacgtcctcatcaggaacaacgaggacagcggtaagctgctgtgtgcagcgattgcgatgctctttttcttgtgttcacttcaacaaactgccatcagtattggtggattggattatttctttgaccacttgaagcctcagttagtgtactactataatttcttccagtggagaacacaatgaaaaatagggtcaattagc

SEQ ID NO: 4599 - DNA, 1418 bp, Setaria italica
ccacgatgacgacgacgatgatgaggctgaggcagcacctggcctcctcccctatttatacctccgccatcgccaggatcggcaacaacagagcccaccgcctactccccgtcgcaccaccgcaaaagcaccgcccgacaagtaccaccaacaagctcctgctcctgattgttctgctactcttcttcttcttcttcctccgcttggtcccgaccgtcttgttgcccccagcgcgagtcatgtcgtcgtcttcctccgcttcggatgccgctgccgccgtgccgttcgagaagcccagggccgtggtcaagaagctcctcgccgagtcgcagtccgaggggcagggcgccaccgtccggaggagcatcggcagccatgagctcaggaacctggaccccttcctcatgctcgacgaggtctcagtctccaagcccgccgggttccccgaccatccccacagaggattcgagacagtcacctacatgctcgagggagcctgcatccaccaggactttgcgggccacaagggcaccatcagggcaggggatgtccagtggatgactgccggccggggcatcgtgcactcggagatgccggcgggggacgaggtgaataagggcctgcagctctggatcaacctctcctccaaggacaagatgatcgagccccggtaccaggagctccagagcaagaacatcagccgcgccgagaaggacggcgtcgaggtccggatcatcgccggcgaggccttcggcgtgcgctccccggtctacacgcgcaccccgaccatgtacatggacttcaccatgcgcccgggctcccagctccaccagcccatcccggagggctggaacgccttcgtctacatcgtcgacggcgagggcgtcttcagccgggacaagtcggcacccgtgtcggcgcaccactgcatcgtcctgggcgccggcgacgggatcagcgtctggaacaagtccggcgcgccgctgcggttcgcgctggtggccgggcagccgctgggcgagccggtggtgcagcacgggccgttcgtcatgaactcccgcgccgagatccagcaggccatggaggactactactacggcaagaacgggttcgagagggccagccagtggagctcctccgcctgatcatcgatcacccgcttctaaattctgatgcatgcatttcttgagaaattgacatggaagacaaggaaattgctgtcctgcatacctggatgggaaaagactaaagagtagtagaccattagtagatactctgatcttgattatgatttttacatttttttaatgattgtattgtagaagcatgtgcttgtcgtttgtacggtgatttgttataagcaggatggcaaattccactgttcatcataatcaagatacacaatccaagtcaacatc

SEQ ID NO: 4600 - DNA, 1469 bp, Panicum virgatum
cggcaaaggtatttgtagtggcacgtcccatgcctcctcgccacccctcgaacccacgcacaaggatgacgacgacgatgatgaggctgaggcagcacctggcctcccctatttatacctccgccatcgccaggatcggcaacagagcccaccaccaccgcctccccatcgcgccaccgcaaaagctgcgaccaagtactgctagtactacccacaacaagctcctgctcctcctgattcttctgctagtcgtcgtcttcttcttcttcttgatcccgaccgtcttgttgcccccagaccgaaccatgtcgtcgtcgtcgtcgtcgtcttcctctgcatcggacgccgccgcttcgacgccgttcgagaagcccagggccgtggtcaagaagctcctcgccgagtcgcagcccgagggtcagggcgccaccgtccggaggagcatcggcaggcatgagctcaggaacctggaccccttcctcatgctcgacgagttctcagtctccaagcccgccgggttccccgaccatccccacagaggattcgagaccgtcacctacatgctcgagggcgccttcacccaccaggattttgcaggccacaagggcaccatcaggacaggggatgtccagtggatgactgccgggcgtggcatcgtgcactcggagatgccggcgggagacggggtgcagaagggcctgcagctctggatcaacctctcctccaaagacaagatgatcgagccccggtaccaggagctccagagcaaggacatcagccgcgccgacaaggacggcgtggaggtccggatcatcgccggcgaggccttcggcgtgcgctccccggtgtacacgcgcaccccgaccatgtacatggacttcaccatgcggccggggtcggagctccaccagcccatcccggagggctggaacgccttcgtctacatcatcgacggcgagggcgtgttcggccgggagaggtcggcccccgtcggcgcgcaccactgcctcgtgctgggccccggcgacgggctgagcgtgtggaacaagtccggcgcgccgctgcggttcgcgctggtgggcgggcagccgctgggcgagccggtggtgcagcacgggcccttcgtcatgaactcgcgcgccgagatccagcaggccatggaggactactactacggcaagaacggcttcgagagggccacccagtggacctcctcctccgcctgatccacagagaaatcgacacagggggaagaaaaaggaaaacaaaacaattgatgtcctccatcatacttggattggacagagttgaccattagcctatacatactactgtactcttatcttgataactaattttttctctccttattgtcttgtatggtgattgtaataagcagattggagaatttatttacagtctgttctaatataccatcatgatttctttcaatggattaaatttgtcca

SEQ ID NO: 4601 - DNA, 1320 bp, Panicum virgatum
ccaccgcctccccatcgcgccaccggaaaagctgcgaccaagtactgctagtactacccacaacaagctcctgctcctcctgattcttctgctagtcgtcctcgtcgtcttcttcttcttcttcttcttcttgatcccaaccgtcttgttgcccccagaccgaaccatgtcgtcgtcgtcttcctctgcatccgacgccgccgcttcgacgccgttcgagaagcccagggccgtggtcaagaagctcctcgccgagtcgcagtccgagggacagggcgccaccgtccggaggagcatcggcaggcatgagctcaggaacctggaccccttcctcatgctcgacgagttctcagtctccaagcccgccgggttccccgaccatccccacagaggattcgagaccgtcacctacatgctcgagggcgccttcacccaccaggattttgcaggccacaagggcaccatcaggacaggggatgtccagtggatgactgccgggcgtggcatcgtgcactcggagatgccggcgggagacggggtgcagaagggcctgcagctctggatcaacctctcctccaaagacaagatgatcgagccccggtaccaggagctccagagcaaggacatcagccgcgccgacaaggacggcgtggaggtccggatcatcgccggcgaggccttcggcgtgcgctccccggtgtacacgcgcaccccgaccatgtacatggacttcaccatgcggccggggtcggagctccaccagcccatcccggagggctggaacgccttcgtctacatcatcgacggcgagggcgtgttcggccgggagaggtcggcccccgtcggcgcgcaccactgcctcgtgctgggccccggcgacgggctgagcgtgtggaacaagtccggcgcgccgctgcggttcgcgctggtgggcgggcagccgctgggcgagccggtggtgcagcacgggcccttcgtcatgaactcgcgcgccgagatccagcaggccatggaggactactactacggcaagaaccgcttcgagagggccacccagtggacctcctcctccgcctgatccacagagaaatcgacacagggggaagaaaaaggaaaacaaaacaattgatgtcctccatcatacttggattggacagagttgaccattagcctatacatactactgtactcttatcttgataactaattttttctctccttattgtcttgtatggtgattgtaataagcagattggagaatttatttacagtctgttctaatataccatcatgatttctttcaatggattaaatttgtcc

SEQ ID NO: 4602 - DNA, 1590 bp, Brachypodium distachyon
aagcagccggccgcagtcaacgctccctgaaatcccgaattgatcctccatttatctgccccccttggggttccatgatccatcaaccattatcatggcccagaaggtgctcgcggccacgacgaggctgaggccttcttcttcttcctcttcccctatttatacggctctcgcgcggctcaccaagcgcaacagcagccaccgtcttctctcctcctcctccagaaacacaacaagtaaagccaagtccaaacctatcctcctcttgctcatcctcttcctcctggttgttgctgtcgtcgtgaccgtcttgctgttcccagcgctcgccatgtcgtcgtcgtcagcgtcgtctgcggttgcggccgggccgttggagaatcccagggcggtggtgaagaaggtgctggccgagtcgcagcccgagggtcagggcgccaccgtccggcgcagcatcggcaggcacgagctccggaacctggaccctttcctcatgctcgacgagttctcagtctccaagcccgccgggttccccgaccacccccaccgaggattcgagaccgtcacctacatgctcgacggagccttcacccaccaggacttctcgggccacaagggcaccatcaggacaggagatgtccagtggatgacggcgggccgcggcatcgtgcactcggagatgccggcgtccgacggagtgcagaagggcctgcagctctggatcaacctctcctccaaggacaagatgatcgagccgcggtaccaggagctgcagagcaaggacataagccgtgccgagaaggacggcgtcgaggtgaggatcatcgccggcgaggccttcggggtgcggtcgcccgtgtacacccggacgccgaccatgtacatggacttcacaatgcaaccagggtcccagctccaccagccgatcccggaggggtggaacgccttcgtatacatcatcgagggcgagggcgtgttcggcagcgagaaggcggcccccgcgagcgcgcaccattgcctcgtgctcggcgcctccggcgacggcctgagcgtgtggaacaagtccggcgcgccactgcggttcgcgctggcggctgggcagccgctgaaggagcccgtggtgcagcagggccccttcgtgatgaacacccgtgccgagatccagcaggccatggaagactattactatggcaagaatggcttcgagaaggctagccagtggagctcctccacctgatcatctcgccggcgatgatgcaaatattaccattgcaataagatacattgtactgccattttattgatactttagttgtttttcttctctttcattttttggcttgcttatggttaagatttggggtacaagaaatgtctgtaataaggaggaattcagtacttagggcaaggggatacgagtataatgggttcattactttggcacaggagcaatttctgaggtttaattagctcgcacacacaatcatccagattacagattaaaatactattgttagaggtttacatgtgcttcaaagcactacgtacacgcacagggagaattacaaccaaagttcaaacggaaaaaat

SEQ ID NO: 4603 - DNA, 669 bp, Sorghum bicolor
aaaccaagtagcgtctagggtttagcctctacaactccgcgaggttttgcttcggcaccgacgacgcatcgtcatcgcacacgacgcgagaagacaggggaagaagaaatggcatctttgtcccggaccgccgccgccgtcgccgtagccgtgaggtcggcggcccgctccgcacccgttaccggccgcgtcctcggcgcgccactgcctccccttgcctcgccttccgctgcccggtccgcccggatcctccgcagttcggcggccgcgttgtcggcggggctggagacgctcctgccgctgcacagcgcggtggcggccgcgcggcttaggtcctgcatcgccgttgactcctcctgctggtgttcgctctcacaaggatatgctttgcctttgtgacagcgagctgcgcctgaagaaaccaatggacattaggaattacaaacaagggctgtaataatgtgattcttgtaaactaatttttcctttgatgtttattgaattttgtgacctgaatcatccaaagatgtgctactagcattcgttgatgtttgaattttatttatgtggatccacgacttacctgcagctcctctttcaaacagttggttcattattgtcattggccgttcaaatattctttgctattccaaaacatgtttgagctcc

SEQ ID NO: 4604 - DNA, 597 bp, Panicum virgatum
ttttattactcacggaacaaacaaaccaaataaactgaacgcccagaactattcgacgcgagctccgcacgaagacaggagtgggggacgaaatggcatcccttgcccgcgccgccgccgccgtgaggtcggcggcccgctccgcgcccctcacaggccgcgccctcggcgcgccgttgccttccctggcgtcgccttctgctgctgcccgccgctccgcccggatcctccgcaggtcggcggccgcggcgtcggcggggctggagacgctcatgccgctgcacagcgcggtggcggcggcgcggcttaggtcctgcatcgccgtcgactcctcctgctggagctcgctctcgcaaggatatgctttgcctttgtgacagaagctgcacctgaagcaaccaatggtattacaaacaaggcctgtaataatgatgcttgtaaactaatttcgcttttgaagttcattgaattttgtaacatgaatcattcaagatgtggaactagcatttgctggatttagattttattcaagggcccacgaattatctgcggctcatttaaagcattcgattcgttatttgtcattggctatttaaa

SEQ ID NO: 4605 - DNA, 732 bp, Zea mays
aaaccaattagcgtctagggtttagcctctccaacccacgtggttttgcttcgacaacgacgctttggcatcgcacacgacgtgagaagaaatggcatctttgtcccgcacagccgtcgccgccgtgaggtccgcagcccgctcagcaccccttaccggccgcgtcccaggcgcgccactgccttcccttgcctcgtcttccgctgcccggtccgcccggatcctccgcaggtcggcggccgcgtcgtcgtcggggctggagacgctcatgccgctgcacagcgcggtggcggccgcgcggcttaggtcctgcatcgccgttgacttctcctgctggagctcgctctcacaaggatacgctttgcctttgtgacagagagaagaaaccaatgaacattaggaatcactatcaagggctgtaataatgtgattcttgtaaactaattttgcctttatagttcattggattttgtaacctggaccattcgaagatgtgcagctggcattcgttgatgcttggattttatttctggatccgtttcttacctgcagcttgtctttcagacagacagttggttggctgttgggatattattcccaattctaaatcatgcgtttttcaaggtaaagttacacaagcatcacctggaattttgtacagtggaatcatctgtgcactcacaggaggaacagtaaacagtaaagcctatttgccaagaagtatgtgtgatt

SEQ ID NO: 4606 - DNA, 485 bp, Sorghum bicolor
ctcaacgaggctataaacctgttctcagtcgcgaatccatccatgggccacccaaatttctccttcctccggcccataccaagtcgtcctgatgaacgccggtcggcccaaacgaaagcagcgtttagggtttagcctctcgaacccccacgaggttttgcttcgacaccgacgcgagaagtcaggggaagagggaaatggcatcgttatcccgcacagccgccgccgccgccgccgccgtgaggtcggcggtccgctccgcaccccttaccggccgcgtcctcggagcgccactgccttcccttgcctcgacttccgctgcccggtccgcccggatcctccgcaggtcggcggccgcggcgtccgcggggctcgaaacgctattgcctctgcacagcgcggtggcggccgcgcggcttaggtcctgcatcgcggtcgattccacctgctggagctcgctctcgcaaggtaactctttgttctgg

SEQ ID NO: 4607 - DNA, 447 bp, Triticum aestivum
  misc_feature (416)..(416): n is a, c, g, or t
  misc_feature (435)..(435): n is a, c, g, or t
ctttgtcccgcacagccgtcgccgccgtgaggtccgcagcccgctcagcaccccttaccggccgcgtcccaggtgcgccactgccttcccttgcctcgtcttccgctgcccggtccgcccggatcctccgcaggtcggcggccgcgtcgtcgtcggggctggagacgctcatgccgctgcacagcgcggtggcggccgcgcggcttaggtcctgcatcgccgttgacttctcctgctggagctcgctctcacaaggatacgctttgcctttgtgacagagagaagaaaccaatgaacattaggaatcactatcaagggctgtaataatgtgattcttgtaaactaattttgctttatagttcattggattttgtaacctggaccattcgaagatgtgcaactggcattcgttatgntggatttattttggatcanaaaaaaaaaaaa

SEQ ID NO: 4608 - DNA, 2352 bp, Panicum virgatum
ttcctgacccatccatcacgcgcgcccgtctcaagatctcagccgccgtcttctccctctccccgccactcccccctgcccccgctaaaaccctaatccctcgccgccatggctgcggcggcggccgccacctcgctcctcctccgccgcaatcgcaacccccagctcctcctcctccgcgccgcgatctcctcatcccgcgcgctgccccagcaggcggagctctccccggagccgaccgccgccgccgccgccgccgcccccgaccccgcgccgcttcccccgaatcccagcacggggagccccttctacggcgagaactggcgaaaccccgccgccgccaacccgccctcctcgctcctccccgccgtcgtcgggggcaccgccttcggggcgcaccaacgcatggcggcctactccgacgccgcggggctcaaggagaccttcgccaagtggatggcggagcagaagtgggaggacatgaagctgctcttcgactcgtgggtgcgctcgctcgacaccgccacggggaagcccaaccgccccgacgtcgatctcttcaaccactacctccgcgcgaacctcatgacgggggccatgccgcacgagatgctcgatctcgccgaccacatgcgcgagttcgagatcgagcccaacacggcctcgtacaacctcgtgctcaagagcatggtcacagcgcaggaggccgagggtgccgagaagctcgttgaacggatgctgcaaacaggaactgtaccagatgatgaatcctacaatttggtcgttggcctgctgattagacagaacctttttgactcagctctgaagtatttggatatggtgcttaaatcaggccacacactatctctaactattttcactgattatgtccgagcatgtatgagatctgggagattggacacattggcatcaattatagagaaatgcaagacaacagataagaacaaagtcttgtgtccacaatgggcctggtgcattgacatagcagaagctgcatttgaagctaacaatagcaaattagctctttttgctttggaatttcttgcaagatggattgttcgtggtgagaatgttaaacctcccgctcagctgtcagttaatgaaggtcttgtaatatcagctctaagtgcttctggcagaacttatagtactgacctcttgaatgctgcttggtctctactacggaggtccctgcgccagaagagggcacccactccagatacatatcttgccaagatttatgctcattcatcaattggccagcttcaacgggcttttgggacactgcgtgaatttgaaaacgcctacgggaactctgaggacattgatccagagctcttctcgccatttacttccttgcatccacttgttgttgcttgctgcaaagatggctttagcacactggattcggtgtatgttcaattggagaatctgactcgtgcggatccaccatacaaatctgttgctgcccttaactgtgttgtattaggctgtgcaaacatttgggatattgaccgagcatatgaaacttttgtggctatcaaggataagtttgaactcacacctgacatacattcatacaatgcccttctgtgtgcgtttggaaagaagaaaaggacagaagaagcttgtaatgtgttcgagcatatattaactcttggtgtcaagccaaatgcaacaacatactccctacttgtcgatgcccatcttgcaaataaagacccaaaagctgctcttgccgtaattgataagatggttgatgctggatttacaccttcaaaggataccctcaagaaggttcggagacgctgctctcgtgaatctgacttcgacagtgatgagaaggtgcaatccctggctaagcagttaaactacagaatgggtggtgaaaacaggagagagttgctttatagcatagaatacaatcctgtgtactgaagcagtaagtactggttcatctattggatttcacacttgtagtggttgctgtttttttgcccaggcaattagtgttgcaacttgccgcttaggcttagcggacttgtttttctctgacttcatttgacgctgttgtttttttcattttgataggcagcttgcgctcagtttgctggcatttcggaaagcagacattgtagcttgtaaattatttcgatgtaccagattttcttaagcaattttcagttacccatcccatcatttttgctggcaggattgatgttaggacattataataaggctgtcatactatttgttcattcagaaatcgaaaatgtcagttctttttcgtaattacagtagcatcttgcatgtcactgacttcgccccgtt

SEQ ID NO: 4609 - DNA, 3317 bp, Setaria italica
tcacacgtactcgagctgccccctccctctcggctctctgcgccgccgccatggaggacgacgatgactgccctcccctcgccgtcccgcagcgagcgccgtctcctccgacgccagatccctcggaagcctctccagttggcgtcaccgtcatcaccggctacctcggggccggcaagtccacgttagtcaactacattttgaacgagcaacatgggaagagaatcgccgttatactaaacgagtttggagaggaaattggggttgaaagggcgatgatcaatgaggggcaaggtggtgcacttgtcgaggaatgggtggagctggcaaatggatgtgtctgttgctctgtaaaacacagcctggttcaagcacttgagcagcttgtgcagagaaaggatagaatggatcatatattactagagacaacaggattggctgatcctgcaccacttgtttctgttctttggctagacgaccaattggaatcatcaattagattggattctattattacggttattgatgcaaaaaacttcagggttcagattgatgagcacaaaaactcttcctcatttcctgaagcatttcaccaaattgcatttgcggatgttgtgatattgaacaaaattgacctagtggaagacaatctcgaggatttggaaaaacatatccatgatgtgaacactctggttacagtggtgcggtctgtcaggtgccaggttgacttgaatgaagtatttaacaggcaggcatatggtgccaagaattcatctcatctgcaagaactgctggactatagtaaatcaataccacctaatcgccgtcatgataacagtatttccaccttgtgcatctatgaacaggatccagtttacttggctaaggtggaatcatggcttgaagatcttctttgggaaaagaattctagtatggatatatatcgttgtaaagggattttacacatccaggactcagatcaaattcatacattacaggttgttacaccacttacgaaaccacaccatccaactcggcactccgctcttccattcctgacatcacgcccgcccatctcaagatctctcagccgccgtcttctcccccgctccgccactcctccctccctccctcccacaccccactaaaaccctaatccctcgccgccatggctgcggcggcggccgccacctcgctcctcctccgccgcaatcgcaacccccagctcctcctcctccgcgccgcgatctcctcgtcccgcacgctgccccagcaggcggagctctccccggacccgaccgccgccgcccccgaccccgccccgctccccccgaaccccagcacggggagccccttctacggcgagaactggcgcaacccctcagccgccaacctgccctcctcgctcctccccgccgtcgtcgggggcagccccttcggggcgccccaccgcacggcaggcttctccgacgccgcggggctcaaggagaccttcgccgtgtggatggcggagcagcggtgggaggacatgaagcagctcttcgaatcatgggtgcgctcgctcgacgccgctacggggaagcccaaccgccccgacgtcgatctcttcaaccactacctccgcgcaaacctcatggcgggggccctgccgcacgagatgctcgatctcgccgaccacatgcgcgagttcgaggtcgagcctaacacggcctcatacaacctcgtgctcaagagcatggtcaccgcgctggaggccgagggcgccgagaagctcgttgaacggatgctgcaaacaggaactgtaccagatgatgaaacctacaatttggttataagcctgctgattagacagaacctttttgactcagctctgaagtacttggatctgatgcttaaatcaggccacacactatcgctaactattttcaatgattatgtccgagcatgtgtgagatctgggagattggacacactggcatcaattatagagaagtgcaagacaacagataagaacaaagtcttgtgtccacaatgggcctggtgcattgacatagcagaagctgcatttgatgctaacaatagcaaattagctctttttgctttggaatttcttgcaagatggattgttcttggtgagaatgctaaacttcagctgtcagttaatgaaggtcttgtaatatcagctctaagtgctgctggcagaacttacagtactgacctcttgaatgctgcttggtcgctactaaagaagtccctgcgccagaagagggcacccactccagagacatatcttgccaagatttatgctcattcatcaattggccagcttcaacgggcttttgggacacttcgtgaatttgaaaatgcctatgggaactctgaggacattgatttagagctcttctcgccattcacttccttgcatccacttgtcgttgcttgttgcaaagatggctttagcacactggattcggtgtatgttcaattggagaatctgagtcgcgcggacacaccatacaaatctgttgctgctcttaactgtgttatattaggctgcgcaaacatttgggacattgaccgagcatatgaaacttttgttgccattaaggacaagtttgaactcacaccagacatacattcatacaatgcccttctgtgtgcatttggaaagaagaaaaggaccgacgaagcatgtaatgtgtttgagcatatatcaactcttggtgttaagccaaatgcaacaacgtactccctacttgtcgacgcccatcttgcaaataaagatccaaaagctgctcttgccataattgataagatggttgatgctggattcacaccttcaaaggataccctcaagaaggttcgaaggcgctgctctcgtgaatcagactttgacagtgacgagaaggtgcaatccctggctaagcagttcaactaccgaatgggtggtgaaaaccggagagagatgctttataacatagaatacaatcctgtgtactgaagcagcagctcgtgctcagtttgctggcagttggagagcacagacattgtagcttgtaaattacttcgcggtacctcctaagcggttttcagttacccaacccatcgtttttgctggaaggattgatgttaggacatgataataaggctgtcatactatttgtttgttcggaaatggaaaatgtcagttcttttttcataattgtagtagcattttgcatggcgctgatatcgctcttttcaatgtttccggaagtttgttttgggccatgtttacacttggaatgcaactaacgaagaagtccttgaaagatgct

SEQ ID NO: 4610 - DNA, 3730 bp, Panicum virgatum
gtccaatctttgaagatgttcatagggttagagtttgcgcttgtatgtttataggactgagtgtgcgtgatcgtactccttccgtcctaaaataattgtaactatagagttcaaaatttgtcctaaaaaatttgctaactttgacctacctaccacaaaaaataagataattccgaaagtcccagaaaagacaactaacaactcatccactcatcacaaaagacaagacatctaaacattggtttacatgtttggtcataaagttgtatttatttttggacggagggagtactatgtaattttaaaaaaaaagttatccagattagatagatgcacggggccgaagtacaaccgaaaatacaaaaaagaataaataaaaaataaaaaaggagaaaaatgaaaagaaagcgcagtcacacggagcggttctcgagctttctccctgtcggctctcagcgccgccgccatggaggacgacgacgactgccctcccctcgccgtcgagctaccgccgcaagtgccatctcctccggcgccagctcctccggatgcgtcgccagttggcgttaccgtcatcaccggctacctcggggccggcaagtccacgttagtcaactacattttgaatgaacaacatggaaagagaatcgccgtgatactaaacgagtttggagaagaaattggggttgaaagggcgatgatcaacgagggtcaaggtggtgcacttgttgaggaatgggtggagctggcaaatggatgtgtctgttgctctgtaaaacacagcctggttcaagcacttgagcagcttgtgctgagaaaggatagaatggatcatatattacttgagacaacaggtttggctgatcctgcaccacttgtctctgttctttggctagatgaccaattggaatcatcaattagactggattctattattacggtcattgatgcaaaaaatttcagggttcagattgatgagcacaaaaacgcttcctcattccctgaagcatttcatcaaattgcatttgcggatgttgtgatattgaacaaaattgacctagtgaaggacagcgttgaggatttggaaaaacatattcatgatgtgaatgctctggttacagtggtgcggtctgtccggtgccaagttgacttgaatgaagtatttaacaggcaagcatatggtgccaagaattcttctcatctgcaagaactgctggactatagtaaatcaataccacctaacctccgtcatgataacagtatttccaccttgtgcatctatgaacaggatccagttaacttggctaaggtggaatcgtggctcgaagatcttctttgggaaaagaaatctactatggatatatatcgttgtaaagggattttacatatccatgactcagatcaagttcatacattacaggtttttacacaaattacgaaaccacccccaactcagcactccgctcttccattcctgacccatcacacccgcccatctcagccgccgtcttctccctcgccccgccactcctccctctcccccaccacccccgctaaaaccctaatccctcgccgccatggctgcggctgcggccgccacctcgcttctcctccgccgcaattgcaacccccagctcctcctcctccgcgccgcgatctcctcatcccgcgcgctgccccagcaggcggagctctccccggagccgaccgccgccgccgcgcccgaccccgcgccgctccccccgaatcccagcacggggagccccttctacggagagaactggcgaaaccccgccgccgccaatccgccatcctcgctcctccccgccgtcatcgggggcacccccttcggggcgcaccaacgcatggcagcctactccgacgccacggggctcaaggagaccttcgccatgtggatggcagagcagcggtgggaggacatgaagcagctcttcgactcgtgggtgcgctcgctcgacaccgccacggggaagcccaaccgccccgacgtcgatctcttcaaccactaccttcgcgcgaacctcatgacgggggccacgccgcacgagatgctcgaactcgcctaccacatgcgcgagttcgagatcgagcccaacacggcctcgtacaacctcgtgctcaagagcatggtcacagcgcaggaggccaagggcgccgagcagctcgttgaacggatgctgcgaacaggaactgtaccagatgatgaatcctacaatttggtcgttggtctgctgattagacagaacctttttgactcagctcttaagtatttggatatgatgcttaaatcaggccacacactatccctaactattttcactgattatgtccgagcatgtgtgagatctgggagattggacacattggcatcaatcatagagaaatgcaagacaacagataagaacaaagtcttgtgtccacaatggacctggtgcattgacctagcagaagctgcatttgaagctaacaatagcaaattagctctttttgctttggaatttcttgcaagatggattgttcgtggtgagaatgctaaacctcccgctcagctgtcagttaatgaaggtctcgtaatatcagctctaagtgctgctggcagaacttatagtactgacctcttgaatgctgcttggtctctactgcggaagtccctgcgccagaagagggcacccactccagatacatatcttgccaagatttatgctcattcatcaattggccagcttcaacgggcttttgggacactgcgtgaatttgaaaatgcctacgggaactctgaggacattgatccagagctcttctcgccatttacttccttgcatccgcttgttgttgcttgctgcaaagatggctttagcacactggattcggtgtatgttcaattggagaatctgactcgtgcggatccaccatacaaatctgttgctgcccttaactgtattatattaggctgtgcaaacatttgggatattgaccgagcatatgaaacttttgtggctatcaaggataagtttgaactcacacctgacatacattcatacaatgcccttctgtgtgcgtttggaaagaagaaagggacagaagaagcttgcaatgtgttcgagcatatattaactcttggtgttaagccaaatgcaacaacatactccctacttgtcgacgcccatcttgcaaataaagatccaaaagctgctcttgccgtaattgataagatggttgatgctggatttataccttcaaaggataccctgaagaaggttcgtagacgctgctctcgtgaatctgacttcgacagtgatgagaaggtgcaatccctggctaagcagttcaactaccgaatgggtggtgaaaacaggagggagttgctttataacatagaatacaatcctgtgtactgaagcagcagctcgtgctcagtttgctggcatttccgaaagcagacattgtagcttgtaaattatttcggtgtaccagactcttaagcaatttcagttacccatcccatcatttttgctggcaggattgatgttaggacatgataataaggctgtcatactatttgtttgttcagaaatcgaaaatgtcagtttttttttaattacagaagcatcatgcatgtcactgggatcgcccattttaatgattccagaaatttgtttcgtgccattttgcaattgggatgcaactaacgaagaagtccttgaatgat

SEQ ID NO: 4611 - DNA, 2028 bp, Pennisetum glaucum
cccccactaaaaccctaatccctcgccgccatggctgcggcggcggccgccacctcgctcctcctccgccggaatcgcaacccccagctcctcctcctccgcgccgccatctcctcgtcccgcgcgctgccccagcaggcggagctctccccggacccgaccaccgccgcccccgaccccgtcccgctccccccgaaccccagcactgggagccccttctacggcgagaactggcgcaacccctcagccgccaacatgccctcctcgctcctccccgccgtcgtcgggggcagccccttcggggcgccccaccgcacggcaggcgcctccgacaccgcagagctcaaagaggccttcgccgtgtggatggcggagcagcggtgggaggacatgaagcagctcttcgaatcatgggtgcgctcgctcgacgccgccacggggaagcccaaccgccccgacgtcgatctcttcaaccactacctccgcgcaaacctcatggtgggggccgggccgcgcgatatgctcgatctgcttgaccacatgcatgagttcgaggtcgagcctaacacggcctcatacaacctcgtgctcaagagcatggtcaccgcactggaggccgagggtgccgagaagctcgttgaacggatgctgcaaatagggactgtaccagatgatgaaacctacaatttggttataggcctgctgattaaacagaacctttttgactcagctctgaagtacttggatctgatgcttaaatcaggccacacattatcactaactattttcactgattatgtccgaacatgtgtgagatctgggagattggacacactggcatcaattatagagaagtgcaagacaacagataagaacaaagtcttgtgtccacaatgggcctggtgcattgacatagcagaagctgcatttgatgctaacaatagcaaattagctctttttgctttggaatttcttgcaagatggattgttcgtggtgagaatgctaaaattcagctgtcagttaatgaaggtcttgtaatatcagctctaagtgctgctggcagaacttatagtactgaccttttgaatgctgcttggtcgctactaaagaagtcactgcgccagaagagggcacccactccagagacatatcttgccaagatttatgctcattcatcaattggccagcttcaacgggcttttgggacactgcgtgaatttgaaaatgcccatggaaactctgaggacattgatttagagctcttctcaccattcacctccttgcatccacttgttgttgcttgttgcaaagatggctttagcacactggattcggtgtatattcaattggagaatctgagtcgcgctgacccaccatacaaatctgttgctgctcttaactgtgttatattaggctgtgcaaacatttgggacatcgaccgagcatatgaaacttttgttgccattaaggacaagtttgaactcacaccagacatacattcatacaatgcccttctgtgtgcatttggaaagaagaaaagaaccgaagaagcaagtaatgtgtttgagcatatatcaactcttggtgttaagccaaatgcaacaacatactccctacttgctgacgcccatcttgcaaataaagatccaaaagctgctcttgccgtaattgataagatggttgaggctggattcacaccttccaaggataccctcaagaaggttcgaaggcgctgttctcgtgaatcagactttgacagtgacgagaaggtgcaatccctggctaaacagttcaactaccgaatgggtggtgaaaaccggagagagatgctttataacatagaatacaatcctgtgtactgaagcagcagctcgtgctcagtttgctggcagttgggagggcacagatactgtagcttgtaaattacttcgcggtaccagactcctaagtggttttcagttacccaacccatcatttttgctggaaggattgatgttaggacatgataataaggctgtcatgttatt

SEQ ID NO: 4612 - DNA, 967 bp, Saccharum officinarum
aaaaataaaagagcagcggaacggagcggagcggagcagagcatgctcttccttcagtgccagcagcctctgccgtccccgtccgcgtcggcgccgcctttccgtccccgcgtcagcgtcgcggctccactgagcgtgcgcgtcaccggcgggaggcgagcgcaggcggtggtggcgatggcgtccgctgacgcgcgcttggcggggatcgcctcctccatccgcgtcatccccgacttccccaagccagggatcatgttccaggacatcacgacgttgctgctcgaccccaaggcgtttcgtgacaccatcgacctctttgttgagcggtacaaggaccaagggatcaccgttgttgctggtgttgaagctagagggttcatttttggtcctcctatcgctttagccatcggtgcaaaatttgtacctttgaggaagccaaagaagttgccaggcgaggtgatctccgaagaatattctttggaatatggaactgacaagatagaaatgcatgttggagctgtgcaggccaacgatcgggctcttgtagtcgatgatcttattgccactggtggaacactctgtgcagctgtcaaacttattgaacgtgttggagcaaaggttgttgagtgtgcttgtgtcattgaattgccagaactgaagggccgagacaagcttggggacaggccagtttttgtccttgtggaagcagacgcttgagcggaacctgggacttctcagcgagttagagttggcgctgttgatgctccatctctggaaacaacaaagttcccatgttaccatgttggctattttctggctgacgcgtaataaagttttattccaaattgtgatcccctgaatgatttgtcaatgtagacatgattgctggtcctcgtaaactgtggcttatgttttgtcaaaacagtgctaattattcatatcaattaaggataatcctgattgg

SEQ ID NO: 4613 - DNA, 1640 bp, Sorghum bicolor
cagcatccccgggcccgcgtgtcagggacggagacgtctcccggggctcggctatagccgacacggccgcgagcgcggcccgcgtgaaggcccagataaataaaaataaaaagagcagcggagcggaggcggagcagagcatgctcttcctgcagtgccagcagcagcctcgcgtgccgtccccgcccgcgtcggcgccgccttttcgtccccgcgtcgcggcggctccgctgagcgtgcgcgtcaccggcgggaggcgagggaggcaggcggtggtggcgatggcgtccgcagacgcgcgcttggccgggatcgcctcctccatccgcgtcatccccgacttccccaagccagggatcatgttccaggacatcacgacgttgctgctcgaccccaaggcgttccgtgacaccatcgacctctttgtcgagcgctacaaggaccaagggatcaccgtagttgctggtgttgaagctagagggttcattttcggtcctcctatcgctttagccatcggtgcaaaatttgtgcctttgagaaagccaaagaagttgccaggcgaggtgatctccgaagagtattctttggaatacggaactgacaagatcgaaatgcatgttggagctgtacaggccaacgatcgggctcttgtggtcgatgatcttattgccactggtggaacactctgtgcagctgtcaaacttcttgaacgtgttggagcaaaggttgttgagtgtgcttgtgtcattgaattgccagaactgaagggccgagacaagcttggggacaggccagtttttgtccttgtggaagcagacgcttgagcggaactttggacttctcagagagttagagttggcgctgttgatgctccctctctggaaacaacaaagttcccatgttaccatgttggctattttctggctgacgcgtaataaagttttattccaaattgtgatcccctgaatgatttgtcaatgtagacatgattgctggtccttgtaaactgtggcttatgttttgtcaaaacagtgctaattattcacatcaattgaggataatcctgattggagatgcttgtttgttctagtaatgttcctttcttgttttgtcggcgcaactattgatgaaataaagttgccatctcaataattgaataatggctggtgtatggagatgggcttctgaattaatttgggagatcatgctgctggtggcaagcttagggccctagtggtcatgggctctaaatcagtattttttctgatgaacatgaacactattttccagactttgatttttgtgcagtttgatacacatactctgtatgccttttgcaatttcctttatctcaactggcatttagcatggtctcttgagtcttgactcttgattataccagtttgtagcttgaacctttggaatcccttagatagaattgaccacataaaggcaattagttgcataactgagaaggattttgaatcttgacaaactatatttacttcaagcattttgttctaggcaatgcatatgctttcatggcactgaaatttttggccgacttttgctgtcctacctatgctccatttctacaactgagtgttctgcctatctctgtattaaggtgtactcggtgg

SEQ ID NO: 4614 - DNA, 1171 bp, Setaria italica
cccccccacccgcccgcggcgcgggtataacggaccgaggtgccggcggcccgcgggcgcggcccagataaaaagagcatgctgctgcggttccagcctcgcctccgcctcctcccgtcagcagcagcagcagcgtcggcgccgccttttcctccgcgcgggcccgcctccaccaccggcgtctccgtcgtcgtcgtcggcggcggcgcgggatcgggcgtgcgcatcacctgcgggcggcggcggcggcgtcgcgggacggcggtggcgatggcgtccggcgacgcgcgcgtggcggggatcgcgtcctccatccgcgtcatccccgacttccccaagccagggatcatgtttcaagacatcacgacgttgctccttgatccgaaggcgttccgcgacacgatcgacctctttgttgagcggtacaaggaccaagggatcaccgttgttgctggtgttgaagctaggggttttatctttggccctcctattgctttagctataggtgcaaaatttgtacctttgagaaagccaaaaaagttgccaggtgaggtgatctctgaagaatattctttggaatacgggaccgacaaaatagaaatgcacgtcggagctgtggaggccaatgatcgagcacttgttgtcgatgatcttattgctactggtggaacactttgtgcagctgtcaaacttcttgaacgtgttggagcaaaggtggttgagtgtgcttgtgtcattgaattgccagaattaaagggccgggacaagctaggggacaggcccgtttttgtccttgtgaaagcagactgagcaggatggaatacaagtacacaacttaggacttctcagagttggccctgttgatgctccctctccagaaccattctggaggcaacaaagtatcccattttacagcatcggctaattcctagctgatgcataataaagttttatctttgaatttgtgaggccatgaattatttgtcaatatggacatgattgctggtccttgtaaggcttatgtatgtcaaaacagtgccaactattcagatcaaaattaaggataatccttgttggagtttgttgtcattgctagtacatactttcttggtgcaattattcatgacttaaagttgccatcataatagtggttcatgtttggacatgggct

SEQ ID NO: 4615 - DNA, 1146 bp, Panicum virgatum
ttatattttgggatagagaggtagtataacggaccggggccgacggcggcccgatgcgaggcgtggcccagataaaaaggagcacatgccactccggctccagccccgcctccgcctcctcccgccgtcagccgcagcagcgtcggcgccgccttttcctccgcgcgggccagcctccgccaccggatcgagcgcgcgcctcaccggcgggcgtaggcggcgcgggccggcggtggccatggcgtccggcgacgcgcgcgtggcggggatcgcgtcctccatccgcgtcatccccgacttccccaagccagggatcatgtttcaggacatcacgacgttgctcctagatccgaaggcgttccgcgacacgatcgacctctttgtcgagcggtacaaggaccaagggatcacggtagttgctggtgttgaagctaggggttttatctttggccctcctattgctttagccataggtgcaaaatttgtacctttgagaaagccaaaaaagttgccaggtgaggtgatctccgaagaatattctttggaatatggcactgacaaaatagaaatgcatgtcggagctgtggaggctaatgatcgagcacttgttgttgatgatctcattgccaccggtggaacactgtgtgcagctgtcaaacttcttgagcgtgttggagcaaaggtggttgagtgtgcttgtgtcattgaattgccggaattgaagggccgggacaagctaggggacaggcctgtttttgtccttgtgaaagcggacggagcatgatgaaacacaagcacacaacttaggacatctcagagttggcccagttgatgttctctctctagaatcattctggaaatgacacagtatcccatgctacattggctagttcctagctgatgtttaataaagttttatctttaaatttgaggccatgaattatttgtcaatgtggacgtgattgctggtccttgtaaggcttatgtatgtgaaaacagtgccagttattcacatcaattgaggataatccttgttggagtttgttgtcgttgctagcagcattactttgtttcttggtgcaattattcacatcacaatagttgtttctgaagtgatttgaggagattatgctacatgcaagctaa

SEQ ID NO: 4616 - DNA, 969 bp, Panicum virgatum
aaaaaggagcacatgccgctccggctccagccccgcctccgcctcctcccgccgtcagcagcagcagcgtcggcgccgccttttcctccgcgcgggcccgcctccgccaccggatcgagcgcgcgcctcaccggcgggcgtaggcggcgcgggccggcggtggccatggcgtccggcgacgcgcgcgtggcggggatcgcgtcctccatccgcgtcatccccgacttccccaagccagggatcatgtttcaggacatcacgacgttgctcctagatccgaaggcgttccgcgacacgatcgacctctttgtcgagcggtacaaggaccaagggatcacggtagttgctggtgttgaagctaggggttttatctttggccctcctattgctttagccataggtgcaaaatttgtacctttgagaaagccaaaaaagttgccaggtgaggtgatctccgaagaatattctttggaatatggcactgacaaaatagaaatgcatgtcggagctgtggaggctaatgatcgagcacttgttgttgatgatctcattgccaccggtggaacactgtgtgcagctgtcaaacttcttgagcgtgttggagcaaaggtggttgagtgtgcttgtgtcattgaattgccggaattgaagggccgggacaagctaggggacaggcctgtttttgtccttgtgaaagcggacggagcatgatgaaacacaagcacacaacttaggacatctcagagttggcccagttgatgttctctctctagaatcattctggaaatgacacagtatcccatgctacattggctagttcctagctgatgtttaataaagttttatctttaaatttgaggccatgaattatttgtcaatgtggacgtgattgctggtccttgtaaggcttatgtatgtgaaaacagtgccagttattcacatcaattgaggataatccttgttggagtt

SEQ ID NO: 4617 - DNA, 1272 bp, Panicum virgatum
cccgtggttggtgggtggaggcacgaaccacgcgcgccccacttgacggcgccgagggcccaccacgacatggctcgggcggcttttccccccatgtcagggtcggagacggcggcccgaggcgaggcgaggcccagataaaaaggagcacatgccgctgcggctccagccccgcctccgcctcctcccgtcgtcagcggcagcagcagcgtcggcgccgccgctttttcctccgcgcgggcccgcctccgccaccggatcgagcgcgcgccccacaggcgggcgcaggcggcgcgggccggcggtggcgatggcgtccggcgacgcgcgcgtggcggggatcgcgtcctccatccgcgtcatccccgacttccccaagccagggatcatgtttcaggacatcacgacgctgctcctggatcccaaggcgttccgcgacacgatcgacctctttgttgagcggtacaaggaccaagggatcaccgtagttgctggtgttgaagctaggggttttatctttggccctcctattgctttagccattggtgcaaaatttgtacctttgagaaagccgaaaaagttgccaggtgaggtgatctctgaagaatattctttggaatacggcactgacaaaatagaaatgcatgtcggagctgtggatgctaatgatcgagcacttgttgtcgatgatctcattgccaccggtggaacactgtgtgcagctgtcaaacttcttgagcgtgttggagcaaaggtggttgagtgtgcttgtgtcattgaattgccggaattgaagggccgggacaagctaggggacaggcctgtttttgtccttgtgaaagcagatggagcctgatgaaacacgagcacacaatttaggacatctcagagttggcccagttgatgttccctctctagaatcattctggaaatgacagagtatctcatgttacattggctagttcctagctgatgtttaataaagttttatctttaaatttgaggccatgaattatttgtcaatgtggacgtgattgctggtccttgtaaggcttatgtatgtcaaaacagtgccaattattcacgtcaattgaggataatccttgttggagtttgttgtcgttgctagcagcattactttgtttcttggtgcaattattcacatcataatagtggttgatgtttggaggtgggcatctgaagtgacttgaggagattatgctactggcaagctaaggggcctggtggccatgctttatatttccctgatga

SEQ ID NO: 4618 - DNA, 969 bp, Panicum virgatum
gcctcctcccgtcgtcagcggcagcagcatcgtcggcgccgccgctttttcctccgcgcgggcccgcctccgccaccggatcgagcgcgcgccccacaggcgggcgcaggaggcgcgggccggcggtggcgatggcgtccggcgacgcgcgcgtggcggggatcgcgtcctccatccgcgtcctccccgacttccccaagccagggatcatgtttcaggacatcacgacgctgctcctggatcccaaggcgttccgcgacacgatcgacctctttgttgagcggtacaaggaccaagggatcaccgtagttgctggtgttgaagctaggggttttatctttggccctcctattgctttagccattggtgcaaaatttgtacctttgagaaagccgaaaaagttgccaggtgaggtgatctctgaagaatattctttggaatacggcactgacaaaatagaaatgcatgtcggagctgtggatgctaatgatcgagcacttgttgtcgatgatctcattgccaccggtggaacactgtgtgcagctgtcaaacttcttgagcgtgttggagcaaaggtggttgagtgtgcttgtgtcattgaattgccggaattgaagggccgggacaagctaggggacaggcctgtttttgtccttgtgaaagcagatggagcctgatgaaacacgagcacacaatttaggacatctcagagttggcccagttgatgttccctctctagaatcattctggaaatgacagagtatctcatgttacattggctagttcctagctgatgtttaataaagttttatctttaaatttgaggccatgaattatttgtcaatgtggacgtgattgctggtccttgtaaggcttatgtatgtcaaaacagtgccaattattcacgtcaattgaggataatccttgttggagtttttttgtcgttgctagcagcattactttgtttct

SEQ ID NO: 4619 - DNA, 902 bp, Pennisetum glaucum
gtctgcgtcgtcgcgggcgcgggcgcgcgcatcacctgcgggcggcggcgcgggacggcggtggcgatggcgtccgtcgacgcgcgcgtggcggggatcgcgtcctccatccgcgtcatccccgacttccccaagccagggatcatgtttcaggacatcacgacgttgctccttgatcccaaggcgttccgcgacacgatcgacctctttgttgagcggtacaaggaccaaaagatcaccgttgttgctggtgtcgaagctaggggtttcatctttggccctcctattgctttagctataggtgcaaaatttgtacctttgagaaagccaaaaaaattgccaggtgaggtgatctccgaagaatattctttggaatatgggacagacaaaatagaaatgcacgtcggagctgtggaggctaatgatcgagcacttgttgtcgatgatcttattgctactggtggaacactgtgtgcagctgtcaaccttcttgaacgtgttggagcaacggtggttgagtgtgcttgtgtcatcgaattgccagaattgaagggccgggacaagctaggggacaggcccgtttttgtccttgtcaaagctgactgatcaggatggaacacaagtaaacaacttaggacttctcagagttggccctgttgacgttccctctccagaaccattctggaagcagcaaagtatcccgtgttacagcattggctaattcctagctgatgtgtaataaagttttatctttgaatttgtgaggccatgaattgtttgtcaatgtggacatgattgctggtccttgtaaggcttatgtatgtcaaaacagtgccaattattcagatcaattcaggataatccttgttggagtttaaaaaaaaaaagaaaaaaaaggtact

SEQ ID NO: 4620 - DNA, 758 bp, Cynodon dactylon
atgcccggttgccgcctcctcctcctcccgtccgcgccggcgctccctcctgccctccgcgcgagatcgagcgagcggctcgggctccctccctccctcggcgagcggcggcggcggcgcggggtggcggcggcgatggcgtccggcgacgcgcgcgtggcgcagatcgcgtcctccatccgcgtcatccccgacttccccaggccagggatcatgtttcaggatatcacgacgttgctccttgatccgaatgcgttccgtaacacaattgatctctttgtggagcggtacaaggacaaagggatcactgtggttgctggtgttgaagctagaggatttatttttggccctcctattgctttagccataggtgcaaagtttgtgccactcaggaagccgaaaaagctgccaggtgctgtgatttctgaagagtattcgttggaatatggtaccgacaagatagagatgcatgtaggagctgtagaatctaacgatcatgcacttgttgttgacgatcttattgccactggtggaactctgtgtgcggccgtcaaccttcttgagcgtgttggtgcaaaggtggttgagtgtgcttgtgttattgagctgcctgaattaaagggccgggacaggctaggggacaggccagtgtttgtccttgtgaaggcggatgcatgagaagagcttaggacttcacggagagtgggctggttgatgttccctctcttgacgcaccagtttcccttgttacattgttg

SEQ ID NO: 4621 - DNA, 829 bp, Eragrostis curvula
  misc_feature (158)..(158): n is a, c, g, or t
  misc_feature (177)..(177): n is a, c, g, or t
  misc_feature (652)..(652): n is a, c, g, or t
  misc_feature (682)..(682): n is a, c, g, or t
ggcgtggggaaggggcgcgaataaagagcggagcagagggcggaggagagagagcatgcccggttgccgcctcgtccacctccgccgcccaccgtccgcgccggcgcctcttcctcttctccgccagctcggttcacgcgggtcctccgcgagatcgngcttgcgggtcggctcccncggcggacagcagcggcggcagcggcgcgggctggccgtgatggcgtcgggcgacccgcgcgtggcgcagatcgcgtcctccatccgcgtcatccccgacttccccaagccagggatcatgtttcaggatatcacgacgttgctcctggatccgaaggcgttccgtgacacgatcgacctctttgtggagaggtacaaggacaaagggatcaccgtagttgctggtgttgaagctcgaggattcattttgggccctcctattgcattagccataggtgcaaagtttgtaccattgagaaagccaaaaaagttgcctggtgctgtgatctctgaagagtattctttggaatatggtaccgacaaaatagagatgcatgtaggagctgtagactctaatgatcgggcacttgttgttgacgatcttattgccactggtggcactttgtgtgcggctgtcaaccttcttgagcgtgtnggagcaaaggtggttgagtgtgcttgtgtnattgagctggctgaactgaagggccgggacaagctaggggacagaccgggttttgtccttgtgaaggcggattgagcaggatgaatgcagcttaggacttcacaatgagtgggctcaattgatattccctctctctggaagcaatag

SEQ ID NO: 4622 - DNA, 1267 bp, Brachypodium distachyon
ctcttccttgttggttctggccgctataattgacggcgctggaggggcgaaataaaaagcggcatgctgctttctcctcgtcgtctccacctccgaatccctcactgctgcagccctgctccggctccgtctgctcttctcggcggctcgggtgtggtgcggaggctcggatccggggcacggcggcgcggggcggtcgccatggcaaccgacggccgcgtggagcggatcgcgtccaccatccgcgtcatccccgacttccccaagccaggtattttgtttcaggacatcacaacattgcttctcgatccgcaggcgttccatgacacaactgacctctttgtcgagcggtacaaggacaaagggatcactgtagttgctggtgttgaagcaagaggattcatttttggtcctcccattgcactagccataggtgcaaagtttgttcctataaggaagccgaagaaattacctggtgaggtcatctcggaagagtattctctggagtatggcaccgacaaaattgaaatgcatgtaggagctgtgttacccagtgatcgggctcttattgtggacgatctaattgccactgggggaaccctttgtgctgctgccaaacttattgagcgcgttggagcagaggtggttgagtgtgcttgtgttattgaactgccagagttgaagcggccgggacaagttgggcgacaggccagtttttgtccttgtgaaggcggactaagtaggatgaagcgagttaccttcgagttgttctcattgtgtttcccttctggaactatactggaagcaacaacccaatcttagctagttcctatgtggagctgctcaataagaattctatctttagatttgtcagcgtgcaaattatttgggaatgcagacttgattgctgttccttgtaatacacatatttctgtccgaaaacggtgcaaattatccatggcaatcaaggatagttcatatttgttgctattgcgagcatgattactttcaagctttcttggtacaacttgtcacgactgaaaatggcaggtgtgacgcatttctggttgatgtctagatttgtcctgcatttatctaaagataagttgccagtggtacgagtacttggtattttggaatcactcatggatgttttttctttcatgaccaccgataatgttgggggttagagttggcccactgtacatttgacatctttgtcgtattaaacaggttttagttttgcatgtggttgtcatgctgttaa

SEQ ID NO: 4623 - DNA, 926 bp, Avena sativa
ctcccttctgcttcttgctcccttctccgtcaccccactccccctccccctccccccggcggcgcacgcgtgcggcagttccgaccttccagaggcgcgcggcttcggcttggtcgtaggcgagggtcggcagcggtcgcgatggcgtccgatgggcgcgtggagcggatcacgtccaccatccgcgtcatccccgacttccccaagccagggattttgtttcaggacattacaacgttgcttctcgatccacaggcgttccgtgacactactgacctctttgttgagcggtacaaggacaaaggcatcactgtagttgctggtgttgaagctagaggattcatttttggacctcccattgcattagccataggtgcaaagtttgttccaataaggaagccgaaaaagttacctggtgaggtgatatcggaagaatattctcttgaatatggcaccgacaaaatcgaaatgcatgtaggagctgtgcagcccaatgaccgggcccttattgtggacgatctaattgccacagggggaaccctatgcgctgctgccaaacttatcgagcgtgtcggagcagaggtggttgagtgtgcctgtgttattgaactgccagagttgaagggccgggacaagttgggcaacaggccagtttttgtccttgtgaaggctgaagaatcaggatgaaacaagttatgaccttttgagttgttcccatgatgtatgccttctggaaatacttgaagcagcaaagatatccaatgttacctctagctagttcctatctggacctgctcaataaagtcccatcttcaaatttatgagctcacatattatttgggaatgcagacttgatggttccctgtaatacatggcttatttctgtaaacaacagtgcaaattattcatgtcaaattatcagtcaa

SEQ ID NO: 4624 - DNA, 897 bp, Avena sativa
ccccggcggcgcacgcgtgcggcagttccgaccttccagaggcgcgcggcttcggcttggtcgtaggcgagggtcggcagcggtcgcgatggcgtccgatgggcgcgtggagcggatcacgtccaccatccgcgtcatccccgacttccccaagccagggattttgtttcaggacatcacaacgttgcttctcgatccacaggcgtttcgtgacactactgacctctttgttgagcggtacaaggacaaaggcatcactgtagttgctggtgttgaagccagaggattcatttttggacctcccattgcattagccataggtgcaaagtttgttccaataaggaagccgaaaaagttacctggtgaggtgatatcggaagaatattctcttgaatatggcaccgacaaaattgaaatgcatgtaggagctgtgcagcccaatgaccgggcccttattgtggatgatctaattgccacggggggaaccctatgcgctgctgccaaacttatcgagcgtgttggagcagaggtggttgagtgtgcctgtgttattgaactgccagagttgaagggccgggacaagttgggcaacaggccagtttttgtccttgtgaaggctgaagaatcaggatgaaacaagttatggcctcttgagttgttcccatgatgtatgccttgtggaaatacttgaagcagcaaagatatccaatgttacctctagctagttcctatctggacctgctcaataaagtcctctctttaaatttatgagctcacatattatttgggaatgcagacttgatggttccctgtaatacatggcttatttctgtaaacaacagtgcaaaattattcatgtcaaattatcagtcaagaatagtccgtatttaagtttac

SEQ ID NO: 4625 - DNA, 1112 bp, Triticum aestivum
ccttctcgcttcctcctcaccccgcactgccccaccgcgccggccccgactccgactccgacacaccccggcggcgcgcgctcgccgagctcggtcgcgctgcggttcggatcccccggaggcgtgcggcttcggcgcgggcgagggtcggcggcggtcgcgatggcatccgacgggcgcgtggagcggatcgcgtccagcatccgcgccatccccaacttccccaagccagggattttgtttcaggacatcacaaccttgcttctcgatccgcaggcattccgtgacaccactgacctctttgtcgagcggtacaaggacaaagacataactgtagttgctggtgttgaagccagaggattcatttttggtcctcccattgcattagccataggtgcaaagtttgttccaataaggaagccgaaaaaattacctggtgaggtgatatcggaagaatattctctggaatatggcactgacaaaatcgaaatgcacgtaggagctgtgcagcccaatgaccgagtccttattgtggatgatctaattgccacagggggaaccctttgtgccgctgccaaacttattgagcgtgttggagcaaaggtggttgagtgtgcctgtgttattgaactgccagagctgaagggccgggacaagttgggggacatgccagtttttgtcctagtgcaggcagacgaatcagtatgaaacaagttgtgactcttgagttgttccaatgatgtttcccttctggaactatactggaagcagcaaagatatccgttacaatcttagctagttcctatctggagctgctcaataaaagtttcatctttaaatttgtccttctggaactgtttgggaatgcagacttgattgttgttccctgtaatacgtggcttatttctgtcaaaaacagtgcaaattattcatgtcaatgaaggatagtctgtactgaagtttgtttctgttgctacttgctagcattatttactttcatgctttgttggtgcttgtcatgactgaaaattgccgacccattttttgttgatgtattcagatctcctgcatttatctgagatttttgtggtgtctgtacttggtatactcat

SEQ ID NO: 4626 - DNA, 977 bp, Leymus cinereus x Leymus triticoides
  misc_feature (18)..(18): n is a, c, g, or t
  misc_feature (255)..(255): n is a, c, g, or t
  misc_feature (259)..(259): n is a, c, g, or t
  misc_feature (267)..(267): n is a, c, g, or t
  misc_feature (279)..(279): n is a, c, g, or t
  misc_feature (722)..(722): n is a, c, g, or t
  misc_feature (861)..(861): n is a, c, g, or t
  misc_feature (942)..(942): n is a, c, g, or t
ctcctcctcccgcactgncccaccgcgccggtcccgactccgactccgacaccccccggcggcgcgcgctcaccgagctcggtcgcgctacggttcggatcccccggaggcgtgcggcttcggcgcaggcgagggtcggcggcggtcgcgatggcatccgacgggcgcgtagagcggatcgcgtccagcatccgcgccatccccaacttccccaagccagggattttgtttcaggacatcacaaccttgcttctngatncgcaggcnttccgtgacacnaccgacctctttgtcgagcggtacaaggacaaaagtataactgtagttgctggtgttgaagccagaggattcatttttggtcctcccattgcattagccataggtgcaaagtttgttccaataaggaagccgaaaaaattacctggtgaggtgatatcggaagaatattctctggaatatggcactgacaaaattgaaatgcacgtaggagctgtgcagcccaatgaccgggtccttattgtggatgatctaattgccacagggggaaccctttgtgccgctgccaaacttattgagcgtgttggagcagaggtggttgagtgtgcctgtgttattgaactgccagagttgaagggccgggacaagttgggggacaggccagtttttgttcttgtgcaggcagacgaatcagtatgaaacaagttgtgactcttgagttgttncaatgatgtttcccttctggaactatactggaagcagcaaagatatccgttacaatcttagctagttcctatctggagctgctcaataaaagttccatctttaaatttgtccttctggaactgtttgggaatgaagacntgattgttgttccctgtaatacgtggcttatttctgtcaaaaacagtgcaaattattcatgtcaatgaaggatagtctgtnatgaagtttgtttctgttgctacttgctagcatta

SEQ ID NO: 4627 - DNA, 982 bp, Pseudoroegneria spicata
  misc_feature (8)..(8): n is a, c, g, or t
ctgccccnccgcgtcggccccgactccgactccgacaccccccggcggcgcgcgctcaccgagctcggtcgtgctgcggttcggatcccccggaggcgtgcggcttcggcgcaggcgagggtcggcggcggtcgcgatggcatccgacgggcgcgtggagcggatcgcgtccagcatccgcgccatccccaacttccccaagccagggattttgtttcaggacatcacaaccttgcttctcgatccgcaggcattccgtgacaccactgacctctttgtcgagcggtacaaggacaaagacataactgtagttgctggtgttgaggccagaggattcatttttggtcctcccattgcattagccataggtgcaaagtttgttccaataaggaagccgaaaaaattacctggtgaggtgatatcggaagaatattctctggaatatggcactgacaaaatcgaaatgcacgtaggagctgtgcagcccaatgaccgggtccttattgtggatgatctaattgccacagggggaactctttgtgcctctgccaaacttattgagcgtgttggagcaaaggtggttgagtgtgcctgtgttattgaactgccagagttgaagggccgggacaagttgggggacatgccagtttttgtccttgtgcaggcagacgaatccgtatgaaacaagttgtgattcttgagttgttccaatgatgtttcccttctggaactatactggaagcagcaaagatatccgttacaatcttagctagttcctatctggagctgctcaataaaagtccacctttaaatttgtccttttggaactgtttgggaatgcagacttcattgttgtcccctgtaatatgtggcttatttctgtcaaaaacagtgcaaattattcatgtcaatgaaggatagtctgtactgaagtttgtttctgttgctacttgctagcattatttactttcgtgctttgtta

SEQ ID NO: 4628 - DNA, 863 bp, Lolium multiflorum
tccccactcccactctccccggcggcgcgcggcttcggcttcggcgtaggagagggtcggcggcggtcgcgatggcgtccgacgggcgcgtggagcggatcgcgtccaccatccgcgtcatccccgacttccccaagccagggattttgtttcaggacatcacgacgctgcttctcgacccgcaggcattccgtgacactaccgacctctttgttgagcgctacaaggacaaaggcatcactgtggttgctggtgttgaagctagaggattcatttttggacctcccattgcattagccataggtgcaaagtttgttccaataaggaagcccaaaaagttacctggtgaggtgatatcagaagaatattctctggaatatggcaccgacaaaatcgaaatgcatgtaggagctgtgcagcccaatgaccgggttgttatcgtggacgatctaattgcaacagggggaaccctatctgcagctgccaaacttattgagcgtgttggagcagaggtggttgagtgtgcctgtgttattgaactgccagagctgaagggccgggacaagttgggcaacaggcctgtttttgtccttgtgcaggcggaagaatcaggatgaaacaagttatgccctttcgagttgttcccaccatgtttgccttctggaaatagtggatgcagcaaagatatcccacgtaacttctagctagttcctctttggaacggctcaataaagttcgatctttaaatttgttaggtcacatattatttgggaatgcagacttgattgttccctgtaatcgatggcttatttctgtaaccaacagtgcaattattcatgtcaatcaagaatagttgtagtcca

SEQ ID NO: 4629 - DNA, 984 bp, Secale cereale
gctcccttctcgcttcctgctcctcccgcactgccccaccgcgccggccccgactcggactccgacactccccggcgtcgcgcgctcgccgagctcggtcgcgctgcggttcggatcccccggaggcgtgcggcttcggcgcgggcgagggtcggcggcggtcgcgatggcatccgacgggcgcgtggagcggatcgcgtccagcatccgcgccatccccaacttccccaagccagggattttatttcaggacatcacaaccttgcttctcgatacgcaggcgttccgtgacaccaccgacctctttgtcgagcgatacaaggacaaagacataactgtagttgctggcgttgaagctagaggattcatttttggtcctcccattgcattagccataggtgcgaagtttgttccaataaggaagccaaaaaagctacctggtgaggtgatatcggaagaatattctctggaatatggcacggacaaaatcgaaatgcacgtaggagctgtgcagcccaaagaccgggtccttattgtggatgatctaattgccacaggggggaccctttgtgccgctgccaaacttatagagcgtgttggagcagaggtcgttgagtgtgcctgtgttattgaactgccagagttgaagggccgggacaagttgggggacaggccagtttttgtccttgtgcaggcagacgaatcagtatgaaacaagttgtgactctttagttgttccaatgttgtttcccttctggaactatactggaagcagcaaagatatccgttacaatcttagttagctctatctggagctgctcaataaaagttccttcttaaatttgtcctggaactgtcttggaatgcagacttgattgttgttccctgtaatacgtggcttatttctgtcaaaaacagtgcaaattattcatgtcaatgaaggatagtctgtaatgaagtttgtttctgttgctacttgctagc

SEQ ID NO: 4630 - DNA, 1506 bp, Eucalyptus grandis
tgcattttcttttaatgagatgccgttttcaaatcctaaattcttgcacctacccaagtgagattaaattgctctaatcctaagcaacatgtctaattgggttttacaagggaggacaattggagggcaattgggtcttcccatatgaggttttattaaagtgaaattcgataattttcctgttcgtgcaaatatcggccaaagtgaaaaagcggacatcgtgatttccatgcctaatgtttttttcctcccccttttgactttttgatgggcggcgtgaaaaatggacatgtcctaatggccatttgatgtcgggaggggttggtggaatgtcctttggtccaacttttcctcggcctttatagtgtttggtaagctcggtcgtcccatcattcgacgacagagcaacgttcgccctctccctctccctctctctctctctttctcttcgtgtcgctgacggcccaatattccttttggctgctttggcatctgcttcgagccagcgcgagatcaacacatggcgtcccaaggcggtcaggaccctcgtctcgccaagatcgcctcttcgatccgcgtcatcccagatttccccaagccagggattatgtttcaggatataacgacgttgcttcttaatcctgaggcgtttaaggatactattgatctgtttgtcgagaggtacagagagcaaaatatctctgttgtggcaggtgttgaagcaagaggatttatttttggccctcccattgcattggctattggtgcaaaatttgtcccaatgagaaaacccaacaaattacctggggaagtcatctcagaggagtactcattggaatatggaacagacacgatggagatgcatgtaggagctgtgcaaccaggggaccgtgccttgatagtagatgaccttatagcaacgggtggaacattgtgtgcagcaatcaagcttattgagcgtgttggggcagaagtggttgaatgtgcatgtgccattgaattaccggagctaaagggtcgagatcggttgggcgacaagccactatttgttctggtgagttcagacatttagaacacagtagcagtgaaacaccgacttatattcagatcagcgaaccattcctggtgcttatcttgagctggagattaataaagatcgccagttccagtggatgtttcaccggtaataaaacatttattttaccttttaatgaggaggtatggtttggctagttttcttttcttttctgtttttccagactgttctttcctccttgctttctcccatgagagcttgtggggagctcaaggtcggaacctgggacatgcacaagtcccaaggaagatgaccataattcatgtctgattatgtgatgtaaactcacatttcaatttaaacagctttactctatttgcgattgaattattatgtggacttgaagatgtctttcttttagataactgttttaatgaaatctaaggtgatcatgatctgcatctttctgc

SEQ ID NO: 4631 - DNA, 1057 bp, Trigonella foenum-graecum
gttgtttggttcagccgtcactccaactcttccctcttgtcttagattcccatcactctcattatcgatcgctacttcaacttcttcctcgattcgcttcaaacccctccgctccacttcttcatcgagtgattctccgcaaatggcttcaaaggattctcaagatccgcgtatagctggaatctcatcttcgatccgtatcatccctgattttcccaagccagggattatgtttcaagatataacgacactgcttttggatacaaaggctttcaaagataccattgatttgtttgttgagaggtacaaagatcaaaacatttctgttgtcgcaggcgttgaagcaagaggctttatttttggcccaccgattgcgttggcgattggagcaaagtttgttccaatgaggaaacccaaaaaattgcctggagaggttatctcagaagagtattctttggagtatggaactgacaaaatagaaatgcacgtaggggctgtacaatctggagaaagggccttagtcatagatgatcttatagccactggtggaacattatgtgctgcgattaaactactagaacgtgttggggtgactgttgttgagtgtgcttgtgtgattgaattaccagaattaaaggggcgagaaaagctgggcggcaagccgttgttcgtcttagttgaaggagaaggagcctaatatttgctgttgtgattatgttctagttattgaccattttgagctggctcttgtttcgagcattattgatgactttagatgggattaactgctgaaagctcgagtgtttgtgagctcagttcacattaaaggctatttttaaaataaaaatattatgtgtttttcaattaaagaatcaacagaggtcaggctcgagctgtatgtaacattatcctattttataatattgaagacttaattgtgtgcttgccatttggtagctgaagatccctatgttatgggtttactttaatgatgaggtgcaatgagcatgcaacatggatgtaccaccagtgttatttaataatactatctgctata

SEQ ID NO: 4632 - DNA, 1214 bp, Oryza sativa
ggttgctgacccgcttttgctccggccaataaaaaggcgaggcgaagcggaggagcggaagcagatgacctcgccgccgccgccgccgtcgtcgttgctccgccgcctcccgaccacgcgctgctgctgctttgcctccgcgtcgagcggctggagcgcgagtgcgagcgtgcggctcggatccctcggcgggaagcagcggcgggggcatcgcggcgtggcggtgatggcggcggcggcggcagggggaggaggcttcgaggcgcgcgtggcgcggatcgcgtccaccatccgcgtcatccccgacttccccaagccagggattatgtttcaagatatcacaacaatgcttctcaagccagatgcatttcgtgacacgatcgagctcttcgttgagcgatacaaggacaaagggatcactgtaattgctggtgttgaagctagaggattcatttttggtccgcccattgctttagcactaggtgcaaaatttgttccattgaggaagccaaaaaagttacctggtgaggtgatctcggaagaatattctttggaatatggtacagataaaatagaaatgcatgtaggagctgtggagccaaatggccgggccgttgttgttgatgatctaatcgctacaggtggaaccttatctgcagccgttaaacttattgagcgtgctggagcagaggttgttgagtgcgcatgtgtcattgaactaccagaactgaagggtcgggacaagctggggaacaagccagtttttgtccttgtgaaggcagactaagcggaatgaaacaactaagggcctctcaagttgtccctattaatatcagtgtccttctcgaagcatgttggaagcaactaagatatcggtcgtgacaatattagcttgttctatccagtgctctgcaataaaagtctcatctttaaatttgtaggcacatgagttatttgggaattcggacttgaatgatccttgtaatacatcaaaacacggcataattttttttaaaggagtgccaattattcatggggaatgagaatcacctattttggagtttgttgttctgcttgctatcactattgcattcctgctttcctgtacaactttcactgacaatttgtgatcatggacttctgcattgacttgtggagatcatgatgctggcaattcaaggtgcccagtggtttgtggtacttcattttttttg

SEQ ID NO: 4633 - DNA, 804 bp, Euphorbia peplus
ggaagaagagactctcatcatcctaaaatggcagctcaagatccacgcattaagggaatttcctcttcgattcgagtcatccctgactttcccaagccagggatcatgtttcaagatataacgacgttgcttctcgatactaaggcgttcaaggacaccattgatttgtttgtcgaacgatacaaagatatgaatatctctgttgttgcaggtgttgaagcaagagggtttatatttggccctccaattgcattggctattggggcaaaatttgtccccatgaggaagcccaataagttgcctggggaagttatttcagaggagtactcattggaatatggaacagacaaaatagagatgcatgtaggtgctgtacaagccggagaacgcgctttagttattgatgatctcattgcaactggtggaacactatgtgctgcaatcaaactacttgagcgtgttggtgttcgtgttgtagaatgtgcctgtgttattgaattggctgagctaaagggtcgggaccggttaggagagacaccacttttcgttctcgtgaattctgcttgagttcagtgttcccgcgatagcaacatatgattctaccgctgtcttaattgttggaactctattcccaaaacgaccaacatgagatctgacgattgaggtgaagggaacttgattgataataaagattagacgctgtacattcaactctattttttccccctggattgcattatgtattttaagattgttgttggccttgtatgcctgtgtggattcgcacctttgtaatagaggaat

SEQ ID NO: 4634 - DNA, 1108 bp, Cicer arietinum
caagaagagaatgcaatcaagtagtagtaggcttttgttgtgttcctcaaaaccaaattcattgtttggttcagccgtcactcccactctcccctcttctcttagattcccaccactctcccttaccatccctaactctacctcatcctctattcgcttacgatccctccgctcctccgcgagtgactcttctcaagttacagaaatggcttctcaagatcaagacccacgtatagccagaatctcatctgcgatccgtgtcatccccgattttcctaagccaggtatcatgtttcaagatataaccacactacttctggatacaaaggctttcaaagataccattgacttgtttgttgagaggtatagagatcaaaacatttctgttgtcgcaggtgttgaagccagaggctttatttttgggccacccattgcattggcaattggagcaaaatttgtcccaatgaggaaacccaagaaattgccaggagaggtaatctcagaagagtattctttggagtatggaactgacaaaatagaaatgcacgtaggggctgtacaacctggagaaagagccttagtcattgatgatcttatagccaccggtggaaccctatgtgctgcgattaaactgctagaacgtgttgaggtgactgttgttgagtgcgcttgtgtgattgaattaccggagttaaaggggagagaaaggctgggagacaggtcgttgttcgtcttagttgaagcagaaggagcttgatatttgttgttgtgattgtgtagttatcgaccatttgagctgactcttgttaggagcattattgatgaagttcactttagtggttattattttttaaaaataaattttttgtgtttcttagaaaagaaccaagagagaggtcaggctcgagttgtattgtatgtaacaatatcctattttaatactcttgaaaagaattgtgtgcttgcttgccggaagatcctaagttttgggtttactttaatgatgaggtgtaatgagcatgccgcatggatggtacttactttgcaccaccagtggtatttgatactactatatgctattccaggacttgtggaattcgcaattaag

SEQ ID NO: 4635 - DNA, 1770 bp, Cicer arietinum
gttttatttgttttttgttaatttaatttacgattatatttgactcattattaggaaagtgatgagatagtatacgacgcaagaagagaatgcaatcaagtagtagtaggcttttgttgtgttcctcaaaaccaaattcattgtttggttcagccgtcactcccactctcccctcttctcttagattcccaccactctcccttaccatccctaactctacctcatcctctattcgcttacgatccctccgctcctccgcgagtgactcttctcaagttacagaaatggcttctcaagatcaagacccacgtatagccagaatctcatctgcgatccgtgtcatccccgattttcctaagccaggtatcatgtttcaagatataaccacactacttctggatacaaaggctttcaaagataccattgacttgtttgttgagaggtatagagatcaaaacatttctgttgtcgcaggtgttgaagccagaggctttatttttgggccacccattgcattggcaattggagcaaaatttgtcccaatgaggaaacccaagaaattgccaggagaggtaatctcagaagagtattctttggagtatggaactgacaaaatagaaatgcacgtaggggctgtacaacctggagaaagagccttagtcattgatgatcttatagccaccggtggaaccctatgtgctgcgattaaactgctagaacgtgttgaggtgactgttgttgagtgcgcttgtgtgattgaattaccggagttaaaggggagagaaaggctgggagacaggtcgttgttcgtcttagttgaagcagaaggagcttgatatttgttgttgtgattgtgtagttatcgaccatttgagctgactcttgttaggagcattattgatgaagttcactttagtggttattattttttaaaaataaatttttttgtgtttcttagaaaagaaccaagagagaggtcaggctcgagttgtattgtatgtaacaatatcctattttaatactcttgaaaagaattgtgtgcttgcttgccggaagatcctaagttttgggtttactttaatgatgaggtgtaatgagcatgccgcatggatggtacttactttgcaccaccagtggtatttgatactactatatgctattccaggacttgtggaattcgcaattaagatttttttaaaatgtatttttgtaatttttatcttgccttcttccctaaccaaatgggtagttggcatgtctccatgcctcactgttaaactatattgtgactaaatctctctcagctgttgagaatgtcttgggactgaacagtttcagacttgatatcaaaagaagtagctgaaacttgaaagtgctacacgaagaataagtgtagcaagatggagcgtccacattttttcagaaataggtattttcatgtttattataagtgatgtatgcaaacagttctaagttacattgctgcagggatcatttgaaagcaggcagcagcctacaaaatgaaattgacatattttgtttttgaacgtttgtccatatagagacactaataacttggcccaatggtataaatcatacatacaatagtggttagacaaagtcatgtaaataaaggatatattgtgttctctcgagatttcttgcaccgggtttttgaagtaccttgttaacatccatatgattacacatatcgctgtgtacagtagggctgaaacaacatataatattgaatgttccgtattctatctc

SEQ ID NO: 4636 - DNA, 909 bp, Elaeis guineensis
ggcgtcgctggaagtcttccaatttataacagcgacgcctgcaaaccgcactcctctttggagcatgtcttcggggtcctccctcattttccacatcccttcttcgtgccgtcttcccctatctcctccctctcctcgaatcccttttctccgaactcgtttcatctcgttgaaggccatggcgtcggaggacggcaaggaccatcgcctggcgaggatctcctcgtcgatccgcgtcattcccgacttccccaagcccgggatcatgtttcaggacatcacgacgctgcttctcgatcacaaggcgttcagggacaccattgatatattcgtggagagatacagagagaaaaacatctcggttgtggcgggtattgaagcaagaggctttatattcggtccccctattgccttagctattggagcaaagtttgttcccatgagaaagccaaagaagttgcctggtgaagttatttcggaagagtatgctctggaatatggcacagacaaaatggagatgcatgtaggagctgtccagccaggagatcgggcacttgtcattgacgatcttattgcaacaggagggaccttatgtgctgcagtcagacttcttgaaagagttggagcagatgtggtggaatgcgcttgtgttattgagttgccagaattaaagggccgggaaaaactaggtcacagacctgtgtttgtacttgtgaagggctaaaatcggtctggtacatgcttatttgtttcaaggttcttcattttgcttcctcagattgtatatgctgctacttttgctggatcacttgagctaaataatctgtaatattattattgacatatttttcggaagggcttggtaataagagttgcttatttaaatttgatgactaaaaaaaaaaaaaa

SEQ ID NO: 4637 - DNA, 1026 bp, Solanum lycopersicum
atggagtcaatggcccaaaaggttgctctcaaattcaccagggttaatttcgtcccagaaaaagttacaaatagatattatcacaggggtaattcggtccaaataaaatcacctaccaccaccctaaccacccttcccagtagaaatactcggcttttttcacctatctctgtgtcaaaaggagctgccggagccggagcaggtgaagaaccggagctgaaaacgatcccgatcggagatctagtaagctcagaagttatggcgcctcatgatcttaaagatgaacgtatcgctggaattgcttctgctattcgggtcatacccgactttcctaaaccagggatcatgtttcaggatataacgactttgctacttgatccaaaggcgtttaaggacactattgatttgttcgttgagagatataaggacaaaaacatcagtgtggttgcaggtattgaagcaagaggttttatctttggtcctcccattgcattggctattggagcaaaatttgtccccatgaggaaacccaagaagttacctggggaggttatttcagaagagtactctttggagtatggaacagacaagattgagatgcatgtaggtgctgtgcaagctggtgaacgtgccctcgtggtagatgatctaattgcgactggagggactctaagtgctgcgattaggcttcttgagcgtgttggagttgaggtagtcgaatgcgcatgcgtcattgagttgccagaattgaagggccgtgagcgcttaggagataagccactgtttgttcttgtgagctaaacctgatctcaattagggaaggctctggacagagagcttcattaagatggaattgtatcagagtgacattttggagaggatatatctcatttttattaaaactattgccaattctggcgttcctgtgtggattgaaataagcccttcttaggtgcttttagttgaattagctattctaagtgatatgttctcaatgaattaagtccaatttatgtcgttgtagta

SEQ ID NO: 4638 - DNA, 869 bp, Fraxinus spp
ggagaaagactcctccatctaccgcctccggcgaatactactgcagccaatcaaatcctcacacatggctgcccaaattgttgattctaccgatgatcgcatttctcggatttcctcttccatacgggtcatacccgacttcccgaaacccggaattatgtttcaggatataacgactttgcttcttgatcccaaggcatttaaggacacgatcgatttgtttgttgagagatacaaggaccaaaaatattaatgttgttgcaggcatcgaggcaagaggttttatatttggacctccaattgcgttggctattggggccaaatttgttcccatgagaaagcctaagaagttacctggggaggttatatctgaagagtactctttggagtatggaacagacaaaatggagatgcatgtaggggctgtaaaagctggagagcgggcacttgtagtggatgatctcattgctactggggggaccttgagtgctgcaatccgcctactgagcgagttggggtagatgtggttgagtgtgcttgtgttatcgagttgccagaactaaagggccgggatcggctaggagacaagccgctgtttgttcttgtgagctgaagttgatattgttctgaaacttgaaggaagaaaatttgagttcatgccggcaataattcctggtttctggttttcattattgagttagtatttgcttatttgcttctacaggtgatttgggcgggatagtaatgaaaactatttgcattatctgtgtaaagatgggctgcttgtaattggggtgaatatgtccaaacccagtgttgtattgccaaaaggttgaatgtttataattcagtaacgaacactcactcgt

SEQ ID NO: 4639 - DNA, 882 bp, Antirrhinum majus
actgccagtagtagtaggagtagtagaagaagatcaactcggctgatctaccaagcgtcaacagagccaatcagagcagtacacatggcatccgacgatcgcatcacccggatctcctcctctattcgggtcatacccgacttccccaaaccagggattatgtttcaggatataacgactctgctgcttgatccaaaggcgtttaaggacaccatcgacttgtttgttgagagatacaaggacaagaatatcagtgttgttgcaggtattgaggcaagaggttttatatttggtcctccaatcgcattggctattggggcaaaatttgttcctatgaggaagcccaagaaactacctggggaggtaatatcagaagaatactctttggaatatggaactgacaaaattgagatgcatgtcggagctgtacaatctggagagcgtgcagttattgtagatgatctcattgcaacagggggaactttaaatgcggcaattcgtctgcttgagcgcgttggtgtcaatgtggttgaatgcgcctgtgtcatcgaattgccagaactgaagggccgggacaagttgggagacaagtcactgtttgttcttgtgaactaatcttaacgcaatcatggaccattgattcgacacttgatcgtaactatgaggggaaaatgtatttccaaccaataatggatgtgaaatcttgcttttgtctactctttaatttgtggttatctttgagatggatgtacaattagggatgcttgcattgtttctgtcgagaccctgccttgtatttggggtgaatatcttcaaacccttcttttattgcaactgcagactttcatctatctcaactagtttaaatgaaaaaaaaagcgg

SEQ ID NO: 4640 - DNA, 889 bp, Primula obconica
gagtatatattctgctgctgctaattaatcccactggtctaactaaggtcgtggttgacaggtgatcataaaataggagcaaaagagcaacaaaaatggggtcagatgaccgcatcgccaaaatcacagcggccatccgtgtcatcccagatttccccaaacctggaattatgttccaggatataacgacgttgttgcttgatccaaaggcttttaaagacactattgatttgtttgttgagaggtacaaagacaaaggcatctctgttgttgcaggtgtcgaagcaagaggctttatatttgggcctcccattgcattagctattggagcaaaatttgtccctatgagaaaacccaaaaagttgccaggagaggttatctctgaagaatactctttggagtatggaacagataaaatagagatgcatgttggggcagtacaagcaggagagcgtgccctagtgatcgatgatctaattgcaactgggggcaccttatgtgctgcagtcaggctacttgaacgtgtcggtgtgcaggtgtttgagtgcgcgtgtgttattgaattggcaggactgaagggtcgagaacggctaggagagaaacccctctttgtccttgtaagctcagattgatcttccattatggcatatgccttcataatgagcagttttctatttattggtcttaaagtggataacagtccaattaaaaccccttattggaaatgaaaaggtatgcttgttacaaataaaatgtattattttgattgcatcgaatggtgggtattattgcttttatgtggtacaaacgaattgtaagatttattcagtgtttaaagatggaattttgagaacttctctttgatagtttgatgttatccgtaattgaa

SEQ ID NO: 4641 - DNA, 999 bp, Medicago truncatula
aaacaagtaggcttttgttgtgttcctcctccgcctcctcttcaaatcagttgttgttgtttggttcagccgtcactctaactcttccctcttgtcttagattcccatcactctctttaacgatcactaattcaacttcttcttcgattcgcttcaattccatacgctccacttcttcacaaatggcttcaaaggattctcaagatccgcgtattgctagaatttcatcttcgatccgtatcatccccgattttcccaagccagggattatgtttcaagatatcaccacactgcttttggatacaaaggctttcaaagataccattgatttgtttgttgagaggtacagagatcaaaacatttctgttgtcgcaggcgttgaagcaagaggctttatttttggcccaccgattgctttggcgattggagcaaaatttgttccaatgaggaaacccaaaaaattgccaggcgaggttatctcagaagagtattctttggagtatggaactgacaaaatagaaatgcacgtaggggctgtacaaactggagaaagagccttagtcatagatgatcttatagccactggtggaaccttatgtgctgcgattaaactactagaacgtgttggggtgactgttgttgagtgcgcttgtgtgatcgaattaccagaattaaaggggcgagcaaagctgggcggcaagccgttgttcgtcttagttgaaggagaaggagcctgatatttgttgctgtgattatgttctagttattgaccatttgagctggctctttttttgagcattattggtgattttagatgggattaaatgctgaaagctcgagcgtttgtgagctcagttcacattaagggctatttttaaaataaaaatattatgtgtttttttattaaaagaatcaacagacaggtcaggctcgaactgtatgtaacattatcctattttataatattgaagacttaattgtttgcttgccatttggtgg

SEQ ID NO: 4642 - DNA, 866 bp, Curcuma longa
gcaccctgtcttcgcctcactaaaccctttcgccgcctttgcaagcgatccatggcctccgacggagcagaggaccaccgcctgccgcggattgcctcctccatacgcgtcatccctgacttccccaagccgggtattttgtttcaggatattacgaccctgttgctggatcctgaggcctttaaagatacgatcgatatgttcgtagagagatacagagacaaagaaatttcagtggtcgcaggtattgaggcaagaggatttatatttggccctcccattgcattggctattggagcaaagtttgtacctatgagaaagccaaagaagttgcctggggaagttatttctgaggaatactcgttagaatatggtacagacaaaatggagatgcatgtaggagctgtccaggcaggagatcgggcacttgttattgacgatctaattgcaactggtggaacattagctgctgctatgagactccttgatcgtgttggagctgaagtggtcgagtgtgcttgtgtcattgaattgccagagctgaagggacgtgacaaactgggtggcaggcctctctttgtgctggtcaaagcggtttagcagaaagaatgcagttcgttggtaatttacgttttcttccttcctaggcatctattggtagatcctctagctagctagggcttgataataaggtttaactttccatggcttcttgaaccatggcgagataaccacggttttctggagattgcgagtggggattatttcagtaaaacatttaccatgtaatatgagattttgatcttggaacctattcgtgtgcgtaattgagtggttcgatttcagtaattaatcagacttttctt

SEQ ID NO: 4643 - DNA, 1144 bp, Arachis hypogaea
taaagagaatgcaatcaggtgtgggtgtgtgttgctcctcttcctccaattggttgtttgggcttgcagccgcagccgcccctcttcttccctcttctcttactacaatttcgttcccaatttcaaagtcttcttcttcttcactcatcacactctccactcccttactaattgcatctcctctacgctccattgcgagtgcgagtggttcgtctcagcttaacgaaatggcttccgatgatgctcaagatccacgcttacagagaatctcctctgcgatccgtgtcatccctgacttccctaagcctggaattatgtttcaggacataaccacgctgctgcttgatactaaggcttttaaagataccattgacttgttcgttgagaggtacagagatcaaaacatttctgttgttgcaggtgttgaagcaagaggatttatatttggcccacctattgcattggctattggtgcaaaatttgtccccatgaggaaacccaacaagttgccaggggaggtaatttcagaagagtattctcttgagtatggaactgacaaaatggagatgcatgtaggagctgtacaacgtggagatcgagccttagtcatagatgatcttattgctactgggggcaccttatgtgctgcaattaagctactagaacgtgttcaggcacaagttgttgagtgtgcttgtgtgattgaattgccggaattaaaggggcgagataagcttaccggcaagccactatttgtcctagttaaaggagcctgatctcgatattctgtagtattcgtggttgtgtcttagtaatccacaatttgagctcttagttgttcgacttcagagctttattgttgactgcttatattttcatacaatatatttgatgggatgtgctgaagagaagctgaggttacttctgtggccgagctctgctttagattttattttttaaagcagtgatctgtgggacatttaaaactcttaacttacgttgcgttatagtgaataaccaatccagagctgaagtgtttgttactaacgcctctatcatgttctattcatgagacagcagaagtgtttgatattattatttattaattgtttagtggattaagaatgctaccttttacgggtta

SEQ ID NO: 4644 - DNA, 889 bp, Olea europaea
ctgaaattttccttcaaagtaattatcacagtgtcaattcggtcaagttcaaattattacctaacactaaaacccccactgcacgaagcaggaaaactcatccgatctaccgcccggcgaatactactgcagccaatcaaagcctcacacatggctgcccaaattggtgattctaccgctgatcgcatttctcggatttcctcttccatccgggtcatacccgacttccccaaacccggaattatgtttcaggatataacgactttgcttcttgatcccaaggcatttaagtacacgatcgatttgtttgttgagagatacacgggccaaaatattagtgttgttgcaggcgtcgaggctagaggttttatatttggacctccaattgcgttggctatcggggccaaatttgttcccatgagaaagcctaagaagttacctggggaggttatctcagaagagtactctttggagtatggaacagacaaaatggagatgcatgtaggggctgtgcaagctggagagcgtgcacttgtagtggatgatctcattgcaactggggggaccttgagtgctgctatccgcctacttgagcgagttggggtcgatgtggttgagtgtgcttgtgttatcgaattgccagaacttaagggccggaatcgtctaggagacaagccactgtttgttcttgtgagtgaagttgatactgttgtgaaacttgataatgagatttgaaggaagaaaattcgaattcatgccaacgataaatactggtttctggctatcattgtttagtatttgcttatttgcttcaactagtgctttgtgcgggatattaatgaaaactacttgcattttgtgtgtaaagatgggctgcttgtaattgggg

SEQ ID NO: 4645 - DNA, 1123 bp, Nicotiana benthamiana
gctatggagtcactgactcaaaaagttgctctcaaattcactaaggccaattttgtcccagaaaaagttactcacagatattttcacaggggcaatttggtcaaactaaagtcacctaccaccaccactatcaccaccataaccactgctcccactagaaatactcctgtttccccccctatctttgtgtccgaaagagctgccgtacccagagccggtgaagaacccgagttgaaaacgatccgtatccgagatccagtgagctcagcagatatggcgtctaaagatccgattctcaaagacgatcgtatcgcccggatttcttcttctattcgggtcatccctgactttcctaaacccgggattatgtttcaggatataacaacattgctacttgatactaaggcgtttaaggacactattgatttgtttgttgagaggtacaaggacaaaaacatcagtgtcgttgcaggtattgaagcaagaggttttatatttggtcctccaattgcattggctattggggcaaaatttgtccccatgaggaaacccaagaagttgccgggggaggttatttcagaagagtattctttggagtatggaacagacaagattgagatgcatgtaggtgccgtgcaagccggtgaacgtgcacttgtggtggatgatcttatcgcaactggagggaccctatctgctgcaattaggcttctagagcgtgttggagttgaggtcgtcgagtgtgcatgtcttattgagttgccagaattgaagggccgggacaggttaggtgataaaccactctttgttcttgtgagctcaacctgatcctcaattaggaaatggatctggacaaagagcttcattgaggtgtaactgtattggggtgacattttaaatttggagaggagaaatctcatttttataacaaccattgccaattctggccttgatgtgtggattgaaataagcccttgttaggtgctttcatttgaattaaactattgcgagacgtatgctcaatgaattaagtccaacttcttatgttgtagctggtggaactcacttctgtgtgtatgacatcgagttcaccacaagaatcggttcaatatttaaggttatg

SEQ ID NO: 4646 - DNA, 1222 bp, Solanum melongena
acattatggagtcactgacccaaaagattgctctcaaatttaccagggtcaatttcgtcccagaaaatgttacaaacacatattaccacaggggcagtttggtccaaataaaatcacctactacccccaccactctaaccacgcctcccactagaaatactcggctttcttcaccgatctctgggtcaaaaatagccgccggagcaggaaccggagaaggtgaagaacctaagttgaaaacaaaccggatccgagatccagtaagctcagcagatatggcggctcatgaaccgattcttaaggacgatcgtatcgctgggatctcttctgctattcgggtcatacccgactttcctaaacccgggattatgtttcaggatataacgactttgcttcttgatactaaggcgtttaaggacactgttgacttgtttgttgagagatacaaggacaaaaacatcactgtggttgcaggtgtggaagcaagaggttttatctttggtcctcccattgcattggctattggagccaaatttgtccccatgaggaaacctaagaagctacctggggaggttatttcagaagagtattctttggaatatggaacagacaagatggagatgcatgtaggtgctgtgcaagccagtgaccgtgcacttgtggtagatgatcttattgcgactggagggaccctaactgctgcgattaggcttcttgagcgtgtgggagctgtggtggtcgagtgtgcatgtgtaattgagttgccagaattgaagggccgggaccggctaggagataagccattgtttgttcttgtgaactcagcctgatctcaatttggataggctctggagagagcttcattaaggtgaaaattgtatcagaatgactctttgattttggagaggatatatctcatatttttaaaaaccattgccaattctggcgtgtatgtgtggattgaaataagtccttaggtgctttcagttgaattagctattctaagagatatgttctccatgaattaagtcctatttctgtcgttataatagtgtttgctcctctcttcctactggttctctctttatcaaaatcagacacaggattgccgcgccacgccatcatatgtgcagatattatgttttggccagtgggtaatctggtgcattgtattaggaacaatgtatttccagataaatgatggttgcccattagcattacc

SEQ ID NO: 4647 - DNA, 1299 bp, Lotus japonicus
gatacatgacccatagcatagattaggaaagtgaaattgaaaacattaagagaaaagagaatgcagtcaagtagggtgctcttgtgctcatccaccaattcattgtcggggtcagccgtcactcccacacttgcctcttttcccagattcccagcaccactctcagcaaagatagcaaactcaacatcatcatcatcatcatcatcatcctcctcgattcgcttccaaaattctccaccactccgctccactgcttcttcttcttcttcctcagcgaatatggcttcgcaagacccgcgcatagcaacaatctcctctgcgatccgagtcattcctgattttcccaagccaggtatcatgttccaggatataaccactctgcttcttgatcccaaggctttcaaggataccattgacttgtttgttgagaggtacagagatcaaaacatttctgttgtcgcaggcgttgaagcaagaggttttatatttggccctcccattgcattagccattggtgcaaaatttgtccccatgaggaaacccaagaaattgccaggaccggttatctcagaagagtattcgttggagtatggaactgataaaattgagatgcacgtgggggctgtacaagctggagaacgagccttgatcatagatgatcttattgctactggaggaacgttaagtgctgcaattaggctactagaacgtgttgaggtgcaagttgttgagtgtgcttgtgtgattgaattaccagagttaaaggggcgggaaaggctgggcgacaaggcgctattcgtcttagttaatggatcttgatatttactctggtgattgtcttttagttattaaccatttgagatggctcttgggggttatacgcttagttctacttaattttccttttaaactttctatgtgccgcttttggtttgaaactcttaatttatagtgaagagccatttgagagctcaggctcgagttccatgcaacattaccctatttttatattgaggaaatgatggctgtaataaagttcttgtttgccatttggtatcacaagatcctaagtttaggattattattatactatgagttgtattgggaacgtgaatcctacatgatggatttgggtcccctgtggtttcaaaatatatcaccgggaccatttgatattatttagtacttgcaaggctttttctctatgctcaaccggtaatcaaataattcacttgtgtatcatgagcttacatgtatcctaataatatagtacatggttgaattattcattttaacccc

SEQ ID NO: 4648 - DNA, 819 bp, Phalaenopsis aphrodite
ctgacatcgacggcgcatgtcgagcttatcgtttccatatcctgtaaatctctcgctcgctctctgtagccttcctcgtcccctttctcttccactccgtcgcaggaggagtttccgcggcggcgcaaccaggataatggcgtctttagaagagaagaaccgtatagcgagagtggcatcgtcgatccgcgcgatcccaaactttcccaagccaggggttatgtttcaggatatcacgacactgctgcttgatcccaaggcgtttcgggatgctgtggacttgtttgtggagaggtatagggatcagcggatttctgttgtcgcgggtgttgaagcaagaggctttatctttggcccgcccattgcgctggctattggagcaaagtttgtacctttgagaaaaccaaagaagttaccaggtgaagtgatttcagaggagtacttacttgaatatggcacagataaaatcgagatgcatgtcggtgccgttcagcctgatgatcgggctgttgtaattgatgatcttattgcaaccggagggaccttatgcgctgcaatcaagctacttgaacgtgtcggcgcagaggtggttgaatgtgcttgcgtcattgagctaccagagctgaagggtcgggagaagttaggagagagaccgctttttgttcttgtgaacggagcctgcttgacctgaatcaactacggtatgctaattcatacacagcttctcacatatcctctctgattttgatgaagtgttcgattctctaatttttcgttccctgttgtatgattatcattccttgtctgcattccagatct

SEQ ID NO: 4649 - DNA, 1121 bp, Platanus occidentalis
tgttcttctttctttggtgaagtggtggttcttctttggcggttcggttctggtggtgattgtctcagtgcaagaggacatatatctctagctacaacaaagaagaatgacttctgaagatggtcacgatcatcgaattgacagaatttcttctgcgattcgggtcataccagacttccctaaaccagggattttatttcaagatataacaactttgcttcttgacccaaaggcatttaaggacaccattgatttgttcgtggagagatacaaagacaaaaacatctccgttgttgcaggaattgaagcaagaggctttatattcggccctcctattgccttggctattggagcaaaatttgtccctttgagaaaacccaagaaattgcctggggaggttatttcggaagagtactctttggagtatggaacagacaaaattgagatgcatgtaggagctgtacagaaaggagaacgtgcccttgtcattgatgatctcattgcaactgggggtaccttgtgtgctgcaataaatctattggaacgtgttggggtggaggtggttgagtgtgcatgtgtcattgaattgcaagagctaaagggccgggaccgtttaggagacaagccattgtttgtccttgtaaacgcagtttaatcagagtttttggtaaacttcaggtttttcatccatatgaattgcagttgctgtagatttttctgccggggaagagaatgttggttgtaggagaatgcttccttgatttgatgctttatgagacctgaaatagttttttttttttttaattttgatatttgaaactgacaagtataaagtgggcctggagggatggtaaatatttactgaggggtgtccaaaagaaacggatactctgcagtaaagaaattgtagtccccctggctccatcagccagcaataaactttgaaagaaaaatgatgatgcaggtacttcaaagaaaaaaaaaaaaaaaaaaaaaaactaaattcttagacgtcactaaagtaacactactaaataactaacgaaaggacacttacttccttaccaaccaaaccaacttacttcttccccggttcccgagaaaataaactcaacacgaac

SEQ ID NO: 4650 - DNA, 666 bp, Carpinus betulus
gcgactggctcggtgaaacgacaagaaatggcttctcaggatgcccaagagggccaagatggtcgcgtagccagaattgcctcggccatccgagtcatcccagactttccgaagccagggattatgttccaagatataaccaccttgcttcttgataccaaggctttcagagacactatcgatttgtttgttgagaggtacaaagacaaagacatctctgtggtcgcaggaattgaagctagaggttttatatttggcctcccattgcattggctataggggcaaagtttgttcctatgagaaagcccaataagttgcctggggaggttatttcggaggagtattctttagagtatggaacagacataatggagatgcatgtaggggctgtacaagcaggagaacgtgcactggtaatagacgatctcattgcaactgggggaaccttatgtgctgcactcgggctacttgagcgtgttggagtgcatgtggtcgagtgtgcatgtgtcattgaattgccagagctgaagggccgtgaccgattgggagacaaaccgttgttcgttcttgtaaacgcagcttgatctagtgtgtctgaggtaccccagcccgttttttggctatatgatttcataaatggtaagagttgttgaagctaaagacctt

SEQ ID NO: 4651 - DNA, 1369 bp, Vaccinium corymbosum
ggccattacgccgggggacacagaacctgtctttccaaatttcgacggtcaatatcttcagacggaaagatcaatcccatttgaccaatcgcaattcagtcacatcactacaattacctccctcatcttcatcttctgctgctaatctccttcgacgacctttgatctacatccatcctcacatacgagctcatagcgatcagcagcagcaagaaccgagctcatcaatggccgccgtagacgatcgcatcgccgcaatcgctgaatcgatccgcatcattccggatttccccaaacctgggattatgtttcaggatataacgacgttgctgctggatccgaaggcgttcaaggacaccattgatttgttcgttgagaggtataaagataagaacatttctgttgtagcaggtgttgaagcaagaggttttatatttgggcctcctattgcactggctattggagctaaatttgtccctatgagaaaacccaacaagttgcctggggaggttatctcggaagagtacactttggagtatggaacggacaagatagagatgcatgttggggctgtacaagcaggagaacgtgccctagtaattgatgatcttattgcaactgggggtaccttgtgtgctgcgatgaatctacttgagcgtgtaggtgtggatgtggtcgagtgtgcctgtgtgattgaattagcagagctaaagggtcgggagcggcttcgaggcaaaccactcttcgtccttgttagctcaacttgatgttgcattgcattgtaaacctgcctgttggtgtatgaagttgtaattcgtttatcaaaaagcttgagagggccttatgaaaagaccatttgattgaagggggagaggatttgattgaaaacactagggttcgtcgtctatcgttcttagtaggaggttcaaatgaatagggagatgggttttggtgtggccatgcgttatctaaatgagttttgacttcaatttcatatcaggatggatgtatcgtaaaatatggaaacctctcttccatttgtttactggctgattgcaatgggataagttttcccacccttttaaaagagtgcgtctgttattcctatataagctcctgggcaccgtctcgtgttagccagttttcaaaggttacttccgcgcattgttatccagtttttgaaaggtgatgcaacaaaagtgtcaaatgcagaccaatggagcgcaggttgataaagaaatgatgcaagtgttttaatttccagtcactggttaaatccgtgcaggtgataattaatttagccttgttatgaactagaaggtaatgtgtagggactgaaaattgaatgaatcgaccatgttactaaccg

SEQ ID NO: 4652 - DNA, 868 bp, Fraxinus spp
cggcccgggggattgcaagaaagaggaactccgacgatctacggacggacaagtactcctcggggtctgcagccaatcaaatcctcgcacatggcggcccaaaatgttgattcgactgatgatcgtatttctcggatttcatcttccattcgggtcatagctgatttccccaaacctgggatactgtttcaggatataacgactttgctccttgatcccaaagcatttaaggacacgatcgatttgtttgttgagagatacaaggaacaaaatattaatgttgttgcaggaatcgaggccagaggttttatatttggacctccaattgcattggctatcggggccaaatttgttcccttgagaaagcctaagaagttacctggggaggttatatcagaagagtactctttggagtatggaacagacataatggagatgcatgtaggagctgtacaagctggagaacgggcacttgtagtggatgatctcattgcaactggggggaccttgagtgctgctatccgcctacttgagcgagttggggttgatgtggttgagtgtgcatgtgttattgaattgccggaactgaagggacggaatctgttaggagacaagccgctgtttgttcttgttagctgaacttgatgctgttgtggaacttgatatcgagatttgaaggaggagaattcgtattcatgccgaaaataattaatggtttctggctttcattattgaattagtatttgcttatttgcttcaagtgctttgggtgggatataaatgacaactattcgcatcttatctgtgtaaacatgggctgctggtaattggggtgtatatgtccaaacccagtgttgtattgccaaaa

SEQ ID NO: 4653 - DNA, 1078 bp, Orobanche aegyptiaca
ttaaatattttcgaggctaaaattgtcaccccaaaatatttgtacagtggcaaatcggtcaagttaggtttctttctgcctcacactaacgccaccctttcaaggagcgagattccactgatctacggcggttctactggtgccgcagtcacagcggagaggcagccgaggagtgtagtacacatgggatcctcagatgttaacaacacagacgatcgcatctctcggatatcctcctccattcgggtcatacccaattttccgaaacccgggattatgtttcaggatataacaacgttgttgctcgatccaaaggcgtttaaggatacgatcgatttgtttgtcgagagatacaaagacaaaaatatcaatgttgtcgcgggtgttgaggcaagaggttttatttttggtcccccaattgcactggctattggagcgaaatttgttcctatgaggaaacccaaaaaattgcctggagaggtaatatcagaagagtactctcttgagtatggtactgacaaaattgagatgcacgttggagctgtacagattggagaacgtgcaattgtggtggatgatctcattgctacaggtggcaccttaactgctgcaatcaacctgcttgagcgcgttggagtcgatgtggtcgagtgtgcttgtgtgattgagttgccagaactgaagggtcgggacagattaggggacaagcagctgtttgttcttgtgagctcatcaacctgaggaaagagattcctctttgccaacaacactgttgagtattagcttgtgcttgatccttttaattagtaccgtactggaaaagaaaatttaaatggatgcgaagtatttttagcagaaagaccgtgctcatttttttgggggtgatttatgcccaactccctttgcgtactacaacttttcttttgtaatgttttttatttgaatcagagatatttgcattccattaaaagttgaccatgtaattgtctcagtacaagctgctctcaaagccgaaagaaggaaaaatttatctgttccgaataaaaggtaaatgggtcaaagaagcgaaacttgtgtg

SEQ ID NO: 4654 - DNA, 851 bp, Allium cepa
ttttctttgaattttcccagaaccagcaacaaaaattctatatcttttgccatctcctctatcaaaatcagatccatggcttctgcagaaaacaataacgctgatatccgtatttccaaaatcgcttcgtccattcgagtcattccaaatttccctaagcctggagtgatgtttcaggatataacgaccctgctcttggagccgaagatatttagagatgcgatcgatctgtttgttgaaagataccgagataaaaatattacagtagttgctggagttgaagcaagaggatttatatttgggcctcccattgctttagatattggagcaaagtttgtacctataagaaaaccaaagaagttacctggtgaagttgtttcagaagaatattcattagaatatggcacagataagattgagatgcatgtaggagctgtgcagcctggagatcgggttttggttgttgatgatcttattgcaactggtgggactttgggcgctgctgtaaaactgattgaacgtgtaggagctgaagttgtggaatgtgcttgtctcattgaaatgcctgaattaaagggccgtgagaagttgggaaatcgatctctctttgttcttgttgaagcagatgcttgattgggtatggaccacgtgcacttctgagtttcaccatatttgtgcttcccctcccatataataaaatgtaccaaatattaacttattgtctgattgcatattgagcatgagaatgtaactgtcagggattcatttatttgttactaagatgaattttattggaagctgttcgtctattatctagtgctccggggacattttaatcaaaagtgcgtttt

SEQ ID NO: 4655 - DNA, 931 bp, Nicotiana tabacum
ggccattacggccgggggtccaaaagagctgccgtacccagagccggtgaggaaaccgagctgaaaacgacccggatccgagatccagtgagctcagcagatatggcgtctaaagatccgattctcaaagacgatcgtatcgctcggatttcttcttctattcgggtcatccctgactttcctaaacccgggattatgtttcaggatataacaacattactacttgatactaaggcgtttaaggacactattgatttgtttcttgagagatacaaggacaaaaacatcagtgtcgttgcaggtattgaagcaagaggttttatatttggtcctcccatcgcattggctattggggcaaaatttgtccccatgaggaaacccaagaagttgccgggggaggttatttcagaagagtattctttggagtatggaacagacaagattgagatgcatgtaggtgccgtgcaagccggtgaacgtgcacttgtggtagatgatcttatcgcaactggagggaccctagctgctgcaattaggcttctagagcgtgttggagttgaggtggtcgagtgtgcatgtcttattgagttgccagaattgaagggccgggacaggttaggtgataagccactatttgttcttgtgagctcaacctgatcctcaattaggaaatggatctagacagagagcttcattgaggtggaactgtattggagtgacattttgaatttggagaggagaaatctcatttttataacaaccattgccaattatggccttcaatgtgtggattgaaataagcccttgttaggtgctttcagttgacttagttattgtgagagatgctctcaatgaattaaagtcctacttttattgttgtggtagttggtggaactcacttctgtgtgtatgacatcaagttcaccgcgag

SEQ ID NO: 4656 - DNA, 1055 bp, Linum usitatissimum
ccacgcgtccggaatttgaagccaaattgtggaccgttgattacgcgttgatatgctatttgctggtcgtctaccttctctttacccttttccctctcacatttgctttcttcttcttctttggtgttgagagcagccgctgactcactgtcgccgctcaatcgaaaaatggccgcagctaacgaccaccaagatcctcgcctcgctggaatcgcttccgcgattcgagtcattccagacttccccaagccagggattatgtttcaggatattactacgctgcttcttgacgtcaaggctttcaaggacactatcgatttgttcgtggagaggtacaaagacaaaggcatctccgtcgttgctggtattgaagcaaggggtttcatatttggccctccacttgcattggctattggagcaaaatttgttccattgaggaagcccaaaaaattacctggggaggttatatcggaagaatactctctggaatatggaacggacaagattgaaatgcatgtaggtgctgtgcaagcaggtgaacgtgcactggttgtagatgatctcattgcaactggtgggaccttgaaggctgcaatcaatctcctagagcgtgttggggtggaagtttatgaatgcgcttgtctcattgagttgcctgagttgaagggtcgcgatcgattgggagacaagccgttgtttgtcctggtcagctctaccatcgaagcaaatgatttctaatccttagatcacttgtaacagaaagaaagaaagaaagaaagactggagaacaaacaagttgattgtgggaggaaagagagttagttccattgcttaacaataaaattatttgtattgagccgcttgatgacttgtggaaacgcaaggtaagggagggtttatgatttggattttggaatcggagttcaggttaatactgaacaatagccatcttgtataatttttaattataccctagtcttggcatattaaaacgattggcttgtgttgtgtccaaagacattgcaacgttcttcatctacgctgctttatgtgcg

SEQ ID NO: 4657 - DNA, 961 bp, Linum usitatissimum
tgatagcagccgctgactcacggtcgccgctgaatcgagaaatggctgcagctaacgaccaccaagatcctcgccttgctggaatcgcttccgcgattcgagtcattccagacttccccaagccggggattatgtttcaggatatcactactctgcttcttgacgtcaaggctttcaaggacactatcgatttgttcgtggagaggtacaaagacaaaggcatctcagtcgttgctggtattgaagcaaggggtttcatatttggccctccgcttgcattggctattggagcaaaatttgttccattgaggaagcccaaaaaattacctggggaggttatatcagaagaatactctctggaatatggaacggacaagattgaaatgcatgtaggtgctgtgcaagcaggtgaacgtgcactggttgtagatgatctcattgcaactggcgggaccttaaaggctgcaatcaatctcctagagcgtgtaggggtggaagtttatgagtgcgcttgtctcattgagttgcctgagttgaagggtcgcgatcgattgggagacaagccgttgtttgtcctggtgacctctaccatcgaagcacatgatttctaatccttgaatcacttgtaacagaaagaaagaaagactggagaacaaacaagctgtttggggggaggaaggagagtttgcttaacaataaaattatttgtattgagccgtttgatgatttgtggaaacgcaaggtaatttggctaagggagggtttatgatttggattttggaatcggagttcaggttaatactgaacaatagccatcttgtatcattttaattataccctagttatattaaaaccattggcttgtgtttgtgtccaaagtcatcgcaatgttccgcatatgctgttttatgtgtgagtacagcctttgcgtgttggttagtgaagttgaagatcttcagtg

SEQ ID NO: 4658 - DNA, 1110 bp, Ambrosia trifida
ttctctctgtgattctctcaaatcaggctatcactgtgactctgttcaaaccaatgaattcgttaaaactcttcttcaactccgatgtcgtcatctaacccccaaagaaccttttccatggcaatttcgtcaatccacttaaattaccttcaccttcctcctttcccctaaaataccactccatctccgcctcaacgccaccactaaccaccaccgccgccgtctcctcctctcacatggcgggtcccacttctgatgacgatcgcatctcccgtattacgtcagccattcgtgttattccagattttcccaaaccagggattttgtttcaggatatcaccacgttgttgcttgatcctgtagctttcaaggatacgattgatctgttcgttgaacggtataaggataaagatatctctgttgttgctggtgttgaagcaagaggttttatatttggtcctcctattgcattggccattggagcaaaatttgtccctatgagaaaaccaaacaagttacctggacctgttatatcagaagagtattccttggagtatggcacagacaaaattgagatgcatgttggagctgtacaagcaggagaccgcgctcttgtattagatgatttaattgcaactggtggaaccttgtgtgctgcaatcaatctacttgagcgggttggagctcatgtagttgagtgtgcttgtgttattgaattgcctgaactcaagggccgggatcgattaggagacaagccgctgtttgtcctcgtctcgtgatgattgtgtggaaatcagtatgattgatcattgaggtttatggaacttaaataaaatgttatataaagaatatgaatcccataatttactattattatcttgtatgtattacttggtggtgggtgaaggcaacccgatcaaaagttgaagaacgcaacatcaatttttattctagccttaagttgttgacttatgaaaattgaaggattattttcaagaaagtttatattgttcaaaaagaaaaagtaccgactgcgactcacaacatgatttcctttcaccataaaaaacacttgtaatattatgtaataattattaacggatcagtact

SEQ ID NO: 4659 - DNA, 1086 bp, Cucurbita pepo
ttctctctggtcttacctcccttgaactgggttttgatcgagtgtccggcggctgtttggcagtgcgggagacggtgtcggatcaagaaatggcgtctattgatgtagaagacccacgcatagccaaaatcgccaaggccattcgagttatccctgattttcccaaaccagggattttgtttcaggacattacgacgttgcttcttgataccaaggccttcagggacactattgatttgttcgtggagaggtacagagggaaagatatcactgtggttgctgggattgaggcgaggggtttcatttttggacctcccatagctctggctattggtgcaaaatttgttcccatgagaaaacccaagaagttgcctggtgaagtcatttcagaagagtactctttagagtatggaacagataaaattgagatgcatgtaggagctgttgaagctggagaacgcgctcttgtgatagatgatctcattgcaactgggggaaccttgtgtgcagcaataagactacttgagcgagttggcgtggatgtggtcgagtgtgcttgtgtgattgagctgcacggactaaagggtcgtgaaagattgggagacaaacctctgtttgttctagttaacgcagcagcatgatcgcagagccttcttctgtaacacgacgtgttcggtaatgacaatattatcacgtatcgctgcaagaagttgaagtttcaaagtaatgcataattttgaagccgagagtgttgctagaaataaaagggctggtattaattttgaatatctgcagaaacttctttattttgaagttaagtagtttatatgtctttctttctctgaatatgccttatttgaatgagtttataatgatcactcttttcccaagccaatgtggaaccttgtatgtactcctagcaatcttccccttgaaggtagtacctttttaggcttctttgtcgacttgatccgaccatatcttgtacgactgcgaatcacattgtggggtattccctaatggtgacgatgacgatcacctatcgcatcactctacccaccctccctcgaacgagatctactcctc

SEQ ID NO: 4660 - DNA, 889 bp, Phalaenopsis aphrodite
attgctaacgcactaaccggcaaatagctttgatggcgtctatagatcaggatactcggatcaagaggattgcgtcttcgatccgcatcattcccaacttccccaaggatggtgttatgtttcaagatatcacgacgctgctgctcgatcccaaagcttttagagataccgtggagttgttcgtggagaggtacagggacatgcggatctctgttgtggctggcgttgaagctagagggtttatctttgggcctcctattgctctagctattggagcaaaatttgtccctttgaggaagccaaaaagctaccaggtgaagtcatttcagaagaatattctctagaatatggtacggatacaatggaaatgcatgttggagctgtccagtttaatgatcaggttcttgttattgatgaccttattgcaacaggagggaccttatgtgctgcaataaagctaatcgaacgtgcaggagcagaggtggttgagtgtgcttgcgttattgagctcccagaactaaagggtcgagaaagattgggtgacagaccgctttttgtcctggtgaaaggttgaaaggcgggcaacaacttttatgaactgcaacgccttctgatctccacatcttaatttaaacatggaacttttgagatcgggtgtagcacaaagtcttccaacggacatctaaatcctaatgcgagtttgttattctataattattagacctttgattgtgttttagaaattatgttctgcttaatggagcaggaattgtttaattagtacttaatctcatctatctatctcgagcttctttgccatttatgattttattatatgttttctttcgttcaaaacaaattgagtatttttttcttttttttgtttaat

SEQ ID NO: 4661 - DNA, 1030 bp, Phaseolus vulgaris
gatgttttattttaattattttttgtggttatttttaattttgtgaaaatggaaaagtgacaagtgaggaggcaagaagaatgcgggttgtgtgttgctccatttcgtggtcgtttgggtcagccgtcactgccgctctcccctctttcccttcttccagattccctccgctcctccctcttcctctttcactcccttcttccaatttttcacccaccctcagccgccgctccactccttccgggagacgagtgaccagaatggctctgaaggacgctcaagatcaacaagacccgcgcttagagagaatctcctctgcaatccgagtgatccctgactttcccaagccaggaattttgtttcaggacataaccacgctgcttcttgatcccaaggctttcaaagacaccatcgacctttttgttgagaggtacagagatcaaaatatcaatgttgttgcaggtgttgaagcaagaggctttatatttggtccacccattgcattagctattggagcaaaatttgtccccatgaggaaacccaataaattgccaggggaggttatctcagaagagtactctttggagtatggaacagacaaaatcgagatgcatgtaggggctgtacagccgggagaacgggccttagtcatagatgatcttattgccactgggggaacgttagatgctgcaattaagctactagaacgtgttggggttgatgttgtggagtgtgcttgtctgattgaattaccagagttgaaggggcgggacaggctgggagacaagccgctatttgtcttagttaaagtgacggcctgatatttttcctgctgattatgtttagttattgaccattggatctggctcttgttaggagctctattgatgactgcttagattttcttaacatatattttgatgggattgctgcagaaagcttcgttgtttctgcgattagttctgctctattattattatcattattattattatcattattattattattattattattattttctgtg

SEQ ID NO: 4662 - DNA, 1077 bp, Phaseolus vulgaris
gtgtagagtggtattctgaaattcccagttggcacttagaagaaagagatgttttattttaattattttttgtggttatttttaattttgtgaaaatggaaaagtgacaagtgaggaggcaagaagaatgcgggttgtgtgttgctccatttcgtggtcgtttgggtcagccgtcactgccgctctcccctctttcccttcttccagattccctccgctcctccctcttcctctttcactcccttcttccaatttttcacccaccctcagccgccgctccactccttccgggagacgagtgaccagaatggctctgaaggacgctcaagatcaacaagacccgcgcttagagagaatctcctctgcaatccgagtgatccctgactttcccaagccaggaattttgtttcaggacataaccacgctgcttcttgatcccaaggctttcaaagacaccatcgacctttttgttgagaggtacagagatcaaaatatcaatgttgttgcaggtgttgaagcaagaggctttatatttggtccacccattgcattagctattggagcaaaatttgtccccatgaggaaacccaataaattgccaggggaggttatctcagaagagtactctttggagtatggaacagacaaaatcgagatgcatgtaggggctgtacaaccgggagaacgggccttagtcatagatgatcttattgccactgggggaacgttagatgctgcaattaagctactagaacgtgttggggttgatgttgtggagtgtgcttgtctgattgaattaccagagttgaaggggcgggacaggctgggagacaagccgctatttgtcttagttaaagtgacggcctgatatttttcctgctgattatgtttagttattgaccattggatctggctcttgttaggagctctattgatgactgcttagattttcttaacatatattttgatgggattgctgcagaaagcttcgttgtttctgcgattagttctgctctattattattattattattattattatcattattattattattattattattattttctgtg

SEQ ID NO: 4663 - DNA, 1096 bp, Aquilegia formosa
aaaatttcatctgaaaatcccagaactcttttagtcctaaactaacatctgaatcagagcagggggtgtgctgagtgcagtgtgcatcatgccttcatgcaataagtagtgacatgttgccagatttgactagcattggtttcaactttcaagccatgggcagcataagtatagcacacaacattactactattggcgcccaacaacaacataaagtgacaaaacccttagcaagtgctgctgctcaattccctgtgtctcggactacaagtttcatcactctttcttcttcctttgcttcttctttgagtcaatttcagacaacttgtaaagaagcaaagcaccaactttactgtttacccacatcagaagaaggagaagaagagaaaatgggttctaaagaaggaacagaccatagaattgctagaatttcttctgcaattcgagtcattccaaacttccctaaaccagggattttgtttcaggatataactactttgctacttgatccaaaggcatttaaggacactattgatttgttcgtcgaaagatataaagacaaagagatttctgttgttgctggaatcgaagcgagaggttttatatttggccctccaattgctttggccattggagccaaatttgttcctatgagaaaacccaagaagttgcctggggaggttatttcggaagaatattcgctggagtatggaacagacaaaattgagatgcatgtaggtgctgtagagcccggagaacgggctcttatcattgatgatcttatagcaactgggggcaccttgtgtgctgcaatcaggctactagaacgagttggggtgaaggtggttgagtgtgcctgtgtaatagaattgccagagttagagggtcggaaacgcttgggagacaaaccactgttcgtccttgtggaagcagctgaccagatttgatatggccatgtggggaatgctcctccattgaagggatctttgtcttaataaggaaagcacaatattttatatggattataacacattatttttttattgaataatgtagaatcgaagggattatcttctatgattagagttgaatgtcc

SEQ ID NO: 4664 - DNA, 1111 bp, Glycine max
acccaattgttttgcgttccaatggaaaagtgagaagtgaagagaatgcgggttgtttgttgctccaattcaggcgtgagtgccactcttccatctttcccttgtcccagattccctccactcattgcaatttcttcgatccgctttctaaattccacacccctccgttccactgcttcgccgcgacaagttacaagaatggcttcgaagaatgctcaacaagacacgcgcttagccagaatcgcctctgcgatccgagtcatccccgactttcctaagccaggaattttgtttcaggacataaccacgctgcttcttgatacaaaggctttcaaagacaccgttgacttgtttgttgagaggtacagagatcaaaacatcaatgttgtcgcaggagttgaagcaaggggctttatatttggtccacccattgcattagctattggagcaaaatttgtccccatgaggaaacccaataaattgcctggggaggttatctcagaagagtattctttggagtatggaacagacaaaatggagatgcatgtaggggctgtacaacctggagaacgagccttaatcatagatgatcttattgccactgggggaacgttaggtgcagcaattaagcttctagaacgtgttggggtgcatgttgtggagtgtgcttgtgtgattgaattaccagagttaaaggggcgggataggctgggagacaagtcgctgtttgtcttgattaaagggggagcctgattttgtgtttttattattttagctggctcttgttaggagctttattgatggctgcttagatttcctcaagatatatattttgatgctgcggaaacggaaagctcagttctgctcaattattgttattatcattatctgtgacgattgacgaatgagagaacgacggctataatataggacttgcttgccccttggcagcggaaacttaaatttaatgacacatgtaaaaggaacggaactccatctgatgctcgtttggagtgtgcttccttaaaactgatatgctcataacgtatagccacagatatgcatcaagtcacgatcaaattaatttaattaatcacttcgtgcttaaatt

SEQ ID NO: 4665 - DNA, 1168 bp, Glycine max
caatattacccaattgttttgcgttccaatggaaaagtgagaagtgaagagaatgcgggttgtttgttgctccaattcaggcgtgagtgccactcttccatctttcccttgtcccagattccctccactcattgcaatttcttcgatccgctttctaaattccacacccctccgttccactgcttcgccgcgacaagttacaagaatggcttcgaagaatgctcaacaagacacgcgcttagccagaatcgcctctgcgatccgagtcatccccgactttcctaagccaggaattttgtttcaggacataaccacgctgcttcttgatacaaaggctttcaaagacaccgttgacttgtttgttgagaggtacagagatcaaaacatcaatgttgtcgcaggagttgaagcaaggggctttatatttggtccacccattgcattagctattggagcaaaatttgtccccatgaggaaacccaataaattgcctggggaggttatctcagaagagtattctttggagtatggaacagacaaaatggagatgcatgtaggggctgtacaacctggagaacgagccttaatcatagatgatcttattgccactgggggaacgttaggtgcagcaattaagcttctagaacgtgttggggtgcatgttgtggagtgtgcttgtgtgattgaattaccagagttaaaggggcgggataggctgggagacaagtcgctgtttgtcttgattaaagggggagcctgattttgtgtttttattattttagctggctcttgttaggagctttattgatggctgcttagatttcctcaagatatatattttgatgctgcggaaacggaaagctcagttctgctcaattattgttattatcattatctgtgacgattgacgaatgagagaacgacggctataatataggacttgcttgccccttggcagcggaaacttaaatttaatgacacatgtaaaaggaacggaactccatctgatgctcgtttggagtgtgcttccttaaaactgatatgctcataacgtatagccacagatatgcatcaagtcacgatcaaattaatttaattaatcacttcgtgcttaaatttaaatattgtaaaatcaatggtaaattgcacataacttcactgtagtttc

SEQ ID NO: 4666 - DNA, 891 bp, Tabernaemontana elegans
gaggaggtcgacagcagccgcagcagagaaagatccagtgacgtcatccacattcatggcttcttctgctgctgaagctgatcaccaccaaagccccgccgtagatgatcgcatcccgcgtattgcatctgccattcgggtcataccggattttcctaaacctgggattatgtttcaggacataaccaccttgctgctcgatccagaggcgtttaaggatactattgatttgtttgtggagagatatagagatgaaaagattaatgttgtcgcaggtattgaagcaagaggtttcatatttggccctcctattgccctggccattggggcaaaatttgttccatttagaaagcccaagaagttacctggagaggttatttcagaagagtactccttggaatatggaacggacaaaatggagatgcacgtaggggctgtacaagctggagaacgtgctgtgatagtcgatgatctcattgcgactggagggaccttaactgctgcaatcaggctacttgagcgtgtaggggtcgaggttgtcgagtgcgcatgtgttattgaattgccagaactcaagggtcgggaccggttaggtgacaagccactatttgttcttgtaagctcagactgatcttggattcaatattgtaacagtttgttgtctttatctgctatgagttcatgtaaaattgggaaatctgcatgtatgctaattcaagggatttgaaacttgcgttgctggaaaatagcttttcttgattttgattggtggattggaataagattcaattggtgatctgggttggggaatttatctggaaaacactttctcagaatgtgactagcttcagagtccctctactgtgggcaaaatgataggatcctctctca

SEQ ID NO: 4667 - DNA, 1022 bp, Tragopogon dubius
tcgttttaatttcccttttgtgagctctcgtcgattccgattgggacaaaaaccccaggcaaggcaatggatacgcttaagatctttaacttcgatgtcgtcatcgtgagtggcaatttcgtcaatccgctaaaattgcctcttgccccattctttccttccacttgcgcaaaaaagcgatccatctccgcgtcaacgacacgaggagcaaccggtggccgccattttcacacttccggccgcaccgatctaaacatcagctgcttctctcacatggcgcctcctacttcggatggtctcaaagacgatcgcatctcccgaattacatccgctattcgcgtcatcccagacttccccaagccagggattttgttccaggatataactacgttgttgcttgatcctgtggcgtttaaggacacgatcgatctgtttgtcgagaggtacaaagacaaagacatctcggttgttgctggtgttgaagctagaggtttcatattcggtcctccaattgcattggccattggtgcaaaatttgtccctatgagaaaaccaaacaagttacctggagctgttatatcagaagagtattcgttggagtatggtacagacaaaattgagatgcatgttggagctgtacaagaaggagaacgtgcccttgtaatagatgatttaattgcaaccggaggaaccttgtgtgctgcaatcagtctacttgagcgagttggagtgaaagtagttgagtgcgcgtgcgttattgagttgcctgatctcaagggtcgggcccgattaggagacaagccgctgtttgtgctcgtgagttgaatctgatgtttcgttatttcctaaaagctttgattgctatcactggtttttcagtgtcaaccaacatttgtactcttgtgatttcaagactcatttggaaattaatctagtttcttcactgatccttgagtttatgaaacttcaataaaatgttgatttaggcttgtaatattttaaatcaacgagtggaggaaaga

SEQ ID NO: 4668 - DNA, 941 bp, Nicotiana tabacum
gtcaaaaagagcttccgtacccggagccggtgaagaacacgagttgaaaacgacccgaatccgagatccagtgagctcaacagatatggcgtctaatgatccgattctcaaagacgatcgtatcgttcggatttcgtcttctattcgggtcatccctgacttccctaaacccgggattatgtttcaggatataacaacattgttacttgatactaaggcgtttaagtacactattgatttgtttgttgagagatacaaggacaaaaacatcagtgtcgttgcaggtattgaagcaagaggttttatatttggtcctcccattgcattggccattggggcaaaatttgtccccatgaggaaacccaagaagttgccgggggaggttatttcagaagagtattctttggagtatggaacagacaagattgagatgcatgtaggtgccgtgcaagccggtgaacgtgcacttgtggtagatgatcttatcgcaactggagggaccctaactgctgcaattaggcttctagagcgtgttggagttgaggtggtcgagtgtgcatgtcttattgagttgccagaattgaagggccgggacaggttaggtgataagccactatttgttcttgtgagctcaacctgatcctcaattaggaaatggatctggacagagagcttcattgaggtggaactgtattggagtaacattttgaatttggagaggagacatctcatttttataacaaccattgccaattctggccttaaatgtgtggattgaaataagcccttgttaggtgctttcagttgaattaagctattgtgagagagatgctctcattgaattaagtccaacttctattgttgttgtagttggtggaactcacttctgtgtgtatgacatcaagttcaccgcgagaatcagttcaatcttaaaggatttg

SEQ ID NO: 4669 - DNA, 884 bp, Olea europaea
cctccgatccacggccgggcaaatactcctcggccactgcagccaatcagatttttgcacatggcggcccaaaatgttgattcgactgatgatcgtatttctgggatttcatcttccattcgggtcatacccgatttccccaaacctgggataatgtttcaggatataacgactttgcttcttgatcccaaggcatttaaggacacgatcgatttgtttgttgagagatacaaggaccaaaatattaatgttgttgcaggcatcgaggctagaggtttcatatttgggcctccaattgcattggctattggggccaaatttgttcccatgagaaagcctaagaagttacctggtgaggttatttcagaagagtactctttggagtatggaacagacataatggagatgcatgtaggggctgtacaagctggagaacgggcacttgtcgttgatgatcttattgcaactgggggaaccttgagtgctgcaatccgcctacttgagcgagttggggttgatgtggttgagtgtgcatgtgttattgaattgccggaactgaagggccggaatcgattaggagacaagccgctgtttgttcttgtgacctgaacttgatgctgttgtgaaacttgatatcgagattggaaggaggagaatgtgttcatgtcgaaaataattaatggtttctggctttcattattgaatttgtatttgcttatttgcttcaacaagtgctttgggcaggatttaaatgaaaactattcgcattcttatctgtgaaaacatggctgctggtaattgtggtgtatatgtccaaacctagtgttgtattgccaaaacttcgaatgcatgtgcttacatatagtttcttttgaagtaattct

SEQ ID NO: 4670 - DNA, 1035 bp, Capsicum annuum
aaaaaattgctctcaaattaaccaaggccaatttcgtccaagaaaaattaacaattacaaacaaatattaccataaggacaatttagtccaaataaaatcaccaaccaacaccaccattaccaccaccctaactactacccatcacactagaaatactcgggtttttccacctatctgtgtgtccaaaatatctgctggaaccggagcaggtgaagaatccgagttgaaaacgacccggatccggatccgagatccagtaagctcaacagatatggcagcctctcatgatgttaaagatgctcgtattgctgggatttcttctgctattcgggtcatacccgattttcctaaacccgggattatgtttcaggatataacaactttgcttcttgatactaaggcgtttaaggacactattgatttgtttgttgagagatacaaggacaagaacatcagtgtcgttgcaggtattgaagcaagaggttttatatttggtcctcccattgcattggccattggagcaaaatttgtcccaatgaggaaacccaagaagttgcctggggaggttatttccgaagagtattccttggagtacgggacagacaagatggagatgcatgtaggtgccgtggaagctggtgaacgtgctcttgtggtagatgatcttattgcgacaggagggaccctaaatgctgcgattaggctcctagagcgtgttgaagttgaggtggtcgagtgtgcatgtgtcattgaattgccagaattgaagggccgggaacgcctaggagataagccattgtttgttcttgtgaactaaacctgatcgtcaattgggaaaggatctggacagaggtcatcattaagattgaattgtatcggagtgtcattttgaatttggagtggagaaatctcatttttataacaaccattgccaattctggcgttaatgtgtggtttgaaataagcccttgttaggtactttcagttgaatttagctattctaagagatgccttttgatgaattaagtccaatt

SEQ ID NO: 4671 - DNA, 979 bp, Amorphophallus konjac
gtcggccatggcctcccgggacagcgccgaggacccccggctggcgaggatcgcctccgcgatccgcgtgatccccgacttccccaagcccgggatcttgttccaggatatcacgaccctgctgctcgatacgaaggcgttcagggatacgatcgatatgttcgtggagaggtatagggacatgaatatctcggttgtcgcaggtattgaagcaagaggttttatatttggaccacccattgctttagctattggagcaaagtttgttccaatgagaaaaccaaaaaaattgcctggtgaagtcatttcagaggaatattctttggagtatggcacagatcgaatggagatgcatgtgggagctgtccaggcagggaacgtgctattgttattgatgatcttattgcaactgggggaaccctatctgctgcaatcaggctacttgaacgtgttggtgtggatgtggttgaatgtgcatgtgtcattgaattaccggagctaaagggtcgagaaagactaggagacaggccgctttttgtccttgttaaagctgtctgaacctttttgttccttttcgttccacgtctccttcagagtcggtcgccttggttgcagttggactttgttaaggccttgttcaaggtgtgacactcggttgcccacgagcttctctgggcagcagatgtaataacttgtcttcttcgagttttgctttggcttgttgtatctgttcattcctggctggtgtttccccaggcaaggcagtcggtctcggttgggattcctagattgttgtgcccccgagcgttgaggaagcggaatttgaatacatgggttttgatggtaatcttgattagttgcggatttggaggttaatgtattcgaatgggtgtgtagtttgcagcactttcatgcccttggtcgtcgaacattgttgggatgtaaagtttactgcgataatattggaaagttttatctg

SEQ ID NO: 4672 - DNA, 1104 bp, Vitis vinifera
cggcaattcggtcatttaaagagtaaacagagtttcatctgggcagctacagcagagtcagcccgcacgaggtagcagcatctcgtctggttgagttgctactgactcagtggtctgtaagatctcacaccaaccaatggcttctgaggatgcccaggatcatcgtattgctcgaatttcttctgcgattcgggtcatccccgactttcccaaaccaggtattatgtttcaggacataacaacattgcttctcgaccctcaggctttcaaggacactatcgatttgtttgttgagagatacaaagggaaaaacatctctgttgttgcaggtattgaagcaagaggttttatatttggtccgccaattgcattggccattggagcaaaatttgtccccatgagaaaacctaataaattgcctggggcggttatttctcaagagtatgcattggagtatggaacagacaaaattgagatgcatgttggggctgtacaagctggagaacgggccttagtcatagatgatctcattgcaactgggggaacgttgtgtgctgcaatcaacctccttgaacgggttgaggtggatgtggttgagtgtgcttgtgtcattgaattaccagagctaaagggtagggaccgattaggagacaaaccactgtttgtccttgtaagtgcagcttgatctcacagttcctgtggtataacttcaagcaggtggttggagtttatgattgctagagcttttctctgaagttggagaaccttaatgacccagctcgattgaagggaagagaaaattgtttggtaatgaagggttttctctaggttaggtagttggagacctgaaaacaattggttgattaaagtaataagacttttcaggttaggaggatttatataattcttcgttttttaagggaatggccagattcaacgcctgactgttggttaaatatacataaaaaccttacccggttttctcttgtgaacaccattaattgtgtttacttttattgatgcaaaaaattgtgtgttgatgctttaacatgtgcttaaagctgagtccacagtttctgttgattgtccatcattgtttcatgt

SEQ ID NO: 4673 - DNA, 713 bp, Cleome spinosa
gcgagtcaggactcggagttgcacgctgaaatggctggtgaagatggacaagaccccagaatccctaagatcgcttctgcgattcgagttatccccaacttccccaaaccaggtatcatgtttcaggatataacgacacttcttctggacactcgggcctttagggacaccattgatctgttcgtcgagaggtacaaagggaaagacatctctgttgttgcaggtgtcgaagctagaggtttcatatttggccctcctattgctttggccattggagctaaatttgttcctatgaggaagcccaaaaagttacccggggaggttatctcagaggagtactccttggagtatggaaccgataagattgaaatgcatgtgggtgctgtccagccgggtgaacgtgctcttgttatagacgatctcatcgccactggcggcaccttatgtgctgcaatccgactactcgaacgtgtgggagtgaaggttgttgagtgtgcttgcgttatcgagttacccgagcttaagggccgggagaaactaggggagacgcctctgtttattctcgtaagctcaactgaacccgagaaggagacagaagcttgagagaggagtcttggatggaagtgaagacccttttgctccattgaatcaaagtgttgatggttttttttataatgttcggtaacacgtttctttgcgttctgtttaacatt

SEQ ID NO: 4674 - DNA, 947 bp, Phalaenopsis aphrodite
atccgtcattttcaaatctgagtttctcacccactcatatcttcctttccagattcttctcagttcaatcctctccattgctaacgcagtaaccggcaaatagctttgatggcgtctatagatcaggatactcggatcaagaggatcgcgtcttcgatccgcatcattcccaacttccccaaggatggtgttatgtttcaagatatcacgacgctgctgctcgatcccaaagcttttagagataccgtggagttgttcgtggagaggtacagggacatgcggatctctgttgtggctggcgttgaagctagagggtttatctttgggcctcctattgctctagctattggggcaaaatttgtccctttgaggaagccaaaaagctaccaggtgaagtcatttcagaagaatattctctagaatatggtacggatacgatggaaatgcatgttggagctgtccagtttaatgatcaggttcttgttattgatgaccttgttgcaacaggagggaccttatgtgctgcaataaagctaatcgaacgtgcaggagcagaggtggttgagtgtgcttgcgttattgagctcccagaactaaagggtcgagaaagattgggtgacagaccgctttttgtcctggtgaaaggttgaaaggcgggcaacaaatggccaactttgtatgaactgcaacgccttctgatctccacatcttaatttaaacatggaacttttgagatcgggagtagcacaaagtctgccaacggacatctaaatcctaatgcgagtttgttattctataattattagacctttgattgtgttattgtgttttagaaattatgttctgcttaatggagcaggaattgtttaattagtacttaatctcatctatctatctccagcttctttgccatttatgattttcttatatgttttctttcgttcaaa

SEQ ID NO: 4675 - DNA, 1232 bp, Papaver somniferum
acatcaagattcgcacttgcttaccaaatcttttccaggattttccgcggttgttggtgaaagagaaccaataccaaacaacacgacataactcgtaatgttacaacaccaaacgaaacttaatgtccatccaacacgtacaacaccattattatataaaatccctaattcaccactattggtgggattgttaacagcaaaatccgatacgcttcgaaggaccaaaaaccataaatagacgactcaatttcactcctttctactgtccagtctagtctctcctcctttaatatttttactatcttcttctcaacacactagagatggctgctgttgaagatgatcgaattgctaggatttcttctgcaatcagggttatccctaacttccctaaaccagggattatgtttcaagacataacaactttgcttcttgacccaaaagcttttaaagataccattgatctatttgttgagagatacaaagacaagaacatcagtgtagttgcaggaatggaagccagaggtttcatctttggtcctccaattgccttggctattggggcaaagtttgtgcctatgaggaaacctaagaagctacctggggaggttatatctgaagagtactctttggagtatggaacagataagctagaaatgcatgtcggagctgtacaggcaggagaacgtgctcttatagtcgatgatctcattgccacaggggggactttatgtgctggaatcaggctattggaacgtgtcggcgcagagatagtcgagtgtgcttgtctgattgaattagcagagctaaagggtcgtgatcgattaggcggcaaaccattgttcatccttgtaagcgcagcttgatcagagctgggatggtttcagtttttaacgaaatttcagttgggacgagctttgagtcgtacctatgagtgttataggtgcctctctttagatggaggtttccttaagtgtttgtataagttgatggatttctgataacccatttcagtggtttatatgaacatcgctcagtcaacggcatatttatttatcaatttgaaattcaataatagtaatggttttaagaaactgaaaattgtcttctatcatctcacctgcccttctggaaggcccaagttttcagtgttttataaatttcttgttaatggaaaatgattgcccattttattacgatcaggccctctcattcattgtagaaaaaaaaaa

SEQ ID NO: 4676 - DNA, 763 bp, Cleome spinosa
tgaagatggaacagaccccagaatccctaagatcgcctccgcgattcgtgtgatccccaacttccccaaaccaggtatcatgtttcaggatataacgacgcttcttctggacactcaggcctttaaggacaccattgatttgtttgtcgagaggtacaaagggaaagacatctctgttgttgcaggtgttgaagctcgaggtttcatatttggccctcctattgctttggctatcggagcaaaatttgttcctatgaggaagcccaaaaagttgcccggggaggtcatctcggaggaatattcgttggagtatggaaccgataagatagaaatgcatgtgggagctgtacagccgggcgaacgtgctcttgttatagacgatctcatcgccactggcggcactttatgtgctgcaatccgtctactcgagcgtgtgggagtgaaggttgtggaatgtgcttgtgttatcgagttagccgagctcaagggtcgggagaaactaggagagacgccgctcttcgtccttgtaagctcaacctgagaagattgacgacagaaagatcgtgtaatttcagaggagcccttcgttttatggaattcaagttatgatgttttatgctttgtaacattttctcagagagagagagagagatgaagttttgggtttggatttgcttgaggttagaaccagaagcatccgatcagaatttacattggttggtgttttggctccaccatgattggaggtaataagtcctttttt

SEQ ID NO: 4677 - DNA, 1291 bp, Trifolium pratense
tttttgttgtgttcctccaattccaatccgttatttgggtcaccctcagccgtcactgccgctcttcttccctcttgtcttagattcccaccactctccctaaccatcatcgctaattcatcctcgattcgcttcaaatccctccgctccactgcttcatcgagtgactctccgcaatttacagaaatggcatcaaaggattctaaagatcaagacccgcgtattgccagaatttcatctgccatccgtatcatccccgattttcccaagccagggattatgtttcaagacataaccactctgcttctcgatacaaaggctttcaaagataccattgacttgtttgttgagaggtacagagatcaaaacatttctgtcgtcgcaggcgttgaagcaagaggctttatttttggcccacccattgcattggcgattggagcaaaatttgtcccaatgaggaaacccaaaaaattgccaggagaggttatctcagaagagtactctttggagtatggaactgacaaaatagaaatgcacgtaggggctgtacaacctggtgaaagagctttggtcatagatgatcttattgccactggtggaaccttatgtgctgcaattaaacttctagaacgtgttggggtgaatgttgttgagtgcgcttgtgtgattgaattgccggagttaaaggggagagaaaagctgggcggcaagtctttgttcatcttagttgaaggagaaggagcctgatgtttgttgttgtgattggttctagttatttgaccatttgagctggctctcgttaggagcattattgatgactttagatgggatttactgcagaaagctcgagtgtttgtgagctcagttcacattaagggctatttttaaaataaaatatcgtgtttgtcaggctcgagcagtatgtaacattatcctattttaatattgaagacttgtttatttgtttgccatttggtagcgaaagatcctaacttatgggtttacttgaatgatgaggtgtaatgagcatgtcacatgaatggtatttgatatatatatatatatatatatatatatatatatatatatatatatgctatggcaagacttgtggactatatttaaagcttgcttcttgccttctttcctaaccgaatgtgttgttggcatcgctccatccctcacggtaaaaccataccgcgactatatccctcttaggggttgagacttgagaatgtcttgtaactaacaggtttcatgtttattatgaatggtttatgcattatgttgc

SEQ ID NO: 4678 - DNA, 777 bp, Ambrosia trifida
aattcgctaaaaatcttcctcaactccgatgtcgtcatcctaaactcccaacgatccttttccagtggcaatttcgtcaatccacttaaattaccttcaccttcctttccaacaaaataccactccatctccgcctcaacgccaccactaaccaccgccgccgccgccgccgcctccgcctctcacatgcgggcccacttccgatgacgatcgcatctcccgtattacgtcagccattcgtgttattccggattttcctaaaccagggattttgtttcaggatatcacgacttgttgcttgatcctgtagcttttaaggatacgatcgatctgttcgttgaacggtataaggataaagatatctccgttgttgctggtgttgaagcaagaggttttatatttggtcctcctattgcattggccattggagcaaaatttgttcctatgagaaaaccaaacaagttacctggacctgtcatatcagaagagtattccttggagtatggcactgacaaaattgagatgcatgttggagctgtacaaacaggagatcgtgctcttgtaatagatgatttaattgcaactggtggaaccttgtgtgctgcaatcaatctacttgagcgggttggagctcatgtagtcgagtgtgcttgtgttattgaattgcctgaactcaagagccaggatcgattaggagacaagccgctgtttgtcctcgtctcgtgaggcttctgattgtgtggaaatcaatatgattgatcattgaggtttatggaa

SEQ ID NO: 4679 - DNA, 838 bp, Centaurea maculosa
  misc_feature (108)..(108): n is a, c, g, or t
  misc_feature (130)..(131): n is a, c, g, or t
  misc_feature (135)..(135): n is a, c, g, or t
  misc_feature (291)..(291): n is a, c, g, or t
  misc_feature (648)..(648): n is a, c, g, or t
  misc_feature (657)..(657): n is a, c, g, or t
  misc_feature (694)..(694): n is a, c, g, or t
  misc_feature (705)..(705): n is a, c, g, or t
  misc_feature (759)..(759): n is a, c, g, or t
  misc_feature (811)..(811): n is a, c, g, or t
  misc_feature (815)..(815): n is a, c, g, or t
  misc_feature (825)..(825): n is a, c, g, or t
gggggccaaaagcgttcctctccgcgtcacggcactaggaggaggaccaaccggtggccgccatttccacactccaaaccccagcaccagctcaagctccagctccanctccttctctcccatggcggcnnctantcccgatgcggccataaacaagatgatcgcatctctcgaatcacatccgccattcgcgtcatccctgacttccccaagccagggattttgttccaggatataacgaccttgttgcttgatccggttgctttcaaggatacgatcgatctgtttgtngagaggtacaaagacaaagacatctcggttgttgctggcgtcgaagcaagaggtttcatatttggtcctcctattgcgttggcaattggtgccaaatttgtccccatgagaaaaccaaacaagttacctggagctgttatatcacaagagtattcattggagtatggcacagacaaaattgagatgcatgttggagcggtacaagaaggagaacgtgctcttgtaatagatgatctaattgcaaccggaggaaccttgtgtgctgcaatcagtctacttgagcgggttggagtcaaagtagtcgagtgcgcttgtgttattgaattgccagaactgaagggtcgggacagattaggngacaagccnctgtttgtgctcgtaagttgaatttgatcgtcatttntttcctaaaanctttgattgctattactggttctagaatggtttcatgtaaccggtactcatgtnttgactcttgtgattttaagactcatttaaaataatttgatcaatgagtagnattntttgagtttntgaaacttgaatc

SEQ ID NO: 4680 - DNA, 1127 bp, Cirsium arvense
tttcgtcaatccactaaagtggactgcccttcctattcatccacttgcacaaaaagcgttcttccatctcctccgcgtcaacggcaccaggaggaaccggtggccgccatttccacactgctgctcgtacccgaattcgaaaccccagctgctcctctcacatggcggcacctacttccgatggtcacaaagaagatatcgtcgtcaaggatgatcgcatctctcgcattacatccgccattcgcgtcattccagacttcccgaagccagggattttgttccaggatataacgacgttgttgcttgatccggttgcgtttaaggacacgatcgatctgtttgttgagaggtacaaagacaaagacatctcggttgttgctggcgttgaagccagaggtttcatatttggtcctcctattgcgttggcaattggtgccaaatttgtccccatgagaaaaccaaacaagttacctggagctgttatatcacaagagtattccttggagtatggtacagacaaaattgagatgcacgttggagcggtacaagaaggagaacgtgctcttgtaatagatgatttaattgcaactggaggaaccttgtgtgctgcaatcagtctacttgagcgggttggagtcaaagtagtggagtgcgcttgtgttattgaattgccggaactgaagggtcgggacagattaggggacaagccactgtttgtgctcgtaagttgaatttgatcttcattattttctaaaagctttgattgttattactggttctagaatggttttcatgtaaccggtactcatgtctttctttactcttgcgattttaagactcattttggaaattaaaataatttgatcaatgagcattatttgagtttatgaaaaaagaaaaagtaccgactgcgactagcaaaggacaaagtattcaatactacctgcaagcaagcaactaaccaacagaaaaacagcaaagcaggtctatgaagaacccccaactcatgggtaaatgtttttaaactgataatagaaagaactgatgctggcaatagtatgatgaaaaaaagttaaatacaatctgatttgtgctgcagaacagagtaaaccagatgcatctgatcc

SEQ ID NO: 4681 - DNA, 995 bp, Vigna unguiculata
gtgtagagtggaatgcgaaatctgggcacttgcaagaaatatatgtttttattttaattattttttgtggttttttttaattttgtggaaatggaaaagtgacaactgaggaaacaagaagagaatgcgggttgtgtgttgctccatttcgtggtcgtttgggtcagccgtcactgctgctctcccctctttcccttctcccagattccctctctcactcccctcttccaactctccggccaccgtcctccgccgttccactcctccacctagacgagtgaccagaatggctctgaaaaacgctaaagatgaacaagacccgcgcttggagagaatctcctctgcaatccgagtcatccctgactttcccaagccaggaattttgtttcaggacataacaacgctgcttcttgatcccaaggctttcaaagacaccatcgatctttttgttgagaggtacagagatcaaaatatcaatgttgtcgcaggtgttgaagcaagaggttttatatttggtccacccattgcattagctattggggcaaaatttgtccccatgaggaaacccaataaattgccaggggaggttatatcagaagagtattcattggagtatggaaaagacaaaattgagatgcatgtaggggctgtactacctggagaacgggccttagtcatagatgatcttattgccaccgggggaacgttagatgctgcaatcaagctactagaacgtgttggggttgatgttgtggagtgtgcttgtctgattgaattaccagagctgaaggggcgggataggctgggaaacaagccgctatttgtcttagttaaagtgacggcatgatctttttcctggtgattgtgtttagttatgaccatttgatcaggctcttgttaggagctttattgatgactgcttagattttcttaagatatatttttatggggatatgctgcagaagccttcgttgtttctgcgattagttctgctc

SEQ ID NO: 4682 - DNA, 1175 bp, Ipomoea batatas
gccgggggatttcatccatggaagcatcacccaccaattggctctgagactctgggaggacaattttggccgagaaaagttaccaagatattgtgaaggtggcaatttagtccgaataaagttacctaacacaactgcctccttctccgccgccgccgccaccactacaccaaaactagctcagccaatccgagcgtccgccggtgccggagctagacccgaacccgacaccactcccttctcatcggagatggcttctcacgatccggctagcaaagacactcggatcgcccagatttcatccgccattcgcgttatccctgacttccccaaacccgggattatgtttcaggatataacgacgttgctgcttgatcccaaggcgttcaaggacactatcgatttgtttgtggagagatatcaggacaaaaagatcaatgtggttgcaggtattgaagcaagaggttttatttttggccctccaatagcattggctataggggcaaaatttgttcctatgaggaaacccaagaagttacctggtgaggttatctcagaagaatactctttggagtatggaacagatgtaatggagatgcatgtaggtgctgtccaagaaggggaacgcgtccttataatagatgatcttattgcaactgggggtaccttgggtgctgcaatcaggctaattgagcgtgttggcggcactgtggttgagtgtgcatgtgttattgaattgccagaactgaaggggcgagcgcggttaggagacaaaccactgtttgttctcgtgagctcaacttgatcgtgaaatgtagcagtgggaaagcaagcatgctcaagttgttcccattcaagagagatcttaacaatcttatcttcttataataacagcagaaaattgaaccctggctttggtcagttgactgtaataagaaataaaggttgttgttttagttggattgttgcatagtataacacaagttaagacatcttaattatgtgtgatcatcaactttcctatttcactacttacaacttgaatacttctcatgttctaatcggataaattcttatttttaaaaaaaaaaaaaaaaaacaaagactagtcctcgtgccgaattctttggatccagtagtgcaacaagcaggcgcgcgaagtctcccgacgggcc

SEQ ID NO: 4683 - DNA, 1387 bp, Papaver somniferum
aaaaagggaaaattagtgatcaatggagacatttggaatcagttcagtaaatggtaatctgatttcatcatcccccattaccactaataacaactccccacatctctcaaacatgatgaattcttctgtttcacttaaaacctcttttatttgtaatggcaacgacacacctaacttcagaagctcaagcaaaagaatcacagttcctaaaattaggtctttttcagctaacaactctaaaaagttgagtcaagagaatctcaaagatggattgcaagatgatcgaattgcaaggatttcttctgcgattaggctcatacctgacttccctaaaccaggaatcatgtttcaagacataacaacattgcttcttgacccaaaggcatttcaagatacgattgatctgttcgttgagagatacaagaacaaggacatcactgtagtcgcaggaatggaagccagaggtttcatcttcggtcctccaattgccttagctattggggcaaaatttgtgcctatgaggaaacccaagaagctacctggggaggttatatctgaagagtacactttggagtacggaacagataaactagaaatgcatgttggagctgtacaggcaggagaacgcgctcttatagtcgatgatcttattgcgacaggggggactttatgtgctggaatcaggctattggaacgtgttggagcagaggtagtcgagtgtgcttgtctaattgaattacctgagcttaaggggcgtgatcgattgggaaataaaccactcttcattcttgtaagtgcggtttagtttcatgtttaaagagaattttttcttggtgggaggagctctttatcgcacatggtttggttgaaataagtgttttcttgaagtgtaatagtgaactagtattagttggttgtagtagaagctgaataatgactcatatgaaaaacgtgaaatggctttgtcagtgaacaacttatttggtttacatattgaattgctgagttcagctagaaccggtgccgaaattgaaactttaagactcaaaaacaattatcctatgagttgttacttttgaattgctctatccaactttactttattttggttttcatgtcccacaatgtcctagctgaaccacccttcctagttgaacccgcttgcattttgaatgctcttcaaattgaactcacatgtcctagcttacaggtatcactttgttttatcgtgtacattatttccgacgcagtttggagttgtacacccatgtttacacctactctcatatttggaagaaaaacccacattgatattatttctatattcatatttagattgcataaggtatggtgtaaatttcttaaatatagtaaaaaagttaaaaat

SEQ ID NO: 4684 - DNA, 1068 bp, Papaver somniferum
attttttactatcttcttctcaacacactagagatggctgctgttgaagatgatcgaattgctaggatttcttctgcaatcagggttatccctaacttccctaaaccagggattatgtttcaagacataacaactttgcttcttgacccaaaagcttttaaagataccattgatctatttgttgagagatacaaagacaagaacatcagtgtagttgcaggaatggaagccagaggtttcatcttcggtcctccaattgccttggctattggggcaaaatttgtgcctatgaggaaacctaagaagctacctggggaggttatatctgaagagtactctttggagtatggaacagataagttagaaatgcatgtcggagctgtacaggcaggagaacgtgctcttatagtcgatgatctcattgccacagggggggactttatgtgctggaatcaggctattggaacgtgtcggcgcagagatagtcgagtgtgcttgtctgattgaattagcagagctaaagggtcgtgatcgattaggcggcaaaccattgttcatccttgtaagcgctgcttgatcagagctgggatggtttcagtttttaatgaaatttcagttgggacgagctttgagtcgtacctatgagtgttataggtgcctctctttagatggaggtttccttgagtgtttgtataagttgatggatttctgataaacccatttcagtggtttatatgaacatcgctcagtcaacagcatatttatttatcaatttgaaattcaataatagtaatggttttaagaaactgaaaattctcttctatcatctcacctaggggtgagcattttacccgtaatccccggatttaaccgggaccaaccgtatatttgcggatggatgcccggactgttcgctaatgggttggacgcggatgaaatttttgaaatccggatgcaaccttgaaaatccgttgtacatccatatccgttagattaagggcaattacatagtttctagaaaatagatagataattttggaatttttaaggtgtttgcttggagtgttg

SEQ ID NO: 4685 - DNA, 784 bp, Thalictrum flavum
gccaatttcagacaaccggtaaagaagcaaagcagcagcatctttactgtttgcctacatcatcagaaggagaagaagagaaaatgggttctagagcaggagaagacaatagaattgctagaatttcttctgcaattcgagtcattccaaacttccctaaaccagggattttgttccaggatataactactttgctacttgatccaagggcatttaaggacaccattgatttgtttgtggagagatacaaagacaaagagatttctgttgttgctggaatcgaagcgagaggttttatatttggccctcctattgccttggccattggagccaaatttgttcctatgagaaaacccaagaagttgcctggggaggttatttcggaagaatattccctggagtatggaacagacaaaattgagatgcatgtaggtgccgcagagtccggagaacgtgctcttatcattgatgatcttatagcaactgggggcacattgtgtgctgcaatcaggctacttgaacgagttggggtgaaggtggttgagtgtgcctgtgtgatagaattgccagagttagagggtcgtaaacgcttgggagacaaaccactctttgtccttgtggaagcagctgaccagatttgatgagagttttttgttggttgctcatgtttgatatcattggttaagcatttttatttggggaaatccccctcgcttgaagggacctttgttttgttttaataaggaaagcacaacattttatgaattatatagcacaatatttt

SEQ ID NO: 4686 - DNA, 965 bp, Thalictrum flavum
ggattcaagtcatgggtagcagcatagtacacaacactactactattggcgcccaacaacaacgtaaagtgtcaaaacgctttacaagggctgctgaattccacctgtctcggagtagtttcattagtctttctccttccttttcttcttcttcttcgttgttggtgagtcaatttcagacaactggtaaagaagcaaagctgcagcatctttactgcttgcctacatcggaagaaggagaagaagagaaaatgggttctaaagcaggagaagacaatagaattgctagaatttcttctgcaattcgagtcattccaaacttccctaaaccagggattttgttccaggatataactactttgctacttgatccaagggcatttaaggacaccattgatttgtttgttgagagatacaaagacaaagagatttctgttgttgctggaatcgaagcaagaggttttatatttggtcctccaattgccttggccattggagccaaatttgttcctatgagaaaacccaagaagttgcctggggaggttatttcggaagaatattccctggagtatggaacagacaaaattgagatgcatgtaggtgccgtagagtccggagaacgtgctcttatcattgatgatcttatagcaactgggggcaccttgtgtggtgcaatcaggctacttgaacgagttggggtgaaggtggttgagtgtgcctgtgtgatagaattgccagagttagagggtcgtaaacgcttgggagacaaaccactctttgtccttgtggaagcagctgaccagatttgatgagagtattttgttggttgctcacgtttgatatctttagttgagcatttttatttggtgaaatccccctagcttgaaggaacctttgttttgttttaataaggaaagcacaacattttatgaattatagcacaatatttttaatgaataatgtag

SEQ ID NO: 4687 - DNA, 1104 bp, Vinca minor
ctttcattccccacttttcacttcacccttccattataaaaatacccagaaatgaacaccctaaccatatcctttcctattcaatctatcagggccaaaatcgtccaacgatatcccccgagacatttccccagtggcaattccgtcagagtaaatttacctaacactgcaagacgaggccaaagcgaagtccagcagaggaggccgccgccaccacccgccgcagccgctgagaaagatcaggtgacgtcatcatccacgttcgtcatggctcccaccggagaagctgatcaaaacgctgtcgtcgtagatgatcgcatcccccgcatttcggctgcgattcgggtcataccggattttcctaaacaagggattatgtttcaggatataactactttgctgcttgatccaagggcgtttaaggatactattgatttgttcgtcgagagatacggagataagaacattaatgtcgtcgcaggtattgaagcaagaggttttatatttggacctcctattgccctggctattggggcgaaatttgttccatttaggaaacccaagaagttgcctggtgaggttatttcagaagagtactccttggaatatggaacagacataatggagatgcatgtaggggctgtacaagctggagatcgcgctttgatagttgatgacctcattgcaactggaggaaccttatgtgctgcaatcaggctacttgagcgtgttggcgctgaagttgttgagtgcgcatgtgttattgaattgccagaactcaagggacgggatcgtttaggggacaagccactgtttgttcttgtaagctgaaactgatattgggttcaagattgagacatgaagattgcagttcaattatctttatctactaggatttcacataaatttgggattttcgaatgtttgtaaaacattttctcagactctaatgtctttgttgaatcttttaaactataaaatttactgcttaatggatctttcattctgattgttgttctagaaaatactattgttgtctgaaaacaaatattccattgtgaaatgtgtggcggttatagtgcagaataaaaaaagtgtcagttt

SEQ ID NO: 4688 - DNA, 1113 bp, Petunia hybrida
cattatggagtcatataaaatgctctcaacttcattaaggccaatttagtcccacaaaaaatcacttcaaacagatattattattatcatcaaaaggacaatgaagtcaaaataaaatcaccaaccaccaccactatcactactgccactacaaaaactagggtcttttcacctatctccgcatccaaaaatttcaccggaaccggagccggtgaagaaccctatttaaaaacaacccggatccaagatccagttagcttaacaaacatggcatctcatgatccgattcttgtagatgaacgtatccctcgtatttcttctgctattcgggtcatacccgattttcctaaacccgggattatgtttcaggatataacaactttgctactcgatactaaggcatttaaggatactattgatttgtttgtcgagagatacaaggacaaaaaaatcagtgtggttgcaggtattgaagcaagaggttttatatttggtcctcccattgctttggctatcggagcaaaatttgtccccatgaggaaacccaagaagttgcctggagaggttatttcagaagagtattccttggagtacggaacagacaagatagaaatgcatgtaggtgctgtggaagctggtgaacgtgcacttgtggtagatgatctcattgcgactggagggacactaactgctgcaatcaggctcctagagcgtgttggagtcgaggtggtcgagtgtgcatgtcttattgagttgccagaattgaagggccgtgaccggttaggagataagccattgtttgttcttgtgagctcttgatcttcaagtaggaaatgggtctggacagagagctttattgaggtggaattgtattggagtatattttgaattttgagaggaaaaatctcattttttattacagaccttgccaattctggccttaatgtgtggattgaaataagcccttgttaaatgttttcagttgaattagctattgtaagagatttgctctcaatgaattaagtccagtttctgttgttgtagtcttggaattcacttgtgtgagtgacatctagttcacccaaagatttggctcaatctttaaggttctgt

SEQ ID NO: 4689 - DNA, 1043 bp, Solanum phureja
ctaaaatggagtcaatagcccacaaaattgctctcaaattcaccagggtcaatttcgtcccagaaaaagttacaaacagatattataacaggggtaatttggtccaaattaaatcacctaccaccaccctaaccaccccttccagtagaaatactcggcttttttcaccaatctctgtgtcaaaaggagctgccggaaccggagcaggtgaagaacccgagctgaaaacgatcccgatcggagatccagtaagctcagtagatatggcgcctcatgatccgattcttaaagacgaacgtatcgctgggattgcttctgctattcgggtcatacccgactttcctaaaccagggatcatgtttcaggatataacgactttgctacttgatcctaaggcgtttaaggacactattgatttgtttgttgagagatataaggacaaaaacatcagtgtggttgcaggtattgaagcaagaggttttatctttggtcctcccattgcattggctattggagcaaaatttgtccccatgaggaaacccaagaagttacctggggaggttatttcagaagagtattctttggagtatggaacagacaagatggagatgcatgtaggtgctgtgcaagctggtgaacgtgccctcgtggtagatgatctaattgcgactggagggactctaactgctgcgattaggcttcttgagcgtgttggagttgaggtattcgagtgtgcatgtgtcattgagttgccagaattgaagggccgggaacgcttaggagataagccactgtttgttcttgtgagctgaacctgatcttcaatttggtaaggctctggacagagagcttcattaagatggaattgtttcgtagtgtgacattttggagaggatatatctcatttttattaaaaccattgccaattctggcgttcttgtgtggattgaaataagcccttcttaggtgctttcagtttaattagctgttctaagagatatgttctcaatgaattaagtccaatttctatcgtcgttgttgta

SEQ ID NO: 4690 - DNA, 1183 bp, Glycine max
gcagaattaatgtttagtttgtgtggaaatgaaaaaagtgacaagaagtgaagagaatgcgggttgtttgttgttccaattcaggcgtgagtgctttccctagttgtcttagattccctccactgatcgcaatttcaacaacaccctcttcgatccgctttctaaattctccacccctccgttccactgcttcgtcgcaacacgttacaataatggcttcgaagaattctcaacaagacacgcgcttagcgagaatcgcctctgcaatccgagtcatccccgactttcctaagccaggaattttgtttcaggacataaccacgctgcttcttgatacaaaggctttcaaagacaccattgacttgtttgttgagaggtacagagatcaaaacatcaatgttgtcgcaggagttgaagctagaggctttatatttggtccacccattgcattagctattggagcaaaatttgtccccatgaggaaacccaataaattgcctggggaggttatctcagaagagtattctttggagtatggaacagacaaaatggagatgcatgtaggggctgtacaacctggagaacgagccctaatcatagatgatcttattgccactgggggaacgttaggtgctgcaattaagcttctagaacgtgttggggtgcatgttgtggagtgtgcttgtgtgattgaattgccagagttaaaggggcgggaaaggttgggagacaagtcgctatttgtcttgattaatgggggagcctgatcttttttccaagtgattgtgtttttattagctggctcttgttaggagctttattgatgactgcttagatttccttaagatacattttgatgctgcggaaacggaaagcgtgctttgtttgagcgcgctcagttctgctcaattattattattattatcttctgtgagtcccgtttggtaatgacgattgagagaacgatggctataatataggacttgcttgccacttggctgcggaacatcctaagtggctaaggtttactgaaaggaacggaactccatctgatgctcaattggactgtgctttccctgtttccttaaaactgatatgctcttaacgtatagccacaaatatgcactagcctttaagccaccatcaaattaatttaattaatcacttcgtgcttaaatttaaa

SEQ ID NO: 4691 - DNA, 1227 bp, Glycine max
catatattaaattgtattgagcaataaagcagaattaatgtttagtttgtgtggaaatgaaaaaagtgacaagaagtgaagagaatgcgggttgtttgttgttccaattcaggcgtgagtgctttccctagttgtcttagattccctccactgatcgcaatttcaacaacaccctcttcgatccgctttctaaattctccacccctccgttccactgcttcgtcgcaacacgttacaataatggcttcgaagaattctcaacaagacacgcgcttagcgagaatcgcctctgcaatccgagtcatccccgactttcctaagccaggaattttgtttcaggacataaccacgctgcttcttgatacaaaggctttcaaagacaccattgacttgtttgttgagaggtacagagatcaaaacatcaatgttgtcgcaggagttgaagctagaggctttatatttggtccacccattgcattagctattggagcaaaatttgtccccatgaggaaacccaataaattgcctggggaggttatctcagaagagtattctttggagtatggaacagacaaaatggagatgcatgtaggggctgtacaacctggagaacgagccctaatcatagatgatcttattgccactgggggaacgttaggtgctgcaattaagcttctagaacgtgttggggtgcatgttgtggagtgtgcttgtgtgattgaattgccagagttaaaggggcgggaaaggttgggagacaagtcgctatttgtcttgattaatgggggagcctgatcttttttccaagtgattgtgtttttattagctggctcttgttaggagctttattgatgactgcttagatttccttaagatacattttgatgctgcggaaacggaaagcgtgctttgtttgagcgcgctcagttctgctcaattattattattattatcttctgtgagtcccgtttggtaatgacgattgagagaacgatggctataatataggacttgcttgccacttggctgcggaacatcctaagtggctaaggtttactgaaaggaacggaactccatctgatgctcaattggactgtgctttccctgtttccttaaaactgatatgctcttaacgtatagccacaaatatgcactagcctttaagccaccatcaaattaatttaattaatcacttcgtgcttaaatttaaatattataaatcgcacg

SEQ ID NO: 4692 - DNA, 619 bp, Fagus grandifolia
tagcgagtgactcggcgaaaccacaagaaatggctgctggagatgtccaagaccctcgcatacagaaaattgcttctgcaatccgagtcatcccagactttcctaagccagggattttgttccaggatataaccaccttgcttcttgataccaaggcttttagggatactattgatttgtttgttgagaggtacaaggacaaaggtatctccgtggttgcaggtattgaagctagaggttttatctttggccctcccattgcattggctataggggcaaagtttgttcctatgagaaagcctaataagttgcctggggaggttatttcggaagagtattcgttggagtatggaactgacataatggagatgcatgttggggctgtagaagcaggagaacgtgcactggtaattgacgatctcattgcaactggtggaaccttgtgtgctgcaatcaggctactagagcgagttggagtgcatgtgtttgagtgtgcatgtgttatagaattgccggagctaaagggtcgggaccggttgggagacaaaccactgtttgttcttgttaatgcagcgggtgtctgagcctgaggtagtactgcttgtttctaggccatatg

SEQ ID NO: 4693 - DNA, 1268 bp, Populus trichocarpa
acaaatactgtctggaccgaataaccctcgttcaaagcaaaacccatatatttagcaacacgctctacggcagcatttttgtgagtcaagaaaatcatgcaaagaagtcttctgctccgttgttcaaattccatctttcgtcctccaccaaactctcatcgacttcgaccaccgtctctgaaacgtcagtcggctccgattgcagcctcctccggtgcccaattacctttaactttctcccagaattacagaactgcccccaatcgccttcactgctctgtgagcgagtcacagtggaagcaagatagagaaatggccactgcagatgagcagcaagatcctcgtatagccagaatctcctctgctataagggtcatccctgacttccctaaaccagggattatgtttcaggatataacaacgttgcttcttgatacaaaagcgtttaaggatactatagatttgtttgttgagaggtacagagataaaaacatctctgtcgttgcaggtgttgaagctaggggttttatatttggccctcccattgcactggcaatcggagcaaaatttgtacccatgaggaaacccaataagttgcctggggaggttatttcggaagagtactctttggaatatggaacagacaaaatggagatgcatgtgggtgcagtagaagcaggagaacatgcattggtaattgatgatctcattgcaactggtgggaccttatgtgctgcagtgaaactactcgagcgtgttggggtacatgttgtcgagtgtgcctgtgttattgaattgttagggctgaagggacgggaacgcctaggagacagaccgttatttgtccttgtaaactcaacttagtctctttgtttttatggtggaaaagctccttttcgaccctatatttgttcctgattgctggagctctgctcaaatccatgtaagactggttaaataacgaacttgatggttgaagtgttggaaacggtagaccaacttgcttcctcccagtgttttttttggactgatttaagcagtaataagttagtggctgtttgacttgctggccgtgtggattttagtaaggtaatgtccattcttgatgtctgatgtttgaggatgttaaaaaaaaatgttaagatgtgaagtaaccttcttttttgcctgcgtgcttgaatgccttgtcatacaattgtggatgcaagagactctgtattgattcttctaatacatttgagtttgatttcatgacttctgtgttttta

SEQ ID NO: 4694 - DNA, 1138 bp, Populus trichocarpa
aaagaaaaaagaatgcaagaaagacctactcgcaaacagcttatttctctttgaagctagccaaaaaatctgagttagttcttgttgagtagtgagcgagtcacagtggaagcaagatagagaaatggccactgcagatgagcagcaagatcctcgtatagccagaatctcctctgctataagggtcatccctgacttccctaaaccagggattatgtttcaggatataacaacgttgcttcttgatacaaaagcgtttaaggatactatagatttgtttgttgagaggtacagagataaaaacatctctgtcgttgcaggtgttgaagctaggggttttatatttggccctcccattgcactggcaatcggagcaaaatttgtacccatgaggaaacccaataagttgcctggggaggttatttcggaagagtactctttggaatatggaacagacaaaatggagatgcatgtgggtgcagtagaagcaggagaacatgcattggtaattgatgatctcattgcaactggtgggaccttatgtgctgcagtgaaactactcgagcgtgttggggtacatgttgtcgagtgtgcctgtgttattgaattgttagggctgaagggacgggaacgcctaggagacagaccgttatttgtccttgtaaactcaacttagtctcgctgtttttatggtagaaaagctccttttcgaccctatatttgttcctgattgctggagctctgctcaaatccatgtaagactggttaaataacgaacttgatggttgaagtgttggaaacggtagaccaacttgcttcctcccagtgtttattttggactgatttaagcagtaataagttagtggctgtttgacttgctggccgtgtggattttagtaaggtaatgtccattcttgatgtctgatgtttgaggatgttaaaaaaaaatgttaagatgtgaagtaaccttcttttttgcctgcgtgcttgaatgccttgtcatacaattgtggatgcaagagactctgtattgattcttctaatacatttgagtttgatttcatgacttctgtgtttttatttgtggtgtggtctgtgttttgctttttaattacagatttaaaagtttttggttaat

SEQ ID NO: 4695 - DNA, 990 bp, Picea glauca
tgttgagtagtgagcgagtcacagttgaagcaagatagagaaatggccactgcagatgagcagcaagatcctcgtatagccagaatctcctctgctataagggtcatccctgacttccctaaaccagggattatgtttcaggatataacaacgttgcttcttgatacaaaagcgtttaaggatactatagatttgtttgttgagaggtacagagataaaaacatctctgtcgttgcaggtgttgaagctaggggttttatatttggccctcccattgcactggcaatcggagcaaaatttgtacccatgaggaaacccaataagttgcctggggaggttatttcggaagagtactctttggaatatggaacagacaaaatggagatgcatgtgggtgcagtagaagcaggagaacatgcattggtaattgatgatctcattgcaactggtgggaccttatgtgctgcagtgaaactactcgagcgtgttggggtacatgttgtcgagtgtgcctgtgttattgaattgttagggctgaagggacgggaacgcctaggagacagaccgttatttgtccttgtaaactcaacttagtctctttgtttttatggtggaaaagctccttttcgaccctatatttgttcctgattgctggagctctgctcaaatccatgtaagactggttaaataacgaacttgatggttgaagtgttggaaacggtagaccaacttgcttcctcccagtgttttttttggactgatttaagcagtaataagttagtggctgtttgacttgctggccgtgtggattttagtaaggtaatgtccattcttgatgtctgatgtttgaggatgttaaaaaaaaatgttaagatgtgaagtaaccttcttttttgcctgcgtgcttgaatgccttgtcatacaattgtggatgcaagagactctgtattgattcttctaatacatttgagtttgatttcaccctcgtgc

SEQ ID NO: 4696 - DNA, 1664 bp, Cannabis sativa
ggtttttccacgaaaatttgagttgagttaaatgatagtagaataattgttgaaaagatttatttgaaaaaatctcttttataaaagcaaaatgaaacaaaaagacagacacactaattaatcgaaactacgtcgtttacttgtaacagagtcagatccagcagcaatcaattgaataagatggaaaacagctcactcttcctctcgtcttcaccaaattcattgtctctgtcacccaccaaaaccactcctgccgctgactgtattcgaatcggagctccgcgcacaacaacggttctagcttcttctagggtcgaattcccctccattcgcttgcatcactcccgatccccactctcccctctgtgctgcaccgcgagcgagtctgtgaaggaagaacaagaaatggctttgaaagatggtcaggacgatcgcatagctagaatttcctctgccattcgagtaatccccaactttcctaagccagggattttgttccaagacatcactacgttgcttctggataccaaggctttcaaagacaccattgatttgtttgttgaaaggtacaaagacaaacgcatctccgtcgttgcaggtgttgaagcaagaggttttatattcggcccacctattgctttggctataggagcaaaatttgtacctatgaggaagccacataagttgccaggggaggttatttcagaagaatattctttggagtacggaactgacaagatcgagatgcatgttggagctgtagaagcaggagagcgtgcactgatcatagatgatcttattgcaactggaggaaccttgtgtgctgcaatcaggctacttgaacgtgttggagtggatgtggttgagtgtgcttgtgttattgaactgcccgagctgaagggtcgagcccgactaggtgggaaaccattgtttgtgctagttgatgcagcagcctgatgatcaacactcttgttttaatttctgcttgttggtgaagctagtctgaaaattctggaacttgttgtgaggtggcagatttgagaaaaccgcttattattaaggggaggaattggtcgataataaagggtttgtaacatttgggatggtttatttttatttttatgaaaaataattgttggcgatgctaaggtataatttgttatttcattgttgttgaagatagagttcaattgccaaagtgtatgttacagcagtgtatgttacagcagcttgaaatgaagtactgccaaaaacgtcaccaaacttgaaataaacgtcttactagagagcagagacttgttttgccttggatcaaaatgtttctgtcagccccattaactaatgagtttaataactttttccattactaaatatattgggtaactatttttcttcaaagaaaaaatagttcaatactagtccacacaaatctataaacagaatatgtctgagaatcatctttgtcggcgatgaagactttcccacaattgcagatacaatcgttcattgttggacgactctgtccgttgaccggaatattattgttattaatgccttggatgttaatccggtgatgatgatgattgcttcgacagtgacgtgaattaagatttaacatttctgtatcagatgccatactaatgcgctctttaatcataaaaaag

SEQ ID NO: 4697 - DNA, 1170 bp, Malus domestica
gttgcgagttacgagtttaacatcaaacttgcgtgaaaccgaaaagcccgctgctgctcgttgagagttgacgggcccgttgctattttgttctgatgcttcaacttcaaaccatctcacttttctcgtcgaattccttcactttctcacccgccgtagccttccgcactcccgcagctaaaactttgtcctccgccgccgccgcgcttcccttcattcgtttcccaaattaccgatccgcccgccctcccccgtgctgctctgtgggtaagagtgaagcactgaaagttgaagcaatggcagcggaagacggtcaggatcttcgccttgctagaatttcatctgctatcagagtcattccgaacttccccaagccagggattatgttctatgatattaccacattgctcctggataccaaggctttcaaggatactattgatttgtttgttgagaggtacaaagacaaagaaatctctgttgttgcaggtgttgaagctagaggttttatatttggccctcctattgccttggccattggggcaaaatttgtgcccttgaggaagccaaagaagttgcctgggaaggttatttctgaagagtactctttggagtatggaacagatattatggaaatgcacgtgggagctgtagaagcgggtgaacgtgccttgatcatagatgacctcattgcaactgggggaaccttgggtgctgccatcaagctacttgagcgtgtaggggtgcatgtcgttgagtgcgcctgtgtaattgaattaccagaactaaagggtcgggaacgactgggggagaaaccattgtttgttctagttagcggagatgcatgagcatggtttcttttggggctgcatattttcaagaaaccaacttgattgttagcaggggcgtacggttgattatcggtgtgttttcattgggtgattgaagagctaaaaaacactttggtagatgtatgtactatttactatgcagaaataagttgtttttctgtttcacttataaatctggtaatatttgatcaacggatgaattaaacatcaaatcaccaaagtaaaattatctcagttatctcgtatttttctcttcaatatttgaagggacatcaagtttgaataattttcctccttcaatagaaaaataatattctcg

SEQ ID NO: 4698 - DNA, 1031 bp, Cucurbita pepo
attggccgctgcccttcttttgctctgatttacctccgtcaaattgtgttgatcgagtgtccggcgggtgtttggcagtgagtaagacggtgccggatcaagaaatggcgtccaccgatgaacaagacccacgcatagccaaaatcgccaaggccattcgagtaatcccagatttccctaaaccagggattttgtttcaggatatcacaacgttgcttcttgatataaaggcctttagggacactattgatttgtttgtggagaggtacagagggaaggatatttctgtcgttgctggaattgaggcgaggggcttcatttttggccctccgatagctctggctatcggtgcaaaatttgttcccatgagaaaacccaagaagttgcctggtgaagtcatttcagaagaatactctttagagtatggaacagataaaattgagatgcacgtaggagctgttgaagctggagaacgtgctcttgtgatagatgatctcattgcaactgggggaaccttgtgtgcagcaataaggctacttgagcgagttggcgttgaggtggtcgagtgtgcttgtgtgatcgagctgcagggactaaagggacgagaacgattgggaggcaaacctctattcgttctagttaacgcgatggcatgatcgtagagccttcttatgcaatacaacgcgcttggtattggtcattacaagatcttactgctgctagaagttgaagtttccaagtactgcataattttgaagtggagagtattgctagaaataaaagggatggtattaatctgagagttgaagagataaaacaaaaagaagaaaagaaaatattagcttttgattattctggttgttatgtatttgttgtttgtcaattgtcctgctgtctcctttctgcctgcctgttgatgatgttaatcttgattatctgcacaaacttctttattttgcagttaattagtttttatcaaataaaatgcctcctcatgcatcattactttttatagtaagtctattatatac

SEQ ID NO: 4699 - DNA, 624 bp, Euphorbia peplus
cgctctcagccgctgctaatccgaaaatggcagctcaacacgagaaagatccccgcatagagggaatttcttcttcaattagggtcatccctgacttccccaaaccaggaattatgtttcaagatataacgacgttgcttcttgatacaaaggcgtttaaggacacaatagatttgtttgtggaaagatacaaggggcaggatatctctgttgttgcaggtgttgaagcaagaggttttatatttggccctcctattgcattggctattggggcaaaatttgtccccatgaggaaacctaataagttgcctggggaagttatttcagaggagtactcgttggaatatggaacagacaaaatggagatgcatgtaggtgctgtacaggcaggagagcgtgctttaattattgatgatctcattgcaactggtggaacgttatgtgctgcaatcagactacttgagcgtgttggagtacatgttgtagaatgtgcctgtgttattgaattgcctgagctaaagggtcgggaccggttaggagagacaccactgtttgttctcgtgaattgaattctgcttgaggttgctgtttctgtgatagcaacatgtgattctgccaccgtct

SEQ ID NO: 4700 - DNA, 978 bp, Helianthus annuus
ctttacaagattagggcaaaattccaatttgtcttcccagaaagccatgaatacgcataaaatcctcttcaactccaatgtcgtcatccaaagattctctcacagtggcaatttcgtcaatccactaaaatcccccaccccctcttttccaaccacttgtcaaaaataccaacccatctccgcgtcagcgccaccagcagccaccaccacccgccaccactttcacacctactcctcctcttctcacatggctgctcctacttccgatgacgatcgcatctcccgaattacatcagcaattcgcgtcattccagacttccccaagccagggattttgtttcaggatattacgacgttgttgcttgatccggtagcttttaaggatacgattgatctgttcgttgagcggtataaagataaggatatctcggttgttgctggtgttgaagcaagaggtttcatatttggtcctcctattgcattggccatcggagcaaaatttgtccctatgagaaaaccaaacaagttacccggacctgttatatcagaagagtattcattggagtatggcaaagacaaaattgagatgcacgtcggagctgtagaagcaggagatcgtgctctcgtaatagatgatttaattgcaactggtggaaccttgtgtgctgcaatcaatttacttgagcgggttggagctcatgtagtcgagtgtgcttgtgttattgaattgcctgaactgaagggtcgggatcgattaggagacaagccgctgtttgtcctcgtctcgtgagtcttatgactgtgtggaaatcaaaatgatttttaacaaagaggtttatttgggtttatggaactaaaataaaatgttgatttacaccttgcgggaatctaaatatgtaatatgtactcttgtatacattacttggtggtggtgaaggcaaccttattaaggttgaagaacacaacatcattcttttt

SEQ ID NO: 4701 - DNA, 1099 bp, Helianthus annuus
tttcactttctccgtgtaactttaccaaatcacacctttactttacatgattagggcaaaattccaatttgtcttcccagaagccatgaatacgcataaaatcctcttcaactccaatgtcgacatcctaaacccccaaagattctctcacagtggcaatttcgtcaatccactaaaatcccccacccctccctttccacccacttgccaaaaataccaacccatctccgcgtcaacgccaccagcagccaccaccacccgccaccactttcacacctactcctcctcctctcacatggctgctcctacttccgatgacgatcgcatctcccgaattacgtcagcaattcgcgtcattccagactttcccaaaccagggattttgtttcaggatattacgacgttgttgcttgatccggtagcttttaaggatacgattgatctgttcgttgagcggtataaagataaggatatctcggttgttgctggtgttgaagcaagaggtttcatatttggtcctcctattgcattggccatcggagcaaaatttgtccctatgagaaaaccaaacaagttacccggacctgttatatcagaagagtattcattggagtatggcaaagacaaaattgagatgcacgtcggagctgtagaagcaggagatcgtgctctcgtaatagatgatttaattgcaactggtggaaccttgtgtgctgcaatcaatttacttgagcgggttggagctcatgtagtcgagtgtgcttgtgttattgaattgcctgaactgaagggtcgggatcgattaggagacaagccgctgtttgtcctcgtctcgtgagtcttatgactgtggaaatcaaaatgatttttatcaaagaggtttatttgggtttatggaactaaaataaaatgttgatttacaccttgcgggaatctaaatatgtaatatgtactcttgtatacattacttggtggtggtgaaggcaaccttattaaggttgaagaacacaacatcattcttttttctcatcccttaagttgttaaattatgaaggattgttttcaagatagtttctattattcaccaaaataccacaac

SEQ ID NO: 4702 - DNA, 1121 bp, Cajanus cajan
tgtgagaagcgaagagaatgcgagttgtgtgttgctccaattcgtcgttagccgtcactgccactcttccatcttttccctgtctgggtcctagattccttccacgcatagcaattccaatttcaataccatcctctgctatccgctttcttcccctccgctccactgcttcgccgagacaaatcacaacaatggcttccaagaatgctcaagatcaacaagactcgcgcttagagagtatctcctccgcaatccgagtcatccccgactttcctaagccaggaattatgtttcaggatataaccacgctgcttcttgatacaaaggctttcaaagacacgattgacttgtttgttgagaggtacagagataaaaatatttctgttgtcgcaggcatcgaagcaagaggctttatatttggaccacccattgcattagctattggagcaaaatttgtccccatgaggaaacccaataaattgccaggggaggttatctcggaagagtattcattggagtatggaacagacaaaatggagatgcatgttggggctgtacaacctggagatcgagccttaatcatagatgatcttatcgccaccggagggacgttgggtgctgcaattaagctactagaacgtgttggggtgcatgttgtggagtgtgcttgtgtgattgaattaccagagttaaaggggcgtgataggctgggagacaagccgctatttgtcttggttaaagggatggcctgatcattttcctgggagacaagttgtttattcactcagttctgaattattaatattattattcgagtgtcccgtttataaagctcgtaatttataattatagtacagaaccagtagagagctcaggtggaggagctctatgtaacattaccttattttggttccgtggaatgagggaatgatgactataataaaggacatgcttgccattggtatttgccatttggcagcggataatcaagtttaggtttacttaaatgacttgtaatgagcatagtcacacctaagttatgttcaaatttcagcccttactttttggtagatgtataactttattttattcaatatatgctcacattcacatatccttca

SEQ ID NO: 4703 - DNA, 1200 bp, Valeriana officinalis
aaagccaccgcgctgaaaatatccggggttaatatcgtcaaagcacaagtttcacggtatttacacagtggtaattcggtcacaataaaactgcccaatacctgctctcgatttcgatctattgggggagaacattcggaacatagtcgccgccgtcaaagtacagttccgatcgggtcaactagagatcaactcgactcagacatggcagctccggtggatctggactctaatatcgatcgcatcgctcggatttcctccgccattcgagttattcctgatttccctaaacctgggattatgtttcaggatataactactttgttgcttgatcctaaagcttttaaggacaccatcgatctgtttgttgagaggtataaagataaaaatatctctgtcgttgcaggtattgaagcaagaggttttattttcggtccacccattgctttagcaattggtgcaaaatttgtccctattcgaaagcctaaaaagttgcctggcgaggttatatcggaggagtattcattagagtatggaacagacaaaatagagatgcacgttggagctgtaaacaacggcgagcgagctcttgtaatcgatgatttaatagcaacaggtggaaccttggctgctgcaatcaagctactcgaacgtgttggggcaaatgtggttgaatgtgcttgcgtgattgagcttgcagagcttaagggcagggatcggttaggagacaggccactgtttgtgcttgtaagctcgacttgaaagcattttcgccggagaggagatgccaaattttctgaggaggtattatcagagtgctttttaataaagaatttatcatttctgattgtttgagtcgaaccctatttttctagtacttgttactttctgattgtaatctactaagtgaagcccaacacttctaaaggataatctgctacttggcttacacatctttttacgaacgaaatcaaagctagagtgggccttctgagtccactattggatgggccacatattagagtccatcctaagcccaatttttacaagtagctcatattaaggcaaactttatattttgttgtttttagactctgtcgagtaaaattttataggagtactctatttctttatttagtaattcttttaaaaaatattttaattttttacataatttatataaaatacaattatgatcga

SEQ ID NO: 4704 - DNA, 932 bp, Nicotiana benthamiana
tttgtgtccaaaagagctggcgtacccagagccggtgaagaacccgagttgaaaacaacccggatccgagatcctctgagcttagcagatatggcgcataaagatccgattctcaaagatgatcgcatcgctcggatttcttcttctattcgggtcatccccgacttccctaaacccgggattatgtttcaggatataacatcattgctacttgatactaaggcatttaaggacactattgatttgtttgttgagagatacgaggacaaaaacatcagtgtcgttgcaggtattgaagcaagaggtttcatatttggtcctcccatcgcattggctattggggcaaaatttgtccccatgaggaaacccaagaagttgcctggggaggttatttcagaagagtattctttggagtatggaacagacaagattgagatgcatgtaggtgctgtgcaagccggtgaacgtgcattcgtggtagatgatcttatcgcaactggagggaccctaactgctgcaattaggcttctagagcgtgttggagttgaggtggtcgagtgtgcatgtcttattgagttgccagaattgaagggccgggacaggttaggtgataagccactatttgttcttgtgagctcaacctgatcttcaattaggaaatggatctggacagggagcttcattgaggtggaactgtagtggagtgacattttgaattttgagaggagaaatctcatttttatatcaaccattgccagttctggccttaatgggtggattgaaataagcccttgttaggtgctttcatttgacttagaaattgtgagagatatgatctcaaagaattgagtccaacttttattgttgtggtagttggtggaactcacttgtgtatgacatcaagttcaccatgggtagtggtggcaaaatgg

SEQ ID NO: 4705 - DNA, 625 bp, Brassica juncea
gatccgagaatccccaagatcgcttcttcaatcagagtcatccccgacttccctaaaccagggatcatgtttcaggacataacgacgctgcttctggacactgaggcatttagagacaccattgatatttttgttgaaagatacaaaggcaaaggcatctctgttgttgcaggtgttgaagcaagaggtttcatttttggccctcctattgccttggctattggtgctaaatttgttcccatgaggaagcccaagaagctacctgggaaggttatatcggaggagtattcgttggagtatggaacagacaagatagagatgcatgtaggtgcggtggagcctggtgagcgtgctatcatcatagatgacctcattgccactggtggcactctcgctgctgcaatccgactacttgagcgagtaggagtgaagatagtggagtgtgcatgcgtgattgagttaccagagcttaagggacgggagaaactaggagaggcgccactttttattcttgtcacctcggatgctgcttaaccagaaataaacccttgaaggaaaaatggggtggtttattgggatgatatcaaaatgttacaactacttttcattgtatgggtgagagacg

SEQ ID NO: 4706 - DNA, 1510 bp, Citrus clementina
atgcaacctggattttcaattttgtgcttccaagccagcgcagacttgccttttctggttttctaccaaaggaaaggcgtgatgcatgctgcagcttcacttcttaactcttcaaacctctcccttcgctttgcatctcaaacgcagacacgactctctccctggatcgccgctccctcctctgttcgcctaccgttgaaccgctcgcaaaattacagaattgcactccctcctctgcattccaccgtgagtggtgactcgacgcaacctcaacaaatggcttcagctgacgtaaaagcacaagaccctcgaatcgctgggatttcctcagcaattcgtgtcatcccagacttccctaaaccagggattatgtttcaagatatcacaacattgcttcttgataccaaggcttttagagatactattgatctgttcgttgagaggtacaaggacaaaaacatctctgttgttgcaggtattgaagctaggggttttatatttgggcctcctattgcattggctattggggcaaagtttgttcctatgaggaaacctaagaagcttcctggggaggttatttccgaagagtattccttggaatatggaaaagatgtaatggagatgcatgtaggtgctgtacaagcaggggagcgtgctttaatagtagacgatctagttgcaactggtgggaccttgtctgctgcaatcaggctacttgagcgagttggggtgcatgtggttgagtgtgcatgcgtgattgaactgccagagctaaagggtcgggaacggctgggagagaaaccactatttgttcttgtaagctaaacttgacctcaggttatggtttaaatgcaatgtttgtggaccatatgggtttctagtcgctcgggctctgctcaaagcttgagaacttcataaaaccatctggtaatataagagcagtttcattggctttttattttatttaagacgttggggaaagagtggtggggaagctgggttctgtctgctattgttgggtttaagaatgataggcttatgaaaaaattccatcttcccgtaaacagctgtatttgatgcttttcaaattatctggagattctatctgatggttgttgatgtatcatgtgtgaattaaaccgaattcaactcgtctctttattatttaatcattattgagtccgtttgctacgcgtagattagggaatggtagagaggcctgcttattctttattaaaagaaaaggaaataaaaggtaaattcatttactggacgcaggcaagatcatcaagcataaacaagcagtacgtgggagctttgcctcattggaaaatggtcattacattttcttcccctttttggcttgagctgcgcccgctcttggactctagcccttgttttttatatttatttatttatttatgttttgggccatcctctttgggtctccgtccggttttgtgttttggatttattttaagaaagaaaatgaaaacaccatacctaataa

SEQ ID NO: 4707 - DNA, 908 bp, Flaveria ramosissima
accactttcgttaatccactaaaaccctctccacccacttgcaaaaccaacagatccatctccgccgcaacgccaccagtagcctccggtggccgccgcctccacaccgccttccgtaccgtcccgccgccgtgccgctcctctcacatggccactcctacttccgacggccaccgtgacgacgtcgtcaaagacgatcgcatcgctcgaatcacatcctccattcgcgtcattccagacttccctaaaccagggattttgtttcaggatataacgacgttgttgcttgatccggtggcgtttaaggatacgatcgatctgtttgttgagaggtataaggataaagagatctcggttgttgctggtgttgaagcaagaggcttcatattcggtcctccgattgcgttggctattggtgcaaaatttgtccctatgagaaagccgaacaagttacctggagctgttatatcagaagagtattctttggagtatggcactgataaaattgagatgcacgttggagctgtagaagcgggagaacgtgctcttgtaatagatgatttaattgcaacaggtggaactttgcgtgctgcaatcaatttacttgagcgtgttggagtcaatgttgtcgagtgtgcctgtgttattgaattgcctgaactgaagggtcgggatcgattagcaggcaagccgttgtttgtgctagtgagctgagtttgatcttcattatttcctaaaagctttaaattttgctattactggttcaaaaacaaggtttttatgcaaccagtactcacatttgtactatgtatgatttaagactcgagcatgatcgttgttgctttgcgaaactcaaataaaacgttggttagacttatgattatgtaaagccagtaaatgttaatttg

SEQ ID NO: 4708 - DNA, 1083 bp, Pinus pinaster
tccgccagtgccatcaaaaccagatccctctctccctttctttccccatctcattctctcatttccatctcaaggttcttcccctgttccctcacaagtcgagggttccactcccgcgactcctcaccttgttttgaccatttctgtctccacgcagcaggcattcgggacaatacaatgtcggcttctgaagatggggatgcgagagtccaggggatatttaacgcaattcgagtagttccagattttccaaagcctggaataatgtttcaggacataacgacgttacttctggatcacaaggcatttcgggacagcattgatatatttgttgagagatacaaggataagaatattgcagttgtagcaggaattgaggctagaggatttatttttggtcctccaattgcattggcaattggtgccaaatttgtacctattcgaaaacccaaaaagttgccaggtgaggtcatttctgaggagtatgcgttggagtatggaacagatcgtattgaaatgcatgttggagcagtacaacctggtgatcgcaccctggttgttgatgatctaattgctactgggggcaccttatctgcagccatgagattattggagcgtgttggcgctgaagttgttgaatgtgcatgtgttattgaattgccagagttgaagggccgggagaagttaggtgggaagccactcttcatcctagtagagtctgcttaattgagctgcagcaagtgaacgtactttttagcaacaatccttgagccttattgagaaaggactaatatgtaggaaatattctttctactgcacgagttgtggtgatctggatcttttaggtgaggtcagcagcctgagcgaaattgatttatcttttcgtaaaggtttgttcagtagaattgctactcttatggggatctgctttgatataaagatcatattatttatgcattatgattatttcactttgctgcaaagatgtaattaggccagatatttttcttttcgcaatgatgtaatgagcctggaagcataggaatggtctccttgatgtttgaattactgctgaaaatttta

SEQ ID NO: 4709 - DNA, 1124 bp, Mimulus guttatus
aaattattcttcgtagctatactttatcaaacaaaaagcatcaaattaaaccttcaatttattaatcacccacttttccacaccctaccctttaatttctctttaaatcccactcatgtacactctatctcaactctcgccaatcgagatcttcgagggtaaaattgtcccgatcggatatttgtgcagccgcattaaggttaaatcaaatatcttcatctcccactctaacgccgccaccactgcaatcagcagcagcagcagaaaagacaatccggcgatctacggcagattaactggtggcgcagccgtacccgaacggaagcttacgagagcagcacacatggcttcagcaaatgttggcgaaacggacgatcgtatctctcggatctcctccaccattcgggtcatacccgatttccccaaacctggaattatgtttcaggatataacgactttgttgcttgatcataaggcgttcaaggacacgatcgatttgtttgttgagagatataaagacaaaaatatcaatgttgttgcaggtatcgaggcaagaggttttatattcggccctccgattgcattggctattggtgcaaaatttgttcctatgaggaagcccaaaaaactacccggtaaggtaatatcggaagagtattcgctggagtacggaactgacaagatggagatgcatgttggagctgtcgaagctggagaacgcgcacttattgttgatgatctcattgctactgggggaaccttaaatgctgcgatccgcttacttgagcgcgttgaagtaaccgtggttgagtgtgcctgtgttattgaattgccggaactgaagggtcgggacaagttaggagacaagccactgtttgttcttgtgagctcgtcaatctgaggaaaacagataatctatgatgccaacaaataatttgatgtaataatatttggcagagttcttagcttattcttcttcatacctgttattgattaacaaattctactgtattattattcatctaaacacattgtttgtatttgtgagagaccaatacctctttcatttgtatggaatattttatgttctgtcaagtttatgtgcatgcaagtatgtttcaata

SEQ ID NO: 4710 - DNA, 1130 bp, Mimulus guttatus
aaattattcttcgtagctatactttatcaaacaaaaagcatcaaattaaaccttcaatttattaatcacccacttttccacaccctaccctttaatttctctttaaatcccactcatgtacactctatctcaactctcgccaatcgagatcttcgagggtaaaattgtcccgatcggatatttgtgcagccgcattaaggttaaatcaaatatcttcatctcccactctaacgccgccaccactgcaatcagcagcagcagcagaaaagacaatccggcgatctacggcagattaactggtggcgcagccgtacccgaacggaagcttacgagagcagcacacatggcttcagcaaatgttggcgaaacggacgatcgtatctctcggatctcctccaccattcgggtcatacccgatttccccaaacctggaattatgtttcaggatataacgactttgttgcttgatcataaggcgttcaaggacacgatcgatttgtttgttgagagatataaagacaaaaatatcaatgttgttgcaggtatcgaggcaagaggttttatattcggccctccgattgcattggctattggtgcaaaatttgttcctatgaggaagcccaaaaaactacccggtaaggtaatatcggaagagtattcgctggagtacggaactgacaagatggagatgcatgttggagctgtcgaagctggagaacgcgcacttattgttgatgatctcattgctactgggggaaccttaaatgctgcgatccgcttacttgagcgcgttgaagtaaccgtggttgagtgtgcctgtgttattgaattgccggaactgaagggtcgggacaagttaggagacaagccactgtttgttcttgtgagctcgtcaatctgaggaaaacagataatctatgatgccaacaaataatttgatgtaataatatttggcagagttcttagcttattcttcttcatacctgttattgattaacaaattctactgtattattattcatctaaacacattgtttgtatttgtgagagaccaatacctctttcatttgtatggaatattttatgttctgtcaagtttatgtgcatgcaagtatgtttcaatattgtcg

SEQ ID NO: 4711 - DNA, 879 bp, Olea europaea
gggcaaatactcctcggccactgcagccaatcagattttcgcacatggcggcccaaaatgttgattcgactgatgatcgtatttctcggatttcatcttccattcgggtcatacccgatttccccaaacctgggataatgtttcaggatataacgactttgctccttgatcccaaggcatttaaggacacgatcgatttgtttgttgagagatacgaggaccaaaatattaacgttgttgcaggcattgaggctagaggtttcatatttgggcctccaattgcattggctatcggggccaaatttgttcccatgagaaagcctaagaagttacctggtgaggttatttcagaagagtactctttggagtatggaacagacataatggagatgcatgtaggggctgtacaagctggagaacgggcacttgtcgttgatgatcttattgcaactgggggaaccttgagtgctgcaatccgcctacttgagcgagttggggttgatgtggttgagtgtgcatgtgttattgaattgccggaactgaagggccggaatcgattaggagacaagccgctgtttgttcttgtgacctgaacttgatgctgttgtgaaacttgatatcgagattggaaggaggagaatgtgttcatgtcgaaaataattaatggtttctggctttcattattgaatttgtatttgcttatttgcttcaacaagtgctttgggtcgaggatttaaattagaaaactaattcgcattcttatctgtgaaacaatggctgctggtaattgtggtgtatatgtccaaacctagtgttgtattgccaaaacttacgaatgcatgtgcttacatatagtttcttttgtaagtaattcttacg

SEQ ID NO: 4712 - DNA, 1514 bp, Citrus sinensis
atgcaacctggattttcaattttgtgcttccaagccagcgcagacttgccttttctggttttctaccaaaggaaaggcgtgatgcatgctgcagcttcacttcttaactcttcaaacctctcccttcgctttgcatctcaaacgcagacacgactctctccctggatcgccgctccctcctctgttcgcctaccgttgaaccgctcgcaaaattacagaattgcactccctcctctgcattccactgtgagtggtgactcgacgcaacctcaacaaatggcttcagctgacgtaaaagcacaagaccctcgaatcgctggtatttcctcagcaattcgtgtcatcccagacttccctaaaccagggattatgtttcaagatatcacaacattgcttcttgataccaaggcttttagagatactattgatctgttcgttgagaggtacaaggacaaaaacatctctgttgttgcaggtattgaagctaggggttttatatttgggcctcctattgcattggctattggggcaaagtttgttcctatgaggaaacctaagaagcttcctggggaggttatttccgaagagtattccttggaatatggaaaagatgtaatggagatgcatgtaggtgctgtacaagcaggggagcgtgctttaatagtagacgatctagttgcaactggtgggaccttgtctgctgcaatcaggctacttgagcgagttggggtgcatgtggttgagtgtgcatgcgtgattgaactgccagagctaaagggtcgggaacggctgggagagaaaccactatttgttcttgtaagctaaacttgacctcaggttatggtttaaatgcaatgtttgtggaccatatgggtttctagtcgctcgggctctgctcaaagcttgagaacttcataaaaccatctgattaatataagagcagtttcattggctttttattttatttaagaggttggggaaagagtggtggggaagctgggttctgtctgctattgttgggtttaagaatgataggcttatgaaaaaattccatcttcccgtaaacagctgtatttgatgcttttcaaattatctggagattctatctgatggttgttgatgtatcatgtgtgaattaaaccgaattcaactcgtctctttattatttaatcattattgagtccgtttgctacgcgtagattagggaatggtgatagagaggcctgcttattctttattaaaagaaaaggaaataaaaggtaaattcatttactggacgcaggcaagatcatcaagcataaacaagcagtacgtgggagctttgcctcattggaaaatggtcattacattttcttcccctttttggcttgagctgcgcccgctcttggactctagcccttgttttttatatttatttatttatttatgttttgggccatcctctttgggtctccgtccggttttgtgttttggatttattttaagaaagaaaatgaaaacaccatacctaataa

SEQ ID NO: 4713 - DNA, 969 bp, Lippia dulcis
ctctatccctaaaaatcgtgggggctaaaatcgtctctcaaagttgttctctccactgtggtaaatacgccaaatcgtctctcttcctacctaccactaacgccaccactgcgaggaggagcagaggacgggagaatcggttgatctacgcagtgttgactggtggcggagctgtggaggaacggcggacgatgagtgttatggcgcacgcggcatcctcgaacgttgatgagagagacgctcgcatctctcggatctcctcctccattcgggtcatacccgatttccccaaacctgggattatgtttcaggatataacgacgctattgcttgttcctgaggcatttaaggatactatcgatttgtttgttgagagatacaaagacaagaatatcaatgttgtagcgggtgttgaggcaagaggttttatatttggtcctcctattgcactggcaatcggggcgaaatttgttccaatgaggaaacccaataaattacctggggaagtaatatctgaagagtactctttggaatatggaactgacacgatggagatgcatgtcggagctgtaaaatctggagaacgtgcaatagtagttgatgatctcattgctacaggggggaccttaagagctgctattaacttacttgagcgcgttgaagtcaaagtggttgagtgcgcttgtgtcattgaattgccagaactgaagggtcgggacaagttggcggacaagccgttgtttgttcttgtgagttcagcttgaggaagaatagctgtgacaaacaatattgctattttatctgtcttcaagtcatggattagttgctagttcttgcttgatgctatgcaccgaatatacaaattcaaatacctgcatgtatcctttttatgttggggggaattatagtccaaacgaacaaaaatctctttttgttgcagagtggttattttaagacatcatgaatttg

SEQ ID NO: 4714 - DNA, 1516 bp, Pinus taeda
tccattccaaggcacatgagtcaaatcccaaaagaggcaagttgcgccaatctacggaaaaaaggtggatcatgtgaacatttcgtgaatggctaaacgtacacgctggttacggtcacgtttgagaccacacataatctcaaccaaaacaggaaatcaaattcattcactgcccactgaaacccggcggcgatgtcgccgcacttctctccaaccatcgactgccacaccatcgttggacaaattctctccattaaaaaaatcccacttttcactgagaacttgtactctcttaattattgctattttccttctctctcctccgccagtgccatcaaaaccagatccctctctccctttctttccccatctcattctctcatttccatctcaaggttcttcacctgttccctcacaagtcgagggttcccctcccgcgactcctcaccttgttttgaccatttctgtctccacgcagcaggcattcgagacaatacaatgtcggcttctgaagatggggatgcgagagtccaggggatatttaatgcaattcgagtagttccagattttccaaagcctggaataatgtttcaggacataacgacgttacttctggatcacaaggcatttcgggacagcatcgatatatttgttgagagatacaaggataagaatattgcagttgtagcaggaattgaggctagaggatttatttttggtcctccaattgcattggcaattggtgccaaatttgtacctattcgaaaacccaaaaagttgccaggtgaggtcatttctgaggagtatgcgttggagtatggaacagatcgtattgagatgcatgttggagcagtacaacctggtgatcgcacccttgttgttgatgatctaattgctactgggggcaccttatctgcagccatgagattattggagcgtgttggtgctgaagttgttgaatgtgcttgtgttattgaattgccagagttgaagggccgggagaagttaggtgggaagccactgttcatcctagtagagtctgcttaattgacctggagcaagtgaacgtactttttagcaacaatccttgagccttattgagaaaggattaatatgtaggaaatattctttctactgcacgagttgtggtgatctcgatcttttaggtgaggtcagcagcctgagcgaaattgatttatcttttcgtaaaggtttgttcagtagaattgctacttttatggggatctgctttgatataaagatcatattatgtatgcattatgattatttcgctttgctgcaaagatgtaattatgccagatatttttcttttcgcaatgatgtaatgagcctggaagcataggaatggtctccttgatgtttgaattactgctgaaattttatttaccgtcatttcctccagttcttacattcttaataatcaatctctgcttcaagatatagactggtgtttccaatgtaaacagcttgcatgtctaaataaacagtagaaaat

SEQ ID NO: 4715 - DNA, 1184 bp, Solanum tuberosum
gtcaatagcccacaaaattgctctcaaattcaccagggtcaatttcgtcccagaaaaagttacaaacagatattataacaggggtaatttggtccaaattaaatcacctaccaccaccctaaccaccccttccagtagaaatactcggcttttttcaccaatctctgtgtcaaaaggagctgccggagccggagcaggtgaagaacccgagctgaaaacgatcccgatcggagatccagtaagctcagtagatatggcgcctcatgatccgattcttaaagacgaacgtatcgctgggattgcttctgctattcgggtcatacccgactttcctaaaccagggatcatgtttcaggatataacgactttgctacttgatcctaaggcgtttaaggacactattgatttgtttgttgagagatataaggacaaaaacatcagtgtggttgcaggtattgaagcaagaggttttatctttggtcctcccattgcattggctattggagcgaaatttgtccccatgaggaaacccaagaagttacctggggaggttatttcagaagagtattctttggagtatggaacagacaagatggagatgcatgtaggtgctgtgcaagctggtgaatgtgccctcgtggtagatgatctaattgcgactggagggactctatctgctgcgattaggcttcttgagcgtgttggagttgaggtattcgagtgtgcatgtgtcattgagttgccagaattgaagggccgggagcgcttaggagataagccactgtttgttctagtgagctgaacctgatcttcaattaggaaaggctctggacagggagcttcattaagatggaattgtttcggtgtgacattttggagaggatatatcagatttttattaaaaccattgccaattctggcgtttttgtgtggattgaaataagcccttcttaggtgctttcagtttaattagctattctaagagatatgttctcaatgaattaagtccaatttctgtcgtcgttgttgtagttttaatctcttttgcgccattcatttgtcgtggtccatatgtgcagatcttgtattctggccggtggatcacctggtgcattgtaatgggaacaatgtatttccagataaatgatgtctggccattagcattaaaaaaaaaaaaaaaaaac

SEQ ID NO: 4716 - DNA, 1112 bp, Triphysaria pusilla
ccctagggcgtgattggaggaaacaagagaaaaaccctcactccctttttcttcacattaccattatcaactatataaattccacacatgtccagtctttctaaaccgatatctctaaaaagtctcgagggtagaattgtcacccaaaattatttctaccgtgggaaatcggtcttcattcctcactccaactccaccactgcgaacagcaagtttccactgatttacggtgggtcttgtggtggcgcatctgaagcgaaaaggcagacagtaagcgtagttcaaatggcgtcctcagatctcaacgacacagacaatcgcatctcacggatctcatcatccattcgggtcatacccgatttcccgaagcccgggatcctgtttcaggatataacgacattgttgcttgatccgaaggcttttaaggatacgatcgatttgtttgttgagagatacaaagataaacatatcaatgtcgttgcaggtgttgaggcaagaggtttcatatttggtcccccaatcgctttggctattggagcaaaatttgttcctatgaggaaacctaaaaaactccctggggaggtaatatcagaagaatactctctggagtatggaaccgacaagatagagatgcatgttggagctgttcagtctggagaacgtgcaattgtggtagatgatctcattgctacagggggcaccttaaatgctgcaatccgccttcttgagcgcgttggagttgatgtggttgagtgcgcttgtgttattgaactgccagaacttaagggtcgggacaagttaggggacaagaagctgtttgttcttgtgagctcataaacctgatcaaagagagtttatctatgccaacagtaactgcattttcttgtggctttcactggtgaggctatttgttaggttgtgcttgatccttttaactgttctgtatcagacaaatttcagatagttgttagtattgttgagcgacacagtgcttgtatcttgggaggtcatttatgttcgaacccctattatgtattaattcaacaaacctaccggaacaagccaaaacctacggtttacaacagttttttttataaatcattcacgaggcg

SEQ ID NO: 4717 - DNA, 963 bp, Tripterygium wilfordii
atataaactttgacgctattgcctattggttgaactcggtcttgttgcgcctctctcgcactctcctcactctctgcgtgactttcttagcagtgagtggcgactccgtgggagatcgaaaaatggctggaagtgccgcagatgggaaggatcctcgtgtagcaggaatcgcctctgcaattcgcgtgatcccagatttccctaaaccagggattctgtttcaagatataacgactttgctgcttgacccgaaggcattcaaggacactgttgatttgtttgtcgagaggtacaaggggaaagatatctctgtggttgcaggtattgaagcaagaggttttatatttggacctcctatcgcattggctattggggcaaaatttgtccccatgaggaaacccaaaaagttgcctggggaggttatttcggaagaatattcattggagtatggaacagacataatggagatgcatgtaggcgctgttcaagcaggagagcgtgctttgataatagatgatcttattgcaactggagggacattgtgtgctgcaatcaggctactcgagcgtgttggggttgaagttgtcgagtgtgcttgtgttattgaattaccagagctcaagggtcgtgaaaggttaggagacaaacccctgtttgttcttgtgagctagatccgcatgtttcttgcctactgtaataatagttgttcgagagttgcacacggctagagaactatcaatttggcttgattgaaggaaggaggcattgttggtaataaatggtttgttgctggtgcggaagttctgtaaatggtgaccatcaaaaacgagtgtctgtaatttggttccggttctagactagttctagtgcctgttctttcttgtgggtatgacaaaaattttaacgcctgatttgtatgatgtaaaactttacagcataaacttgtaccatgacgaacacaat

SEQ ID NO: 4718 - DNA, 4687 bp, Zea mays
cgcgatggagaaggtgtgggagtcggggcggcggatgagccggagcatcggccgcggcatgggcatggaggcgtggggcgtcgacgacgtcttcatgccgcagcacggctcccggtcccggacaagcagccgcggcggccgcgtcgacgacgacgaggaggcgctgcgatgggccgccatcgagcgcctccccacctacagccgcgtgcgcaccgccatcctgtcggaggccgccgccgtgggcggggttaacgacgacgacgacggcggcaagcagcagcggttcaaggaggtggacgtgaggaagctcggcgttggcgagcgccaggagttcatcgagcgcgtcttccgcgtcgccgaggaggacaaccagcggttcctccagaagctccgcaaccgcatcgacagggtgggcatcgagctgccgacggtggaggtgcggttcgagaggctgacggtgcaggccaagtgccacgtgggcagccgcgcgctgccgacgctgctgaacacggcgcgcaacatcgcggagggcgccctgggcctgtgcggcgtgcggctggggcggcaggccaggctcaccatcctcggggacgtgtccggcgccgtccgcccctcgcggatgacgctgctgctgggcccgccgtcgtcggggaagaccacgctgctgctcgccctcgccggcaagctggaccccgcgctcacgcgcgccggcgaggtcacctacaacggcttccgcctcgacgagttcgtgccgcagaagacggcggcgtacatcagccagacggacgtgcacgtcggcgagatgacggtcaaggagacgctcgacttctccgccaggtgccagggcgtcggcaccaaatacgatctcatgaccgagttggcgaggagggagaaggaggccggcatccgcccggagcctgaagtcgacctcttcatgaagatactggggctggacatctgcgcggacaccatcgtcggcgaccagatgcagcgggggatctccggtggccagaagaagcgtgtcaccacaggagagatgattgttggcccgaccaaggtgctattcatggacgagatatcaactgggctggacagctccacgacattccaaatcgtcaaatgtctccagcagattgtccacttgggcgaggccaccatcctcatgtccctcctccagcctgcccccgagaccttcgacctattcgatgacatcatcctactgtcagaaggccagattgtttaccagggaccccgcgaacacgtccttgagttcttcgaatcttgcggattcagctgccccgagcgcaagggtactgcagactttcttcaggaggtaacatcaaggaaggatcaggagcagtactgggctgacaagcagaggccttacagatacatttcggtgccagaatttgcacagcggtttcaacggttccatgtcgggctgcagcttgagaaccacctctcacttccgtttgacaagagccgtagccatcaggctgcccttgtattctcaaagcattctgtgtcaacaacagaactcctcaaggcatcttttgacaaggagtggctcctcatcaagcgcaattcattcgtgtacatcttcaagaccttacagcttatcattgtagccctcgttgcttcaacggtgtttctgagaactcacatgcatacgaggaatctagatgatggctttgtctacattggagcactgctctttactctgattgtgaacatgttcaatggttttgctgagctctccttggccataacaaggttgccggtgttcttcaagcaccgggacctgctcttctatcctgcttgggtcttcacactaccgaacgtcattcttaggatcccattctccattattgaatctatagtctgggttcttgtcacatattataccatagggttttctccagaggctgacaggtttttcaagcacttgctgctcgtgttcttgatccagcagatggcaggtgggcttttcagagcaatcgctggactttgcaggtccatgatcattgctcacactggtggagcactatctcttcttctcttctttgttcttggaggctttctcctgccaaaagctttcatccctaaatggtggatttggggatactggatttcacctttaatgtatggatacaatgctctagcagtcaatgaattctattctcctcggtggatgaataagtttgtactggatcaaaatggtgttccaaaaagactggggatagctatgcttgaaggtgccaacatctttgttgacaaaaattggtactggattggagcagcagggctcttgggtttcaccatctttttcaatgttcttttcacattgtcactcatgtacctgaaccctcttggcaagccacaagctattatatcagaagaaactgcaaaagaagcggaagggaatgggcatgcaaaagggacaataagaaatggaagcacgaaatcgaaggacggtagccatgataaggaaatgaaggagatgagattgaatgcgcgtttgagcagcagttcatctaatggggtttcacgagtcatgtccattggcagcaatgaagccgctctgtcaagaggcatggttcttccattcaaccctcttgccatgtcttttgataatgtgaattactatgtcgacatgcctgcggaaatgaaacagcaaggagtgcaggatgaccgactccaattgttgcgtgaggttacgggatcattcaggcctggagtgctgacagcacttatgggtgtcagtggagctggaaagactactcttatggatgttttagctggaagaaagactgggggttatattgaaggagatatcagaattgcaggctatcccaagaaccaagcaacatttgcaaggatttctggatactgcgagcaaaatgatatccattctcctcaggtcacagttcgggagtctttgatatactctgcctttttgcgccttcctgaaaagattggagataaagaaataactgatgatataaagattcaatttgtggatgaagttatggaactagtggaactcaacaatctgagcgacgctatagttgggctaccaggaatcacagggctttcaacagagcaaagaaaaaggttgacaatagccgtggagcttgttgccaatccatcaatcatatttatggatgaaccaacatcaggacttgatgcaagagctgcggcaattgtcatgagaaccgtgcgaaacacagttgacaccggacggacagttgtttgcacaatccatcagccaagcattgacatctttgaggcttttgatgagttgctattgttaaaaagaggaggccaggtgatctactctgggaaattgggtcgcaactcccagaaaatggttgagtattttgaggcaattcctggagtgcctaaaattaaagataagtacaatcctgcaacgtggatgctggaggtcagttcagttgcagctgaagtgcgactaaagatggattttgctgagtactataaaacatcagatctcaacatgcaaaacaaggtactggtgaaccagctgagtcaaccagaaccaggaacatcagatctttatttccctacagagtactcacaatccacagtaggacagttcaaagcctgcctctggaagcaatggctgacctattggcgcagcccggattacaaccttgttagattttccttcactttgttagttgccttgctgctcggctccattttctggaggataggcaccaacatgggagattcaaccactctcaggatggttattggatcaatgtacactgctgtgatgtttgtcggcatcaacaattgttcaactgtgcagccaattgtttcaattgagaggacggtcttctacagagagagggctgctgggatgtactctgcaatgccatatgccattgctcaggttgtcatagagataccatatgtgtttgtccaaacaacgtattacaccctcatcgtatacgccatgatgagtttccaatggacagctgccaagttcttctggttcttcttcatttcctacttctccttcctctacttcacctactatggcatgatgactgtctcaatctccccaaaccatgaggttgcatccatcttcgccgcagctttctattctctgttcaacctcttctcaggctttttcattccaagaccgagaattcctagatggtggatctggtactactggatttgcccattggcatggacagtgtatgggctcatcgtgacacaatacggagacctgcaagaccccatcacagtccctggcgaaagcaaccagacgattagctactatataacacatcattttggataccatagggattttatgccagtcgttgcgccagttctcgtgctctttgcagtattcttcgctttcatgtacgcagtctgcatcaagaagttgaactttcagcaacgataggaacaagatatggcagaaaagctcttgagagtattttttctttttttggaaaatacttccttttctcctttcatttttgagtccctttaatatattgcaatgtatatagggtgtagcttcggtattccacacatcgtcaaatgtggcgaggtcttatacagatttctagccgtttaactgtggaacattgtaatttgtaagagcacatctatgagaaagttttgttcatgcccaattcatttc

SEQ ID NO: 4719 - DNA, 5306 bp, Sorghum bicolor
tcacgcccccatgccgtctttcttttctagtattttttaataacacaaaaaagctcctacacacggcgactcagccagacctggcaagtaataacaatgaagaaaatttcagttgcctcgccggctaaccccacccatttgcccgcgcggcagacccagaccagcgcatataaacggcgcgctgctcctccacctcctcccgctcactcctcttcctcctctcaccccctcctctctccctctccccttccagaaacactactcatgcagcccgtacggcaccaccaccaccaactgccgcactgacgtgcatgcgcacaagcacaagtatctctagctagggacggagctccatatcctttcgttcgaccaagcaaaagcacgcgcgagcggcgtgcaccaccaccaccaccaccacctgccgggggtgccgggtgccggccggcagacaggccgacagacgtcctcctctcctagctcgtcctatttggagagagcgcgacgatggagaaggtgtgggagtccgggcggcggatgagcaggagcatcagccgtgggatgggcatggagaactggggcgtggacgacgtcttcctgccgcagcacgggggctcccggtcccgggccggaagccgcagcggccgcggcggcgtcgacgacgacgaggaggcgctgcggtgggccgccatcgagcgcctcccgacctacaaccgcgtgcgcaccgccatcctctcctcctccaccgaggccgccgacgccgacgacaacagcagcgagcccctccgcgggtcgcaccaccagcagcagcagcagttcaaggcggtggacgtgcggaagctcggcgtcggcgagcgccaggagttcatcgagcgcgtcttccgtgtcgccgaggaggataaccagcggttcctccagaagctccgcaaccgcctcgacagggtgggcatcgagctgccgacggtggaggtccggttcgagcagctgaacgtgcaggccaagtgccacgtgggcagccgggcgctgccgacgctgctcaacacggcgcgcaacgtcgcggaatcggcgctgggcctctgcggcgtccgtctggggcggcaggcgacgctgaccatcctaaaagacgtctccggcgtggtccgcccgtcgcggatgacgctgctgctgggcccgccgtcgtcggggaagacgacgctgctgctggcgctggcggggaagctggacacggcgctccggcgggccggcgaggtcacctacaacgggttccgcctcgacgagttcgtgccgcagaagacggcggcgtacatcagccagacggacgtgcacgtcggcgagatgacggtgaaggagacgctcgacttctccgcccggtgccagggcgtcggcaccaagtacgacctcatgaccgagctcgccaggagggagaaggaggccggcatccgcccggagcctgaagtcgacctcttcatgaagatactggggctggacatctgcgccgacaccatcgtcggcgaccagatgcagcgggggatctccggcggccagaagaagcgcgtcaccacaggagagatgattgttggcccgaccaaggtgctattcatggatgagatatcaactggattggacagttccacaacattccaaatcgtcaaatgtctccagcagattgtccacttgggcgaggccaccatcctcatgtccctccttcagcctgcccctgagaccttcgacctattcgatgacatcatcctactgtcagaaggccagattgtttaccagggaccccgcgaatacgtccttgagttctttgaatcctgcggattctgctgccctgagcgcaagggcactgcagactttcttcaggaggtaacatcaaggaaggatcaggagcagtactgggctgacaagcggaggccttacagatacatttcggtgccagaatttgcgcaacgatttaaacggttccatgtcgggcttcaggttgagaaccacctctcacttccgtttgacaagagccgtagccatcaggctgcccttgtattctcgaagcattcggtgtcaacaacagaactcctcaaggcatcctttgacaaggagtggctcctcatcaagcgcaattcattcgtgtacatcttcaagaccatacagcttatcattatagccctcgttgcatcaacggtgtttctgagaactcacatgcatacaaggaatcaagatgatggtgttctctacattggagcactgctctttactctgattgtgaatatgttcaatggttttgctgagctctccttggccataacaaggttgccggtgttctacaagcaccgggaccttctcttctatcctgcttgggtcttcacactaccgaatgtcattctcagaatcccattctccattattgaatgtgtagcctgggttcttgtcacatattacaccatagggcttgctccagaggccgagaggtttttcaagcacttgctgctcgtgttcttgatccagcagatggcaggtgggcttttcagagcaatcgctggactttgcaggtccatgatcattgctcacactggtggagctctatctcttcttctgttttttgttcttggaggttttctcctgccaaaagctttcattcctaaatggtggatctggggctactggatttcacctttaatgtacggatacaatgctctagcagtcaatgaattctatgctcctcggtggatgaataagtttgtaccggacgaaaatggtgttccgaaaagactgggggtagctatgcttgaaggttccagcatctttgttgacaaaaactggtactggattggagcagcagggctcttgggtttcaccatcttcttcaatgtccttttcacactgtcacttatgtacctgaaccccctcggcaagccacaagctgttatatcagaagaaactgcaaaggaagcggaaggcaatgggcatgcaaaagagacaataagaaatggaagcacaaaatcaaaggatggtagtcataacaaggaaatgaaggagatgagactgagtgcacgtttgagcagctcttcatcaaatggggtttcacgagtcatgtccattggcagcaatggagctgctccagcaagaggaatggttcttccattcaaccctcttgccatgtcttttgataatatgaactactatgtcgacatgcctgcggaaatgaaacagcaaggagtgcaggatgacaaactccaattgttgcgtgaggttacaggatcattcaggcctggagtgctgacagcacttatgggtgtcagtggagctgggaagactactcttatggatgttttggctggaagaaagactggggggtatattgaaggagatatcagaattgcaggctatccaaagaaccaagcaacatttgcaaggatttctggatactgcgagcaaaatgatatacattctcctcaggtcacagttagggagtctttgatatactctgcctttttgcgtcttcctggacagattggagatcaagaaataactgatgatataaagattcaatttgtggatgaagttatggaactagtggagcttgacaatttgagggatgctttagttgggttaccaggaatcacagggctttcaacagagcaaagaaaaaggttgacaatagctgtggagctcgttgccaatccatccatcatattcatggatgaaccaacatcagggcttgatgcaagagctgcagcaattgtcatgagaacagtgcggaacacagttgacactggacggacagttgtttgcacaatccatcagccaagcattgacatctttgaggcttttgatgagctgctattgttgaaaagaggaggccaggtgatctactctgggaaattgggtcgcaactcccagaaaatggttgagtattttgaggcaattcctggagtgcctaaaattaaagataagtacaatcctgcaacgtggatgctcgaggtcagttcagttgcagctgaagtgcgactaaagatggattttgctgagtactataaaacatcagatctgtacaagcaaaacaaggtagtggtgaaccagttgagtcaaccagagccaggaacatcagatctttatttccctacagagtactcgcaatccacaataggacagttcaaagcctgcctctggaagcaatggctgacctattggcgcagcccggattacaaccttgttagatttaccttcactttgtttgttgccttgctgctcggctccattttctggaggataggcaccaacatgggagatgcaaacagtctcaggatggttattggagcaatgtacaccgctgtcatgtttgttggcatcaacaattgttcaactgtgcagccaattgtttcaattgagaggacggtcttctacagagagagggctgctgggatgtactctgcaataccatatgccttgtctcaggttgtcatagaggtaccatatgtgtttgtgcaaacaacgtattacaccgtcatcgtatacgccatgatgagcttccaatggacagctgccaagttcttctggttcttcttcgtttcctacttctccttcctctacttcacctactatggcatgatgactgtctcaatctccccaaaccatgaggttgcagccatcttcgctgcagctttctattctctcttcaatctcttctcaggcttcttcattccgagaccgaaaattcccagatggtggatatggtactactggatttgcccattggcatggacagtgtatgggctcatcgtgacacaatacggagacctgcaaaagctcatcacagttcctggcgaaactgacaagcagacgattagctactacgtaacacatcattttggataccacagggattttatgccagttgttgcgccggttctcgtgctctttgcagtattcttcgctttcatgtacgcagtctgcatcaagaagttgaacttccagcaacgataggaacagattatggcagcaaaaggtcttgagatatatttttttttggggggggggggggggtacacttctttttctctttcattttttgaatccctttaatatattgcagtgtatataaggtgtaccttgggtattccacacatcgccaaatgttgcgaggtcttatacagatttcttgtacccatttaactgtggaccattgcaagagcataactatgagaaaattttgttcatgcccaattcatttcacagggaatgtttcgtgaaaccaactattttaatggaaatgagtataggctcaggctctgtgaaaagcagaagttgttttt

SEQ ID NO: 4720 - DNA, 2286 bp, Zea mays
gcggattctaaagattcgtcgttatttgagtataatgtctctgcaggtagcaaatattaatgccaaagaagagacaccagttggtcatggagaagtaatatgctttagcatctattcagcaaattctgatgtacaggcagctgattttggaaatggcaaaacttgcatttgggttgatgttctagatggtggaaggggtgtcctgatggagtttgctcctttctttgaagattcatcgatcaagaaggtttggcataactatagttttgatagccatgtcattgagaattatggaatcaaaattgctgggtttcatgctgatacaatgcatcttgcacgcctttgggattcatcaaggaaaattgatggtggatattcacttgaaggacttacaaatgaccgtagagtcatggatactgttccagaggatttacctaagcctggaaagacatcaatgaaaaccatctttggcaggaaaaatattagaaaagatggatctgaagggaaagttgtatctgttgagccagtcaagaagttacaaagggaagacagagagttatggatttgttattcttctctagattccatgagcacattgagactttatgacagcttaaaaagcaagcttacaacaaggagatggatcttggatggttgtcctaggggcaccatgtatgatttctatgaacagtactggcgtccttttggtgccctacttgtgaaaatggagacagagggaatgcttgttgaccgtggttacctttcagagatagaaaaggctgctattgctgaacggaaacttgctgcagataagtttcggaaatgggcatctaaatattgtcctgatgccaagtacatgaatgtgaatagcgatattcaaattcgccaacttctctttggtggcattgaaaatagacacaaatctggtgaaacttggccacatagtaaaacttttaaagtgctaaatgaagaaagtgttgctacagagggtaagaagacgtcaaagtatcgtacaatcaaactttgcagtattgttgaagatctgaaaatcgatatgttcaccccgagtggctggccaacagtcagcggggatgcattgagaagtttggctggtaaaatacctacagaatatatttacacaatagatgatattcaagatgatgatgaatataccagtggttcagaaaacccagatgggaattcctcttatggaacagcatatgaagcatttggtggaggaaagaatggaaaagaagcatgccatgcaattgcagctttatgtgaaatatgttctattgattctttgatatccaatttcattcttccgttgcagggagatcacatatcatgtgcagaggggcgcattcactgttcattgaatatcaatactgagacagggcgcttgtcagcaagaacaccaaatctacagaaccaacctgcccttgagaaggataggtataggattcgccaagcttttgttgcagccccgggaaattctcttatcgttgcagattatggtcagctggagcttaggattttagctcaccttactaattgtaaaagcatgctgcatgctttcaaggcgggtggtgatttccattctaggacagccatgaatatgtatcagcatatccgtgatgctgtccaagaaaagaaagttcttcttgagtggcaccctcaacctggtcaagagaaacctccagtgccgctattgaaggatgcttttggcgctgagaggaggaaagctaaaatgcttaatttttccattgcttatggaaagacagctgttgggctatcccgggactggaaggtttctgttaaagaggcaagagatacactgaagctctggtacagggatagaaaagaagtgttagcttggcaaaaaagtcagaagaagcttgcaagcgagaagggtgaagtctacactttgcttgggcggtcgcgccattttccttacctgactcagtatggtcctggccaacgaggtcatattgagcgtgctgctataaatgcaccagtgcagggaagtgcagcagatgttgctatgtgtgccatgcttgagatcgaaaggaatgtccgccttaaggagcttggttggaggctcttattgcaggtgcatgatgaagtgatactggaagggccttcagagtctgctgaggtggccaaggctatagtggtggagtgtatgtccaaacctttctacggaaccaacatcttgaacgtcgacctggctgtcgacgccaagtgtgcaaagagctggtatgctgccaaatagactgaggagac

SEQ ID NO: 4721 - DNA, 4435 bp, Sorghum bicolor
cctccgcaccggacgatgcggatttcgttttccaaccacggagacggatttcgccggttcgccggttcgctgtcgctggtcagcagggcgcatagacagcagccgcttaaaccctggttcccctttcctcgtctcccccaaggcccaaaccccgctggcctcccctcctccgcccccgcccccgccaccgccaccgcctgcactccccagccccaggtctccagtctccacaatcggcggctccccgcatcacgccgacgccctaatgctctcgccggcatcctcccgctaggccgcgccgcggacgagcgttccccaccacctgctcgctctcccgcccgcgccctcgccccgcgccgccagaagacggcggcgccccgctgcggcctcggtttctgcttgaccggcgccggcggcgctgcgcggaggaccaacctgaggcggtccgtttttgcgtcgatggtggtggcgcaggtgacgccggggccactgctgcggcgccacggctcggcgcccccgtggctgtcgtcgtcgtcgcccttcttcctgcgccgccgcgcctcgccgccaccggcgatttccggatgcaggaggcaggactattctcatagttcagatatggcagttcgaggaagcagtggttccaagcttgggttctatcccaacttaaacgtgcgaaatattgcacaagaatgggttcaagagagccggaggctgttctatctcagaactgccaacaatgtcacaaataatatctacaagggaagcaccactctatgggctggaaatgtacaaaatgaactctctgaagatcgcaggggtttgaactacccttacttgcagaatctgagagaacgtgtatcatccaattcaattgtaaatagacatggtaatagtcaagaactggtcaggcataggatggtaaatcagcctgtgcaatcagtgccagctccgataagtgttgttaataatagcgccaagtgtttgagcatgcctagagcctctaaggtggagattccttggcgtgactattcaccagcggaggatcctttgcttgataaagctaatacagaggtaattttggagctagatgataaagttcatgatggtgatgacaaaaaggagaagaaacttgtagtaaaaaaagtggtttcacctttgccaactaaagcagtcttctctgaggaatctttgaaagcacggaaggcacttgctagcatctacgacaaagttttggtagttgacaatattgagtcagctaggagcattgttaaactgctcactacaaagtacaagagttttattcatgcatgtgacacagaggtagcaaatattgaagccaaagaagagacaccagttggtcatggagaagtaatatgctttagcatctattcagcaaattctgatgtacaggcagctgactttggaaatggcaaaacttgcatttgggttgatgttctagatggtggaaggggtgtcctgatggagtttgctcctttctttgaagatccatccatcaagaaggtttggcataactatagttttgataaccatgtcattgagaattatggaatcaaagttgctgggtttcgtgctgatacaatgcatcttgcacgcctttgggattcatcaagaaaaattgatggtgggtattcacttgaaggacttacaaatgaccgtagagtcatggatactgttccagaggatttacctaaacctggaaagatatcaatgaaaaccatcttcggcaggaaaaaagttagaaaagatggatctgaagggaaagttgtatctattgatccagtcaaagagttacaaagggaagacagagagttatggatttgttattcttctctggattcaatgagcacactgagactttatgagagcttaaaaagaaaacttgaaacaaggagatgggtcttggatggttgtcctaggggcactatgtacgatttctatgaacagtattggtgtcccttcggtgccctacttgtgaagatggaaacagagggcatgcttgttgaccgtggttatctttcagagatagaaaaggctgctattgctgaacgggaactagctgcagataagtttcggaaatgggcatctaaatattgtcctgatgccaagtacatgaatgtgaatagcgatactcaaattcgccaacttctctttggtggcattgaaaatagacacaaatctggtgaaacttggccacagagtaaaacttttaaagtgctaaatgaagaaaatgttgctacagagggcaagaagacgtcaaagtatcgtactatcaaactttgcagtattgttgaagatctgaaaactgatatgttcaccccgagtggctggccatcagccagtggagatgcattgagaagtttggctggtaaaatacctacagaatatatttacacaatgggtgatatccaagaggatgatgaagattcaagcggttcagaaaacccagatggagattcctcttatggaacagcatatgaagcgttcggtggaggaaagaatggaaaagaagcatgccatgcaattgcagctttatgtgaaatatgttctattgattcattgatatccaatttcattcttcctttgcagggagatcgtatatcatgtgcggaggggcgcattcactgttcattaaatatcaatactgagacagggcgcttgtcagcgagaacaccaaatctacagaaccaacctgcccttgagaaggataggtataagattcgtcaagcttttgttgcagctccggggaattctcttattgttgcagattatggtcagctggagcttaggatcttagcccaccttactaattgtaaaagcatgctggatgctttcaaggccggtggtgatttccattctaggacagccatgaatatgtaccagcatatccgtgatgctgtccatgagaagaaagttcttcttgagtggcaccctcaacctggtcaagagaaacctccagtgccgctattgaaggatgcttttggcgctgagaggaggaaagctaaaatgcttaatttttccattgcttatggaaagacagctcttgggctatcccgggattggaaggtttctgttaaggaggcaagggatacattgaagctctggtatggagatagaaaagaagtgttagcttggcaaaaaagtcagaagaagcttgcacgcgagaaatgcgaagtctacactttgcttgggcggtcacgccattttcctaacttgactcagtttggtcctggtcaacgaggtcatattgagcgtgctgctataaatgcaccggtgcagggaagtgcagcagatgttgctatgtgtgccatgcttgagatcgaaaggaatgcccgccttaaggaacttggttggaggctcttgttgcaggtgcatgatgaagtgatactggaagggccttcagaatctgctgaggtggccaaggctatagtggtggaatgtatgtccaaacctttccacggaaccaacattttgaaagtcgacctggctgttgacgccaagtgtgcaaagagctggtatgctgccaaatagtctgaagcagatgctgtcatccgaggaatgtctatatatatatgcacatgtttgcctgccacaaggctgatgacgctgcagataaaaaatggtggacttggtcgtcatgcagactgcaggttcaggatcatgagtttgaagtggtaaccccagtcctggcaggatcacacgcccatttcttggctgcagcagaacagcgaaagacacggaagactgctgccagcacctggagttgtggatgtacaccagtagtgtagtagcgcccagacttcttggaggataggtttctcagtagaccatatcagaattcgaggtggcttgatctctgagtgaagtagcagtgccaaagcatgctgttttgttcataatataacttgttcagcgtgctggtgcgctaggttagtttactgatttgttctgttccagtgaggccaattatcatcactgtggtggtgatgctgtgtttatgttggtcgagggttaacacagtttagctttttagcatcagctattcattgtccttttctagagacaagttcttcaacatcgctctgcattattgggggataactagtcattcttatcagctatggctaggtgttagccacctaatagctagagctgactgttagttggctaatagttagctggcttaaattattcatatcctgtttggatacaagagctgctattttggtatgtgctgctgctgctgtaatgttgcctctactgtgctatactgatattcgtcctgtgctgtgatgttgacttgtgcatgctctcctattgccgctatgtgctactggtacaataataaaaataaaactctcctattgccgttactgtgtcattggttgaataaaaataaaaatgcttgtccgca

SEQ ID NO: 4722 - DNA, 4098 bp, Oryza sativa
cgccgcttaaaccctggtcccccttgtctcccaaaccctctctccttcccctcgcttccgcctccggccgccgccgccgccgccgcgaggccaccgcctgctgctgcagcggcctacccttgcgtcggtgcaagacggcgccctgcggcttcggttgcggggtgggtggtggcgttgcgggaggaggaggagggaggcgggcggggtccaagctgaggcggctcgtgaggtccatggcggtggcgccgccgctgccgccggcaccggcgcggcagctacggcggtggaaggggtcttcgccgcggccgccgccgtggctgtcctctcccttccgccgcacccgctacttgtcgcgcccggccttcgccgcgggaggaaggcaagattattctcctagttcaggcatgggggttagcaaaaccggtgctttcaggcttggattgtatggcaacttaaatgtacaaagtagtgtgcaagaatgggttgatgaaaccaagaggttatttttcctcaggaccacaaacagtgtcagaaacaacatcactaatggcactactcctctgcgggttggaaatctgcgtcatgatccctcagaagatatcaggagttcaaactatccttccttgtataatcaaagagaaagaggaccatctaattcaattgtaaatagacatgtcgatacagatttggctaagcatcgtgtgatgtatcagtcagcacatgctgtgcctgccccattcagtgttgttaataatgatatcaaaccactgaacatgcttgatggctccaaggaggaaattccttggcacgattccgttacgatggaatcttctctgcctaaagtttccaagtcagagaaaactttggtggttgataaagctatcccagacaaaaaggagcacaaacgcattacaaggaaggtgacgccaaatttcccggacaaagcttccttgtccactgagtcaaaaaatgcacggaagttgcttgctaccatctatgacaaagttttggttgtcgacaatgttgagtcagctaggagtgttgttaaattgcttactacaaagtacaaaggctttattcatgcatgtgacacggaggtggcaaatattgatgtcaaagaagagacaccagttggtcacggagaagtaatatgctttagcatctgttcaggaaattctgatggggaggctgattttggaaatggtaaaacatgcatatgggtggatgtgctagatggtggaagggatgttctaatggagtttgctcctttctttgaggacccatttatcaaaaaggtttggcataactatagttttgatatccatgtcattgagaactgtggaatcaaggttgctggatttcatgctgatacgatgcatcttgcacgcctgtgggattcttccaggagaactgatggtggatattcacttgaaggactaacaaatgattacagagtcatggatgctgttctaaaggacatacctaaaactgggaaggtgtcaatgaaaactatctttggccggaaaaaggttagaaaagatggatctgaagggaaaaccatatctatcgagccagtcgaaaagttacaaagggaggatagagagttgtggatttgctattcctcactagattcaatgagtacattgaagctttatgaaagcttgaaaaacaagcttgaagcaaaggaatggattttcgatgattgtcctagaggaacaatgtatgatttctacgaagagtattggcgtccctttggtgctcttcttgtaaagatggaaacagagggagtgcttgttgaccgtgcatacctttcggagattgagaaagctgctgttactgaacgagaattagcagcggataagtttcggaaatgggcatctaagcattgtcctgatgccaagtacatgaatgtgaatagtgataatcaaattcgccaacttttctttggtggcatcgaaaatagaaataagcgtggtgaaacttggccacaaagtaaaacttttaaagtgccaaatgatgaaggcatagctacagagggcaagaagactccaaagtctcgcacaatcaaacttttcactattgtggaagatcttaaaattgatatgttcaccccgactggttggccttcagtcagtggggacgttttaaggagtttggctggtaaaatacccacagatcatatatataaaattgatgatggccaagagtttgatgaagatgggagcagtttggaacttcctgagcaggatatagaagacacttccccatatggaactgcatatgaagcgtttggtggaggaaagaagggaagggaagcatgtcatgccattgctgctctatgtgaagtcttttctattgacaaattgatatccggcttcattgttccattgcagggagatcgtatatcatgcaaggaagggcgcattcactgttcattaaatatcaatactgaaacaggacgcttgtcagcaagaacaccaaacttacagaatcaacctgctcttgaaaaggataggtacaagattcgccatgcttttgtcgcagctccagggaacactcttattgttgctgattatggccaactggaactgaggatcttggcgcatcttactaattgtaaaagcatgctggaagctttcaaggctggtggtgacttccattctaggacagccatgaatatgtaccagcatgttcgtgatgctgttgaagaaaagaaagttctgcttgaatggcatcctcaaccaggtcaagacaaacccccagtgccattattgaaggatgcttttggcgctgagaggaggaaggccaaaatgcttaatttctccattgcatatgggaagactgctgttggtctatcttgggattggaaggtttctgttagggaagcaagggatacactcaaactttggtatagggatagaaaggaagtttcagcttggcaaaagaagcagaaagcctttgcgcttgaaaagtgcgaagtctacactttgctcgggcgatcacgccaatttcctaatatgactcatgcgggtcctggtcaaaagggtcacgtcgagcgtgctgctataaatgcaccagtgcagggcagtgcagcagatgttgctatgtgtgcaatgcttgagatagaaagaaacgctcgccttaaggagcttggttggagactcctattgcaggtgcatgatgaagtaatcttggaggggcctacagaatctgccgaggaagccaagaccatcgttgtggagtgcatgtccaagcctttctatggaaccaacatcctcaaggtcgacctagctgtcgacgccaagtacgcgaagagctggtatgctgccaagtagtagaatccgcactcggttcttctgccctatacatagccagatgagcacatttgtctgccccaaagttaggcgacaccaaagttatgtgtcgccgatgcgatgaagactctgcccatccgtcctgacgaaatacagcggactgaaccagcacagatagagatgcaagccgctcaagaagttgaagtgccacccccatcacccacaggaacacaagaccacacgtccatttttcggtggcagaggcagagcatccaagaaccgaataggctgaagactctttcactggcagtagctgaatgtacactagtagcctgtccgatagttactccattagatttggatttgactgtagagaccacagtagatactgacctgtatgagactttcagatacttgatcatgaaggaagtgcagaagcatgctgtcttcatatgacctgttcagcatgttgtggcattcgtaagactgttactggaatgtcctgttcctgtcaggcctagcattgcagttggtagaactgcttgccgaggtgtcactgtgcctgtgtcacatatatactcccgtaaccatttcttttttgtatttttgtccatactttttgtcacaatggacaaagcagggcacaccagggtttcccaaaccgccggggccgaggttaccgcgccccagcggtaagcacggttaccgcggtaaccgtgaaaaaccgtgtaaaatccatcaaaaattcaaattattttttaaatttatttgaatttaaggaggt

SEQ ID NO: 4723 - DNA, 3987 bp, Oryza sativa
cgcgccgttgctgccgtaaacccttcctctatccccctcccactcctctccaaactctgcgaacccgagctctcctcgcttcgtctccctcctctcgccgcgccgcgccgcccgcctcctcctcgtcgagtcgagtggccctgatgcccgcgtgcgccgccgccgccgcctgctgctgctccgagcggtagccgcgtcggagtcgcccaagacggcgcccggtggcttcgggtgtgggtgcggtgggctagcgggagggggagggggaggagggaggggaggggggaggctgagcgcctggtgagctccatagcgatggccgctccggccccggcgccggcgcccgcgcagctgcggcggtgcccgtgctccgcgcctctctgggccgcgccgtcgcccttccgctgctgcggcggccgccgcggccgctcgccgttcatcggaggcggaaggcaggactactcgcatagtagctcgggccttggagttacagacaacagtgctttcaaaattggagtgtataccaacttcaatgtgcaaagtaatgcacaagaatggcttgaggagagcaagaggatatcctcgatcaaaaccaggaataacgtgggaaacactatttataaaggttctactcatctacgaacaggaattcttcatcacgaacctttggaagatcacaaaagttccaactattcttcattgtacaatgtaagagaaagaatgactcctaattctcttgcaaataggcatgctaacatggagttggcaaagcataacacgaggaatcaagctgcaagtgctgtgtcagcactgaccagtgttgttaacgatgacattaaaccactcaacaggtctagtggctctgaactgaagactcaatggcaaccagattctaagactgatgcttccgttctgaagatctctaaagtcgagacaagcctgcagtttgatgacaaagctagggatggttatgatggagatgaacatgaatgcacagccaagaatacagtacaagattctccagctaaggcacccatgtccaaggagtctaaagatgcgaggaaggcacttgctactgtgtacgacaaagttctggtggttgacaatgtgaagtcagctaggagtgttgttcaattgcttacttcaaagtacaaaaactttattcatgcatgtgacacagaggtagctaatattgatgttaaacaagagacaccagttagccatggagaggtcatttgctttagcatctactctggcaactctgatgcagaagctgattttggaaatggaaaaacatgcatttgggtggacgtgctggatggtgggcgagatgtcctcatggagtttgctccattttttgaggacccctcaatcaggaaggtttggcacaactatagttttgatagccatgtcatagagaactatggaatcaaagttgctgggtttcatgctgatacgatgcatcttgcacgactttgggactcttcaagaagaattgatggaggatattcacttgaaggacttacaaatgatcacagggtcatgggtgttgtaccaaaggaattacaaaagattggaaagagatcaatgaaaaccatctttggttggaaaaagattaaaaaggatggatctgcagggaaaattatctctatggagcctgtcgaagtattacaaagggatgacagagaaatgtggatctgttattcttcattagattcaatgagtaccttacgactttatgaaagtttgaaaagcaagctggaaaaaaagcactggacttttgatggttgccctagaggttcaatgtatgatttctacgaggagtattggcgtccttttggtgcccttcttgtcaagatggaaacagctggaatgctagtcgaccgtggttacctttcagaaattgaaaaggttgctgttgcacagcgaaaactagctgcggataaatttcggaaatgggcatctaaatattgtcctgatgcaaaatacatgaacgtgaacagtgatactcagattcgccaactgttctttggtggtatagagaatagatgcaaacctggtgaaactttgccaaagagtagaactattaaagtaccaaatgatggaagccttattgcagagggcaagaaaactccaaagtattgtactattgaacttttcagcattgtggaagatctgaaaactgatctatttactgcaagtggctggccttcagtaagtggagatgcattgagaagtttggctggtaaactgccaactgatcttgtttacacaacagatgatgtagaggatgatgacagtggtgattcagaaatttctgagcatgatctaaacgacactgcctcttatggaactgcatatgaagcatttggaggaggaaagaaaggaaaggaagcatgccatgccattgcggctctctgtgagatttgttctattgactcgttgatatccaactttattcttcccttacaggggaatcatatatcatgtgacgaggggcggatccactgttcattaaatataaatacagaaacagggcgtctgtcagcaagaacaccaaatttacagaatcaacctgcactggaaaaggatcggtataaaatccgtcaagcctttgttgcagctccagggaactctctcatcgttgctgattatggtcagctggagctcaggatcttggcacatcttgctagttgtaaaagcatgttagatgctttcaaagctggtggtgacttccattccaggacagctatgaacatgtaccagcatatccgtgatgctgttgaagaaaagaaagtacttcttgaatggcatcctcaacctggccaagagaaacctcctgtgcccttgttgaaggatgcctttggtgctgagaggcggaaagctaaaatgcttaatttctccattgcatatggaaaaacacctgttgggcttgctcgagattggaaggtctctgtcaaggaagcaaaggataccctgaaactctggtacagggatagaaaagaggttttagcttggcaaatgaaacaaaaagaattagcgcaggagaagtgtgaagtttacactttgctcgggcggtcgcgccgctttcctaacatggctcatgcaacttctggtcaaaggggtcacattgagcgagctgctatcaatgcaccagtacagggcagcgcagcagatgttgctatgtgtgctatgctcgagatagatcggaatgctcgtcttaaggaactcggttggaggcttctcttgcaggtgcacgatgaagtgatactggaagggcctacggaatctgccgatctggccaagtcgattgtggttgaatgcatgtccaagcccttctacggcaccaacatcttgaatgttgaactggctgttgatgccaagtgtgcgcagaattggtatgcagccaagtaggttgccatactcttccccaattaactcctaaggctgcatagttgcatctcgggagtgcttcaaactcaacgatgaaatatgttctcagctggtatgagctgccagaacagaggtttgccctggtgtccgggaggcatgcataaccattcggctaaccagggcaatgagcagtctgcagcgaaggcactgtacaatgtaggctgaatagcttgacttccacattcttccaagtaggaatgtcatttttgtgtcacgtgtagtaatctggagactggactcttggagggaagtaggaaaaactaggcatgcgttgtttataagatttgtttagcatgctgatgtagtattaggttagctgaccaattctgcttatgtctgactctgctactacacaccgcagcttgtttgatgaacgttcctcaacctgttactctacattatttggacatattgtggttagctgaatgaatacctgaatatagccagggggaactccatccttaaaatggccggatgccacatggcccacaaagtccgaagagcaacctcaaatcgaaaagtgtaaaagcgacg

SEQ ID NO: 4724 - DNA, 4374 bp, Oryza sativa
ggggagcggatgggcggggaggaggcaggctgcggcgggcggacgggcgaggcgcgggcgggctgggaagcggcggcggtggccggcgggcgcggagccgcgcaggcgaggcggcggatgccgacgcgggcggggaagcggcggcggtggtcggtgggagcggagccgcgcaggcgagtggcgcaggcgacggcggcggttgctgaggtgggcaggcggcgcaggcggggtgcgggatcgggagcggcggctgcagccggcggcgggcgagcgacgacgacgacgacgacgacgacggagggtacgttgatccggaaatcccgatgggggcgggagcgcggacgtcgaggcatggcgtgaggagagagagagagagagagagagaatcgctatatttggccgaactctctccgatttggcggatcttctatttttggaagcctcgatgcccgtatctgctggagcgacgatttctcctcccatatgcgctatatttcggatggagtaccaaatagaggatctgctgggatgctcttaaaccctcgttccccttgtctcccaaaccctctctctccttcccctcgcttccgcctccggccgccgccgcgaggccatcgcctgctgctgcagcggcctaccctagcgtcggtgcaagacggcgccctgcggcttcggttgcggggtgggtggtggcgttgcgggaggaggagggaggcgggccgggtccaagctgaggcggctcgtgaggtccatggcggtggcgccgccgctgccgccggcaccggcgcggctgctccggcggtggcaggggtcgtcgccgtggctgtcctcttccttcggccgcacccgctacttttcgcgcccggccttcgccgcgggaggaaggcaagattattctcctagttctggcatgggggttagcaaaactggtgctttcaggctgggattgcatggcaacttaaatgtacaaagtagcgtgcaagaatgggttgatgaaaccaagaggttatttttcctcaggaccaccaacaatgtcaggaacaacatcactaatggcactactcctctgcgggttggaaatctgcgtcatgatccctcagaagatatcaggagttcaaactatccttccttgtataatcaaagagaaagagggccatctaattcaattgtaaatagacatgtcgatacagatttggctaagcatcgtgtgatgtatcagtcagcacatgctgtgcctgccccattcagtgttgctaataatgatatcaaaccactgaacctgcttgatggctccaaggaggaaattccttggcacgattccgttacggtggaatcttctctgcctaaagtttccaagtcagagacaactttggtggttgataaagctatcccaaacaaaaaggagcacaaacgcattacaaggaaagtgacgctaaatatcccggacaaagcttccttgtccactgagtcaaaaaatgcacggaagttgcttgctaccatctatgacaaagttttggttgtcgacaatgttgagtcagctaggagtgttgttaaattgcttactacaaagtacaaaggctttattcatgcatgtgacacggaggtggcaaatattgatgtcaaagaagagacgccagttggtcatggagaagtaatatgctttagcatctattcaggaaattctgatggggaggctgattttggaaatggcaaaacatgcatatgggtggatgtgctagatggtggaagggatgttctaatggagtttgctcctttctttgaggacccatctatcaaaaaggtttggcataactatagttttgatagccatgtcattgagaactgtggaatcaaggttgctggatttcatgctgatacaatgcatcttgcacgcctgtgggattcttccaggagagctgatggtggatattcacttgaaggactaacaaatgatcacagaatcatgaatgctgttctaaaggacatacataaaactgggaaggtgtcaatgaaaactatttttggtcggaaaaatgttagaaaaaatggatctgaagggaaaaccatatctatcgagccagtcaaaaagttacaaagggaggatagagagttgtggatttgctattcctcactagattcaatgagtacattgaagctttatgaaagcttgaaaaacaagcttgaagcaaaggaatggattttcgatggttgtcctagaggaacaatgtatgatttctacgaagagtattggcgtccctttggtgctcttcttgtaaagatggaaacagagggaatgtttgttgaccgtgcatacctttcggagattgagaaaactgctgttgttgaacgaaaattagcagcggataagtttcggaaatgggcatctaagcattgtcctgatgccaagtacatgaatgtgaatagtgataatcaaattcgccaacttttctttggtggcatcaaaaatagaaataagcctggtgaaacttggccacaaagtaaagcttttaaagtgccaaatgatgaaagcatagctacagagggcaagaagattccaaagtctcgcacaatcaaacttttcactattgtggaagatcttaaacttttcactacagagggcaagaagactacaaagactggctggcttaaagtccgtggggacgttttatggagtttggctggtaaaatacccacagatcatatatataaaattgatgatgatggccaagagtttgatgaagatgggagcagtgtggaacttcctgagcaggatatagaagacacttccccatatggaactgcatatgaagcgtttggtggaggaaagaagggaagggaagcatgtcatgccattgctgctctatgtgaagtcttttctattgacaaattgatatccggcttcattgttccattgcagggagatcatatatcatgtaaggaagggcgcattcactgttcgttaaatatcaatactgaaacaggacgcttgtcagcaagaacaccaagcttgcagaatcaacctgctcttgaaaaggataggtacaagattcgccaagcttttgtcgcagctccagggaacactcttattgttgctgattatggccaactggaactgaggatcttggcgcatcttactaattgtaaaagcatgctggaagctttcaaggctggtggtgactttcattctaggacagccatgaatatgtaccagcatgttcgtgatgctgttgaagaaaagaaagttctgcttgaatggcatcctcaaccaggtcaagacaaacccccagtgccattattgaaggatgcttttggcgctgagaggaggaaggccaaaatgctcaatttctccattgcatatgggaagactgctgttggtctatctcaggattggaatgttgaagttagggaagcaagggatacactcaaactttggcatagggatagaaaggaaatttcagcttggcaaaagaagcagaaagcccttgcgtttgagaagtgcgaagtctacactttgctcgggcgatcacgccaatttcctaatatgactcatgcgggtcctggtcaaaagagtcacgtcgagcgtgctgctataaatgcaccagtgcagggcagtgcagcagatgttgctatgtgtgcaatgcttgagatagaaagaaacgctcgccttaaggagcttggttggagactcctattgcaggtgcatgatgaagtgatcttggaagggcctacagaatctgccgaggaggccaaggccatcgttgtggagtgcatgtccaagcctttctatggaaccaacatcctcaaggttgacctagctgtcgacgccaagtacgcgaagagctggtatgctgccaagtagaatccacactcagttcttctgccctatacatagccagatgaacacatttgtctgccccaaagttaggcgacaccaaagttatgtgtcgccgatgcgatgaagactgcccatccatcctgacgaaatacagcggactgagccagcatagataagagatgcaaagccgctcaagcactcgaagtgccacccccatcacccacaggaacacaagatcacacgtccattttttcggtggcagaggcagagcatccaacgagggccgaataggctgaagactctttcactggcagtagctgaatgtacagaagtagcctgtctgatagttagatttggatttgactgtagggaccccagtagatactgacctgtatgagactttcagatacttgggcagtgtttagttcccttcaaactttaaaaaatttcgttacatcaaatgtttggacacatacatgaagcaataagggcttgttcgtttctctaacaaggaggagatgaaattttcgatactcgtg

SEQ ID NO: 4725 - DNA, 3789 bp, Setaria italica
cccaaactctcctctcgccctcgtcctcccgccgccgctccattcgcggccgccgaatgcccgcgcccggcacctcctgctccgaaccctcgaggcgtgcctagcccgcgccgcgcggtgtggtccaagacggcgccctgcggcctcggttgcggcggtgggggagcgggggcaggggccgggaagctgaggcggctcgtggggtccatggcgatggccgggacggcgccggggcccgcgcccgcgctgctccggcggtgcccgtgctccgcgcctccgtggacgccctcgcccttccgcccccgccgccgcggccgctcgatggtctcgccgttcaccggcggcagaaggcaggagtactctcagagttcaggtgttggaattcaagacaacagagctcttaagtttggagtatgtgtcaactttaatgtgcaaagtagtggggcacaagaatgggctgccgagagcaagaggttatcttccatcagaaccagcaacagtacctatagcggttccagtcatctagggcccgctattattcatcatgaacacctggaagatttcaagagctccaaccagtcttcacctcacagtgtaagacaaagaatggcacctaattcccttgcaaataggcatgccagtgtggaacctgcaaagcgtcatatgattaatcgtgctgcagctgctgtgtcagccctggccagtgttgttaaggatgacaccaaaccaattaaaaggcctaatgaatccgaagtggaggctcattggcctaatggttccaagtttcatgcttctcttccaaaaatttctgaagttgaaacaagcttaccatttgacgacaaggctacagatggcaatgctgaagatgagaatgaatgctcacccaaggagacagtacaacctccaccagctagagcacccttgtctcaggagtctaaagatgcacggaaggcacttggtaccatctatgaaaaagttctggtggttgatgatgtcaagtcagctaggagtgtcgtccagttgcttactacgaagtacagaaattttttccatgcatgtgacacagaggttgctaatattgatgttaaacaagagacaccagttggccatggaaaggtcacgtgctttagcatatactctggcacttctggtgctgaagctgattttggaaatggcaagacatgcatttgggtggatgtgctggatggtggacaggatgtccttatggagtttgccccattttttgaagattcatcaatcaggaagatttggcacaattatagtttcgatagtcatgtcatagagaactatggaattaaagtttctggatttcatgctgatacaatgcatcttgcacgactttgggattcgtcaagaagactggatgggggatattctcttgagggacttacaaatgatcacagggttatgggtgttgttccaaaggaattgcaaaagattggaaagcgatcaatgaaaaccatctttggtaggaaaaagataaaaaaggatggatcggaaggtaaaattactgcaattgagcctgttgaaattttacaaagagaggacagagagctgtggatctgttattcttcactagattccatgagtaccttgaggctttatgaaagcttgaaaagcaagcttgaaaggaagccctggacttttgatggtgttccaagaggttcaatgtacgatttctacgaggagtattggcgtccttttggtgctgttcttgtcaaaatggaaacagctggaatgcttgtcgaccgtgcttacctttcaaagattgaaaaagttgctgttgcacagcgcaaattagctgctgataaatttcggaagtgggcatctaagtattgccctgatgcgaaatacatgaatgttaatagcgatactcagattcgacaactcttctttggtggtatagagaacagatgcaaacctggtgaatttttgccaacgagtaaggctattaaagtgcctaatgatgaaactgcagttgcagaaggcaagaaggttccaaagtatcgcacaattgaacttttcagtattgtggaagacctcaaaactgatatattcacagctagtggctggccttcagttagtggggatgcattgagaaatttggctgggaaagttccttcggatcttgtttacacgacagatgatgtaaatgatgatgaatgtggtagcgattctgaaatttctgattgtgatctagaagacacctcctcttatggaactgcatatgaagcatttggaggagggaagaaaggaaaagaagcatgccatgccattgccgctctatgtgagatatgctcaattgactcgttgatatccaacttcattcttccattacagggaaatcatatatcatgtaaggaggggcggatccactgttccttaaatatcaacacagaaacagggcgtttatctgcaaggacaccaaatttacagaaccaacctgcacttgaaaaggatcggtataaaatccgccaagcttttgttgcagctccagggaacactcttattgttgctgattatggtcagctggagctcaggatcttggcacatcttgctgattgtaaaagcatgttagatgctttcaaagctggcggtgacttccattccaggacagccatgaacatgtaccagcatattcgcgaagctgttgaagaagagagagtaattcttgaatggcatcctcaacctggtcaagagaaacctcctgtgccactgttgaaggatgcttttggtgctgagaggaggaaagctaaaatgctaaatttctccattgcatacggaaaaacagcccatgggcttgctcgggattggaaggtttctgttaaggaagcaaaagacacactgaaactctggtatagcgatagaaaggaggttctggcttggcaaatgaagcagaaagaactagcacaggagaagtgtgaagtttatactttacttgggcgatcacgccgttttccaaacatggcttatgcaacttctggccaaaggggtcacattgagcgtgctgctatcaatgctcctgtacagggcagtgcagcagatgttgccatgtgcgcaatgcttgagatagacaggaatactcatctgaaggagcttggttggacgctactcttgcaggtgcatgatgaagtgatactggaagggccttcagagtctgctgaactggccaagtccatagtggtcgagtgcatgtctaagcccttctacggcaccaacatcctgaatgttgacctggctgttgatgccaaatgtgcgcagaattggtatgccgccaagtagatccatactgtctttactcctcccctgtgagtgattactaccaagcctggcaagtttgtgcctcatcaattcctgcggtgaaattcagtgcgtttttgaactggtatcaactggtaggctactgcacgccccaggtcggatgccatgcactagttatttcgccatgggagtggtagctgggcagtgggcggtcggcactcagctgggaaggcattgtacactaccatatagatcggattagcttgactcccactcttccaattaggacctgtgtcgatctatcatttgcgtgatgtagttgactgtccagaagagaagtagaaaagtccaggcatgcgatgttcataagatttgtttagcgtgctggtgtgttaggttagctgacctattctgctgatgttaaacacttcgttacgtactacaactgcaactatgctttggtcaaggctcaagagaatgcaatttagcgtggtttcgtccttaata

SEQ ID NO: 4726 - DNA, 3892 bp, Brachypodium distachyon
cacaaagctagctgagtcgctgacgctgtcccctctttacagccgcgccacagatacgccgtaaacccttctcctccctatcccccaagcgcccaaacccctcctgacctcctctcctctcgctcgctcttgtttccccaagtctgctaatgctcgcgcgcgccgccgccgccgccgcctgccccgagcccgagcccgagccctagccgcggttgcccaagacggcgccctgcggcttcggttgcggcggcgggggagcggggggagtagtagcaggaggaagggggaagctgaggcggctcgtgggctccatggcgatggccgcgccgccggcgcccgtgcccgcgcagctgcggaggtgcccgtgctccgcgcctctctgggcgccgtcgcccttccaccaccaccgccgcctccggcgctcgcccgcctcgccgttcatcggcggcagaaggcaggaatactcttatagttcaggccttggtatgacagacaacaacgctctcaagcttggagtgtgtctcaacttcaatgtgcggagtagtaagcaagagtggatagaggagagcaagaggttatataatataaaaaccacaaatagtgtgatgaataatgtttgtaatggtgctcatctacgagcaggaatttttcaccatgaaccctttgaagatagcaagagcctcaaccagtcctcattgtacagtgtaagagaaagaatggctcctaactctcttgcaaatagacatgccaatgttgaactggcaaagcatcatgtgacgagtcatgctgcaggtgctgtgttagcactgactagtgttgttaatgatgacattaaatcgctaagcaggcctagtggctctgaagtgaagatccattggcctaatggttccaaggttgatgcttctctgcctaaaattcgtgaagttgaaaagatcatgcagttagatgataaggctattgatggttatgatggagatgaatgcgcatccaagacaacggtacaatcttctccagttaaagcccccttgtccaaggaggctgaagatgcacgtaaggctcttgctaccatctatgacaaagttctggtggttgacactgtgaagtcagctaggagcgttgttcagttacttacaacgaagtacaagagctttattcatgcatgtgacacagaggtagcaaatattgatgttaaacaagagacaccagttggccatggcgagatcacatgctttagcatctactgtgccagctctgatgctgaagctgattttggaaatggcaaaaaatgcatttgggtggatgtactggacggtggacgggatgtcctcatggagtttgttccgttttttgaagatccgtcgatcaggaaggtatggcacaactatagtttcgatagccatgtcattgagaactatggaatcaaagttgctggatttcatgctgatacgatgcatcttgcacggctttgggactcttcgaggagaactgatggaggatattcacttgaaggactcacaaatgatagcagagtgatgggagctgtcccaaaggaactacaaaatattggaaagagatcaatgaaaacaatctttggtaggaaaaagattaaaaaagatggtaccgaaggaaaaattacgtccattgagtctgttgatattttacaaagagaggacagagaactgtggatcagttattcttcattagattcaatgagtaccttgaggctttatgaaagcttgaaaagcaagcttgaaaaaaagcactggacttttgatggctgccccagaggttcaatgtatgatttctatgaggagtattggcgtccttttggtgccattcttgtaaaaatggagacagctggaatgcttgttgaccgttcttacctctcagagatcgaaaaggttgctgttgcacagcgaaaattagctgcagacaagttccagaaatgggcgtctaaacattgccctgatgcaaagtacatgaatgtcaatagtgatacccagattcgccaactcttctttggtggaatagagaatagatgcaaacctggtgaatttttgccaaagagtagagcaattaaagtgccaaatgatgataacacagttacagagggcaagaaggctccaaagtaccgcacaattgaacttttcagcattgtagaagatctgaaaactgatatattcactgcaagtggatggccttcagtcagtggggatgcgctgagaaatttggctgggaaactgaaaactgatcttgcttatccaatggatgatgcagagggtgatcgatatggcagtgattcagaaatttctgaggatgatgtagaagatactacctcttatgggactgcatatgaagcatttggaggaggaaggaaaggaaaagaagcatgttatgccattgcagctctctgcgagatctgctctattgattcgttgatatccaactttattcttcccttacagggaaatcgtatatcatgtaacgaagggaggatccactgttccttaaatatcaatacagaaactgggcgtttgtcagcaagggcaccaaatttgcagaatcaacctgcacttgaaaaggaccggtataaaatccgccaagcatttgttgcagctccagggaactctcttattgttgctgattatggacagctggagctcaggatcctggcacatcttgctgattgtagaagcatgttagatgctttcaaagctggtggtgactttcattccaggacagccatgaatatgtaccagcatatccgtgatgctgttgaagaaaagacagtacttctagagtggcatcctcaacctggtcaagagaaacctcctgtgccactgttgaaggatgcgtttggtgctgagaggaggaaagctaagatgctcaatttctccattgcatacggcaaaacagctgttggacttgctcgtgattggaaggtttctgttaaggaagcaaaggataccctgaaactctggtacagagatagaaaagaagtattgacatggcaaatgaaacagagagaattagcagaagagaagtgtgaagtttatactttgcttgggcgatcacgccgtttccccaacatggcttatgcatctcctggtcaaaggggtcacattgagcgtgctgctatcaatgctcctgtgcagggcagtgcagcagatgttgccatgtgtgcgatgcttgagatagataggaatactcgtcttaaggagcttggttggacgctactgttgcaggtgcacgatgaagtgatactggaaggaccttcagaatcggctgacgtggccaagggaatagtggttgagtgcatgtctaagcccttctatggcaccaacatcctgacggttgacctggctgttgacgctaagtgtgcacaaaactggtatgcagccaagtaggatccaatatcattgcccccttcgtcgacttcaagttgcgaacatggtgtagtcgcgccccaaaagcgcatctcgtcctacgaattgtggtgcgttttgagccggtgtcaaatactggcctatggacggcatgcacatgccatccggccgttgcagcagaacagtgaggttagcagtgaaagcatggtacgctaatatagattggatagcttgactcccacacctttccaagtaggaccctgaatctggagggaagtagcaaagacatgccatgcactttgtctataagaatccttagtatgctaatgtattagtaggttagatgacctggtgtgctgatgtgtcttaaaactgtgtcacgtgctgtaacctgttttgatggagacattagattgcacctcaacatgagctttcctctattgctctatcacctgttacattatttgccgttctgatgcgtgtatatgacttcgttttgttcccat

SEQ ID NO: 4727 - DNA, 3956 bp, Panicum virgatum
ccgccgccgccgctccattcgcggccgccgaatgcccgcgcggcccggcgcgtcctgaccctgaaccctaacacgcgtgcctaccccgcgccgcgcggtgttgtccaagacggcgccctgcggcctcggttgcggcggcgggggagccgggggaggggccgggaggctgaggcggctcgtggggtccatggcgatggccgggacggcgccggcgccggcgccggcgctgctccggcggtgcccgtgctcggcgcctccctgggcgccctcgcccttccgcccccgccgccgcggccgctcgacgatgtcgcccttcaccggtggcagaaggcaggagtactctcatagttcaggtgctggaattcaagacaacaaacctcttaagtttggagtatgtgtcaactttaacgtgcaaagtagtggggcgcaagaatgggctgctgagagcaagaggttatctgccatcagaaccagcaacggtacctacaaaggttccagtcacctagggccagctattcttcatcatgaacaccttgaagatttcaagagctccaagcagtcttcagctcacagtttaagacaaataatggcgccgaattcacttgcaaataggcatgccaatatggaacctgcaaagcatcacatgattaatcgtgctgcaactgctgtgtcagcactggccagtgttgttaaagatgacaccaaaccagttaacaggcatagtgaatccgaagtggaggctcattggccaaatggttccaagtttcatgcttctcttccgaaaatttctgaaattgaaacaagcttgccatttgatgacaaggctacagaaagcgatcctaaagatgaaaatgaatgctcacccaaggagacagtacaaccttctcccgctaaagcacccttgtccaaggagtctaaagatgcacggaaggcacttgctaccatctatgaaaaagttctggtggttgatgatgtcaagtcagctaggagagttgttcagttgcttactacgaagtacagaaattttattcatgcatgtgatacagaggtagctaatattgatgttaaacaagagacaccagttggccatggaaaggtcacatgctttagcatctactctggcacttctggtgctgaagctgattttggaaatggcaagacatgcatttgggtggatgtgctggatggtggacgggatgtcctcatggagttttccccattttttgaagattcatcaattaggaaggtttggcacaattatagtttcgatagtcatgtcatagagaactatggaattaaagtttctggatttcatgctgatacaatgcatctcgcacgactttgggattcgtcaagaagaacggatgggggatattctcttgagggacttacaaatgatcacagggtcttgggtgttgtcccaaaggaagtgcaaaagatcgggaagcggtcaatgaaaaccatctttggtaggaaaaagataaaaaaagatggatcagaaggtaaaattactgcaattgagcctgttgaaattttacaaagagaagatagagaactgtggatctgttattcttcactagattccatgagtacgttgaggctttatgaaagcttgaaaatcaagcttgaaaggatgccatggacttttgatggtgtccccagaggttcaatgtacgatttctatgaggagtattggcgtccgtttggtgctattcttgtcaaaatggaaacagctggaatgcttgtcgaccgtgcttacctttcagagattgaaaaagttgctgttgcacagcgcaaattagttgctgaaaaatttcggaagtgggcatctaagtattgccctgatgcaaaatacatgaatgttaatagtgatattcagattcgacaactcttctttggtggtatagagaacagattcaaacctggtgaatttttgccgaagagtagagctattaaagtgcctaatgatgaaactgcagttgcagaaggcaagaagattccaaagtatcgcacaattgaacttttcagtattgtcgaagacctccaaactgaaatattcactgcaagtggctggccttcagttagtggggatgcattgagaaatttggctgggaaagttccatcggatcttgtttacacaacagatgatgtaagtaatgatgaatgtggtagtgattctgaaatttctgattgtgacctagaagacacctcctcttatggaactgcatatgaagcatttgggggaggcaagaaaggaaaagaagcatgtcatgccattgcagctctatgtgagatctgttctattgactcgttgatatccaacttcattcttcctttacagggaaatcatatatcatgtaaggaggggcggatccactgttctttaaatatcaacacagaaacagggcgtttatcggcgagaacaccaaatttgcagaaccaacctgcacttgaaaaggatcggtataaaattcgccaagcttttgtcgcagctccagggaacactcttattgttgctgattatggtcagctggagctccggatattggcgcatcttgctggttgtaaaagcatgttagatgctttcaaagctggcggtgacttccattccaggactgccatgaacatgtaccagcatattcgcgaggctgttgaagaagagaaagtaattcttgagtggcatcctcaacctggtcaagagaaacctcctgtgccactgttgaaggatgcttttggtgctgagaggaggaaagctaaaatgctaaatttttccattgcatatggaaaaacagcccatggacttgctcgagattggaaggtttctgttaaggaagcaaaggacacactgaaactctggtatagtgatcgaaaggaggttaaggcttggcaaatgaagcagaaagcgctagcacaggagaggtgtgaagtttatactttgcttgggcgatcacgccgttttccaaacatggctcatgcaacttctggccaaaggggtcacattgagcgtgctgctatcaatgctcctgtacagggcagtgcagcagatgttgctatgtgtgcaatgcatgagatagacaggaatactcgtctgaaggaacttggttggacgctactcttgcaggtacatgatgaagtgatactggaagggcctgccgagtccgctgaacaggccaagtccatagtagtcgagtgcatgtctaagcccttctatggcaccaacatcctgaaggtcgacctggctgttgatgccaaatgtgcgcagaattggtatgcagctaagtagaccatgttgagcaaaaacggtaaggttgtgcctcatcaattcctgcggtgaaattcagtgccttttgaactggtatcaactggtagagtagtgcggccccccaggttggatgccatgcactatttatttcgccatgggcagtgggcgatcggcactcggttgggaaggcattgtgctaaagaccggattagcttgactcccactctcccaattaggatctgtgtcgatctgtcgtttgcatgatgtagttgactgtcccgaagagaagtagtaaaaacgaagcatgcaatgtttataagatttgtctagcatgctgacgtgttagttttttttttaacggacgtattaggttagctgacctattctgctgatgctgaacacttcgctacgtactgcaactgaaactatgttttggtagagactcaagggaatgtaatttagcgtcgttctgttcgtaatcttgttttttttttctgcggcattgtgaaattgtgcgtagcagtgttgtgatgatgttccagctcgtcaagaattcatctccaaatgccttacttcagcacctgtgtctgccgaacttcgtcttgaaagttgcaggaaaaaaaagaggggacgggatgacaagtgacagagccaagtgatgacagaaaaagagttacaacttgagattaggtag

SEQ ID NO: 4728 - DNA, 3813 bp, Zea mays
gcccagctgcccctgcctcctcctaccgccgccgtttcgctccattcgcctcccggaggccgccgaatgcccgcgcccagcgccacccgccctcaaacctagactagacgtgtgcctcgcccgcgccgtgcggtctggtccaagacggcgccctgcgggctcggctgctgcggcgggggagcgaggggagggggcgggaggctgaggcggctcgtggggtccatggcagtggccggattggcgccctcaccggcgcccgcgctgctccggaggttcccgtgctctgcgcctccctgggcgccctcgcccttccgcccccgccgcccccgccgcggccgctccatgatgtcgccgttcactggcgccagaaggcaggagtactcccatagctcagtccttggaattcaagacaaccgagctcttaagcttccagtatgtgtcaactttaatctgcaaaacggcggcgcacaagaatgggctgacgagagcaggaggttatcattaagcaaagccggcaatagtaatggttccactcatctagggtctggtattttccatcatgaacccttggaagatttcaagagctccaaccaatctctattgcacagtgtaagacaaagaatggcaccaaattctcttgcgaataggcacgtcaacacggaattggcaaagcatcatgcgattaagcatgctgcagttgctgtgtcagcactgaccagtgttgttaatgatgaccttaaatcagtgaagaggcctaaggaatctgaagtggaggttcattggtctaatggccccaagtttcattctcatattccgaaaatctctgaagttgaaacaagcctgcgatttgatgaaaatgctacagatggctatgctaaagatgtgaatgaatgctcacctgaggagacagtacaaccctctcgaactagagcgccctcatcccaggagtctctagatgcacggaaggcactcagtaccatatatgacaaagttctggtggttgacaatgtcatgtcagctaggagtgttgttcaactgcttactacgaagtacagaaattatattcatgcatgtgacacagaggtagctaatattaatgttaaacaagagacaccagttggccatggaaaggtcacatgctttagcatttactctggcactaaaggtgctgaggctgattttggaaatggcaagacatgcatttgggtggatgtgctagatggtggaccagatgtactcatggagtttgtcccattttttgaggattcatcaatcaggaaggtttggcacaactatagttttgatagtcatgttatagagaactatggaattaaagttgctggatttcatgctgatacaatgcatcttgcacgactttgggattcttcaagaagaacagatggaggatattctcttgagggacttacaaatgatcatagggtcatgggtgttgttccaaaggaattacaaaagattgggaagagatcaatgaaaaccatctttggtcggaaaaaaataaagaaggatgggtcagaagggaagattactgcaattgagcctgttgaaattttacaaagagaagacagagaattgtggatctgctattcttcgttagattccatgagtaccttgaggctttatgagagcttgaaaagcaagcttgaaaggaagccctggacttttgacggttaccccagacccggaggttcattgtacgatttctacgaggagtattggtgtcctttcggtgctattcttgtaaaaatggaaacagctggaatgcttgttgaccgtgcttacctttcagagattgaaaaggttgctgttgcacagcgcgaatcagctgcagataaatttcggaagtgggcatctaagtattgccctgatgcaaaatacatgaatgttaatagtgacactcagattcgacaactcttcttcggtggtatagagaacatatacaaatctggtgattttttgccgaagagtaaagctattaaagtgcctaacaatgaaactgctgtttcagaaggcaagaaggttccaaagtatcgcacaattgaccttttcagcattgtggaagacctgaaaactgatatatttactgcaagtggttggccttcagttagtggggctgcattgagaaatttggctgggaaggttccatcagatcttgtttactcaacagatgatgtaaatgatgatgaatgtggtattcattctgaaatttcccattgtgatctagaagacacctcttcttatggtactgcatatgatgcatttgggggaggaaaggaaggaaaagaagcatgccatgccattgcagctttgtgtgagatctgttctattaactcgttaatatccaacttcattcttcctctacagggaaatcatatatcatgtaaggaagggcggattcactgttccttaaatatcaacacagagacaggacgtttatcggcaagggcaccaaatttacagaaccaacctgcacttgaaaaggataggtataaaatccgccaagcttttgttgcagctccagggaacactcttattgttgctgattatggtcagctggaactcaggatcttggcgcatcttgctgattgcaaaagcatgttagatgcttttaaagctggcggcgacttccattccaggacagccatgaacatgtatcagcatattcgtgaggctgttgaagaagagaaagtaattcttgagtggcatcctcaacccggtcaagagaaacctcctgtgccgttgttgaaggatgcttttggtgctgagaggaggaaagctaagatgctaaatttctccattgcatatgggaaaacggctcatgggcttgctcgtgattggaaggtttctgttaaggaagcaaaagatacactgaaactctggtatagcgatagaaaggaagttctggcttggcaaatgaagcagaaacagctagcacatgagaagcgtgaagtttatactttgcttgggcgatcacgccgttttccaaatatggctcatgcaacttctggccaaaggggtcacattgagcgtgctgctatcaatgctcctgtacagggcagtgcagctgatgttgctatgtgtgcaatgcttgagatagacaggaatactcgtcttaaggagcttggttggacgctactcttgcaggtgcatgatgaagtgatactggaagggccttcagagtctgcggagctggccaagtccatagttgttgagtgcatgtctaagcccttctatggcaccaatatcctgaaggtcgaccttgctgttgatgccaagtgtgcacagaattggtatgcggccaaatagacctgttaagtgtcccagaagggcgtcaattccttcggtgaaactcggtggattttgaactggtatctgctggctgctgctagtagcctagtgagctcatctccacgtggatgccatgcactgattatttcgctgttgatctggacagtgaggggtcagcactgagcagcgaaggcactgtacactattccgtattccctataggtcgggtagcttcaccttccacactccctgttaggatctctcgatcattcatgcctgatgtagttggtcgtcctggatagcagtgaagactaagcatgccgtgttcataagatttatttagcatgctgatgtgttgagttgctgaccagttctgctgacgtctaacactgttgcacgcactgcaacaatgttttgatcacaagagaatgtagttgattgtgagcgttcttaatctccttatttctgctgttgaactgtgcgtcttgttaattgtatcttctctaa

SEQ ID NO: 4729 - DNA, 3020 bp, Sorghum bicolor
cgtgacctgagcagccccgttgactgagacttgacgtgccagccctggtgtgcagcggtctcggcttggtgaggacggtgaagacttcatatgaactccggcgcggagcctcgtcgaggaggcaggaggctcagtacctcatccagcgaggccctcagactcgccgtcgatctcctcgactcccctctccgtcgtcttatcgcggcggaggtataaattaggtgaattcagacatgtcagataccctatttgtagttctcaggaaagttgctctttccctaggagaacgagcactagagaggatcggcacagaggtggttgaagctgcaccagttttgacagattttgaacatagcatgaaacaaatagaggccgagcttttgattctgcaggcttttattggtcaggttggggcgcagaaagttgatgacaaagcattcgatgcctggctggaccaagtgagaggtgttgcccatgaggtagaagacattatggatgagtatgtttaccatgctgctcaagctgtggatactggcagcttctttaagaggaagttccgtcagataaaaaacatagtagcatggcagaggttcgctagccagatcagtcaagtagaagctcgaattcagaggctaggtgaaatcaggagtcggtacggcatctcagtaggtgaaatagacaggagtaacaaggtaagacgccccaatcagctctttaagtcggattcttcttacttaacagataactctgaaatagtggggaatgttgatgaaattggaagattgacacaatggctactcgaggacagacaagatcgaattgtcattgcgatctttggtatgggaggtttaggaaaaactactattgcaagcagtgcctacaagaatcagaagatcacaagaacttttaactgtcacgcatgggttactgtatctcagacttatcatgttgaagaactactaagagaaatcataaatcagctaatagatcagagagcaagcatggcaagtggtttcatgagcatgagcggcatgaaactagttgaggtaatacaaagctatttgcaagacaaaaaatatttcattgttttggatgatgtgtgggataaagatgcttggttatttctgaactatgcatttgtcagaaacaactgtggaagcaaagtgctgataactactaggagaaaggacatatcttctttggctgttgataactatgccattgagcttaaaactcttcaatatgctgaatcctgggaacttttctgtaaaaaggcgtttcgtgcatcaagagataaccaatgtccggaaaaccttaggttttttgcagagaaaattgttgataaatgtcaaggattgccactggctattgtaaccattggaagtactctatcataccatgaattggaagaggagcggtgggcatttttctacaacaaacttagctggcagttagctaacaatccagagctgaattggatttctaatgttctgaatatgagcttgaatgatctcccaagttatctgaggagctgcttcctgtactgcagtctctatcctgaagattacaaaattagaagaaacgtgatttccaagctttggattgcagaaggttttgtggaagatagagacgatggaacaacaatggaggatgttgccaattattatcttacggagcttactcagcgttgtcttcttcaagtcatagaaagcaatgcatgtggaaggcctagaacatttcttatgcatgatcttgtgcgagaggtaacctccatcattgctaaaaaggagaatttcggtattgcatatgacaatgctagtataaatcaagtttcccgtgaagctcgccgcttaagcattcaaagaggtgcccagtccttattttctttaaaaggccaccgactccgctcatttattttgtttgaccctgaagtgccatcttcttggatacatgatgtcttatcacacttcagactgctgagggtcctgtgcttaaggtttgccaacattgaacaagtgccaggcatggtaacagaactgtataatttgcgttatctagatttttctcacacaaaagtgaagaagataccagcatcaatcagaaaacttaggaacctacaagttttaaatctcagattcagctatgtggaggagttaccattggaaataactatgctaactaatttacgacatttatatgtgtctgtagtctatgatctgcaagaaagatcattggattgctttagtggtacaaaaattcctggtaatatttgctgtctaaagaatctgcaagctttacatattgtctcagccagcaaagatttagtttcacaattgggaaacttgactctgttgagaagtttggctataatgaaagtacgacaaagctacatttcagagttgtggagcgctctgacaaagatgcctaacttgagcaggttgcttatttccacatttgatatggatgagattcttgatttgaaaatgctcaagcccctacccaatctgaagttcctctggctcgctggaaagttggatgcaggtgttcttccatcaatgttttctaagtttgagaaattagcgtgtttaaagatggactggtctggtctgaagaaggatcctattatctccttctctcacatgttaaacctagttgatttgcggctctatgggacatatcatggggaacagctaactttttgtgcaggttggttccctaagctcaattctctgcaattagttgacatggaacatctgaaatggattgagatcgaggacgggacaatgataagtctgtatcatctggaacttgttggtttagggaatctaaaggcagtacctacaggcatcaagtaccttaggacactccaccaaatgtttctgacagatatgtcaaagggattcatacaaagactggaagaaagtgaatcagttgacaatttcattgtccaacatatacctaacatccatatttttgactcctctgattctcaagcaggtaatttccatgttctgtgctaa

SEQ ID NO: 4730 - DNA, 2386 bp, Glycine max
ccaccaccgacaataaaaggacaacaacgttaaagtgttaaagcatgaaaatgctgccatctgccaccgccggagatgccggacacggcagtgccggtgaccgcatcgtggtggtgggcatgaagatggactcccacagcaccgagttgctcacttgggctctgttcaaagtggctcaacccggtgatgttgtgcttgctcttcatgttctcgggaatgatgaaattgtgaatcgagaagggaaatcctctttgttttcacttgtcaaagcatttgactctatccttgctgtttatgaagggttctgcaatttgaagcaggtggatctcaagttcaaaatatgccggggttcatcagtgacgagaattttggttcgagaagcaaatgcttattctgcaacacacatcatagttggaagttctcaaggtcttcatataactcggccatgcatatctgtggcaaggtactgtgctaagaagttaccaaaggattgttgggtttttgctgttgataacgggaaaatcgtgttcaagagagaagggtcagccgcaactcgttcagacttaaaaggacttgatcgggatcacaaaaccgggttgctcggttcgattcacaggacaatcagcaagaaagaggtgctctactagtgcttcagaagaagaagaatcttgtgctgatgcttgtgatgagatgaacccattggcaatagtgcctgtgcagaccaatgatgctgcttctaaaccgggttggcccctgcttcgtaagacaattgtatctgacaggaaatgttctcaaagatcgctcttgtgccagatctcggtggtacaatgggcaatgcacaagagtggtgctcttgttccggtggatgctgaaatagggactgctccttcgactgaacacaattcaagaagcattcctaaggaattggagggccttcatgagaaatactcatccacttgcagattgttcaagtaccaagaacttgtattggcaacatcaaattttttgccagaaaatttgattgggaaaggaggaagtagtcaggtttatagaggttgccttcctgatggcaaggaacttgctgttaagatcttaaagccatctgatgatgttttgaaggagtttgttctagaaatagaaattatcactaccttaaatcacaaaagcttaatttccctccttggattttgctttgaggatggcaatcttcttttggtttatgatttcttatcaagaggaagccttgaagagaatctccatggtaataagaaaaatccacttatgtttggttggactgagagatataaggtggcaataggtgttgctgaggctttggagtatctgcataataatgatggccaatctgtgatccatcgcgatgtgaaatcatcaaatgttttgttatctgaggattttgagccccagctctctgactttggacttgctaaatgggcgtcgaccacttcatcacatataatctgcaccgatgttgctggaacctttggttacatggctcctgaatacttcatgtacggtaaagtaaatgacaagattgatgtctatgcatttggtgtagtgcttcttgagcttctttctggaagaaagcccataagtggtgattatcccaaaggtcaagagagccttgtcatgtgggcaagtccaattctaaatagtggaaaggtgttacaattgttagatcctagtttgggtgataactataatcatgaagagatggaaaggatggtcttggcagccacactttgtaccagacgtgctccaagagctaggcctcaaatgagccttatctctaagctccttggaggtgatcctgatgtgatcaagtgggcaagactagaagttaatgctttggaagcaccagaaatgcttgatgatgaagcttgtccaccttccaatttgcagtctcatctcaaccttgcactgcttgacgtggaggacgactcgctctccatgtgcagtgtcgagcaaaacgtctcgttggaggactacttgagaggccggtggagccgctcatcaagctttgattaagcaaactactgcaaattgatagaagaagaaggattgtgttttttaaaatctaaatccttttgtaaataattttgctgtgttgcatgtgctgtgaaagtttttataaatgggtttaggatgagaggttgtttgtgtgtgccctcctccttcccttgcttgccaaggaaattatgccttgtaatttttaaggctagttaccctttgtctttctactttatttggtgctagtttcaacccttaatctcaatttgatcgagtgtaatatgttctggtgcgaagaatgaacaatgaaaaagttgtatcttaaaactacataatgagtactgttctcatgcatttt

SEQ ID NO: 4731 - DNA, 2607 bp, Glycine max
ctgaattagcagaacacaacactataatttttctctcaatttctttctgcactcaaattggtggccttactttttccacttacactcactcacgcacgagcttcaaaaccaaaatcaaaaccaaaaccaaacacttccaaaaaccaaaaccaaactctcttccaacctccaaacttttatgccattcatgactcagaacatcatagaagaagaactactactcacgaaccgcgaccaccaccgacaataaaaggacaacaacgttaaagtgttaaagcatgaaaatgctgccatctgccaccgccggagatgccggacacggcagtgccggtgaccgcatcgtggtggtgggcatgaagatggactcccacagcaccgagttgctcacttgggctctgttcaaagtggctcaacccggtgatgttgtgcttgctcttcatgttctcgggaatgatgaaattgtgaatcgagaagggaaatcctctttgttttcacttgtcaaagcatttgactctatccttgctgtttatgaagggttctgcaatttgaagcaggtggatctcaagttcaaaatatgccggggttcatcagtgacgagaattttggttcgagaagcaaatgcttattctgcaacacacatcatagttggaagttctcaaggtcttcatataactcggccatgcatatctgtggcaaggtactgtgctaagaagttaccaaaggattgttgggtttttgctgttgataacgggaaaatcgtgttcaagagagaagggtcagccgcaactcgttcagacttaaaagaattcattgagaagaagaggtgctctactagtgcttcagaagaagaagaatcttgtgctgatgcttgtgatgagatgaacccattggcaatagtgcctgtgcagaccaatgatgctgcttctaaaccgggttggcccctgcttcgtaagacaattgtatctgacaggaaatgttctcaaagatcgctcttgtgccagatctcggtggtacaatgggcaatgcacaagagtggtgctcttgttccggtggatgctgaaatagggactgctccttcgactgaacacaattcaagaagcattcctaaggaattggagggccttcatgagaaatactcatccacttgcagattgttcaagtaccaagaacttgtattggcaacatcaaattttttgccagaaaatttgattgggaaaggaggaagtagtcaggtttatagaggttgccttcctgatggcaaggaacttgctgttaagatcttaaagccatctgatgatgttttgaaggagtttgttctagaaatagaaattatcactaccttaaatcacaaaagcttaatttccctccttggattttgctttgaggatggcaatcttcttttggtttatgatttcttatcaagaggaagccttgaagagaatctccatggtaataagaaaaatccacttatgtttggttggactgagagatataaggtggcaataggtgttgctgaggctttggagtatctgcataataatgatggccaatctgtgatccatcgcgatgtgaaatcatcaaatgttttgttatctgaggattttgagccccagctctctgactttggacttgctaaatgggcgtcgaccacttcatcacatataatctgcaccgatgttgctggaacctttggttacatggctcctgaatacttcatgtacggtaaagtaaatgacaagattgatgtctatgcatttggtgtagtgcttcttgagcttctttctggaagaaagcccataagtggtgattatcccaaaggtcaagagagccttgtcatgtgggcaagtccaattctaaatagtggaaaggtgttacaattgttagatcctagtttgggtgataactataatcatgaagagatggaaaggatggtcttggcagccacactttgtaccagacgtgctccaagagctaggcctcaaatgagccttatctctaagctccttggaggtgatcctgatgtgatcaagtgggcaagactagaagttaatgctttggaagcaccagaaatgcttgatgatgaagcttgtccaccttccaatttgcagtctcatctcaaccttgcactgcttgacgtggaggacgactcgctctccatgtgcagtgtcgagcaaaacgtctcgttggaggactacttgagaggccggtggagccgctcatcaagctttgattaagcaaactactgcaaattgatagaagaagaaggattgtgttttttaaaatctaaatccttttgtaaataattttgctgtgttgcatgtgctgtgaaagtttttataaatgggtttaggatgagaggttgtttgtgtgtgccctcctccttcccttgcttgccaaggaaattatgccttgtaatttttaaggctagttaccctttgtctttctactttatttggtgctagtttcaacccttaatctcaatttgatcgagtgtaatatgttctggtgcgaagaatgaacaatgaaaaagttgtatcttaaaactacataatgagtactgttctcatgcattttatcaaagttaatggcaatttcttctttgctttt

SEQ ID NO: 4732 - DNA, 4772 bp, Brachypodium distachyon
acggcaggcatgaaacgacaattttaatccagggtgttcaccgcaatactccggtttccgtgtttaataattttcttgtatgcgcgcagaggcaaaggccgcgtcttggcactgcaagctcggatcagagtgagtgagaccttgcctgcttgcttgctcatccatcactcgccagctcgagcaaggaaaataaaaaaaaaggaggaagaaagctggtctcccccattacttatagtcatagatccgccccccgaagccacagcccttgcgatcctcaagagccaccgccgcacgcgaaccgaggatcagtcgctcgcgcttcctgtcgtatgctcttccaccaggcaccagcgcgcctctgaccgaatttcctgcctgaatttttcgtcccggagaggaaaagatttttgcttcggaatccggtctgtccagtccttttccttgtgagctttttttgtgtgctttaatgctggtccaagaaatggccgcggcggcgatctgtcgatatagtggccggcgggaggagcacctgagctgagatgttgttgccttgttcttttctcttgtgggcttcttcattgaccgaaagttgccgcctcttttcctttcggaaagtggggatttgtttctggtgagttccttggcgcgattcgattccttgctgcctctcgctaaatctcgaggggatttcttcgccttggactcgcagatccttttcctcccccagccgggcattcttgctcggttgctgctctgcttcgtgttgcgggcctctgcaaatttgtctgaaggtcaaatctgggaggatcttcggtttggtggcgcacggagtatggtgtcgagatcctactccaacctcatggagctcgccaccgggagcggcgaggagccgctgccgtcgctcgggcggcggcggataccgcgcgtggtgacggcgtctggcattgtgcccgacctcgactgctccgacgacgacgccgcctcggcggcttccgaccactcctcctcccacgcgccgcgagagcgcaccatcatcgtcgccaaccagctccccatccgcgcctcccgccgcgccggcggcggcggctgggagttctcgtgggacgaggacagcctcctgcggcagctcaaggacagcctgcgcgcgcaccagggccgcgcggacatggacttcgtctacgtcggctgcctccgcgaggacatcccggcggccgaccaggaccaggtcgcgcacgagctcttcgagggcttccggtgcgtgcccaccttcatccccgccgacctccgctcccgcttctaccatggcttctgcaagcagcagctgtggccactgttccattacatgctgccgctctcgccggagctcggcggccgcttcgaccgcgtgctctggcaggcctacgtatcggtgaacaagatcttcgctgacaagatcctggaggtgatcagccccgacgaagacttcgtctgggtgcatgattaccatctcatggtgttgccgacgttcctgcgcaagcggttcaaccgggtccggcttggcttcttcctgcacagcccgttcccgtcttcggagatttacaagacgctgccggttcgtgaggagctgctccgagcactgctgaatgcagatttgattgggttccacacatttgattatgctagacatttcctgtcatgttgtagcaggatgctgggattgaagtatgaatcgcagaggggctacattgcactggagtattatggacggactgttactatcaaaattttaccagtgggaattcatttgacgcagttgcagtcagtgctcaaccttccagagactggggtcaaggttgccgagcttctgaagcagttctgtgaccgcggccggcttttgatgcttggtgtggatgatatggacatctttaaaggcatcagtttgaagcttttggcatttgagcagctgttgatgcaacatccagagtggcgaggaaaggtggtgttggtacagattgccaatcctgccagggggcgtgggaaggatgtacaggaggtacaggatgagagctatgcaatggttaggcgcatcaacgaggcatttgggcagccagattaccagccagttatactgatcgataggccactacaattctacgagagaatggcttattatgtcgtcgccgagtgctgtttggtgactgcagtgagggatggcatgaatctaataccgtatgagtacataattgcaaggcaggggaatgagaagatagacaggatcttgggtctcagcccttccacaaggaagaagagcatgcttgtcgtgtcggaattcattggctgctcaccctccctgagtggtgcgattcgggtgaacccttggaacatagattcagtggctgatgcaatggactctgcactggagatacctgaaggggagaaggtgctgagacatgagaagcaccacaaatatgtgagcacacatgatgtcggttactgggcaaacagcttcttgcaagatctggagaggacttgcctggaccataacaagaggcgttgttggggcatcggatttgggttaaagttcagggttgtggcccttgatacaagcttcaagaagcttgcggttgaacagcttgtctcagcgtaccggaggacaaccacgcgcgccattctcctggactatgatggtacactgatgcctcagacatcattcggtaagaacccaagctccaaaacgatggacatgttgaacagcctctgtcgcgataagaacaacatggtcttgcttgccagcacaaagactcgagcgaccttaaatgaatggttctcaccttgtgaaaacctagggctagctgctgagcatggctacttcctcaggatgagaagagatgcagaatgggagatatgtgccccagcaacagattgcagctggaagcaaattgtggagcctgtgatgaaaacctacacggagacaacagatgggtcaacaatcgaggacaaggagaccgctattgtctggtgctacgaggatgcagaccctgattttgggtcttgccaagccaaggagctccatgaccatctggagagtgtcctttctaatgagccagtttcagtcaaagctgacctgaaccatgtcgaggtgaagccacagggtgtgaacaagggcctcgtggcgaagcggatgctatcgacaatgcaggagcaaggcctcctgccggacttcatactctgcatcggggatgaccggtctgatgaggacatgttcgaggtgatcactactgccattgacggcccgtgcctgaaccccgatgccgaggtcttcgcttgcacggttggccgtaaacccagcaaggccaagtactacctggacgaccctgccgacatcgtgcggctgatccaggccctcgccaacgtctccaaccaggcgcagagcagcactcctccctcctccgccagcgactgacaccgtgccgaggtgagcaagtggggcaccaaccagcctagctctggcctcattaagggtatcagtatcaccatctcctccaggtgtacatactcctaggaatgatgaatgcaccatcgatcagcagcatggtgtgtttcgtcatcgtcgtcaagagacgatctttgcccgatgtgtacataaacttgccgaattgctgctttgtcgccgaaattaaatttctccaccagatgatgctccaaaatggcaagataagaaagacgccatctttggagccgctgcttttgttggtcgttggcggtaggtcctggatcggacggctggttagtgctggtgcgccgcctcctttctcggctagtggagggcgccaataatttttatcgtgatcatcctcttctgtttcagctcgtgctgaccgtgtgcctccatagtgcaattgtattttgtggggttttggataacagggttaggtcttggctgctattctagtccggcggccaatgatgggtggagaggtgttgttggttgcgcttatggttttatgccatatggggtaatcatcgtgcgcgctactgatgggaatggggctaaaagcaaagcctttcgtctcacattggaagggtcaccacagagaccggccgggtttaaagcaaagcatctcgtctacgctcgggtgatcgacgtgttgagtggtgtttttccccttgcacttccgttgcgtgctttcgtggtgttgtttaggaggagtgtggctggttttggccggcacctggtaattttgttgttgggataaagaggccggtggttttatgctcgtacggcacggcaaagaggaattcttttgagtacctcggaccgttcgttaggctttgggatacgttttgccgccgaggacgataagatctctgccctccggttggaatattactatatgtatctagacattttttgtcgaaatattacatgtatctagacattttttatatatagatacatctgtatttagacaaatttgatgatacatgtccgagtgaatagtattatatcttagcagggcggcgtgagcggcgcacgccgccgaggcacgacgacttggtgggggtctcggggacgtctcgtttagttccctttttgtcgattcggtggatccaggtcggcgtaccgacgtcgtgttgcggattgtcaggaaacagcgaaagggattagcatcagctccggtgtttccaagggccacgccgcttggcattgttcgtgtacagatgtgctactgatgatgcgagcacatcactatgatacaaggaagaagtcacaatcagcgccgggagctata

SEQ ID NO: 4733 - DNA, 2434 bp, Hordeum vulgare
acgggtgccgcgggtggtgacggcgtctggcattgtgcccggcctccactgcttcgacgacgacgctggcaccgcctcggtggcctccgaccagccaaaccaggcgccgcgggagcgcaccatcatcgtggccaatcaacttcccatccgcgccacccgcggcgccgacggcgcctgggagttctcgtgggacgaggacagcctcctgcggcagctcaaggagagcatgcgcgggcaccagggccgcgtcgacatggacttcgtctacatcggcagcctgcgcgacgacatcccggcggaggagcaggagaaggtcgcggccgagctctacgatcgcttccgctgcgtgcccgcgttcctggccgccgacctccgctcccgcttctaccacggcttctgcaagcagcagctgtggccactgttccattacatgctgccactgtcgcccgagctcggcggccgctttgaccgcacgctgtggcaggcctacgtgtccgtcaacaagatcttcgccgacaagatcctggaggtgatcaaccccgaggaggacttcgtgtgggtgcacgactaccatctcatggtcctgcccaccttcctgcgcaagcgcttcaaccgggtcaggctgggcttcttcctgcacagccccttcccatcatcggagatctacaagactctgccggtccgcgaggagctgctccgggcgctgctgaatgccgatctgattgggttccacacatttgattatgccagacatttcctatcatgctgcagcaggatgcttgggctcaagtacgagtcgcagaggggatacattgcactggactattacggacgaactgtcaccatcaagatactgcctgtggggatacatttagtgcagctgcagtcggtgctcaacctcccggagactgggctcaaggtcgccgagcttatgaagcagttctgtggtcggggccgcatcttgatgcttggcgtggacgacatggacatcttcaaaggtatcagtctgaagcttttggcatttgagcagctgttggtgcagcatccagagtggcgagggaagctggtgctggtgcagattgccaatccggcgagggggcggggaaaggatgtgaaggatgtacaggatgagagctatgcgatggtgaggcgcatcaatgaggcatttgggcagccagattaccagccagttatactgatcgacaggccactgcacttctatgagagaatggcatactatgttgtcgctgagtgctgtttggtgaccgcagtgagggatggcatgaatcttataccctatgagtacatcattgctaggcaagggaatgacaagattgacaggatcctgggtctcagcccttccacaaagaagaaaagcatgcttgtcgtgtcggagttcattggctgctcaccctccctgagtggcgcgattcgggtgaacccttggaacattgattcagtgactgaggcaatggagaaggccttgtccatatctgactgtgagaaggtgctgaggcacgagaagcatcacaaatttgtgagcacacatgatgtcggatactgggcaaacagcttcctgcaggatctgttgaggagttgccaagaccataacaagaggcgctgttggggcataggatttgggctaaggttcagggttgtggcccttgatacgagcttcaagaagctcgcggctgagcagcttgtctcagcctaccggaaggcaaccacgcgtgccattctcttggactatgatggtacgctgatgcctcagacatcgttcggtaagaatccgggctccaaaacgatagacatgttgaacagcctttgtcgcgatgagaagaacatggtcttaatcgcaagcacaaagacccgggcgaccttaagtgaatggttctcaccatgcgaggacctaggccttgctgctgagcatggctacttttgctgtgtaggctgaaaagagatgcagaatgggagacatgcggcattgcaacagactgcagctggaagcagatcgcggagcctgtgatgaaaacctacaccgagacaacggacgggtcagtcatcgaggacaaggagacagcaatcgtctggtgctacaaggacgccgaccctgattttggatcttgccaagccaaggagctccatgaacacctggagagtgtcctttccaacgagccggtatcggtcaaagctgacgtgaaccatgttgaggtgaagccacaggtaaaagtttgtctgaaaccgacggtgcttttgtttcctcctatactatgcctagtgtgattgaactgcacttgtgtagtggaaaacacttagccatgaaaatgtttcttcgcattgcagggcgtgagcaagggcctggtggcgaagcggatgctgtcggcgatgcaggcgcgagggctcctgcccgacttcatcctgtgcatcggggacg

SEQ ID NO: 4734 - DNA, 2794 bp, Panicum virgatum
caggaatcgcttcccacccagcgcggccaccaccagcagcaagcaccgcaccgctctgctctctccctgtcggcaacggcaaatccggcctccctccctcccgctcgctcgctcgcagtccccctccctgtcggcaacggcaaatctggttcgtgatccggcgcgcggggatggtgtcgagatcctactccaacctcctggagctcgcctccgggggcggcgggggcggggagccgctgccgtcgctggggcgccgccgggtgccgcgcgtcgtcacggcgcccggcattgtgccgggcctcgacgcctccgacgacgacgacgacgccgacgcggcctccgaccgctcctcccacgcgccgcgggagcgcgtcatcatcgtcgccaaccagctccccgtgcgcgccgcgcaccgcgcgggcggcgccggttgggacttcgcgtgggacgaggacagcctcctgctgcaggtcaaggacagcctccgcgcgcaccacggccgcggggacgtcgagttcgtctacgtcggcggcctccgcgacgacgtgccccccgccgaccacgaccacgtcgcgcaccacctcctcgagggcttccgctgcgtgccaaccttcctgcccgccgacctccgctccaggttctaccacggcttctgcaagcagcagctctggccactgttccattacatgctgccactgtcgccggagctcggcggacgcttcgaccgcctgctctggcaggcctacgtctccgtcaacaagatcttcgcggacaagatccttgaggtgatcagccccgacgaggactttgtgtgggtgcacgattaccacctcatggtgctgcccacattcctgcgcaagcgcttcaaccgggtcaagctcggcttcttcctgcacagcccgttcccctcctcggagatctacaagaccctgcctgtgcgtgaggagctgctccggtcgctgctcaatgccgatctgattgggttccacacctttgactatgccagacacttcctgtcgtgctgcagcaggatgctcgggctcaagtacgagtcgcagaggggctacattgcactggagtactatggacgaacagtcacaatcaagatcttgccagtgggggttcacttggagcagttacagtcagtccttaatcttccagagactggagtcaaggtggctgagcttctgaagcagttcaatcatcggagccggctgctgttgcttggtgttgatgatatggatatcttcaaaggaattagcttgaagcttttggcgtttgagcagctgctgatgcagcatccaaagtggcggggaagggtggtgctggttcagattgccaatccggcaagggggaagggaaaggatgtgaaagaggtacaggaagagagcgatgcaatggtaaagcgcatcaatgatgcattcgggcagccagattaccagcctgtaatactgattgataagccactgcggttctatgagaggatggcatattatgttgttgccgagtgctgcttggttactgcagtgagagatggcatgaatcttatcccgtatgagtacattattgctcgacaagggaatgagatgatcgacaggatcctaggtcttggcccatcttcaaggaagaagagcatgcttgttgtctcagagttcatcggatgctcgccctccctaagcggcgcgatccgggtgaacccttggaacattgattcagtggctgatgcgatggactctgcattggagatgccagaaggggagaaggtcttgagacacgagaagcatcatagatatgtgagcacacacgatgttggctattgggcgaacagcttcctgcaagatcttgagaggacttgtctcgaccacaacaggaggcgttgctggggcataggattcgggctaaagttcagggttgtagcccttgacccaaacttcaagaagcttgcagttgagcacttggtctcggcctaccggaggacaacaaagcgcatcattctcttggactatgatgggaccctgatgccgcagacttcgtttggtaagagtcctacctcaaggacgatagacatgttgaacagcctttgccgtgacaagaacaacatggtcttccttgtgagcacaaagagtcggacgactttaagcgagtggttctcaccatgcgagaacttgggactagcagctgaacatggctactttctcaggctgagaagagatgcagaatgggaggagtgtgtcacggtgatagactgcagctggaagcaaattgcagagcctgtgatgaagacctacacagagacgacagacgggtcaacaattgaggacaaggagactgcaattgtttggagctatgaggatgctgatccagattttggctcctgccaggccaaagagctccacgaccatctggagagtgtcctctcaaacgagccggtgtcggtgaaagctggcttgaaccatgttgaggtgaagccacagggcgtgagcaagggcctggtggcgaagcggatcttgtcgacgatgcaggagcgtggtgacctgccggacttcatcctgtgcgtgggcgacgaccggtccgacgaggacatgttcgaggtgatcaccacggcggcggcgcggggcccctcctccctgcacccggaggcggaggtgttcgcgtgcacggtggggcgcaagcccagcaaggccaagtactacctggacgaccccgcggacatcgtgcgcctcatccagggcctcgccaacgtctccaacgaccaggcgtcgcacggcggcagcggcgcgaccctgcccgacga

SEQ ID NO: 4735 - DNA, 4347 bp, Oryza sativa
gtgttctccgcaaaatgtgattattttaatcggtgttgcgccagaggccgcgtcttgagcttgctctctctctctatcactctgctcagctcaagtagccagctcgaacaagaagaagaggagaaaaaaatcgcgcagcttctctccctctctcttacttatagcagcagcagatccgcctcccgaaacccagctctttgtgatcctcaagagccgcctccaacccccaatccacgcgcgacccaagaatccgagaaatttttctgtccagaataagagggtttggtttgattttgggagctccagttgttttcttctcctccttcttcttcttcttctttcttgcaatttgaggaggtttgctctggtttggtttggttctttgttgttgctgccgctgccgcggcgaatggtggcgacgcgaggaagggaatgggttcgttctcctgcgccgcgggcgatctgtcgtgtcgagatagtggcgcgccctgacctgagagatgtttgttcttgttgatttttgtgtgtttgtttgactgaaaggtgctcgtccttttcggaaagtgagggggtttgttcttatttctggttcttgattattattaggattagtttgttcctttgtgtgattcgattccttgccgcgccaaatcttggtttgagatttttctcttttccttttctctctcttggattggatcctttgcctccctcgccgcccattcctccgtgcgatttgagtacttcttggagtgagttcttggtgagtgagatcgagtactttgaggaggatctagaggagatggtttcgagatcctactccaacttgctggagctcgccgccggcggaggaggaggaggcggcggcgaagggccgctgccgtcgctggggcggcgacggattccgcgggtggtgacggcgtcgggcattgtcccggacctggactactccgacgacgacgcggcgtcggcggcgtcgtcgtccgaccactcctccgcccactcccacgcgccgcgcgagcgcgccatcatcgtcgccaaccagctgcccatccgcgcgtctcgccgcggcggcggcggcggcgggtgggagttctcctgggacgaggacagcctcctcctgcagctcagggacagcctccgcgcccacgccgaccgcgccgacgacatggagttcgtctacgtcggcggcctccgcgacgacgtgcccgcggcggagcacgacgaggtggcgcaccacctcctcgagggcttccgctgcgtgcccaccttcctccccgccgacctccggtcgcggttctaccacggattctgcaagcagcagctgtggccactgttccattacatgctcccgctgtcgccggagctcggcggccgcttcgaccgcgcgctgtggcaggcgtacgtgtccgtcaacaagatcttcgccgacaagatactggaggtgatcagccccgacgaggactacgtctgggtgcacgactaccatctcatgatcttgccgacgttcctgcggaagcggttcaaccgcgtcaagctcggcttcttcctccacagcccgttcccgtcgtcggagatctacaagaccctgcccgtccgcgaggagctgctccggtcgctcctgaacgccgatttgatcgggttccacaccttcgattatgccaggcatttcctgtcctgctgtggaaggatgctcgggttgaagtatgagtcgcagaggggctacattgcgctggagtattatggtcggacggttaccatcaagatattgccggtgggagttcatttggagcagctgcggtcggtgctcaatcttccggagacgggggtcaaggtggccgagcttctcaagcaattctgcgatcagaaccggctgatgttgcttggcgtagatgatatggacatctttaaaggaattagcttgaagcttttggcatttgagcagctcctgatgcaacatcccgaatggcgaggaagggtggttctagtacagattgccaatccagcgaggggacgggggaaagatgtgaaagaggtgcaggatgagagctatgcaatggtgaggcgtatcaatgaggcatttgggcagccaggttaccagccggttatattgatcgatcggccacttcagttctatgagagaatggcttactatgttgtcgctgagtgctgcctggtgaccgcagtgagagatggcatgaatcttatcccgtatgagtatgtaattgctaggcagggcaatgaaaaactagacgggatcttaggtcttggcccatcggcacggaagaagagcatgcttgttgtgtcagagttcatcggctgttcaccttccctaagtggtgcgattcgggtaaacccttggaacatcgatgctgtggctgatgcaatggactctgctttagagatgcctgaaggggagaaggtgctgagacatgagaagcaccacaaatatgtgagcacacatgatgttggatactgggcaaacagcttcttgcaagatctggagaggacttgtctggaccatagcaggaggcgttgttgggggataggattcgggctaaggtttagggttgtagcccttgatccaaacttcaagaagcttgcagttgagcaccttgtctcagcctaccggaggacgaccacgcgaatcattcttttggactatgacgggacgctgatgcctcaaacatcatttggtaagagcccaagctctaaaacgatagatatgctgaacagcctgtcccgtgatcagaacaacatggtcttccttgtgagcacaaagaagcggtcgactctagaagaatggttctcatcatgcgacaacctaggcttagctgctgagcatggatactttctcaggctgaagagagatgcagaatgggagacgtgtgtcccagtgacagacagaagctggaagcaaatcgcagagcctgtgatgaaaacatacaccgagacaacagatgggtcaacaattgaggacaaggagaccgcgatagtgtggagctacgaggatgctgatcctgattttggatcttgccaagccaaggagctccatgaccatctggagagtgtccttgcaaatgagccagttacagtaaaagctggcctgaaccatgtcgaggtgaagccacagggtgtaagcaagggccttgtggcaaaacggcttttgtcgataatacgggagaacagcctccttccggactttgtcctctgcatcggtgatgaccgctccgatgaagacatgttcgaggtgatcaccactgcagcacaggacaactgcctaagcccagacgccgaggtcttcgcctgcaccgttggtcgcaagcccagcaaggccaagtactacctggatgacctggccgacattgtgaggctgatccagggcctcgccaatgtctctgacgagatgcacagcacaatgcccacacctgtcgacgccgcagacaccgccctgaggtgaaaacacacctgccccagctccacccccaataaggcatgccatcttggaagaagggatcatcgatcgctgctccccccaggtgtacatactcgaagggatgcaacaaaaatgcaatcaaaacacatcatccaccatcttcatccctgcgtgttttcgcatcaaaataccaaacctttcaccggtgtgtacagaaactcggccgagaaattaaccccccccccccccatgttcttctatcaaaaactcagatccatctcaccatcacagtcagatcaggctccaaagtttggccgggatgaatccgcaaccactggagccggagccactccttttgctggcatggtgcaggtgtcaaatggttggtgcgtactaccctttggtggaggcgctaattatttcatcttctttctttcttttctttcgggctcgtgctgtactgtgcccatgtactgctgctgcacattgctgtggggctttggattggattaggtctcttccgttccagcttgtgtggtagcagcagtagttcttgctgccaatgatggatggcaatagtggaggcttgtgtttttcttggtgttatgccgtttgggggttaaaaaacaaagaggctatgatcatgctggtgatgagataaggctataatgctgtctatgttgaattgtagtaaccggctgtaaagagattaatgtgttcctggctgaattgagcaaaaaaaacatttcttcgtctgctccggctgggctaatcatcttctgatctctccgttctgtttgtgtttagttggccaacgtgatatgatgatggattttgatttttgacactaatgctggtcattcctcattttgtagtagcatttagttttctgaaccttggcgatgatactc

SEQ ID NO: 4736 - DNA, 1499 bp, Triticum aestivum
agcgaaaacagcagacagcagcagcagggcaacccaccaaatgccccaaaccctccgctccctcctcttctagggtttcctcctccccgtccgcgccgcccgcccgcccatggccgccacctccggcgacgccccggtcccgaccgccatgccggacctcgtccgtgaccacctctacttcggcggcatcaacgacgccatcgcggccctcaccgcctccctcccggacggtaccgacatcacccacgtcctctccgtcgtcagctccgcctccatctccttcttcaccgactaccgcccgggcctctccttgccagccgaggaggtccgccgcgtcgtcgccggggaggacggggcgccctcggcggtggccccggggcggctgatgcgggtggtggagaggaccggggaagggctaagggtgacgcggatggccgtgccgctcagggacacggaggaggagaacctgctcgaccacctcgagccgtgcctcgactttatcgacgaggggaggaaggcgggcaacgtgctcgtgcattgcttcgcgggggtctcgaggagtgctaccatcatcacggcatatctaatgagaacagagcagaaatctctggatgaagcactagagtccttgaaggaaattaatgagtccgtttgcccaaacgacggtttccttgaccagttaaaattgtttgaagaaatgggtttcaaggttgatacttcaagtcctttatacaggcgcttccgcttgaaattgttaggtcagtcctacaaagttggagagaaaatagggaaccatgtatttgaagacgatcctggagttgctcgacagcctaatcctaaccaggaattgtcaggcaaggagaagacccttaaaacagcataccgctgcaagaaatgcaggaggatcgttgctgcacaggacaatgttatcggccacactcctggcgagggcaactctagctttgcgtggcacgacaagaggaaaggccacacacacaacaaggaacaagattgttcctctctgtatgtcgagcctctaaagtggatgactccagtagaagatggtgctttggaggggaagctgtcgtgcatccactgcggggcgcgcctagggtacttcaactggtcagggatccagtgcaactgtggcagctggatcacccctgccttccaaatttccaagagcaaagttgatgtaagcaccatctagatcttctcccatgggctagcagattcgatgggtttgtcagggggtggtgtaaataccatatcgtctgaaccgtcatgcattggatcacaaggagcaaaagctggagcctgcttcatgcattcacctattgtactctgaaatactgtacctcacaacagcttacaggagaagtttaacacatcatagtgaagcagtcgcagatcctaaacgtttactacctgctttttcatcaattaagcggcaacctgatatatttttaacgttgtagggaattcacgagtgtggtgta

SEQ ID NO: 4737 - DNA, 1350 bp, Secale cereale
gactcagcggcatcagggcaacccccccaaatgcccccgctccctcctcttctagggtttcgtttccttctccccatccgccccgccctcccatggccgccgcctcccgcgacgctccggtcccggccgccatgccggacctcgtccgcgaccacctctactttggcggcatcaacgacgccatcgcggccctcaccgcctccctcccggacggcaccgacatcacccacgtcctctccgtcgtcagctccacctccatctccttcttcaccgactaccgcccgggcctctccttaccagccgaggaggtccgccgcgtcgtcgccggggaggacgggacgccctcggcgttggccccagggcggctgatgcgggtggtggagaggaccggggaagggctaagggtgacgcggatggccgtgccgctcaaggacacggaggaagagaacctgctcgaccacctcgagccgtgcctcgacttcatcgacgaggggaggaaggcgggcagcgtgctcgtgcattgcttcgcgggggtctccaggagtgctaccatcatcacggcatatctaatgagaacagagcagaaatccctggaagcactagagtccttgaaggaaattaatgagtctgtttgcccaaacgacggtttccttgaccagttaaaattgtttgaagaaatgggtttcaaggttgatacttcaagtcctttatacaggcgcttccgcttaaaattgttaggtcagtcctacaaagttggagagaaaataggggaccatgtatttgaagacgatcctggagttgctcgacagcctaatcctaacctggaatcgtcaggcaaggagaagacccttaaaacagcataccgctgcaagaaatgcaggaggatcgttgctgcacaggacaatgttatcggccacacacctggcgagggcaactctagctttgcgtggcacgacaagaggaaaggccacacatacaacaaggaacaagattgttcctctctgtatgtcgagcctctaaagtggatgactccagtagaagatggcgcattggaggggaagctgtcgtgcatccactgcggggcgcgcctagggtacttcaactggtcggggatccagtgcaactgtggcagctggatcacccctgccttccagatttccaagagcaaagtcgatgtaagcaccatctagatcttctcccatgggctagcagattcgatgggtttgtcgggggtggtgtaaataccatatcgtctgaaccgtcatgcattggatcacaaaaggagcaaaagctggagcctgcttcatgtattcacatattgtactctgaaatacagtacgtcacaaaagc

SEQ ID NO: 4738 - DNA, 6304 bp, Triticum aestivum
atgtgtactcaggcaaacagtcccgtcgtttctactacctttgtaccccgtgaatccgcatccttcgagcaagtccagccccgtgcgcgagtggcattcgtcgtctggaaccatcgtcacctcctaatcccatccgaaatcctcacttcgtctcaagccaaattaaaaaaaaaatcagttcctcccgccccttgtacaattcccatttgccccccgctcgatccagcgctgccgaattcgtgccgggtgctgccgattgagttctgatctggcggcgtgcggcgttggagggcccctggtttcggaagcggcgagggccatgcgaattgagtcgctgctgtgctgagcatgaagggtgggagcgctaaaggcctgggtgatgggatcaccggaggggcgcctcgttgagttgttgggagcagtcaagtcgcggatgccgcggcggggagagcactcgccgccgcctgcgccgaaggctgctgctgctgccgatgtgccacaggcgcagccgcatgacttgtccagagacttctggatgccggaccaaagttgccgggtgtgttacgactgcgatgcccagttcaccatccttaatcggcgtcaccactgccgccactgcggccgcgtgttctgtgcccgttgcacggccaactctgtgccccgctcgctgggggacgcggcgcgggaggacatcgagcggatcagggtctgcaactactgcttcaagcgctggctggaggaggaggcggccactcggagggatgtggcgcagccgtcgagcccgtcgccgtcggccacgagtgcggggagcgaaaagtcatgttccaccgggcgtagcagcacggtgaccaacggccagttgttgtcttacgcgaatgtcagctgcactgactctgcatcacggtcggtgggcagcgagggcaactgcggcgagctcgatgcttctctggagttgcagcatgctgtgatggagccggatggggccatggagcatgcggcttatgtggacaattcgcctgatccattcaacttctgcttgaataggagtgatgatgaagatgacgactacacaattttccgctctgattcggaagtacaccacctacaaaactctgatgagtacaatgggcctatgtgttttgatgatcatcaagttatttgcaatgatgctgctaaagattctgcatcaccaagaaaagatacagcaaccttagtcaattctgagggaatggataagactggtgatcatatcattgataatgctgaggagtgcaatgctcgatcttcttcgttgtatggcatggaagtgctagaaaatgaacttgtggattttgaaaacaatagctcactttggctacctccagaagccgaggatgaagaggatgaccatgatggtgctccatgtgatgatgatgagggggaggatgccacaggagaatggggttatctacgctcaaacagcttcagcagtggacattgtcgaagtagagataaatctgctgaggaacacaagaaagccatgaaagatattgttgatgggcattttcgggcattggtggcccaacttcttcaagctgaaaagatagaattgggtgataaaattggcaatgagagttggctagatatagttacctccttgtcttgggaagccgcatctcttttgagaccagataccagcaaaggaggacgtatggaccctggtggctatgtaaaggtgaaatgcttggcttgtggccgtccaagtgacagcttggttgtaagaggagttgtttgtaagaagaatgttgctcatcggcgcatgtcaacaaagaaggaaaagccacgaatcctaattcttggtggtgcacttgaatatcagcgtgtatcgaatttgctttcaagttttgatactttactgcagcaggaaacggattatctgaaaatggcagttgtaaagatcaaagcgcaccaaccaagtgttgtattggtagagaaatctgtgtctcgttatgctcaggatttgtttctggagaaaaacatttcacttgttttgaatatcaaaagaccacttctggaacggatatcccgttgcactggtgctcagatagttccctcgattgattatctgtcatcccaaaagctcgggaattgtgacttattccatgtggagaagtatattgaagagcatgggactgctggagaaggtgggaagaaaatgctgaagacccttatgttttttgaaggctgtccaaagcccttgggttttacaatcttgctaaaaggagctaatggggatgagttgaaaaaagtgaagcatgttgtgcaatatggagtcttcgcagcctatcacttggctcttgaaacatcttttcttgtagatgaaggtgcaaccctgccagaactccctcttaagtcgccgattattgttgctttgccggacaaaccttccagtgctgatagatccatttcaacgatacctattttgcaaatgcctactatttcatcacccaacaacaacctgcaagcatttgatattcaaaaggatgactttacattcaatggttttagaatgatggaccaaatggctgcagcatccttccctgataacaaatgctgggaaagattgggagttggttctacccaagcatcatcagttcaaatcaatgaccaaactggagacattggctgtttgcttggtatggaccctcaatcatataatgatcctctggttcagcagtcgagaatttcattctgccagtgtcctgcttgtactagagatgttggcagcaaaatgaaatttgaagaactccagcctgaaactaatgtcctgagtgtgttgtctgctcatcctgcaaatttggtggctgctgaaagtgatctttcatttgcccataacgccaacaatggtgccaaggtagcggctaagccatctgctcctctcaacttacaagtttcttataataatggcggttcaaatgacggttcaatagtaaaaagggatgaaattccagcatcccctgccgacaaccagagtatattagtttctctgtcctcgcgttgtgtttggaaagaagctatatgtgagcggccacaccttcttcgcataaaatattatggtaactttgacaaacctttaggcaggtttttgcgtgaccagctatttgatcagagcaattgttgtctctcttgtgagctggcaccagaggcccatgtttattgctatgttcacccccaaggcagcttaacaatatcagtgcggaaactcatagtgaagttacctggtgaacatgatggtaaaatctggatgtggcatagatgcttacgctgtccgcgcgataaagggctccctccagcaactaaaagagtagtgatgtctgatgctgcctggggcttatcttttggtaaatttttggaacttagtttttcaaatcatgcagcagcaagtagggtagccagctgtggtcattctcttcacagggactgccttcgtttttatggtttcggtgaaatggttgcttgcttccgatacgcatcaatcaaggttcactcagtctatttgcctccgtcgaaacttgattttacttcccagcatcaggaatgggtagagcaagaagcaaatgaggtggttgattcagctgaactcctgttcactgaagtactgaatgcactccatcaaatttcagagaaaaggccaattacaggctcttttgatggcaacatgaagatccttgagttaagacaaaacatagtagagttggaagatatcctacaagcagagaaggttgatttcacggagtcactaaagaatctactgaaaaaggaaatcagaaaggggcagttattcattgatattcttgaagttaacaaactaaggaggcagctactatttctttgttacttgtgggatcaacgcctaagtttcatagcaacctcaggtggcaagtattgcgctgctctgggaagtctacgagttggaagtaataattctgaaatcaatgatcgatcagctgataccaatacaaacacaaagttggagaagaactcaaagggcaccgattcaaatgcacttcacgctggtgatgaggggaccaaccagcatgatcaatctaatgaaacttgctcgagaaatactgaagagttgaatggtgctgaagatacaatagttgaaataaatcatgcaaatagcgctaatgtcagggatcatttagatcatcaaggatcgattatcggcgttcgtagggtttcttctgaaggtcagttcccagtagctactgacatttcagataaactggatgcaaaatggagaggtgaggatggacctgctcctgatgcaagcctggtgaaaccactagctctgttagaaggtacagctgctgatgtgaaaaaacaagcaaaggcagtaccacgccacacttctgcatctgtcaggtctggggatacagtagaagacttgctaagctgccttaaaatgccatacatgacattttataattcattgaacacaaactctggcacagcaccgacattcggaaccttggccgactacaatcctgtatacatttcattgtttcgcgatctatcacagcaaggtggagcaagactttttctgccaactggagctaatgatgttgttatcccggtatttgatgatgaaccgactagtattatttcttatgcacttgtttcacctgtgtatcactttcaaatgtcagttgagagcaatcaaaataaagacagtgcagattctacactttcgttgcctgtttatgattcaggaaattttaacctgttccatttatttgaggattttggatcctctgatgattttgctgcatcgatatcttccagtagagggtcctttgctcctgatctactgcactccagagtttcttttcaagatggtgggccacttgggaaagttaaatacactgtgacatgctattatgcaaaaagctttgaagaactcagaaggtcttgttgtccatcggagcttgattatttaagatctatcagtcgatgcaagaaatggggagcacaaggtggcaaaagtaatgtgttctttgcaaaatctctggatgatagatttattataaagcaggtcacaaaaacagagcttgaatcattccttcagttcggcccagattattttaagtatttgtcagagtccataagcactggaagccctacatgccttgcaaagattctgggaatctatcaggttacaattaagcatctgaaaggtggcaaggaatcaaaaatggatttgctcgtgatggaaaatctcttatttggacggaatattacgaggctttatgatctcaagggatcttcaaggtcaaggtataatgcagactccagcaggaacaaggtcctgcttgaccagaacttaattgaggcaatgccaacgtcgccaatttttgtcgggaacaaggcgaagcgccttcttgaaagagctgtttggaatgacacttcttttctagcaggaattgatgtaatggattattccttgcttgtgggtgttgatgaggagaaacatgagcttgtcctgggaataattgatttcatgaggcagtatacatgggacaagcaccttgaaacatgggtcaaatcttctggcattctaggtgggcctaagaatgccgctccaactgttgtctcaccgatgcagtacaagaagcggtttaggaaagcaatgtctgcttattttattgtgattcctgagcaatggatgcctgcaataatcaatccagaccagtcctcgtcaaatatttgtgaagacgattctcaaaatgcttcaccagagtagcacggcgctcggtgtgttattgatggatggtggttgccggatttggtcctactgcagtcatgagaaatgattaatttggtactcggccggcattgaaatgatcttcaggctgggcactgtattctcctgtggtcatttgcacagatcagattgcactcgccggtttccatctaatataaaaaaaaccatcacatgtgtatattcttgcgactgcaattgtgattagtttttcctgtgttgcctatatggtacatatatcaagtgtaagtgccttctcgtgtcttgtaggtggttttcattttggctagatgtaaacaacaggaattttgtaagtggttgttgtgtgtctgttgatttttagaggggctatccccgtttgtggtgtatataataacaaaataaaagttgagttagtgctaatgccccgtgtcaagattcatatgccaacaagaagctgtggagaacatatacacgtcagaacatggctctgtgggggcgaaatcactgttttgacccttt

SEQ ID NO: 4739 - DNA, 6276 bp, Secale cereale
gactggcgttcgtcgtctggaaccctcgtcacctcctaatccatccgaaatcctcaccttgccttaagccaaacaaaagaaaatcagtcctcccgcccctgcaattcccatttgctcccccgctcgatccagcgctgccgaattcgtgccgagcttggagtgcagccgattgagttctgatccggcggcgtgccgcgttggagtgcccctggtttcggaagcggcgagggccatgcgaattgagtcgctgctgctttgagcatgaggggtgggagcgctaaaggcctgggtgatgggatcaccggaggggcgcctcgttgagctgctgggagcagtcaagtcgcggatgccgcggcggggagagcactcgccgccgcctgcgccgaaggctgctgctgctgccgatgtgccgccggcgcagccgcatgacttgtccagagacttctggatgccggaccaaagttgccgggtgtgttacgactgcgatgcccagttcaccatccttaatcggcgtcaccactgccgccactgcggccgcgtgttctgtgcccgttgcacggccaactctgtgccccgctcgctgggggacgccgcgggggaggacatcgagcggatcagggtctgtaactactgcttcaagcgctggctggaggaggaggcggccgctcggagggatgtggcgcagtcgtcgagcccgtcgccgtcggccacgagtgcggggagcgaaaagtcatgttccaccgggcgtagcagcacggtgactaacggccagttgttatcttacgcgaatgccagctgcactgactctgcatcacggtcggtgggcagcgagggcaactgcggcaggctagacgcttctctggagttgcagcatgctgtgatggagccggatgggagcgtggagcatgcggcttatgtggacaattcgcctgatccattcaacttctgctcgaataggagtgatgatgaagatgatgactacacaattttctgctctgattcggaagtacaccacctacaaaactctgatgagtacaatgggcttatgtgttttgatgatcatcaagttgtttgcagtgatgctgctaaagattctgcatcgccaagaaaagatacagcaaccttagttaattctgagggaatggataagactggtgatcatatcattgataatgctgaggagtgcaatgctcgatcttcttcgttgtatggcatggaagtgctagaaaatgaacttgtggattttgaaaacaatagctcactttggctacctccggaagccgaggatgaagaggatgaccatgatggtgctccatgtgatgatgatgagggggaggatgccacaggagaatggggttatctacgctcaaacagcttcagcagtggacattgtcgaagtagagataaatctgctgaggaacacaagaaagccatgaaagatattgttgatgggcattttcgggcattggtggcccaacttcttcaagctgaaaagatagaattgggtgataaaattggcaatgagagttggctagatatagttacctccttgtcttgggaagccgcatctcttttgagaccagataccagcaaaggaggacgtatggaccctggtggctatgtaaaggtgaaatgcttggcttgtggccggccaagtgacagcttggttgtaagaggagttgtttgtaagaagaatgttgctcatcggcgcatgtcaacaaagaaggaaaagccacgaatcctaattcttggtggcgcacttgaatatcagcgtgtatcaaatttgctttcaagttttgatactttactgcagcaggaaacggattatctgaaaatggcagttgtaaagatcaaagtgcaccaaccaagtgttgtattggtagagaaatctgtgtctcgttatgctcaggatttgtttctggagaaaaacatttcacttgttttgaatatcaaaagaccacttctggaacggatatcccgttgcactggtgctcagatagttccctcgattgattatctgtcatcccaaaagctcgggaattgtgacttattccatgtggagaagtatattgaagagcatgggactgctggagaaggtgggaagaaaatgctgaagacccttatgttttttgaaggctgtccaaagcccttgggttttacaatcttgctaaaaggagctaatggggatgagttgaaaaaagtgaagcatgttgtgcaatatggagtcttcgcagcctatcacttggctcttgaaacatcttttcttgtagatgaaggtgcaaccctgccagaactccctcttaagtcgccaattattgttgctttgccggacaagccttccagtgctgatagatccatttcaatgatacctattttgcaaatgcctactatttcatcacccagcaacaacctgcaagcatttgatattcaaaaggatgactttacattcaatggttttagaatgatggaccaaatggcagcagcatccttccctgataacaaatgctgggaaagattgggagttggttctagttctacccaagcatcatcagttcaaatcaatgaccaaactggaaatattggctgtttgcttggtatggaccctcaatcatataatgatcctctggttcagcagtcgagaatttcattctgccattgtcctgcttgtactagagatgttggcagcaaaatgaaatttgaagaactccagcctgaaaccaatagacatccgatggctaatggtttgagtgtgttgcctgctcatcctgcaaatttggcggctgctgaaagtgatctttcatttgcccataatgccaacaatggtgccaaggtagcggctaagccatctgctcctctcaacttacaagtttcttataataatggcagttcaaatgacggttcaatagtaaaaagggatgaaattccagcatcccctgccgacaaccagagtatattagtttctctgtcctcgcgttgtgtttggaaagaagctatctgtgagcggccacaccttcttcgcataaaatattatggtaactttgacaaacctttaggcaggtttttgcgtgaccagctatttgatcagagcaattgttgtctctcttgtgagctggcaccagaggcccatgtttattgctatgttcacccccaaggcagcttaacaatatcagtgcggaaactcatagtgaagttacctggtgaacatgatggtaaaatctggatgtggcatagatgcttacgctgtccgcgtgataaagggctccctccagcaactaaaagagtagtgatgtctgatgctgcctggggcttatcttttggtaaatttttggaacttagtttttcaaatcatgcagcagcaagtagggtagccagctgtggtcattctattcacagggactgccttcgtttttatggtttcggtgaaatggttgcttgcttccgatacgcatcaatcaaggttcactcagtctatttgcctccgtcgaaacttgattttacttcccagcatcaggaatgggtagagcaagaagcaaatgaggtggttgattcagcggaactcctgttcactgaagtactgaatgcactgcatcaaatttcagagaaaaggccaattacaggctcttttgatggcaacatgaagatccttgagctaagacaaaacatagtagagttggaagatatcctgcaagcagagaaggtcgatttcacggagtcactaaagaatctactgaaaaaggaaatcagaaaggggcagttattcattgatattcttgaagttaacaaactaaggaggcagctactatttctttgttacttgtgggatcaacgcctaagtttcatagcaacctcaggtggcaagtattgcgatgctctgggaggtctacgagttggaagtaataattctgaaatcaatgatcgattagctgataccaatacaaacacaaagttggagaagaactcaaagggcaccgattcaaatgcacttcacgctggtgatgaggggatcaaccagcatgatcaatctaatgaaactagctcgagaaatactgaagagttgaatggtgctgaagatacaatagttaaaataaatcaggcgaacagcgctaatgtcagggatcatttagatcatcaaggatcaattatcggcgttcgtagggtttcttctgaaggtcagttcccagtagctactgacatttcagataaactggatgcaaaatggagaggtgaggatggacctgctcctgatgcaagcctggtgaaaccacgagctctgttagaaggtacagctgctgatgtgaaaaaacaagcaaaggcagtaccacgccacacttctgcatctgtcaggtctggggatacagtagaagacttgctaagctgccttaaaatgccatacatgacattttataattctttgaacacaaactctggtacagcaccgacatttgggaccttggccgactacaatcctgtatacatttcattgtttcgcgatctgtcacagcaaggtggagcaagactttttctgccaactggagctaatgatgttgttatcccggtatttgatgatgaaccaactagtattatttcttatgcacttgtttcacctgtgtatcactttcaaatgtcagttgagagcaatcaaaataaagacactgcagattctacactttcgttgcctgtttatgattcaggaaatttttaatctgttccatttatttgaggattttggatcctctgatgattttgctgcatcggtatcttccagtagagggtcctttgctcctgatctactgcactccagagtttcttttcaagatggtgggccacttgggaaagttaaatacactgtgacatgctattatgcaaaaagctttgaagaactcagaaggtcttgttgtccatcggagcttgattatttaagatctatcagtcgatgcaagaaatggggagcacaaggtggcaaaagtaatgtgttctttgcaaaatctctggatgatagatttattataaagcaggtcacaaaaacagagcttgaatcattccttcagttcggcccagattattttaagtatttgtcagagtccataagcactggaagccctacatgccttgcaaagattctgggaatctatcaggttacaattaagcatctgaaaggtggcaaggaatcaaaaatggatttgctcgtgatggaaaatctcttatttggacggaatattacgaggctttatgatctcaagggatcttcaaggtcaaggtataatgcagactccagcaggaacaaggtccttcttgaccagaacttaattgaggcaatgccaacgtcaccaatttttgtcgggaacaaggcgaagcgccttcttgaaagagctgtttggaatgacacttcttttctagcaggaattgatgtaatggattattccttgcttgtgggtgttgatgaggagaaacatgaacttgtcctgggaataattgatttcatgaggcagtatacatgggacaagcaccttgaaacatgggtcaaatcttctggcattcttggtgggcctaagaatgccgctccaactgttgtctcaccaatgcagtacaagaagcggtttaggaaagcaatgtctgcttattttattgtgattcctgagcaatggatgcctgcaataatcaatccagaccagtcctcgtcaaacatttgtgaagacgattctcaaaatgcttcaccagagtaacatggcgttctgtgcgttattgatggacggtggttgtcgggtttggtcctactgcagtcatgagaaatactgacctgatgaattttggtactcaggtggcaccgagatgatcttctggctgggcagtgtattctcctgtggtcatttgcacagatcagattgcaactcgccggtttccatctaataaaagaacccatcacgtgtatattcttgcttgtgattaatttttcctgcggtgtctatatggtgcatatataagtgtaagtgccttctcgtttcttgtaggtggttctcattttggctagatgtaaacaggaatttgggcattcttcttttgtatacgtggttgtgtgtctgttgatttttagaggggctatcgccgtatggtgtatataataacaacaaaataaaagtggagttagtgctaatgcctcgcgtcaagattcctatgccaacaaccagctgtggagaacatatacacgtcagaacatggctccccaggggccgaaatgtgttgacccttttcattaacttaagtacgatctgaccccaa

SEQ ID NO: 4740 - DNA, 6346 bp, Brachypodium distachyon
tccatctcgcctccccttcccttcctttctatcgctgccccgtgaatcggcaccctccaagcaagtccaggcctcccgtgctccactggcgctcttctggaaccctcatcacctcctaatcccagccaaaattcgctcttcgtcttaagccaaatcacttcgcgtcccgcaattcctgcttgcgcccccctgttcgatccagcgccaccaaatccgtatcgaccttgtagctgtcctgcccaattcggcggacgagctgtgcgagttgctgccgattgaagtgatctgatctggtggcgtgccgcggacggggcttgtgactggtcctggtttcggaagcggcgagggccatgcgagttggggtgccgctgggttgagcatgaggagtggtggggctgctgctgctgcaggtggtggtggtggcggcgtgcgtggccagggtgatgggatcaccggaggggcgaatcgttgatttgtttggagcagttaagttgtggatgccgcggcggggagagcgctcgccgtcgcctgcgccgaaggctgcggctgcggctgcggctgatgatgtgccgcagccgcatgacctgtccagggacttctggatgccggatcacagttgccgggtgtgctacgactgcgatacgcagttcaccatactgaatcggcgtcaccactgccgccactgcggccgcgtgttctgcgcccgctgcacggccaactctgtgccgcgcccgcccggggacgacccgcgggaggacggcgagcggatcagggtctgcaactactgctttaagcgctggctggaggaggaaacagccgggtggagcgaagtggcgcagccaccgagcccgtcgccgtcggccgcgagcgtcgggagcgacaagtcgtgctcgacgggacgtagcagcgtggtgacgaacggccatatgtcgtcgtatgccaatgtcagctgcggtgactttgcatctctgcccgccgacgacgagggagactgtgaccagcccggagtttctccagagaagaagcatgatgtgatggagccggctgggagcgtggaccatgtggctgatgtggataatgcgtccaatccattcaccttttgcttgaataggagtgatgatgaagatgaagattacacaatttttcgctctgattcgaaagtccacccacaaaaatctgatgaatactatggacctatgtgttttgatgaccatcaagttgtctgtggtgatgctgcaaaagaatctgtatccccaaggaaagatacatcgaccttagttgattctgttggagttgataagactggagatcatatcatcgataataatgaggagggcaatgctcgatcttcttccttgtatggcatggaagtgctagaaagtgaacttgtggattttgaaaacaatagctcactttggctacctcctgaagctgaggatgaagaggatgaccatgatggtgctctatgtgatgatgatgagggggaggatgccacaggagagtgggggtatatgcgctcaaacagctttggcagtggacattgtcgaagtagagataaatctgctgaggaacacaagaaagccatgaaagacattgttgatgggtatttccgggcattggtttctcaacttcttcaggctgaaaaggtaccattggttgatgaaactggcaaagagagttggctagatattgttacatctttgtcttgggaagctgcatctcttctgaaaccagatactagcaaaggaggacggatggaccctggtggctatgtcaaggttaaatgcttggcttgtgggcgtccaagtgacagcttggttgtaagaggagttgtttgtaagaagaatgttgctcatcggcgtatgtcatcaaagaaggaaaagccacgaatcctaattcttggtggtgcacttgaatatcagcgtgtatcgaacttgctttcaagtttcgatactttactgcagcaggaaacagattatctgaaaatggcagttgcaaagatcaaagcgcaccaaccaagtgttgtattggtagagaaatctgtatctcgttatgctcaggatttatttcttgagaaaaatatttcacttgttctgaatatcaaaagaccacttctggaaaggatatctcgttgcactggttctcatattgttccctcaattgattatttgtcatcccaaaaacttgggaattgtgacttattccatgtggagaagtatattgaagagcatgggactgctggagaaggtgggaagaaaatgctgaagacccttatgttttttgaaggctgcccaaagcccttgggttttacaatattgctaaaaggagctaatggtgatgagctgaaaaaagtgaagcatgttgtgcaatatggagtctttgcagcctatcacttggctcttgaaacatcatttcttgttgatgaaggtgcaaccctcccagaactccctctcaagtcaccaattattgttgctttgccggataaaccttccagtgctgatagatccatttcgacaatacctattttacaaatgcctactgcttcatcacccaacaatgatctgcaagcacttaatacgcaaaaggataattttccatttaatggttttagaataatggaccaaacggcagcagcatgctctcctgataacaaaagctgtgaaaggtccagagttagttctatccaaacgtcatctgttcaaatcaataaaaatgaaaacaactgtttgctcggtatggtccctcaatcatatattgatcccttgcttcagcagtcaagaatttcattttgtcactgccccacttgcactagagatgttggcagtgaattgaagtttgaagaacttcagcctgaaagcactagacatgcactggttaaaggtttcggtgtatcgcctgctcctcctgcaaatttggtatctgctgagcatgatttttcatttgcccataactctgagaatggtgtcaagatatcagataagtcatctgcccccctcgaattacaaacttctcatgatgatgacagttcaaaggattgttcgattgtaaaaaaggatgaagttccagcatctcctgttgacaatcagagtatattagtttctatgtcctctcgctgtgtttggaaagaagctgtctgtgagcggccacaccttcttcgcataaaatattatagcaactccgacaaacctctaggcaggtttctgcgtgaccagctatttgatcagaccaatcgttgtatctcttgtgaactggcaccggatgcccatgtttattgctatgttcatccccaaggcagcttaacaatatcagtgaggaaacttattgtaaagttacctggtgaacatgatggtagaatctggatgtggcatagatgcttacgctgtcctcgcaatgatgggctccctccagcaactaaaagagtagtgatgtctgatgctgcctggggcttatcttttggtaaatttttggaacttagtttttcaaaccatgcagcagcaagtagggtagccagctgtggtcattctcttcacagggactgccttcgtttttatggctttggtgaaatggttgcttgcttccgatatgcatctatcatggttcactcagtatatttgccaccatcaaaacttgatttcacttcccagcatcaagaatgggtagagcaagaagcaaatgaggtggttgactcagctgaactcctgttcactgaagtgctgaacgcgctccaccaaatttcagaaaaaaggccaattacaggctctttggatggcaacatgaagatacttgagttaagaagaaacatagtggagctggaagatatcctacaagaagagaaggctgatttcacggagtcactaaaaaatttactgaaaaaggaaatccgaaaggggcagttattcattgatattcttgaggttaacaaactaaggaggcggctactatttctgtgttacttgtgggatcaacggctaagcttcatagctacctcaggtggcaaatactgcgatgctctaggaggtctacaagttggaagtaggaattctgaaagcagcgataggccagctgatatcaatgcaaagttagaaaagaatccaaaggtcactgaacttctcttgaatgctaagaacggatccttgagacagagcctgagcacacctcatgctgacagagaggagctcaaccagcatgatcaatctaatgaaactagcttgagaaatattgcagagttgaattgtactgaagatacagtatttaagatcaaccatgcaaacagcgcaaatgtcaaggatcatttagatcatcaagaatctggcattggtgttcgtaggatttcttctgaaggtcagtttccagtaactgctgatatttcagacacattggatgcaaaatggagaggtgagaatggacctgctcctgatgcaagcatggtgaagcctctagctctgcctggaggtacagcccccgatgttaaaaatcatgttaaggcagtacgctgtcatacttctgctttatctgttaagactggcgatacagtagaagacttactaagctgccttaaattgccatacatgacactttataattcgttgaacacaaactctggtacagcaccgacatttgggaccctggctgactacagtcctgaatacatttcattgtttcgtgagttatcacagcaaggaggagcaagactttttgtgccaactggagctaatgatgttgttatcccggtatttgatgatgaaccgactagtattattgcttacgcacttgtttcacccatgtactacttgcaaatgtcagttgagaacagcaaaactaaagacagtgcagattcttcactttcattgcctgtatacgattcaggaaattttaatccgtttcttttatttgaggattttgggtcccctgatgatttagcttcatcaatatctgctagtagagggtccttggctcctgatctagtgcactctagagtatcttttgaagatggtgggccacttgggaaagttaaatacactgtgacatgctattatgcaaaaagctttgaagcactccgtaggtcgtgttgtccatcggagcttgattttgtaagatctgtcagtcgatgcaagaaatggggggcacaaggtggcaaaagcaacgtgttctttgcaaaatctctggatgatagatttataataaagcaggtcacaaagacagagcttgaatcattccttcagtttggcccagagtattttaaatatttgtcagagtccataagcactggaagccctacatgcctagcaaagattctggggatctatcaggttacaagcaagcatctaaaaggtggcaaggaatccaaaatggatcttctcgtgatggaaaatcttttatttggacggaatattacgaggctttatgatctcaagggatcttcaaggtcaaggtataatgcagactccagcaacaacaaggtccttcttgaccagaacttaattgaggcaatgccaaagtccccaatttttgttgggaacaaggcgaagcggcttctggaaagagctgtttggaatgatacttcttttctagcaggtattgatgtaatggattattccttacttgtgggtgttgaccaggagaaacatgaactggtcctgggaataattgattttatgaggcagtatacatgggacaagcaccttgaaacatgggtcaaatcttctggcattctcggtgggcctaagaatgcggctccaacagtagtttcaccaatgcagtacaagaagcggtttaggaaagccatgtctgcttatttcattgtgattcctgatcaatggatgcctgcagtaatcaacccggacagatcatcctcagatatttgccaagatgattctcaaaatacttcacaagagtaatatgatatcctgtgcaatactgacggacagagggtgccggatttggtcctactccaatcatgagaagtactgaccgactgatctggcgacccaggtggccttgaagtgatcttcagtatgaaccgtgtattctcctgtgcttatttgcacaggatctgattgcactcgctgattcccatctcaagaatcatagcatgtgtatattcctgctactgtaattatgcattagtctttttttctcgcctttgtctatatatagtacatatatcagtacaagtgttgtccggtcgtcgcttcaagggtagtttttatgaaccggggctctgcgaaataaaagctgagttcatgctattgcggtgaaataaaagttgagttcatgcagatttagagttcatgctgaatgaagcaagtcaattcacgcccctcaactcttggcgaaaacccttgct

SEQ ID NO: 4741 - DNA, 6672 bp, Oryza sativa
cgcctgtgagatgaggtagccggaggcggcaagaaaaaaaaagaagcaaataaccaaaaagccgaggaaaagaacagaaacaaacaacacccaatcaagaaaaatgaaaatgaaaagaaagaagaaaaaacaaaagaattatctgcctgaaaaaagatttgaaaaaacccggagacgcgttggtttaatccatctccccccctccccttttctatccctctcctcgtgaatcctcgcctctccagccgtcccgtgctccgctccactggcgcccttctggaaccctcaccccctcctaaatccaaccaaatttccctcttctcttagcccaaatcacttccccttgttccaaatcccgcttcgatccagcagccgcggtcgggttcgtggcgaggttggagtgctcctgccgaattcgggcggttttgctgggggcaccgagagttgctgccatctgtggtgatctgatccggcggcgcgcggcgggagtggtggtggtctccgttggttctggaagtggtggtaagagctatgtggattgaggcgtcgccggattgagcatgaggggtggggttgctggtggtggtggtggtggtggcggcggcggcggtgtgcgtggcctggatgatgggatcaccggaggggcggttagtggagctgtttggcgcggtgaagtcgtggatgccgcggcggggagatcactctccgcctccgccgctgccgccgccgccggcgtcgcaggtgggtgctgggggtggtggtggcgcggcatcgccgcagccgcatgatttgtcgagggacttctggatgccggaccagagctgccgcgtgtgctacgactgcgacgcgcagttcaccatcctgaaccggcgccaccactgccgccactgcggccgcgtgttctgtgcccggtgcacggccaactccgtgccgcgcgcgccgggggacgccgcgcgtgaggacggcgagcggatcagggtctgcaattactgcttcaggcgctggctggaggaggaggcggcggctcggagggacgtggcgcagccatcgagcccggtgctgagcccgtcggcgtctgccgtgagcatcgggagcgacaagtccagttcgactgcgcgtagcagcgccgggacgaacggccagatgtcgtcttacacgaatgttagctacactgacttcccatctatggcagtcgagggccagggtgagtgctgcgagagggaaggttgtgcagagaagcagctgcctgcaatggagccggctgggggcgtggagcctgcgacttatgtggacaacacatcggatccatacaattttggcataaataggagtgatgatgaggatgatgattatgcagttttccactcagattcaaaaacacaacacttgcaaaattctgatgagtacttcaaaactgtgtgttttgatgctcatcaagttgattgtagtcatgtaaaagaatctgtttctccgatgcaagatacggaaaattttattggttctgtgggagtagataagactggagatcacatcatggataatactgaggaatgcaatactcgatcttcttccttgtatagcatggaaatgctagaaaatgagcctgtagattttgaaaacaatagctcactctggctgcctcctgaacctgaggatgaagaggacgaccatgatggtgctttatgtgatgaggatgatggggaggatgccacaggagagtggggatatctacgctcaaacagttttggcagcggacattgtcgaagtagagataagtcagctgaggaacacaagagagccatgaaagacattgttgatgggcattttcgggcattggttgctcaacttcttcaggcggaaaaggtacagttggttgataaatctggcaaacagagttggctagatatagttacttctctgtcttgggaagctgcatctattctaaaaccagataccagcaaagggggacggatggaccctggtggctatgtgaaggtgaaatgcttggcttgtggtcgtccaagtgatagttttgttgtaaaaggagttgtttgtaagaagaatgttgctcatcggcgcatggcgtcacggaaagaaaagccacgcatcctgatccttggtggtgcacttgaatatcagcgcatatcgaatttgctttcaagttttgatactttactgcagcaggaaacagattatttgaaaatggcagttgcaaagatcaaagcccaccaaccaagtgtagtgttggtagagaaatctgtgtctcgatatgctcaggatttattcttggagaaaaacatttcacttgttctgaatatcaaaaggccacttctggaaaggatatcacgttgcactggtgctcatatagttccgtcaattgattacgtgtcatcccaaaagcttgggcattgtgatctattccatgtggagaaatatgttgaagagcatgggactgctggagaaggtggaaagaaaatgctgaagacccttatgttttttgaaggctgcccaaagcccttgggttgtacaatattgctcaaaggagctaatggcgatgagctgaaaaaagtgaagcatgttgtgcaatatggagtctttgcagcctatcacttggctctggaaacatcttttcttgtggatgaaggtgcaacacttccagaactccctcttaagtcaccaattattgttgctttgccagataagccttctagtgccgatagatccatttcaactatacctattttacaaatgcctactgcttcatcaccaaacgatagcttgcaagcatttgatgtgcaaacggatggttcaacatttaatggttttcaaacaatggaccaaacaatggtaatgtgctctcctgagtataaaagctgcaaaaaactgggagctggttctgcccaaaccgaatctgcccatttcaatggccaggataaaaatattgcctgtttgcatggtatggttccttggtcatctactgatcccttggttcagcaatcggccagttcactttgtcattgtccttcttgttctagagatgtagttaataaaaagcattttgaagaacgtcaacctgaaacatctggacataccctggataatgatttcaatgcgttgtctgcacatcgaacaaatttggagtctgttgagagcggtcacttatttgcctataattctgagaatggtgacaagataagagctaaactgtctgttcctctcaatgtgcaaatttctcttgatgatgacagttcaaaggatgattcagtaataaaaaaagatgaaattccggcatctcctgctgacaaccagagtatattggtttctctgtcttcccgttgtgtttggaaagaaactgtttgtcagcggccacaccttctccgcataaagtattatggcaactttgacaagcctttaggaagatttctgcgtgaccagctctttgatcagaacaataattgtatctcttgtgagttgccaccggaggcccatgtttattgctatgtccacccgcaaggcagcttaacaatttcagtgaggaaacttgcagtgaagttgcctggtgaacatgatggtaaaatatggatgtggcatagatgcttacgatgtcctcgtgttattgggctccctccagcgactaaaagagtagtgatgtctgatgctgcctggggcttgtcctttggaaaatttctggaacttagcttctcaaatcatgcggcagctagtagggtagccagttgtggccattctcttcacagggattgccttcgtttttacggctttggtgaaatggttgcttgcttccgatatgcatcgatcaaggttcattcagtgtatttgccaccaccgaaacttgatttcacttctcagcaccaggaatgggtagagcaagaagcaaatgaggtggttgactcagctgaacttctgttcactgaagtactgaatgcactccaccaaatttcagagggaaggccaattacaggttcttttgatggcaacatgaaaatcctcgagttaagaaggaacatcatggagctggaagagatcctgcaaatagagaaagcagattttacggaatcattgaagaatctactgaacaaggagatcagaaaggggaagccattcattgatattcttgaggttaacaaactaaggaggcagctactgtttctgtgttacctgtgggatcagcggctaatctttatagcaaattcaggtggcaagtactgtgacacactaggaggtttacgggttgggagtaggagttctgactctaacgataaatcagttgataccaatgcaactacaaaactagagaagagctcaaagggctccgaagttctttcaaatgctaaggaaggatccttgaagcagagccaaagtccacttcatgctaatgacaaggagcccaaccaacctgatcaatctaatggaaatagttcaaggattggtgcagggttgaatggcatggaagatgcgattgccaaaatcaatcattctaacagcgcagatgttaaggataacctggatcatcaagaatccagtattggtgttcgtagggttctttctgatggtcagtttccagtaaatgctgatatttcagacacattggatgcaaaatggagaggtgaaaatggaacagttcctgatacaagtatcctgaaaccattagctctgctagaaggttcagctgatcttaaaaaccaagctaaggcagtgccaaccaatgcttctttatctgtcaggtctggagatacagtagaagacttatcaagctggctcaaaatgccatacatgacattctatgactccttaaacacaaattctgggacagcaccgagatttggggccctggctgactacaatcctgtgtacattacattgttccgtgagttatcacagcaaggtggagcaagactttttctgccaactggagctaatgatgttgttattccagtatttgatgatgaaccgaccagtataatttcttatgcacttgtttcacccatgtactgtcaccaaatgttggatgagaacagcaagaacaaagatggtccagattcttcacttccattgcctgtatatgattctggaaattttaatccttttcatttatttgaggatttcggatccgctgatgatcttgcttcgtcaatatctggaaccagagggtcatttgttcccgatctagttcacctaagagttccctttgaggatggtggcccactcgggaaggtgaaatacacagtgacgtgctactatgcgaaaagctttgaagctcttagaaggtcttgctgtccatctgaacttgactttttaagatctatcagtcgatgcaagaaatggggagcacaaggtggcaaaagcaatgtgttttttgcaaaatctctggatgatagatttataataaagcaggtcacaaaaacagaacttgaatcattccttaagtttggactagattattttaaatatttatcagagtctataagcaccggaagccctacatcccttgcaaagattctgggaatctatcaggttacaattaagcatgtgaagggtggcaaggagtcaaaaatggatttacttgtgatggaaaatcttttatttggacggaatattacaaggctctatgatctcaagggatcttcgaggtcaaggtataatgctgattccagcagcaacaaggttcttcttgaccagaacttgattgaggcaatgccaacgtcaccaattttcgttgggaacaaggcaaagaggcttctggaaagagctgtttggaatgatacttcctttctggcaggaattgatgtgatggattactcattgcttgtgggagttgacgaggagaaacatgaattggttctgggaataattgattttatgaggcagtatacatgggacaagcacctcgagacatgggtcaaatcgtccggtattctcggcgggccgaagaatgcccctccaactgtgatttcacccatgcagtataagaagcggtttagaaaagctatgtctgcttattttattgtaattccggagcaatggatgcctgcaataatcaatccgagcaaatcatcatcaaatctttgccaagaagatcctcaaaatgcttcacaagagtagtacaatattcagttcattatgccaggcagagagcacctggttttttgtcttgatccaatcaaaagcgccaaacgatcagtctggatgctgcggcatcaatgtggtattacgactgcaattatcaaaatgcttggactctcatttgcacagatccgattgcagtggagtcgtcttggctcaagaatcatcgggtgtatatatccttgaaactgtaattatgcattagtttttttattttctttttgatttattatgtaataatataatgtcgtcgcttctctctagttcccattccattttggttggatgtaaacaatagaagtggggcattttttttttgtaagtgctcgttgtatattattatatatatatgccatgttatttatttgggggggctattgccgtctgtaataacaaaaataagagtagttcatgcaaatgtcctgcgtccaaactcttctggcaggagaatgttgaggtctggaataagaaacagaaactgccataaaagagaggccagaaagctccttctgtgtgcataacagctactgt

SEQ ID NO: 4742 - DNA, 1413 bp, Triticum aestivum
atttttttccgcataaatcatcctccgtcaccggcggggcgagggagacgcggtcggcgggcgagacgccagagacaaacccaacggagtttccccccctgccgccgaccccaaaccctagccgctccttccagccccagccgctcctaccgaccccagccagccgccggaattctcctgggtgttctgttggctttcctcaagcctgtagcttcatcgcggcagcatgagctctgctggttctgcaagggttccaaagaggagacggactaccaagacgtcggaggctgcagaccggcaacttcgggagcgacagtttctggacctgaacttgtttccagctgttgaagtagccagaactgggggttcactctccatcaatgagcctgtctcacacaggcagccccctcctacggtggctgccctgctttacgagaccacacaggtcgtggtgtcatctgctgctgcagagtcaaacattggcatgaatagtttccccatcaacgtggaagtgattgatgatgatgttgcgatttatacctcagggccgccccctcaagcaaggcaacagtcgtccaggacaggacctatcactgtgataatagatgatgattctgaaactactgctggaccagcaggggaagctcttgatgagcatgtgaacactctgctgtctctgggaatgaacccgaggcacaatccctcgagagcacaacccaacaccgaccttgtaataaacatagtagacacacctgagaccaacaacataccgcccaaggtggtgcaggctgtccctgaacctgtgaaggagatcccaaaggaaacaaagttcagctgcccagtctgcatgaatgagctggtcaatgcatcatcgaccatctgcggccacatcttctgccagaagtgcatcaaggcctccatccaggctcagaagaagtgccctacctgccggaggaagctgaccatgagcaacttccaccgggtctacctcccgacggcagataattaaacctatccgccattcttggagcattagagccgtggcagctgtgacccttttttggcaccggcattgtggtgattgtatctgagctattcttcacagggtcatcatgaacattcagttttttccccaacaatttaacaagtgctcgagacgtgattaccaatctgcatacctggtggtagtggacactgttagtagtctttccttgtgggaaagtggaaacctgtgcttggtactgtgagattaatgcttgaaaatatttgatacgtttcctgcgtgtttagttttttagtgtttcctgcttgtttaggtatatcattttttctgcgcaactctagaaaatgtttgggctcgttgtcacctaaattcagacccattgggcctgtatcctgtcacaccaacacata

SEQ ID NO: 4743 - DNA, 1421 bp, Secale cereale
tcagtctaaatttttaatttttttaccgtactaattaaaattactaattccttccgttcaccggcggggcgagggagacgcggtcggcgggcgagacgccagagacaaacccaacggagtttccccccctgccgccgaccccaaaccctagccgctcctaccagccccggccgctcctaccgaccccggccagcctccggaattctcctgggtgttctattggctttcctcaagcctgtagcttcatcgcggcagcatgagctctgctggttctgcaagggttccaaagaggagacggactaccaagacgtcggaggccgcagaccggcaacttcgggagcgacagtttctggacctgaacttgtttccagctgttgatgtagccagtactgggggttcactctccattaatgagcctgtctcacgcacgcagccccctcctacggtggctgccctgctttacgagaccacacaggtcgtggtgtcatctgctgctgcagggtcaaacattggcttgaatagtttccccatcaacgtggaggtgattgatgatgatgttgcgatttatacctcagggccgccccctcaagcaaggcaacagtcgtccaggacaggacctatcactgtgataatagatgatgattctgaaactactgctggaccagcaggggaagctcttgatgagcatgtgaacactctgctgtctctgggaatgaacccgaggcacaatccctcgagagcaccacccaacaccgaccttgtaataaacatagtagacacacctgagaccaacaacttaccgcccaaggtggtggaggctgtccctgaacctgtgaaggagatcccaaaggaaacaaagttcagctgcccagtctgcatgaatgagctggtcaatgcatcatcgaccatctgcggccacatcttctgccagaagtgcatcaaggcctccatccaggctcagaagaagtgccctacctgccgtaggaagctgaccatgagcaacttccaccgggtctacctcccgatggcagataattagacatatccgccattcttggagcattagagccgtggcagctgtgacccttttttggcaccggcgttgtggtgattgtatctgagctattcctcacagggtcatcatgaacattcagttttttccccaacaatttaacaagtgctcgagacgtgattaccaatctgcatacctggtggtagtggacactgttagtagtctttccttgtgggaaagtggaaacctgtgcttggtactgtgagattaatgcttgaaaatatttgatacgtttcctgcctgtttagcctttcttagcgttttctgcttctttaggtatatctatttttttctgtgcaactctagaaaatgtttgggctcgttgtcacctaaattcagactcattggg

SEQ ID NO: 4744 - DNA, 1210 bp, Pseudoroegneria spicata
  misc_feature (381)..(381): n is a, c, g, or t
  misc_feature (637)..(637): n is a, c, g, or t
  misc_feature (1130)..(1130): n is a, c, g, or t
  misc_feature (1173)..(1173): n is a, c, g, or t
  misc_feature (1179)..(1179): n is a, c, g, or t
ggcgagacgccagagacaaacccaacggagttccccccctgccgccgaccccaaaccctagccgctcctaccagccccagccgctcctaccagccccagccgccggaattctcctgggggttctattggctttcctcaagcctgtagcttcattgcggcagcatgagctctgctggttctgcaaggattccaaagaggagaaggactaccaagacgtcggaggctgcagaccgacaacttcaggagcgacagtttctggacctgaactcgcttccaggtgttgaaggagtcagtattgggggttcactctccattaatgagcgtgtctcacacagccagccccctcctacggtggttgagctggtttacgagaccacacanttcgtggtgtcatctgctgctgcagggtcaaacattggcatgaacagtttccccatcaatgtggaagtgattgatgatgatgttgcgatttatacctcagggccgccccctcaagcaaggcaacagtcgtccaggacaggacctatcactgtgataatagatgatgattctgaaactactgctggaccagcaggggaagctcttgatgagcatgtgaacactctgctgtctctggggatgaaccctaggcacaatncctcgagagcacaacccagcaccgaccttgtaataaacatagtagacgcacctgagaccaacaacataccgcccaaggttgcgcaggctgtccctgaacctgtgaaggagatcccaaaggaaccaaagtttagctgcccagtctgcatgaatgagctggtcaatgcatcatcgaccatctgtggccacatcttctgccagaagtgcatcaaggcctccatccaggctcaaaagaagtgccctacctgccggaggaagctgaccatgagcaacttccaccgggtctacctcccgacggcagaaaattaaacctatccagccattcttggagcattagagccgtggcagctgtgacccttttttggcaccgacattgtggtgattgtatctgagctattcttcacagggtcatcatgaacattcagttttttccccaacaatttaacaagtgctcgagacgtgattaccaatctgcatacctggtggtagtgganaccgtagtagtctttccttgtgggaaagtggatacctgtgctnggtacngtgagattaatgctcgaaaatatttgataca

SEQ ID NO: 4745 - DNA, 2653 bp, Triticum aestivum
ttccttttccaaatctccgtattaaactaacaatctgaatcgcgcagccccaagagcaagcaacctctgctctgctccagttgcctccctccctgccagtggcttagcatcagattctttctctctcagggcacagccaaaacagcagtgacagcacagggcggctgcgaagccagttccacttttttctcgatttattgctagttttctcgcttcccttttggtgctgattcttgtttagttagttaaccgcccgtacccaccgccaatccccagccccaggccgccgcctgctcttgccaaaccccaaccacccgcagcagtcagcacagcccgctttcttctgcatatcttgccggttcttcggccttgggattgattgctaagtgctaacggttcttggaaattcttcctggaagcaagctcactttagttttctcattcttctgttgccgtattgccaagttcgcggggttggataccgttgattgctcttgaagggaatacaaagggattgagcagaggcttgagttgaccgagcttgtcatggagccatccactgggttccgggcctctgtctggagctgcttcaagttcttgcccttcttttgtggccttcttctcctggggatcatcaaaggtgttctgtttggcccatgggcatggcttattatggcgatcggaatatctgcactcgttctgggattatggcctatgcatttgatttggacatactactgcatcatcagaaccaagctggtgggacctgttgtgaagctgcttcttcttatttctgtatctgggattttagtcttgtggctgatagttggcatccttggaagtgtacttgctgggttagcatacggctttctagcaccagtaatggccacatttgatgcactcggtgaaggaaaagaaagaccactggttcattgttttgtggatggaacatggagcactatcacaggaggctgtacagtagtcagggacctgaaagacatgctattccattcataccttgcatatatggatgatctacggtaccacgaacctcctggtggaaaaccatttgaaataagagtgcttgatattcctggcgcagtactcgctgctgcatgtggactcttaatggatgggataatgttcacagcaattgccttgtacaagttccctgtgatgcttttcaaaggatggaagcgactgattgaagatctagttggcagagaaggaccttttcttgagacagtgtgtgtgccattcgctggtctggctattcttctctggccatttgctgttttaggagccttcctagcctccatgatctccagtgttcctctaggcgcgtatgctgccattgtggtttatcaggaatcctcgcttttcatgggactatcttatgcaatatcatcagtatccatcttcgatgagtatacaaatgatgtacttgacatggcaccaggatcttgctttcctaggtttgtataccggaagaatcaagcttccgtggaaagtgtccgtggcccgctatcaaggcctgcctcattcagggataagcaagatggaaagaaagctccagcacggattacatcatttaagagtagctttgatgagttcaatccatttaagttgctagatcacctattcgaagagtgtcagcaccgtggcgaggctctggtcgctgaaggagtgataacaccaaaagatattgaagaaacaaagtcaggcaaaggcggcagcggagtgcttaatgtcggtttgccagcatatgttattctcaatgcactcctacgatctgcaaaggctgattccgatggcctgattctgagagatggctgtgaaatcacatctgacaacaggcctaagaatacactatttgattggttctttgaccctctgatggtcatcaaagatcaaatcaaagccgagaattttacagaagaggaggaggcgtaccttcagaaacgcgtactgttgatcagcgacccgaagcgcctcaaggccactcttccgcatttgccatccctgaatgagcgaaaacaagcagaaatagatgcatttgctcggagattgcaagggatcactaagtcgatatcaaggtacccgacatccaagcgccgtttcgatgaccttgtcaaagcgctttctgaggagcttgagagggcaatgggtggcagccgatctgtcagtggatcacagtttcagaagctcagaagcggccttgttcgaatgcttagccagagatcgatggggaagacagcaagcatccgaggaggtgatcaagaggcgcagctcacaagcgacactcgtgctgcataatatttcaaaaaagcggcgaagagaagatcgccgttgtccatttgtgtttcctgagttgattttcactaactttgtgcagagagctgactctagtgtatgggttatatattgcaaacttgcaaagctccatgttttagaaagcaaagttcgcctcgtttttttatctcaaaaatgtcgatttatgtggattttattagcttttatccaccaaaatggtgttacactgaaaataggatgagtccaaatttgaggatcattcattcgagtttgtgttattttggtgccttcacatgaatgttgcactaaataaattacaaacacgaatatccagtagttg

SEQ ID NO: 4746 - DNA, 2624 bp, Triticum aestivum
ccccatccctttcgtcttccttcccccttgcaacctgcaccccaccagcaaacaatctgagctcctttccttttccaaatctccgtattaaactaacaatctgaatcgcgcagccccaagagcaagcaacctctgctctgctccagttgcctccctcccctgccagtggcttagcatcagattctttctctctcagggcacagccaaaacagcagtgacagcacagggcagctgcggctgcgaagccagttccacttttttctcgatttattgctagttttctcgcttcccctttggtgctggttcttgtttagttagttaaccgcccgtacccaccgccaatcccaagcccgaggccgcctgctcttgccaaaccccaaccacccgcagcagtcagcacagcccgctttcttctgcatatcttgccggttcttcggccttgggattgattgctaagtgctaacggttcttggaaattcttcctggaagcaagctcagttttgttctcattcttctgttgccgacttgccgtcttgccaagttcgtggggttggataacgttgcttgctcttgaagggaatacaaagggattgagcagagtcttgagttgaccgagcttgtcatggagccatcgactgggttccgggcctctgtctggagctgcttcaaattcttgcccttcttctgtggccttcttctcctggggatcatcaaaggtgttctgtttggcccatgggcatggcttattatggcgatcggaatatctgcactcgttctgggattatggcctgtgcatgtgatttggacatactactgcatcatcagaaccaagctggtgggacctgttgtgaagctgctgcttcttatttctgtatctgggattttagtcttgtggctgatagttggcatccttggaagtgtacttgctgggttagcatacggctttctagcaccagtaatggccacatttgatgcactcggtgaaggaaaagaaaggccactggttcattgttttgtggatggcacatggagcactatcacaggaggctgtacagtagtcagggacctgaaagacatgttattccattcataccttgcatatatggatgatctacggttccacgaacctcctggtggaaaaccatttgaaataagagtgcttgatattcctggcgcagtactcgctgccgcatgtggactcttaatggatgggataatgttcacagcaattgccttgtacaagttccctgtgatgcttttcaaaggatggaagcgacttattgaagatctagttggcagagaaggaccttttcttgagacagtgtgtgtgccattcgctggtcttgctattcttctctggccatttgctgttttaggagccttcctagcctccatgatctccagtgttcctctaggcgcatatgctgccattgtggtttatcaggaatcctcgcttttcatgggactatcttatgcaatatcatcagtatccatcttcgatgagtatacaaatgatgtacttgacatggcaccaggatcttgctttcctaggtttgtataccggaagaatcaagcttccatggaaagtggccgtggcccgctctcaaggcctgcctcattcagggataagcaagatggaaagaaagctccagcacggattacatcatttaagagtagctttgatgagttcaatccatttaagttgctagatcacctattcgaagagtgtcagcaccgtggcgaggctctggtcgctgaaggagtgataacaccgaaagatattgaagaaacaaagtcaggcaaaggcggcagcggagtgcttaatgtcggtttgccagcatatgttattctcaatgcactcctacgatctgcaaaggctgattccgatggcctgattctgagagatggctgtgaaataacatctgacaacaggcctaagaatacactatttgattggttctttgaccctctgatggtgatcaaagatcaaatcaaagccgagaattttacagaagaggaggaggcgtaccttcagaaatgcgtgctgttgatcagcgacccgaagcgcctcaaggcgactcttccgcatttgccatccctgaatgagcgaaaacaagcagaaatagacgcatttgctcggagattgcaagggatcacaaagtcgatatcaaggtacccgacatccaagcgccgtttcgacgacctagtcaaagcgctttctgaggagctggagagggcaatgggcggcagccgatctgtcagtggatcacagtttcagaagctcagaagcggccttgttcgaatgcttagccagagatcgatggggaagacagcaagcatccgaggaggtgatcaagaggcgcagctcacaaacgacgctggtgctgcgtaatatttcaaaaaagcggtgaagagaagatcgccgttgtccatatgtgtttcctaagttgtttttcactaactttgtacagagagctgactctagtgtgtgggttaaacttgcaatgctccatgtttcagaaagcaaagttcgcctcattttttaatctaaaaaatgtcgatttatgtggattttattagcttttatccaccaaaatggtgttacagtgaaaataggaggagtc

SEQ ID NO: 4747 - DNA, 2222 bp, Triticum aestivum
cccgctttcttctgcatatcttgccggttcttcggccttgggattgattgctaagtgctaacggttcttggaaattcttcctggaagcaagctcagttttgttctcattcttctgttgccgacttgccgtcttgccaagttcgtggggttggataacgttgcttgctcttgaagggaatacaaagggattgagcagagtcttgagttgaccgagcttgtcatggagccatcgactgggttccgggcctctgtctggagctgcttcaaattcttgcccttcttctgtggccttcttctcctggggatcatcaaaggtgttctgtttggcccatgggcatggcttattatggcgatcggaatatctgcactcgttctgggattatggcctgtgcatgtgatttggacatactactgcatcatcaggcagaaccaagctggtgggacctgttgtgaagctgctgcttcttatttctgtatctgggattttagtcttgtggctgatagttggcatccttggaagtgtacttgctgggttagcatacggctttctagcaccagtaatggccacatttgatgcactcggtgaaggaaaagaaaggccactggttcattgttttgtggatggcacatggagcactatcacaggaggctgtacagtagtcagggacctgaaagacatgttattccattcataccttgcatatatggatgatctacggttccacgaacctcctggtggaaaaccatttgaaataagagtgcttgatattcctggcgcagtactcgctgccgcatgtggactcttaatggatgggataatgttcacagcaattgccttgtacaagttccctgtgatgcttttcaaaggatggaagcgacttattgaagatctagttggcagagaaggaccttttcttgagacagtgtgtgtgccattcgctggtcttgctattcttctctggccatttgctgttttaggagccttcctagcctccatgatctccagtgttcctctaggcgcatatgctgccattgtggtttatcaggaatcctcgcttttcatgggactatcttatgcaatatcatcagtatccatcttcgatgagtatacaaatgatgtacttgacatggcaccaggatcttgctttcctaggtttgtataccggaagaatcaagcttccatggaaagtggccgtggcccgctctcaaggcctgcctcattcagggataagcaagatggaaagaaagctccagcacggattacatcatttaagagtagctttgatgagttcaatccatttaagttgctagatcacctattcgaagagtgtcagcaccgtggcgaggctctggtcgctgaaggagtgataacaccgaaagatattgaagaaacaaagtcaggcaaaggcggcagcggagtgcttaatgtcggtttgccagcatatgttattctcaatgcactcctacgatctgcaaaggctgattccgatggcctgattctgagagatggctgtgaaatcacatctgacaacaggcctaagaatacactatttgattggttctttgaccctctgatggtcatcaaagatcaaatcaaagccgagaattttacagaagaggaggaggcgtaccttcagaaacgcgtactgttgatcagcgacccgaagcgcctcaaggccactcttccgcatttgccatccctgaatgagcgaaaacaagcagaaatagatgcatttgctcggagattgcaagggatcacaaagtcgatatcaaggtacccgacattcaagcgccgtttcgacgacctagtcaaagcgctttctgaggagctggagagggcaatgggcggcagccgatctgtcagtggatcacagtttcagaagctcagaagcggccttgttcgaatgcttagccagagatcgatggggaagacggcaagcatccgaggaggtgatcaagaggcgcagctcacaaacgacgctggtgttgcgtaatatttcaaaaaagcggtgaagagaagatcgccattgtccatatgtgtttcctgagttgattttcactaactttgtgcagagagctgactctagtgtatgggttatatattgcaaacttgcaaagctccatgttttagaaagcaaagttcgcctcgtttttttatctcaaaaatgtggattatgtggattttattagcttacattgtccaccaaaatggtgttacagtg

SEQ ID NO: 4748 - DNA, 2435 bp, Triticum aestivum
gggaagcaacctctgctctgctccagttgcctccctccctgccagtggcttagcatcagattctctctctctcagggcacagccaaaacagcagtgacagcacagggcggctgcggctgcggctgcgaagccagttccacttttttctcgatttattgctagttttctcgcttcccctttggtgctggttcttgtttagttagttaaccgcccgtacccaccgccaatcccaagcccgaggccgcctgctcttgccaaaccccaaccacccgcagcagtcagcacagcccgctttcttctgcatatcttgccggttcttcggccttgggattgattgctaagtgctaacggttcttggaaattcttcctggaagcaagctcagtttagttttctcattcttctgttgccgtcttgccaagttcgtgcggttggatggcgttgattgctcttgaagggaatacaaggggaattagcagagtctcgagttgaccgagcttgtcatggagccatcggctgggttccgggcctctgtctggagctgcttcaagttcttgcccttcttctgtggccttcttctcctggggatcatcaaaggtgttctgtttggcccatgggcctggcttattatagcgatcggtatttctgcactcgtcctggggttatggcctatgcatgtgatttggacgtactactgcatcataagaaccaagctggtgggacctgttgtgaagctgctgcttcttatttctgtatctgggattttagtcttgtggctgatagttggcatcgttggaagcgtacttgctgggttagcatacggctttctagcaccagtaatggccacatttgatgcactcggtgaaggaaaaaaaaggccactggttcattgctttgtggatggcacatggagcactatcacaggaggctgtacagtagtcagggacctgaaagacatgctattccattcatatcttgcatatatggatgatctacggtaccacgaacctcctggtggaaaaccatttgaaataagagtgcttgatattcctggcgcagtactcgctgctgcatgtggactcttaatggatgggataatgttcacagcaattgccttgtacaagttccctgtgatgctttttaaaggatggaagcgactgattgaagatctggttggcagagaaggacctttccttgagacagcgtgtgtgccattcgctggtctggctattcttctctggccatttgctgttttaggagccttcctagcctccatgatctccagtgttcctctaggcgcatatgctgccattgtggtttatcaggaatcctctcttttcatgggactatcttatgcaatatcatcagtatccatctttgatgagtatacaaatgatgtacttgacatggcaccaggatcttgctttcctaggtttgtataccagaagaatgaagcttccgtggaaagtacccgtggcccgctgtcaaggcccgcctcattcagggataagcaagatggaaagaaagctccagcacgggttacatcatttaagagtagctttgatgagttcaatccatttaagttgctagatcacctattcgaagagtgtcaccaccgtggcgaggctctggtcgctgaaggagtgataacaccgaaagatatcgaagaaacaaagtcaggcaaaggcggcagcggagtgcttaatgtgggtttgccagcatatgttattctcaatgcactcctacgatctgcaaaggctgattccgatggcctgattctcagagatggctgtgaaataacatctgacaacaggcctaagaatacactatttgattggttctttgaccctctgatggtcatcaaagatcaaatcaaagccgagaattttacagaagaggaggaggcgtaccttcagaaacgcgtactgttgatcagcgacccgaagcgcctcaaggcgactcttccgcatttgtcatccctgaatgagcgaaaacaagcagaaatagatgcatttgctcggagattgcaagggatcacaaagtcgatatcaagatacccgacattcaagcgccgtttcgacgacctagtgaaagcactttctgaggagctggagagggcaatgggcggcagccgatctgtcagtggatcacagtttcagaagctcagaagcggtcttgttcgaatgcttagccagagatcgatggggaagacggcaagcatccgaggaggtgatcaagaggcgcagctcacaaacgacgctggtgttgcgtaatatttcaaaaaagcggtgaagagaagatcgccattgtccatatgtgtttcctgagttgattttcactaactttgtgcagagagctgactctagtgtatgggttatatattgcaaacttgcaaagctccatgttttagaaagcaaagttcgcctcgttttttatc

SEQ ID NO: 4749 - DNA, 2694 bp, Triticum aestivum
gcgcagccccaagagcaagcaacctctgctctgctccagttgcctccctccctgccagtggcttagcatcagattctttctctctcagggcacagccaaaacagcagtgacagcacagggcagctgcggctgcgaagccagttccactttttttctcgatttattgctagttttctcgcttcccctttggcgctgattcttgtttacttagttaaccgcccgtacccaccgccaatccccaggccgccgcctgctcttgccgaaccccaaccacccatagcagtcagcacagcccgctttcttctgcatatcttgccggttcttcggccttgggattgattgctaagtgctaacggttcttggaaattcttcctggaagcaagctcagtttagttttctcattcttctgttgccgtcttgccaagttcgtgcggttggatggcgttgattgctcttgaagggaatacaaggggaattagcagagtctcgagttgaccgagcttgtcatggagccatcggctgggttccgggcctctgtctggagctgcttcaagttcttgcccttcttctgtggccttcttctcctggggatcatcaaaggtgttctgtttggcccatgggcatggcttattatggcgatcggaatatctgcactcgttctgggattatggcctatgcatgtgatttggacatactactgcatcatcagaaccaagctggtgggacctgttgtgaagctgctgcttcttatttctgtatctgggattttagtcttgtggctgatagttggcatcgttggaagcgtacttgctgggttagcatacggctttctagcaccagtaatggccacatttgatgcactcggtgaaggaaaaaaaaggccactcgttcattgctttgtggatggaacatggagcactatcacaggaggctgtacagtagtcagggacctgaaagacatgctattccattcatatcttgcatatatggatgatctacggttccacgaacctcctggtggaaaaccatttgaaataagagtgcttgatattcctggcgcagtactcgctgccgcatgtggactcttaatggatgggataatgttcacagcaattgccttgtacaagttccctgtgatgcttttcaaaggatggaagcgacttattgaagatctagttggcagagaaggaccttttcttgagacagtgtgtgtgccattcgctggtcttgctattcttctctggccatttgctgttttaggagccttcctagcctccatgatctccagtgttcctctaggcgcatatgctgccattgtggtttatcaggaatcctcgcttttcatgggactatcttatgcaatatcatcagtatccatcttcgatgagtatacaaatgatgtacttgacatggcaccaggatcttgctttcctaggtttgtataccggaagaatcaagcttccatggaaagtggccgtggcccgctctcaaggcctgcctcattcagggataagcaagatggaaagaaagctccagcacggattacatcatttaagagtagctttgatgagttcaatccatttaagttgctagatcacctattcgaagagtgtcagcaccgtggcgaggctctggtcgctgaaggagtgataacaccgaaagatattgaagaaacaaagtcaggcaaaggcggcagcggagtgcttaatgtcggtttgccagcatatgttattctcaatgcactcctacgatctgcaaaggctgattccgatggcctgattctgagagatggctgtgaaataacatctgacaacaggcctaagaatacactatttgattggttctttgaccctctgatggtgatcaaagatcaaatcaaagccgagaattttacagaagaggaggaggcgtaccttcagaaatgcgtgctgttgatcagcgacccgaagcgcctcaaggcgactcttccgcatttgccatccctgaatgagcgaaaacaagcagaaatagacgcatttgctcggagattgcaagggatcacaaagtcgatatcaaggtacccgacatccaagcgccgtttcgacgacctagtcaaagcactttctgaggagctggagagggcaagtgggcggcagccgatctgtcagtggatcactagttcagaagctcagaagcggtcttgttcgaatgcttagccagagatcgagtgggaagacagcaagcatccgaggaggtgatcaagaggcgcagctcacaagcgacactcgtgctgcataatatttcaaaaagcggcgaagagaagatcgccgttgtccatttatgtttcctgagttgattttcactaactttgtacagagagctgaccctggtgtatgggctgtatattgcaaacttgcaatgctccatgtttcagaaagcaaagttcgcctcattttttaatctaaaaaatgtcgatttatgtggattttatagcttttatccaacaaatggtgttacagtgaaaataggactctccaacaatattcgacgatcacccgtttgagtttgtgttattttggtactttcactagtagaattgttgtaactaaataaattagtgaacagtagtagtttgttttacttacaaaaaagaaaagtaccgatgcgtgccgctcgtctagaacgtactcgtacgacgacgacacgaggagagcg

SEQ ID NO: 4750 - DNA, 2136 bp, Triticum aestivum
atctgggctcctttccttttccaaatctccgtattaaactaacaatctgaatcgcgcagccccaagagcaagcaacctctgctctgctccagttgcctccctccctgccagtggcttagcatcagattctctctctctcagggcacagccaaaacagcagtgacagcacagggcggctgcggctgcggctgcgaagccagttccacttttttctcgatttattgctagttttctcgcttcccctttggcgctgattcttgtttacttagttaaccgcccgtacccaccgccaatccccaggccgccgcctgctcttgccgaaccccaaccacccatagcagtcagcacagcccgctttcttctgcatatcttgccggttcttcggccttgggattgattgctaagtgctaacggttcttggaaattcttcctggaagcaagctcagtttagttttctcattcttctgttgccgtcttgccaagttcgtgcggttggatggcgttgattgctcttgaagggaatacaaggggaattagcagagtctcgagttgaccgagcttgtcatggagccatcggctgggttccgggcctctgtctggagctgcttcaagttcttgcccttcttctgtggccttcttctcctggggatcatcaaaggtgttctgtttggcccatgggcctggcttattatagcgatcggtatttctgcactcgtcctggggttatggcctatgcatgtgatttggacgtactactgcatcataagaaccaagctggtgggacctgttgtgaagctgctgcttcttatttctgtatctgggattttagtcttgtggctgatagttggcatcgttggaagcgtacttgctgggttagcatacggctttctagcaccagtaatggccacatttgatgcactcggtgaaggaaaaaggccactcgttcattgctttgtggatggaacatggagcactatcacaggaggctgtacagtagtcagggacctgaaagacatgctattccattcatatcttgcatatatggatgatctacggttccacgaacctcctggtggaaaaccatttgaaataagagtgcttgatattcctggcgcagtactcgctgccgcatgtggactcttaatggatgggataatgttcacagcaattgccttgtacaagttccctgtgatgctttttaaaggatggaagcgactgattgaagatctggttggcagagaaggacctttccttgagacagcgtgtgtgccattcgctggtctggctattcttctctggccatttgctgttttaggagccttcctagcctccatgatctccagtgttcctctaggcgcatatgctgccattgtggtttatcaggaatcctctcttttcatgggactatcttatgcaatatcatcagtatccatctttgatgagtatacaaatgatgtacttgacatggcaccaggatcttgctttcctaggtttgtataccagaagaatgaagcttccgtggaaagtacccgtggcccgctgtcaaggcccgcctcattcagggataagcaagatggaaagaaagctccagcacggattacatcatttaagagtagctttgatgagttcaatccatttaagttgctagatcacctattcgaagagtgtcagcaccgtggcgaggctctggtcgctgaaggagtgataacaccgaaagatatcgaagaaacaaagtcaggcaaaggcggcagcggagtgctatgcggtttgccagcatatgttattctcaatgcactccaacgatctgcaaaggctgattccgatggcctgattctgagagatggctgtgaaataacaatctgacaacaggcctaagaatacactatttgattggttctttgaccctctgatggtgatcaaagatcaaatcaaagccgagaattttacagaagaggaggaggcgtaccttcagaaatgcgtgctgttgatcagcgacccgaagcgcctcaaggcgactcttccgcatttgccatccctgaatgagcgaaaacaagcaaaaatagacgcatttgctcggagattgcaagggatcacaaagtcgatatcaaggtacccgacatccaagcgccgtttcga

SEQ ID NO: 4751 - DNA, 2528 bp, Oryza sativa
gcaccacgcgacgcatccggtcgggaccatcccttccttccctccccttccctgccaaactcccagcttcgcgctgcctcgctgccgctgccgccgccgccgcgacccccacttctccgccagcaaagcgagctgctctgctccggttgccttcctccctaagcctgctctgctcgcgggcaccagattcggcgggcagcgaagcagacagctctctccgcccctgccttttctgtttcttgattagtataatatcaattaggaggcttttctttgctttcgatgggtgtgtgcgtgcgtgttggtaattttgattagttagcggcccatcctagccacgcgacgccgatctccagggcgcggctgttcttgccaaaccgcaaccaccactagcccccacttcgtccggttttaattttcaattatcttggcagttcgtgagcctttcgttttcttggggctccagggtttcgcgtctctctctggtttggactttgagacttgacgacgctctggtgagcgggttgatcggcgttgaggaagagattgggcggaaggttgtcgatggagccgccgtctgggattcgggcatctgcctggagcttcttcaagttcctgcctttcttccttggccttctcctcctggggatcatcaaaggtgctttgctcttcccatgggcatggcttatcatgatgatcggaatctctgcactcgttcttggcttatggcctatgcatgtgatctggacatactactgcatcatcagatccaagcttgtcgggcctgttgtaaagctgcttcttcttgtcgccgcatctgtgattttagtcttatggctcattgtcgggatcgtgggaagtgtcctaattggtgtggtgtatggttttctcgctccagtaatggccacatttgatgcagttggagaaggaaaagaaagaccactataccactgttttgtggatggaacatggagtactataacaggaagctgtacagtagttagggacctgaaagatttattattgcattcatatttttcaataatggatgaccttcgttttcatgcacctcctggaggagagccatatgaaataagagtgcttgacattcctggtgcattattcgctgctgcgtgtggatttctagtggatggaataatgttcacactaattgccttctacaagttccctgtgatgcttttcaaaggatggaagcggctgatcgaagacttagtcggcagggaaggacctttcctggagacagcttgtgtgccatttgctggtcttgctattcttctgtggccatttgctgtttttggagcttttctagcctccatcatctccagtattcctttaggtgcttttgctgctgttgtggtttatcaggaatcctcgcttatcatgggactaaattatgtaatatcatcagtggccatctttgatgaatatacaaatgatgtgcttgacatggcaccaggatcctgctttcccaggtttaaataccggaaaaatgaagcttcgacagagggtggttcattatcaaggcctgcctcatttaaggacaagcaagacgggaagaaagctccatcacgtgttacatcgtttaagggcagctttgatgagttcaatccatttaagttgctagatcacctgtttgaggagtgtaagcaccgtggagaggttctggttgctgaaggagtgataacaccaaaagacattgaagaaacaaagtcaggaaaaatcgggattggagtacttaatgttggtttgccggcatatgttattcttcacgcactcattagatctgcaaaagctaattctgatggcctaattttaagtgatggttctgaaataacatctgataacaggcctaagaacacaatctttgattggttctttgatcctctgatggtcatcaaagagcaaataaaagcccagaattttacagaagaggaagaagcatacctcaagaagcgagtgctgctgaccagtgatccgaagcgcctcaaagaggttgttcctcatctgccatcatcactgaatgagcgaaaacaagctgaaatcgacgcactttcccggagattgcaaggaatcacaaggtcgatatcaaggtacccaacggccaagcgtcgtttcgacgaccttgtcagatcactctcggaagagctcgagaggacaatgggtggcagccaatctggcagtgtgtcccagatgcagaaactgagaagcggcatcagccgaatgctcagccagagatccatggggaagaggacgagcaaccgtggtgatgatcgggaggcgcagttgacaattgatccctaacatctccagaaagttcagacagaatttcttcgtcgtctttctagagctactttagctgtcttgatttgtacagaactgtttagaccggtgtatgaactaattctaaccactcttgaatgaaatggatgttgcaagattctgtgtttttggaatcaagcccacacatcttagaataatcggtgcccccaaatacgatgccacctggc

SEQ ID NO: 4752 - DNA, 3172 bp, Secale cereale
gtcgcacgcacacgcggtgaggccggcgccgctcccagactccaccccctccaaaaccccccactcccctgcgaatcccccaccagaaatcgcgcggagccatggccgccgccgtccggagaaacgtcgctccctcgcccgccggagccgcgcgtcttcgccaagccttgatggtgtagggagaggtgctagagggggcaggtaagtgggagagcgaatgggggtgattggaggcggcgagtccgtgcagtgggacaagatgaatggagccgaggtgatgaacggcggtggaagtggtgcaggaagcctggataggatacaagtgttagtgagggtgaggccgctgagtgacaaggagattgcaaggggtgagcccgcggagtgggagtgcatcaatgacaccaccatcatgtttcggagtaccttcccggatcgacccacggctccaaccgcatacacatttgacagggtatttcattctgagtgcagtacgaaagaagtctaccaggaaggggttaaggaagttgccctctctgtagttagtggcattaactcaagtgtttttgcgtacgggcaaacaagtagtgggaagacatacactatgactggagtgacagaatgcacagtagctgatatatatgactatattagcaagcatgaggagagagcattcgtgttgaaattctcagcaattgaaatatataatgaagttgttagggatcttctgagtgcagaaaatactcctcttagactttgggatgatgcagagaaaggcacctacgtggagaatcttacggaggttatattaagggactggaaccacctcaagggacttatttctgtttgtgaagctcaaaggagaacgggggagaccttcttaaatgaaaaaagctccagatcccatcaaatacttaaattgactgttgaaagttctgctcgtgaattcttaggaaaggacaagtcaactacccttgtggctagtgtgaactttgttgatctggcaggaagtgagcgtgcatctcaggctatgtcagctggcacaaggctgaaagaaggttgccacattaataaaagtttgctttcccttggcaccgtcattaggaagctaagcatggggagtaatgcacacgtaccatatagagattccaagcttacacgcatattacaaccttctttgggaggcaatgcaagaaccgcgattatttgtacactcagccctgcgacaagtcacattgagcaatcaagaaatacactgtttttcgggagttgtgcaaaggacgtagttacaaatgctcaggttaatgtggtcatgtctgataaaacactggttaagcatttgcaaaaggaacttgctagactggagagtgaattgcggcatccagtttcaaactctagtctggaagcacaggtgaaggaaaaggacaaccaaatcagaaagatggagaaagaaataaaagaactgaagtcgcaacgtgatttggctcagtccaggttgcaggatttgctgcaagttgttggtgatcgtgacccaaagcaccaggtctcaggaaagcgttcaatcagaagtcctccgtctgttggaatgcccccaagtgctagcagagatgacagttctcagatctctcatgatgattcagatcattacaaggaagtgcgatgtattgaaacaaatgaaactggaggaaatgaacgtttgtctttgtctgctggtgaaagtactagcccacaagattcaaataggaattctagcatgcgtggtaatgattcaacagcttcagtgaattcaaggcgtcttggtgaaactcctattaccttggagcaacatttggagaacatcagaagaccttttatcactaaagatctaggatcttcaacacgcaacccgtcaagttgtagaataattggtagaagcaggagttgtagatcactaacagggtctactttacttgatgagatggagatggaggattgcacaccagtaaacagaagtttggtaatcttcccaggaagacctgaagagtaccagagaagaggatctgcattaaactacgatgcagggagcgagactctttcaagggcaggatctgaaattagcacttcgaagggagctagcaagacaggtgatgcagaatttaccggtataggtgaatttgttgctgaacttaaggagatggctcaggttcattatcagaaacagttaggtgaccagagcggcaggaatgggaagagcatcggattagacccaatcatggatggtttgcaatcaccttctcgatggccgttggaattcgagaagaaacagcaggagatcatcgagctttggcacgcctgcagcatttcgctggtccacaggacctacttcttcttgctgttcaaaggagaatcagccgactcgatttacatggaagtggagcttcggaggctatcgttcctcagagacaccttctccaggggaagcacccccagcaacgtggtcgtaggcagcctcagttcttcccccgttgcgagcgccaagaagctgcagcgcgagagggagatgctggcgaggcagatgcagaagcggttctccgtggaggagaggaaccacatgtacaccaaatggagcgtcccgctggactccaagaagaggaagctgcaggtggcccgccggctgtggacggagagcagagacctggagcacgtgagggagagcgcgtccctggtcgccaagctgatcgggctgcaggagcccgggcaggtcctgagggagatgttcgggctcagcttcgcgccgcagcagccccccacccggcggtcctccaacggctggagatacgggatcccctcgtttggttgattgattgggcccgtgacgacacgaggcaagaagatgacaggatgatgcggctgaccaaaagatcttttttttttctggtggttttacatatcttgctgttgcctgttctgattgtccataggatgtcaggacacgcgcatgcgggcgttcgtttgtgtatgccctctgcgtgtaggacggcccggtttggtgcgcctgtttctgagcaggcgccgccggtctgattgctaacattattaacgtgccccttgcgtgtccaaacgcacgctcttgtattaatgtgttattgcaattcccacggtttgcaccattcatctgtcaaaattggttgttccg

SEQ ID NO: 4753 - DNA, 3145 bp, Triticum aestivum
cgtgtacgtatcatatgtgccttgcttcttgggctgtggtcttataatggcgcatttctggcagatggtgtagggagaggtgctggacggggcaggtaagtgggagagcgaatggggggcgattggaggcaacgagtccgtgcagtgggacaagatgaatggggcggaggtggtgaatggcggtgggagtggcgcaggaagcctggataggatacaggtgctagtgagggtgaggccgctgagtgacaaggagattgcaaggggtgagcctgcggagtgggagtgcatcaatgacaccaccatcatgttccggagtaccttcccggatcgacccacggctccaaccgcatacacatttgacagggtatttcattccgagtgcagtacgaaagaagtctaccaggaaggggttaaggaagttgccctctctgtagttggtggcattaactcaagtgtttttgcgtacgggcaaacaagtagtgggaagacattcactatgactggagtgacagaatgcacagtagcagatatatacgattatattaacaagcatgaggaaagagcatttgtgttgaaattctcagcaattgaaatatacaatgaagttgttagggatcttctgagtgcagaaaatactcctcttagactttgggatgatgcagagaaaggcacctacgtggagaatcttacggaggttatattaagggattggaaccacctcaagggacttatttctgtttgcgaagctcaaaggaaaaccggggagaccttcttaaatgaaaaaagctccagatcccatcaaatacttaaattgactgttgaaagttctgctcgtgaattcttaggaaaggacaagtcaaccacccttgtggctagtgtgaactttgttgatctggcaggaagtgagcgtgcatctcaggctatgtcagctggcacaaggctgaaagaaggttgccacatcaataaaagtttgctttcccttggcaccgtcattaggaagctaagcatggggagtaatgcacacgtaccgtatagagattccaagcttacacgcatattacaaccttctttgggaggcaatgcaagaaccgcgattatttgtacactcagccctgcaacaagtcacattgagcaatcaaggaatacactgtttttcgggagttgtgcaaaggacgtagttacaaatgctcaggttaatgtggtcatgtctgataaaacactagttaagcatttgcaaaaggaagttgctagactggagagtgagttgcggcagccagtttcaaactctagtctggaagcacaggtgaaggaaaaggacaaccaaatcagaaagatggagaaagaaataaaagaactgaagtcgcaacgtgatttggctcagtccaggttgcaggatttgctgcaagttgttggtgatcgtgacccaaagcaccaggtctcaggaaagcgttcaatcagaagtcccccgtctgttggaatgcccccaagcgctagcagagatgacagttctcagatctctcatgatgattcagatcattacaaggaagtgcgatgtattgagccaaatgaaacgagaggaaatgaacgtttgtctatgtcagctggtgaaagtaccagcccacgagcttcaaataggaattctagcatgcgtggtaatgattcaacagcttcagtgaattcaaggaggcttggtgaaactcctattaccttggagcaacatttggagaacatcagaaggccttttatcactaaagatctaggatcttcaacacgtaacccatcaagttgtagagtaattggtagaagcaggagctgtagatcactaacagggtctactttacttgatgagatggagatggaggattgcacaccagtaaacagaagtttggtaatcttcccaggaagacctgaagagtaccagagaagaggatctgcattgaactacgatgcagggagtgagactctttcaagggcaggatctgaaattagcacttcaaagggagctagcaagacaggtgatgcagaatttaccggtataggtgaatttgttgctgaacttaaggagatggctcaggttcattatcagaaacagttaggtgaccagagtgggaatggaaagagcatcggattagacccaatcatggatggtttgcaatcaccttcgcgatggccattggaattcgagaagaaacagcaggagatcattgagctttggcatgcttgcagcatttccttggtccacaggacatactttttcctgctgttcaaaggagaatctgccgactcgatttacatggaagtggagcttcgaaggctatcgttcctcagagacacctactccaggggaagcacccccagcaatgtgaccgtaggcagcctcagctcttcccccgtcgcgagcgccaagaagctgcagcgcgagagggagatgctggcgaggcagatgcagaagcggctgtccgtggaggagaggaaccacatgtacaccaagtggagcgtgtcgctggactccaagaagaggaagctgcaggtggctcgccggctgtggacagagagcagggacctggagcacgtgagggagagcgcgtccttggtggccaagctgatcgggctccaggagcccgggcaggtcctgagggagatgttcgggctcagcttcgcgccgcagcagccccccgcccggcggtcctccaacggctggagatacgggatcccctcgtttggctgattgattgggcccctgacgacaagaggcaagaagatgacaggatgatgcggctgaccaaaagatcttttttctctctggtggttttgtatcttggggtgttgcctgttctgattttccatagggtatcaggacacgcgcatgcggggggtttgatcttggtgcatgccctttgcgtgtaggacgaccggtttggtgcgcggttcctgagcaggcgccgccggtctgattgctaacattattaacgtatcactgcgtatccagagacacgctcttttgttaacgtgttgttgcagttcccacggtttgcacccctcatctgtcagaaatggttgttccgatgtgtatcgaaagcttgtagaaaatcaaacacgtgtcgtacgttgcagccaccacaacgagctgacccttgttggaagc

SEQ ID NO: 4754 - DNA, 3357 bp, Brachypodium distachyon
atctgctaataactacgagttcctcctgaaggaggatggtcagggtgatggcatgaggaagtcgtgtggtggtgtagtgctagatttggaatattatgtggttctgcagtagcatccatctatcggacatgctaaccactgtcctagctcctaattatgtgcgtaatcactggtagtaagggtccacagaaaatgcttgccttctcctccacccgctgcagcaagttttgtcaacagccttgccctgcactcaaattcatgtggataggacatattcgtgcatctcatctcgttggcttcttgtgtggttattccttattggtattatatgctttgcttcttcggttgtggtcttatagtgctgcaattctggcagatggtgtagggagccggcaggagggattagtgcgtgggagagcaaatgggggcgattggaggtgaggagttggtgcagtgggacaaggtcaatggacctgagggggtgaacggcggtggaagtggtgcaggcaagctggataggatacaagtgttagtgaggctgagaccgctgaacgacaaggagattgcaaggggtgagcctgcggagtgggagtgcatcaatgacactaccatcatgttccggagtaccttcccagacagaccgacggccccaactgcatatacatttgatagggtatttcattctgaatgcagtaccaaagaagtctatgagcaaggggttaaggaagttgccctctctgtagttagcggcattaactcaagtatttttgcctatggacaaacaagtagtggaaagacatacactatgactggagtgacagaaaacacagtggctgatatatatgattatattaacaagcatgaagagagagcatttgtgttgaaattctcggcaactgaaatttataatgaagttgtcagagatcttctgagtgcagaaaatactcctcttagactttgggatgatgcagagaagggcacctatgttgagaatcttacggaggttatattaagggactggaaccacctgaagggacttatttctgtgtgtgaagctcaaaggaggacaggggagaccttcttaaatgaaaaaagctccagatcccatcaaatacttagattgatcgttgaaagttcttctcgtgaattcttaggaaaggataagtcaactacccttgtggctagtgtgaactttgttgatctagcgggaagtgagcgtgcatctcaggcgatgtcagctggcacgaggctgaaagaaggttgccatattaataaaagtttactttccctcggcactgtcattaggaagctaagcatggggagtaatgcacacataccgtatagagattccaagctcacacgcatattacagccttctctgggaggtaatgcaagaactgcaattatctgtactctgagccctgcaacaagtcacatcgagcaatcaagaaatacactattctttgggaattgtgcaaaggacgtagctactaatgctcaggttaatgtggtcatgtctgataaaacgctagttaagcatttgcaaaaggaagttgctagattggagagtgagctgcggcacccagtttcaaattccagtctggaaacaatagtgaaggaaaaagacaatcaaattagaaagatggagaaagaaattaaagaactgaagtcacaacgtgattcggctgagtctaggttgcaggatttgctgcaagttgttggtgatcgtgatccaaagcaccaggtcccaggaaagcgttcggtcagaagtcctccgtctgttggaatgctcccaagcactagcagagatgacagttctcagatctctcatgatgattcagatcactacaaggaagtgcgatgcattgagaccaacgaaactggattaaatgaactcttgtgtgctggtgaaagtgttagcctgcacgattcaaataggaattctagcacgcatgttaatgattcaaatgcatcagtgaattcaaggcgccttggtgaaactcctattaccttggagcaacatttggagaacattagaaggccttttatcactaaagatttaggatcttcaacacgcaactcatcaggctgtagattaattggtagaagcaggagctgtcgatccctaacagggtctactttactggatgagatggagatggatgattgcacaccagtaaacagaagtttggtcaacttcccaggaagacctgaagagtatcatagaagaggatccgcattaaactatgatgcagggagtgaaactctttcaagggcaggatctgaaattagcacttcgaaagttgcatgtgatgcggaatttaccggtataggtgaatttgttgctgaacttaaagagatggctcaggttcattatcagaaacaattaggtgaccagagtgcaaatggaaagagcatcggactagacccgatcatggatgttttgcaatcaccttctcgatggccattggaattcgagaagaaacagcaagagatcatcgagctttggcatgcttgcagtatttccttggtacacagaacttattttttcttgctattcaaaggagaatcagccgactccatttacatggaagtggagcttcggcggctattattccttagagatacttactctagggggagcactccaagcaatgttgtagtaggtagcctcagttcttcccctgttgcgagcgccaagaagctacttcgcgagagggagatgcttgccaggcagatgcagaagcggttctccttggaggaaagaaaccgcatatacaccaaatggggtgtttcgctggactccaagaagaggaaactgcaggttgctcgccgcctttggactgagaccaaagatctggagcatgtcagggagagcgcttccctggtcgccaagctgattgggctccaggagccggggcaagtcctcagggagatgttcgggctcagcttcgcgcctcaacagccaccctcccggcgatcctctaacggttggagatatgggatcccttcgtttggttgattagatctttatccatgacacaagagctgacacacgatgtggctgacggaaagatcttttttgtctttcttttctcgttttatcggtgttgcctgttctgattgtccataggatatcaggagacattcatggtggcgtacgtttgtgctcctgtgcgacctgtttcgtgcgtgattcgctggtcttggttgctgacaacattaacgcacctccaagtctaaacgatgttgtataatgaaaagctcttatcttttgcggaatatggactctttatttctctactcatatgggtgaggttaatggggtactccagcaaaagcattgagggacactac

SEQ ID NO: 4755 - DNA, 2841 bp, Triticum aestivum
cagctccaccgctacactttgccgggtattcatccggagtgcgtacggaaggagttacccgggaagggttaaggacttctctctctgtagttggtggcattaactcaagtgtttttgcgtacgggccaaccagtagtggggacgacattcactatgcttggggtgacggaatgcccagtagcagatatatatgattatattaaccaagcatgaggagagagcatttgtgttgaattctcagcaattgaaatatataatgaagttgttagggatcttctgagtgcagaaaatactcctcttagactttgggatgatgcagagaaaggcacctacgtggagaatcttacggaggttatattaagggattggaaccacctcaagggacttatttctgtttgcgaagctcaaaggaaaaccggggagaccttcttaaatgaaaaaagctccagatcccatcaaatacttaaattgactgttgaaagttctgctcgtgaattcttaggaaaggacaagtcaaccacccttgtggctagtgtgaactttgttgatctggcaggaagtgagcgtgcatctcaggctatgtcagctggcacaaggctgaaagaaggttgccacatcaataaaagtttgctttcccttggcaccgtcattaggaagctaagcatggggagtaatgtgcacgtaccatatagagattccaagcttacacgcatattacaaccttctttgggaggcaatgcaagaaccgcgattatttgcacactcagccctgcaacaagtcacattgagcaatcaaggaatacactgtttttcgggagttgtgcaaaggacgtagttacaaatgctcaggttaatgtggtcatgtctgataaaacactagttaagcatttgcaaaaggaagttgccagactggagagtgagttgcggcagccagtttcaaactctagtctggaagcacaggtgaaggaaaaggacaaccaaatcagaaagatggagaaagaaataaaagaactgaagtcgcaacgtgatttggctcagtccaggttgcaggatttgctgcaagttgttggtgatcgtgacccaaagcaccaggtctcaggaaagcgttcaatcagaagtcctccgtctgttggaatgcccccaagcgctagcagagatgacagttctcagatctctcatgatgattcagatcattacaaggaagtgcgatgtattgagccaaatgaaacgagaggaaatgaacgtttgtctttgtcagctggtgaaagtaccagcccacaagcttcaaataggaattctagcatgcgtggtaatgattcaacagcttcagtgaattcaaggagtcttggtgaaactcctattaccttggagcaacatttggagaacatcagaaggccttttatcactaaagatctaggatcttcaacacgcaacccatcaagttgtagagtaattggtagaagcaggagctgtagatcactaacagggtctactttacttgatgagatggagatggaggattgcacaccagtaaacagaagtttggtaatcttcccaggacgacctgaagagtaccagagaagaggatctgcattgaactacgatgcagggagtgagactctttcaagggcaggatctgaaattagcacttcaaagggagctagcaagacaggtgatgcagaatttaccggtataggtgaatttgttgctgaacttaaggagatggctcaggttcattatcagaaacagttaggtgaccagagtgggaatggaaagagcatcggattagacccaatcatggatgctttgcaatcaccttctcgatggccattggaattcgagaagaaacagcaggagatcatcgagctctggcacgcgtgcagcatttcgttggtccacaggacttacttcttcttgctgttcaaaggagaatcagccgactcgatttacatggaagtggagctgcgaaggctgtcgttcctcagagacacctactctaggggaagcacccccagcaatgtgaccgtaggcagcctcagctcttcccccgtcgcgagcgccaagaagcttcagcgcgagagggagatgctggcgaggcagatgcagaagcggctgtccgtggaggagaggaaccacatgtacaccaagtggagcgtgtcgctggactccaagaggaggaagctgcaggtggctcgccggctgtggacggagagcagggacctggagcacgtgagggagagcgcgtccctggtggccaagctgatcgggctccaggagcccgggcaggtcctgagggagatgttcgggctcagcttcgcgccgcagcagccgcccacccggcggtcctccaacggctggagatacgggatcccctcgttcggctgattgattgatgattgggggtcggtgacgacacgaggcgagatgatggcaggatgatgcggctgaccaaaagatcttttttttttctctctggtggttttgtatcttggggtgttgcctgttctgattttccatagggtatcaggacacgcgcatgcggggggtttgatcttggtgcattccctttgcgtgtaggacgaccggtttggtgcgcggtttctgagcaggcgccgccggtctgattgctaacattattaacgtatcactgcgtatccagacgcacgcacttgtgttaacgtgttgttgcagttcccacgttttgcaccactcatctgtcagaaatggttgttccgatgtgtatcgaaggcttgtagaaaattcaacacgtgtcgtacgttgcagccaccacaacgagctgacccttgttggaagcgtgctgtttgatctgcaattgtgctt

SEQ ID NO: 4756 - DNA, 3638 bp, Oryza sativa
gcaccctgtatgctccaaaaaaaacgtacatgggctccactcaacaaccctattctccatggggtctcgcattcaaaaacacccaccaaagaacaatcgacagagagagccacagagccattgaaaacaaccccaggggaagagaagacaaacgactcagcgcaacggtctccttgggttggagaagactcaaacaaacaaaaaaatcaccaaaaaaaaaaagaaaaaaacaaagtactactcctccactgtacaccaccgtctcttgcactcctctcgcctctctctctctctctctctccccccacaaattcaacaagatcgtcgtggggagcacagcccgcacgcggtgaagcgcccgctctctctccatccaccacctccaacctcccccaaaacctccacctccaccgccaaattcgcgaaggagttcaaacactcgaagggccatggctgccgccgcggggctccgccgctcaaccgtcacgccgcggggagccgccgccgcgtgcctgcgtttttccggagccggccgccgccttcgcccagcctcgatggtgtaggagaaaagagggataggagaaggggggagtgagcgggagagagatgggggcgattggaggcgacgagctggtgcagtgggacaagatgggtgcagctgaggcagtcaatggcggctgtggaggcgccgggaagatggataggatacaggtgttggtgaggctgaggccgctgagcgagaaggaggttgctaggagggagccagcggagtgggagtgcatcaatgacagcactgtcatgttccggagcaccttccctgaccgacccacggcgccaacagcatacacgttcgatagggtatttcactctgattgcagtaccaaagaagtctacgaggaaggggtgaaggaagttgccctctctgtagttagtggcattaactcaagtatttttgcatatggacaaaccagcagtggaaagacatacactatgactggagtaacagaatatacagtagcagatatatatgattatattaacaagcatgaagagagagcctttgtgttgaagttctctgcgattgaaatatataatgaagttatacgggatcttcttagtgcggaaaatacccctcttagactctgggatgatgcagagaagggcacctatgtagagaatcttacagaggttgtattaagggattggaaccatctcaagggacttatttctgtgtgtgaagctcaaaggaggacaggggagaccttcttaaacgaaaaaagttctagatcccatcagatacttcgattgacagttgaaagctctgctcgcgagttcttaggaaaggacaagtcaactacacttgtggctagtgcaaactttgttgatctggctggaagtgagcgtgcatctcaggcattgtcagctggcacaagactgaaagaaggttgtcacattaataggagtttgcttgcccttggcactgtcattagaaaactgagcatgggaagtaatgcacacataccgtatagagattcaaagcttacacgcatactacagccatctttgggaggtaatgcaagaactgcaattatttgtacactgagccctgccactagccacattgagcaatcaagaaatactctgctatttgggagttgtgcaaaggaagtagttacaaatgctcaggttaatgtggtcatgtctgataaagcactggttaagcacttgcaaaaggaacttgctagattggagagcgagttgcggcatccagttcagagttccagtctcgaaacattattgaaggaaaaggacaaccaaatcagaaagatggagaaagaaataaaagaactgaagtcacaacgtgatttggctcaatccaggttgcaggatttgctgcaatctgtcggtgatcatgacctgaaccgtcaagttcaaggaaagcattcagtcagaagccctccatctgttggaatgcccccaagcgtcagcagagatgatagttctcaggtctctcatgatgattcagatctttacaaggaagtgcgatgtattgaaagcaatcggacaggaggaaatgaccagttggacttatcagctggtgaaagtagtagcccacaagattcaaatatgaattctggtttgcatggaaatgattcaaatgcatcagtgaattctaggcattcaaggccctctggcgaagctcctattactttggaggaacacttggagaatattagaaggccttttgtcagtctagccaaagatctaggatcttcaacacgtaactcatcaaacttaagagtaattggtagaagcaggagctgtagatcactgacaggttctactatgtttgacgatatggagatggatgattgcactccactaaatagaagtttggtggagttcccaggaagacctgtggaatctcatagaagaggatctgcactgcactatgatgcagagaccgacacactttcaagggcaggatccatgagttctgagatcagcacttttaaggatgcaaagacaaatgggtctgttgcatgcgatacagaattcactggtattggtgaatttgttgctgaactcaaagagatggcccaggttcattatcagaagcagttaggtgaccagaatgcaaatggaaagagcatcggattggacccgatcgagggtgtttctcagtcaccttctcgatggcctttggaattcgagaagaagcagcaagagatcatcgagctttggcaagcttgcagcatttccttggtccacaggacttactttttcttgctattcaagggagaagcagctgactcgatctacatggaagtggagcttcgaaggctatcattcctgagagatacatactcaagggggagcacccctagcaatgcgatagtaggcagcctgagtacttcccctgttgcgagcgcaaagaagctgcagcgggagagggagatgcttgccaggcagatgcagaagcggctgtccacggaggagagggagcacacgtacacaaaatggggtgtctcgctggactccaagaggaggaaactgcaggtcgctcgccgcctctggaccgagacgaaagacctggagcatgtcagggagagcgcgtccctggtcgccaagctgatcgggctccaggagccaggccaagttctcaaggagatgttcgggctcagcttcgcgccgcagcagcagccgacccggcggcgatcctccaacggctggagatacgggatcccttcgttcgcctgatttggatcgaccacacacgaaacaaggctgacacgacgatgcgactgaccaaaggatcttttgttttttctccttttattttttccccttttcgatcttggtgtatctgcatgttctgattgtccataggattttaggaagcacaaaattgatggtggcgtccgtttgcgccctttgtgttgccggcctcgtgcatgtttctgcccagccgccgccggtctttgattgctgctgacattatatcgccgcagagccaatcggtgttgtgttgtataacgtgtgctagtttctcgtattttgcttgtagatccgcttgatataactgtgcttactagaaatgccgaagagaatgccgcatgtgactggagtgtattttt

SEQ ID NO: 4757 - DNA, 3770 bp, Panicum virgatum
ccagagtcagaagagaccctgcctcccaaatcaccgggcgagcgagatcgtcgtgggcggcactcgctctcgcgcgcggtgaggcggcgctatcagagcggactccgcctcaaaaccccaccaggtaggtctgctgcactctgcaccgcaaccatggccgcggccgccgggctcagccgccgctgcaccgtccgcggacaagtcgcgctttcgccttccgggagcaaccgtcttcgcccggccctggtgttgtagaagaggaaaggttagggggagggggagaggtaaggtgagcggcaatgggggcgattgggggtgatgagctggtgcagtgggataagatggctggaccggaggcggttaatggaggcggaggaggtgcggggaggatggacaggatacaggtgctggtcaggctgaggccgctgagcgagaaggaggttgcgaggggggaacctgcggagtgggagtgcatcaatgacaccaccgtcatgttccggagcaccttcccggaccgaccaacagccccgacggcgtacacatttgatcgggtttttcattctgactgcagcaccaaggaagtctacgatgaaggggttagggaagttgctctattagtagtcagtggcattaactcaagtatttttgcgtatggacaaacaagtagcggaaagacatataccatgaccggagtaacagagtatacagtagcagacatatatgattacattagtaagcatgaagagagagcatttgttctaaagttctcagcaatcgaaatatataatgaagttgtaagggatcttcttagcgcggaaaatactcctcttagactctgggacgatgcagagaagggcacctatgtggagaatcttactgaggttgtattaagggactggaaccacctcaaggggcttatttctgtctgcgaagctcaaagaaggacaggggagacctttttaaatgaaaaaagctccagatctcatcagatgctgagattgacagttgaaagttctgctcgggagttcctagggaaggacaagtcaaccacacttgttgctagtgccaactttgttgatttggcaggaagtgagcgtgcatctcaggcattgtctgctggcacaagactaaaagaaggttgtcatattaacagaagtttgcttgccctcggcactgtcattaggaaactaagcatggggagtaatgcacatataccgtatagagattcaaagctcacacgcatattacaaccatctttgggaggtaatgcaagaaccgccatcatttgtacactgagcccggccactagtcatattgagcaatcaagaaataccctattatttgggagctgtgcaaaggaagtagttacaaatgccaaagtcaatgtggtcatgtctgataaagcgctagttaaacatttgcaaaaggaagttgctagattggagagtgagttgcggcaaccagcttcaaattccagtcttgaagcattagtaaaggaaaaggacaaccaaatcagaaagatggagaaagaaataaaagaactcaagtcacagcgtgatctggctcaatctaggttgcagaatctgctgcagactgttggggaccactcaaagcacccgggctcaggaaagcgttcagcccgaagtcctccatcaattggaatgcccccaagcatcagcagggatgatagttctcagatctctcatgatgattcagatctttacaaggaagtgcgatgcattgagaccagtggaacaggaggaaatgaacagttggatatgtcagctggtgaaagcagtagtccacaaggttcaaacatgaattctagcttgcgtggtaacggttccaatacatcagtgaattcaaggcgttcaaggctccttggtgaatctcctgtcacgttggagcagcatttggagaatatcagaaggccttttgccactgttggcagagatctaggatcttcgacacgtaactcatcaggctccagaattcttggtagaagcaggagctgtagatcacttacagctactactatgtttgatggcatagaggtggatgatgacaccccgctgcatagaagtttggttggtttcccaggaaggcctgaagggggtcatagaaggggatctgcactgaactatgatgtagaaagtgaaactctttcaagagcaggatcaatagtttcaaccaagacgaatggtgcatgcgatgcagagttcactggtataggtgaatttgttgctgaattgaaggaaatggctcaggttcattatcagaaacagtatggtggtcagaatgcaaatggagactttggagaggggaccataaagagcattggattggacccgattgctgatgcttcacaatcaccgtctcgctggccgttggaattcgagaagaaacagcaggagatcatcgagctttggcactcatgcagtatttccttagtacacaggacctattttttcttgctattcaagggagatcaggctgactcaatctacatggaagtggagcttcggaggctatcattcctcagagatacttactctcggggaagcacccctagcaatgtggtagtaggtagcttgaactcttccccagctgcgagtgctaagaagctgcagcgcgagcgggagatgcttgcgaggcagatgcagaagcggctcacggcagtggaaagagaacacgtgtacaccaagtggggcgtttccctggactccaagaagaggaagctgcaggtggctcgccgcctctggacgcagacaaaggacctggagcacgtcagggagagcgcctccctggtcgccaggctgatcgggctccaggagccagggcaggtcctccgggagatgttcgggctcagcttcgccccgcagcagcagccgccccctcgccggcgatcctccaacggctggaaatacgggttaccttcgttcggctgatcggatcaacacccactcacgacgataacagatgacacggcgcgagcgacgactgaccagagagatgtaacttttatcccttctgtttcttttttttcccgctctcttgtggtggtgtaacttgctgcctctgatttgagtaggatcttaggaaaccattcgccgggccgttcgcttgtgctccggtggctggctggctggtggctggtgtatctttctgcctagccgctgccgctgctgccgcctcggccccagttgctgacgacgccatcctacgaccgtaattccggacgctgttgtgtaactttaacctgtggtgcaatggtaacctgtcgtgccatcttggccgagattgctcccgtgcccgtacggactgtgcggctgtgcccctgaatcctctcccgacctgtgtcccgcatgtggttcgagaccccgcgtggcctgccccggcggggtgggccggaagcggaaggatgtgtcgcgcgctcggttgggtcgagcccggcaaccgccgccactgccagcaggaacagcagcgggcgccggagcgcaacgtgcttaatggtgaacgtgctttagggtttagagtttctccgcggaccatgagcggaacactggacgctgcagagaaaccttcatatctggacgccgtagacgacgacagggtgggaaagcgccggcggggagagacgctcgctccagctgcaggaggagtagggcgcggcgtgccggcagcggccgccactttgcatgatcctcagcctccggtggcgggtgccggcgcggcccctcgccatgtgagcccgcgacttcgaatccccc

SEQ ID NO: 4758 - DNA, 3668 bp, Panicum virgatum
ttattggagaattataaaaaaaacctcctctaataatcaatataaatgtcacagaggcatctaaatactattttacggaagatatttattgaagaaccgccggaaacctgcaaaatggtgaaaggtcttttgtcgaaacgagcacaaaacatagggccggcacgcaaaaacaccaatccaccgaccgtggagtgagtaaacaaacaattgaaagccatcccacggtgggaaaggcgaagcactacagaatcatcgcaacggtccgctggcagcgaaacaaaagaaaaaaaaaatatcggcgccgtctcctgcactccagagtcagaagagaccctgcccccccaaatcaccgggcgagcgagatcgtcgtgggcggcactcgctctcgcgcgcggtgaggcggcgctatcagagcggactccgccaggtaggcaggtctgctgcacgctgcactgcaaacatggccgcggccgccgggctcagccgccgctgcaccgtccgcggacaagtcgagctttcgccttccgggagcaaccgtcttcgcccggtcctggtgttgtagaagaggaaaggttaggaggagggggagaggtaaggtgagcgacaatgggggcgattgggggtgatgagctggtgcagtgggataagatggctggaccggaggcggttaatggaggcggaggaggtgtggggaggatggacaggatacaggtgctggtcaggcttaggccgctgagcgagaaggaggttgcgaggggggaacctgtggagtgggagtgcatcaatgacaccaccgtcatgttccggagcaccttcccggaccgaccaacagccccgacggcgtacacatttgatcgggtttttcattctgactgcagtaccaaggaagtctacgaggaaggggttagggaagttgttctatcagtagtcagtggcattaactcaagtatttttgcgtatggacaaacgagtagcggaaagacatataccatgacaggagtaacagagtatacagtagcagacatatatgattacattaataagcatgaagagagagcatttgttctaaagttctcagcaatcgaaatatataatgaagttgtaagggatcttcttagcgcggaaaatactcctcttagactctgggacgatgcagagaagggcacctatgtggagaaccttactgaggttgtattaagggactggaaccacctcaaggggcttatttctgtatgcgaagctcaaagaaggacaggggagacctttttaaatgaaaaaagctccagatctcatcagatactgagattgacagttgaaagttctgctcgggagttcctagggaaggacaagtcaactacacttgttgctagtgcaaactttgttgatctggcaggaagtgagcgtgcatcgcaggcgttgtctgctggcacaagactaaaagaaggttgtcatattaacagaagtttgcttgccctcggcactgtcattaggaaactaagcatggggagtaatgcacatataccatatagagattcaaagctcacacgcatattacaaccatctttgggaggtaatgcaagaactgccatcatttgtacactgagcccagccaccagtcatattgagcaatcaagaaatactctattatttgggagctgtgcaaaggaagtagttacaaatgcccaagtcaatgtggtcatgtctgataaagcgctagttaaacatttgcaaaaggaagttgctagactggagagtgagttgcggcaaccagcttcaaattccagtcttgaagcattagtaaaggaaaaggacaaccaaatcagaaagatggagaaagaaataaaagaactcaagtcacagcgtgatttggctcaatctaggttgcagaatctgctgcagactgttggggaccacccgaagcactcgggctcaggaaagcgttcagcccgaagtcctccatcaattggaatgcccccaagcatcagcagggatgatagttctcagatctctcatgatgattcagatctttacaaggaagtgcgatgcattgagaccagtggaacaggaggaaatgaacagttggatatgtcagctggtgaaagcagtagtccacaaggttcaaacatgaattctagcttgtgtggtaatggttcaaatacgtcagtgaattcaaggcattcaaggctccttggtgaatctcctatcacgttggagcagcatttggagaatatcagaaggccttttgccactgttggcagagatctaggatcttcgacacgtaactcatcaggctccagaattcttggtagaagcaggagctgtagatcacttacaggtactactatgtttgatggcatggaggtggatgatgacaccccgctgcatagaagtttggttggtttcccaggagggcctgaagggaatcatagaaggggatctgcactgaacaatgatgtagaaagtgaaactctttcaagagcaggatcaatagtttcaaccaagacgaatggtgcatgcgatgcagagttcactggtataggtgaatttgttgctgaattgaaggaaatggctcaggttcattatcagaaacagtatggtggtcagaatgcaaatggagaatttggagaggggaccataaagagcattggattggacccgattgctgatgcttcacaatcaccatctcgctggccattggaattcgagaagaaacagcaggagatcattgagctttggcactcatgcagtatttccttagtccacaggacctactttttcttgctattcaagggagatcaggctgactcaatctacatggaagtggagcttcggaggctgtcattcctcagcgatacttattctcggggaagcacccctagcaatgtggtagtagggagcttgaactcttccccagctgcgagtgctaagaagctgcagcgcgagcgggagatgcttgcgaggcagatgcagaagcggctcacggcagtggaaagagagcacgtgtacaccaagtggggcatttctctggactccaagaagaggaagctgcaggtggctcgccgcctctggacgcggacaaaggacctggagcacgtcagggagagcgcctccctggtcgccaggctgatcgggctccaggagccagggcaggtcctccgggagatgttcgggctcagcttcgcgccgcagcagcagctgccccctcgccggcgatcctccaacggctggaaatacgggttaccttcgttcggctgatcggatcaacacccactcatgacacgacactgcacgatcgacgactgaccagagagttgtaacttttctcccttctgtttcttctttttcctcacttgttgtggtgtatcttggctctgatttgagtaggatcttaggaaacacattcgccgggccgttcgcttgtgctccggtggctggctgcttgcatgcttttctgcctagccgccgccgccgccgccgcctcagccccagttgctgacgacaccatcctacgaccgtaatttcggacgctgttgtgtaactttaacgtgtggtgcgatggtaatatgtcattgccatcttgtccgagattgcccccgtgcccgttggaccgtgcccctcaatcctttccccggatggtaatgatatggatcatggttctagcgttctca

SEQ ID NO: 4759 - DNA, 3347 bp, Setaria italica
tcgcaacggtctgctggcctgctgctggggttggaaaaacaaaagaaaaaaggaaaagaaattcgccaccgtctcttgcactccagcagtcagaagaacctcccccaaatcaccggacgagatcgtcgtgggcggcactcgctctcgcacgcggtgaggcggcgctatcagagcggaagcggactccgccccaaaaccccccacgtccctccaggtaggtgtgcaccatggccgcggccgccgggctcagccaccgcttcaccgtccgcagacaagtcgagctttcgccttccgagagcaaccgtcttcgctcggtcccggtgctgtagagaagaggaaaggttaggaggagggggagaggcgagtgggagcggcaatgggggcgattgggggcgatgagttggtgcagtgggataagatggctggaccggaggcggttaatggtggcggaggaggtgcggggaggatggacaggatacaggtgctggtcaggctgaggccgctgagcgagaaggagattgcgaggggggagcctgcagagtgggagtgcatcaatgacaccactgtcatgttccggagcaccttcccggaccgaccgacagctccgacggcatacgcatttgatcgggtttttcattctgactgcagtaccaaggaagtctatgaggaaggggttagggaagttgccctctctgtagttagtggcattaactcaagtatttttgcgtatggacaaacaagtagtggaaagacatataccatgactggagtaacagaatatacagtagcagacatatatgattacattaataagcatgaagagagagcatttgttctgaagttctcagcaatcgaaatatataatgaagttgtaagggatcttcttagcgcggaaaacactcctcttagactctgggatgatgcagagaagggcacctatgtggagaaccttactgaggttgtgttaagggactggaaccacctcaaggggcttatttctgtatgtgaagctcaaagaaggacaggagagaccttcttaaatgaaaaaagctccagatctcaccagatactgagattgacagttgaaagtactgcccgggagttccttggaaaggataagtcaactacacttgttgctagtgcaaactttgttgatctagcaggaagtgagcgtgcatctcaggcgttgtctgctggcacaaggctaaaagaaggttgccatattaacagaagtttgcttgcccttggcactgtcattaggaaactaagcatggggagtaatgcacacataccatatagagattcgaagctcacacgtatattacagccatctttgggaggtaatgcaagaactgccatcatctgtacactgagcccagccactagccatattgagcaatcaagaaataccctattatttgggagctgtgcaaaggaagtagttacaaatgcccaagtcaatgtggtcatgtctgataaagcgctagttaagcatttgcaaaaggaagttgctagattggagagtgagttgcggcaaccagcttcaaattccagtcttgaagcattagtaaaggaaaaggacaatcaaatcagaaagatggagaaagaaataaaagaactcaagtcacagcgtgatttggctcagtctaggttgcagaatctgctgcagactgttggggaccacccaaagcattcgggctcgggaaagcgttcagcccggagtcctccatcaattggaatgcccccaggcatcattagggatgatagttctcaggtatctcaagacgattcagatctttacaaggaagtgcggtgcattgagaccagtggaacaggaggaaatgaacagttggatatgtcagctggcgaaagcagtagtccacaaggttcaaacgtgaattctagtttgcgtggtaatggttcaaatacatcggtgaattcaaggcgttcaaggctccttggtgaatctcctatcacgttggagcagcatttggagaatatcagaaggccttttgccagtgttggcagagatctaggatcttcgacacgtaactcatcaggctccagattacttggtagaagcaggagctgcagatcacttacagcttctactatgtttgatggcatggaagcagatgatggcaccccggtgcatagaagtttggttggtttcccaggaaggcctgaaagggatcatacaagcggatctgtgctgaactatgatgcagaaagcgaaactctttcaagagcaggatctatagtttcagccaagacaaatggtgcatgcgatgcagagttcactggtataggtgaatttgttgctgaattgaaggaaatggctcaggttcattatcagaaacagtatggtgatcagaatgcaaatggggaatttggagagggcaccataaagagcattggattggacccgattgctgatgcttcacaatcaccgtctcgctggccattggaattcgagaagaaacagcaggaaatcatcgagctttggcatgcatgcagtatttccttagtccacaggacatactttttcttgctattcaagggagatcaggctgactcaatctacatggaagtggagcttcggaggctatcattcctcagagatacttactctcggggaggcacccctagcaatgtggtagtaggcagcctgaactcttccccggctgcaagtgctaagaagctgcaacgcgagcgggaaatgcttgcgaggcagatgcagaaacggctcacggcagtcgaaagggaccacctgtacagcaagtggggcatttccctggactccaagaagaggaagctgcaggttgctcgccgcctctggacggagaccaaggacctggagcacgtcagggagagcgcctccctagtcgccaagctgctagggctccaggagccagggctcagggagatgttcggactcagcttcgcgccgcagcagcaaccgccccctcgccggcggtcctccaacggctggaaatacgggttaccttcattcggatgatcggatcaaccaccactcacaaacaatgacagatgacacggtgcgagcgactgaccaaagtgatgtaacttctctcccttctgttttttctcctcttgttatggtgtatcttgcctctgatttcagtagggttttaggaaaacattcaccgggcctttcgcttgtgctccggtggctggcttcgtgcatgcttttctgcctagccgccgccggctcggcctcaattgctaacgacctacgaccgtaattccggacgctgttgtgtaactttaatgtgtggtgcaatagtaatatgtcacgacatattgtgggagatttgctcccgtgc

SEQ ID NO: 4760 - DNA, 3361 bp, Zea mays
agaagaccctccccaagtcaccgaacaagatcgtcgtgggcagcactcgccactcgctctcgcaggcggtgaggcggcgctatcagagcggacttcgccctccccccacccccacccccacgtccccctacaggtagccctgcaaccatggccgcggcggccgggctcagccgccggtgcaccgtccgctgacaagtcgacctttctcctacgacagcaaccgtcttcgtccggtcctggctgtttaaaaggagaggaaaggcaggaggaggggaggagttagtgttaagccaatgggggctattggaggcaatgagtcggtgcagtgggataaagtggctggagctgatgctgttaatggcggcggaacaagtgtgggcaggatggacaggatacaggtgctggtcaggctgaggccactgagcgagaaggaggttgcgaggggagagcctgcagaatgggagtgcatcaatgacaccactgtcatgttccggagcacgttccctgatcgacccaccgctccgacggcatacacatttgatcgggtttttcattctgactgtagtactaaagaagtctacgaggaaggggttagggaagttgccctctctgtagttagtggcattaactcaagtgtttttgcatatggacaaacgagtagtggaaagacttataccatgaatggagtaacagaatatacagtagcagacatatatgattacattaataagcatgaagagagagcatttgttctgaaattctcagcaattgaaatatacaatgaagctgtaagggatcttctgagtgcagaaaacactcctcttagactctgggacgatgcagagaagggcacctatgtggagaaccttacagaggttgtgttaagggactggaaccacctcaaggggcttatttctgtatgtgaagctcaaagaaggacaggggagaccttcttgaatgaaaaaagctccagatctcatcagatactgagattgacaattgaaagttctgcacgggagttcctagggaaggacaagtcaactacacttgtcgctagtgctaactttgttgatctagcaggaagtgagcgtgcatctcaggcgttgtctgctggcacgaggctaaaagaaggctgccatattaacagaagtttacttgcccttggcactgtcattaggaaactaagcatggggagtaatgcacacataccatacagagattcaaagctcacacgcatattacaaccttctttaggaggtaatgcaagaacggctattatctgtacactgagccctgccactagccatattgagcattcaagaaatactttattatttggaagttgtgcaaaggaagtagttacaaatgctcaggtaaatgtggtcatgtctgataaagcactagtaaagcatttgcaaaaggaagttgctaggttggagagtgagttgcggcaaccagcttcaaattccagtcttgaagcattagtaaaggaaaaggataaccaaattagaaagatggagaaagaaattaaagaactcaagtcacagcgtgatttggctcagtctagattgcagaatttgctggagactgttggggaccaagtgaagcactcgggctcagggaagcgttcagcccgcagtcctccatcaattggaatatccccaggcatcagcagggatgatagttctcagatctctcacgatgattcagatcttttcaaggacgtgcgatgcattgggaccagtggaacaggaggaaatgaacagttggacctgtcagctggtgaaagcagtagccttcaaggtttaaacatgaattctagtttgcatggaagcggttcaaatgcatcagtgaattctaggcgctcaaggctccttagtgaatctcctatcacattggagcagcatttggagaatatcaaaaggccttttgttagtcttggcagagatctaggatcgtcgacacataactcatcaggctccagaatacttggtagaagcaggagctgtagatcacttatgggttctaccatgtttgatggcatggagatggatgatggcacccctctgcatagaagtttggttggtttccctggaaggcctgaagggaatcatagaaggggatcaacaccgaaccatgacgcagaaagtgaaactctttcaagagcaggatccgtagtttcaaccaagacaaatgctgcatgcgatgcagagtttactggtataggtgaatttgttgctgaactgaaagagatggctcaggttcattaccagaaacagttaggcaatcagattacaaatggagaatttgtagacataaagaacattggtttggacccgattgctgatgcttcgcaatcaccttctcgctggccattagaattcgagaagaaacagcaagagatcatcgggctttggcacgcgtgctgtatttccttagtccacaggacctactttttcttgctattcaagggagaacaagctgattcaatctacatggaagtggagctccggaggctatcattcctcagagatacctactctcggggaaacacccctagcaatgcggtggtaggcagcttgaactcttcccccgctgcgagcgccaagaagctgcagcgtgaacgggagatgcttgcgaggcagatgcagaagcggctcacggcagaggaaagggagcgcctgtacaccaaatggggcatttcgctggactccaagaagaggaagctccaggtcgctcgccggctctggaccgaggccgaggacctagaacatgtcagggagagtgcctcccttgtcgccaagctgatcgggctccaggagccagggcaagtcctcagggagatgttcgggctcagctttgcgccgcagcagcagccgccccctcgccggcgatcctccaatggctggagatacgggatcccttcgttcggctgatcggatcggatgaacggtgcgagcgactgacctaagagatgtaactaccctcccccccactttttttttattatcttggtgtggtgtacggtaccttctgatttctgtagttttttagtaggatacctaccgggccatcatttgtttgtgcggctggcttcgtgcatgcttttctgcctagccgccgccgatcaggcctcaattgctgacgacatcgtcctatcctacgaccgtaattgtaattcctgactcttctgtgttatcgtgttgacgtgcgctgcaacagcgcaatagtaacgtgatgttccattccatcaggaaaaaaaatcactgggactggtccctatagctaatcatggtcatctaccgtgaactcatgatatttgtctgtctgcatattgaattactgcataaatttagaagta

SEQ ID NO: 4761 - DNA, 1444 bp, Secale cereale
tccattcccctgaagcgtggcgactggcgaccacttccaggctccacctcgccgccgtcgccgcatctccgctctccgccacgcgccgcggcctcttccccgcctccattggttgcccgcatcggctagacggcgagggagagggccggcttgattaatcgccatggcgcggcctcgggcgtgggctccccttcccggccccgccctgtccctcctctccgtcatcctcctcctcgtcggccgccgcggcgctgccgtggcaggcggcggccgcggcaggggcagctccgtgtacccggcccccgtcgtctacccgcaccactccagacagatctcctggcatccgagggtcttcctctacccgcacttcctcaccgacgacgaggccaaccacctcgtctccctcgccagggcggagctcaagaggtcggcggtcgccgatgaaacgtcgggcaagagccagctcagcgaggtccgcaccagctccggcaccttcatcagcaagggccaggatccaattgttgctggtatagaggataaaattgccgcatggacatttcttccaaaagagaacggcgaagacatgcaagttctaaggtataagcgcggagagaagtatgagccgcactatgatttcttcaccgacagtgttaacactatccgtggtggacatcgggtagctactgtacttttatacttaacagacgttgcagaaggaggggaaactgttttccccttagccaaggcacgcaaaggatcacaccataaggatttgtcagaatgtgcacagaaaggcattgcagtgaaaccacggaaaggggacgcccttctgttcttcaaccttcggccggacgccgagacagacccgttgagcctccatggcggatgcgaggtcatcaagggggagaaatggtcggccacgaaatggatccgcgtggcctcgttcgacaaggtctatcacatgccaggcaactgcactgacagcagcaacagctgctcgcaatgggcggcactgggagagtgcacgaagaacccggcgtacatggtgggaaccgcggcactgcccgggcactgtaggaggagctgcaacgtgtgttagcgctggaatggaatccttggaacgtcgcttgttgctggagttcgggttcatacagaagcagcaatggcgggtcgaactgagcatgaggtttgctcgtccagatcgtaccatttattgatgttaccagaggatagacccttgctgattagcgcttgtaatttgtgctaggccggcagagatgagttgattgtttaagttggtccatggcaggtttcatgagcttgtggtgccatttttgtccgtagactgtagggactgtaatatcttttctcactcctgtgctatactgtggtatatatatatgtagcaccaacacgtgttccctgaattcgacgaacattgcca

SEQ ID NO: 4762 - DNA, 1174 bp, Panicum virgatum
acagcaaggccaacccgcgctccgaggcagcgagctccaacccaacccccacatggccgcctccgcaatgccgctgctcctggtcctcctgctggcgtcgccggcggccacgcgcctggcgtccgccgcctgcgcgagcgagaagttcccggcggggcggacgtacgccacctgcgaggacctccccaagctgggcgcgtcgctgcactggacctacgacgcgtccaagtcgtcgctctccgtggcgttcgtggcggcgcccgccgcgcccggcgggtgggtggcgtgggggcttaacccggccggcgagggcatggccggcgcgcaggcgctggtggcgctcaaggggtccgggtccgcggcgcccaccgtgaagacgtacaacatctccgggtacgcgctgggcgccccgtccccgctcgagttcccggccaccgaactcgccgcggacgccggcggcagcggcggcaagatccgggtgtacggcaagctgcagctgcgcaaggggatgaaggccgtgaaccaggtgtggcaggtcgggtcctccgccaccggcggcgcccccgacaagcacgccttcggggccgagaacctcgccgccaagggcaagctcgtcctagccggcagcaaggccgccgcgggcgcccccgccgccgcgcccgaggccggcggcccggccgcgtccggcggcagcgacagcggcgcggcgtcgtccatggcgccgtccggcgggaagtccccgaacgctgccgtgtccacggcccgcgtgtcagcgccggcgctcctcgcgctgacgctggtggggctcttggcgacggtatgatgatggcggtagctggaacgccggatggtggacgctgcctgccatcactcctccctcagtgggtgaaggcggcggcggcggcggctccggcgggagaggaaatgctgcgctacttttgttgggttatttttctttctttttggccgtgcaataaaaatggttgctgtacttgtgttgttgaggtgttgttaggtatcatagcgatttactgtagtggagacatgtcattcatccggtcacatggacgtagttcttgccactgcgctctgtgcctctgtttctgaatctctctctggtgggacgatgccttgcctgatcttttttttttctgtaaaaaaatcgccttgcctg

SEQ ID NO: 4763 - DNA, 1114 bp, Panicum virgatum
ctccgctccaagaacacagcaaggccaacccgcgccccgaggcagggagcgccgacccaaccccacatggccgccgccgccgccgcaatgccgctgctgctcctggccctcttgctggcgtcgccggcggccacgcggctggcctccgccgcctgcgcgagcgagaagttcccggcggggcggacgtacgccacctgcgaggacctccccaagctcggcgcgtcgctgcactggacctacgacgcgtccaagtcgtcgctgtccgtggcgttcgtggcggcgcccgccgcgcccggcgggtgggtggcgtgggggctcaacccgtccggcgagggcatggccggcgcgcaggcgctggtggcgctcaaggggtccgggtccgcggcgtccacggtgaagacgtacaacatctccgggtacgcgctgggcgccccgtccccgctcgagttcccggccaccgagctcgccgcggacgccggcggcagcggcggcaagatccgggtgtacggcaagctgcagctgcgcaaggggatgaaggccgtgaaccaggtgtggcaggtcgggtcctccgccaccggcggcgcccccgacaagcacgccttcggggccgacaacctctccgcgaagagcaagctcgtcctcgccggcagcaaggccgccgcgggcgcccccgccgcctcgcccgccgcggcgcccgaggccggcggcccggccgcgtccggcagcgacagcggcgcggcgtcgtccatggcgccgtccgccgggaacggcaagaccccgaacgccgctgtgtccacggccgccgtatccgctccggcgctcctcgcgctggcgctggtggggctcttggcggcggtatgatgatggcggtagctggaacgccggctggtggtcgctgcctgccatcattccccagcgaaggcggcggcttgccggcgggagaggaaatgctgcgctatttttgttgggttgtttttctttctttttggccgtgcaataaaaatggttgctgtacttgtgttgttgaggtgttgttaagtagcatagcgattttactgtagtggagacatgccattcatccggtcacatggccgtagttcttgccactgcgctc

SEQ ID NO: 4764 - DNA, 1544 bp, Sorghum bicolor
agctttagactctatgatggagtctgtactgtgagtgtcctaacagcgaaagtgctactataaaagtcgaaaacaacctctaagacgcccggaattgccgattaagcccacaccactttccgctcgttataaatcccccgacacgcactcattcaacagctccaagaacagagcgaaccgagcactgaatctgaaggagagtgagctgtccaaagcctcctccacaatggcgcaccacctcgcgctgctcctgctcctgctggcctcgccggcggcgacgcgtctagcatccgccgcctgcgggagcgagaagttcccagcggggcgcgcgtacgcgtcgtgcgaggacctgccgaagctgggcgcgtcaatccactggacgtacgacgcgtccaagacctccctgtccgtggcgttcgtcgcggcccccgcggcggccggcgggtgggtggcgtggggcctgaacccgacgggggaaggcatggcggggacgcaggcgctggtggcgctggcggggtccgggtccgcggcgcccaccgtgcgcacgtacaacatcacgggctacgtcccgctcggcaaggcgtcgacgccgctcgacttcccggccaccgacctcgccgcggacgccgccgggagtggaggcaagatccgggtgtacggcaagctgcagctgcgcaaggggatgaaggccgtgaaccaggtgtggcaggtcggcgcgtcatccaccggcggcgcacccgacaagcacgcgttccaggcggataacctcagcgccaagagcaagctcgtcctcgccggcaaggccgccgcggccgaggccccctcgcctgcctcccccgcgcccgaggccggcggcccgtccgcgtccggcgcaggcagcgacagcggcgcggcgtcgtccatgtcgccctccaagtcgcctaacgctgctgtgcccgcggctggcgtgtccgcgcccgcactcctcgtgctcgcgctggtgggcttcttggtgacggtatgatgatgatgatgatgcatggtggctggatggtgggcggtggcaccattcccagcgaaggtggcggcggcggcggcggtgggtaggggaggggaggaaatattgtggctgttttagttcatttttcggtttgtttttggccgtgaaataaaaaaaaggggggttgatgtactgccgtactgattgttgagctgttgttaggtaggcatgatttactatttactgtagtggacgcggtgttcatcggttctccataatgagttctctggcctttagttgtcgacgaaagctagtcggcagtctatcttagggtatacccacggtagtagtttatcggtagacggtgcgcgaactacgaactcgacggtgacgcaagacacggacaagctttttatccaggttcggccgccgagttggcgtaatacctacgtcctgcgtctggttgtattgatttgtgctgagagaatatgatgtatatgacttgtcctctaggggactcctgcccctccttatatatcctgaagggacagagttacaagcaaag

SEQ ID NO: 4765 - DNA, 960 bp, Pennisetum glaucum
cgcctcctctcttttccgtcagcatgcttgcctcgttttcgctccttctccttcttgatcatcccgaccgtcttgttccccccagcgcgagtcatgtcgtcgtcgtcctcctcatcctcctccgccgtgccgttcgagaagcccagggccgtcgtcaagaagctcctcgccgagtcgcagcccgaggggcagggcgccaccgtccgccggagcatcggcaggcatgagctcaggaacctcgaccccttcctcatgctcgacgagttctctgtctccaagcccgccgggttccccgaccatccccacagagggttcgagaccgtcacctacatgctcgagggggccttcacccaccaggactttgcaggccacaagggcaccatcagggcaggggatgtccagtggatgactgccggccgcggcatcgtgcactcggagatgccggcgggggacggcgtgcacaagggcctgcagctgtggatcaacctctcctccaaggacaagatgatcgagccccggtaccaggagctttgcagcgaggacatcagccgcgccgagaaggacggcgtcgaggtccggatcatcgccggcgaggccttcggcgtgcggtccccggtctacacgcgcaccccgaccatgtacatggacttcaccatgcgcccgggctcccggctccaccagcccgtcccggagggctggaacgccttcgcctacatcatcgacggcgagggcgtcttcggccgggaggagtcggcgccgcccgtgcccgcgcaccactgcgtcgtcctgggccccggcgacggggtcagcgtgtggaacaggtccgccgcgcccctgcggttcgcgctcgtcgccgggcagccgctgggcgagccggtggtgcagcatgggcccttcgtcatgaactcccgcgccgagatccagcaggccatggaggactactactacggcaagaacggg

SEQ ID NO: 4766 - DNA, 1764 bp, Panicum virgatum
gacacctaacccatctctcaaccttcatcctctcagctataaagaggggggccatcgcatgccaccgagctgtagcccggtggtggagggcgggcttggtctcagtgcatggccattcttccctctctaccttagacagcagctggaggaagacaacatcttctccagtctccacacaagaatagatagagcttcttcttcctcgttttttttcgttcttcttttcttttctccgtttctttctcttcttcttgatctaaagccgctgcatcgatcaatcctagcatccttgctgtttttcttccccaaggatctcgctagcttcttcttgcagttttcactcaaactaatacagttctttcagcttttaaccttctcagcagttctccttttgatttccttttcccttcagcaatcccaacggaaacctgtgtctttcttggagcaaaatagcgcagagagacctaagaagtaagacctttcatcccagatcaacaagatggaaaacgttctctttgatcgatcgtctggaagcctcgagttccccaagacgaggtccctcggccgcagccggcgggggctcggcgcgaggccggcggcgccgggcggcgcgtacagctccttcccgatgctccagccatacaaccacctgcacaacggtggcgcgtggacctccgctccggcgcttccgtacgcgaggcctccgatatactcgtcgccatctctgcctctcctaccgtccaaccaaccgccgctcctgccactcccacccgccgccaccaagtacgccactttcccctgcctaccagcagctccgcccccgccaccgccggcgccacgcgccggccggagcgcagcggtaaccaccacagttccagcagcagcagcagcgccagcacctgcgcggcgtgagagggacaggaggaggaggccggcaaggccgccgccgccgtcgacggcggaggcgcccagggcgcaaaaaaagaagccgttggagcgggcgacgcctctgccgcccgcgccggtggtgaacgaggcgctggacgacctcgagcaggaggtggccaggaacttcgtccaggaactgctgcacgcgctcgcgccgccacccagcagcctgccgatgcccaggttctccctcgtcatgaaagcgtcccctgccacggcctcccgggcggtggcggtgccggccgcgccgtcctgcaacgtggaggccgccaccgccgacggcatccacggcctcctccgcctgtaggagagaagcaaggcttctccgccgcgtttggtattctctagaatatttccctccaatattattttttttggccgggaaaattaaatgcgtcccaaaggtaggaaaaaaatattgggagaaaatatgtgatgctcgagctatggtcggtcgagttgtccgtagtgtgactgtgatggtggcgttggatggatgctatctctggcggtgcaaaagcgagaggaagaagacgatgtctgctaatgaggttagtttgtggaagacgccatgtggtagatatctagggttttacgtgatgtcttccgacgtaagtacgtaactatatgtacgacgcagcacttcttttcttgattgggtgatgggtttttgaattaccttgtatcaagagattactacatgtatggtgtatgcaagtgatggcgtggctttacttatatatatacaaaaaaaatgtgtgcttgcagaatattgaagtgtggaaaatgttgcttccttgtgatctaatccacctg

SEQ ID NO: 4767 - DNA, 1790 bp, Panicum virgatum
ggacggtagtttgtggtcaattgtcaaatcccttttcgcaattttttttgtcaaatcccctcccatattttccccaacgttagacggtgtgacacctaacccatctctcaaccttcatctctcggctataaagagggggccatcgcatgccaccgagctgtagcccggtggtggagggtgggcttggtctcggtgcatggccattccctctctaccttagacagcagctggaggaagacaacatcttctccagtctccacacaagaatagatagagcttcttcctcgttttttttttctgtttctttcttctgctcttgatctaaagccgctgcatcgatcaatcctagcaatctagcatccttgctgtttttcttccccaaggatctagctagctttttcgatcttgcagttttcactcaaactaatacagttctttcagcttttaaccttccttctcatcagcagttctccttttgatttccttttcccttacctgtgtctttcttggagcaaaatagcgcagagagacctaagaagtaagacctttcatcccagatcaacaagatggaaaacgttctcctggatcgatcgtctggaagactcgagttccccaagacgaggtccctcagccgcagccggcggggccccggcgcgaagccagcggcgccgggcggcgcgtacggctccttcccgatgctccagccatacaaccacctccacaacggtggcgcgtggacctccgctcccgcgcttccgtacgcgaggcctccgatatactcgtcgccatctctgcctctcctaccgtccaaccaaccgccgctcctgccgctcccacccactgccgccaagtacgccactttcccctgcctaccagcagctccgcctccaccaccgccggcgccacgcgccggccggggcgcagcggtaaccaccacagttccagcagcagaggcagcgccagcacctgcgcggcgtgagagagacaggaggaggaggccggcaaagccgtcgacggcggaggcgcccagggcgcagaagaagaagccgctggagcgggcgacgcctctgccgcccgcgcctgtggtgaccgaggcgctggacgacctcgagcaggaggtggccaggaacttcgtccaggaactgctgcacgcgctcgcgccgccgcccagcagcctgccgatgcccaggttctccctcgtcatgaaagcccctgccacagcctccaggacggtggcgccggccgctccgtcctgcaacgtggaggccgccaccgccgacggcatccacggcctcctccgcctgtaggagagaagcaaggccgtttctccgccgcgttttggtattctctataatatttccctccaatactatttttttggccgggaaaattaaatgcgtactaaaggtaggaaaaatattgggagaaaatatgtgatgctcgagctatggtcggtcgagctgtccgtagtgtgactgtgatggcggcgttggatggatgctatctctggcggtgcaaaagcgagaggaagaagacgatgtcagctaatgaggttagtctgtggaagacgccatgtggtagatatctagggttttacgtgatgtctaccgacgtgagtacgtaactactgtgtacgaagcagtacagcttttcttgattgggtgatgggtttttgaattaccttgtatcaagagattactacatatatggtgtattcaagtggtgtggcttttacttatatatatatacaaaaaaaattgtgtgcttggcaaagtattgaagtgagaaaa

SEQ ID NO: 4768 - DNA, 1351 bp, Saccharum officinarum
gctttgtgcaaaggccattccctcgctctctacactagatagcaggaggaggaagataacatctagcttctgcttcctctttgggtttctccgttcttccttttcactttgtttttctttcttcttcgatctaaactcgccttccatcgatcctagcatccttgctgtttttcttccccaaggatgttgctaggtctcctcttgcagatttctgaaactaatacaagttctctaagctcttaaccatctgagttctccttttagcacttccttttccactcagcaatcaatatcgaaaccctctttcttgagcaaaatagcgcaaatactacctaagaagcttttgccctatagacagcaaaaacaagatggaaaacgttctcctcgatcgatcatctagcagaagccttgagttcccgaagaggtcccttggtcgcagccggcgggggccagctggcgcgaggccggcggtgccgggcggcggctcgtacagctccttcccgacgtggcagccatacaatcacctgcacaaaggtggcgcgtggacctccgctcccgcgcttccatacgcgaggtctccgactccgatgatatactcgtcgccatctcttcctctcctgccgtccaaccaaccgccgctcctgccgctcccacccatcgccaccaagtacgccactttccccggcctaccagcagctccacccccaccaccgccggcgccacgcgccgccggcagggcagcagcggcaaccaccacagtttcagcagcagcagcaccagcccctgcgccgccgcgccagagggataggaggaggaggccggcaaggccgccgccgacgacgacagagaggtcgtccacaccgcagaagaagaagccgctggagcgggcgacgcctctgccgcccgcgccagtggtgacggaggcactggacgacctcgagcaggaggtggccaggaacttcgttcaggacctgctacacgtgctggcgccgccgccaagcagcctgccgctgccaagcttctccctcgtcgtgaaagcgtcccctgccagggacaccagagtggtggcgccggccgcgccgacctgcaacgtggaggccgccaccgccgacggcatccgcggcctcctccgtctgtaggacagccgcaggagaatgaaggcctctctgccagcctgccgtgcttagtattccataatatttccccgccaatattattctcttggggtgggaaaattcaatgggttcttaaagtggaaaaaatttggagagaaaaaatgtgaagctcgagccatgggtgcggccactcgttccccaaatgtgaatgtgatattggggttggatggatgctt

SEQ ID NO: 4769 - DNA, 1042 bp, Zea mays
ccagcaatccggccgcggccaggcagccaccagcagcgacaagaaatcgagaatcctcgtttcccattttgtggctggcgcgagcgtgcagcgtcacaggtttccggacggacgctttctatcgcaatcctatctatatatttatcccaaggcttcgtggtttttgttgctgctgctgctgtcacggccgccttccactcccacaagcttcagctagccttcttactcccgccgtcacccccgatccgagagcgagcatggcgcactctctcgccgcctccttctcgccggccgccgcccggcgccaggtcacaaatgtgattccaagctggacctcggtttccttccagagccacaggatgacttctgtatccatccgctcaagacaaaggtctcttgggtttaagatttgctgttcggctaagaaagagacagtggacaaggtttgcagtatagtgaaggagcagctggctcttcccgatgggaccgccatcactgccgaatcaaaattcgctgaacttggcgctgattcgctggatacggtcgagattgtgatgggcctcgaggaggcgttcaacataacagtcgacgaaacaagcgcacaggacatcgcaacagtgcaggacgctgcggaccttatcgagaagctcatgctggaggcacctccaaaggtcgtctagatccagcaaccttgcgatcgacgaccttgtgtttgatctatgttgtgtgttaatttgttcgtgttgccccatttgttctttcttgatgattcaagatgaggttttgtattggtgttgctgaggtgaattagatagccccaaaggccacatgaagcagatgaggacagttcattccactttgaatttgtatgttgtaacttgtagtgctgctatagagaaaccaatggactgttatgaagagtcaatgcaactgttgcttttttagttttgggaagtcacacacatgaaagtctgaatcagatgcagtactaattgttgagcttggggtgcagatatatgcaaataccaggatgtcaggtgct

SEQ ID NO: 4770 - DNA, 809 bp, Panicum virgatum
tgcgtggtagcttctgcctcacctgacctcacctccccaccccagcgagcatcaccagcagagccagcctctctctctgtcccgccgccgccccccgatccgagagagcgagcatggcgcactccctcgccgccgccgcatccttctcgccggccgccgcccggcgccaggtgacgaatgtttccttccagagccacaggatgacttctgtgtccattcgttcaagaccaaattctcttcggcttaagatttgctgttcggctaaaaaagagacagtcgataaggtttgtagtatagtgaaggagcagctagctctccctgatgggactgcgctcagcggcgaatcaaaattcgctgaacttggtgctgattcactggatacggttgagattgtgatgggcctcgaggaggcattcaacatcactgtcgacgaaacgagcgcacaagacatcgcaactgtgcaggatgcggcggacctcattgagaagcttgtgctcgagaaggctgcataagcaccataagtggacgatccaactggacccttcgaccctgtgatcaatgactttgcattcgatctctgttgttcaagttacccatttgttgtttcttgatcgttcaagataagattttgtattgaattattgatgttgctgaggcaaattagatgcaccaaagactacatgaagcaaatgaaaatgatgtattccactttccatttgtatgttgttaaactggcgaagagtcactgcaactgtcttctagatttttgagaagtcatacagtgctttataaaaagtctgaatacgacg

SEQ ID NO: 4771 - DNA, 809 bp, Cenchrus ciliaris
  misc_feature (774)..(774): n is a, c, g, or t
ccacgacccaatgctggcgaccgcctgcggcgcgccgccgtgcccgtgcgcgcggtcgcgcctgctcccctcggcgagcttaggaatcggctttggcggtgcatgcgttcgcaatacaaggcggaggacgccgaggagggccgcggtggtgcggtgcgggctgctgcccgtggatccatgggcgccgaccatggactcccagagcgtggcgtcgcagctcttcgccgtgtcgctcttcccctacctgggcttcctctacttcatgaccaggtccaagaccgcgcccgggctcacgctcttcggattctacttcctcctcgtcttcgtcggcgccaccatacctgctgggatttatgcaaaagttcattatggaacctctctctctaatgtcgactggctgcacgggagtgcagaatcgctgcttactcttaccaatctattcattgttttggggctgagaggagcattgaggaagctggaggaagaggatacaaaggagagcatttctgaagcttctcaagacagtaaagaaaaaagttctgtctagacagttctttgtatatgtaccctaattgtgcatctagttatgtcgtaggagtacatatatttcttctgctcaactagccgttaaggtttatgtatagaaaccctcagcaggttttctttgtgcatatgctgatccagaacatgggagttactgcagttcttgcagcactgtgtaacgatttatggtactgcaatttccactgggatagctattcagtattcacaatntaagtgcccgaacgtgattattgacaaagccttta

SEQ ID NO: 4772 - DNA, 1386 bp, Sorghum bicolor
agacaatggaaagtagaaaacccttccggcctgacatttcgtcgaacgccgccgccgagtcgtgccccagccaccgcagccatgctcctcacgaaaccccacctctccaactcgttcctcccagtcccatccccgccgccctcgagtcccactctcagcttcagctccaaccatgccaggccccttgccgcccctatttgccggcgcagccgcctccgcatctccgccacatccacggctgcgccggctccttccgcggcggcggcggccgctgccaccgcggcgctgagccgagtggacgtgctctcggaggcgctccctttcatccagcgattcaagggcaagacggtggtggtcaagtacggcggtgcggcgatgaagtccccggagctgcaggcgtccgtgatccgcgacctcgtgctcctctcctgcgtcggcctccgccccgtgctcgtccacggcgggggcccggagattaactcctggctgctgcgcgtcggcgtcgagccgcagttccgcgacggcctccgcgtcacggacgcgctcaccatggaggtcgtcgagatggtgctcgtggggacggtcaacaagaacctcgtctccctcatcaacattgcgggaggcaccgccgttggcctctgcggcaaggacgcgcgcctcatcaccgcgcgcccgtccccaaacgcagcggcgctgggattcgtcggcgaggtctcgcgcgtggacgccgccgtcctccatcccatcatcgccgcgggacatatcccagttatcgccaccgtggccgccgacgagactgggcaggcctataacatcaatgccgatacggcggctggtgagatagcagctgccgtgggcgccgagaagctgctgctgctcacggatgtgtctgggattctggcggaccgtaatgaccctgggagcctggtgaaggagatcgacattgctggggtgcggcagatggtggccgacgggaaggtagctggtgggatgatacccaaagtggaatgctgcgttcgcgcccttgcacaaggtgtacacaccgctagtatcattgatgggcgtgtcccacactcccttctgcttgagattctcacagacgagggcacaggcaccatgatcactggctgagctgcttcgtgccttcatggtattttcctgtgcctcttttctcattttgtcatgtattttatggctatgtaggcttgactcaagattgcaataagactacctaagtttggttgaaatgtttcatgtttgtgcgcccatttattatatgtaactttgttggcaacttgttgaggaagatgttgaagttctgtagtttgtttggtaaattggatcaattcaggttataatttatttaagggaagcggtatttattgt

SEQ ID NO: 4773 - DNA, 1924 bp, Oryza sativa
tcatgtatgatctttctccggttttgtgtttcttttgtttcggagagctgatctggatagttcactctttcgtttgaatcaagtagtccagtatgagatgtgtgacaatcgtcagactttgaatccggagacagtgtcagacaaaaaaatcgtgttcactggccagcctcttctacccttcttctgatcctctcccgtatagccatttcgtcgaacaccttcccgagccgactgccgccgccgccgccatgctcctcgcgaagccccacctctcctcctcctctttcctcccatccacgcgggtgtctagccccgctccgggtcccaaccacgcaaagcccatcgccgcctctcccgcccctcgacgctgcctccgtctcgccgtcacatccgccgcggcgccggctgcttcgtcggcggaggcggcggcggcgctgagccgcgtggatgtgctctcagaggcgctccccttcatccagcgcttcaaggggaagaccgtggtggtgaagtacggcggcgcggcgatgaagtcgccggagctccaggcttcagtgatccgcgacctggtcctcctctcgtgcgtcggcctccaccccgtgctcgtccacggcggcggccccgagatcaactcctggctgctccgcgtcggcgtcgagccgcagttccggaacggcctccgcgtcactgacgcgctcaccatggaggtcgtcgagatggtgctcgtcggcaaggtcaacaagcacctcgtctccctcatcaacctcgcgggcggaaccgccgtaggtctctgtggcaaggacgctcgcctcctcaccgcgcgcccctccccgaacgcagcggccctcggcttcgtcggcgaggtctcgcgcgtggacgccaccgtcctccacccaatcatcgcctccggtcacatcccggtcatcgccactgtggccgccgacgagaccgggcaggcctacaacatcaacgctgacacggcggccggcgagatcgccgccgcggtcggcgcggagaagctgttgctgctcacagatgtgtctggaattctggccgaccgtaatgaccccgggagtctggtgaaagagatcgacattgctggggtgcggcagatggtggccgacgggcaggtagctggtgggatgataccgaaggtggaatgctgcgtgcgtgccctcgcacagggcgtgcacactgcaagcatcatcgatgggcgtgtcccgcactcgttgctgctcgagattctcacagatgagggcactggcactatgatcactggctgaggtgattcatcccgtcgtggtttttgtcattctttttggagttggcctggtgtgatatgatagattgaactgtgaaccacaagtgaatggagaaaatgacttgatttggcaccactataccaaggttctagctgtgactcatgaggtttggagaaactgatggcatggagggctggactggtagagctctgggtccttgcagacatcattcctctgttctttccaccaccatggcatggtcagagcaaattccacttgcatctaatggaacggtgccttcttttccgtatttaagtactgtattagtggaaactttcagtctttcattgtgccattcgtcatttctgatctgttgtgtgagagaaattttgagaaaagggaggaaaagctctaccccttcacttggcgttacagaatctattcctcattatgttgtctatttactttttgtgcgatactgatacggtaagcatatcgtagtgctgtttagtgtctgttgagcacttcagccccttagaactgttgtgcttagcactacaatgcttgcggctatataataataagacataccttcagatttaaggggccatttctgtttagcttgatttttttccccaacatgttgttctgttcattcctttcgg

SEQ ID NO: 4774 - DNA, 1350 bp, Oryza sativa
cgcagtcttgtagtctcgtgcaccaatcgtcgcgccgcggcgacgttaggcatttcgtcgaacacctagagcgcagccatgatgctcaccaagccccacccttcgtccaacctcctcctccccaccaccacagcgctcccaaatcctagcccaaaccctagccgcgtcacgcccctggcttccggccgtggccgccgcggccaccaccgcgtgtgcgcctcctccgtggcgcccgcgcagcccgcgtcggtggcccagcccacggcaccggcgctgagccgcgtggacgtgctctcggaggcgctcccgttcatccagcggttcaggggcaagacggtggtggtgaagtacggcggcgcggcgatgaagtcgcccgagctgcagtcgtcggtgatccgcgacctggtcctcctctcctgcgtcggcctccgccccgtgctcgtgcacggcgggggcccggagatcaactcgtggctggggcgcgtcggcgtcgagccgcagttccggaacggcctccgcgtcacggacgcgctcaccatggaggtcgtggagatggtgctcgtcggcaaggtcaacaagcagctcgtctccctcatcagcgtcgccggcgccaccgccgtcggcctctgcggcaaggacgcgcgcctcctcaccgcgcgcccttcccccgacgccgccgcactcggcttcgttggcgaggtgacgcgcgtcaacccgtccgtcctccaccccatcatcgagtccggccacatcccggtcatcgcgaccgtggccgccgacgagaccgggcaggcctacaacatcaacgccgacaccgcggccggcgagatcgccgccgcgttgggcgcggagaagctgctgctgctcaccgacgtgtccgggatactcgccgaccgcaatgaccccgggagccttgtgaaggagatcgacatcgccggggtgcggcagatggtggccgacgggaaggtgggcggtgggatgatccccaaggtggagtgctgcgtccgcgcgctggcgcagggcgtgcacaccgcgagtatcatcgacggccgcgtcccgcactcgctgctgctggagatcctcaccgacgagggcaccggcaccatgatcactggctgaatttctgaatttctgggcaggcaataagcatggttaattcaattcttcgttgtttttggcatctttttttgggggattggttgttcgaacttggaattgatcttggaaccagatggttttgcaccctttggatgtaacagaaatgtgatcttgaatctcattgctatgagaaacgtcgatgaaaagggaaaacagaattcaattttgtgagtgcacaatcaatcttggtgc

SEQ ID NO: 4775 - DNA, 4784 bp, Oryza sativa
atgctccaattccacaagaaaccaaacgaggagctacaacaaggtaggaattgtgggtgaccccaagcaatactccacctccatccagatattgcaactacccttcctatcccagtcaaaagccttcaaaaatttattatctccaccacatcatcacaagccgcagcagtcagaaaaacaaggggaagaagagcagattggattagcgccgagccgaggcggcctcgacgataagcttcgcctcgccggccgccgccatgcggaacccgcccgggaggcacctcctccgcgtcgccacccgcgccgtgcgctcctcgtcggcgctcggcagcggcggcggcggagggggcgcctcgacctccgccacgtcccccgtcgccgcctcctcctcatccggtggccgcccgcgcacccgctccggcggccgcctcctgcgcgccacctcgccgcccccgccctccgccatcgccgcggccgcgtgctgggagtcccgcacgatgcgccgcgagggggaggaggagtgggaggaggtcgtcgccggggccgaggaggcggttcatggggcccccgtgcctgttgcggaggaggaggaggagtacagggtggtgttctggtcgccgcccaccggcgacgaggtccgcgcagccttcaccagcatcgaggaggtatttggtgatccttttcgtgcgcattcttatgaaactgaggagcaatcagcattgtccacctcagtacattcgtcatctggcaattcatcaggatcagatgactggattgaacctgctgcctatgctctcaactcaactgctcttctgacaagggaacatagaaatgttttggatgccttccgtttattgcaaaaagatcctaatgttcagaaaatggtcatgtccttgtcatgcgacagggctgtatgggatgctgttatgaacaacgaggcagtgcaagaattcaggagatctttccaggatgacaaagaagcagcaggtagaaagggaaaccctggtggtcctgctggagtgcttaagtggattctgggcaacacccaagcaaaaataatggaattcatgaataatataatgaagattgtgaacatgcttttccactctgatgatgatgaagcgaagcccgacctttacactgatgcagtgaaggtgtcattcatgctctcagttttcatcttcatcgtggtggccattgctcgtatcaattttgagccgtgggatttcaaagtgtggtgatgcaagattctgcaagccgtgtgtgcatgttttgtaggacagctcatgatttccaagctatctaacttaaattcacacgaaattgtacatcgatgatttctgtatcatttgaccctgttagtctgttgtaaaggattggtttgtctgtgtcccattttcactgggagattaatatacttaagaatagataaatagttccgcttgcttggacgatgggttggaactcgcccgtcgcgttgccgccttgcagcagcaagttgaccgtggttgtcaagcccaatctctgaagctaccttccccgtccacgctaagaatgtcgagcaacaaatccacaagcacccaccaaccttaggtcaaatcgcaccaaacaaagcatatgcgcttatgtttggaagtttgaattgacactgtaacttttcatccgaataaatctgcaccaagattgattgtgcactcacaaaattgaattctgttttcccttttcatcgacgtttctcatagcaatgagattcaagatcacatttctgttacatccaaagggtgcaaaaccatctggttccaagatcaattccaagttcgaacaaccaatcccccaaaaaaagatgccaaaaacaacgaagaattgaattaaccatgcttattgcctgcccagaaattcagaaattcagccagtgatcatggtgccggtgccctcgtcggtgaggatctccagcagcagcgagtgcgggacgcggccgtcgatgatactcgcggtgtgcacgccctgcgccagcgcgcggacgcagcactccaccttggggatcatcccaccgcccaccttcccgtcggccaccatctgccgcaccccggcgatgtcgatctccttcacaaggctcccggggtcattgcggtcggcgagtatcccggacacgtcggtgagcagcagcagcttctccgcgcccaacgcggcggcgatctcgccggccgcggtgtcggcgttgatgttgtaggcctgcccggtctcgtcggcggccacggtcgcgatgaccgggatgtggccggactcgatgatggggtggaggacggacgggttgacgcgcgtcacctcgccaacgaagccgagtgcggcggcgtcgggggaagggcgcgcggtgaggaggcgcgcgtccttgccgcagaggccgacggcggtggcgccggcgacgctgatgagggagacgagctgcttgttgaccttgccgacgagcaccatctccacgacctccatggtgagcgcgtccgtgacgcggaggccgttccggaactgcggctcgacgccgacgcgccccagccacgagttgatctccgggcccccgccgtgcacgagcacggggcggaggccgacgcaggagaggaggaccaggtcgcggatcaccgacgactgcagctcgggcgacttcatcgccgcgccgccgtacttcaccaccaccgtcttgcccctgaaccgctggatgaacgggagcgcctccgagagcacgtccacgcggctcagcgccggtgccgtgggctgggccaccgacgcgggctgcgcgggcgccacggaggaggcgcacacgcggtggtggccgcggcggccacggccggaagccaggggcgtgacgcggctagggtttgggctaggatttgggagcgctgtggtggtggggaggaggaggttggacgaagggtggggcttggtgagcatcatggctgcgctctaggtgttcgacgaaatgcctaacgtcgccgcggcgcgacgattggtgcacgagactacaagactgcggcgtcggacgtgcggcacagtgtttgggtacttgtagatggtggcggcgggcggagtaggtgatgaccgggctcccgagctggtgcggtgcgcgagagcggctgcggtttgacacgagcacgtgcttttccttttggtgttggctataacaagggttaattggatccatgccaacttttttttcccacctctcgcaggcgcagccaaaaccaccgcaaatagttaaatgcccccaaattctcccacctcctcggcttgctacctcaaatcgcaatccggggattaggctgggggttggtgcctttccccttcgcctcgccggaggagggattggtacggtggtttgggcgcattgggaggggtggttagggttcgtatcatggagggcactgatgatcctgacccggagcggcagcgctccagctctgttgcaccggcgccgcctcgccggctgcggtggcagccaccaatcggtccgtgcctcccccgcgctccgacgaaaagaagaaatcaaaaacttttggaatagctagaagtccataagttggagtactgttcccttgggagtaaattaatgatctaaaacagcagcagagtgctaataatgagacccttggtctggttaacaagccttgggagaaggctagctatacttctatgtttcctttactccaaaaaaccacaagtcttcaaacatttaccaagtgtttcatttgaacagcttgtgatagatttgtactatgttgtttctgttcacagaagcagtagtccttgctcagaattctgccagcggtaatcaacgtagaatatgaaggaataaggcaataagcctcccaaaaagcatattcctaagcatgtgactactacagctggtttttttatgatgctaccaagtttctggcgaattcccagtcatattatagtgtatctaggttcctcagtcagcctgagtaaaaagttagcctgggcaaagaactggcaaaaaaaaaaaaaaactggttattggcacttgcagtttgtgaaacacactttctattcctcagtcaacacttcctgttgaatgaacgaaaaccttgaaagcgcttgccccttttgttgcacttgaatctgcctatcacccaaatttatcttgttcgtttagcaaaaaataatatctacacagtagttcttcacattgttagcgtgataatatgtgctgaatttttagaaaatctaaagttagtaatgcacaatatacatgttgggttgcttagtaaaatatatacgagcaatcatcacctgtgtaagttctaaagagggacacacggtcatgtaagtcctgaagaggtcatgttagcttgatttataaattgtttggatcaaagaagaatatttcttaatgagttgtgttgcaatcttattgtttttaaatgttactgcagatctttatggaaggtgtcatagtgaaacaggttgaagatggtttgcatttagtggtatacaccttgcacaggagttgcagcaggcaaacagcatggtggatctctacaatgagacaaggtaatgcataaggatacaaaaaatatgatatgcttagttgcttacgggactgatgaagacacggtttctcctaagtcctaatccatttgcagttaaaagtttggctagatgtggtagggatctgtttcgttgggcaatgctcaaagaaagatggtgaacttttttttcgggaatacgcaaggagcgcattttttccattaagagaaataaaagttatttac

SEQ ID NO: 4776 - DNA, 1464 bp, Hordeum vulgare
gagcaccagcccagcccccgacccaacgaccgccgccgcagccatgctcctcacgaagccccagctctcttcctccctactcgcatccacgccgctctttacccccgcatccacccccaaccacgccaagccaatcgtcgcctctcacgccccccggcgctcagccgcgtcgacgtgctctcggaggcgctccccttcatccagcgcttcaagggcaagacggtggtggtcaagtacggcggcgccgcgatgaagtcccccgagctgcagtcgtccgtgatccgcgacctcgtcctcctctcctgcgtcggcctccgccccgtcctcgtccacggcggcgggcccgagatcaactcctggctgctccgcgtcggcgtcgagccgcagttccgcaacggcctccgcgtcacggacgcgctcaccatggaggtcgtcgagatggtgctcgttggcaaggtcaacaagaacctcgtctccctcatcaacctcgccggcggcacggccgtcggcctctgcggcaaggacgcgcgcctcatcaccgcgcgcccctcccccaacgccgcagcccttggcttcgttggcgaagtcgcgcgggtggacgcctcagtcctccaccccatcatcgcctctggccacatcccggtcattgccaccgtggccgccgacgagacagggcaagcctacaacatcaacgcggacacggctgcaggtgagattgccgctgcggtgggcgcagagaagttgctgctgctcacagatgtgtctgggatactggcggaccgtaatgaccctgggagcctggtgaaggagattgatatcgctggggtgcggcagatggtatccggtgggcaggttgctggtggaatgatcccaaaggtggaatgctgcgtgagagctctcgcccagggtgtgcacactgcaagcatcatcgatgggcgtgtcccgcactcgctgctgctcgagattctcacagatgagggcactggcacaatgatcactggctaaggtgtacaatgcctccttggttcttgtaaaatttcaagcgccagtacaggcgcgcagagctaagtgcgagtgatggatagaactgtggaaaccaagtggatggagaaaaggtcttcgattgagcgctgctacgtcaagggccaaattatgctagccatgaggatgcgggagactgagatgggttgattcttctcgtcggttcgaccaccatgtcatgggcatagtgaactccacccacatctaaaaaggaacggtgcctgccttcttttcagtatttaatttaccgcattcatcgaaactcttacgctgctacatctaatttgttggacggggatattgtgagagaaaagaggaggaaatctgtgaccactgtgctggtcgttgcagaatctattccccattatgttgcctgtttgctattcttccgtgatactgaatattattggcgtgcattgctta

SEQ ID NO: 4777 - DNA, 615 bp, Sorghum bicolor
cgaaaggccgcatgtccctcccctcgaccacgcagcccagtgaaacagagccaacgcagcccagtgagcccccggcagccggcacttttccggaccccgactccggcgattccccaccgccatggccgccgccggcgaggcctcaagcaagctcctccgcttcatgtacttcgtcggcgcaggagtcatctgcaccaaggccatcaacacctatcgcgactacgagcacaagaaggaggcctccgcggccgtcgccgccgccgaatcggcgttggctgctgccgcggcggccgagcccgctcctgcaaccgccgccgccgcgaagccctgattgcggaggagggcctgtattcgccggttagggttctcgggatgttgctctacagaggggaaatagatattatcttttgtttctgatgtttttgtcacatgtatcgtgttgtcttgacatgaatcatcaataataatacttcatttcctgtctcgtgatcatggtgctactggcttgaattttgttactagtacttaatttccctatgatgcttagtgttgttatcgcacatttgttagctgagtatccgtggccacgatgctttgccttttgctaattctgca

SEQ ID NO: 4778 - DNA, 796 bp, Panicum virgatum
aaggcccataaaggtcacttgcatatgacttcacacatatgggcccaaagtagcccaaggcccgtatacaccagcagatcagatctccttcctcaacagacaggcccgagaaaaacagccgaggaacgaagaaggccgagacccgcagcccagttaggccccggcgcttcctccgaccgattccggcgacctccccaccaggccaccaccatggccgccgccggcgaggcctccagcaagctcctccgtttcctctacttcgtcggcgccggagtgatctgcaccaaggccatcaacacctatcgcgattacgagcacaagaaggatgcctcagctgccgtcgccgcggccgaagcagcgttggcttccgcagcggcgcccgaacccgcgcctgcaaccgccgccgccgccgcaaagccctgattgcggagtggggcctatcttcgccggctagggttattcggatgttgttctccagaggagaaatagatattatcttttgtttctgatattttaattatatgtatcgtactgtggtgacatggtgaatcaataatagccttttttccccatgtcgtgatcatggtgctactggcttgaattcgattgcttaatttttcaatgatgcttaatgttattacacttatgctagccaagtattcgtggccatgatgctttacctgtttgtgttgtttattgtggttttgattttatttactgggttgctatgccaatgcgggaggatcagtgaggaggtagtttatctgttacaattgaggtatagatcatgtttctc

SEQ ID NO: 4779 - DNA, 490 bp, Panicum virgatum
ggttaggccccggcgcttcctccgaccgattccggcgacctccccaccaggccaccaccatggccgccgccggcgaggcctccagcaagctcctccgtttcctctacttcgtcggcgccggagtgatctgcaccaaggccatcaacacctatcgcgattacgagcacaagaaggatgcctcagctgccgtcgccgcggccgaagcagcgttggcttccgcagcggcgcccgaacccgcgcctgcaaccgccgccgccgccgcaaagccctgattgcggagtggggcctatcttcgccggctagggttattcggatgttgttctccagaggagaaatagatattatcttttgtttctgatattttaattatatgtatcgtactgtggtgacatggtgaatcaataatagccttttttccccatgtcgtgatcatggtgctactggcttgaattcgattgcttaatttttcaatgatgcttaatgttattac

SEQ ID NO: 4780 - DNA, 464 bp, Panicum virgatum
gccgaggcacgacaaaagccgagacccgcagcccagttaagctccggaccgactccggcgacctccccaccaccatggccgccgccggcgaggcctccagcaagctcctccgcttcctctacttcgtcggcgccggagtgatctgcaccaaggccatcaacacctttcgcgactacgagcacaagaaggaggcctcagcggccgtcgccgcggcagaagcagcgttggcttctgcatcggcgcccgaaccagcgcctgcaaccgtcgccgccgccgccggaaagccctgattgcggagtggggcctgtcttcgccggttagggttcttcggatgttgtgctcaagaggaggaatatatattatcttttgtttctgatatttttattatatgtatcgtactgtggtgacatgatgaatcaataatagcccctttttccccatgtcgtgatcatggtgctactggc

SEQ ID NO: 4781 - DNA, 1588 bp, Zea mays
ccctcttctctccgtccccacctactactcggcgcctctggtttctctccaagtctccatgctacgcgaccggaaacttccagaatctaccagtaccaccttcctctctctctctcactcttcctgcgcgacggtgcaccctagcccgatccgcggcgccgccatggtcgccgagcaggccaccaccactgtggctgtgggcgagccgccaactgccaccccgcagccggcggcggcagcggctgcggggcagaggtccgtgcccacgccgttcctcaccaagacgtaccagctggtggacgacccggcggtggacgacgtcatctcgtggaacgacgacgggtcggccttcatcgtgtggcggccggcggagttcgcgcgcgacctcctgcccaagtacttcaagcacaacaacttctctagtttcgtgcgccagctcaacacctacgggttcaggaagatcgtgccggacaggtgggagttcgcgaacgactgcttccgccgaggggagaagcggctgctctgcgacatacaccgccggaaggtgacgctgccagtcgcggcggccacgagggcggtcacggtggtggcgaccatccccatggcgctgcccgtggactcgccggtgtactccggcgaggagcaggtgctgtcgtcaagctcgtcccccgagcccccgtcgctgctgcagcagcagccgacgccgtccgcgtctggctccggtgacatgggcgaggagaacgaacggctgcggcgggagaacgcgtggctcgcgcgcgagctcgggcagatgaagaagctgtgcaacaacatcctcctcctcatgtccaagtacgccgccactaagcagccggacgccgccaaggcggcggccgccgggaactgctccggcggcgagtcgtcgggcgccgccgcggcgcctccgcttccttcgatcctggagctcctgccctcctgccgccgcgaccccgcgtccgcggccgtcgacgcagcggcagcggcagcgggaacggagcacgaggttgatgaaaaggcgggcgctaggctgttcggcgtctccatcgggcggaaacgaatgcgggacgagagcagcggtcacggcggcggcggcgaggaccccgtgggccgctcggcggaggtgaaggcggagccggtggacgcgcgtctcgaccatcagcacagcgcgacggagccgcagtcgtggcccatttaccggcccaggccagtgtaccacccgctccgggcctgcagcggcttggtcagcgctgggagcgaccacgactggtccaacaactcgaggtgacttttgcttgcaagcccaatcgtccacaggttacaggttaaacttagaatgagagatcaagtgtttatgtagcaataactttttgttagtttatctcatattaccgcaagtttcgagtatcattcatgtatagcgatccattaaactagaggttaccttactgaggacgacttgaattaaagtcagttgtttaaactgctagtcagttatttagactgttatcgttgtatttcataatgttaagtaaccctaattagggttatgtgggtaaatatctgctttgcc

SEQ ID NO: 4782 - DNA, 2323 bp, Panicum virgatum
cagcaccagcacgacgttgctagcggagaggaggagatcgcaaccgaaacactagcccctcctcgctatcttagggaaatccagtgacggtccagtattggtggttactggtcacacaactttctctcttagctatcaagctatgcttatcaatgaaaataagcttttggattttgcgaggacgagacagctttattcgtcgcccggaatcggcatcatggctctcgcgatttctttgcctgcctatatatgcgtcggctatgcagagtgtgaggccatgcctctcctgggtcgtgcaagcttagttcatctgaaggagctgagacaagaggagggaaacaatggcgagttcttccatggacactgaagctgcaggccaagagctcaagggcggtggctacaccgtcgcggctactgctcatgcagtagactcagactcgtggcagcaggtggggctgttgctggtgatcggcttcaactgcgcctacgtgctgagcttctccaacctcatgatggcgccgctgggctggggctggggcgtcgcctgcctgctgctcgtcggggccgccgcctggtacgccaactggctcctcgccggcctccatttcatcgacggccagaggttcatccggtacagggacctcatgggcttcgtcttcgggaggaaaatgtactacatcacttatttcctgcagttcaccactctgcttctctgcaacatgggattcatcttacttggtgcaagagcactcaaggcaatcaacgtggagttcacccactcccccgccaggctccagtggttcatcaccgcgacgggaatcgtctacttcgccttcgcctacttcgtgccgacgatttctgccatgaggaactggctcgccacgtcggcggcgctgacgttagcatacgacgtcgctctgctggccatcctaatcagagatgggaaatcgaacaagcagaaggattacaacgtccatggcagcccagccgagaaggtgttcaacgcgttgggcgccgtcgccgccatcctcgtctgcaacacgtccgggctgctcccggagatacagtcgacggtgcgggagccggcggtgcgcggcatgcggcgggcgctgctgctgcagtacaccgccggcgccgcggcctactacggcgtcagcgtggcggggtactgggcgtacgggtcgtcggtgtcggagtacctccccaacgagctcggtggaccgcggtgggccgccgtgctcatcaacgccaccgccttcctccagagcgtcgtctcccaacacctgttcgcggtgccgatccacgaggccatggacacgcggctgcagcggctggaggagggcatgttctcccggtacaacctgacgcgccgcttcttcgctcgggggctcatcttcggcttcaacatcttcgtcaccgcgctgttccccttcatgggcgacttcgtcaacctcttcggctccttcgctctcgtgccgctcaccttcatgttccccagcatggtcgtgctcaagattgaagggaagagtagtgggagatggagcaggctctggcattggggcgtcatcgttttctcctctgttctctgcgtcgcgaccaccgccgccgcagttcgtttgatcttcaacaatgccaggatctaccacttcttcgccgacatgtaggggagtgaaaacaccatggaagagatactatatatgaacatggtgcagcattttaggttatcagcttatcgccttttataaggtgtttaggttcaggaatagctaggttgatcaataattatcttctcactcctttcatttttgttaggtttgaggagtggaatatggtcagctcattcttgacaaatgtatgattaggatgaggcggatcctgaaacaaaacaccttctatacgaaaagatgaacttttcgacagcacatgtggctcttacaaggaccaagaataatgcaccataattgatttacaaggaccaaaaacattgtgataatcgtacaccgctgcttttgtgcttttatgaagaatctaatgcgacctttggacacaaaatatgcatgtcatcataatgctaagtcatatcatatttcgatgttgaaatcttaagaagtaataacttgatttacgaagagaatcgaattggtcgggatcagagttcagccacgcacgctgtggtgatcttggtcttggaaaccaagttgcggatttacaccagatttagggttccacgagcgctcattattatgtatctgagaaaattctatgtggacctatatgtatattgtatccgaagaaaataataaaagaaagatggctctcccca

SEQ ID NO: 4783 - DNA, 1821 bp, Hordeum vulgare
aggccacatccttctcctcctgcctgcctgcctaggttcgttccaacagattcgcccagcacagatcgacgacgtactacggaattgcactcgatttaataagacgcgggcggcggaagagagaagcgatcggttggcaacaatggcttcctcgtcgctcgacacggaggcgggaggagcgcagcacaaggccgccggcggcgacagcggcgggtacaccaccgcagccaccgcccacgcggtagacacagattcatggcagcaggtcgggctgctgctggtgacggggttcaactgcgcctacgtgctcagcttctccaacctgatgatggtgccgctggggtgggggtggggcgccgcctgcctgctgctcctcgccgccgccgcctggtacgccaactggctcctcgccggcctccacgtcgtcgacggccagaggttcatccgctacagggacctcatgggcttcgtcttcgggaggaaaatgtactacctcacctggttcctgcagttcaccaccctactcctgggaagcatgggcttcatcctactcggcgggagagcactcaaggcgatcagcgcggagttcaccgagacccctccgaggctgcagtggttcatcgcggcgacgggcttggtctacttcgccttcgcctacttcgtgcccaccatctccgccatgaggaactggctcgccacctccgccgcgctcaccgtcaccttcgacgtcgcgctgctggccgtcctcgtcagagacggtcggtcgaacgagcggcgggactacggcatccacgggacgggggcggagaaggtgttcaacgcgctgggcgcggtggcggccatcctggtgtgcaacacctcggggctgctgccggagatccagtcgacgctgcggaagccgtcggtggccaacatgcggcgggcgctggcgctgcagtacacggtgggcgcggcggggtactacgggatcagcgtggccggctactgggcgtacggcgccgccgcgtccgagtacctgcccaaccagctctccggcccgcgctgggcctccgtgctcatcaacgccaccgccttcctccagagcatcgtctcgcagcacctgttcacggtgccgatccacgaggccatggacacggggctgcagaggctggaggagggcatgttctcgcgctacaacatgacgcgacggctcttggccaggggggtgctcttcggggtcaacatcttcgtcaccgcgctcttccccttcatgggcgacttcgtcaacctcttcggctccttcgcgctcttcccgctcaccttcatgttccccagcatgatcatcctcaagatcaaaggggagtgcgacgggagaccgggcaggctgtggcactggggcatcatcgtcgtctcctcggccgtcggcctcgctacatccgccgccgcagtcagattgatcctgcataacgccagcgtctaccgcttcttcgccgacacctagagcacggctatatatcccgccacgcaggatgatgatgcatgcgcccaaccgtgacataacattactagtactaccatcagaccatcgtacgtatccatgtcaattccttggcacgtttaacatgacaaacgtgtcactaaaatagtactactgctagtatagtcatagtagcagtactgactagtgaaacgcgtgcattggacgccatttgagcaagaagcaacttccattccgaaacgaaaaccagagataaaataaaataatgccacttccccttggaagagatcactgcggatttgtacagacgcatcaatcaaaaaacaaacatatcccggccgggc

SEQ ID NO: 4784 - DNA, 6375 bp, Oryza sativa
tgttcacaacagcagacgacgtcacaacggcagctaatgcttctttcttttagagagagagagcggcacagcggctacagctagtgcgagccacgggtgcatatgcgaccgagctacaatgccgtcgaattcagctcatgtttccttccacctttttaattcctttaatttgcatgtctctccatcactaccaaattcagctgatcattcatgctttccattgatccccttctatatatatatgtatgaagtgtgcgtgtgtgagagagtgtgtatgtatcagtttgattgcatatgaaatggctgcttcatcgctcgacgccgaggcagcagctgcaggccaacaagacaaggccggcagcggcagctacaccactgcagccactgctcatcaaatagacacagattcatggcagcaggtaggggtgctgctggtggtggggttcaactgcgcctacgtgctgagcttctccaacctgatgatggcgccgctgggttgggggtggggcatcgcctgcctgctgttcatcggcgccgcctcctggtacgccaattggctcctcgccggcctccatgtcatcgacggccagaggttcatccgctacagggacctcatgggcttcgtcttcgggaggaaaatgtactacatcacttggttcctgcagttcatcaccctgatactcggaaacatgggcttcattctgctaggcggaagagcactcaaggcgatacatgcggagttcagcagcagccactcaccggcgaggctccagtggttcatcgctgcaaccggattcgtctacttcgccttcgcctacttcgtgccgaccatttccgccatgaggaactggctggccacgtccgccgcactgaccgtcgcctacgacgtcgccctcattgtcatcctaatcaaagacgggaaatcgaacaagcagaaggactacaatgtccacgggacgcaggcagagaaggtgttcggcgcgttcggcgccatcgcggccatcctcgtgtgcaacacctccgggctgctgccggagatacagtcgacgctgcggaagccggtggtgtccaacatgcggcgggcgctgctgctgcagtacacggccggggcggcggtgtactacgggatcagcgtggccggctactgggcgtacggcgccgccgtgtcggagtacctccccgaccagctcagcgggcccagctgggccaccgtcctcatcaacgccaccgccttcctccagagcatcgtctcgcagcacctgttcacggtgccgatacacgaggcgctggacacgcagatgcagaggctggacgaagggatgttctcgcggtacaacctcgggaggcggctgctggcgagggggctcgtgttcggagccaacgccttcgtcaccgcgctcttccccttcatgggcgacttcgtcaacctcttcggctccttcgtcctcttccctctcaccttcatgttccccagcatggtcgtcctcaagatcaaagggaaggatgaagcagggagatggaacaggatttggcactggggcatcatcgtcgcctcctccgtcctcagcgtcgtcaccaccgccgccgccgtccgtctcatcgtccacaacgccagcgtctaccatttcttcgcggacatgtaatcaatcgacgccggagattaccatttgcaccgtcgattaccatttgcaagtgcagtgtgctgtgatcagccgggtttagagctttgcattcttccattaaggatgagattgcaagcgcagcgctgtgattagcgggtttacagctttgcattcttccgtaaggattatatcatctttgacgaacacattggacctaaccaatgttaagctatgccaacctattacacttgacgccgaacacgatattatttttaccgaggacggcatgataccagtgtaacatagttgaggcaatttgcaggtatgccggcatcagaacaaaagcaggggacaaattcactagaaaaaatggcaccaaaaaaagtcactttcaatcatatacgaaaactgcaaatctttacaaaaacgcatgaataaacaaacaaatcttgcatgaagacggcactggaaaacgaatcctctaaaacttatgtcggccacggtgacgaaaccaacatcgcgatatgtacaaatgttcgactaatcagacagactcctgttcgatccatcaggatttctccttttctttcttttcttcaattcgttagaatattttatcaacccacttcttgcactggagttcggatcattcctagtgggtttcaatacttgagacatcccctgctccacaatcttggagcagtggattgctggccttgcgatccttgtcgatgcaaacccagtacttaacgggcttgtctgcaagccgttcaaaggctttgcatggattgcacttgaagcatccaatacaatccatcgcccaatgtgacacaaggtggtctccagtatgccacccattcgcaaatgatccaaactgccattgctagtatagctttattcttgtggagattggactgcgacatattgggcacgattcgaggctctgcccacaatcacagcaggtctgcaaaattatatactttgttagaaaaggatgctgacgctgacgtttcaacaagcccacaaaagcagaaaatgacacccccaagaagcaagaaaacactgaatctagcaagagggtgaatgtctcacctggtgtccgcagccaaacgccatgtctttggggttcacaaggcagattgggcaaacctacaggagaaaaagaattatttaagacacaaaattatgcaaatgcctgccttaagaaacaagcaacagatagcatgttgtcaccgcacgcgaaggtatacctgattgtcataagtagaagaaggtacagcagggctcgaactctgtgcagtttcatagtgaggatatgacgatgatgatgtactactctgtgggtaggtacttggtttactaaagctttttgatccatacgagtaagcatcatggcttccaccagggggagggagaggaaccctttcaggcgacttgaaagagcgacgactgatgccacatcaatattaattttagtcagaatactacagaatgaatcaataattcaacagatcaaagcattagagtaataacgtgttaggggcgtaccctaaaattcctaattcaacagttgctttgtattgctgaggtatctccatcaaggctgaaagtgcaaatgctgcctctttccttgattggggcatgtttttgttcatgatctccgaaaaattcacaaactacacagataatagatcctcagtaaggagtaacaaaaatttcatctaccatatacaaacatgcctacatgggttcattagggttctcagtgacttacttgaaaattgtcaaaagcacgagaaggaatgttgtcgtcaaactctttcatcatgtcccaagggccatcaccaactcctactagcacaatagacaacggcaattcactgcagacgaaaaccagaaagcaaaacatcagcaacatccatgacagaggcaacgcaaactatgtgaacatataaagtaatcgccacaaaaacaggagtcaaaatgcatgggagttacaggcggtatgagcatatcaaaacaatgtaaaaaaggaacttatgaagtacgaacctagctctcacaatagcatcaacagtcttttgctcttgtgaactcagctgcccagatgcagtgtctacactccttgtaacctgtgataatatgacagctaataaggtataaagaaaatgaatgtctagtcgttaggttggtccaacatgtagaacaagcttcaaactaagaataacctcaaataaaaaattgctcgactaaggatcatgtaggacagagtatcaaatgacattacaacatgcttcagatggaacacaagtggacatagaacatgccatttctaatcctcaaattcaacagtccaccgatcccagcacgtgaaactccatatatgaaaaacatgttttgtcattcaaagctttaaaatagtgaactgaaaacaacgattcatatggggaaaacaaaatttcagcatgaatgttttatttaacaaaaaaaatatttccctttgtgtgttttacacagtacctgcccatcagcaattatcaacagaacatggtactgcccgccactttgttccacgatggtcattgccatctcaatgattggtgcaaaggatgttggtcctgttcaaaaaacaacattccaagtatgaattaacagtatagaaccagcataagaggcatcactgggcaacatcagcttaccagctaagcgcaagtgtggaacaagttccctgtaccggcttagagcttctgagaatccattgcaaggtctcaaatcaggataaaaacagaagacgtcttggtcatgtgttgttgctgaaaaaacacacccagttgaattatgattggacaaattataatatagtgcgagaaatggtcagctaatgaatagaatcgctaccatctccaaatccaaaacagggaatcaagttatcttcatcaaatttcgacagtgtctgtccaatgatcgagattgcttgttcatacggattaggtgcattgctaatgtgatgtaaactgcgtccatggaaggaaaattttcctgtaaatgaaaacaaaccataagcatcaaggggcaatgcaacacaaaagactgataagaaaataaaccaaacaacgatttgttagtactaacctaaccattcattgctctttgtgaaatcaatgccaacaataagattcgaagactcaagtcctgcttgagctagtgcatcagtaacctgcaattaatattaatcctgagcaaaccaattcatgggaataatagcaacacaatagaaactggattgtttgcttatgtgcctgattcttatactaatggttatgaggccagaatacagaaatgttagaaaagtttaaatacaacatatgaaacaacttttaccgataaacaactaattgtgaacaatagcgtaatgtgctacgcaaaaaataaaaaaaaaacattcagaaaacttagacatggagttagtaatgtaagcagaaaattggaagtgtgaaacattaaactggtggaccagtttatcccaccaataaaaataaacatcctccaattgccgcattttggacattgaggcaaggagcattcaggaagtacagaggccagactcaattgattaatgctaatttgcgtactcataagatctttgagaattgagaagaccaagcaaaagagaccaactacaaccaataatgatggttggccgaaagctggagccgccaataatgcccaacctcacaacaaacatttttttttaattcttcatcaacagtgattggcagttgaccagcaggcttaacgagtcgtctccttctgatttttgcacaaacatcaattcgatccaccactacagatcatcctaatctgaagtttcaagtggctacagctacagattgaccaactatgaagtgcaaatcggtaacgagcgattcgctaacaatcctaagatggaaaaacaaaaaaccgcgattaagggagaaaggcctacacgagcgggttcgaatcaaccaaatccgatgctccgaaaagcaggatcgaatatccaaattccacacgaatctacagaaccgcaggatatgatgctcgggcagatacctgatccacggagtggtagtcgtcggcgatccgcgagtagcggcggtcgaggcgcggcttggacgcgccccccgcccgggccggcggctgcgtcgccgctggggacggcatcggcggcggcggctgctgataagccgggtacggcgccgcgtatcccccttgcggcgccggcgcgccgtagtagcctcctccatgcgcatcctgcccatagggatacccaccgccgccgccgccgccgccgccaccgccaccgccccactgctgctggaacgacggcgagtggccgtacctcccgtggccgctcccgtcccgcgggctcctcgactggccccctcccatctcaactagatcgaccaaggaaaaaaatccaacaaaaccaaccaaccaaccgatcgatcgatcaaccaagcccgcgacgcggggggcgtatatctcctcgtgcgcgacgcggaggcggcgggggaacgacgacgacgaccaaggtgagtacgcaacgcaaccgctcgcggcgccgcctttgcggtttatttttcgggagaggcgcggcgaggcttcggggctccttccttcgcgttgcgtcgccgcttgggacttgggaggcgtgagctggtggtggtttggctgcttctgcagtgccacggcctcacgggtgcaactgtgc

SEQ ID NO: 4785 - DNA, 4025 bp, Zea mays
cgcattgcagttgctcccttcggtttctttcgtgttccccctcctcaagagcagggcaacgcccaagagtatcgtcgctgccgctgccgctgcctcgcccgcgcgcaggccgctcgctgaaattccctcttcttcctcagtgcttatccgcggcggaatccaatcacctccctcatcacgtccttctcccgagcaaagcctcccctcgcttttggcgtatgcccccgctggcgcgcccatgattcccgccgattcctccgcccgttcggtccagcaaaccttgctgctgctgctgcgctgcggctagttcggtggcggggaaagaggaggagggatcttggagtagggcgaagcggaaatgtcgtcgccgtcgaacaaccgtgggacgtgctcccggagcagctctgcgcggtccaagcacagcgcgcgggtggtggcgcagacgcccgtggacgcgcagctgcacgccgatttcgagggctcccagcgccacttcgactactcatcctcggtgggcgccgccaaccgcccgtcggccagcacgagcaccgtctccacctacctccagaacatgcagcggggccgctacatccagcccttcggctgcctgctcgccgtccacccggacaccttcgcgctgctcgcctacagcgagaacgcgccggagatgctcgacctcacgccacacgcggtcccaaccatcgaccagcgggacgcgctcaccatcggcgccgacgtgcgcacgctcttccgctcgcagagctccgtcgcgcttcacaaggccgccaccttcggggaggtcaacctgctcaaccccatcctcgtgcacgccaggacgtcggggaagcccttctacgccatattgcaccggatcgacgtcggccttgtcatcgaccttgagccgttcaacccagcagacgtgccagtcacggccgcgggcgcgcttaagtcgtacaagctcgccgccaaggccatctccaggctgcagtcgctgcccagcgggaacctgtcgttgctgtgcgatgtgcttgtccgtgaggtgagcgagctcacgggctatgaccgggtcatggcgtacaagttccatgaggatgagcacggtgaggtcatttctgagtgcaggaggtccgatctggagccgtatcttggcctgcactacccagccaccgacatcccgcaggcgtccaggtttctgtttatgaagaacaaaatgcggatgatatgtgatttctctgccactccagtgctgatcattcaggatggcagccttgcacagcccgtcagcctctgtggttctaccctcagggcttcccatggttgccatgcacagtacatggcaaacatgggttctgttgcatcgcttgtgatgtcagtcactataaacgacgatgaggaggaagatggggataccgacagtgaccaacaaccgaaaggcaggaagctgtgggggctggtcgtctgccatcatacaagcccgaggtttgtccctttcccgctaaggtacgcttgcgagtttctcttgcaagtatttggcatacagctcagcaaggaggtggaactggctgctcaggcaaaggagaggcacatcctcagaacgcaaacccttctttgtgatatgctcctgcgggatgctcttgttgggatatttacccagtcacctaatgtgatggatctagtaaagtgcgatggagctgcattgtattatcagaaccaggttttggtgctcggatcaacaccgtccgagtcagagattaagagcattgccacatggctgcaggagaaccatgatggttcaactgggctgagtactgacagcttagtggaagcgggttatcctggtgctgctgcactccgtgaagtcgtgtgtggcatggtggccattaagatctcttccaaaaattttatcttctggttccgatcacacacaacaaaggagatcaagtggagtggggctaagcatgaaccgtttgacgcagatgacaatggcaggaagatgcatccacgatcttcattcaaggccttcttggaggtggttaaatggagaagtgttccctgggaggatgttgaaatggatgctatccattctttgcagttaatattacgtgactccctgcaaggtgaagatgccaacagaaacaacatcaggtccattgtaaaagctccatctgatgatatgaagaagttacaggggctacttgaactaagaacagttacaaacgagatggtccgcttaattgagacagcaactgcccctgtcttggctgttgacattgccggtaacataaatggatggaacaaaaaagctgcagaactaacagggttacctgtaatggaagccatagggaggcctctgatagatcttgttgttgctgattctgttgaagtggttaagcagattttggactcagctttacaaggaattgaagagcaaaatctggaaatcaagcttaaaacattccatgaacaggagtgttgtggtccagttatcttgatgattaactcctgctgtagtcgggatctttcagagaaagtcattggagtttgctttgtagcacaagatttgaccaggcagaagatgattatggataagtatactaggatacaaggagactatgttgccataataaagaaccccagtgagctcatccctcccatatttatgatcaatgatcttggttcctgcttagagtggaataaagctatgcagaagattactggtatgaagagggaagacgcgataaataagttgttaattggggaggtcttcacgctccatgattatggctgtagggtgaaagatcatgctactctaacgaaacttagcatactgatgaatgcagtgatttctggtcaggatccagagaagctcctgtttggtttcttcggcacaggtgggaagtatattgaatccttgctgacagtgaacaagagaacaaatgctgagggtaaaatcactggcgctctttgctttctgcatgtggctagcccagagcttcagcatgctcttgaggtccagaaaatgtctgaacaagctgctacaaacagctttaaagaattaacttacattcgtcaagaattaaggaacccactcaatggcatgcaatttacttataacttattgaagccttccgaattgacagaggatcagcggcaacttgtttcatctaatgttctgtgtcaggaccagctgaaaaagattttacatgacactgatcttgaaagcattgaacagtgctatatggagacgaacacagtagagttcaaccttgaggaagctctgaatacggtcctgatgcaaggcattcctttgggcaaggaaaaacgtatttctattgaacgtgattggcctgtggaagtgtcacacatgtacatttacggggacaatataaggcttcagcaggtcctagcagattatctggcttgcgcccttcaattcacacaaccagctgaaggacatatcgtgctccaggtcattcccaagaaggaaaacattgggtctggcatgcagattgctcatttggaattcaggattgtccatccagctccaggcgttccagaggccctgatacaggagatgttccagcacaacccaggggtgtccagggagggtctcggcctgtacataagccagaagctggtgaaaacgatgagcggcacgttgcagtacctacgagaagccgacacctcttcgttcatcatcctgatagagttcccggtcgcccagctcagcagcaagcggtccaagccttcgccaagtaaattctgacactgatgctcctggaactgcagtgacggttcggccgtgtcaaattctcgggtgtagggtgtacctctggccaagtgactgatattctgaaaaacatacggacttctagtataggagaagaggaatcctaatcctagtaattatatcttagtagatatgtgcttagtctcttgttaattttttgtcttgagaggactatatatactgataaagtgataatttattcagagaataaagaatgggctccatgctttgtcta

SEQ ID NO: 4786 - DNA, 4503 bp, Sorghum bicolor
agggagtatgcattgagactggcctaatacaatctgatctaatctacgggaagtagcacagtaatcctccactaccaggatctatcgttacccgagatggaaatggcggcgattgctgcggagaagacgacccagatgacgccagacagcttaccactctcggagccttgactacacactcctcccaaactgcgtcggcgggtcttaaccccgtgaatcccccaattttcgccgctccaattcgcccatccgtccgcgcgcccctcgccgaccggccgccggcgtcctctcgccggggtagtcagtggcgcacggcgcatcgctgttgctccctccggccggttcctttcgtgtccctcgcttttgagcgggcaacgtccaagagatattatcgctgccgctccgctgccccgcgcaaggccgctcgctgtcccactcgcgcgccacgcctgacgcctcggacccggaggtgtattccctcttcttcccccgtgcttatccgcggcggaatccaatcccctccctcatcacgtccttctcccaggcaaagccccctctttttgggcgtatgcccccgctggcgcgcctatgattcccgccgattcatccgcccgctcggtccagcaacccttgctgctgcagtgctgcggctagttcggtggcggggaaggaggaggaggagggatcttgcagtggggcgaagcggagatgtcgtcgccgttgaacaaccgggggacgtgctcccggagcagctctgcgcggtccaggcacagcgcgcgggtggtggcgcagacgcccgtggacgcgcagctgcacgccgagttcgagagctcccagcgcaacttcgactactcctcgtcggtgagcgccgccatccgaccgtcggtcagcaccagcaccgtctccacctaccaccagaccatgcagcggggcctctacatccagcccttcggctgcctgctcgccgtccacccggacaccttcacgttgctcgcctacagcgagaacgcgcccgagatgctcgacctcacgccacacgcggtccccaccatcgaccagcgggacgcgctcgccgtcggcgccgacgtgcgcacgctcttccgctcgcagagctccgtcgcgctgcacaaggccgccaccttcggggaggtcaacctgctcaaccccatcctcgtgcatgccaggacgtcggggaagcccttctacgccatattgcaccggatcgacgtcggccttgtcatcgaccttgagccggtcaacccagttgacgtgccagtcactgctgcgggtgcgcttaagtcgtacaagctcgccgccaaggccatctccaggctgcagtcgctgcccagcgggaacctgtcgctgctgtgcgatgtgcttgtccgtgaggtgagcgagctcacgggctatgaccgggtcatggcgtacaagttccatgaggatgagcatggtgaggtcatttccgagtgcaggaggtctgatctggagccgtatcttggcctgcactacccagccaccgacatcccgcaggcgtccaggttcttgtttatgaagaacaaagtgaggatgatatgtgattgctctgccactctggtgaagatcattcaggatgatagcctagcacagcctctcagcctctgtggttccaccctcagggcttcccatggttgccatgcacagtacatggcaaacatgggttctgttgcatcgcttgtgatgtcagtgactataagcaatgatgaggaggaagatgttgataccgggagtgaccaacaaccgaaaggcaggaaactgtgggggctggtcgtctgccatcatacaagcccgaggttcgtccctttcccactaaggtacgcttgcgagtttctcttgcaagtatttggcatacagctaaacaaggaggtggaattggctgctcaggcaaaggagaggcacatcctcagaacgcaaacccttctttgtgatatgctcctgcgggatgctcctgttgggatatttacccagtcacctaatgtgatggatctagtaaagtgcgatggagctgcattgtattaccagaaccagcttttgttgctcggatcaacaccctccgagtcagagataaagagcattgccacatggctgcaggagaaccatgatggttcaactgggctgagtactgacagcttagtggaagcaggttatcctggtgctgctgcacttcgtgaagttgtgtgtggcatggcggctataaagatctcttccaaagattttatcttctggttccgatcgcacacaacaaaggagatcaagtggggtggggctaagcatgaaccggttgacgcagatgacaatggcaggaagatgcatccacgatcttcattcaaggccttcttggaggtggttaaatggagaagtgttccctgggaggatgttgaaatggatgctattcattctttgcagttaatattacgtggctccctgcaagatgaagatgccaacagaaacaatgtaaggtccattgtaaaagctccacctgatgatacgaagaagatacaggggctacttgaactaagaacagttacaaacgagatggtccgcttaattgagacagcaaccgcccctgtcttggctgtcgacattgccggtaacataaatggatggaacaataaagctgcagaactaacagggttacctgtaatggaagccatagggaggcctctgatagatcttgttgttgttgattctattgaagtggttaagcggattttggactcagctttacaaggaattgaagagcaaaatctggaaatcaagcttaaagcattccatgaacaggaatgcaatggtccaataatcttgatggttaactcctgctgtagtcgggacctttcagagaaagtcattggagtttgctttgtaggacaagatttgaccacgcagaagatgattatggataagtatactaggatacaaggagactatgttgccatagtaaagaaccccagtgagctcatccctcccatatttatgatcaatgatcttggttcctgcttagagtggaataaagctatgcagaagattaccggtatacagagggaagatgtgatagataagttgttaattggggaggtcttcacccttcatgattatggctgtagggtgaaagatcatgctactctaacgaaacttagcatactgatgaatgcagtgatttctggtcaggatcctgagaagctcctttttggtttcttcgacacagatgggaagtatattgaatccttgctgacagtgaacaagagaataaatgctgagggtaagatcactggcgctatttgctttctgcatgtggccagtccagagcttcagcatgctctccaggtgcagaaaatgtctgaacaagctgccacaaacagttttaaggaattaacttacattcatcaagaattaaggaacccactcaatggcatgcaatttacttgcaacttattggagccttccgaattgacagaggagcagaggaaacttctttcatctaatattctctgtcaggaccagctgaaaaagattttacatgacactgatcttgaaagcattgaacagtgctatatggagatgaacacagtagagttcaaccttgaggaagctcttaatacggtcctaatgcaaggcattcctttgggcaaggaaaagcgaatttctattgaacgtgattggccggtggaaatatcacgcatgtacctttacggggacaatttaaggcttcagcaggtcctagcagactatctggcatgcgcccttcaattcacacaaccagctgaaggacctatcgtgctccaggtcattcccaagaaggaaaacattgggtctggcatgcagattgctcatttggagttcaggattgtccatccagctccaggcgtccccgaggccctgatacaggagatgttccggcacaacccagaggtgtccagggagggcctcggcctgtacatatgccagaagctggtgaaaacgatgagtggcacggtacagtacctacgagaagccgatacctcatcgttcatcatcctgatagagttcccagtcgcccagctcagcagcaagcggtccaagccttcgacgagtaaattctgacactcatgctcctggaactgcagtgagagttcggccgtgtcaaattctcgggtgtagttggtcaactgactgtgcagtctgaaacatcggttggtcagttctggtatcttagcacgtctgtgtaacgcgggtagatttggttgtttgtatttggagagatataaagctagctggctaggtgtaacgtaacttcgaccgataactgtatgtgaatgatgagctgtgaggatgaataaaagcttcacttgtgttctctattgctcttctgaaaagcccttcacttgcggtgttagcatacacatataccctgtgatttggaaactattgtggattcctgaatttttgactgtacactcggcatatcttgaagcgatggaattgttgaag

SEQ ID NO: 4787 - DNA, 3709 bp, Pennisetum glaucum
gacggcggagatgtcgtcgtcgcggtccaacaaccgggggacgtgctcccggagcagctcggcgaggtccaagcacagcgcgcgggtggtggcgcagacgcccgtggacgcgcagctgcacgccgagttcgagggctcccagctccacttcgactactccacgtcggtgggcgccggcaaccgcccgtcggccagcaccagcaccgtctccgcctacctccagaacatgcagcggggccgctacatccagcccttcggctgcctgctcgccgtccacccggacaccttcgcgctgctcgcctacagcgagaacgcgcccgagatgctcgacctcacgccgcacgccgtccccaccatcgaccagcgggacgcgctcgccgtcggcgccgacgtgcgcacgctcttccgctcccagagcgccgtcgcgctgcacaaggccgccaccttcggggaggtcaacctgctcaaccccatcctcgtgcacgccaggacgtcggggaagcccttctacgccattatgcaccgcgtcgacgtcggcctcgtcatcgatctcgagccggtcaaccgagccgacgtcccggtcaccgccgcgggcgcgctcaagtcctacaagctcgccgccaaggctatctccaggctgcagtcgctgcccagcgggaacctctcgctgctgtgcgatgtgcttgtgcgtgaggtgagcgagctcacgggctatgacagggtcatggcgtacaagttccatgaggatgagcacggcgaggttatctccgagtgtaggagatctgatctggaaccgtatcttggcctacactacccggccactgacatcccgcaggcgtccaggtttctgtttatgaagaacaaagtgcggatgatatgcgattgctctgccgttccagtgaagatcattcaggatgatagcctagcacagcctctcagcctatgtggttccacgctccgggcttcccatggttgccacacacaatacatggcgaacatgggctctgttgcgtcacttgttatgtcagtaactataaacgaggatgaggaggatggggatactgggagtgatcagcagcccaaaggcaggaagctgtgggggctggtggtctgccatcacacaagcccgaggttcgttcctttcccgctaaggtacgcttgcgagttcctcttgcaagtatttggcatacagctcaacaaggaggtagaactggctgctcaggcaaaggagaggcacatcctccggacacaaacccttctgtgtgacatgcttctgcgggatgcccctgttgggatatttacccaatcacctaatgtgatggatctagtaaagtgtgatggagctgcactgtattaccaaaaccaggtttgggcactcggatcggcaccctccgaggcagagataaggtgcattgtcgcgtggctgcaggagaaccatgatggttcaactgggctgagtactgacagcttagtggaagcgggttatcctggtgctgctgcacttcgtgaggttgtgtgtggcatggcagccataaagatctcttccaaagatttcatcttctggttccgagcccacacagcaaaggagatcaagtggggtggagctaagcatgaagcagtggatgcagatgagaatggcaggaagatgcatccacgatcttcgtttaaggccttcttggaggtggttaaatggagaagtgttccctgggaggatgttgaaatggacgctatccattctttgcagttaatattacgcggctccctgcaagatgaagatagcaacagaaacaatgtaaggaccatcgtaaaagctccatctgaggatacaaagaagatacaggggctacttgaactaaggacagttacagacgagatggtccgcttaattgagacagcaactgcccctatcctggctgttgatgttgccggtaacataaatggatggaataataaagctgcagaactaactggattacctgttatggaagccatagggaggcctctggtagatcttgtcgtctctgattctgttgaagtagttaaacagattttggactcagctttacaaggaattgaagagcgaaatctggaaatcaggcttaaaacattcaaccaacaggaatgcaatggccctgtaattttgatggtcaactcctgctgcagtcgggacctttcagataacgttgttggagtttgctttgtagcacaagatttgactgggcagaagatgattatggataaatatactaggatacaaggtgactatgttgccatagtgaagaaccccagtgagctcatccctcccatatttatgatcaatgatcttggttcatgcttagagtggaatgaagctatgcagaagattactggtatgaagagggaagatgccatagacaagttgttaattggggaggttttcacccttcatgattatggctgtagggtgaaagatcatgctactctaacgaaacttagcatactgatgaacacagtgatttcgggtcaggatcctggaaaactcctttttggtttctttgacacagatggcaagtatgtggaatcccttctcacagcaagtaagaggacaaatgttgagggcaagatcaccggtgctctttgcttcctgcatgtagccagcccagagcttcagcatgctctccaggtgcagaaaatgtctgagcaagcggctacaaacagctttaaggaattgacctacattcgccaagaattaaggaacccactcaatggcatgcaatttacacatagtttattggaaccttctgagttgacagaggaacagaggcggcttgttgcatctaatgttctctgtcaggatcagctgaaaaagattttacatgatactgatcttgaaagcattgaacaatgctatatggagatgaacacagtagaatttaaacttgaggaagctctgaatacggtcctaatgcaaggcatgcctctgggcaaggaaaaacagatttctattgaacgtgattggcctgtggaagtatcatgcatgcacctctatggagacaatttaaggcttcagcaggtcctagcagactatctggcatgcactcttcaattcacccaatcagctgaaggacctattgtgctccaagtcattcccaagaaagaaaatattgggtctggcatgcagattgctcatttagagttcaggattgtccatccagcaccgggtgtcccagatgcccttatccaggagatgttccggcacagcccagaggtgtctagggagggccttggactgtacataagccagaagctggtgaagacgatgagcggcacagtacagtaccttcgggaagctgacaggtcatcgttcgtcgttctggtagagttcccggtcgcccagctcagcagcaagcggtccaagccttcaacaagtaaattctgacgctcttgcacccagaactgcaaacagcaatccctccggtgagagcacggctgtgttaaatagccaaatacagctagtttgaagcattgttggccgccttggcacggtctttgtaatgtggatagatttgggcatttcgggagttggctaggtgtagtgtgtaactttaaccaacacgtgtatgtgtatgttgagttgtgagaatgaataaaaggtccacctgtattcttctgaacgagcttcactgtgttctcagaccatgtgctgctggtgaatgcggaaatttgacca

SEQ ID NO: 4788 - DNA, 4552 bp, Panicum virgatum
tcttagtaactcaattttatgcatccataaggcaagctcacttccctccaatttgcactagtttcgccactgttagctcatatcttaatcatcatgtctcagctacatctttaatctaattttagctccttattcaaacatgtggcactgtggcagccacatctttaatctaatttaatttatctaatctgctgctgatcacttgcccaccgcgattcgcggttaccggagatggaaagggcgtcgaccgctgcggggaagaagacccccgaatgacgccacaaggctttctactcttggagccctgaccgcccgcccactcgtcttcagctgcggcggcgggtcttagcactctagccccgcgcgtcctccggtttccgccgctccgatcccccccttcgtccgcgggctactcgccggcgtcctctccccgcggtcagtcacccagtcgcgcatcgctgttgctgttgctcctttcctgttcccctttgcagcagggcagagcagcgtggaggagaggagatattatcgctgccgccgccgccgctgccgccgctgtcccactcgcgcgccacgaagcctcggcctcggaggcgtattcccttccgcccccgtgcttatccgcggcggaatccaatcccctccctcgcgtccttctccccagcaaaggccacccacccgcttttggcaaattacccccgctgccgcgcccatgattcccggcgattcctcagcccatttgctcctgctcccctcctcgccgcagctgcaatccggccgcggctgctagttcggtagcggggaagggggtggaggaggaggaggaggaggagggaaggggggcttttgattggcggcggagatgtcgtcgtcgcgatccaacaaccgggcccggagcagctcggcgcggtccaagcacagcgcgcgggtggtggcgcagacgcccgtggacgcgcagctgcacaccgagttcgagggctcccagcgccacttcgactactcctcctcggtgagcgcggccaaccgcccgtccgccagcaccagcaccagcaccgtctccacctacctccagaacatgcagcggggccgcttcatccagcccttcggctgcctgctcgccgtccacccggacaccttcgcgctgctcgcctacagcgggaacgcgcccgagatgctcgacctcacgccgcacgcagtccccaccatcgaccagcgggatgcgctcgccatcggcgccgacgtgcgcatgctcttccgctcgcagagctccgtcgcgctgcacaaggctgcctccttcggggaggtcaacctgctcaaccccatcctcgtgcatgccaggacgtcggggaagcccttctacgccattatgcaccgcatcgacgttggcctcgtcatcgatctcgagccggtcaatcccgccgaggtgccagtcaccgccgcgggatcgctcaagtcgtacaagctcgccgccaaggctatctccaggctgcagtcgctgcccagcgggaacctttcgctgctgtgcgatgtgcttgtccgtgaggtgagcgagctcacgggctatgacagggtcatggcgtacaagttccatgaggatgagcatggcgaggttatcgccgagtgcaggagatctgatctagaaccatatcttggcctgcactacccagccacggacatcccgcaggcgtccagatttatgtttatgaagaacaaagtgcggatgatatacgattgctctgccactccagttaagatcattcaggatgatagcctagcacagcctctcagcctatgtggttccacgcttcgggctccccatggttgccatacgcaatacatggcaaacatgggctctgttgcgtcgcttgtgatgtcaataactataaacgaggatgcagaggaggatggggatactgggagtgaccagcagccgaaaggcaggaagctgtgggggctggtggtctgccatcacatgactccgaggttcgttcctttcccactaaggtacgcttgcgagtttctcttgcaagtgtttggcatacagctcaacaaggaggtagaattggctgctcaggcaaaggagaggcacatcctccgaacgcaaacacttctgtgtgatatgcttgtgcgggatgctcctgttgggatatttacccagttgcctaatgtaatggatctagtaaagtgtgatggagcggcactgtactaccaaaaccagctttgggtgctcggatcaacaccctccaaggcagagataaagagcattgtcacgtggcttcaggagaaccatgatggttcaactgggctgagtaccgacagcttagtggaagcgggttatcctggtgctgctgcacttcgtgaggttgtgtgtggcatggcagccataaagatctcttccaaagatttcatcttctggttccgagcccacacagcaaaggagatcaagtggggtggaagtaagcatgaaacggtcgatgcagatgagaacggccggcagatgcatccacgatcttcattcaaggcattcttggaggtggttaaatggagaagtgttccctgggaggatgttgaaatggacgctatccattctttgcagttaatattacgcggctccctgcaagataaagatgccaacaaaaacaatgtaatgtccattgtagaagctccatctgaggatacaaagaatatacaggggctacttgagctaagaacagttacaaacgagatggtccgcttaattgagacagcaactgcccctatctttgctgttgacattgacggtaacataaatgggtggaataataaagtcgcagaactcactggattacctgttatggaagccatagggaggccccttgtagatcttgtcatgtctgattctgttgaagtggttaaactgattttggactcagctttaccaggaatcgaagagcaaaatctggagatcaagcttaaaacattcaatcaacaggaatgcaatggccccgtaattttgatggtcaactcctgctgcaatcgggacctttcagacaaagttgttggagtttgctttgtagctcaagatttgactgggcagaagatgataatggataagtatactaggatacaaggagactatgttaccatagtgaagaaccccagtgagcttatccctcccatatttatgatcaatgatcttggttcctgcttagagtggaatgaagctatgcagaggattaccggtatgaaaagggaagatgcaatagataagttgttaattggggaggttttcacccttcatgattatggctgtagggtgaaagatcatgctactctaacaaaacttagcatactgatgaacacagtgatttctggtcaggatcctgggaaactcctttttggtttcttcgatacatatggcaagtatgtggaatccctgctcacagcaaataagaggacaaatgttgagggcaagatcaccggtgctctttgctttctgcatgtggccagcccagagcttcagcatgctctcaaggtgcagaaaatgtctgaacaagctgctgcaaacagctttaaggaattaacctacattcgccaagaattaagaaacccactcaatggcatgcaatttacacatagtttattggaaccttctgagttgacagaggaacagaggcggcttgttgcatctaatgttctctgtcaggatcagctgaaaaagattttacacgacactgatcttgaaagcattgaacagtgctatatggagatgaacatggaagaattcaaacttgaggaggctctgaatacggtcctaatgcaaggcatgtctctgggcaaggaaaaatggatttctattgaacgtgattggcctgtggaagtatcaagcatgtacctctatggagacaatttaaggcttcagcaggtcctagcagactatctggcatgcactcttcaatttacccaaccagccaaaggacctattgtgctccaagtcattcccaagaaggaaaatattgggtctggcatgcagattgcacatttagagttcaggatcgtccatccagcaccgggcgtcccagaggccctgatacaggagatgttccggcacagctcagaggtgtctagggagggccttggtctgtacattagccagaagctggtgaagacgatgagcggcacagtacagtacctccgggaagccgacagctcgtcgttcatcgtcctggtagaattccctgtcgcccaactcagcagcaagcggtccaagccttcaacaagtaaattctgacgccgttgcacctggaactgtaaacagcagtcccttcagtgagcgctcggctgtttaaattagtcaaatgcaggtaatatgaagtttgtatttggcacggtctgtgtaatgtgggtcgatttggtcgtttggggagttggctaggtgtagcgtaagcgtaattttaaccgacaactgtatgtgtatgttgagttgtgagaatgaataaaaatttcacctgtgttcttttcttctgagttctgaacgagcttcgctgtgctttccctgggagaatatctcaca

SEQ ID NO: 4789 - DNA, 8203 bp, Oryza sativa
gctttgccaaaagggagaaaggcatattcgatgaaaaagaaaaggttttgaaagtatacatgtgtgtctctgttgctttatcatttacaaccctatcgattaatgaaacaatgtatacgtgcgtaccttgctaggcacgttcgaccatgaaacaatgtactggctctagctattcacatcattaagatattgctcaaattttccctgtacacgaagggcataggcaagaagaacaatagggagccatcgtttcgcttattcgtgaaataagcgaaatgacatatttataaatgaaaagtaatctgtgaataaaacttttatatatgtgttcttagcgatctaaaagtaaaggctgaaaaaataaactttgctgaaaaacctcaaaatcagctccaaatttaaggttgaaaattcaaattttggctgataaatataagcataagcgaaaaaagagaccgatatatcatgtaataccattcatctctacctcttttttctagtatatcttgtggtcgagacatctcttatttgtctctcttctcccttttcgtatatccacataagcaaaataatgggtattccctttgttgtaaaatataaggaccatatttctaaaaattattgtaaattttaactaataactaaagtaacaatactatatatgttgagtatcatgaatatgatatcattaattagggttcctttgaaacgcagtattctcaatatacttaaaaaaatacagaattgaagtattctagtaccttaagtcttgtggattgaaaaaaaaacagagaaaattctcacgaattattgtttagatggagcatagaaaaatgtacagtaactagaagatagatggacacaaatgatcttttccaataggttgaagttcacgttagaattccttcaaaatctctacgtctcgagccaatctaaaggaatttcataggatactttccttttatccaaatgaccacgtatgaaagttttttatagaattgattttttttttcttctaaaattcctcaaggaatattttgttccaaaggagccaatagtatttgaaattgcattcatatgatgttcaattttatactccacctgtttcgaaatataaggtgtatttcttgttttctgcaaagtcaaaatttatttttttgactaataattaaactaaaaatatgaatgttagtctcatgcatgtagtatcacttgatttatattttaaaatatattcatacaacgttagttttttagttgctgataacatattataaaaatagtattggtcacagtataatgttggagaccgtatagaaacataatacgcctcatattgtcagacacatggagtaactgttaatactattacgaaagaaattaaaagtgaaagttttatgttggagaccatgaaaacttgtatggtattttgaagaaaaggagtatatataaggctttgacttgtctagatgcatatgtcaaggctacaagctatcaacatcgaagggtgcactacaactccatatatgttttgtcgcataagtcaacaaaggaaaggatagtgaaatatctttcacacagcaaatattttcttcactttaaaatatagtattacactgatgacttctgatattatttccatcccagtttgatcactacctaagaaaaaggcactaaaaccaaggtcactaaaacatttatcatagtaaaattaatcctcatcgattaatgtggtatgtcggttcgtgcgaatcatgtccaacaaaaattaattcatactttaaatgttgcatagattaaaccaataaaaattagtcttggttagttgcacgtatacagttatatacatgcagggcactccacggtgcacatgtactatttgcacaaagaaacaaagagaagctttgttaaatgatgattattttgaaaaaaacttaaaaatcttggatgatgatcaaattgggatagagagattatatcgtttgactatgttttgattaaaagtttagtgtaaaatgtaaagttgtaagtcatgcttaaaatatatttagtgataaaaataagacacacatgcttacatagttttagttttctctaagtaagactaacgatacaaatatcatatctaaaagttaatatagtccatatattttaaaggggaagatgatagtttatgtttgttagaatttaaaaaaaaagtattccaaacatataccaaataagctaacaatatggaggtgtagaattgtgggtcatgtattggagtcaaaggctaacttgaagtactactaaaataaggatagatctatgacaacaatttttaatggggttgtttggcgggacttgttgcagcatctttgctacgctgcgtaacctcgtcgcttggctacagcctacaacagtggacagacttgagggcttgaggccgctacatgtaggatgtagcggctgctcgttgttggtataactagttgtagctgttgtagttattgttggctggctgctgcaacaagctcttccgaacaaccccaataataaaacattcaacttatttactcctacgatagttaggctctgtttagtttgcgaaaaaaaaaaatttttggtgttagatcggacgtttgactggatgtcggaaggggttttcgggcatgaatgaaaaaaactaatttcataactcgcatggaaaccacgagacgaatcttttgagcctaattaatccattattagtacatatgggttattgtagcactaatgactaatcatagactaattaggttcagaagattcatctcgagatttcctccctaactgtgcaattaatttttatttttatctatatttaatgctttacgcatgtgtctaaagattcgatatgatgtttttaagaaaaacttttggtgaactaaacggggcctttattaaaactttaggaaattgattattctttagcgtaaatcgaatagcactggatttcatcatctgcctcatagctcaaactcacgtgtgtcagggttatggataccacatacctacctaatacctaatagtagttgattaaatctcggcaggacccaccatatactatgtcttatactgacactgacctcggatatggatgaagttccggataaggaaagacaaccagagttctatatggaaacgacaagaactactcggattgtattcatattggtttccctagttttacttggacaaagggacacttatgggtataaatacaagaccctctaagaggagaggggacacggaacaatagatcaagacataagatcaatatacaagccaacatacgccaagacaagacgctaggtatcgacttcagagataggcatgactagtcccctacgatgcctatggctaccgtcaggagagatatagagttgtctctgatctatgcggattcgaggaggaaggttaccatgttgtcgactacgagtcaatactacagaccgccaggtcgacaacagttagataggctaccccaaatattatactggtatgattatggtgaataagagcaataccggcttcggccaacaggatgtagggttattacctgacaattcaggggcccgaacctgtataaaaatcctcgtcgttatctcttttacctaagtctcgtatacatcttagtaccaacgatccccatactatgtaaataccggaaccgcgacatcaaacgtcgaccgacaacgtggtacagtataaaaaagtttttaaatatttttaggtctgatcaaaccatcgaatccaatcaatacagggcctactctaccaaagttctggcctttgggaagcatttccccatttttttagcacttaccacgagtggaaaaggacggacttctgcgcgaggaagaagaaccggatgacgttgtacggctttcctctctcggtttcccgacgcgaccgcctccgccgccatcgccgcctctcctcacctcgccgcgccgcgccgccccgcctcggccgcgcgcgtcccctcttccccgcctaagccccgcatcccgctcacccaccccacgcaccaacccccgcctcgcctcgccgtcgtcgtcgccgtcgccccctcgcctcgccgcctctgcgtggtggtgaggtagtaatcgctgttgcttcggtttccctttggttgggaggtgggaggaggaagacgaagagagggagagagagagggagatattatcttgggctgccttgccgtgcagtgtggctcgctgtcccactcaggtgcggcgctattccaatccgtgcttatccccggcagaatccaatccccctcgcggcttttctccaaaagcgctccgccttctcgcctatttcgctcgctgccgcggccatgattccccgctgatacctccgcgcgcccatttggttcctcctcgccgaatcccccttcgcagccggtggttctagttgaggaggaggaggaggggatttggttgggggcgagggggaggagggggttgtggagatgtcgtcgtcgcggtcgaacaaccgggcgacgtgctcgcggagcagctcggcgcggtccaagcacagcgcgcgggtggtggcgcagacgccgatggacgcgcagctgcacgcggagttcgaggggtcgcagcgccacttcgactactcgtcgtcggtgggcgcggccaatcggtcgggcgccaccaccagcaacgtctccgcctacctccagaacatgcagcgcggccgcttcgtccagcccttcgggtgcctgctcgccgtccacccggagacgttcgcgctgctcgcctacagcgagaacgccgccgagatgctcgacctcacgccgcacgccgtgcccaccattgaccagcgcgaggcgctcgccgtcggcaccgacgtgcgcacgctcttccgctcgcacagcttcgtcgcgctgcagaaggccgccaccttcggggacgtcaacctgctcaaccccatcctcgtccacgccaggacctccgggaagcccttctacgccatcatgcaccgcatcgacgtcggcctcgtcatcgacctcgagccggtcaaccccgtcgacctgcccgtcaccgccacaggcgcgatcaagtcgtacaagctcgctgccagggccatcgccaggctgcagtccctgcccagtgggaacctctccctgctgtgcgacgtgctggtccgcgaggtgagcgagctcactggctatgacagggtgatggcgtacaagttccatgaggatgagcatggtgaggtgattgctgagtgcaagagatctgatttggagccgtatcttggcctgcactacccagccactgacattcctcaggcatccaggtttttgttcatgaagaacaaagtgcggatgatatgcgattgctccgcaacgcctgtgaagatcatccaagatgacagcctaacacaacctataagcatatgcggatctactctcagggcaccccatggttgccatgcacagtacatggcaagcatgggctccgttgcatcacttgtgatgtcggtcactataaatgaggatgaggatgatgatggagacactgggagtgaccagcagccgaaagggaggaagctgtgggggttgatggtctgccatcacacaagcccgaggtttgtccctttcccgcttaggtatgcttgcgagtttctcttgcaagtatttgggatacagatcaacaaggaggtggaactggctgctcaggcaaaggagaggcacatcctccgcacgcagactcttctctgtgatatgctccttcgagatgctcctgttgggatatttacccaatcacctaacgtaatggatctagtgaaatgtgatggtgcagcattgtattaccaaaaccagctttgggtgctaggatcaacgccctctgaagcagagataaaaaacattgttgcttggttgcaggagtaccatgacggttctactggattgagtaccgacagcttagttgaagcaggttatcctggcgctgctgcacttggtgatgttgtgtgtggcatggcagctataaagatctcttcaaaagatttcatcttctggttccgatcccacacggcaaaggagattaaatggggaggagctaagcatgaaccaattgatgcagatgacaatggtaggaagatgcatccacgatcttcattcaaagccttcttggaggtagttaaatggaggagtgttccttgggaggatgttgaaatggatgctatccattctctgcagctaatattacgtggctccttgcaagatgaagatgccaacaagaacaacaatgcaaagtccattgttacagctccatctgatgatatgaagaagattcaggggctccttgaactgagaaccgttacaaacgagatggtgcgcctaattgagacagcaactgcgcctatcttggctgttgacatcactgggagcataaacggatggaataataaggctgcagaactcactggattacctgtcatggaagccatagggaagcctctggtcgatctcgtcatcgatgattctgttgaagtggttaagcaaattttaaattcagctttacaaggaatagaagagcaaaatctgcaaattaagcttaaaacatttaatcaccaggaaaataatggacctgtaattttgatggttaacgcctgctgcagtcgtgacctttcagagaaagttgtgggggtttgctttgtagcacaagatatgacagggcagaacattatcatggataagtacactcggatacaaggggactatgttgctatagtaaagaacccttcggagctcatcccccctatatttatgatcaatgatcttggttcctgcttagagtggaatgaagctatgcaaaaaattactggtataaagagggaagatgcagtagataaattgctaatcggggaagttttcacccaccatgagtatggctgtagggtgaaagaccatggtactctgaccaaacttagcatattaatgaacacagtgatatctggtcaagatcctgagaagcttctttttggtttcttcaacaccgatggcaagtacatagagtcactgatgacagcaaccaagaggacagatgctgagggtaagatcactggcgccctttgctttcttcatgtggccagcccagagcttcaacatgctctgcaggtgcagaagatgtctgaacaagctgctatgaacagctttaaggaactgacatacatacgtcaagaattaaggaacccactcaatggcatgcaatttactcgaaatttgttggaaccttctgacttgactgaggagcagaggaaacttctagcatcaaatgtcctctgtcaagaacagctgaaaaagattttacatgacactgatctagaaagcattgaacagtgctacacggagatgagcaccgtagatttcaacctggaggaagccctgaatacagtcctaatgcaagccatgccccagagcaaggagaaacaaatttccattgaccgtgattggcctgcagaagtatcatgtatgcacctctgcggggacaatttaaggcttcaacaagtcctagcagacttcctggcatgcatgcttcaatttacacagccagctgaagggcctattgtgctccaagtcatccccaggatggaaaatattggatctggaatgcagattgctcatctagagttcaggcttgtccatccagctccgggcgttccagaggctctgatacaagagatgttccgccacagcccaggtgcatctcgagagggccttggcctttacataagccagaagctcgtgaagacgatgagcggcacggttcagtacctccgggaatcagagagctcgtcgttcatcgtcctggtagagttcccggtcgcccagctcagcaccaagaggtgcaaggcttccacgagtaaattctgaacttagggctatggccaaaattcttgtgggtgctgtattgttgttgttgctgctgctgctattagcagatcaggcagtctgaggagtacgttagctgaagatgtatcagatgtgtgtagcttgtgaaagtgaaggtagtggttggatagatgtatttgtcacgttgatgtctggagagctagtgagcgagctactaggtgttagtgtaatttaaccggcaaatgtatgaacgaattatgaataaaatcttcacttgtgttgtcatgaataaaatcttcacttgtgctgtca

SEQ ID NO: 4790 - DNA, 2255 bp, Sorghum bicolor
gtcattattcctcccgtcccgtgtgtgtggtgtgtcgccttcttcctcctcgcacacgccaggcacgagaccaacacccccagcgcacgcactccaaatagcgagccgaagaggggccgaggctacgagtcctccacctctcctccgccgcgtcgctcgcgctccacgcacgcgccgagagccgaatcggagccgtgaggcagccgcccccggcggatcgaccttagggccagggcatgggcggaggggacggggacgccgacgccggcggcgagcccgcggccgcgcaggccacgctgcacatccggtgcaccaacggctccaagttcgccgtgcgggccgacctgggcaccaccgtcggggcgttcaaggcgatcgtcgccgagagctgcgacgtgccggcgccgcagcagcggctgatctacaagggtcggatcttgaaggacgaccaaaccctagccagctacggtgtggagacagaccatacaatccacatggtacgtggtgctgcgccaccaccagcatctactgcacctgcagccaaccaagaacctaccactgctgctcctgccagttccccggcagcaggattgggtggcttgttacaaagtctgggtgctacaggggctgctgctaacagtggggggtcaggtttgtttggatctggcctccctgagttagaccagatgcaacaacagctagcggaaaatccgaacttgatgagggaaataatgaatatgccacttatgcagaatttgatgaacagtcctgaactcatacgcagtataataatgaacaatcctcaaatgcgtgagcttattgatcgcaatccagatcttgctcatgtcctcaatgatccaagcatcatgcgccagacttttgaagcagttcggaatcctgaactcatgagggagatgatgcggaacacagacagagccatgagcaacattgaatcttctccagaaggattcaacatgctccgtcgcatgtatgaaactgtccaagagccttttctgaatgcaacaacaatgggtagcgagggtgatcgaaactcgaatccatttgctgctcttctaggaaaccaggggtctaaccaagcaagagactcagctgcaaatggaacaactacagcttcagaccccacttcaggctctccagctccaaatactaatccacttccaaatccttggggcccaaatgctggctctacccaaggagcagcaaggtcccctcctgctagcaacactaggagtaccacagcaagtggcctaggagggttgggttcagcagatttgggaagtatgcttggtgccagtggtggtggctctgatgctaccttcttgactcaagttttgcaaaacccaactatgatgcagatgatgcaaaacattatgtctaatcctcagtccatgaatcagctgcttaatatgaatccaaatgtacgtaacatgatggaatccaatactcaaatgagagaaatgattcagaatccagaatttcttcgccagttgacgtctcctgaaacattgcagcaattaatttcattccagcagtctttgatgtcacaacttggccaacaacaagctggacaggagcggacacaatcaggctctggtgcaggcaatgtcaacctcaacaccttgatgaacatgttcagcgggcttggtgctggtggtggcctaggtgttccaaatgctcctaatgtgccgccagaagaactgtatgcaacacaattagctcagctccaagaaatgggtttctttgacacacaggagaacatccgagccttggccgctaccgctggaaatgttcatgctgcagtggagcgacttcttggaaatatgggccaatagaatatgatgatgatcataactgttttgtagttggcgttgtgagattatgtttggttcattggttttacacctgagattcagaggcggcatctagattctgtgtttaaggatgaataaagagtgtaccggtagaacctttcatatacatgtggtctggtgtcatggttaaaattgttgttgttggtacattgggttgctgtacatacacattgatctcttgcaatgtacatggacaatgtctttctgtacaagagggtgggggtggggcagggagagggaatatgtagagcaaaccatgagaactcataaaaaattgtatttcgattgcttaagaaaatatgacatgcatccataccccatagatgtattttgttgcaatagttgggatttcctcaattttag

SEQ ID NO: 4791 - DNA, 2323 bp, Zea mays
cgtctgcgtgtggtgcgttgccttcttcctcctcgcacacgccaggcacgagaccaacacccacagcgcacgcactccaaatagcgagccaaaggcgggccgaggccacgagtcctccgcctctcctccgccgcgtcgctcgcgctccaggcacgccgaaagccgaatcggggccgcgaggcagcctccccgggcggatcgaccccagggccaggggcatgggcggaggggacgccgacgccggcggcgagcccgcggccgcgcaggccacgctgcacatccggtgcaccaacggctccaagttcgccgtgcgggccgacctgggcgccaccgtgggaacgttcaaggcgatcgtagccgatagctgcgacgtgccggcgccgcagcagcggctgatctacaagggccggatcttgaaggacgagcaaaccctagccagctacggtgtggagacagaccatacaatccacatggtacgtggtgctgcgccaccaccagcatccactgcacctgcagccaaccaagaacctaccactgctgctcctgccagttccccagcagcaggattgggtggcttgttgcaaaatctgggtgctacaggggctgctgctaacagtgggggtttgggtttgtttggatctggcctccctgaattagaccacatgcaacaacagctagctgaaaatcctaacttgatgagggaaataatgaatatgccactcatgcagaatttaatgaacagtcctgaactgatacgcagtataataatgaacaaccctcaaatgcgcgagctcattgatcgcaatccggatcttgctcatgtcctcaatgatccaagcatcatgcgccagacttttgaagcagttcggaatcctgaactcatgagggagatgatgcggaacacagacagagccatgagcaacattgaatcttctccagagggattcaacatgctccgtcgcatgtatgaaactgttcaagagccttttctgaatgcgacaacaatgggtagcgagggtgatcgaaattcgaatccatttgctgcacttctaggaaatcaggggtctaaccaagcaagagactcagctgcaaatggaacaactacagcttcagacaccacatcaggggctccagctccaaatactaatccacttccgaatccttggggtccaaatgctggatctgcccaaggagcagcaagatcccctcctgctaccaacactaggagtactacagcaggtggcccaggagggttgggttcagcagattttggaagtactcttggtgccagtggtggtggctctgatgctaccttcttgactcaagttttgcaaaacccaactatgatgcagatgatgcagaacattatgtctaatcctcagtccatgaatcagctgcttaatatgaatccaaatgtacgtaacatgatggaatccaatactcaaatgagagaaatgattcagaatccagaatttattcgccagttgacgtctcctgaaacattgcagcaattaatttcattccagcagtctttgatgtcacaacttggccaacaacaaactggacaggagcggacacaatcagcctctggtgcaggcaatgtgaacctcaacaccttgatgaacatgttcagtgggcttggtgctggtggtggcctaggtgttccaaatgctcctaatgtgccaccagaagaactgtatgcaacacaattagctcagctccaagaaatgggtttttttgacacacaggagaacatccgagccttggccgccactgctggaaatgttcatgctgcagtggagcgacttcttggaaacatgggccaatagaatatgatgacgaacataactgtgttctgatccatgcgatctgtagttggcattgtgagattatgtctggttcattggttttagacctgagattgagaggcggcatctagattctgtgtttaaggatgaataaagagtgtaccggtggaaccttacatataaatgtggtctggtgtcatggttaaaattgttgttgttggtacattgggttgctgtacatatggatcttttgcaatcttatttgcattgtacatggacaatgttttatgtaagagctgattccgtgaccaggggtcacggagggattggaggggattgaaagagaaatgaactaatttcccctcaacccctccaatctctttgtgatccctggtcatcaaatcagccctaaaggggtgggggtatgtagtactaacgatgttgtggtttcactttggattgaagctggtacaaaataaagctaaatgaacaggctaacgtgaactcataaaaaa

SEQ ID NO: 4792 - DNA, 2062 bp, Panicum virgatum
cgtgtgggcgactgcctgccttcttcctcctcccccacgccacgaggccgacccctcagcgcacgcgctctccaaatagcgaagcggaaggggaccgaagccacgagtccaccacccctcccacctctcctccccccgccgcgtcgcgagagcgcgctccgagagccgaatcggaccgcgaggtggtccccccggggcggatcgagcctagggctaggacatgggcggaggggacgccgacgccgacgccggcggcgagcacgcggccgcgcaggcgacgctgcacatccggtgcaccaacggctccaagttcgccgtgcgggccgacctgggcgccaccgtcggggcgttcaaggcgatcgtcgccgagagctgcgacgtgccggccccgcagcagcggctgatctacaagggccggatcttgaaggacgagcaaaccctagccagctacggtgtggagacagatcatacgattcacatggtacgaggtgctgcaccaccactagcatcaactgcacctgcagctaaccaagaaacttccactactgctcctgccagttccccagcagcaggattgggtggcttgttgccaggtctgggtgctacaggggctgctaatagtggagggttgggtttgtttgcatctggcctcccagaattagaccagatgcaacaacagctagccgacaaccccaacttgatgagggaaataatgaatatgccactcatgcagaatttaatgaataatcctgatctcatacgcaatataataatgaacaatcctcaaatgcgtgagctcattgatcgcaatccagatcttgcccatgtcctcaatgatccaagcatcctgcgccagactgttgaagcagctaggaatcctgaacttatgagggagatgatgcggaacacagatagagccatgagcaacattgaatcttctccagaaggtttcaacatgctccgtcgcatgtatgaaactgtccaagagccttttctgaatgcaacgacgatgggtggtgagggtgatcgaaatgcaaacccatttgcagctcttctaggaaatcaggggactaaccaaacaagggacccagctgcaaatgcaccaactacagcatcagaccctgcagcagggtctccagccccaaatactaatccacttccgaatccctggggctcaaatgctgggtctgcccaaggagcagcaaggcctcctcctgctagcaacaccaacacaaggactgctacagcaggtggtctaggagggttgggttcagcagatttaggaagtgtgcttggtggtggcgctgatgcttccttcttgagtcaggttttgcaaaacccaactatgatgcaaatgatgcagaatattatgtctaatcctcagtccatgaatcagttgtttaatatgaacccaaatgtacgtaatatgatggaatcgaatactcaactgagagaaatgtttcagaatccagaatttcttcgccagttgacgtctcctgaaacattgcagcaattaatttcattccagcagtccttgatgtcacaacttggccaacaagctggacaggagcgtacacaatcaggcactggtgcaggcaatgtcaacctcaacaccttgatgaacatgttcagcgggcttggtgctggtggtggcctaggtgttccaaatgcccctaatgtacctccagaagaactgtatgcaacacagctaactcagctccaagaaatgggtttctttgacacacaggagaatctccgagccttgatcgccaccgcaggaaatgttcatgccgccgtggagcgacttctcgggaatttgggttaatagaatgtgacaataaccgtacgcccatcatatgacctgtagttggcattgtaagatcctgtttggttcattggtttcacacccggtgagatttgagaggcggcatcaagattctgtgttctaagacgaataaacgtgtaccagtggaaccttgcatatacatgggctctggtgtcatggttaaaattggtgttgttgatacccttgggttgctgtacatacatactattgaattac

SEQ ID NO: 4793 - DNA, 2182 bp, Setaria italica
cgtgtccgtgtgcgtgtgcctctcccttcttcctcctcgcacggcacgagccggactcctccacagcgcgccgcgagtccaccacccctcccacctctccaccgtcgcgtcgcgccgcgcgcgcggactccgagagccgaatcggagcgcgaggcggcgcctccggggcggatcgagcctagggctagggcatgggcggaggggacgccggcgccgaccccggcgctgagcccgcggccgcgcaggcgacgctgcacatccggtgcaccaacggctccaagttcgccgtgcgggccgacctgggcgccaccgtcggggcgttcaaggcgatcgtcgccgagagctgcgacgtcccggcgccgcagcagcggctgatctacaagggccggatcttgaaggacgaggaaaccctagccagctacggtgtggagactgatcatactattcacatggtacgtggtgctgctccaccaccagcatcaactgcacgtgcagccaaccaagaaacttcctctactgctcctgccagttccccagcagcaggtttgagtggcttgttgcaaggtctgggtggtacaggggctgctaatagtggagggttgggtttgtttggatctggcctcccagaattagaccagatgcaacaacagctagctgaaaaccccaacttgatgagggaaatgatgaatatgccactcatgcagaatctaatgaataatcctgatctcatgcgcaatataataatgaacaatcctcaaatgcgtgagctcattgatcgcaatccagatcttgcccatgtcctcaatgatccaagtatcctgcgccagactgttgaagcagctaggaatcctgaacttatgagggagatgatgcggaacacagatagagccatgagcaacattgaatcttcaccagaaggtttcaacatgctccgccgcatgtatgaaactgtccaagagccttttctgaatgcaacaacaatgggtggtgagggtgatcgaaatccaaacccatttgctgctcttctaggaaatcaggggtccaaccaagcaagggacccagctgcaaacgcaccaactacagcttcagacccggcagcagggtctccagctccaaacattaatccacttccgaatccctggggcacaaatgctggatctgcccaaggagcagcaaggccccctcctgctagcaacacaaacacaaggagtgctacagcaggtggtctaggaggattgggctcagcagatttaggaagtgtgcttggtggtggctctgatgcttccttcttgagtcaggttttgcaaaacccaactatgatgcagatgatgcagaacattatgtctaatccccagtccatgaaccagttgctcaatatcaacccaaatgtacgtaacatgatggaatcaaatacccagctgagagaaatgtttcagaatccagaatttcttcgccagttgacgtctcctgaaacattgcagcaactaatttcattccagcagtccttggtttcacaacttggccaacaacaagctggacaggagcgtacacaatcaggcactggtgcaggcaatgtcaacctcaacaccttgatgaacatgttcagcgggcttggtgctggtggtggcctaggtgttccaaatgcccctaatgtggctccagaagaactgtatgcaacacagctagctcagctccaagaaatgggtttcttcgacacacaggagaacctccgggccttgatcgctaccgctggaaacgtccatgccgcagtggagcgacttcttgggaatttgggccaatagaatatgatcataactgtagttggcattgtgagatcctgtctggttcattggttttacacccggtgagatttgagaggcggcatctagattctgtgttctaagatgaataaggagtgtaacagcagaaccttgcatatacatgggctctggtgtcagtgatggttaaaattggtgttgtcgatgccttgggttgctgtacatacatactattgaatgagcgggtcttactgcaatgtacatggccgatgtcttctaccctcttgtactcttgtcttatatcttgtggccacctacagatgacctactttgtttttttcctgaaacctgaaggtgcgctgatccttgagacgagctgggatcatgagaatgcgattgaaggt

SEQ ID NO: 4794 - DNA, 2185 bp, Panicum virgatum
cggcttgtgggctgcctgccttgccttgtcccttcttccacggttccacctcccccaacggcacgagcccgacccctccagcgcacgcgctctccaaatagcggagcggaaggggacagaagccacgagtccaccacctctcccccgtcgcgtcgcgtcgcgtcgcgtcgcgcgagcgcactccgagagccgaatcggagcgcgaggcagcacccccggggcggatcgagcctagggctaggacatgggcggaggggacgccgacgccgccggcgagcccgcggccgctcaggcgacgctgcacatccggtgcaccaacggctccaagttcgccgtgcgggccgacctgggcgccaccgtcggcgccttcaaggcgatcgtcgccgagagctgcgacgtgccggccccgcagcagcggctgatctacaagggccggatcttgaaggacgagcaaaccctagccagctacggtgtagagacagatcatacgattcacatggtacgaggtgctgcgccaccactagcatcaactgcacctgcagctaaccaagaaacttccactactgctcctgccagttccccagcagcaggattgggtggcttgttgccaggtcttggtgctacaggggctgctaatagtcgagggttggatttgtttggatctggcctcccagaattagaccagatgcaacaacagctagccgacaaccccaacttgatgagggaaataatgaatatgccactcatgcagaatttattgaatagtcctgatctcatacgcaatataataatgaataatcctcaaatgcgtgagctcattgatcgcaatccagatcttgcccatgtcctcaatgatccaagcatcctgcgccagactgttgaagcagctaggaatcctgaacttatgagggagatgatgcggaacacagatagagccatgagcaacattgaatcttctccagaaggtttcaacatgctccgtcgcatgtatgaaactgtccaagagccttttctgaatgcaacaacaatgggtggtgagggtgatcgaaatgcaaacccatttgcagctcttctaggaaatcaggggactaaccaaccaagggacccagccgcaaatgcaccaactacagcttcagaccctgcagcagggtctccagctccagctccaaatactaatccacttccgaatccctggggctcaaatgctggctctgcccaaggagcagcaaggccccctcctgctagcaacaccaacacaaggactgctacagcaggtggtctaggagggttgggttcagcagatctgggaggtgtgcttggtggtggtgctgatgcttccttcttgagtcaggttttgcaaaacccaactatgatgcaaatgatgcagaatattatgtctaatcctcagtccatgaatcagttgcttaatatgaacccaaatgtacgtaatatgatggaatcgaatactcaactaagagaaatgtttcagaatccagaatttcttcgccagttgacatctcctgaaacattgcagcaattaatttcattccagcagtccttgatgtcacaacttggccaacaacaaactggacaggagcatacacgatcaggcactagtgcaggcaatgtcaacctcaacaccttgatgaacatgttcagcgggcttggtgctggtggtggcctaggtgttccaaatgcccctaatgtgcctccagaagagctgtatgcaacacagctagctcagctccaagaaatgggtttctttgacacacaggagaacctccgagccttgatcgctaccgctggaaatgttcatgctgcagtggagcgacttctcgggaatttgggccaatagaatgtgataactgtactcccatcctatgacctgtaattggcattgtaagatcctgtttggtccattggttttacacccggtgagatttgagaggcggcatctagattctgtgttctaagacgaataaacgagtgtgccagtggaaccttgcatataaatgggctatggtgtcattgttaaaattggtgttgttgatacttgggttgttgaattaccgggtcttactgcaatgcacatggccgatgtcttgtagcctcttcttactttgtgtttgctgaatccagaaagtgcactgattcttcagaaatgagaactgatgatcgttggata

SEQ ID NO: 4795 - DNA, 1916 bp, Panicum virgatum
gcaggcgacgctgcacatccggtgcaccaacggctccaagttcgccgtgcgggccgacctgggcgccaccgtcggggcgttcaaggcgatcgtcgccgagagctgcgacgtgccggccccgcagcagcggctgatctacaagggccggatcttgaaggacgagcaaaccctagccagctacggtgtggagacagatcatacgattcacatggtacgaggtgctgcaccaccactagcatcaactgcacctgcagctaaccaagaaacttccactactgctcctgccagttccccagcagcaggattgggtggcttgttgccaggtctgggtgctacaggggctgctaatagtggagggttgggtttgtttgcatctggcctcccagaattagaccagatgcaacaacagctagccgacaaccccaacttgatgagggaaataatgaatatgccactcatgcagaatttaatgaataatcctgatctcatacgcaatataataatgaacaatcctcaaatgcgtgagctcattgatcgcaatccagatcttgcccatgtcctcaatgatccaagcatcctgcgccagactgttgaagcagctaggaatcctgaacttatgagggagatgatgcggaacacagatagagccatgagcaacattgaatcttctccagaaaggtttcaacatgctccgtcgcatgtatgaaactgtccaagagccttttctgaatgcaacgacaatgggtggtgagggtgatcgaaatgcaaacccatttgcagctcttctaggaaatcaggggactaaccaaacaagggacccagctgcaaatgcaccaactacagcatcagaccctgcagcagggtctccagccccaaatactaatccacttccgaatccctggggctcaaatgctgggtctgcccaaggagcagcaaggcctcctcctgctagcaacaccaacacaaggactgctacagcaggtggtctaggagggttgggttcagcagatttaggaagtgtgcttggtggtggcgctgatgcttccttcttgagtcaggttttgcaaaacccaactatgatgcaaatgatgcagaatattatgtctaatcctcagtccatgaatcagttgtttaatatgaacccaaatgtacgtaatatgatggaatcgaatactcaactgagagaaatgtttcagaatccagaatttcttcgccagttgacgtctcctgaaacattgcagcaattaatttcattccagcagtccttgatgtcacaacttggccaacaacaagctggacaggagcgtacacaatcaggcactggtgcaggcaatgtcaacctcaacaccttgatgaacatgttcagcggtcttggtgctggtggtggcctaggtgttccaaatgcccctaatgtgcctccagaagaactgtatgcaacacagctagctcagctccaagaaatgggtttctttgacacacaggagaatctccgagccttgatcgccaccgcaggaaatgttcatgccgccgtggagcgacttctcgggaatttgggttaatagaatgtgacaataaccgtacgcccatcatatgacctgtagttggcattgtaagatcctgtttggttcattggtttcacacccggtgagatttgagaggcggcatcaagattctgtgttctaagacgaataaacgtgtaccagtggaaccttgcatatacatgggctctggtgtcatggttaaaattggtgttgttgatacccttgggttgctgtacatacatactattgaattaccgggtattactgcaatgtacatggccgatgtcttgtagcctcttactctgtgtttgctcaatccagaaactgcactgattcttcagaaatgagaactgatggtcgttgttgggtagctgt

SEQ ID NO: 4796 - DNA, 2324 bp, Oryza sativa
cgccgactcgccgtgggcccccaccgacgcaaaggaatcacagccttccatctctgtcgcgcacttatttccgccgttaatctctccgcccaaagttattccgccgcctcctcttccccccctcctcgttctcctccctcccacaagcccgtgcagacgagacgcgacacgcgacacgggaagaggaggggggaggggaacacacgccacactcctctcgcccgcatcgcactcgcaccgcacgcgtcgaaggatcgggaaggcgcagccccgcgtcggatcgagagctagggttatgagcggcggggacggggaagaggcagccgccgcggcggcggccgcgacgctgcacatccggtgcaccaacggctccaagctcgcggtgcgggccgacctggggctcagcgtcggggcgttcaaggcgatcgtcgccgagagctgcgacgtgccggcgccgcagcagcggctgatctacaagggccggatcttgaaggacgagcaaaccctagccagctacggtgttgagacggatcacaccattcacatggtccgtggtgctgcaccaccaccagcgtcaaccgcacctcctgcagccaacaatgtaactcctgccattaatgctaccactgcttccaattcaccagcagttggttttggaggtttgttgcatggtcttgggggttcaggttctgctaacagtggagggttgggctcatttggttctggccttccagaactatcccagatgcaacaacagctatccgagaaccctacgttgatgagagaaataatgaatatgccactcatgcagaatatattgaatagccctgatctaattcgcaatataattatgaacaacccccaaatgcgtgaaattgttgatcgtaatccagatcttgctcatgtcctcaatgatccaagcattctccgccagactgttgaagcagctaggaatcctgaacttatgcgagagatgatgcggaacacagacagagccatgagcaacattgaatcttctccagaagggttcaatatgctccgccgcatgtatgaaactgttcaagagccatttctgaatgcaacaacgatggctggggagggtgatagaagttcaaacccattttctgctctcctaggaaatcatggatcaaaccaagccagagatccagctgcaaattcaccaacgaccacctcagaatccacaacaggttctcctgctccaaacactaatccacttccaaatccctggagcacaactgctggagctgcacagggagcaacaaggccctctccagttaccaatgcaaggagtgccacagctggtggcctaggagggttaagttctacagatttgggaggtatgctgggtggtggctcggatacttccttcttgagtcaggtgttgcaaaatcctacaatgatgcaaatgatgcagaacattatgtcaaatcctcagtccatgaatcagctgcttaatatcaacccaaatgtacgtaatatgatggaatctaacactcagttgagggagatgttccagaacccagaatttgttcgccagttgacatctcctgaaactttgcagcaattaatctcattccagcagtccttgatgtcacaacttggtcaacaacaagctggcccagagcgaacccaatcaggtgctggtgcaggcaatactaacctcaacaatctgatgagcatgttcagtgggctcggtgctggtggtggcctaggtgttcctagtgcacccaatgttccaccagaagagctatatgcaacacaactagctcagctccaagaaatgggtttctttgacacacaggagaacattcgagctttgattgctacagcgggaaatgttcatgctgcggtggagcgacttcttgggaatattggctgatagactgttgtgatcgaagatgtcctcgacttgttacctgtagctcagattgtaagattgtctggttcattggttttataccgtcagattcaaaggcatcatctaggtacatggtttagatgaataaatgagtcaagtgggttaacctttccatacatggttgtcatgtcgtgatcgagatattggtgtattgatggtactttgggttggtgtatatacatattgagctattggtggttactgcagtgtacatgaccgttgtttatgtttacttgcctgctcttacaacctatagataccctaactcttcactgaagatgtgctagaaatttgctttctcatgtgttgatggcattattggattgaaaaggggctcttgtgaagctaaaactctacaatagtgaaagatggaaggtggttggct

SEQ ID NO: 4797 - DNA, 2189 bp, Brachypodium distachyon
gctgccttgccttcccttcccttcccttcttcctcctccagcgcacggcgtgtacaaaagccagaaaaaagaggggaacgaacaaacgcctcgcacacacaacgacaagaacaaagtctcaaacccctccagagcactcgccggaccccgaatcggagcggaatcccggccgaatcgaggcctagggctagagacgggatgggtggcggcgaaggagagggtggcgagtccgcgggagccccgcccgcgacgctgcacatccggggcgccagcggcaacaagttcgcggtgcaggccgacctgggcacaaccgtcggggcgttcaaggcgatcgtcgcccagagctgcgacgtgccggcgccgcagcagcggctgatctacaagggccggatcttgaaggacgagcaaaccctagccagctacggtgtggagacggatcacaccatccatatggtgcgtggtgctgcaccaccagcaacagcagctccacccgctgcagtcaaccatgggacttcaactactactccttctaatactccggctgccggtttaggaggcttgttgcaaggtctgggcgctacaggaactgctggcaccgggttgggttttcctggcactgggcttgcaggattggagcagatgcaacaacagttgactgagaatcccaacttaatgagggaaatattgaacatgccagccatgcagagtataatgaacaaccctgatataatgcgcgatatgattatgagcaatcctcaaatgcgtgagctcattgatcgtaatccggatctggcacatgtcctgaatgatccaagcatccttcgtcagactgttgaagcggctaggaatcctgagcttatgagggagatgatgcggaacacagacagagcaatgagcaacatcgaatcttctccagaagggttcaatatgcttcgccgcatgtatgaaactgttcaagagccactactgaatgcaacaacaatggctggggagggtgatagaaattcaaacccgtttgcagctcttctaggaaaccaggggtctaaccaagccagagatccagctggaaatgcaccaactactgcttcagagtccacgacaggctctcctgctccaaatactaatccgcttccaaatccctggagtgcaaatgctgggcctgcacaaggagcggcaaggccttctcctgctagcaatgcaaggagtgccacaagcggtggcctaggactaggagggttgggttctgcagatttgggaaatatgctgggtggtggctctgatgcttccttcttgaaccaggttttgcaaaacccaacaatgatgcaaatgatgcaaaatattatgtctaatcctcagtccatgaatcagttgctcaacatgaacccaaatgtacgtaacatgatggaatcaaattcccagatgagagaaatgtttcagaatccagaatttcttcgacagttgacgtctcccgaaacattgcagcaactgatttcattccagcaggctatgacctcccaacttggtcaacaacaagctggccaggagcggacccaagcaggcactggtgcaggcaatgttaacctcaacaccttaatgaacatgttcagtgggcttggtgctggtggtggtttgggtgttccaaatgccccgaatgtgccaccggaagaactatatgcaacacagctagctcagctccaggaaatgggtttcttcgacccacaggagaacatccgagcattggtggctactgctggaaatgtgaacgctgcagtggagcgacttctcgggaattttgggcaatagaagatgtgatccaagctgtgtctggtgttttacctgtagtttgcatcgtgagatcatctgcttcattgattttatacctggtcagattaaaaggcaacatctagattctatgttttaagatgaataaaccagtctctactggctatcctttgcatacatgggtcgtgtgtcttgttgttaaactgtggtatattggtaccttgagtcggtgtagatacatgttggtactatgggggcttattgagtgtacatgacttgttttcctaccctggtgagctaaccatccgtatattgctgacttgtttcattgaagatgtgctagttttctgtacgtgggctcatggaactggaaaggcgattgttcagtttaagtgtgcacggcgcct

SEQ ID NO: 4798 - DNA, 2234 bp, Brachypodium distachyon
tcacggtcgtctcagcccacagagttattcctcgctgccttcccttcccttcttcctcctccagcgcacggcgcgtacaaaagccaggaaaagaggggaacgaacgaacacaacaacaacaacaaagcctcaaacccctcctgagcactcgacggagccgaatcggagcggaaccccggccggatcgaaacccagggctaaggaggggatgggcggcgacgaaggagagggtggcgagtccacgggagccccaccggcgacgctgcacatccggggcgccagcggcaacaagttcgcggtgcaggccgacctgggcaccaccgtcggggcgttcaaggcgatagtcgcccagagctgcgacgtgccagcgccgcagcagcggctgatctacaagggccggatcttgaaggacgagcaaaccctagccagctacggtgtggatacagatcacaccatccatatggtgtgtggtgctgcaccaccagcaacagcagctgcaccggctgcagccaaccatgggacttcaactactactactgcaaatacttcgcctgctggtttaggaggattgttgcaaggtctgggcgctacaggaactgctggaacggggttgggtttacctggctctggccttgcaggattggagcagatgcaacagcagttgactgagaatcccaacttaatgagggaaatattgaacatgccagccatgcagagtttaatgaacaaccctgatataatgcgtgatatgattatgaacaatcctcagatgcgtgagctcattgatcgtaatccggatctggcacatgtcctgaatgatccaagcatccttcgtcagactgttgaagcggctaggaatcctgagcttatgagggagatgatgcggaacacagacagagcaatgagcaacattgaatcttctccagaagggttcaatatgctccgccgcatgtatgaaactgttcaagagccatttctgaatgcaacaacaatggctggggagggtgatagaaatccaaacccgtttgcagctcttctaggaaaccaggggtctaaccaagccagagatccagctggaaatgcaccaactactgcttcagagtccacgacaggctctcctgctccaaatactaatccgcttccaaatccctggagtgcaaatgctgggtctgcgcaaggagcggcaaggccttctcctgctagcaatgcaaggagtgccactagcggtggcctaggactaggagggttgggttctgcagatttgggaagtatgctggctggtggctctgatgcttccttcttgaaccaggttttgcaaaaccctacaatgatgcaaatgatgcaaaatattatgtctaatcctcagtccatgaatcagttgctcaacatgaacccaaatgtacgtaacatgatggaatcaaattcccagatgagagaaatgtttcagaatccagaatttcttcgacagttgacgtctcccgaaacattgcagcaactgatttcattccagcaggctatgacgtcccaacttggtcaacaacaagctggccaggagcggacgcaagcaggaactggtgcaggcaatgttaacctcaacaccttgatgaacatgttcagtgggcttggtggtggtttgggtgttccaaatgccccgaatgtgccaccggaagaactatatgcaacacagctagctcagctccaagaaatgggtttctttgacccacaggagaacatccgagcattggtcgccactgctggaaatgtgaatgctgcagtggagcgacttcttgggaattttgggcaatagaagatgatcgaagttctctgcctggtgttacctgtagttcgcaccttgagattatctggttcgttgattttatacctggtcagattaaaaggcaacatctagattctatgttttaagatgaataaaccagtctctactggctatcctttgcatacatgggtcctgtgtcttgtggttaaattgtggtatattggtaccttgagtcggtgtacaactgtacatacatgttggtactatggggtctcattgagtgtacatgactgttgttttcctacttggtgagctaaccatccgtatgttgctgacttcttcattgaagatgtccttttttttagggagaacatgtcctagttttctgtacatgggatttgaaaagctcttgttcagtgaaagtgagcacggcgcctgaaccgcctgccgttgcctt

SEQ ID NO: 4799 - DNA, 4202 bp, Setaria italica
tggagcctactactcccgcaccatgtggagtcgccatcctccaacggaaacgggtttcgccgcttctcagcgctcaccagtcaccaggccagcagccgcttaaaccctcgttcccctttcgtctcccctcccaaaccccccaacaccccccgcctccactccccccacagcccggccgccaccgcctccgctcctccggcctcgcctccccagcagcctcatcccgccccccttaatgctctatcccgcctccctccgctagccgcgccgcgggcgcgcgtccccaccaccacccgctctctctcccgtggcggccgcgcgaagacggcgcccccctgcggcctcggcttctgcggggccggcggcggcgctgcggggaggagggcggccgggtccaagctgaggcggttcgtggggtccatggcggtggcggggccggcgccggctccgcttctgcggtgccgcggctcggcgccgccgtggttcgcgtcgtcgtcgcccttcttctcccgccgccgcgcccgccgctcctcgccgcccccggcgctctccggatgcaggaggcaaaactattcccatagctcagatatggaagttcgaggaagcagcactttcaagcttggattctatgccaacttaaacgtgcaaaatattgcacaagaatggcttgttgagagcaggaggctgttttatctcagaaccgtcaacagtgtcacgaataacatctttaagggcaccactcctctacgggctgagaacctacaaaatgaactctcagaagatcgcaggggcttaaaccacccttccttgcataatctaagagagtttatatcatccaagtcaattgtaaatagacatgaaaataccgaactggtcaggcatagtatgataaatcatgtgcaatcagtgttcccagtaagtgctgttaataatagtgtcaaacagagcatgcctagaggcccaaatgttactttgcgtgacatctctaatacagaggcagttttggagctggatgataaagttcatgatggtgatgacaaaaaggtcaagaaacctgtagttaaaaaatgggtttcatctttgccacctaaagcatccttctccgaggaatctgtgaaagctcggaaggcacttgctggcatctacaacaaagttttggtagttgacaatatcgagtcagctaggaccattgttcaactgcttactacaaagtacaagaactttattcatgcatgtgacacggaggtatcaaatatcaatgtcaaagaagagacaccagttggtcatggacacgtaacatgctttagtatttattcagcaaattctaatgcacaagtggctgattttggaaatggcaaaacttgcatttgggttgatgttctggatggtgggagagatgtcctgatggagtttgctcctttttttgaagatccatccatcaagaaggtttggcataattatagctttgatagccatgttattgagaaccatggaattaaagtagctgggtttcatgctgatacaatgcatcttgcacgcctttgggattcatcgaggaaaactgatggcggatattcacttgaaggacttacaaatgatcgtagagtcatggatgctgttctagaagatttacctaatgctggaaagacatcaatgaaaaccatatttggcaggaaaaaagttagaaaggatggatctgaagggaaagtcatatctgttgacccagttgaaaagttacaaagggaagacaaagagttgtggatttgttattcttcactagattcaatgagcaccttgaggctttacgagagcttaaaaagaaagcttgaaacaaaggaatggatctttgatggttgccccaggggcacaatgtatgatttctatgaagagtattggcgtcccttcggtgccattcttgtgaagatggaaacagagggaatgcttgttgatcgtggttacctttcagagatagaaaaggctgctattgctgaacgagaagtagctgcaaataagtttcgaaaatgggcatctaaatactgtcccgatgccaagtacatgaatgtgaatagcgatactcaaattcgccaacttctctttggtggcattgagaatagacataaatctggtgaaacttggccactcagtaaaacttttaaagtgccaaatgaagaaactgtagatacagagggaaagaagacttcaaagtatcgtacaatcaaactttgcagtattgtcgaagatctgaaaattgatatgttcaccccgagtggctggccatcagtcagcggggatgcattgagaagtttggctggtaaaatacccacggaacatatttacacaatggatgattgtgatgaagattccagtggttcagaagatccggagcaggaaatagatgaaaattcctcatatggaacagcatatgaagcgtttggtggaggaaagaagggaaaagaagcatgccatgcaattgcagctttatgtgaaatatgttctatcgattcattgatatccaatttcattcttcccttgcagggagatcatatatcatgtgcagaggggcgcattcactgttcattaaatatcaatactgagacagggcgcttgtcagcacgaactccaaatctacagaatcaacctgcccttgaaaaggataggtataagattcggcaagccttcgttgcggctccaggaaattctcttattgttgctgattatggtcagctggagctgaggatcttagcccaccttactaattgtaaaagcatgctggatgctttcaaggctggtggtgacttccattctaggactgccatgaatatgtaccagcatatccgtgatgctgttgatgaaaagaaagttcttcttgagtggcatcctcaacctggtcaagagaaacctccagtgccgctattgaaggatgcttttggtgctgagaggaggaaagctaaaatgcttaatttctccattgcgtacggaaagacagctgttgggctatcccgggattggaaggtttctgttaaggaggcaagggatacgcttaagctatggtatggagatagaaaagaagtgttagcttggcaaaagaggcagaagaagcttgcacacgagaaatgtgaagtttacactttgctcggccgatcgcgccgatttcctaacttgactcaatttggtcctggtcaacgaggtcatattgagcgtgctgctataaatgcaccagtgcagggaagcgcagcagatgttgctatgtgtgccatgcttgagatcgaaagggatacccgtcttaaggagcttggttggaggctcctattgcaggtgcatgatgaagtgatactggaagggccttcggaatctgctgagacggccaaggccatagtagtggagtgtatgtccaaacctttctacggaactaacatcctgaacgtcgacctggctgttgatgccaagtgcgcaaagagctggtatgctgccaaatagacactgcacacatcctgttatcctacaaaatacaaatgtgcagatgcacgtttgcctgccacaaggttgctgacagtggtgcaatcggcgcccctccattcagattaaaaaaaaatggaattgagtcatcctggagaccgcggctccaggattatcacgttttaagtggtagccccaaccacggcaggatcacacccccatttcttggttgcagcagaacattgaaagaccgaagacttgctggcagtcacctcgagttgttgtgagtgtacactagtagtgtagtagcgcttagatttcttggagtgtaggttctcagtaggaccagatcggagtttgagatggcttgatctcgagagaagtagcagtgccaaagcatgctgtttgttcataagatgacttgttcagcatgctggtgcattaggttagtttcctgatttgttctgttccagtgaggccagctaacgtcttggtgaattggtgatgccgggtttatgttggtcgagggataacacagttcagcttttaccacgagctatgtctcgttttcctttttcttgagctaagtaagttattctgtattcagcactttcgtgttattgccttgttcagcagcaaccacaaattcttatttcttcctcccctcgtcacaaatatcgtaaataagtgacattctagacattgatacggttttaaagcacagtttcacttgtatttttggagtt

SEQ ID NO: 4800 - DNA, 3675 bp, Panicum virgatum
cgccgggccgccaccgcctccgcaacagcctcgtcccgccccctcgatgctctctcccgcctcccgccgctagccgccgcgctcgcgaacgcgcttccccgccaccagctctctcccgcgctgttgcgcagcgagagacggcgccaccctgcggcctcggtttctacggggccggcggccgcgctgcgggggcgaaggcggcccggtccaagctgaggcggttcgtgggatccatggcggtggcggcgcaggcgccggtgccgctgctgcggtgccgcggctcggcgccgccgtggctctcgtcgtcgtcgcacttcttcctccgccgccgcgcccgccgctcctcgccgccgccggcgctgtccggatgcaggaggcaagactattctcatagctcagatatgggagttcgagaaagcagtgctttcaagcttggattctatgccaacttaaacgtgccaaatattgcacaagagtggcttgtcgagagcaggaggctgttttatctcagaaccatcaacagtgtcacaaataacatctataagggtaccactcctcgacgggctggaaacctacaaagtgaactctcagaagattgcaggggtttaaactacccttccttacacaatataagagaacatgtatcacccaagtcaattgtaaatagacatgaaaacactgaactggtcaggcatagtatgataaatcagtctgtgcaatcagtgttcccagtaagtattgttaataatagtgtcaaacaaagcatgcctagaggcccaaatgtggggattcctttgcatgacatctctaatacagaggttattttggagctggatgataaggttcacgatggcaaagacaaggtcaagaaacttgtagttaaaaaaagggtttcatctttgccaactaaagcatccttctccaaggaatctatggaagcacggaaggaagttgctgccatctatgacaaagttttggtagttgacagtatggagtcagctaggaccattgttcaactgcttactacaaagtataagaactttattcatgcatgtgacacggaggaagcaaatattgacgtcaaagatgagacaccagttggtcatggacaagtaacatgctttagcatttgctcagcaaattctaatgcacaggtcgctgattttggaaacggaaaaacttgcatttgggttgatgttttggatggtgggagggatgtcctgatggagtttgctcctttctttgaagatccatccatcaagaaggtttggcataactatagctttgatagccatgtcattgagaaccatggaattaaagttgctgggtttcatgctgatacaatgcatcttgcacgcctttgggattcatcaaggagaactgatggtggatattctcttgaaggacttacaaatgactgtagagtcatggatgctgctccaaaggatttacctaatgctggaaagacatcaatgaaaaccatctttggcaagaaaaatgttaaaaaggatggatctgaagggaaagtcatatctgttgacccagtcgaaaagttacaaagggaagacagggagttgtggatttgctattcttcacttgattcaatgagcaccttgaggctttatgagagcttcaaaagaaagcttgaaacaaaggaatggatctttgatggttgccccaggggcacaatgtatgatttctatgaagagtattggcgtcccttcggtgcccttcttgtgaagatggaaacagagggaatgcttgttgatcgtggttacctttcagagatagaaaaggctgctattgctgaacgagaagtagctgcaaataagtttcggaaatgggcatctaaatactgtcctgatgccaagtacatgaatgtgaatagcgatactcaaattcgccaacttctctttggtggcattgaaaatagacataaatccggtgcaacttggcatcacagcaaaacttttaaagtgccaaatgaagaaagtgtagatacagagggaaagaagacttcaaagtatcgtacaatcaaactttgcagtatcgttgaagatctgaaaattgatatgttcacccctagtggctggccatcagtcagcgcggatgcattgagaagtttggctggtaaaatacccacggaacatatttacacaatagatggtattgaagggggtgaagaagatactagtggttcagaacattctgagcaggaagtagatgaaagttcgtcatatggaacagcatatgaagcgtttggaggaggaaagaagggaaaagaagcatgcaatgcaattgcagctttatgtgaaatatgttctatcgattcattgatatccaatttcattcttcccttgcagggagatcatatatcttgtgcagaggggcgcattcactgttcattaaatatcaatactgagacaggacgcttgtcagcacgaacgccaaatctacagaatcaacctgcacttgaaaaggataggtataagattcgccaagccttcgttgcagctccaggaaattctctcattgttgctgattatggtcagctggagctgaggatcttagcccaccttgctaattgtaaaagcatgctggatgctttcaaggctggtggtgacttccactctaggactgccatgaatatgtaccagcatatccgtgatgctgttgatgaaaataaagttcttcttgagtggcaccctcaacctggtcaagagaaacctccagtgcctctattgaaggatgcttttggtgctgagaggaggaaagctaaaatgcttaatttctcaattgcatatggaaagacagctgttgggctatctcgagattggaaggtttctgttaaggaggcaagggatacactcaagctatggtatggagatagaaaagaagtgttagcttggcaaaagaggcaaaagaagcttgcacacgagaaatgcgaagtttacactttgcttgggcgatcacgtcgttttcctaacttgactcaatttggtcctggtcaacgaggtcatattgagcgtgctgctataaatgcaccagtgcagggaagtgcagcagatgttgctatgtgtgccatgcttgagatcgaaaggaatacccgtcttaaggagcttggttggaggctcctattgcaggtgcatgacgaagtgatactggaagggccttcagattctgctgagacggccaaggccatagtggtggagtgtatgtccaaacctttctacggaatcaacatcctgaatgtcgacctggctgtcgatgccaagtgcgcaaagagctggtatgctgccaaatagactctgaacacatcctgtcatcctaaaaatgtccagatgcacgtttgcccgccacacgggtgatgacaagggtgcgatcaagacctctcccatcagattaaaattaaaaatggtggacttgaatcatcatggagactgcgtctccaggactgtcaagtatgaagcggtaagcccaaccacgacagtatcacacgtccatttcttggttgcagcagaacggtgaaagaccaaagactcgctggcagcctggtgttgtgaatgtacactagtagtttagtagcacgtagaattcttgtagtgtgggttctcagtagggtcagatcagagtttgaggtggcttgatcataagtagcagtgccaaagcatgctg

SEQ ID NO: 4801 - DNA, 1232 bp, Saccharum officinarum
aacaggtggtggccgttgcaattgcatccacatcccaactccggctccaggtccaggcagccagcaggctagcttgcccctcctctccgactccaacccaatccatccaatggccatcctccgcccccgttgtctcacctcacgcgctccctgccctccctgacctgcccccagcacgacgcgatgctccgcaccgcgtcggatagatggacgatattgctgggcagccgggaaggaaaggagacgactcttcccgtgccgtgctgacgccaccaccacgcggccccagtctcctctcgccctcctctcctccgtctggatctggtcctatcccctccccaccctccgccgctgtcctcgccctcccggcctcagccgcgagccagagcgccgggctcctcgcctcgtctcgcctcgccggcgagatggacggcggcggggagacgctgctggtgcggaggagcaagggcaagaagaagagaccgcagccggcggcgcccgcggagaggggctccggcggcagcggggacaggttccgcacgctctggcgggactaccacgacctgctgcaggagactgaggcaaagaagaagaggctggcgagcacaaagaggagaagcctcgccttgcttgctgaagtcaagttcttgcgaagcaagtaccaatcctttctgaagggtggctcgcagcagaaacactacaagttgaagaagcaggcttggtacacgccatctccattgggaagcaacaagactacagctttagcagatcatggtgcagggaccgaagtgccttctactagcaaaaacccaaacgttgatttaaatcaagattctgttccgaatgatgcggggaatgatcgccaagggcaacagggccatccagaagttgaaaagtttgatcaggtcacggtggatgaagatatgatgacagctgatgtcaaattatcagtttgtagggatacaggaaactctcctgcaagtgaaggtaagagggcagttccatggcaagaccggttagcgttgaaggcctaggccctcagttgatgtggctaagaaataagctgcttctctgatagctggctttgcaactgtatccctcaaatgctcagtagtgctttgtacagaaacaatgggatatgatagttatgtgcatgttacattgcctgattgacaaactcagatggttgtatcatgctcctaagcaagttagacaagaggattgtgattttt

SEQ ID NO: 4802 - DNA, 1668 bp, Sorghum bicolor
aacaaatttggcgaaaccatggacaccaaagaggaagacaaacagtcacaaccaatcacggcgccaaaacatgcagcgcagcttcatcatcgtggcctcatgggtccttcctggatatggcggaggaaaaacaggtggtggccgttgcaatcgcagccaggtccaggccgctccaactccagctccagcagcttgcccttgcccctctcccctctccgactccaacccaacccccccatccaatggccctccggctccgcccccgttgttgtctcacctcacgcgctccctgacctgccccgccccgccccgcccccagcacgacgcgatgctccgcaccgcgtcggatagatggacgatattgctggggagccgggaaggaaaggggacgactcttcccgtgccgtgctgacgccaccaccacgcggccccggtctcctctcgccctcctctcctccgtctggatctggtcctatcccctccccaccctccgccgccgccgccgctgtcctcgccctcccggcctcagccacgagccagggcgccgggctcctggcctcgtctcgcctcgccggcgagatggacggcggcggggagacgctgctggtgcggaggagcaagggcaagaagaagagaccgcagccggccgcggagaggggctccggcggcagcggggacaggttccgcacgctctggcgggactaccacgacctgctgcaggagactgagggaaagaagaagatgctggcgagcacgaagcggagaagcctcgccttgcttgctgaagtcaagttcttgcgaaggaagtaccaatcctttctcaagggtggctcacagcagaaacattacaagttgaagaagcaagctcggtacatgccatctccattgggaagcaacaaggccaccgcgttaggtgatcatggtgcaaggaccaaagtgccttctaccagcaaaaactcaaaccttcacttaaatcaagattctgttccgaatgatgtggtgaatgatcaccaggggcaacagggccatccagaagtcgaaaagtttgatgaggtcggggtggatgaagatatgatgacacctgatgtcaaattatcagtttgtagggatacaggaaactcgcctgcaagtgaaggtaagaggacggttccatggcaagatcggttagcgttgaaggcctaggtcctcagctgatgtggctaagaaataagctgcttctctgatagctggctttgcaactgtatccctcaaatgatcaatagtgctttgtacagaaacgatgggatatgatatatgcatgttacattgcctgattgaaaaaactcagatggttataccatgcgcctaagcaagttcgacaagaggattttgattttatgaatggttctgtccaggttttggattgactactttgaatgtgtttgtgcaatgaatgtattttcagtcatccagacaaacagacgctttagcaatgatcatgaattctatgaattgcaagtttgtagtgttaaatctctggtttcacaatttaggttttaaataggctctttatcacgaggacaaatgtaataaatgcttcgtggttttgtatagcaagttttaggtttgggtgttgcatttttaaaattggtgtaccatggtcaataggcagcatgtagattcgtctca

SEQ ID NO: 4803 - DNA, 1416 bp, Zea mays
actgctggcggccgttgcaattgcagccacattcaactcaggctccaggccgctgcaacccaagccgccagcagcctgcccctcctctccgactccaaaccaatccaatggccctccgccccccgctgtctcacctcacgcgctctctgccctggcctgcccccagcatgacgcgatgctccgcactgcgtcggatacatggacgatattgctggggagcgggggaggaaaggagacgactcttcccgtgccgtgctgacgccaccacgcggccccggtctcctctcgccctcctctccgtctagatctgatcctatcccctccccaccctccgccgccgtcctcgccctcccggccgcagccacgagcccgagcgccgggctcctggcctcgtctcgcctcaccggcgagatggacggcggcggggagacgctgctggtgcggaggagcaagggcaagaagaggcggcagccggcggcgcccgcggagaggggctccggcagcggggacaggttccgcgcgctctggcgggactaccacgacctgctgcaggagaccgaggcaaagaagaggaggctggcgagcaagaagcgaagaagcctcgccctgcttgctgaagtcaagttcttgcgaaggaagtatcagtcctttccgaagggtggctcgcagcagacacattacaggttgaagaagcaggctcggtacatgccatccccattgggccatggtgcagggaccgaagtgccttctaccagcagaaacccaaaccttgacttaaatcaagattctgtcctgaacgatgtggggaatgattgccaggggcaacatggccatccagaagttgaaaagttagatcaggtcgaggtgaatgaagatacgatgacacctgatgtcaaattatcagtttgtagggatacaggagagtactctcctgtaagtgaaggtaagagggcggttccatggcaagaccggttcgcgttgaagacctaggccctcagttgatgtggctaagaaataagctgcttctctgacagctagttttgctactgtatccctcaaatgctcagtagtgctctgtacagaaacaatgggacatgatacttatatgcatgttacattgcctgattgacaaactcagatgtttgtagcatgcttctaagcaagttagacaagtgagttgtgattctatgaatggttctgtccagaatttggattggcccatttgattttgcctttgtgcatcgaatgtttcttcaatcagcaagatcatgaattctgtgaattgcaagtttggagggttaaatttctggtttcatagtttaggtttcaaatagcctctttagcaatgatcataaggacaagtataactattgattggtttttggttttgagttgcaagtttatggtttgtttgtc

SEQ ID NO: 4804 - DNA, 1984 bp, Setaria italica
catttcttctccatctacctataataaccagctccggggcctcctgctaacattggcagcgcagccaccatggctgagcccggcaaggtcgtacgacggtggcagcggtgggcgttcgccaacctgggctcggcgttcaccaacttcggctcgctgtggttcatcctggcgccgctggtgtcgctggtcgccacctacgcgccgcgccgcctgttccagacctacttcaacctcttcctccgccgccgcacccgccgggtcctcaacgtcgtcgacccctacgtcaccatcgacatctcggagcccggctccgacgtgcgctactcccggtacggccccgtctccgacaacgacggtacctacgaggaggtcaaggcgtacctgagcggcgcgtgctcgcacgaggacgcgcgcgagctccgcgccgagggtgccaaggacggcgacggcctcgtcatcagcatgcgcgacggccaggacgtcgccgacgagttccgcggcgttccgctctggtggtcgtcggtggtggataaggacgtgcaggggcagcgccaggggaagcgacgcttccagcgcctcacgttccacctccgccaccgccggctcgtcgtcgacgagtacctgccacacgtccgccgccggggacgcgagatcctcttcagcaaccgccgccgcaggctctacaccaacagcaagtcacgcgatgtttacagctacgaatccaagtcatggagctacatcgacttcgatcacccgacgacgttcaacacgctggccatggaccgggccaagaagaaggacatcatggacgacctcgacgcgttccggaacaacagggacttctaccggcgaaccggcaagccgtggaagcgcgggtacctactctacggcccgccgggcaccggcaagtccaccatggtcgccgctatggccaactacctcgactacgacatctacgacgtcgagctcaccgtcgtgaacaccaacaccgacctccgcaggctcctcattgagaccaccagcaagtccatcatcgtcatcgaggacatcgactgctccctcgacctcaccggcgaccgcgccaggcagcggcgacgccccggcgggccgcccaaggatgacgacaggtactacgccgacgacaggccccgcaacacggtgaccctgtccggcctgctcaacttcatcgacgggctgtggtcggcgtccggcggcgagcgaatcgtcgtgttcaccaccaaccacgtcgacaagctcgacccggcgctgatccggcgcggcaggatggacatgcacatcgagatgtcctactgcggcttcgaggcgttccagaccctcgccaagaactacctggacatcgacgaccacgagctgttcggctccgtcgaggagatactgcgggaggtgaagctcacgccggccgatgtcgctgagtgcctcatgacggccaagcgagcgggagccggcgagccttctccgtgccttgagatattgatcgatgagctgaagaagagagcagaggagaaggagaaggccgaggcggaggcgaaggcgaaggctgaggcagaggccaaggcatgggctgaggcagaggccaaagcggcagcggaggcagaggccaaagcggcggcggaggcaaacgcgagcgaaatggcccgtgggaacacacggtaagaagaggatgcagagaaaattcgaggatgtgttagagttttatgaataatcctgaacaaggctttgctaaatctcgctctggaatctcttaatcctgactcgatcgttttggtacttaacttatgtgaggttcgcaattaggaatatagtgtcgtgcaagagtttagaaaagaaatcatgtactgcttcgtgatcttcagacacctgagttttagtttgcgccttagttataattattactttataatttttatatatgtaactttaagtcacgaaggtaactttatagctgcgggatctcatcatatac

SEQ ID NO: 4805 - DNA, 1569 bp, Setaria italica
aaatcatccgctgccggcgtcagcgttgtatccaaagcgtccaccgtcgtgctagattccacaactaggcaggcagacgccacacgccagccgtcctggtgtgcgtcactgcgtctcgtgcagacagacgcggtccacagctcgccacggccatggacgtggaagcgcgcaaggacgcggcgcccgcgcgcggcaaggcgatgcgccgcctcctggtggcgctcaactgcgggatgctcgcgctgggtgccatcggcgggccgctcctcagccgcctctacttcagcaagggcggccaccgtcagtggctgtccgcgtggctcgagaccgccggctggccgctgctgctggtccccgtggtggcggcttacgtcgcccgccgcgcgcgcgaccgggccgccccggccctcctcaccccgccgcgcatcctgctggccgcggtgggcctcggcgtcgccacgggcgtggacgacttcatctacgcctacgggctctcgtacctccccgtgtccacctccgcgatcctcatctcgacgcagctcgcgttcacggtgctcttcgcgttcctcatcgtgcggcagcggctgaccgccgcgtccgtgaacgccgtggcgctcctcaccgtgggcgccgtcgtgctggggctgcacgtctcctccgaccggccccccggggtcaccaggggccagtactggctggggttcatcctcacgctcggcgccgccgcgctctacggcctggtcctgccgctggtcgagctcgcgtacaggcgcgccgccggcggcgggcgcgccgtgacgtacgcgctggtgatagagatgcagctggtgatggggttcttcgccaccgcgttctgcaccgtgggcatgatcgtgaacaaggatttccaggcgatcccaagggaggcgaagcacttcgagctaggggaggcccggtactacacggtgctggtgtggtcggccgtgctgtggcagtgcttcttcctgggcgccgtgggggtcatcttctgcgtgcacacgctgctcgcgggcatcctcatcgccgtgttcatcccggtcacggaggtggccgccgtgatcttcctgcacgagaagttcagcagcgagaagggcgtggcgctggtgctctcgctctggggcctcgcgtcctactcctacggcgagtggagcgactccagggccaagaagaaggctgaggccgccgcggaaggccaggcctcgtgattcttatactgcaactgtggacgatgatgagagatcgaggctctgatctcttcccgttgtactttctatatgctgtgattgtggccgtgtcgatggagtcgcgtaagtcgtcacctgcaactgtaggatggtcaacattcttcagttcagttgggtgggtagtactgtactgcatggtgcatggaggtgtgtatgtcatactagtactgtaccgtacagtacatgaaactgctcgctacgtttgaagtcgtagcaaagcgatcggcgcacttgtaacccgattccgggtatggttagaacgaatacaaaatatgtttctgtgactattctccacagttaaaacgag

SEQ ID NO: 4806 - protein, 266 aa, Triticum aestivum
MALHAVSPAAAASPPCALSSARLPQRPGCGCLSNRSSLLSSSTNFMKFQSGAVGFFGVPLVLQHSDKRAVLRHATNEEIEEEKMIVEEQAKEKMEKAIETVQSNFNTVRTGRANPSMLDRIEVEYYGTPVNLKTIAQINTPDATSLLIQPYDKSCLKLIEKAIVAANIGVTPSNDGEVIRVTVPPLTSDRRKEMTKTVAKLSEEGKVAIRNIRRDAIKAYDKLEKEKKLSEDNVKDLSADLQKITDEYMKKVEAIQKQKEQELSKV

SEQ ID NO: 4807 - protein, 266 aa, Triticum aestivum
MALHAVSPAAAASPPCALSSARLPQRPGCGCLSNRSSLLSSSTNFMKFHSGAVGFFGVPLVLQHSDKRAVLRHATNEEIEEEKMIVEEQAKEKMEKAIETVQSNFNTVRTGRANPSMLDRIEVEYYGTPVNLKTIAQINTPDATSLLIQPYDKSCLKLIEKAIVAANIGVTPSNDGEVIRVTVPPLTSDRRKEMTKTVAKLSEEGKVAIRNIRRDAIKAYDKLEKEKKLSEDNVKDLSADLQKITDEYMKKVEAIQKQKEQELSKV

SEQ ID NO: 4808 - protein, 173 aa, Secale cereale
MEKAIETVQSNFNTVRTGRANPSMLDRIEVEYYGTPVNLKTLAQINTPDATSLLIQPYDKSCLKLIEKAIVAANIGVTPSNDGEVIRVTVPPLTSDRRKEMTKTVAKLSEEGKVAIRNIRRDAIKAYDKLEKEKKLSEDNVKDLSADLQKITDVYMKKVEAIQKQKEQELSKV

SEQ ID NO: 4809 - protein, 266 aa, Leymus cinereus x Leymus triticoides
  misc_feature (16)..(16): Xaa can be any naturally occurring amino acid
  misc_feature (48)..(49): Xaa can be any naturally occurring amino acid
  misc_feature (81)..(81): Xaa can be any naturally occurring amino acid
  misc_feature (86)..(86): Xaa can be any naturally occurring amino acid
  misc_feature (101)..(101): Xaa can be any naturally occurring amino acid
  misc_feature (166)..(166): Xaa can be any naturally occurring amino acid
MALHAVSPAAAASPPXALSSARLPQRPGCGCLSNRSSLLSSSTNFMKXXSGAVGFFGVPLVLQHSDKRAVLRHATNEEIEXEKTIXEEQAKEKMEKAIETXQSNFNTVRTGRANPSMLDRIEVEYYGTPVNLKTIAQINTPDATSLLIQPYDKSCLKLIEKAIVAXNIGVTPSNDGEVIRVTVPPLTSDRRKEMTKTVAKLSEEGKVAIRNIRRDAIKAYDKLEKEKKLSEDNVKDLSADLQKITDEYMKKVEAIQKQKEQELSKV

SEQ ID NO: 4810 - protein, 266 aa, Brachypodium distachyon
MALHAVSPAAAASPPCALSSARLPQRPGCGCLSSRSSLLSSSTNFMKLHSGAVGFFSAPLVIQYSDKRAVLRHATIEEIEAEKTIIEDQAKEKMEKAIETVQTNFNTVRTGRANPAMLDRIEVEYYGTPVNLKSIAQINTPDATSLLIQPYDKTCLKLIEKAIVAANIGVTPSNDGEVIRVTVPPLTSDRRKEMTKTVAKLSEEGKVAIRNIRRDAIKAYDKLEKEKKLSEDNVKDLSADLQKLTDEYMKKVEAIQKQKEQELSKV

SEQ ID NO: 4811 - protein, 266 aa, Avena sativa
MALRAVSPAAAASPPCALYSARIPQRPGCGCLSNRSSLLISSTSFLNLHSGAVGFFSVPLVLQHSDKRAVLRHATIEEIEAEKTIIEDQAKEKMEKAIETMQTNFNTVRTGRANPTMLDRIEVEYYGTPVNLKSIAQINTPDASSLLIQPFDKSCLKLIEKAIVAANIGVTPSNDGEVIRVTVPPLTSDRRKEMAKTVAKLSEDGKVAIRNIRRDAIKAYDKLEKEKKLSEDNKKDLSADLQKITDEYMKKVESIQKAKEQELSKV

SEQ ID NO: 4812 - protein, 266 aa, Oryza sativa
MPPLHAVSPAAAAAPPRALSSAARVPQRPGCVPERPNILSSSTNFMSLRAGPMRFYSRPLILQNSDKRAVLRHATIEEIEAEKSVIEDQARERMEKAIETVQNNFNTVRTGRANPAMLDRIEVEYYGTPVNLKSIAQINTPDATSLLIQPYDKSSLKLIEKTIVAANLGVTPSNDGEVIRVTVPPLTSDRRKELAKTVAKLAEEGKVAIRNIRRDAIKAYDKLEKEKKLSEDNVKDLSADLQKVTDEYMKKIEAIQKQKEQELMKI

SEQ ID NO: 4813 - protein, 263 aa, Panicum virgatum
MALHAVSPAAASSPLRALSRRLAERQGCGCLPKQLVYSSTNFARLQAGQVDFVGRPLVLQHSDKRAVLTHATIEEIEAEKSVIEEQAKEKMEKAIETVQTNFNTVRTGRANPAMLDRIEVEYYGTPVNLKSIAQISTPDATSLLIQPYDKSSLKLIEKTIVAANLGVTPSNDGEVIRVTVPPLTSDRRKELAKTVAKLAEDGKVAIRNIRRDAIKAYDKLQKEKKLSEDNVKDLSADLQKVTDGYMKKIESIQKQKEEELMKI

SEQ ID NO: 4814 - protein, 263 aa, Panicum virgatum
MALHAVSPAAASSPLRALSRRLAERPGCGCLPKQLVYSSKNFARLQAGQVDFVGRPLVLQHSDKRAVLTHATIEEIEAEKSVIEEQAKEKMEKAIETVQTNFNTVRTGRANPAMLDRIEVEYYGTPVNLKSIAQISTPDATSLLIQPYDKSSLKLIEKTIVAANLGVTPSNDGEVIRVTVPPLTSDRRKELAKTVAKLAEDGKVAIRNIRRDAIKAYDKLQKEKKLSEDNVKDLSADLQKVTDGYMKKIESIQKQKEEELMKI

SEQ ID NO: 4815 - protein, 278 aa, Festuca arundinacea
  misc_feature (160)..(160): Xaa can be any naturally occurring amino acid
  misc_feature (219)..(219): Xaa can be any naturally occurring amino acid
  misc_feature (225)..(225): Xaa can be any naturally occurring amino acid
  misc_feature (240)..(240): Xaa can be any naturally occurring amino acid
  misc_feature (249)..(249): Xaa can be any naturally occurring amino acid
  misc_feature (254)..(254): Xaa can be any naturally occurring amino acid
  misc_feature (262)..(262): Xaa can be any naturally occurring amino acid
HEDKIHYPPPGCCSDMALHAVSPAAAASPPCTLSSARIPQRPGCGCLSNRSSLLSFSTNLMNLHSGAVGFFSVPLVFQHSDKRAVLRHATIEEIEAEKTIIEDQAKEKMEKALETMQTNFNTVRTGRANPAMLDRIEVEYYGTPVNLKSIAQINTPDASXLLIQPFDKSCLKLIEKAIVAANIGVTPSNDGEVIRVTVPPLTSDRRKEMAKTVAKLSEXGKVAIXNIRRDAIKAYDKLEXEKKLSEDNXKDLSXDLQKITDXYMKKVESLQKAKEQEL

SEQ ID NO: 4816 - protein, 264 aa, Zea mays
MALHAVSSAAVSSPLRALSRSLPQRPGCGCLPKQSVMIYSTKFARPQAGPVDFAGRPLVLGRSDKRAVLMHATIEEIEAEKSLIEDQAKEKMEKAIETVQANFNTVRTGRANPAMLDRIEVEYYGTPVNLKSIAQISTPDATSLLIQPYDKSSLKLIEKTIVAANLGVTPSNDGEVIRVTVPPLTSDRRKELSKTVAKLAEDGKVAIRNIRRDAIKAYDKLEKEKKLSEDNVKDLSADLQKVTDEYMKKIESIQKQKEQELMKI

SEQ ID NO: 4817 - protein, 265 aa, Sorghum bicolor
MALHAVSPAAVSSPLRALSRSLPQRPGCGCLPKQSLAVYSSINFARLRAGPVDFGGRPLVLRHSDKRAVLMHATIEEIEAEKSLIEDQAKEKMEKAIETVQTNFNTVRTGRANPAMLDRIEVEYYGTPVNLKSIAQISTPDATSLLIQPYDKSSLKLIEKTIVAANLGVTPSNDGEVIRVTVPPLTSDRRKELAKTVAKLSEDGKVAIRNIRRDAIKAYDKLQKEKKLSEDNVKDLSADLQKVTDEYMKKIDSIQKQKEQELMKI

SEQ ID NO: 4818 - protein, 263 aa, Panicum virgatum
MALHAVSPAAASSPLRALSRRLAERPGCGCLPKQLVYSSKNFARLQAGQVDFVGRPLVLQHSDKRAVLTHATIEEIEAEKSVIEEQAKEKMEKAIETVQTNFNTVRTGRANPAMLDRIEVEYYGTPVNLKSIAQISTPDATSLLIQPYDKSSLKLIEKTIVAANLGVTPSNDGEVIRVTVPPLTSDRRKELAKTVAKLAEDGKVAIRNMRRDAIKAYDKLQKEKKLSEDNVKDLSADLQKVTDGYMKKIESIQKQKEEELMKI

SEQ ID NO: 4819 - protein, 343 aa, Triticum aestivum
MAGIRWPPEDPEMFPTRMLGTGVWGGPPAAAAGGGPPGEMASDDDRSVAADSWSIKSDYGSTLDDEQRYADTAEVLLASCPSSASSSAASAAAPSACSSSLSAHHSSDFSFDKDVPDVVPPMLGLHNYQDGAYAEDLANYHERSHADDWFGTEAMDVLVGWTKNLCFSKDLPGCSVLDIGTGSGRLLQQLAKQGFSDLTGIDYSEAAIELARNLAIRDGFEHINFLVDDVLESKLERRFELVMDEGTLDAIGLHPDGPVKRMMYWQSVASLVSPGGILVITSCSRTKDELVQEVENFNQRKLGAMVSEGALASDAVVFKYLDHVQAYPNVDGVCIATVAFLHT

SEQ ID NO: 4820 - protein, 349 aa, Secale cereale
MAGIRWPPEDPEMFPTRMLGTGVWGGPPAAAGGGGGGGPPGPPGEMASDDDRSVAADSWSIKSDYGSTLDDEQRYADTAEVLLASCPSSASSSAASAAAPSACSSSLSAHHSSDFSFDKDVPDVVPPMLGLHNYQDGSYAEDLANYHERSHADDWFGTEAMDVLVGWTKNLCSSKDLPGCSVLDIGTGSGRLLQQLAKQGFSDLTGIDYSEAAIELARNLAIRDGFEHINFLVDDVLESKLERRFELVMDEGTLDAIGLHPDGPVKRMMYWQSVASLVSPGGILVITSCSRTKDELVQEVENFNQRKLGATIPEGALASDAVVFKYLDRVQAYPNVDGVCIATVAFLHT

SEQ ID NO: 4821 - protein, 336 aa, Brachypodium distachyon
MAGIRWPPEDPEMFPTRMLGSGVWAGAGAGAPGEMASDDDRSVAADSWSIKSDYGSTLDDEQRYADTAEVLLASSCSASSASSSVVAPSSASSLSAHHSSDFSFDKDVPDVVPPMLGLHNYHDGAYAEDLAHYHERSHADDWFGTEVMDVLVGWTTNLCSSKNLPGCSVLDIGTGSGRLLQQLAKQGFSDLTGIDYSEAAIEHARNLSIRDGFEHINFLVDDVLESKLERRFELVMDEGTLDAIGLHPDGPVKRMMYWQSVASLVSPGGVLVITSCSRTKDELVQEVENFNQRKLGATVSEGALGSDAVVFKYLDHVQAYPNVDSPCIATVAFLHM

SEQ ID NO: 4822 - protein, 338 aa, Secale cereale
PGDVPDADAGDRGLGRAPRAAGGGGGEAPGPPGEMASDDDRSVAADSWSIKSDYGSTLDDEQRYADTAEVLLASCPSSASSSAASAAAPSACSSSLSAHHSSDFSFDKDVPDVVPPMLGLHNYQDGAYAEDLANYHERSHADDWFGTEAMDVLVGWTKNLCSSKDLPGCSVLDIGTGSGRLLQQLAKQGFSDLTGIDYSEAAIELARNLAIRDGFEHINFLVDDVLESKLERRFELVMDEGTLDAIGLHPDGPVKRMMYWQSVASLVSPGGILVITSCSRTKDELVQEVENFNQRKLGATIPEGALASDAVVFKYLDRVQAYPNVDGVCIATVAFLHT

SEQ ID NO: 4823 - protein, 330 aa, Setaria italica
MAGIRWPPEDPEIFPSRMVGSGVWVPVGPPGEMASDDDRSVAADSWSIKSDYGSTLDDEQRYADTAEVLLASSSASAAAAPSASVAANPSSDFSFDKDVPDSGDVEPPLLAMQNFQDGAYAEDLANFHERSHADDWFGTEVMDVRVGWTKNLCSSKDLPSCSVLDIGTGSGRLLQQLAKQGFSDLTGIDYSEGAIELARNLAIRDGFEHINFLVDDVLESKVERRFELVMDEGTLDAIGLHPDGPVKRMMYWQSVASLVSPGGILVITSCSRTKDELVQEVENFNQRKLGAMGSEGLPASDTAVFSYLDHVRSYPNVDSSCITTVAFLHK

SEQ ID NO: 4824 - protein, 330 aa, Sorghum bicolor
MAGIRWPPEDPEIFPSRMVSGGAWIPVAPPGEMASDDDRSVAADSWSIKSDYGSTLDDDQRYADTAEVLLASSSASSAAAPSASVAVHPSSDFSFDKDVPDSSDVEPRLLGLQNFQDGAYAEDLANFHERSHADDWFGTEIMDIRVGWTKNLCSSRDLPSCSVLDIGTGSGRLLQQLAKQGFSDLTGIDYSEGAIELARNLAIRDGFEHINFLVDDVLESKLERRFELVMDEGTLDAIGLHPDGPVKRMMYWQSVASLVFPGGILVITSCSRTKDELVQEVENFNQRKLGAMGSEGLPASEAAVFSYLDHVQSYPSVDSSCITTVAFLHK

SEQ ID NO: 4825 - protein, 330 aa, Pennisetum glaucum
MAGIRWPPEDPEIFPSRMVGSGVWVPVGPPGEMASDDDRSVAADSWSIKSDYGSTLDDEQRYADTAEVLLASSSASAAAAPSASVAVNPSSDFSFDKDVSDSGDVEPPLLVMQNFQDGAYAEDLTNFHERSHADDWFGTEVMDVRVGWTKNLCSSKDLPSCSVLDIGTGSGRLLQQLAKQGFSDLTGIDYSEGAIELARNLAIRDGFEHINFLVDDVLESKLERRFELVMDEGTLDAIGLHPDGPVKRMMYWQSVASLVSPGGILVITSSSRTKDELVQEVENFNQRKLGAIGPEGLPASDAAVFSYLDHVRSYPSVDSSCITTVAFLHK

SEQ ID NO: 4826 - protein, 329 aa, Panicum virgatum
MAGIRWPPEDPEIFPSRMLGSGVWVPVGPPGEMASDDDRSVAADSWSIKSDYGSTLDDEQRYADTAEVLLASSSASAAAAPSASVAANPSSDFSFDKDVPDSSDVEPPLLVMQNFQDGAYSEDLANFHERSHADVWFGTEVMDIRVGWTKNLCSSKDLPSCSVLDIGTGSGRLLQQLAKQGFSDLTGIDYSEDAIELARNLAIRDGFEHINFLVDDVLESKLERRFELVMDEGTLDAIGLHPDGPVKRMMYWQSVASLVSPGGILVITSCSRSKDELVQEVENFNQRKLGAMGSGVPVIDAAVFSYLDHVQSYPSVDSSSITTVAFLHK

SEQ ID NO: 4827 - protein, 332 aa, Zea mays
MAGIRWPPEDPEIFPSRMVSGGAWVPVAPPGEMASDDDRSVAADSWSIKSDYGSTLDDDQRYSDTAEVLLASSSASSVAAPSTTVAVHPSSDFSFDKDVHDSSYVEPPLLGLQNFQDGAYAEDLANFHERSHADDWFGTDIMDIRVGWTKNLCSSRDLPSCSVLDIGTGSGRLLQQLAKQGFSDLTGIDYSESAIELARSLAIGDGFEHINFLVDDVLESKLERRFELVMDEGTLDAIGLHPDGPVKRMMYWQSVDSLVSRGGILVITSCSRTKDELVQEVENFNQRKLGAVGSGSEGLPASEAAVFSYLDHVQSYPSVDSSCITTVALLHK

SEQ ID NO: 4828 - protein, 276 aa, Triticum aestivum
MGTAVLPVAHKLSLASPFLPRHRRACRPPAQQHCRRRRHGAVVAYMEPDPNSPAAILGRIVGALPVVGLVARILSDDGGVGGDTVDFAEFRRRVSKKCTVMDSQAFYDFNDRRGKVGDPFYVLLCCWLAAIGAGLLKTEEILEGVARLRMSNDIEYEEETFLDMMKIAREKRAKSKSQAPVIPMEARAEKALEAIYVCCFGQDMVEPEDERLLCTMLNAVFPSVGRPAVERMVSTVAKQVASGERRGPGAKVVPKEVAQRQLKDLEFLKQNKLDSI

SEQ ID NO: 4829 - protein, 276 aa, Triticum aestivum
MGTAVLPVAHKLSLASPFLPCHRRPCRPPAQQHCRRRRHGAVVAYMEPDPNSPAAILGRIVGALPVVGLVARILSDDGGVGGDTVDFAEFRRRVSKKCTVMDSQAFYDFNDRRGKVGDPFYVLLCCWLAAIGAGLLKTEEILEGVARLRMSNDIEYEEETFLDMMKIAREKRAKSKSQAPVIPMEARAEKALEAIYVCCFGQDMVEPEDERLLCTMLNAVFPSVGRPAVERMVSTVAKEVASGERRGPGAKVVPKEVAQRQLKDLEFLKQNKLDSI

SEQ ID NO: 4830 - protein, 271 aa, Pseudoroegneria spicata
GTTVLPVAHKLSLASPFLPRHRPPAQRHCRRRRHGAVVAYMEPDPNSPAAILGRIVGALPVVGLVARILSDDGGVGGDTVDFAEFRRRVSKKCTVMDSQAFYDFNDRRGKVGDPFYVLLCCWLAAIGAGLLKTEEILEGVARLRMSNDIEYEEETFLDMMKIAREKRAKSKSQAPVIPMEARAEKALEAIYVCCFGQDMVEPEDERLLCTMLNAVFPSVGRPAVERMVSTMAKQVASGERRGPGAKVVPKEVAQRQLKDLEFLKQNKLDSI

SEQ ID NO: 4831 - protein, 275 aa, Leymus cinereus x Leymus triticoides
  misc_feature (8)..(8): Xaa can be any naturally occurring amino acid
  misc_feature (25)..(25): Xaa can be any naturally occurring amino acid
  misc_feature (32)..(32): Xaa can be any naturally occurring amino acid
  misc_feature (38)..(38): Xaa can be any naturally occurring amino acid
  misc_feature (166)..(166): Xaa can be any naturally occurring amino acid
  misc_feature (196)..(196): Xaa can be any naturally occurring amino acid
  misc_feature (203)..(203): Xaa can be any naturally occurring amino acid
  misc_feature (210)..(210): Xaa can be any naturally occurring amino acid
  misc_feature (259)..(259): Xaa can be any naturally occurring amino acid
MGTTVLPXAHKLSLASPFLPRHRRXCRSPAQXCRRRRXGAVVAYMEPDPNSPAAILGRIVGALPVVGLVARILSDDGGVGGDTVDFAEFRRRVSKKCTVMDSQAFYDFNDRRGKVGDPFYVLLCCWLAAIGAGLLKTEEILEGVARLRMSNDIEYEEETFLDMMKXAREKRAKSKSQAPVIPMEVRAEKALEAIYXCCFGQDXVEPEDEXLLCTMLNAVFPSVGRPAVERMVSTMAKQVASGERRGPGAKVVPKEVAQXQLKDLEFLKQNKLDSI

SEQ ID NO: 4832 - protein, 275 aa, Secale cereale
MGTTVLPVPHQLSLASPPPAPPPGQPLPAQQHCRRRRHGAVVAYMEPDPNSPAAILGRIVGALPVVGLVARILSDDGGVGGDTVDFAEFRRRVSKKCTVMDSQAFYDFNDRRGKVGDPFYVLLCCWLAAIGAGLLKTEEILEGVARLRMSNDIEYEEETFLDMMKIAREKRAKSKSQAPVIPMEARAEKALEAIYVCCFGQEMVEPEDERLLCTMLNAVFPSVGRPAVERMVSTMAKQVASGERRGPDAKVVPKDVAQRQLKDLEFLKQNKLDSI

SEQ ID NO: 4833 - protein, 273 aa, Avena sativa
MGTLPVAHKLSLASPFLPRHRRACRSPAQHCRRRRHGAVVAYMEPDPNSPAAILGRIVGALPVVGLVARILSDDGGVGGDTVDFAEFRRRVSKKCTVMDSQAFYDFNDRRGKVGDPFYVLLCCWLAAIGAGLLKSEEILEGVARLRMSNDIEYEEETFLDMMKLAREKRAKSKGQAPQVPMEVRAEKALEAIYVCCFGQDMVEPEDEELLCTILNAVFPSVGRPAVERMVSTLADQVATGERRGPDAKVVSKEVAQRQLKDLEFLKQNKLDSI

SEQ ID NO: 4834 - protein, 275 aa, Brachypodium distachyon
MGTLAVAHKLSLTSAFLPRHRRPCRSSSSSAQHPRRRRHGAVVAYMEPDPNSPAAILGRIVGALPVVGLVARILTDDGGVGGDTVDFAEFRRRVSKKCTVMDSQAFYDFNDRRGKVGDPFYVLLCCWLAAVGAGLLKTEEILEGVARLRMSSDIEYEEETFLDMMKIAREKRAKSKGQAPQIPMEVRAEKALEAIYVCCFGQDMVEPEDEKLLCTMLNAVFPSVGRPAVERMVSAMAKQVADGERLVSAKVVSKEVVQRQLKDLEFLQQNKLDSI

SEQ ID NO: 4835 - protein, 273 aa, Setaria italica
MGALPVAHKLALTSPFLPRHRRPCPAAHHHGQRRRRHGVVVAYMEPNPNSPAAIAGRLVGALPVVGLVARILSDEGGVGGDIIDFAEFRRRVSKKCTVMDSQAFYDFNERRGKPGDPFYVLLCCWLAAVGAGLLKTEEILEGVARLRISNDIEFEEETFIDMIRTAKEKRAKLKAPAPQIPMETRAEKALEAIYVCCFGQDMVEEEDEKLLRTILNAVFPSVGRPAIERMVASMAKQVASGERKRDGRTVSKEVQQRQLKDLQFLKQNKLDSA

SEQ ID NO: 4836 - protein, 271 aa, Oryza sativa
MGTLPVAHRFSLASAFLPRHRRPSPSAPNRRRRHGTVVAYMEPNPNSPSSIAGRLIGALPVVGLVARILSDEGGVGGDMIDFAEFRRRVSKKCTVMDSQAFYDFNERRGKAGDPFYVLLCCWLAAVGGGLLKTEEILEGVARLRLSNDIEFEEETFLDMMKTAKEKRAKLKAPAPQIPMEARAEKALEAIYVCCFGQDMVEDVDVKLLCKMLNAVFPSVGRQAVERIVTSMAKQVAAGERKGPGVKTVSKEAAQRQLKDLEFLKQNKLDSA

SEQ ID NO: 4837 - protein, 276 aa, Panicum virgatum
MGALPVAHGHLALTSPFLPRPRRGRPGPASHGPGRRRRHAAAVVAYMEPNPNSPAAIAGRLVGALPVVGLVARILSDEGGVGGDIIDFAEFRRRVSKKCTVMDSQAFYDFNERRGKPGDPFYVLLCCWLAAVGAGLLKTEEILEGVARLRISNDIEYEEETFIDMMRAAKEKRAKLKAPAPQIPMETRAEKALEAIYVCCFGQDMVEQEDEKLLRTILNAVFQSVGRPAIERMVASMAKQVASGERKRDGKTVSKEVQQRQLKDLEFLKQNKLDSS

SEQ ID NO: 4838 - protein, 354 aa, Brachypodium distachyon
MPDLVRDRLYFGDINDAIAALTGPLPDGTDITHVLSVVSSASISFIADCRPGLSIPAEEVRRVVAGEDGAPPSAVAPGRLMRVVEKAGQGLRVTRMAVPLRDTEEENLLDHLEPCLDFIDEGRKEGSVLVHCFAGVSRSATIITAYLMRTEQKSLEEALESLKEINESVCPNDGFVEQLKLFEEMGFKVDTSSPLYKRFRLKLLGQSYKIGEKIGSHVLEDDPGVSRQPNPSQELSNIETNKTAYRCKKCRRIVAVQDNVISHTPGEGNSSFEWHDKRKGGHTYNKEKDCSSLYVEPLKWMTPVEDGALEGKLSCIHCGARLGYFNWSGIQCNCGSWITPAFQISKSKVDISII

SEQ ID NO: 4839 - protein, 360 aa, Brachypodium distachyon
MEEAAVTCYSKPLRNNLQPRFFPFSALTGPLPDGTDITHVLSVVSSASISFIADCRPGLSIPAEEVRRVVAGEDGAPPSAVAPGRLMRVVEKAGQGLRVTRMAVPLRDTEEENLLDHLEPCLDFIDEGRKEGSVLVHCFAGVSRSATIITAYLMRTEQKSLEEAVESLKEINESVCPNDGFLDQLRLFEEMGFKVDTSSNLYKRFRLKLLGQSYKIGEKIGSHVLEDDPGVPQQPNPSQELSNKETHKTAYRCKKCRRIVAAEDNVISHTPGEGNSSFEWHDKRKGGHTYNKEKDCSSLYVEPLKWMTPAEDGALQGKLSCIHCGARLGYFNWSGIQCNCGSWITPAFQISKSKVDISTI

SEQ ID NO: 4840 - protein, 263 aa, Pseudoroegneria spicata
MEGGGLDQVCMAAMTNQPSVSDNKPMKNISGEMPATATAGSGSFDCNICLDFAADPVVTLCGHLYCWPCIYEWLRPSVVSASGANSTSARQQCPVCKAALSVDSLVPLYGRGGSSKKSLDGTAIPRRPTVHRENVAHQHAQSNIDDDRHHHNVEPSPPLRPLRHAHHHHPGATEFDFVYPPSPMGRGLIHSTAGGVLGGMAEAVLPWAFRGQVPPSMYYTSPYAVADHTLGPRLRRQQMEVERSLHQIWFFLFVFVVLCLLLF

SEQ ID NO: 4841 - protein, 258 aa, Triticum aestivum
MDQVCMAAMTNQPPVSDNKPMKNISGEMPATATAGSGSFDCNICLDFAADPVVTLCGHLYCWPCIYEWLRPSVVSASGANSTSARQQCPVCKAALSADSLVPLYGRGGSSKKSLDGTAIPRRPTVHRENVAHQHAQSSIDDDRHHHNVEPSPPLRPLRHAHHHHPGATEFDFVYPPSPMGRGLIHSTAGGVLGGMAEAVLPWAFRGQVPPSMYYTSPYAVADHTVGPRLRRQQMEVERSLHQIWFFLFVFVVLCLLLF

SEQ ID NO: 4842 - protein, 258 aa, Leymus cinereus x Leymus triticoides
MDQVCMAAMTNQPSVSDNKLMKNISGEMPATATAGSGSFDCNICLDFAADPVVTLCGHLYCWPCIYEWLRPSVVSASSDNSTSARQQCPVCKAALSADSLVPLYGRGGSSKKSLDGTAIPRRPTVHRENVAHQHAQSNIDDDRHHHNVEPSPLLRPLRHAHHHHPGAAEFDFVYPPSPMGRGLIHSTAGGVLGGMAEAVLPWAFRGQVSPSMYYTSPYAVADHTVGPRLRRQQMEVERSLHQIWFFLFVFVVLCLLLF

SEQ ID NO: 4843 - protein, 258 aa, Secale cereale
MDQVCMAAMTNQPSVSDNKPMKSISGEMPAAATAGSGSFDCNICLDFAADPVVTLCGHLYCWPCIYEWLRPSVVSASGANSTSARQQCPVCKAALSADSLVPLYGRGGSSKKSLDGTAIPRRPTVHRENVAHQHAQSSIDNDRHHHNVEPSPPLRPLRHAHHHHPGATEFDFVYPPSPMGRGLIHSTAGGVLGGMAEAVLPWAFRGQVPPSMYYTSPYAVADHTVGPRLRRQQMEVERSLHQIWFFLFVFVVLCLLLF

SEQ ID NO: 4844 - protein, 260 aa, Secale cereale
MDQVCMAAMTNQPSVSDNKPMKSISGEMPAAATAGSGSFDCNICLDFAADPVVTLCGHLYCWPCIYEWLRPSVVSASGANSTSARQQCPVCKAALSADSLVPLYGRGGSSKKSLDGTAIPRRPTVHRENVAHQHAQSSIDDDRHHHNVEPSPPLRPLRHAHHHHPGATEFDFVYPPSPMGRGLIHSTAGGVLGGMAEAVLPWAFRGQVPPSMYYTSPYAVADHTVGPRLRRQQMEVERSLHQIWFFLQVFHITALYISMI

SEQ ID NO: 4845 - protein, 260 aa, Avena sativa
MDQGCMAAITSEPLVSDDKPMKNISGEMPATATATAGSGSFDCNICLDFAADPVVTLCGHLYCWPCIYEWLRPAVGSASTDNRTAARQQCPVCKAVLSADSLVPLYGRGGSSKKSLDGAAIPRRPTVHRENVEHQHAQSTLGDQHHHNVVEPSPQLRPLRHAHHHHSSTTEFDFIYPPSPMGRGLMHSTAGGVLGGMAEAVLPWAFRGQVPPSMYYTSPYSVADHTVGPRLRRQQMEVERSLHQIWFFLFVFVVLCLLLF

SEQ ID NO: 4846 - protein, 254 aa, Brachypodium distachyon
MDQVCMAAINSQPSVSDDKPMKNISGEMPAAAGSGSFDCNICLDFAADPVVTLCGHLYCWPCIYEWLQPAAESASSNNRSSARQQCPVCKATLSADSLVPLYGRGGSSKKSLDGMAIPRRPMVHRENAEHHHTQSNIDDRHHQNMEPRPLLRPLRHAHHHSGATEFDFIHPPSPLGRGLIHSTAGGVLGGMAEAVLPSAFRGQLPPSMYYTSPYYIAAHNMGPRLRRQQMEVERSLHHIWFFLFVFVVLCLLLF

SEQ ID NO: 4847 - protein, 433 aa, Secale cereale
MAPLTPRLVVPIDVKKKPWEQKVRLHNRWHPDIPPVADVTEGELFRVEMVDWTGGRVRDDDSADDIKFLDLTITHYLSGPLRIVDAEGVPASPGDLLAVEICNLGPLPGDEWGYTGIFERENGGGFLTDHFPSARKAIWYFEGIYAYSPQIPGVRFPGLTHPGIVGTAPSVELLNIWNERERKLIETGHESLKLCEVLHQRPLANLPTSDNCLLGKIQEGTAEWQKIANEAARTIPGRENGGNCDIKNLSRGSKVYLPVFVDGANLSTGDMHFSQGDGEVSFCGAIEMSGFLELKCEIIRGGMKEYLTPVGPTALHVNPIFEIGPVEPRFSEWLVFEGISVDESGKQHFLDASVAYKRAVLNAIEYLSRFGYSKEQVYLLLSCCPCEGRISGIVDAPNAVATLAIPTAIFDQDIKPKRLGHGPKLRRLPDVLR

SEQ ID NO: 4848 - protein, 433 aa, Triticum aestivum
MAPLTPRLVVPIDVKKKPWEQKVRLHNRWHPDIPPVADVTEGELFRVEMVDWTGGRVRDDDSADDIKFLDLTITHYLSGPLRIVDAEGVPASPGDLLAVEICNLGPLPGDEWGYTGIFERENGGGFLTDHFPSARKAIWYFEGIYAYSPQIPGVRFPGLTHPGIVGTAPSVELLNIWNERERKLIETGHESLKLCEVLHQRPLANLPTSDNCLLGKIQEGTAEWQKIANEAARTIPGRENGGNCDIKNLSRGSKVYLPVFVEGANLSTGDMHFSQGDGEVSFCGAIEMSGFLELKCEIIRGGMKEYLTPVGPTALHVNPIFEIGPVEPRFSEWLVFEGISVDESGKQHFLDASVAYKRAVLNAIEYLSRFGYSKEQVYLLLSCCPCEGRISGIVDAPNAVATLAIPTAIFDQDIKPKRLGHGPKLRRLPDVLR

SEQ ID NO: 4849 - protein, 433 aa, Triticum aestivum
MAPLTPRLVVPIDVKKKPWEQKVRLHNRWHPDIPPVADVTEGELFRVEMVDWTGGRVRDDDSADDIKFLDLKITHYLSGPLRIVDAEGVPASPGDLLAVEICNLGPLPGDEWGYTGIFERENGGGFLTDHFPSARKAIWYFEGIYAYSPQIPGVRFPGLTHPGIVGTAPSVELLNIWNERERKLIETGHESLKLCEVLHQRPLANLPTSDNCLLGKIQEGTAEWQKIANEAARTIPGRENGGNCDIKNLSRGSKVYLPVFVDGANLSTGDMHFSQGDGEVSFCGAIEMSGFLELKCEIIRGGMKEYLTPVGPTALHVNPIFEIGPVEPRFSEWLVFEGISVDESGKQHFLDASVAYKRAVLNAIEYLSRFGYSKEQVYLLLSCCPCEGRISGIVDAPNAVATLAIPTAIFDQDIKPKRLGHGPKLRRLPDVLR

SEQ ID NO: 4850 - protein, 246 aa, Triticum aestivum
MAPLTPRLVVPIDVKKKPWEQKVRLHNRWHPDIPPVADVTEGELFRVEMVDWTGGRVRDDDSADDIKFLDLKITHYLSGPLRIVDAEGVPASPGDLLAVEICNLGPLPGDEWGYTGIFERENGGGFLTDHFPSARKAIWYFEGIYAYSPQIPGVRFPGLTHPGIVGTAPSVELLNIWNERERKLIETGHESLKLCEVLHQRPLANLPTSDNCLLGKVLKKGLLNGKKLQMKQQELFLEERMGGIVT

SEQ ID NO: 4851 - protein, 433 aa, Triticum aestivum
MAPLTPRLVVPIDVKKKPWEQKVRLHNRWHPDIPPVADVTEGELFRVEMVDWTGGRVRDDDSADDIKFLDLTITHYLSGPLRIVDAEGVPASPGDLLAVEICNLGPLPGDEWGYTGIFERENGGGFLTDHFPSARKAIWYFEGIYAYSPQIPGVRFPGLTHPGIVGTAPSVELLNIWNERERKLIETGHESLKLCEVLHQRPLANLPTSDNCLLGKIQEGTAEWQKIANEAARTIPGRENGGNCDIKNLSRGSKVYLPVFVEGANLSTGDMHFSQGDGEVSFCGAIEMSGFLELKCEIIRGGMKEYLTPVGPTALHVNPIFEIGPVEPRFSEWLVFEGISVDESGKQHFLDASVAYKRAVLNAIEYLSRFGYSKEQVYLLLSCCPCEGRISGIVDAPNAVATLAIPTAIFDQDIKPKRLGNGPKLRRFPDVLR

SEQ ID NO: 4852 - protein, 435 aa, Avena sativa
MAPLTPRLVVPIDVKKKPWEQKVHLHNRWHPDIPPVADVTEGELFRVEMVDCTGGRVRDDDSADDIKFLDLTIPHYLSGPFRIVDAEGVPASPGDLLAVEICNLGPLPGDEWGYTGIFERENGGGFLTDHFPSARKAIWYFEGIYAYSPQIPGVRFPGLTHPGIVGTAPSAELLNIWNERERKLTETSHESLKLCEVLHQRPLASLPTSENCLLGKIEEGTAEWQKIANEAARTIPGRENGGNCDIKNLSRGSKVYLPVFVEGANLSTGDMHFSQGDGEVSFCGAIEMSGFLELKCEIIRGGMKEYLTPIGPTALHVNPIFEIGPVEPRFSEWLVFEGISVDESGKQHFLDASVAYKCAVLNAIEYLSKFGYSKEQVYLLLSCCPCEGRISGIVDAPNAVATLAIPTAIFDQDIRPKRLGHGPKLRRTPDVLRCT

SEQ ID NO: 4853 - protein, 433 aa, Triticum aestivum
MAPLTPRLVVPVDVKKTPWEQEVQLHNRWHPDIPPVADVTEGELFRVEMVDWTGGQVRDDDSADDIKSLDLTTPHYLSGPLRVVDAEGVPASPGDLLAVEICNLGPLPGDEWGYTGIFERENGGGFLTDHFPSARKAIWYFEGIYAHSPQIPGVRFPGLTHPGIVGTAPSAELLNIWNQRERELVDTGHESLKLCEVLHQRPLANLPTSHSCLLGKIQEGTPEWQRIANEAARTIPGRENGGNCDIKNLSRGSKVYLPVFVEGANLSTGDMHFSQGDGEVSFCGAIEMSGFLELKCEIIRGGMKEYLTPVGPTALHVNPIFEIGPVEPRFSEWLVFEGISVDESGKQHFLDASVAYKRAVLNAIEYLSKFGYSKEQAYLLLSCCPCEGRISGIVDAPNAVATLAIPTAISDQDIRPKRLGHGPKLRRLPDVLR

SEQ ID NO: 4854 - protein, 433 aa, Triticum aestivum
MAPLTPRLVVPIDVKKQPWEQEVPLHNRWHPDIPPVADVTQGELFRVEMVDCTGGQVRDDDSADDIKSLDFAAPHYLSGPLRVVDAEGVPASPGDLLAVEICNLGPLPGDEWGYTGTFEREHGGGFLTDHFPSARKAIWYFEGIYTHSPQIPGVRFPGLTHPGIVGTAPSAELLNIWNQRERELVEAGHESLKLCQVLHQRPLASLPTSHNCLLGKMQEGTAEWEKIANEAARTIPGRENGGNCDIKNLGRGSKVYLPVFVEGANLSTGDMHFSQGDGEVSFCGAIEMSGFLELKCEIIRGGMKEYLTPIGPTPLHVNPIFEIGPVEPRFSEWLVFEGISVDESGKQHFLDASVAYKRAVLNAIEYLSRFGYSKEQVYILLSCCPCEGRISGIVDAPNAVATLAIPTAIFGQDIKPKRLGNGPKLRRFPDVLR

SEQ ID NO: 4855 - protein, 452 aa, Brachypodium distachyon
MAPLTPRLVVPIDVKKKPWEQKVHLHNRWHPDIPPVADVTEGELFRVEMVDWTGGRVSDDNSADDIKFLDLTITHYLSGPFRVIDAEGIPASPGDLLAVEICNLGPLPGDEWGYTAIFERENGGGFLTDHFPSARKAIWYFEGIYAYSPQIPGVRFPGLTHPGIVGTAPSAELLNIWNERERQLTETGHESLKLCEVLHQRPLANLPTPENCLLGKVQEGTAEWQKIANEAARTIPGRENGGNCDIKNLSRGSKVYLPVFVDGANLSTGDMHFSQGDGEVSFCGAIEMSGFLELKCEIIRGGMKEYLTPVGPTPLHVNPIFEIGPVEPRFSEWLVFEGISVDESGKQHFLDASVAYKRAILNAIEYLSRFGYSKEQVYLLLSCCPCEGRISGIVDAPNAVATLAIPTSIFDQDIRPKRLGHGPKLRRVPDVLRCTYDGHLPVTQDQSYARAP

SEQ ID NO: 4856 - protein, 454 aa, Oryza sativa
MALPTPRLVVPIDVSKKPWEQKVPLHNRWHPDIPPVADVTEGELFRVEMVDWTGGRVSDDNSADDIKFLDLTITHYLSGPLRIVDAEGVPAAPGDLLAVEICNLGPLPGDEWGYTAIFERENGGGFLTDHFPSARKAIWYFEGIYAYSPQIPGVRFPGLTHPGIVGTAPSAELLNIWNEREKILAETNHESIKICEVLHQRPLANLPTPENCLLGKIQEGTADWQKIANEAARTIPGRENGGNCDIKNLSRGSKVYLPVFVDGANLSTGDMHFSQGDGEVSFCGAIEMSGFLELKCEIIRGGMKEYLTPIGPTPLHVNPIFDIGPVEPRFSDWLVFEGISVDESGKQHFLDASVAYKRAVLNAIEYLSRFGYSKEQVYLLLSCCPCEGRISGIVDSPNAVATLAIPTAIFDQDVKPKRLSGKQGPKLRRLPDVLRCSSDGHLPVTQDPSGTKAP

SEQ ID NO: 4857 - protein, 454 aa, Zea mays
MAPLTPRLVVPIDVKKQPWEQKVPLHNRWHPDIPPVADVTEGELFRVEMVDWTGGRVRDDNSADDIKSLDLTITHYLSGPLRIVDSEGVPASPGDLLAVEICNLGPLPGDEWGYTAIFERENGGGFLTDHFPTARKAIWYFEGIYAYSPQIPGVRFPGLTHPGIVGTAPSAELLNIWNEREKRLAETSPQTLKLCEVLHQRPLANLPTPENCLLGKIQEGTAGWHKVANEAARTIPGRENGGNCDIKNLSRGSKVYLPVFVEGANLSTGDMHFSQGDGEVSFCGAIEMSGFLELKCEIIRGGMKEYLTPVGPTPLHVNPIFEIGPVEPRFSEWLVFEGISVDESGKQHFLDASVAYKRAVLNAIEYIARFGYSKEQVYLLLSCCPCEGRISGIVDSPNAVATLAIPTAIFDQDIKPKHLRGRPGPKLIRLPDLLSCSNNGHIPVTQDQSGTRAS

SEQ ID NO: 4858 - protein, 454 aa, Setaria italica
MAPLTPRLVVPIDVKKQPWEQKIPLHNRWHPNIPPVADVTEGELFRVEMVDWTGGRVRDDNSADDIKFLDLTTTHYLSGPLRIVDSEGVPASPGDLLVVEICNLGPLPGDEWGYTAIFERENGGGFLTDHFPSARKAIWYFEGIYAYSPQIPGVRFPGLTHPGIVGTAPSVELLNIWNEREKRLAETSPETLKLCEVLHQRPLANLPTPENCLLGKIQKGTAEWHKMANEAARTIPGRENGGNCDIKNLSRGSKVYLPVFVEGANLSTGDMHFSQGDGEVSFCGAIEMSGFLELKCEIIRGGMKEYMTPVGPTSLHVNPIFEIGPVEPRFSEWLVFEGISVDESGKQHFLDASVAYKRAVLNAIEYLSRFGYSKEQVYLLLSCCPCEGRISGIVDSPNAVATLAIPTAIFDQDIRPKHLKGRPGPKLIRLPDLLSCSNDGHLPVTQDQSGRSVP

SEQ ID NO: 4859 - protein, 453 aa, Sorghum bicolor
MAPLTPRLVVPIDVKKQPWEQKVPLHNRWHPDIPPVADVTEGELFRVEMVDWTGGRVRDDNSADDIKFLDLTSTHYLSGPLRIVDSEGVPASPGDLLAVEICNLGPLPGDEWGYTAIFERENGGGFLTDHFPTARKAIWYFEGIYAYSPQIPGVRFPGLTHPGIVGTAPSVELLNIWNEREKRLAETSPHTLKLCEVLHQRPLANLPTPENCLLGKIQEGTAEWHKMANEAARTIPGRENGGNCDIKNLSSGSKVYLPVFVEGANLSTGDMHFSQGDGEVSFCGAIEMSGFLELKCEIIRGGMKEYLPPVGPTPLHVNPIFEIGPVEPRFSEWLVFEGISVDESGRQHFLDASVAYKRAVLNAIEYLSRFGYSKEQVYLLLSCCPCEGRISGIVDSPNAVATLAIPTAIFDQDIRPKHLRGRLRPKLIRLPDLLSCSNNGLPVTQDQSSTRAP

SEQ ID NO: 4860 - protein, 454 aa, Panicum virgatum
MAPLTPRVVVPIDVKKQPWEQKIPLHNRWHPDIPPVADVTEGELFRVEMVDWTGGRVRDDNSADDIKFLDLTITHYLSGPLRIVDSEGLPASPGDLLAVEICNLGPLPGDEWGYTAIFEMENGGGFLTDHFPSARKAIWYFEGIYAYSPQIPGVRFPGLTHPGIVGTAPSVELLNIWNEREKKLAETSPETLKVCEVLHQRPLANLPTPENCLLGKIQKETAVWHKVANEAARTIPGRENGGNCDIKNLSRGSKVYLPVFVEGANLSTGDMHFSQGDGEVSFCGAIEMSGFLELKCEIIRGGMKEYLTPVGPTPLHVNPIFEIGPVEPRFSEWLVFEGISVDESGKQHFLDASVAYKRAVLNAIEYLSKFGYSKEQVYLLLSCCPCEGRISGIVDSPNAVATLAIPTAIFDQDIRPKHLRGRPGPKLIRLPDLLSCSTDGHLPVIQDQSGRSEP

SEQ ID NO: 4861 - protein, 454 aa, Panicum virgatum
MAPLTPRVVVPIDVKKQPWEQKIPLHNRWHPDIPPVADVTEGELFRVEMVDWTGGRVRDDNSADDIKFLDLTITHYLSGPLRIVDSEGLPASPGDLLAVEICNLGPLPGDEWGYTAIFERENGGGFLTDHFPSARKAIWYFEGIYAYSPQIPGVRFPGLTHPGIVGTAPSIELLNIWNEREKKLAETSPETLKVCEVLHQRPLANLPTPENCLLGKIQKETAEWHKMANEAARTIPGRENGGNCDIKNLSRGSKVYLPVFVEGANLSTGDMHFSQGDGEVSFCGAIEMSGFLELKCEIIRGGMKEYLTPVGPTPLHVNPIFEIGPVEPHFSEWLVFEGISVDEYGKQHFLDASVAYKRAVLNAIEYLSKFGYSKEQVYLLLSCCPCEGRISGIVDSPNAVATLAIPTAIFDQDIRPKHLRGRPGPKLIRLPDLLSCSNDGHLPLTQDQSGRSEP

SEQ ID NO: 4862 - protein, 454 aa, Pennisetum glaucum
MAPLTPRLVVPIDVKKKPWEQKIPLHNRWHPNIPPVADVTEGELFRVEMVDWTGGRIRDDNSADDIKFLDLTITHYLSGPLRIVDSEGVPASPGDLLVVEICNLGPLPGDEWGYTAILERENGGGFLTDHFPSARKAIWYFEGIYAYSPQIPGVRFPGLTHPGVVGTAPSVELLNIWNEREKILAETSPETLRVCEVLHQRPLANLPTPENCLLGKIQEGTAEWHKMANEAARTIPGRENGGNCDIKNLSRGSKVYLPVFVEGANLSTGDMHFSQGDGEVSFCGAIEMSGFLELKCEIIRGGMKEYMTPVGPTPLHVNPIFEIGPVEPRFSEWLVFEGISVDESGKQHFLDASVAYKRAVLNAIEYLSRFGYSKEQVYLLLSCCPCEGRISGIVDSPNAVATLAIPIAIFDQDIRPKHLRGRPGPKLIRLPDLLSCSNGGHLPVTQDQSCGSVP

SEQ ID NO: 4863 - protein, 456 aa, Panicum virgatum
MAPLTPRLVIPIDVKKQPWEQKVPLHNRWHPDIPPVADVTEGELFRVEMVDWTGGRVRDDNSADDIKFLDLTITHYLSGPLRIVDSEGLPASPGDLLAVEICNLGPLPGDEWGYTAIFERENRGGFLTDHFPSARKAIWYFEGIYAYSPQIPGVRFPGLTHPGIVGTAPSIELLNIWNEREKKLAETSPETLKVCEVLHQRPLANLPTPENCLLGKIQKEMAEWHKMANEAARTIPGRENGGNCDIKNLSRGSKVYLPVFVEGANLSTGDMHFSQGDGEVSFCGAIEMSGFLELKCEIIRGGMKEYLTPVGPTPLHVNPIFEIGPVEPHFSEWLVFEGISVDEYGKQHFLDASVAYKRAVLNAIEYLSKFGYSKEQAYLLLSCCPCEGRISGIVDSPNAVTTLAIPTAIFDQDIKPKRLSGRPLRGPKLRRLPDLLSCSNSEHLPVTQGQSGTREP

SEQ ID NO: 4864 - protein, 149 aa, Hordeum vulgare
MAPLTPRLVVPIDVKKKPWEQEVPLHNRWHPDIPPVADVTQGELFRVEMVDATGGQVRDDDSADDIKSLDFAAPHYLSGPLRVVDAEGVPASPGDLLAVEICNLGPLPGDEWGYTGIFEREHGGGFLTDHFPSARKAIWYFEGIYAYSP

SEQ ID NO: 4865 - protein, 456 aa, Pennisetum glaucum
MAPLTSRLVVPIDVKKQPWEQKVPLHNRWHPDIPPVADVTEGELFRVEMVDWSGGRVRDDNSADDMKSMDFTIAHYLSGPLRIVDSEGVPASPGDLLAVEICNLGPLPGDEWGYTAILERENGGGFLTDHFPSARKAIWYFEGIYAYSPQIPGVRFPGLTHPGVVGTAPSVELLNIWNEREKRLAETNQETFKLCEVLHQRPLAHLPTPENCLLGKIQEGTAGWDKIANEAARTIAGRENGGNCDIKNLSRGSKVYLPVFVEGANLSTGDMHFSQGDGEISLCGAIEMSGFLELKCEIIRGGMKEYLTPVGPTPFHVNPIFEIGPVEPRFSEWLVFEGISVDESGKQHFLDASVSYKRAVLNAIEYLSKFGYSKEQVYLLLSCCPCEGRISGIVDAPNAVATLAIPTAIFDQDIKPKRLSGRPLPGPKLRRLPDLLSCSEDGHLRVTQGKSGTRAP

SEQ ID NO: 4866 - protein, 456 aa, Sorghum bicolor
MAPLTPRLVVPIDVKKQPWEQKVPLHNRWHPDIPPVADVTEGELFRVEMVDWSGGRVRDDNSADDLKFMDFTVAHYLSGPLRIVDSEGVPASPGDLLAVEICNLGPLPGDEWGYTAILERENGGGFLTDHFPSTRKAIWYFEGIYAYSPQIPGVRFPGITHPGVVGTAPSVELLNIWNEREKRLSETRPETLTLCEVLHQRPLVPLPTPDNCLLGKVQEGTAEWHKIANEAARTIAGRENGGNCDIKNLSRGSKVYLPVFVEGANLSTGDMHFSQGDGEISLCGAIEMSGFLELKCEIIRGGMKEYLTPVGPTPLHVSPIFEIGPVEPRFSEWLVFEGISVDESGKQHFLDASVAYKRAVLNAIEYLSKFGYSKEQVYLLLSCCPCEGRISGIVDSPNAVTTLAIPTAIFDQDIKPKRMNGRPLGGPQLRRLPDLLSCSNDGHLPATQDKSGTSAP

SEQ ID NO: 4867 - protein, 456 aa, Zea mays
MAPLSPRLVVPVDVKKLPREQKVPLHNRWHPDIPPVADVTEGELFRVEMVDWSGGRVRDDNSADDLKFMDFTIAHYLSGPLRIVDSEGVPASPGDLLAVEICNLGPLPGDEWGYTAILERENGGGFLTDHFPSARKAIWYFEGIYACSPQIPGVRFPGLTHPGVVGTAPSLELLNIWNEREKSLSETSLETIKLCEVLHQRPLAHLPTPENCLLGKVQEGTAEWHIIANEAARTIAGRENGGNCDIKNLSRGSRIYLPVFVEGANLSTGDMHFSQGDGEISLCGAIEMSGFLELKCEIIRGGMKEYLTPVGPTPLHVSPIFEIGPVEPRFSEWLVFEGISVDESGKQHFLDASVAYKRAVLNAIEYLSKFGYSKEQVYLLLSCCPCEGRISGIVDSPNAVTTLAIPTAIFDQDIKPKRVKGRPLGGPQLRRLPDLLSCSNHGRLPATQDRSGTSAP

SEQ ID NO: 4868 - protein, 448 aa, Panicum virgatum
VVPIDVKKHPWEQKVPLHNRWHPDIPPVADVTEGEFFRIEMVDWSGGRVKDDNSADDMKSMDFTIAHYLSGPLRIVDSEGVPASPGDLLAVEICNLGPLPGDEWGYTAILERENGGGFLTDHFPSARKAIWYFEGIYAYSPQIPGVRFPGLTHPGVVGTAPSVELLNIWNEREKRLAETNQETLKLCEVLHQRPLAHLPTAENCLLGKIREGTAEWHKIANEAARTIPGRENGGNCDIKNLSRGSKVYLPVFVEGANLSTGDMHFSQGDGEISLCGAIEMSGFLELRCEIIRGGMKEYLTPVGPTPLHVNPIFEIGPVEPRFSEWLVFEGISVDESGKQHFLDASVAYKRAVLNAIEYLSKFGYSKEQAYLLLSCCPCEGRISGIVDSPNAVTTLAIPTAIFDQDIKPKRLSERPLPGPKLRRLPDLLSCSNNGQLPVTQGQSGTRAP

SEQ ID NO: 4869 - protein, 459 aa, Elaeis guineensis
MAPKTPRLVVPIDVKKKPWEQKLPLHNRWHPHIPPVADVTEGEIFRVEMVDANGGQVGDNDSTADIKFANLTGGHYLSGPLRVIDTKGVSAKPGDLLAVEICNLGPLPGDEWGYTASFDRENGGGFLTDHFPSATKAIWYFEGIYAYSPHIPGVRFPGLAHPGVVGTAPSPELLSIWNEREKKLAEEGPGSVTLCEVVHQRPLVSLPTAKNCLLGLIEEGTPEWERIANEAARTVPGRENGGNCDIKNLSRGSKVYLPVFVDGANLSTGDMHFSQGDGEVSFCGAIEMSGFLELKCEIIRGGMREYLTPMGPTPLHVSPIFEIGPVEPRFSEWLVFEGISVDEAGRQHYLDATVAYKRAVLNAIDYLSKFGYSKEQVYLLLSCCPCEGRISGIVDSPNAVATLAIPTAIFDQDIRPKSGKVPVGPQIVKRTPDVLKYTYDGNLPITPNPGAAVSRLSDD

SEQ ID NO: 4870 - protein, 453 aa, Mimulus guttatus
MAPSTPRLVIPVDLKKKPWQQNPPLHNRWHPDIPAVAEVKTGELFRVEMVDWTGGTISDDHSALDVKTLDLSIVHYLSGPIRVVDTDGNPARPGDLLAVEICNLGPLPGDEWGFTAIFDRENGGGFLTDHFPCATKAIWYFEGIYAYSPHIPGVRFPGLTHPGIVGTAPSMELLNIWNERERELEETGLQTLKLCEVLHSRPLANLPSTKGCVLGKIKEGSLEWEKVAREAARTIPGRENGGNCDIKNLSRGSKVYLPVFVDGANLSTGDMHFSQGDGEVAFCGAIEMSGFLELKCEIIRDGMKKYLTPMGPTRLHVNPIFEIGPVEPRFSEWLVFEGISVDESGRQHYLDASVAYKRAVLNAIDYLSRFGYSKEQVYLLLSCCPCEGRISGIVDSPNAVATLAIPIAIFDQDIRPKIGSVPTGPRLVRNNPVLPQCTYDGNLPITKNPSASI

SEQ ID NO: 4871 - protein, 453 aa, Phalaenopsis aphrodite
MAPRSPRLVVPIDPNKKPWQQRHPLHNRWHPHIPPVADVTELEVFRVEMMDWTGGAVADNDSAMDIKSLDLTITHYLSGPIRVSDEGGIPAKPGDLLAIEICDLGPLPGHEWGYTATFDRENGGGFLTDHFPNATKAIWYFEGIYAYSPQIPGVRFPGLIHPGIVGTAPSLELLNIWNGREKKLAENGPNSLKICEVVHQRPLANLPTARNCLLGKINEGTAEWERIANEAARTIPGRENGGNCDIKNLSRGSKIYLPVFVEGANLSTGDMHFSQGDGEVSFCGAIEMGGFLELKCEIIRGGMKEYLSPMGPTTLHVNPIFEIGPVEPRFSEWLVFEGISVDESGRQHFMDATVAYKRAVLNAIDYISKFGYSKEQAYLLLSCCPCEGRISCIVHIPNAVATFAIPVAIFDQDIRPKDRKLVGPRILKQLPDVIRCWYDRNSGSFPSLPTPAK

SEQ ID NO: 4872 - protein, 451 aa, Vitis vinifera
MANYGPRLVVPIDVKKKPWEQKLPLHNRWHPEIPPVDEVRCGEVFRVEMVDFSGGGITKDYSAEDIKYADPSIVHYLSGPIRVLDVDGVPAKPGDLLAVEICNLGPLPGDEWGYTATFDRENGGGFLTDHFPCATKAIWYFEGIYAYSPHIPGVRFPGLTHPGIVGTAPSMELLNIWNERERQVEENGLQTLKLCEVLHSRPLANLPSTKGCHLGKIQKGTPEWERIAREAARTIPGRENGGNCDIKNLSTGSKIYLPVFVDGANLSTGDMHFSQGDGEVSFCGAIEMSGFLELKCEIIRGGMKEYLTPMGPTPLHVNPIFEIGPVEPRFSEWLVFEGISVDESGRQHYLDASVAYKRAVLNAIDYLSKFGYSKEQMYLLLSCCPCEGRISGIVDSPNAVATLAIPTAIFDQDIRPKTKVPVGPRLVRKPDVLRCTYDGNLPTTKNPAATM

SEQ ID NO: 4873 - protein, 452 aa, Citrus clementina
MAPTTPTVVVPIDLKKKPNEQKLTLHNRWHPEIPPVAEVKVGELFRVEMVDWTGGAIKDNDSAIDVKTLDLSTVHYLSGPIKVVDEQGIPAKPGDLLAVEICNLGPLPGDEWGYTATFDRENGGGFLTDHFPCATKAIWYFEGIYAYSPHITGVRFPGLTHPGIIGTAPSMELLKIWNERERELEETGLQSLKLCEVLHTRPLAKLPLTEGCLLGQIQEGTPEWKKIAMEAARTIPGRENGGNCDIKNLSRGSKIYLPVFVDGANLSTGDMHFSQGDGEVTFCGAIEMSGFLDLKCEIIRGGMKEYLTPMGPTPLHVNPIFEIGPVEPRFSEWLVFEGISVDESGGQHYLDATVAYKRAVLNAIDYLSKFGYSKEQVYLLLSCCPCEGRISGIVDSPNAVATLAVPTAIFDQDIRPKSSKVPVGPRLVRKPDVLKCSYEGNLPTTENPGARI

SEQ ID NO: 4874 - protein, 452 aa, Unknown
  Sequence found in Organisms: Gossypium hirsutum, Gossypium raimondii
MAHYGAKVVVPIDLKKKPWEQKHPLHNRWHPDIPVVAEVKDGEVFRVEMVDFSGGGITSDYSAEDVKHADQSIVHYLSGPIRVVDKKETPAMPGDLLAVEICNLGPLPGDEWGYTATFDRENGGGFLTDHFPCATKAIWYFEGIYAYSPHIPGVRFPGLTHPGIIGTAPSMELLNIWNEREREVEENGHKSLKLCEVLHSRPLANLPSTKGCHLGKIKKGTAEWEKIAKEAARTIPGRENGGNCDIKNLSRGSKIYLPVFVEGANLSTGDMHFSQGDGEVSFCGAIEMSGFLELKCEIIRGGMKEYLTPMGPTPLHVNPIFEIGPVEPRFSEWLVFEGISVDESGRQHFLDASVAYKRAVLNAIDYLSKFGYSKEQVYLLLSCCPCEGRISGIVDAPNAVATLAIPTAIFDQDIRPKAGKVPIGPRLVRKPDVLRCSYDGNLPTTKNPAASM

SEQ ID NO: 4875 - protein, 452 aa, Tragopogon dubius
MAPLTPKLVVPIDLKKKPWEQKLPLHNRWHPDIPTVAEVKTGQIFKIEMVDWTGGAIKDDNSASDVKYLDLSTVHYLSGPIRVIDEEGTPAKPGDILAVEICNLGPLPGDEWGFTAIFDRENGGGFLTDHFPCATKAIWYFEGIYASSPHIPGVRFPGITHPGIIGTAPSMELLNIWNERERELEENGLKSLKLCEVLHSRPLANLPSTKGCLLGKIPEGTHEWEKIANEAARTIPGRENGGNCDIKNLSRGSKIYLPVFVEGANFSTGDMHFSQGDGEVSFCGAIEMSGFLELKCEIIRGGMKEYLTPMGPTPLHVNPIFEIGPMEPRFSEWLVFEGISVDESGRQHYLDASVAYKRAVLNAIDYLSKFGYSKEQVYLLLSCCPCEGRISGIVDAPNAVATLAIPIAIFDQDIRPKANKLPVGPRVVRNPDIPRCTYDGNLPITKNPGSTG

SEQ ID NO: 4876 - protein, 459 aa, Elaeis guineensis
MAPQTPRLVVPVDVKKKPWEQKLPLHNRWHPHIPPVADVKEGELFRVEMVDALGGQVGDNNSAEDIQSIDLTAPHYLSGPLRVLDTKGVPAKPGDLLAVEICNLGLLPGDEWGYTATFDREKGGCFLTDHFPSATKAIWYFEGIYAYSPHIPGVRFPGLTHPGVVGTAPSLELLSIWHEREKKLAEDGTGSWTLCEVLHQRPLVSLPTAKSCLLGLIEEGTPEWERIANEAARTIPGRENGGNCDIKNLSRGSKVYLPVFVDGANLSTGDMHFSQGDGEVSFCGAIEMSGFLELKCEIIRGGMREYLTPMGPTPLHVSPIFEIGPVEPRFSEWLVFEGISVDEAGRQHYLDATVAYKRAVLNAIDYLSKFGYSKEQVYLLLSCCPCEGRISGIVDSPNAVATLAIPTAIFDQDVRPKSRKVPAGPRIVKRTPDVLKCTYDGNLPITPNPGARLSLLSDD

SEQ ID NO: 4877 - protein, 466 aa, Cirsium arvense
MAPPTPKLVVPVDLKKKPWEQKFPLHNRWHPEIPPVAEVKTGQMFRIDMVDWTGGAIKDDHSATDVKHIDLSTVHYLSGPIRVVDEEGIPAKAGDLLAVEICNLGPLPGEEWGFTAIFDRENGGGFLTDHFPCATKAIWYFEGIYAYSPHIPGVRFPGLTHPGIIGTAPSTELLNIWNERERELEENGLKSLKLCEVLHSRPLANLPSTKGCVLGKIPEGSEEWEKIANEAARTIPGRENGGNCDIKNLSRGSKIYLPVFVEGANFSTGDMHFSQGDGEVSFCGAIEMSGFLELKCEIIRGGMKEYLTPMGPTPLHVNPIFEIGPVEPRFSEWLVFEGISVDESGRQHYLDASVAYKRAVLNAIDYLSKFGYSKEQVYLLLSCCLCEGRISGIVDAPNAVATLAIPTAIFDQDIRPKRNKLPIGPRVVRNPDIPRCTYDGDLPITKNPGSNRKLIRSMVTLLVIIQ

SEQ ID NO: 4878 - protein, 453 aa, Cirsium arvense
MAPPTPKLVVPVDLEKKPWEQKFPLHNRWHPEIPPVAEVKTGQIFRIDMVDWTGGAIKDDHSATDVKHIDLSTVHYLSGPIRVVDEEGIPAKAGDLLAVEICNLGPLPGEEWGFTAIFDRENGGGFLTDHFPCATKAIWYFEGIYAYSPHIPGVRFPGLTHPGIIGTAPSMELLNIWNERERELEENGLKSLKLCEVLHSRPLANLPSTKGCVLGKIPEGSEEWEKIANEAARTIPGRENGGNCDIKNLSRGSKIYLPVFVEGANFSTGDMHFSQGDGEVSFCGAIEMSGFLELKCEIIRGGMKEYLTPMGPTPLHVNPIFEIGPVEPRFSEWLVFEGISVDESGRQHYLDASVAYKRAVLNAIDYLSKFGYSKEQVYLLLSCCPCEGRISGIVDAPNAVATLAIPTAIFDQDIRPKRNKLPIGPRVVRNPDIPRCTYDGNLPITKNPGATGS

SEQ ID NO: 4879 - protein, 452 aa, Euphorbia peplus
MATFNSKSGSAYRLDQEAMGAKLPLHNRWHPEIPPVAEVRDGEFFRVEMVDWTGGIIKDDESAADVKFIDLSIVHYLSGPIRVVDDNGVPAMPGDLLVVEICNLGPLPGDEWGFTATFDRENGGGFLTDHFPCATKAIWYFEGIYAYSPHIPGVRFPGLTHPGIVGTAPSEELLSIWNKREREVEENGLQTFKLCEVLHSRPLANLPSTKGCHLGKIQKGTPEWEKIANEAARTIPGRENGGNCDIKNLSRGSKVYLPVFVEGANLSTGDMHFSQGDGEISFCGAIEMSGFLELKCEIIRGGMKEYLTPMGPTTLHVNPIFEIGPVEPRFSEWLVFEGISVDESGRQHYLDASVAYKRAVLNAIDYLSKFGYSKEQMYLLLSCCPCEGRISGIVDAPNAVATLAIPTAIFDQDIRPKTSKVPAGPRLVRKPDVLKCTYDGNLPITKNLSAMS

SEQ ID NO: 4880 - protein, 452 aa, Glycine max
MAPATPRFVVPIDLKKNPWEQNAPLHNRWHPHIPHVAAVNTGEVFRVEMVDWTGGAIKDNDSALDIKFLDLSTVHYLSGPIRILDNDGVPAQPGDLLAVEICNLGPLPGDEWGFTATFDRENGGGFLTDHFPCATKAIWYFEGIYAHSPQIPGVRFPGLTHPGIIGTAPSMELLNIWNERERDVEENGIKSFKLCEVLHSRPLASLPLTKSCLLGKIRKGTSEWDKIAKEAARTIPGRENGGNCDIKNLSRGAKVYLPVFVEGANLSTGDMHFSQGDGEVSFCGAIEMSGFLELKCEIIRGGMKEYLTPMGPTPLHVNPIFEIGPVEPRFSEWLVFEGISVDESGRQHYLDASVAYKRAVLNAIDYISKFGYSKEQVYLLLSCIPCEGRISGIVDAPNAVATLAIPTTIFDQDIRPKNNKVPVGPRLVRKPDVFKCTYDGNLPITRNPSATS

SEQ ID NO: 4881 - protein, 453 aa, Musa acuminata
MAPLTPRVVVPVDVKKKPWEQKLPLHNRWHPDIPAVADVTEGEVFRVEMVDWTGGRVGDDNSAEDIKSLDLTITHYLSGPLRVVDSKGIPAKPGDLLMVEICNLGPLPGDEWGYTATFDRENGGGFLTDHFPCATKAIWYFEGIYAYSPHIPGVRFPGLAHPGIVGTAPSMELLCIWNEREKELAENGIGLLKLCEVLHQRPLANLPTAENCLLGMINEGTPEWKKIADEAARTIPGRENGGNCDIKNLSRGSKVYLPVFVEGANLSTGDMHFSQGDGEVSFCGAIEMSGFLELKCEIIRDGMREYLTPMGPTVLHVSPIFEIGPVEPRFSEWLVFEGISVDEAGRQHFLDATVAYKRAVLNAIDYLSKFGYSKEQAYLLLSCCPCEGRISGIVDSPNAVATLAIPTSIFDQDIRPRSGKVPAGPRVLKRLPDVLRCTYDGNLPTTQNPCGSM

SEQ ID NO: 4882 - protein, 451 aa, Flaveria ramosissima
MAPSTPKLVIPIDLKKKPWEQKLPLHNRWHPDIPPVATVKTGQFFRIEMVDWTGGAIKDDNSATDVKYLDLSTVHYLSGPIRVVDDDGPARPGDLLAVEICNLGPLPGDEWGFTAIFDRENGGGFLTDHFPCATKAIWYFEGIYAYSPHIPGVRFPGLTHPGIIGTAPSMELLKIWNDRERELEENGLKSLKLCEVLHSRPLANLPSTKGCLLGQIPEGSPEWEKMAMEAARTIPGRENGGNCDIKNLSRGSKIYLPVFVEGANFSTGDMHFSQGDGEVSFCGAIEMSGFLELKCEIIRGGMKEYLTPMGPTRLHVNPIFEIGPVEPRFSEWLVFEGISVDESGRQHYLDASVAYKRAVLNAIDYLSKFGYSKEQVYLLLSCCPCEGRISGIVDAPNAVATLAIPTAIFDQDIRPKQNKVPIGPRVVRNPDIPRCTYDGNLPITKNLSAIS

SEQ ID NO: 4883 - protein, 451 aa, Lotus japonicus
MEPPTPTLVVPIDLKKKPWEQKLPLHNRWHPYIPPVATVNTDEVFRVEMVDWTGGAIKDDNSALDLKLLDLSTVHYLSGPIRIVDNDGIPAKPGDLLAVEICNLGPLPGDEWGFTGTFDRENGGGFLTDHFSCATKALWYFEGIYAHSPQIPGVRFPGLTHPGIIGTAPSMELLHIWNERERDVEENGVHSFKLCEVLHSRPLASLPTTNSCLLGKIQKGSPEWEKIAMEAARTIPGRENGGNCDIKNLSRGSKVYLPVFVEGANLSTGDMHFSQGDGEVSFCGAIEMSGFLELKCEIIRGGMKEYLTPMGPTPLHVNPIFEIGPVEPRFSEWLVFEGISVDERGRQHFLDASVAYKRAVLNAIDYISKFGYSKEQVYLLLSCIPCEGRISSIVDAPNAVATLAIPTAIFDQDIRPKQNKVPIGPRLVRKPDVFKCTYDGNLPITKNPSAT

SEQ ID NO: 4884 - protein, 452 aa, Helianthus annuus
MAQHGPRLVVPIDVTKKPREQKLPLHNRWHPDIPPVAEVRVGEVFRVEMVDFSGGGITKEYTAEDIKFSDQSIVHYLSGPIRVVDEDGPAKPGDLLAVEICNLGPLPGDEWGFTAIFDRENGGGFLTDHFPCATKAIWYFEGIYAYSPHIPGVRFPGLTHPGIIGTAPSMELLKIWNERERELEENGLKSFKLCEVLHSRPLANLPSTKGCLLGKIEEGSHEWEKMANEAARTIPGRENGGNCDIKNLSRGSKIYLPVFVEGANFSTGDMHFSQGDGEVSFCGAIEMSGFLELKCEIIRGGMKEYLTPMGPTPLHVNPIFEIGPVEPRFSEWLVFEGISVDESGRQHYLDASVAYKRAVLNAIDYLSKFGYSKEQVYLLLSCCPCEGRISGIVDAPNAVATLAIPTAIFDQDIRPKANKLPIGPRVVRNPDIPRCTYDGNLPITKNLSATGS

SEQ ID NO: 4885 - protein, 452 aa, Valeriana officinalis
MAQHGPRLVVPIDLTKKPQQQKLPLHNRWHPDIPPVAEVTTGELFRVEMVDFSGGRITREYTALDIKHADQSIVHYLSGPIRVVGSDGVAAQPGDLLVVEICNLGPLPGDEWGFTAIFDRENGGGFLTDHFPSAHKAIWYFEGIYAYSPHIPGVRFPGLTHPGIVGTAPSMELLQIWNKRERELVETGLESLKLCEVLHSRPLANLPSTKGCVLGKVQQGSDEWEKIAIEAARTIPGRENGGNCDIKNLSRGSKIYLPVFVEGANLSTGDMHFSQGDGEVSFCGAIEMSGFLELKCEIIRGGMKEYLTPMGPTRLHVNPIFEIGPVEPRFSEWLVFEGISVDESGKQHYLDASVAYKRAVLNAIDYLSKFGYTKEQVYLLLSCCPCEGRISGIVDAPNAVATLAIPTAIFDQDIRPKANKVPVGPRLVRNPDIPKCSYDGNLPTTKNPSASI

SEQ ID NO: 4886 - protein, 451 aa, Vitis vinifera
MAPSTPRLVVPIDLKKAAWEQKLPFHNRWHPKIPPVAEVKAGEFFRVEMVDATGGGIKDDDSSLDVKHIDASTVHYLSGPIRVLDVDGVPAKPGDLLAVEICNLGPLPGDEWGYTATFDRENGGGFLTDHFPCATKAIWYFEGINAYSPHIPGVRFPGLTHPGIIGTAPSMELLNIWNERERQVEENGRQTLKLCEVLHSRPLANPPSTKGCHLGKIQQGTPEWERIAREAARTIPGRENGGNCDIKNLSRGSKIYLPVFVDGANLSTGDMHFSQGDGEVSFCGAIEMSGFLELKCEIIRGGMKEYLTPMGPTPLHVNPIFEIGPVEPRFSEWLVFEGISVDESGRQHFLDATVAYKRAVLNAIDYLSKFGYSKEQMYLLLSCCPCEGRISGIVDSPNAVATLAIPTAIFDQDIRPKTKVPVGPRLVRKPDVLRCTYDGNLPTTKNPAATM

SEQ ID NO: 4887 - protein, 451 aa, Populus trichocarpa
MEQHGARLVFPIDVKKKPWEQKLPLHNRWHPDIPPVAEVTVGELFRVEMVDFSGGRITKEYSAEDIKNADPSIVHYLSGPIRVLDEEGKPAQPGDLLAVEICNLGPLPGDEWGFTASFDRENGGGFLTDHFPCATKAIWYFEGIYAYSPQIPGVRFPGLTHPGIVGTAPSRELLNIWNEREREVEENGLKHLKLCEVLHSRPLANLPSTKGCHLGKIQKGTPEWEKIANEAARTIPGRENGGNCDIKNLSRGSKVYLPVFIEGANVSTGDMHFSQGDGEIAFCGAIEMSGFLELKCEIIKGGMKEYLTPMGPTLLHVNPIFEIGPVEPRFSEWLVFEGISVDESGRQHFLDASVAYKRAVLNAIDYLSKFGYSKEQMYLLLSCCPCEGRISGIVDSPNAVATFAIPTSIFDQDIRPKTKVPVGPRLVRTPDVLKCTYDGNLPITKNPCATT

SEQ ID NO: 4888 - protein, 360 aa, Phalaenopsis aphrodite
MAPLSPRLVVPIDIKKKPWEQKHPLHNRWHPHIPAVAEVTEGEVFRVEMMDWSGGSVADNDSAMDIKSIDLAITHYLSGPIRVLDKGGAPAKPGDLLAVEICNLGPLPGDEWGYTASYDRENGGGFLTDHFPSATKAVWYFEGIYAYSPHIPGVRFPGLTHPGIIGTAPSIELLNIWNEREKKLVEDGPNSLKICEVVHQRPLASLPTTKSCLLGMINEGTPEWEKIASEAARTIPGRENGGNCDIKNLSTGSKIYLPVFVEGANFSTGDMHFSQGDGEISLCGAIEMSGFLELKCEIIKGGMKEYLTPMGPTELHVNPIFEIGPVEPRFSEWLVFEGISVDERGSSISWTPQWPTSAPC

SEQ ID NO: 4889 - protein, 283 aa, Ambrosia trifida
MELLNIWNERERELEENGLKSLKLCEVLHSRPLANLPSTKGCLLGKIEEGSREWEKMATEAARTIPGRENGGNCDIKNLSRGSKIYLPVFVEGANFSTGDMHFSQGDGEVSFCGAIEMSGFLELKCEIIRGGMKEYLTPMGPTRLHVNPIFEIGPVEPRFSEWLVFEGISVDESGRQHYLDASVAYKRAVLNAIDYLSKFGYSKEQVYLLLSCCPCEGRISGIVDAPNAVATLAIPTAIFDQDIRPKPNKVPIGPRVVRNPDIPRCTYDGKLPITKNPSAIGS

SEQ ID NO: 4890 - protein, 452 aa, Arnica chamissonis
MAQHAPTLVVPIDVTKKPREQKLPLHNRWHPDIPPVAEVRVSEVFRVEMVDFSGGGITKEYTAQDIKYSDQSVVHYLSGPIRVVDEDGPAKPGDLLAVEICNLGPLPGDEWGFTAIFDRENGGGFLTDHFPCATKAIWYFEGIYAYSPHIPGVRFPGLTHPGIIGTAPSMELLNIWNERERELEENGLKSLKLCEVLHSRPLANLPSTKGCLLGKIQEGTPEWEKIAMEAARTIPGRENGGNCDIKNLSRGSKIYLPVFVEGANFSTGDMHFSQGDGEVSFCGAIEMSGFLELKCEIIRGGMEEYLTPMGPTRLHVNPIFEIGPVEPRFSEWLVFEGISVDESGRQHYLDASVAYKRAVLNAIDYLSKFGYSKEQVYLLLSCCPCEGRISGIVDAPNAVATLAIPTAIFDQDIRPKANKLPVGPRVVRNPDIPRCTYDGNLPITKNLSAKPS

SEQ ID NO: 4891 - protein, 384 aa, Artemisia annua
MAQHGPRMVVPIDVTKKPREQKLPLHNRWHPDIPPVAQVSVGEVFRVEMVDFSGGRITREYTAEDIKYADQSVVHYLSGPIRVVDDEGIAAKPGDLLAVEICNLGPLPGDEWGFTAIFDRENGGGFLTDHFPCATKAIWYFEGIYAYSPHIPGVRFPGITHPGIIGTAPSMELLNIWNKRERELEENGLNSLKLCEVLHSRPLANLPSTKGCLLGQIPEGTNEWEKIANEAARTIPGRENGGNCDIKNLSRGSKIYLPVFVEGANFSTGDMHFSQGDGEVSFCGAIEMSGFLELKCEIIRGGMKEYLTPMGPTPLHVNPIFEIGPVEPRFSEWLVFEGISVDESGRQHYLDASVAYKRAVLNAILVKVWIFQRTGVSFIVMLSL

SEQ ID NO: 4892 - protein, 452 aa, Actinidia deliciosa
  misc_feature (392)..(392): Xaa can be any naturally occurring amino acid
MALHGPRLVLPIDLKKKAWEQKLPLHNRWHPDIPPVAEIRTGEVFRVEMMDFSGGGITQEYSAEDIKHADPSIVHYMSGPIRVVDADGAPAKPGDLLAVEICNLGPLPGDEWGYTATFDRENGGGFLTDHFPCATKAIWYFEGIYAYSPHIPGVRFPGLTHPGIIGTAPSMELLNIWNERERKLEETGLQTLKLCEVLHSRPLANLPSPKGCLLGKIQKGTPEWEKIANEAARTIPGRENGGNCDIKNLSRGSKVYLPVFVEGANFSTGDMHFSQGDGEVSFCGAIEMSGFLELKCEIIRGGMKEYLTPMGPTPLHVNPIFEIGPVEPRFSEWLVFEGISVDESGRQHYLDASVAYKRAVLNAIDYLSKFGYSKEQIYLLLSCCPCEGRISXIVDSPNAVATLAIPTSIFDQDIRPKTNKVPVGPRVVRTPDVLKCAYEGNLPTTKNPCNNI

SEQ ID NO: 4893 - protein, 452 aa, Helianthus annuus
MAQHGPRLVVPIDVTKKPREQKLPLHNRWHPDIPPVAEVRVGEVFRVEMVDFSGGGITKEYTAEDIKFSDQSVVHYLSGPIRVVDEDGPAKPGDLLAVEICNLGPLPGDEWGFTAIFDRENGGGFLTDHFPCATKAIWYFEGIYAYSPHIPGVRFPGLTHPGIIGTAPSMELLKIWNERERELEENGLKSFKLCEVLHSRPLANLPSTKGCLLGKIEEGSREWEKMANEAARTIPGRENGGNCDIKNLSRGSKIYLPVFVEGANFSTGDMHFSQGDGEVSFCGAIEMSGFLELKCEIIRGGMKEYLTPMGPTPLHVNPIFEIGPVEPRFSEWLVFEGISVDESGRQHYLDASVAYKRAVLNAIDYLSKFGYSKEQVYLLLSCCPCEGRISGIVDAPNAVATLAIPTAIFDQDIRPKANKLPIGPRVVRNPDIPRCTYDGNLPITKNLSATGS

SEQ ID NO: 4894 - protein, 451 aa, Populus trichocarpa
MEQHGARLVFPIDVKKKPWEQKLPLHNRWHPDIPPVAEVTVGELFRVEMVDFSGGRITKEYSAEDIKNADPSIVHYLSGPIRVLDEEGKPAQPGDLLAVEICNLGPLPGDEWGFTASFDRENGGGFLTDHFPCATKAIWYFEGIYAYSPQIPGVRFPGLTHPGIVGTAPSRELLNIWNEREREVEENGLKHLKLCEVLHSRPLANLPSTKGCHLGKIQKGTPEWEKIATEAARTIPGRENGGNCDIKNLSRGSKVYLPVFIEGANVSTGDMHFSQGDGEIAFCGAIEMSGFLELKCEIIKGGMKEYLTPMGPTLLHVNPIFEIGPVEPRFSEWLVFEGISVDESGRQHFLDASVAYKRAVLNAIDYLSKFGYSKEQMYLLLSCCPCEGRISGIVDSPNAVATFAIPTSIFDQDIRPKTKVPVGPRLVRTPDVLKCTYDGNLPITKNPSAMT

SEQ ID NO: 4895 - protein, 448 aa, Centaurea maculosa
PKLVVPVDLKKKPWEQKLPLHNRWHPEIPPVAEVKTGQIFRIDMVDWTGGAIKDDHSATDVKHIDLSTVHYLSGPIRVVDEEGIPAKAGDLLAVEICNLGPLPGEEWGFTAIFDRENGGGFLTDHFPCATKAIWYFEGIYAYSPHIPGVRFPGLTHPGIIGTAPSMELLNIWNERERELEENGLKSLKLCEVLHSRPLANLPSTKGCVLGKIPEGSEEWEKIANEAARTIPGRENGGNCDIKNLSRGSKIYLPVFVEGANFSTGDMHFSQGDGEVSFCGAIEMSGFLELKCEIIRGGMKEYLTPMGPTPLHVNPIFEIGPVEPRFSEWLVFEGISVDESGRQHYLDASVAYKRAVLNAIDYLSKFGYSKEQVYLLLSCCPCEGRISGIVDAPNAVATLAIPTAIFDQDIRPKRSKLPIGPRVVRNPDIPRCTYDGNLPITKNPGLTGS

SEQ ID NO: 4896 - protein, 77 aa, Ambrosia trifida
MAQHGPRLVVPIDVTKKPREQKLPLHNRWHPDIPPVAEVRVGRGFSSSRWLIFLVVVSLKNTLLKTSNFLTSLLCII

SEQ ID NO: 4897 - protein, 452 aa, Amsonia hubrichtii
MALRGARLVIPIDVKKKPGEQKLPLHNRWHPDIPPVAEVRTGEVFRVEMVDFSGGGITQEFTAEDIKNADPSIVHYLSGPIRVTDADGIPAKPGDLLAVEICNLGPLPGDEWGFTAIFDRENGGGFLTDHFPHATKAIWYFEGIYAYSPHIPGVRFPGLTHPGIIGTAPSMELLNIWNERERTLEETGHQSLKLCEVLHSRPLANLPSTKGCYLGKIQEGSPEWEKIACEAARTIPGRENGGNCDIKNLSRGSKVYLPVFVEGANLSTGDMHFSQGDGEVAFCGAIEMSGFLELKCEIIRNGMKEYLTPMGPTPLHVNPIFEIGPVEPRFSEWLVFEGISVDESGRQHFLDASVAYKRAVLNAIDYLSKFGYSKEQVYLLLSCCPCEGRISGIVDAPNALATLAIPIAIFDQDIRPKTNKVPTGPQIVRNPGLPQCPYEGNLPTTKNPCATV

SEQ ID NO: 4898 - protein, 454 aa, Cannabis sativa
MAQYGPTVMVPIDVKKKPREQKVPLHNRWHPDIPPVAEAAVGDVFRVEMVDFSGGGITKEYSANDIKFADPFIVHYLSGPIRIVDKDGIPAKPGDLLVVEICNLGPLPGDEWGFTATFDRENGGGFLTDHFPAATKAIWYFEGIYAYSPHIPGVRFPGLTHPGIVGTAPSMELLNIWNERERQLVENGVESLKLCEVVHQRPMASLPTPKGCVLGKIQEGTPEWEKIAREAARTIPGRENGGNCDIKNLSRGSKIYLPVFVEGANLSTGDMHFSQGDGEVSFCGAIEMSGFLDLKCEIIRGGMKEYLTPMGPTPLHVNPIFEIGPVEPRFSEWLVFEGISVDESGRQHYLDATVAYKRAVLNAIDYLSKFGYSKEQAYLLLSCCPCEGRISGIVDAPNAMATLAIPTAIFDQDIRPKASKVPIGPRVVRKPDVLKCSYDGNLPTTTNLSSSSTS

SEQ ID NO: 4899 - protein, 452 aa, Manihot esculenta
MAQYGSRLVFPIDVKKKPWEQKLPLHNRWHPDIPPVAEVTVGEFLRIEMVDFSGGGIKQENSAEDIKHADLSIVHYLSGPIRVLDKEGIPAMPGDLLMVEICNLGPLPGDEWGFTATFDRENGGGFLTDHFPSATKAIWYFEGIYAYSPHIPGVRFPGLTHPGIVGTAPSMELLKIWNERERDVEENGLKSLKLCEVLHSRPLANLPSTKGCHLGKIQKGTPEWERIAKEAARTIPGRENGGNCDIKNLSRGSKVYLPVFVEGANLSTGDMHFSQGDGEVSFCGAIEMSGFLELKCEIIRGGMKEYLTPMGPTPLHVNPIFEIGPTEPRFSEWLVFEGISVDESGRQHYLDASIAYKRAVLNAIDYLSKFGYSKEQMYLLLSCCPCEGRISGIVDAPNAVATLAIPTAIFDQDIRPKASKVPVGPRVVRKPDVLKCTYDGNLPITKNPSAMS

SEQ ID NO: 4900 - protein, 450 aa, Flaveria ramosissima
MAQHGPRVVVPIDVTKKPREQKLPLHNRWHPDIPPVAEVRVGEVFRVEMVDFSGGGITREYTAHDIKYSDQSVVHYLSGPVRVVDDDGPARPGDLLAVEICNLGPLPGDEWGFTAIFDRENGGGFLTDHFPCATKAIWYFEGIYAYSPHIPGVRFPGLTHPGIIGTAPSMELLNIWNERERELEENGLKSLKLCEVLHSRPLANLPSTKGCLLGQIPEGTPEWEKIALEAARTIPGRENGGNCDIKNLSRGSKIYLPVFVEGANFSTGDMHFSQGDGEVSFCGAIEMSGFLELKCEIIRGGMKEYLTPMGPTRLHVNPIFEIGPVEPRFSEWLVFEGISVDESGRQHYLDASVAYKRAVLNAIDYLSKFGYSKEQVYLLLSCCPCEGRISGIVDAPNAVATLAIPTAIFDQDIRPKQNKVPIGPRVVRNPDIPRCSYDGNLPITKNLSAN

SEQ ID NO: 4901 - protein, 454 aa, Sesamum indicum
MGSDRHGARVVVPIDVKKKPWEQQLPLHNRWHPAIPPVAEVCTGELFRVEMVDFSGGGITKDYTAQDIKFADPSIVHYLSGPISVVDTEGNPAKPGDLLAVEICNLGPLPGDEWGFTAIFDRENGGGFLTDHFPRATKAIWYFEGIYAYSPHIPGVRFPGLTHPGIVGTAPSMELLNIWNERERELEETGLQSLKLCEVLHSRPLANLPSTKGCVLGKIKEGTPEWERIAREAARTIPGRENGGNCDIKNLSRGSKVYLPVFVDGANLSTGDMHFSQGDGEVAFCGAIEMSGFLELKCEIIRDGMKKYLTPMGPTPLHVNPIFEIGPVEPRFSEWLVFEGISVDESGRQHYLDASVAYKRAVLNAIDYISRFGYSKEQVYLLLSCCPCEGRISGIVDAPNAVATLAIPVAIFDQDIRPKTTTVPTGPRLVRNPGLPQCTYDGNLPTTRNPCATT

SEQ ID NO: 4902 - protein, 463 aa, Solanum phureja
MAPPTPRLVIPIDLKKKPWEQKLPLHNRWHPEIPPVTEIKTGEMFRIEMVDWTAGAIQDNNSAIDVKTVDLSTVHYLSGPIRVVDTDGNPAEPGDLLAVEICNLGPLPGDEWGFTAIFDRENGGGFLTDHFPRATKAIWYFEGIYAYSPHIPGVRFPGLVHPGIIGTAPSKELLNIWNERERKLEETGPQSLKLCEVLHSRPLANLPSTKGCILGKIQDGTAEWNRIADEAARTIPGRENGGNCDIKNLSRGSKIYLPVFVEGANLSTGDMHFSQGDGEVSFCGAIEMSGFLELKCEILRNGMKEYLTPMGPTPLHVNPIFEIGPMEPRFSEWLVFEGISVDESGQQHYLDASVAYKRAVLNAIDYLSKFGYSKEQVYLLLSCCPCEGRISGIVDAPNAVATLAIPTAIFDQDIRPKVNKVPLGPRLMRNPGIPQCTYDGNLPITKNPSLHQQGSSCDMDASS

SEQ ID NO: 4903 - protein, 463 aa, Solanum lycopersicum
MAPPTPRLVIPIDLKKKPWQQKLPLHNRWHPEIPPVTEIKTGEMFRIEMVDWTAGSIQDNNSAIDVKTVDLSTVHYLSGPIRVVDTDGNPAEPGDLLAVEICNLGPLPGDEWGFTAIFDRENGGGFLTDHFPRATKAIWYFEGIYAYSPHIPGVRFPGLIHPGIIGTAPSKELLNIWNERERKLEETGPRSLKLCEVLHSRPLANLPSTKGCILGKIQDGTPEWIRIANEAARTIPGRENGGNCDIKNLSRGSKIYLPVFVEGANLSTGDMHFSQGDGEVSFCGAIEMSGFLELKCEIIRNGMKEYLTPMGPTSLHVNPIFEIGPMEPRFSEWLVFEGISVDESGQQHYLDASVAYKRAVLNAIDYLSKFGYSKEQVYLLLSCCPCEGRISGIVDAPNAVATLAIPTAIFDQDIRPKVNKVPLGPRLIRNPGIPQCTYDGNLPITKNPLLHQQGSSCNMDASS

SEQ ID NO: 4904 - protein, 453 aa, Centaurea maculosa
MAHHGPRLLVPIDVTKKPTQQKLPLHNRWHPDIPPVAQVSVGELFRVEMVDFSGGGITREYTAHDIKYADQSVVHYLSGPIRVVDEEGIPAKAGDLLAVEICNLGPLPGEEWGFTAIFDRENGGGFLTDHFPCATKAIWYFEGIYAYSPHIPGVRFPGLTHPGIIGTAPSMELLNIWNERERELEENGLKSLKLCEVLHSRPLANLPSTKGCVLGKIPEGSEEWEKIANEAARTIPGRENGGNCDIKNLSRGSKIYLPVFVEGANFSTGDMHFSQGDGEVSFCGAIEMSGFLELKCEIIRGGMKEYLTPMGPTPLHVNPIFEIGPVEPRFSEWLVFEGISVDESGRQHYLDASVAYKRAVLNAIDYLSKFGYSKEQVYLLLSCCPCEGRISGIVDAPNAVATLAIPTAIFDQDIRPKGNKLPIGPRVVRNPDIPRCTYDGNLPITKNPAATGS

SEQ ID NO: 4905 - protein, 243 aa, Centaurea maculosa
MAHHGPRLLVPIDVTKKPTQQKLPLHNRWHPDIPPVAQVSVGELFRVEMVDFSGGGITREYTAHDIKYADQSVVHYLSGPIRVVDEEGIPAKAGDLLAVEICNLGPLPGEEWGFTAIFDRENGGGFLTDHFPCATKAIWYFEGIYAYSPHIPGVRFPGLTHPGIIGTAPSMELLNIWNERERELEENGLKSLKLCEVLHSRPLANLPSTKGCVLGKIPEGSEEWEKIANEAARTIPGRETGEL

SEQ ID NO: 4906 - protein, 452 aa, Castanea mollissima
MAQYGSRLIVPIDVKKKPWEQKLPLHNRWHPDIPPVAEVKVGETFRVEMVDFSGGGITQDYTAEDIKHAEQSIVHYLSGPIRVVDEDGTPAKPGDLLVVEILNLGPLPGDEWGYTATFDRENGGGFLTDHFPCATKAIWYFEGIYAYSPHIPGVRFPGLTHPGIIGTAPSLELLNIWNERERELEENGLQTLKLCEVLHSRPLANLPTTRGCVLGKIEKGTPEWEKIAREAARTIPGRENGGNCDIKNLSRGSKIYLPVFVDGANFSTGDMHFSQGDGEVSFCGAIEMSGFLELKCDIIRGGMKEYLTPMGPTPLHVNPIFEIGPVEPRFSEWLVFEGISVDESGRQHYLDASVAYKRAVLNAIDYLSKFGYSKEQVYLLLSCCPCEGRISGIVDSPNACATLAIPTAIFDQDIRPKNNKVPVGPRLVRKPDVLKCTYDGNLPITKNPSTST

SEQ ID NO: 4907 - protein, 452 aa, Lactuca sativa
MAQHGSRLVVPIDVTKKPRQQKLPLHNRWHPDIPPVAQVTVGEVFRVEMVDFSGGGITKEYTAEDIKYSDQSVVHYLSGPIRVVDEEGEAAKPGDLLVVEICNLGPLPGDEWGFTAIFDRENGGGFLTDHFPCATKAIWYFEGIYAYSPHIPGVRFPGITHPGIIGTAPSMELLNIWNERERELEENGLKSLKLCEVLHSRPLANLPLTKGCLLGKIPEGTQEWEKIANEAARTIPGRENGGNCDIKNLSRGSKIYLPVFVEGANFSTGDMHFSQGDGEVSFCGAIEMSGFLELKCEIIRGGMKEYLTPMGPTPLHVNPIFEIGPMEPRFSEWLVFEGISVDESGRQHYLDASVAYKRAVLNAIDYLSKFGYSKEQVYLLLSCCPCEGRISGIVDAPNAVATLAIPTAIFDQDIRPKTKKVPVGPRVVRNPDIPRCSYDGDLPITKNPGATG

SEQ ID NO: 4908 - protein, 452 aa, Quercus alba
MSQYGSRLIVPIDVKKKPWEQKLPLHNRWHPDIPPVAEVKVGEAFRVEMVDFSGGGITQDYTAEDIKHAEPSIVHYLSGPIRVVDEDGTPAKPGDLLAVEILNLGPLPGDEWGYTATFDRENGGGFLTDHFPCATKAIWYFEGIYAYSPHIPGVRFPGLTHPGIIGTAPSLELLNIWNERERELEENGLQTLKLCEVLHSRPLANLPTTRGCVLGKIEKGTPEWEKIAREAARTIPGRENGGNCDIKNLSRGSKIYLPVFVDGANFSTGDMHFSQGDGEVSFCGAIEMSGFLELKCDIIRGGMKEYLTPMGPTPLHVNPIFEIGPVEPRFSEWLVFEGISVDESGRQHYLDASVAYKRAVLNAIDYLSKFGYSKEQVYLLLSCCPCEGRISGIVDSPNACATLAIPTAIFDQDIRPKNKKVPVGPRLVRKPDVLKCTYDGNLPITKNPSTST

SEQ ID NO: 4909 - protein, 451 aa, Vitis vinifera
MAPSAPRLIVPIDLKKKPWEQKLPLHNRWHPQIPPVAEVMAGEYFRVEMVDANGGNIKDDNSSLDVKLIDSSSFHFLSGPIRVLDVDGVPAKPGDLLAVEICNLGPLPGDEWGYTATLDRENGGGFLTDHFPCATKAIWYFEGIYAYSPHIPGVRFPGLTHPGVIGTAPSMELLNIWNERERQLEENGLKTLKLCEVLHSRPLANLPSTKGCHLGKIQQGTPEWERIAREAARTTPGRENGGNCDIKNLSRGSKIYLPVFVDGANLSTGDMHFSQGDGEVSFCGAIEMNGFLELKCEIIRGGMKEYLTPMGPTPLHVNPIFEIGPVEPRFSEWLVFEGISVDESGRQHYLDASVAYKRAVLNAIDYLSKFGYSKEQMYLLLSCCPCEGRISGIVDSPNAVATLAIPTAIFDQDIRPKTKVPVGPRLVRKPDVLRCTYDGNLPTTKNPASIM

SEQ ID NO: 4910 - protein, 446 aa, Cirsium arvense
MAPPTPRLVVSVDLKKKPWEQKLPFHNRWHPEIPSVAVVKTGEIFRIDMVDWTGGAIKDDDSATDVKYIDLSTVHYLSGPIRVVDEEGIPANPGDLLAVEICNLGPLPGDEWGFTAIFDRENGGGFLTDHFPCATKAIWYFEGIYAYSPHIPGVRFPGLTHPGIIGTAPSMELLNIWNERERELEENGLKSLKLCEVLHSRPLANLPSTKGCLLGKIPEGSEEWEKIANEAARTIPGRENGGNCDIKNLSRGSKIYLPVFVEGANFSTGDMHFSQGDGEVSFCGAIEMSGFLELKCEIIRGGMKEYLTPMGPTPLHVNPIFEIGPVEPRFSEWLVFEGISVDESGRQHYLDASVAYKRAVLNAIDYLSKFGYSKEQVYLLLSCCPCEGRISGIVDAPNAVATLAIPTAIFDQDIRPKRNKLPVGPRVVRNPDIPRCSYDGNLPITK

SEQ ID NO: 4911 - protein, 457 aa, Elaeis guineensis
MAPRTPRLVVPIDVKKKPWEQKLPLHNRWHPHIPPVADVKEGELFRVEMMDWTGGCVGDNDSAADIKFLDLTITHYLSGPLRVLDTKGVPAKAGDLLAVEICNLGPLPGDEWGYTATFDRENGGGFLTDHFPSATKAIWYFEGIFAYSPHIPGVRFPGLTHPGIVGTAPSPKLLSIWNEREKKLAEGGAGSLTLCEVLHQRPLANLPTGKNCLLGLIEEGTPEWERIANEAARTIPGRENGGNCDIKNLSRGSKVYLPVFVDGANLSTGDMHFSQGDGEVSFCGAIEMSGFLELKCEIIRGGMREYLTPMGPSPLHVNPIFEIGPVEPRFSEWLVFEGISVDEAGRQHYLDATVAYKRAVLHAIDYLSKFGYSKEQVYLLLSCCPCEGRISGIVDSPNAVATLAIPTAIFDQDVRPKSGKIPAGPQIVKRTPDILKCTYDGNLPITPNPAAGLLTDD

SEQ ID NO: 4912 - protein, 421 aa, Flaveria ramosissima
MAPSTPKLVIPIDLKKKPWEQKLPLHNRWHPDIPPVATVQTGQFFRIETVDWTGGAIKDDNSATDVKHLDLSTVHYLSGPIRVVDDDGPARPGDLLAVEICNLGPLPGDEWGFTAIFDRENGGGFLTDHFPCATKAIWYFEGIYAYSPHIPGVRFPGLTHPGIIGTAPSMELLNIWNERERELEENGLKSLKLCEVLHSRPLANLPSTKGCLLGQISEGTPEWEKMALEAARTIPGRENGGNCDIKNLSRGSKIYLPVFVEGANFSTGDMHFSQGDGEVSFCGAIEMSGFLELKCDIIRGGMKEYLTPMGPTRLHVSPIFEIGPVEPRFSEWLVFEGISVDESGRQHYLDASVAYKRAVLNAIDYLSKFGYSKEQVYLLLSCCPCEGRISGIVDAPNAVATLAIPTAIFDQDIRPKQKKYR

SEQ ID NO: 4913 - protein, 452 aa, Ricinus communis
MAQYGARLVFPVDVRKKPWEQKLPLHNRWHPDIPPVAEVTAGELFRVEMVDFSGGGITQQNTAEDIKHADPSIVHYLSGPIKVVDKEGIPAKPGDLLVVEICNLGPLPGDEWGYTATFDRENGGGFLTDHFPCATKAIWYFEGIYAHSPHIPGVRFPGLTHPGIIGTAPSAELLNIWNEREREVEENGLKSFKLCEVLHSRPLANLPSTKGCHLGKIQKGTPVWEKIAKEAARTIPGRENGGNCDIKNLSRGSKIYLPVFVEGANLSTGDMHFSQGDGEVSFCGAIEMSGFLELKCEIIRGGMKEYLTPMGPTPLHVNPIFEIGPVEPRFSEWLVFEGISVDEGGRQHYLDASVAYKRAVLNAIDYLSKFGYSKEQMYLLLSCCPCEGRISGIVDSPNAVATLAVPTAIFDQDIRPKASKVPVGPRLVRRPDVLKCTYDGTLPITKNPSAMA

SEQ ID NO: 4914 - protein, 453 aa, Centaurea maculosa
  misc_feature (6)..(6): Xaa can be any naturally occurring amino acid
  misc_feature (12)..(12): Xaa can be any naturally occurring amino acid
  misc_feature (24)..(24): Xaa can be any naturally occurring amino acid
  misc_feature (27)..(27): Xaa can be any naturally occurring amino acid
  misc_feature (40)..(40): Xaa can be any naturally occurring amino acid
MAHHGXRLLVPXDVTKKPTQQKLXLHXRWHPDIPPVAQVXVGELFRVEMVDFSGGGITREYTAHDIKYADQSVVHYLSGPIRVVDEEGIPAKAGDLLAVEICNLGPLPGEEWGFTAIFDRENGGGFLTDHFPCATKAIWYFEGIYAYSPHIPGVRFPGLTHPGIIGTAPSMELLNIWNERERELEENGLKSLKLCEVLHSRPLANLPSTKGCVLGKIPEGSEEWEKIANEAARTIPGRENGGNCDIKNLSRGSKIYLPVFVEGANFSTGDMHFSQGDGEVSFCGAIEMSGFLELKCEIIRGGMKEYLTPMGPTPLHVNPIFEIGPVEPRFSEWLVFEGISVDESGRQHYLDASVAYKRAVLNAIDYLSKFGYSKEQVYLLLSCCPCEGRISGIVDAPNAVATLAIPTAIFDQDIRPKGNKLPIGPRVVRNPDIPRCTYDGNLPITKNPAATGS

SEQ ID NO: 4915 - protein, 452 aa, Tropaeolum majus
MAPPTPRVVVPIDLKKKPWEQKLPLHNRWHPQVPSVDDVITGEVFRVEMVDWTGGAISDNDSAADIKHIDLSTVHYLSGPIRILDEDGIPALPGDLLVVEICNLGPLPGDEWGFTATFDRENGGCFLTDHFPCATKAIWYFEGIYAYSPQIPGVRFPGLTHPGIIGTAPSMELLTIWNERERELEENGPQNLKLCEVLHQRPLANLPVTKGCSLGKIQEGAPTWDKIARAAARTIPGRENGGNCDIKNLSKGSKIYLPVFVEGANLSTGDMHFSQGDGEVSFCGGIEMSGFLELKCEIIRNGMKEYFTPMGPTALHVNPIFEIGPVEPRFSEWLVFEGISVDERGKQHYLDASVAYKRAVLNAIDYLSKFGYSKEQAYLLLSCCPCEGRISGIVDSPNAVATLAIPTSIFDQDIRPKPGKVPVGPRLMRKPDVMKCTYDGSLPMTKNPSAST

SEQ ID NO: 4916 - protein, 410 aa, Lippia dulcis
MVDWTAGAVSDDHSSALDVKTLDLSTVHYLSGPVRVVDTDGQPAKPGDLLAVEICNLGPLPGDEWGFTAIFDRENGGGFLTDHFPRATKAIWYFEGIYAYSPHIPGVRFPGLTHPGIVGTAPSMELLNIWNQRERELEETGPESLKLCEVLHSRPLANLPSTKGCVLGKIKEGTPEWERIAREAARTIPGRENGGNCDIKNLSRGSKVYLPVFVEGANLSTGDMHFSQGDGEVAFCGAIEMSGFLELKCEILRDGMKKYLTPMGPTTLHVNPIFEIGPVEPRFSEWLVFEGISVDESGRQHYLDASVAYKRAVLNAIDYISKFGYSKEQVYLLLSCCPCEGRISGIVDAPNAVATLAIPTAIFDQDIRPKKTDVPTGPRLVRNPGLPQCSYDGNLPTQKTLVLQPIITSN

SEQ ID NO: 4917 - protein, 452 aa, Prunus mume
MASYGPRLVVPIDVKKKPWEQKLPLHNRWHPDIPPVAEVTVGDVFRVEMVDFSGGGITKEYTAEDIKHANPSIVHYLSGPIRVLDKDGTPAKPGDLLAVEICNLGPLPGDEWGFTATFDRENGGGFLTDHFPCATKAIWYFEGIYAYSPQIPGVRFPGLTHPGIVGTAPSMELLNIWNERERELEENGLNSMKLCEVLHQRPLANLPSTKGCVLGGIKEGTPEWEKIALEAARTIPGRENGGNCDIKNLSSGSKIYLPVFIEGANLSTGDMHFSQGDGEISFCGAIEMSGFLELKCEIIRDGMKEYLTPMGPTPLHVNPIFEIGPVEPRFSEWLVFEGISVDESGKQHYLDATVAYKRAVLNAIDYLSKFGYSKEQSYLLLSCCPCEGRISGIVDSPNAIATLAIPTAIFDQDIRPRANKVPVGPRIVRKPDVLKCTYDGNLATTRNLSSAT

SEQ ID NO: 4918 - protein, 454 aa, Arabidopsis lyrata
MAPLSPRVVVKVDLKKKPWQQNQPLHNRWHPEIPPVAEVKAGEFFRVEMIDCMGGVVKDNDSASDIKNADLTTTHHLSGPIRVVDEDGVAAMPGDLLAVEICNLGPLPGDEWGFTGSFDRENGGGFLTDHFPCATKAIWYFEGIYAYSPQIPGVRFPGLTHPGVIGTAPSMELLRIWNERERQLEESGLKSPTLCEVVHQRPLANLPTAKGCLLGNIEEGTPEWERIANEAARTIPGRENGGNCDIKNLSRGSKIYLPVFVEGANLSTGDMHFSQGDGEISFCGAIEMSGFLELKCEIIRNGMQEYLTPMGPTPLHVNPIFEIGPVEPRFSEWLVFEGISVDESGRQHYLDATVAYKRAVLNAIDYLFKFGYSKEQVYLLLSCCPCEGRLSGIVDSPNAVATLAIPTAIFDQDIRPKTRKVPVGPRIVRKPDVLKSTYDGKLPITKNPSSSTSY

SEQ ID NO: 4919 - protein, 452 aa, Arabidopsis thaliana
MAPLSPRVVVKVDLKKKPWQQDQPLHNRWHPEIPPVAEVKAGEFFRVEMIDAMGGVIKDNDSASDIKNLVLTTTHHLSGPIRVVDEEGVAAKAGDLLAVEICNLGPLPGDEWGFTGSFDRENGGGFLTDHFPCATKAIWYFEGIYAYSPQIPGVRFPGLTHPGVIGTAPSNELLRIWNDRERQLEESGVESLTLCEVVHQRPLACLPTTKGCLLGNIEEGTPEWERIANEAARTIPGRENGGNCDIKNLSRGSKIYLPVFVEGANLSTGDMHFSQGDGEISFCGAIEMSGFLELKCEIIRNGMQEYLTPMGPTPLHVNPIFEIGPVEPRFSEWLVFEGISVDESGKQHYLDATVAYKRAVLNAIDYLFKFGYSKEQVYLLLSCCPCEGRLSGIVDSPNAVATLAIPTAIFDQDIRPKNRKVPVGPRVVRKPDVLKSTYDGKLPITKNPSSSS

SEQ ID NO: 4920 - protein, 157 aa, Flaveria ramosissima
MAQHGPRLVVPIDVTKKPREQKLPLHNRWHPDIPPVAEVCVGEVFRVEMVDFSGGGITREYTAHDIKYSDQSVVHYLSGPIRVVDDDGPARPGDLLAVEICNLGPLPGDEWGFTAILIEKMVVVFLLIISLVLQRLYGILKEYMLTLLIFQVYDFRA

SEQ ID NO: 4921 - protein, 320 aa, Orobanche aegyptiaca
MSGHGARLVVPIDVKKKPCEQALPLHNRWHPAIPPVAEVRTGELFRVEMVDFSGGGITKEYTAEDIKFADASIVHYLSGPIRVVDVDGKPAKPGDLLAVEICNLGPLPGDEWGFTAIFDRENGGGFLTDHFPCATKAIWYFEGIYAYSPHIPGVRFPGLTHPGIVGTAPSMELLSIWNERERELEENGLQSLKLCEVLHSRPLANLPSTKGCVLGKIKEGTPEWEKIANEAARTIPGRENGGNCDIKNLSRGSKVYLPVFVDGANLSTGDMHFSQGDGEVAFCGAIEMSGFLELKCEIIRWHEKVPHPNGPNSFTRQPDI

SEQ ID NO: 4922 - protein, 452 aa, Prunus persica
MASYGPRLVVPIDVKKKPWEQKLPLHNRWHPDIPPVAEVTVGDVFRVEMVDFSGGGITKEYTAEDIKHANPSIVHYLSGPIRVLDKDGTPAKPGDLLAVEICNLGPLPGDEWGFTATFDRENGGGFLTDHFPCATKAIWYFEGIYAYSPQIPGVRFPGLTHPGIVGTAPSMELLNIWNERERELEENGLNSMKLCEVLHQRPLANLPSTKGCVLGGIKEGTPEWEKIALEAARTIPGRENGGNCDIKNLSSGSKIYLPVFIEGANLSTGDMHFSQGDGEISFCGAIEMSGFLELKCEIIRDGMKEYLTPMGPTPLHVNPIFEIGPVEPRFSEWLVFEGISVDESGKQHYLDATVAYKRAVLNAIDYLSKFGYSKEQSYLLLSCCPCEGRISGIVDSPNAIATLAIPTAIFDQDIRPRANKVPVGPRIVRKPDVLKCTYDGSLATTRNPSSAT

SEQ ID NO: 4923 - protein, 453 aa, Fragaria vesca
MAASYGARLVVPIDVKKKPWEQELPLHNRWHPDIPPVAEATVGEVFRVEMVDFSGGGITKEYTAEDIKNANPSIVHYLSGPIRISDKDGIPAQPGDLLVVEICNLGPLPGDEWGFTATFDRENGGGFLTDHFPCATKAIWYFEGIYAYSPQIPGVRFPGLTHPGIVGTAPSMELLNIWNKRERELEENGVESLKLCEVVHQRPLASLPSTKGCVLGGIKEGTPEWEKIAVEAARTIPGRENGGNCDIKNLSRGSKVYLPVFVEGANLSTGDMHFSQGDGEISFCGAIEMSGFLELKCDIIRDGMKEYLTPMGPTPLHVNPIFEIGPVEPRFSEWLVFEGISVDESGKQHYLDATVAYKRAVLNAIDYLSKFGYSKEQSYLLLSCCPCEGRISGIVDAPNAVATLAIPIAIFDQDIRPKTNKVPVGPRIVRTPDVLKCTYDGNLPTTRNPSAAT

SEQ ID NO: 4924 - protein, 452 aa, Eutrema halophilum
MAPASPRVVVKVDLKKKPWQQNQPLHNRWHPEIQPVAEVKVGELFRVEMVDWTGGAVKDDGSADDIKSIDLSTVHYLSGPIKVVDEDGVAAKPGDLLVVEICNLGPLPGDEWGFTGSFDRENGGGFLTDHFPCATKAIWYFEGIYAYSPQIPGVRFPGLTHPGIIGTAPTKELLRIWNERERQLEESGVKSLTLCEVVHQRPLANLPTSKGCLLGNIEEGTVEWERVAKEAARTIPGRENGGNCDIKNLSRGSKIYLPVFVEGANLSTGDMHFSQGDGEISFCGAIEMSGFLELKCEIIRNGMQEYLTPMGPTPLHVNPIFEIGPVEPRFSEWLVFEGISVDESGRQHYLDATVAYKRAVLNAIDYLFKFGYSKEQVYLLLSCFPCEGRISGIVDSPNAVATLAIPTAIFDQDIRPKTRNVPVGPRILRKPDVLKSTYDGKLAITKNPNSSS

SEQ ID NO: 4925 - protein, 452 aa, Tripterygium wilfordii
MAQHGARLVIPIDVKKKPWEQKLALHNRWHPEIPPVVDVTVGEVFRVEMMDFSGGGITQEYSAEDIKTADNSIVHYLSGPIKVIDKDGIPAKPGDLLVVEICNLGPLPGDEWGYTATFDRENGGGFLTDHFPCATKAIWYFEGIYAYSPHIPGVRFPGLTHPGIIGTAPSMELLNIWNERERELEENGLQSMKLCEVLHSRPLANLPSTKGCRLGKIQEGTPEWEKIAREAARTIPGRENGGNCDIKNLSRGSKVYLPVFVEGANLSTGDMHFSQGDGEVSFCGAIEMSGFLELKCDIIKGGMKEYLTPMGPTSLHVNPIFEIGPVEPRFSEWLVFEGISVDETGRQHYLDATVAYKRAVLNAIDYLSKFGYSKEQAYLLLSCCPCEGRISGIVDSPNAVATLAIPTSIFDQDIRPKTSKVPVGPHLVRKPDVLKCTYDGKLTTTKNPSATT

SEQ ID NO: 4926 - protein, 454 aa, Triphysaria pusilla
MSTNNHGARLVVPIDVKKKPSEQKHPLHNRWHPEIPAVAEVQTGELFRVEMVDFSGGGITKEYTAEDIKFADASIVHYLSGPIRVVDTDGRPAKPGDLLVVEICNLGPLPGDEWGFTAIFDRENGGGFLTDHFPCATKAIWYFQGIYAYSPHIPGVRFPGLTHPGIVGTAPSMELLNIWNERERELEETGHQSLKLCEVLHSRPLANLPSTKGCVLGKIKEDNPEWERIANEAARTIPGRENGGNCDIKNLSRGSKVYLPVFVDGANLSTGDMHFSQGDGEVAFCGAIEMSGFLELKCEIIRDGMKKYLTPMGPTTLHVNPIFEIGPVEPRFSEWLVFEGISVDESGRQHFLDASVAYKRAVLNAIDYISKFGYSKEQVYLLLSCCPCEGRISGIVDAPNAVATLAIPLAIFDQDIRPKISDVPTGPRVVRNPGLPQCSYDGNLPITKNPCTTK

SEQ ID NO: 4927 - protein, 251 aa, Olea europaea
MEASRGCRVVVPIDLKKKPREQKLPLHNRWHPDIPPVAEVRTGEVFRVEMVDFSGGGITKEYTAEDIKYADPSIVHYLSGPIRVLDVDGNPAKPGDLLAVEICNLGPLPGDEWGFTAIFDRENGGGFLTDHFPCATKAIWYFEGIYAYSPHIPGVRFPGLTHPGIVGTAPSMELLNIWNEREREVEETGLQSLKLCEVLHSRPLANLPSTKGCFLGKIEEGTPEWERIAREAARTIPGRENGGNCDIQKSR

SEQ ID NO: 4928 - protein, 452 aa, Eucalyptus grandis
MAQRHGPRLVIPIDVKKKPHEQALPLHNRWHPEIPPVAEVRTGEFFRVEMVDFSGGGITREYTIDDIKHANMSIVHYLSGPIRVLDTDGIPAKPGDLLAVEICNLGPLPGDEWGFTATFDRENGGGFLTDHFPSATKAIWYFEGIYAYSPQIPGVRFPGLTHPGIVGTAPSKELLKIWNDREREVEENGLQTLKLCEVLHSRPLANLPSTKGCVLGKIQGDTPEWERIAREAARTIPGRENGGNCDIKNLSRGSKVYLPVFVEGANLSTGDMHFSQGDGEVSFCGAIEMSGFLELKCEIIRGGMKEYLTPMGPTLLHVNPIFEIGPVEPRFSEWLVFEGISVDESGRQHYLDASVAYKRAVLNAIDYLSKFGYSKEQMYLLLSCCPCEGRISGIVDSPNAVATLAIPTSIFDQDIRPKNKIPVGPRLVRKPDVLKCTYDGNLPITKNLSATM

SEQ ID NO: 4929 - protein, 126 aa, Fagopyrum esculentum
MGSHGARMVIPIDLKKKPWEQKHRLHNRWHPEIPAVAEVKVGEVFRVEMMDFTGGRITSDFSADDVKNADPSIVHYLSGPIRVSDANGLPAHPGDLLVVEICNLGPLPGDEWGYTATFDRENGGDS

SEQ ID NO: 4930 - protein, 453 aa, Fraxinus spp
MESSHGCRVVVPIDLKKKPRQQKPPLHNRWHPDIPPVAEVRTGEVFRVEMVDFSGGGITKEYTAEDIKYADPSIVHYLSGPIRILDVDGNPAKPGDLLVVEICNLGPLPGDEWGFTAIFDRENGGGFLTDHFPCATKAIWYFEGIYAYSPHIPGVRFPGLTHPGIVGTAPSMELLNIWNERERELEETGLQSLKLCEVLHSRPLANLPSTKGCFLGKIEEGTPEWERIAQEAARTIPGRENGGNCDIKNLSRGSKVYLPVFVDGANLSTGDMHFSQGDGEVAFCGAIEMSGFLELKCEIIRDGMKEYLTPMGPTPLHVNPIFEIGPVEPRFSEWLVFEGISVDESGRQHFLDASVAYKRAVLNAIDYLSRFGYTKEQVYLLLSCCPCEGRISGIVDSPNALATLAIPTSIFDQDIRPKTNKVPIGPRLVRNPNIPQCSYDGKLPTTKNPCATT

SEQ ID NO: 4931 - protein, 452 aa, Medicago truncatula
MARYGSRMLVPVDLKKKPWEQELPLHNRWHPDIPPVAEATTGELFRVEMIDFSGGAITKNYTAEDAKYVDLSAVHHLSGPIRIVDSDGIPAQPGDLLAVEICNLGPLPGDEWGFTATFDRENGGGFLTDHFPYATKAIWYFEGIYAYSPQIPGVRFPGITHPGIIGTAPSMELLNIWNERERDVAENGIHSLKLCEVLHSRPLANLPTEKSCLLGKIEKDTDEWEKIAREAARTIPGRENGGNCDIKNLSRGSKVYLPVFVEGANLSTGDMHFSQGDGEVSLCGAIEMSGFLELKCEIIRGGMKEYLTPMGPTPLHVNPIFEIGPVEPRFSEWLVFEGISVDESGRQHYLDASVAYKRAVLNAIDYISKFGYSKEQVYLLLSCCPCEGRISGIVDAPNACATLAIPTAIFDQDIRPKNNKVPIGPRLVKKPDVFKCTYDGNLPITKNLSASS

SEQ ID NO: 4932 - protein, 452 aa, Vinca minor
MASHGARLVIPIDVKKKPREQKLPLHNRWHPDIPPVVEVKTGELFRVEMVDFSGGAITQDFTAHDIKHADPSIVHYLSGPIRVTDAEGIPAKPGDLLAVEICNLGPLPGDEWGFTAIFDREHGGGFLTDHFPNATKAIWYFEGIYAYSPHIPGVRFPGLTHPGIIGTAPSMELLTIWNDRERTLEETGHQTFKLCEVLHARPLANLPSTKGCYLGKIQEGTPDWEKIAREAARTIPGRENGGNCDIKNLSRGSKVYLPVFVEGANLSTGDMHFSQGDGEVAFCGAIEMSGFLELKCEIIRNGMKEYLTPMGPTPLHVNPIFEIGPVEPRFSEWLVFEGISVDESGRQHFLDASVAYKRAVLNAIDYLSKFGYSKEQVYLLLSCCPCEGRISGIVDSPNAVATLAVPISIFDQDIRPKTNKVPSGPRIVRNPGLPQCPYEGNLPTTKNPCPAV

SEQ ID NO: 4933 - protein, 452 aa, Phaseolus vulgaris
GSLWSKIGGAHRLEEETVAAEKPSSQPLASRYTTGCRVAITAGEVFRVEMVDFSGGAITKNHTAHDVKHVDPLTVHYLSGPIRILDNDGIPAKPGDLLAVEICNLGPLPGDEWGFTATFDRENGGGFLTDHFPCATKAIWYFQGIYAHSPQIPGVRFPGLTHPGIIGTAPSMELLNIWNERERDIEENGVKSFKLCEVLHTRPLANLPSTKSCLLGKIEKGTSEWERIAKEAARTIPGRENGGNCDIKNLSRGAKVYLPVFVEGANLSTGDMHFSQGDGEVSFCGAIEMSGFLELKCEIIRGGMKEYLTPMGPTPLHVNPIFEIGPVEPRFSEWLVFEGISVDESGRQHYLDASVAYKRAVLNGIDYLSKFGYSKEQVYLLLSCIPCEGRISGIVDAPNAVATLAIPTAIFDQDIRPKINKVPVGPRLVRKPDVFKCSYDGNLPITKNPSTT

SEQ ID NO: 4934 - protein, 403 aa, Phaseolus vulgaris
MVDFSGGAITKNHTAHDVKHVDPLTVHYLSGPIRILDNDGIPAKPGDLLAVEICNLGPLPGDEWGFTATFDRENGGGFLTDHFPCATKAIWYFQGIYAHSPQIPGVRFPGLTHPGIIGTAPSMELLNIWNERERDIEENGVKSFKLCEVLHTRPLANLPSTKSCLLGKIEKGTSEWERIAKEAARTIPGRENGGNCDIKNLSRGAKVYLPVFVEGANLSTGDMHFSQGDGEVSFCGAIEMSGFLELKCEIIRGGMKEYLTPMGPTPLHVNPIFEIGPVEPRFSEWLVFEGISVDESGRQHYLDASVAYKRAVLNGIDYLSKFGYSKEQVYLLLSCIPCEGRISGIVDAPNAVATLAIPTAIFDQDIRPKINKVPVGPRLVRKPDVFKCSYDGNLPITKNPSTT

SEQ ID NO: 4935 - protein, 453 aa, Olea europaea
MEASRGCSVVVPIDLKKKPREQKLPLHNRWHPDIPPVAEVRTGEVFRVEMVDCSGGGITKEYTAEDIKYADLSIVHYLSGPIRVLDVDGNPAKPGDLLAVEICNLGPLPGDEWGFTAIFDRENGGGFLTDHFPCATKAIWYFEGIYAYSPHIPGVRFPGLTHPGVVGTAPSMELLNIWNEREREVEETGLQSLKLCEVLHSRPLANLPSTKGCFLGKIEEGAPEWERIAREAARTIPGRENGGNCDIKNLSRGSKVYLPVFVDGANLSTGDMHFSQGDGEVAFCGAIEMSGFLELKCEIIRDGMKEYLTPMGPTPLHVNPIFEIGPVEPRFSEWLVFEGISVDESGRQHFLDASVAYKRAVLNAIDYLSRFGYTKEQVYLLLSCCPCEGRISGIVDSPNALATLAIPTSIFDQDIRPKINKVPKGPRLVRNPNIPQCSYDGKLPTTKNPSATT

SEQ ID NO: 4936 - protein, 454 aa, Brassica rapa
MAPATPRVVVKVDLKKRPWEQEQPLHNRWHPEIQPVGEVKAGEFFRVEMVDWTGGAVKDDDSAEDIKSLDLSTVHYLSGPIKVVDEEGVAAKPGDLLAVEICNLGPLPGDEWGFTASFDRENGGGFLTDHFPCATKAIWYFEGIYAYSPQIPGVRFPGLTHPGIIGTAPSKELLRIWNERERQLEESGLSSLTLCEVVHQRPLANLPIAKGCLLGNMEEGTPEWERIAKEAARTIPGRENGGNCDIKNLSRGSKIYLPVFVEGANLSTGDMHFSQGDGEISFCGAIEMSGFLELKCEIIRNGMKEYLTPMGPTPLHVNPIFEIGPVEPRFSEWLVFEGISVDETGRQHYLDATVAYKRAVLNAIDYLFKFGYSKEQVYLLLSCCPCEGRISGIVDSPNALATLAIPTSIFDQDIRPKTQKVPAGPRIVRKPDVMKSTYDGKLETTRNPSSSSYS

SEQ ID NO: 4937 - protein, 447 aa, Cichorium intybus
VRLVIPIDVTKKPRQQKLPLHNRWHPDIPPVAEVTVGEVFRVEMVDFSGGGITKEYTAEDIKYADQSVVHYLSGPIRVVDEEGIAAKPGDILAVEICNLGPLPGDEWGFTAIFDRENGGGFLTDHFPCATKAIWYFEGIYASSPHIPGVRFPGITHPGIIGTAPSMELLNIWNERERDLEENGLKSLKLCEVLHSRPLANLPSTKGCLLGKIPEGTQEWEKIANEAARTIPGRENGGNCDIKNLSRGSKIYLPVFVEGANFSTGDMHFSQGDGEVSFCGAIEMSGFLELKCEIIRGGMKEYLTPMGPTPLHVNPIFEIGPMEPRFSEWLVFEGISVDESGRQHYLDASVAYKRAVLNAIDYLSKFGYSKEQVYLLLSCCPCEGRISGIVDAPNAVATLAIPLAIFDQDIRPKSNKVPVGPRVVRNPDIPRCSYDGNLPITKNPGATG

SEQ ID NO: 4938 - protein, 452 aa, Cajanus cajan
MARYGPTLVVPIDLKKKPWEQKHPLHNRWHPDIPPVAEVKADQLFRVEMIDFSGGAITNNHTAHDVKHVDPLTVHYLSGPIRILDNDGIPAKPGDLLAVEICNLGPLPGDEWGFTATFDRENGGGFLTDHFPCATKAIWYFEGIYAHSPQIPGVRFPGLTHPGIIGTAPSMELLNIWNERETDVEENGIKSFKLCEVLHSRPLANLPSTKSCLLGKIQKGTTEWEKIAKEAARTIPGRENGGNCDIKNLSRGAKVYLPVFVEGANLSTGDMHFSQGDGEVSFCGAIEMSGFLELKCEIIRGGMKEYLTPMGPTPLHVNPIFEIGPVEPRFSEWLVFEGISVDESGRQHYLDASVAYKRAVLNAIDYISKFGYSKEQVYLLLSCIPCEGRISGIVDAPNAVATLAIPTAIFDQDIRPKNNKVPVGPRLVKKPDVFKCTYDGNLPITRNPSATP

SEQ ID NO: 4939 - protein, 451 aa, Theobroma cacao
MAPTPRLVVPIDLKKKPWEQTLPLHNRWHPEIPSVADVEVGEVFRVEMVDWTGGIIKDDDSATDVKFIDLSTVHYLSGPIRVVDKDGIPAKPGDLLAVEICNLGPLPGDEWGYTATFDRENGGGFLTDHFPCATKAIWYFEGIYAYSPHIPGVRFPGLTHPGIIGTAPSMELLNIWNEREREVEENGHKSLKLCEVLHSRPLANLPSTKGCHLGKITKGTAEWEKIAKEAARTIPGRENGGNCDIKNLSRGSKIYLPVFVEGANFSTGDMHFSQGDGEVAFCGAIEMSGFLELKCEIIRDGMKEYLTPMGPTPLHVNPIFEIGPVEPRFSEWLVFEGISVDETGRQHFLDASVAYKRAVLNAIDYLSKFGYSKEQIYLLLSCCPCEGRISGIVDSPNALATLAIPTAIFDQDIRPKTGKVPVGPRLVRKPDVLRCTYDGNLPTTKNPAALM

SEQ ID NO: 4940 - protein, 422 aa, Catharanthus roseus
SRVGMGMGTRLVIPIDVKKKPREQKLPLHNRWHPDIPPVTEVTTGEVFRVEMVDFSGGGITQEFTAQDIKHVDNSIVHYLSGPIRVTDVDGIPAKPGDLLAVEICNLGPLPGDEWGFTAIFDRENGGGFLTDHFPHATKAIWYFEGIYAYSPHIPGVRFPGLTHPGIIGTAPSIELLTIWNERERTLEETGHQSLKLCEVLHARPLANLPSTKGCYLGKIQEGTPEWEKMAREAARTIPGRENGGNCDIKNLSRGSKIYLPVFVEGANLSTGDMHFSQGDGEVAFCGAIEMSGFLELKCEIIRNGMKEYLTPMGPTPLHVNPIFEIGPVEPRFSEWLVFEGISVDESGRQHFLDASVAYKRAVLNAIDYLSKFGYSKEQVYLLLSCCPCEGRISGIVDSPQCCCHPCCSNCIFVPGYSSQNK

SEQ ID NO: 4941 - protein, 86 aa, Fraxinus spp
MESSHGCRVVVPIDLKKKPREQKPPLHNRWHPDIPPVAEVRTGEVFRVEMVDFSGGGIQKSTLLKTSSMQIPLLCIILVDLLEFLM

SEQ ID NO: 4942 - protein, 452 aa, Aquilegia formosa
MAPGTPKLVVPIDLKKKPWEQKVPLHNRWHPHIPAVTEVTVGDFFRVEMVDWTGGVIQDNDSAMDVKSINLSTVHYLSGPIRVVDTDGIPAKPGDLLAVEICNLGPLPGDEWGYTATFDRENGGGFLTDHFPCATKAIWYFEGIYTYSPQIPGVRFPGLTHPGIIGTAPSMELLNVWNERERELEKNGLQSLKLCDVLHTRPLANLPTAEGCHLGLVKADTSEWANIASEAARTIPGRENGGNCDIKNLSKGSKIYLPVFVEGANFSTGDMHFSQGDGEVSFCGAIEMSGFLELKCDIIRNGMREYLTPMGPTPLHVNPIFEIGPVEPRFSEWLVFEGISVDESGKQHYLDATVAYKRAVLNAIDYLSRFGYSKEQIYLLLSCCPCEGRISGIVDSPNACATLAIPTAIFDQDIRPKSSKVPVGPRVVKKPDVLKCTYDGNLPVTKNPGGAT

SEQ ID NO: 4943 - protein, 504 aa, Triticum aestivum
MKPKVAAAAAGGEKGRGVDPSLPRFKCQECHRALVVVGVESFPDRLPAHANSGIHASSVQGSIMGASRMDSSYVVLSKQNRSQGPGIPPRPPSAAARHVEPNQSTRAIEGSYIMLPPAAASIYKTSTSEGGGAHLSPPNVNSTSPSPGNNSGFHSSVTVLKRAFEIASSQTQVEQPLCLECMRVLSDKMDKEIEDVNTDIKAYDACLQRLEQESYNVLSETDFLKEKEKIEEEEKKLKAAIEEAEKQYSEVSSEMKDLETKSKQFEELEERYWHEFNSFQFQLTSHQEERDAVLAKIEVSQVHLELLKRTNVLNDAFYISHDGVIGTINNFRLGRLPNVQVEWDEINAAWGQAALLLHTMAQYFPKFQYRIKIHPMGSYPRVTDINNNTYELFGPVNLFWSTRFDKAMTWFLTCLQEFSEFAISLDKENNVPSDKSLKLPYKIDGDKVGSYTIFLSFNKLENWTKALKYMLCNLKWVLYWFIGNTSFAPPSASLYLAQSPNKKG

SEQ ID NO: 4944 - protein, 491 aa, Triticum aestivum
KGRGVDPSLPRFKCQECHRALLVVGVESFPDRLPAHANSGMHASSVQGSIMGASRMDSSYVVLSKQNRSQGPGIPPRPPNAAARHVEPNQSTRAIEGSYIMLPPAAASIYKTSTSEGGGAHLSPPNLNSTSPSPGNNTGFHSSVTVLKRAFEIASSQTQVEQPLCLECMRVLSDKMDKEIEDVNTDIKAYDACLQRLEQESYNVLSETDFLKEKEKIEEEEKKLKTAIEEAEKQYSEVSSEMKDLETKSKQFEELEERYWHEFNSFQFQLTSHQEERDAVLAKIEVSQVHLELLKRTNVLNDAFYISHDGVIGTINNFRLGRLPNVQVEWDEINAAWGQAALLLHTMAQYFPKFQYRIKIHPMGSYPRVTDINNNTYELFGPVNLFWSTRFDKAMTWFLTCLQEFSEFAISLDKENNVPADKSLKLPYKIDGDKVGSYTIFLSFNKLENWTKALKYMLCNLKWVLYWFIGNTSFAPPSASLYLAQSPNKKG

SEQ ID NO: 4945 - protein, 502 aa, Brachypodium distachyon
MKPKAAGGGGDKGRGVDPSLPRFKCQECHRALVVIGVESFADRLPAHANSGMHASSVQGSIMGASRMDSSYVVLSKQNKSPGPGIPPRPPSAAARHVEPNQSTRAIEGSYIMLPPAAASIYNTSASEGGGAHLPPPNLNSTSPSPGNNSGFHSSVTVLKRAFEIASSQTQVEQPLCLECMRVLSDKMDKEVEDVNTDIKSYDACLQRLEQESYNILSDADFHKEKQKIEEEEKKLKAAIEEVEKQYSEVTSEMKDLETKSKQFEELEERYWHEFNSFQFQLTSHQEERDAVLAKIEVSQVHLELLKRTNVLNDAFYISHDGVIGTINNFRLGRLPNVQVEWDEINAAWGQAALLLHTMAQYFPKFQYRIKIHPMGSYPRVTDINNNTYELFGPVNLFWSTRFDKAMTWFLTCLQEFAEFAISLDQENNVPSDKSLKLPYKIDNDKVGSHTIFLSFNKLESWTKALKYMLCNLKWVLYWFIGNTSFAPPSASLYLAQSPNKTS

SEQ ID NO: 4946 - protein, 500 aa, Setaria italica
MKPPAAAGKGGAVDPSLPRFRCQECRRALVVVGVDSYADRLPAHAASGNHASSVQGSVMGASRMENSYVVLSRQNRSQGPRIPPRPPSAAAPHTEPSQPTRAIEGSYIVLPPPAASIYKTPASEGGGAQLTPPGVNSSSPSPGNNSGFHSSVTVLKRAFEIASSQTQVEQPLCLECMRVLSDKMDKEIEDVNADIKAYEASLQRLEQEPYNILSETDFQKEKQKIEEEEKKLKAAIEEAEKLYSEVTSEMKDLEIKSKQFEELEERYWHEFNSFQFQLKSHQEERDAVFAKIEVSQVHLELLKRTNVLNDAFYISHDGVIGTINNFRLGRLSNVEVEWDEINAAWGQAALLLHTMAQYFTPKFQYRIKIHPMGSYPRVTDIHNNTYELFGPVNLFWSTRFDKAMTWFLTCLQEFAEFAVSLDKENNVPSEKSLKLPYKIDGDKVGSHTIVLSFNKNENWTKALKYMLCNLKWVLYWFIGNTSFAPPSGPVRAQSLKNKSS

SEQ ID NO: 4947 - protein, 499 aa, Zea mays
MKPPAGASGKGGAVDPSLPRFRCQECRRALVVVGVESYADRLPAHAAPGNHASSVQGSVMGASKMDNSYVVLSRQNKSQGPRIPPRPPSAAAAHADPSQSTRAIEGSYIVLPPPAASIYRTSASEGGAQLTPSGVISSSPSLGNNSGFHSSVTVLKRAFEIASSQTQVEQPLCLECMRVLSDKMDKEIEDVNADIKAYEACLQRLEQEPYNILSETDFQKEKQKIEEEEKKLKAAIEEAEKQYSEVRSEMENLEIKSKQFEELEERYWHEFNSFQFQLTSHQEERDAVFAKIEVSQVHLELLKRTNVLNDAFYISHDGVIGTINNFRLGRLSNVEVEWDEINAAWGQAALLLHTMAQYFTPKFQYRIKIHPMGSYPRVTDIQNNTYELFGPVNLFWSTRFDKAMTWFLTCLQEFAEFAISLDKQNNVPPEKSLKLPYKIDGDKVGSHTIVLSFNKNENWTKALKYMLCNLKWVLYWFIGNTSFAPPSVSLHTQSLKNKS

SEQ ID NO: 4948 - protein, 500 aa, Sorghum bicolor
MKPPAGSSGKGGAVDPSLPRFRCQECRRALVVVGVDSYADRLPAHAAPGNHASSVQGSVMGASKMDNSYVVLSRQNKSQGPRIPPRPPSAAAVHTDPIQSTRAIEGSYIVLPPPAASIYKTPASEGGGAQLTAPGVNSSSPSQGNNSGFHSSVTVLKRAFEIASSQTQVEQPLCLECMRVLSDKMDKEIEDVNADIKSYEACLQRLEQEPYNILSETDFQKEKQKIEEEENKLKAAIEEAEKQYSEVSSEMKDLEIKSKQFEELEERYWHEFNSFQFQLASHQEERDAVFAKIEVSQVHLELLKRTNVLNDAFYISHDGVIGTINNFRLGRLSNVEVEWDEINAAWGQAALLLHTMAQYFTPKFQYRIKIHPMGSYPRVTDIHNNTYELFGPVNLFWSTRFDKAMTWFLTCLQEFAEFAISLDKENNVPPEKSLKLPYKIDGDKVGSHTIVLSFNKNENWTKALKYMLCNLKWVLYWFIGNTSFAPHSGSLHTQSLKNKS

SEQ ID NO: 4949 - protein, 501 aa, Oryza sativa
MKPPASSAAAAGDKGGGVDPSLPRFKCQECQRALVVVGVESFTDKLPAHAVSGMNVSSVQGSVMGASRMDNSYVVLSKQNRSHSHGIPPRPPSAGIPRAEPNQPTRAMEGSYIVLPPAAASIYKTSASEGGGAQLSPTSMNPGSPLPGNNFHSSVTVLKRAFEIATSQTQIEQPLCLDCMRLLSDKMEKEIEDVNTDNKAYEACLQRLEQETYNILSETDFQKERQKIEEEEKKLKAAIEEAEKQYSEICSEMKCLETKSKQFEELEERYCHDLNSFQFQWISHQEERDAVLAKIEVSQVHLELLKRTNVLNDAFYISHDGVIGTINNFRLGRLPNVQVEWDEINAAWGQAALLLHTMAQYFFPKFEYRIKIHPMGSYPKVTDINQNTYELFGPVNLFWSTRFDKAMTWFLTCLQEFADFAVSLDKENNVPPDKSLKLPYKIEGDKVGSYTIFLSFNKLDNWTKALKYMLCNLKWVLYWFIGNTSFAPPSGSLHVAQSSKG

SEQ ID NO: 4950 - protein, 501 aa, Panicum virgatum
MKPPAAATGGKGGAVDPSLPRFRCQECRRALVVVGVDSYSDRIPPHAAAGNHAPSVQGSVMGASRMDNSYVVLSRQNRSQGPGIPPRPPIAAAPHTEPNQSTRAIEGSYIVLPPPAASIYKTPASEKGGAQLTPPGVNSSSPSPGNNSGFHSSVTVLKRAFEIASSQTQVEQPLCLECMRVLSDKMDKEIEDVNADIKAYEACLQRLEQEPYSILSETDFQKEKQKIEEEEKKLKAAIEEAEKLYSEVSSEMKDLEIKSKQFEELEERYWHEFNSFQFQLTSHQEERDAIFARIEVSQVHLELLKRTNVLNDAFYISHDGVIGTINNFRLGRLSNVEVEWDEINAAWGQAALLLHTMAQYFTPKFQYRIKIHPMGSYPRVTDIHNNTYELFGPVNLFWSTRFDKAMTWFLTCLQEFAEFAINLDKENNIPPEKSLKFPYKIDGDKVGSHTIVLSFNKNENWTKALKYMLCNLKWVLYWFIGNTSFAPPSGPVHIQSLRNKN

SEQ ID NO: 4951 - protein, 501 aa, Panicum virgatum
MKPPAAASGGKGGTVDPSLPRFRCQECRRALVVVGVDSYADRLPPHAAAGNHAPSVQGSVMGASRMDNSYVVLSRQNRSQGPGIPPLPPTAAAPHTEPNQSTRVIEGSYIVLPPPAASIYKTPASEGGGAQLTTPGVNSSNHSPGNNSGFHSSVTVLKRAFEIASSQTQVEQPLCLECMRILSDKMDKEIEDVNADIKAYEACLQRLEQEPYDILSETDFQKEKQKIEEEEKKLKAAIEEAEKLYSEVSSEMKDLEIKSKQFEELEERYWHEFNSFQFQLTSHQEERDAVFAKIEVSQVHLELLKRTNVLNDAFHISHDGVIGTINNFRLGRLSNGEVEWDEINAAWGQAALLLHTMAQYFTPKFQYRIKIHPMGSYPRVTDIHNNTYELFGPVNLFWSTRFDKAMTWFLTCLQEFAEFAINLDKENNVPPEKSLKLPYKIDGDKVGSHTIVLSFNKDENWTKALKYMLCNLKWVLYWFIGNTSFAPPSGPVHTQSLRNKN

SEQ ID NO: 4952 - protein, 500 aa, Oryza sativa
MKAPAAAAAAVGNRAGGVDPSIPRFKCQECHRALVVVGVDSFADKLPAQATSAHASSVHGSIMGASRMDNSYVVLSKQNKSHGHGIPPRPPSAAAPHIEPNQPTRAMEGSYIVLPPAAASIYKTSTSEGGGAQLPPPSINSSSLLPGNSFHSNVTVLKRAFEIATSQTQVEQPMCLDCMRLLSDKMDKEIEDVNADIKAYEVCLQHLEQESHTVLSDAGFQKEKLKIEEEEKKLNAAIEEAEKQYSEISSEMKDLEIKSKEFEELEERYWHEFNSFQFQLTSHQEERDAILAKIEVSQVHLELLKQTNVLNDAFYISHDGVIGTINNFRLGRLPNVQVEWDEINAAWGQAALLLHTMAQYFTPKFEYRIKIHPMGSYPRVTDIHKNTYELFGPVNLFWSTRFDKAMTWFLTCLQDFAEFAISLDKENNVPPEKSLKLPYKIDGDKVGSHTIFLSFNKVENWTKALKYTLCNLKWVLYWFIGNTSFAPPSGSLCAAQSSKR

SEQ ID NO: 4953 - protein, 479 aa, Saccharum officinarum
MKPPAGGSGKGGAVDPSLPRFRCQECRRALVVVGVESYADRLPAHAAPGNHASSVQGSVMGASKMDNSYVVLSRQNKSQGPRIPPRPPSAAAAHTDPSQSTRAIEGSYIVLPPPAASIYKTPASEGGGAQLTAPSGNSNNPSQGNNSGFHSSVTVLKRAFEIASSQTQVEQPLCLECMRVLSDKMDKEIEDVNADIKAYEACLQRLEQEPYNILSEADFQKEKQKIEEEEKKLKAAIEEAEKQYSEVSSEMKDLEIKSKQFEELEERYWHELNSFQFQLTSHQEERDAVFAKIEVSQVHLELLKRTNVLNDAFYISHDGVIGTINNFRLGRLSNVEVEWDEINAAWGQAALLLHTMAQYFTPKFQYRIKIHPMGSYPRVTDIHNNTYELFGPVNLFWSTRFDKAMTWFLTCLQEFAEFAIRLDKENNVPPEKALKLPYKIDGDKVGSHTIVLSFNKNENLTKALKYMLCNLKWVLYWFI

SEQ ID NO: 4954 - protein, 500 aa, Zea mays
MKPTAGASGKGGAVYPSLPRLKCQECRRALVVVGVESYADRLPAHAAPGNHASSVQDSVMGASKMDNSYVVLSRQNKVQGPRIPPRPGSAVAAHTDPNQSTRAIEGSYIVLPPPSASIYKKSASEGGGAQLTPPGGNSSSPLSGNNSGFHSSVTVLKRAFEVASSQTQVEQPLCLECMRVLSDKMDKEIEDCNADIKSYEACLQRLQQEPYNILSETDFQKEKQKIEEEEKKLKCAIEEAEKQYSEVSSEMKDLEIKSKQFEELEERYWHEFNSFQFQLTSHQEERDAVFAKIGVSQVHLEMLKHTNVLNDAFYISCDEVIARINNFRLGRLPNVEVEWDEINVAWGQAALLLHTMAHYFTPKFRYRIKIHPMGSYPRVTDIHNHTYELFGPVNLFWSTRFDKAMTWFLTCLQEFAEFAISLDKENNVPPEKTLKLPHKIDGDKVGNHTIVLSFNQDETWTKALKYMLYDLKFVLSWFIGNTSFAPPSRSLHTQFLKNKS

SEQ ID NO: 4955 - protein, 107 aa, Secale cereale
MDTSAPSPFVNGETLKTFLGRRVRTVVQVQHNEGGVLLGLSTDGQQLTIRGAPGAPEPPHYIEVIGIADSSLSIRAESCTDFGENFDGVAFNGLCKLANDKYKYLFL

SEQ ID NO: 4956 - protein, 107 aa, Triticum aestivum
MDTSAPSPFVNGETLKMFLGRRVRTVVQVQHNEGGVLLGLSTDGHQLTIRGASGAPEPPHYIEVIGIADSSLSIRAESCTDFGENFDGVAFNGLCKLANDKYNYLFL

SEQ ID NO: 4957 - protein, 107 aa, Triticum aestivum
MDTSAPSPFVNGETLKMFPGRRVRTVVQVQHNEGGVLLGLSTDGHQLTIRGATGAPEPPHYIEVIGIADSSLSIRAESCTDFGENFDGVAFNGLCKLANDKYKYLFL

SEQ ID NO: 4958 - protein, 107 aa, Triticum aestivum
MDTSAPSPFVNGETLKTFPGRRVRTVVQVQHNEGGVLLGLSTDGHQLTIRGASGAPEPPHYIEVIGIADSSLSIRAESCTDFGENFDGVAFNGLCKLANDKYKYLFL

SEQ ID NO: 4959 - protein, 107 aa, Festuca arundinacea
  misc_feature (65)..(65): Xaa can be any naturally occurring amino acid
MDTSVPSPFVNGETLKMFVGRRVRTVVQVQRNESGVLVVQSTDGHQLTIRGAPGAPEAPHYIEVXGIPDSNQSIRAESWTDFGENFDPVPFNGLCKLASDKYKYLFL

SEQ ID NO: 4960 - protein, 107 aa, Avena sativa
MDTSVPSPFVNGETLKMFVGRRVRTVVQVQRNESGVLAVQSTDGHQLTIRGAPDAPEAPHYIEVMGIPDSNQSIRAESWTDFGENFDVVPFNGLCKLANDKYKYLFL

SEQ ID NO: 4961 - protein, 303 aa, Brachypodium distachyon
MLSLARRPLSAAVPVGNLLGIHLFQCPDAVGIVAKLSECIATRGGNIHSVDVFVPDDKPVFYARSEFTYNPRLWPRDELGADFLHLSNHFKAQKSTVRVPDLDPKYKISVLASKQDHCLFDLLHRWQEGRLPVDINCVISNHDRPTDNHVRRFLQRHGIPYHYLPTTPGNKREQEILELIEGTDFVVLARYMQVMSESFLKAYGKDIINIHHGLLPSFKGGSPSRQAFNAGVKLIGATSHFVTPELDAGPIIEQMVERVSHRDTLQSFVVKSENLEKQCLAEAIKSYCELRVLPYELMKTVVF

SEQ ID NO: 4962 - protein, 283 aa, Secale cereale
IHLFQCPDAVGIVAKLSECIASRGGNIHSVDVFVPDDAPVFYARSEFTYNPRLWPRDVLRTDFLHLSDCFNAQKSTVRVPDIDPKYKIAVLASKQDHCLFDLLHRWQEGRLPVDIHCVISNHDRPVDNHVMRFLQRHEIPYHYLPTTSGNKREQEILELIEGTDFVVLARYMQVMSESFLKAYGKDIINIHHGLLPSFKGGSPSRQAFNAGVKLIGATSHFVTPELDAGPIIEQMVERVSHRDTLHSFVVKSENLEKQCLAEAIKSYCELRVLPYEVMKTVVF

SEQ ID NO: 4963 - protein, 284 aa, Triticum aestivum
GIHLFQCPDAVGIVAKLSECIASRGGNIHSVDVFVPDDAPVFYARSEFTYNPRLWPRDVLRTDFLRLSDCFGAQKSTVRVPDIDPKYKIAVLASKQDHCLFDLLHRWQEGRLPVDIHCVISNHDRPVDNHVMRFLQRHEIPYHYLPTTSGNKREQEILELIEGTDFVVLARYMQVMSEGFLKAYGKDIINIHHGLLPSFKGGSPSRQAFNAGVKLIGATSHFVTPELDAGPIIEQMVERVSHRDTLHSFVVKSENLEKQCLAEAIKSYCELRVLPYEVMKTVVF

SEQ ID NO: 4964 - protein, 301 aa, Setaria italica
MMSSARRPLSAAAGNLLGIHLFQCPDAVGIVAKVSECIASRGGNIHRVDVFVPDDKPVFYSRSEFTYNPRLWPRDDLRKDFLNLSCCFGAQRSTVRVPDLDPKYKIAVLASKQDHCLFDLLHRWQEGRLPVDINCVISNHDRPQDNHVRRFLQRHAIPYYYLPTTPGNKREQEILELIQGTDFVVLARYMQIMSESFLKAYGKDIINIHHGLLPSFKGGHPSRQAFNAGVKLIGATSHFVTPELDAGPIIEQMVERVSHRDTLQSFVVKSENLEKQCLAEAIKSYCELRVLPYELKKTVVF

SEQ ID NO: 4965 - protein, 303 aa, Panicum virgatum
MLSMVRRPLSTAVPAGNLLGIHLFQCPDTVGIVAKLSECIASRGGNIHSVDVFVPDDKRVFYSRSEFTYNPRLWPRDELHKDFLNLSHCFSAQRSTVRVPDLDPKYKISVLASKQDHCLFDLLYRWQEGRLPVDINCVISNHDRPEDNHVRRFLERHGIPYHYLPTTSGNKREQEILELIEGTDFVVLARYMQILSESFLKSYGKDIINIHHGLLPSFKGGHPSRQAFNAGVKLIGATSHFVTTELDAGPIIEQMVERVSHRDTLWSFVVKSENLEKQCLAEAIKSYCELRVLPYELKKTVVF

SEQ ID NO: 4966 - protein, 303 aa, Sorghum bicolor
MLSLARRPLSATVPAGNLLGIHLFQCPDAVGIVAKLSECIASRGGNIHSVDVFVPDDKPVFYSRSEFTYNPRLWPRHELHNDFLNLSRCFNAHTSTVRVPDLDPKYNISILASKQDHCLFDLLHRWQEGRLPLHISCVISNHDRPQDNHVRRFLQRHGIPYHYLPTAPGNKREQEILELIQGTDFVVLARYMQILSESFLKAYGKDIINIHHGLLPSFKGGSPSRQAFNAGVKLIGATSHFVTQELDAGPIIEQMVERVSHRDTLQSFVVKSENLEKQCLAEAIKSYCELRVLPYELKKTVVF

SEQ ID NO: 4967 - protein, 438 aa, Oryza sativa
MRRFRVWPPSPSPWPLLASRPCPHSHHHRSPFHASANSGARQGNFILPGATAATLVMFGILHARRMYEDQKVVERKEKGIEPEFSPDFKASFLRLLPLRSMSRLWGSLMEVELPVFMRPAIYKAWARAFHSNLQEAAMPLEEYPSLQAFFIRSLKEGSRPIDADPNCLVSPVDGKVLRLGELRGPGTMIEQVKGFSYSAASLLGASSSLHGAEEEDFSREHTEQSNPADSNAKSWWRVSVAKPKLWDQTLLSPKKGIFYCVIYLHPGDYHRVHSPVDWNIIKRRHFSGHLFPQNERAVRTIRNLYVENERVVLEGQWKEGFVAIAAIGATNVGSIKLYIEPELRTNRAGSKILNSQPEPPDDRVYEPVGTGVMVKKGEEIAGFKMGSTVVMVFEAPVVSKARWREDGSGTVTSDFDFCIKAGDRIRVGEAIGRWTSRE

SEQ ID NO: 4968 - protein, 303 aa, Pennisetum glaucum
MLSMARRPVSAAVPAGNLLGIHLFKCPDTVGIVARLSECIASRGGNIHSVDVFVPDDKPVFYSRSEFTYNPKLWPRDELHRDFLNLSHCFQAQRSTVRVPDLDPKYKISVLASKQDHCLFDLLYRWQEGRLPVDISCVISNHDRPEDNHVQRFLQRHGIPYHYLPTTSGNKREQEILELIEGTDFVVLARYMQILSESFLKSYGKDIINIHHGLLPSFKGGHPSRQAFDAGVKLIGATSHFVTTELDAGPIIEQMVQRVSHRDTLQSFVVKSENLEKQCLAEAIKSYCELRVLPYELKKTVVF

SEQ ID NO: 4969 - protein, 303 aa, Zea mays
MVSLARRPLSAAVPAGNLLGIHLFRCPDAVGIVAKLSECIASRGGNIHSVDVFVPDDKPVFYSRSEFTYNPRLWPRHELHKDFLNLSRCFNAQTSTVRVPDLDPKYNISILASKQDHCLFDLLYRWQEGRLPVHINCVISNHDRPQDNHVRRFLQRHGIPYHYLPTAPANKREKEILELIQGTDFVVLARYMQILSENLLKAYGKDIINIHHGLLPSFKGGNPSRQAFSAGVKLIGATSHFVTPELDAGPIIEQMVERVSHRDTLQSFVVKSENLEKQCLAEAIKSYCELRVLPYELRKTVVF

SEQ ID NO: 4970 - protein, 313 aa, Secale cereale
IHLFQCPDAVGIVAKLSECIASRGGNIHSVDVFVPDDAPVFYARSEFTYNPRLWPRDMLRTDFLHLSDCFNAQKSTVRVPDIDPKYKIAVLASKQDHCLFDLLHRWQEGRLPVDIHCVISNHDRPVDNHVMRFLQRHEIPYHYLPTTSGNKREQEILELIEGTDFVVLARYMQVMSESFLKAYGKDIINIHHGLLPSFKGGSPSRQAFNAGVKLIGATSHFVTPELDAGPIIEQMVERVSHRDTLHSFVVKSENLEKQCLAEAIKSYCELRVLPYEVMKTVVFCFFFWIVTMCIIFPKLAIHYSFVNIFTLSH

SEQ ID NO: 4971 - protein, 581 aa, Secale cereale
MYRAAAAAISRSSSSVLRRQLARGGFGGGEQRQWARGYAAKEVTFGIDARAAMLRGVNDLADAVKVTMGPKGRNVVIERPNRSPKVTKDGVTVAKSIEFEDSAKNVGASLVKQVADATNKAAGDGTTCATVLTQAILTEGCKAVAAGVNVMDLRKGINKAISAVTAHLKSKAWMIDSPDEINQVATISANGEKEIGDLISKAMGIVGKDGVITIADGKTLDNELEAVQGMKLTRGYISPYFVTDQKTQKCELKDPLILIHDKKISNMNSLLPALQISIQNRRPLLILAEDVDGEALSMLVLNKHRAGLKICAVKAPGFGENRRSNLDDMAVLTGGQVISEDQGLDLDKVELQMLGTAKKVTVSLDDTIILDGGGERQQIEERCQQLRESLENNTSMFDKEKAQERLSKLSGGVAILKIGGASEAEVGEKKDRVTDALNAARAAVEEGIVPGGGVALLYATKELDNIITSHEDEKIGVQIIKNALKAPLMTIAANAGVDGAIVIGKLLEQDNLSLGYDAAKGEYVDMIKAGIIDPVKVIRTALQDAASVSLLMTTTEAAVAELPSTKARIASRMPDMSGMGF

SEQ ID NO: 4972 - protein, 576 aa, Brachypodium distachyon
MYRAAAAAISGSSSALRRQLARGEQRQWARGYAAAKEVTFGVGARAAMLRGVNDLADAVKVTMGPKGRNVIIERAHKSPQVTKDGVTVAKSIEFEDSAKNVGASLVKQVADATNKVAGDGTTCATVLTQAILTEGCKALAAGVNVMDLRIGINKAINAITSHLKSKAWTINSPDEINQVATISANGEKEIGDLISKAMEIVGKDGVITIVDGKTLDNELEAVQGMKLSRGYISPYFVTDQKTKKCEMENPLILIHDKKISNMNSLLPALQISIQNRRPLLIFAEDIEGEALSMLVMNKHRAGLMICAVKAPGFGENRRANLDDMAVLTGGQVVSEDQGLDLGKVKLQMLGTAKKVTVSLDDTIILDGGGDRQQIEERCQQLRESFESSTAMFDKEKAQERLSRLSGGVAILKIGGASEAEVGEKKDRVTDALNAARAAVEEGIVPGGGVALLYATKVLDKISTSHEDEKIGVQIIKNALKAPLMTIAANAGVDGAIVIGKLLEQDNPSLGYDAAKEEYVDMVKAGIIDPVKVIRTALQDAASVSLLMATTEAAVSELPATKARLASRMPQMSGMGF

SEQ ID NO: 4973 - protein, 581 aa, Sorghum bicolor
MYRAAAAAISRSSSVLRRQLPRGAGGEPPRLLARGYASTAKEVSFGVGARAAMLQGVNDLADAVKVTMGPKGRTVIIEGSYKGPKVTKDGVTVAKSVEFEDSAKNVGANLVKQVADATNKAAGDGTTCATVLTQAILTEGCKAVAAGVNVMDLRNGINKAINATTAHLKSKAWKINSPEEINQVATISANGEKEIGDLISKAMEKVGKDGVITIVDGKTLDNELEAVQGMKLSRGYISHYFVTDQKTQKCEMENPLILIHDKKISNMDSLLPALEISIKNRKPLLIVAEDVDGDALSMLVLNKHRAGLKVCAVKAPGFGENRRHNLDDMAVMTGGEVISEERGLDLGKVQLQMLGTAKKVTVSLDDTIILDGGGDKQQIEERCQQLRESIDTSTAVFDKEKAQERLSKLSGGVAVLKIGGASEAEVGEKKDRVTDALNAARAAVEEGIVPGGGVALLYATKELDKISTSNEDEKIGVQIIKNSLKAPLMTIAANAGIDGAIVIGKLIEQEDLSLGYDAAKGEYVDMIKAGIIDPVKVIRTALQDAASVSLLMTTTEAAVSELPATKARIASRMPQMSGMDF

SEQ ID NO: 4974 - protein, 580 aa, Zea mays
MYRAAAVISRSSSALRRQLARGVAGELPRLLARGYAATAKEVSFGVGARAAMLQGVNDLADAVKVTMGPKGRTVIIEGSHKGPKVTKDGVTVAKSVEFEDSAKNVGANLVKQVADATNKAAGDGTTCATVLTQAILTEGCKAVAAGVNVMDLRNGINKAINAITAHLKSKAWKINSPEEINQVATISANGEKEIGDLISKAMEKVGKDGVITIVDGKTLDNELEAVQGMKLSRGYISPYFVTDQKTQKCEMENPLILIHDKKISNMDSLLPALEISIKNRKPLLIVAEDVEGDALSMLVLNKHRAGLKVCAVKAPGFGENRRHNLDDMAVMTGGEVISEERGLDLGKVQLQMLGTAKKVTVSLDDTIILDGGGDKQQIDERCQQLRESIDTSTAVFDKEKAQERLSKLSGGVAVLKIGGASEAEVGEKKDRVTDALNAARAAVEEGIVPGGGVALLYATKELDKISTANEDEKIGVQIIKNSLKAPLMTIAANAGIDGAIVIGKLIEQEDLSLGYDAAKGEYVDMIKAGIIDPVKVIRTALQDAASVSLLMATTEAAVSELPATKSRIASRMPQMSGMDF

SEQ ID NO: 4975 - protein, 581 aa, Oryza sativa
MYRAAAAAASSISRSSSALRKQLSRGGCGEQRLWARGYAAKEVAFGVGARAALLQGVNDLADAVKVTMGPKGRNVIIERSHRAPKVTKDGVTVAKSIEFEDSAKNVGANLVKQVAEATNKVAGDGTTCATVLTQAILTEGCKAVAAGVNVMDLRNGINKAISSITTHLKSKAWIINSSEEINQVATISANGEKEIGDLISKAMEKVGKDGVITITDGKTLDNELEAVQGMKLSRGYISPYFVTDQKTQKCEMENPLILIHDKKISTMNSLLPVLEMSIKNRRPLLIIAEDVEGEALSMLVLNKHRAGLKICAVKAPGFGENRRANLDDVAVLTGGEVVSEDQGLDLGKVELQMLGTAKKVTVSLDDTIILDGGGDKQQIEERCQQLRESMDKSTAVFDKEKAQERLSKLSGGVAVLKIGGASEVEVGEKKDRVTDALHAARAAVEEGIVPGGGVALLYATKELDKIITANEDEKIGVQIIKNALKAPLMTIAANAGIDGGVVIGKLIEQDNLNMGYDAARGEYVDMIKAGIIDPVKVIRTALQDASSVSLLMTTTEAAVAEPPAAKARMASRMPQMSGMDF

SEQ ID NO: 4976 - protein, 579 aa, Setaria italica
MYRAATSAISRSSSALRKHLARGGGGEPQRLWARGYAAKEVAFGVGARAAMLQGVNDLADAVKVTMGPKGRTVIIEGSYKGPKITKDGVTVAKSVEFEDSAKNVGANLVKQVAEATNKTAGDGTTCATVLTQAILTEGCKAVAAGVNVMDLRNGINKAINSITSHLKSKAWKINSPEEINQVATISANGEKEIGDLISKAMEKVGKDGVITIVDGKTLDNELEAVQGMKLSRGYISPYFVTDEKTQKCEMENPLILIHDKKISSMNSLLPVLEISIKNRRPLLIVAEDVEGEALSMLVLNKHRAGLKVCAVKAPGFGDNRRHNLDDMAVMTGGEVVSEERGLDLGKIQQQMLGTAKKVTVSLDDTIILDGGGDKKQIEERCQQLRESFETSTAMFEKEKAQERLSKLSGGVAVLKIGGASEAEVGEKKDRVTDALNAAKAAVEEGIVPGGGVALLYATKELDKISTANEDEKIGVQIIKNALKAPLMTIAANAGIDGAIVIGKLSEQDDLSLGYDASRGEYVDMIKAGIIDPVKVIRTALQDAASVSLLMTTTEAAVSELPATKARIASRMPQMGGMDF

SEQ ID NO: 4977 - protein, 579 aa, Panicum virgatum
MYRAAASAISRSSSVLRKQLARGGGGEPQRLWARGYAAKEVAFGVGARAAMLQGVNDLADAVKVTMGPKGRTVIIDGSHKGPKITKDGVTVAKSVEFEDSAKNVGANLVKQVAEATNKVAGDGTTCATVLTQAILMEGCKAVAAGVNVMDLRNGINKAINSITAHLKSKAWKINSPEEINQVATISANGEKEIGDLISKAMEKVGKDGVITIVDGKTLDNELEAVQGMKLSRGYISPYFVTDEKTQKCEMENPLILIHDKKISNMNSLLPVLEISIKNRRPLLIVAEDVEGEALSMLVLNKHRAGLKVCAVKAPGFGDNRRHNLDDMAVMTGGEVVSEERGLDLGKVQLQMLGTAKKVTVSLDDTIILDGGGDKKQIEERCQQLRESIDTSTAMFDKEKAQERLSKLSGGVAVLKIGGASEAEVGEKKDRVTDALNAAKCAVEEGIVPGGGVALLYASKELDKISTANEDEKIGVQIIKNALKAPLMTITANAGIDGAVVIGKLTEQDDLSLGYDAARGEYVDMIKAGIIDPVKVIRTALQDAASVSLLMTTTEAAVSELPATKARIASRMPQMSGMDF

SEQ ID NO: 4978 - protein, 253 aa, Panicum virgatum
MYRAAASAISRSSSVLRKQLARGGGGEPQRLWARGYAAKEVAFGVGARAAMLQGVNDLADAVKVTMGPKGRTVIIDGSYKGPKITKDGVTVAKSVEFEDSAKNVGANLVKQVAEATNKVAGDGTTCATVLTQAILMEGCKAVAAGVNVMDLRNGINKAINSITAHLKSKAWKINSPEEINQVATISANGEKEIGDLISKAMEKVGKDGVITIVDGKTLDNELEAVQGMKLSRGYISPYFVTDERLKNVRWRTL

SEQ ID NO: 4979 - protein, 503 aa, Triticum aestivum
RPNRSPKVTKDGVTVAKSIEFEDSAKNVGASLVKQVADATNKAAGDGTTCATVLTQAILTEGCKAVAAGVNVMDLRKGINKAISAVTAHLKSKAWMIDSPDEINQVATISANGEKEIGDLISKAMGIVGKDGVITIADGKTLDNELEAVQGMKLTRGYISPYFVTDQKTQKCELKDPLILIHDKKISNMNSLLPAVQISIQNRRPLLIFAEDVDGEALSMLVLNKHRAGLKICAVKAPGFGENRRANLDDMAVLTGGQVISEDQGLDLDKVELQMLGTAKKVTVSLDDTIILDGGGERQQIEERCQQLRESLENSTSMFDKEKAQERLSKLSGGVAILKIGGASEAEVGEKKDRVTDALNAARAAVEEGIVPGGGVALLYATKELDNISTSHEDEKIGVQIIKNALKAPLMTIAANAGIDGAIVIGKLLEQDNLSLGYDAAKGEYVDMIKAGIIDPVKVIRTALQDAASVSLLMTTTEAAVAELPSTKARIASRMPDMSGMGF

SEQ ID NO: 4980 - protein, 390 aa, Secale cereale
MRGSRWCCCCFGGGGGGAGRSGSVADDGLLWDVGLKAHASGEYSVAVAQANEALEDQAQVLVSPAATLVGVYDGHGGPDAARFVNARLFSLIQEFASQSGGLSAQVIKRAFGATEEEFMGMVERSWPSQPRLMSVGSCCLVGAIEDGTLYVANLGDSRAVLGRLASTGGKKRRAVVAERLSRDHNVADEEVRREVAEAHPDDPHIVMSSHGVWRIKGIIQVSRSIGDAYLKRPDLCSPAVMQSLCPFPLRRPVMSAVPSVTSRRLRPGDQFIIFASDGLWEQLSDEAAVGIVSRSPRKGVAMRLVRAAQLEAARKKDIKYESIAAIEKGRRRRFHDDITVVVLFLDSRCEGTPQPTAGAGGIDGTRAPVDVFSLGPDDHGDDPTRPVLLR

SEQ ID NO: 4981 - protein, 389 aa, Triticum aestivum
MRGSRWCCCCFGRGGGGAGRSGSVGDDGLVWDVGLKAHASGEYSVAVAQANEALEDQAQVLVSPAATLVGVYDGHGGPDAARFVNARLFSLIQEFASQSGGISAQVIKRAFGATEEAFMGMVEKSWPSQPRLMSVGSCCLVGAIEGGTLHVANLGDSRAVLGRLASTGGKKRRAVVAERLSRDHNVADEEVRREVAEAHPDDPHIVMSSHGVWRIKGIIQVSRSIGDAYLKRPDLCSPAVMQSLCPFPLRRPVMSAVPSVTSRRLRPGDQFIIFASDGLWEQLSDEAAVGIVSRSPRKGVAMRLVRAAQLEAARKKDIKYESIAAIEKGRRRRFHDDITVVVLFLDNRCEGTPQPTASAGGIDGTRAPVDVSPRGPDDHGDDPTRPVLR

SEQ ID NO: 4982 - protein, 374 aa, Leymus cinereus x Leymus triticoides
GGGAGRSGSVADDGLVWDVGLKAHASGEYSVAVAQANEALEDQAQVLVSPAATLVGVYDGHGGPDAARFVNARLFSLIQEFASQSGGLSAQVIKKAFGATEEEFMGMVEKSWPSQPRLMSVGSCCLVGAIEDGTLYVANLGDSRAVLGRLASAGKKRRAVVAERLSRDHNVADEEVRREVAEAHPDDPHIVMSSHGVWRIKGVIQVSRSIGDAYLKRPDLCSPAVMQFLCPFPLRRPVMSAVPSVTSRRLRPGDQFIIFASDGLWEQLSDEAAVGIVSRSPRKGVAMRLVRAAQLEAARKKDMRYESIAAIEKGRRRRFHDDITVVVLFLDNRCEGTPQSTVGAGDIDGTCAPVDVFSLGPDDQEDDPTRPVLR

SEQ ID NO: 4983 - protein, 91 aa, Secale cereale
MPFLGPEGSSQSEPLESTFIFEDREFSELENLAMNIQGIRKGMEGDRGGRNHGCGEAELTDDFWEELLSEGMRDEAEMLELERRRSRYVDA

SEQ ID NO: 4984 - protein, 313 aa, Secale cereale
MGDVAKDLAAGTVGGAAQLVVGHPFDTIKVKLQSQPTPPPGQPPKFAGAMDAVKQTISAEGPRGLYKGMGAPLATVAAFNAVLFTVRGQMEALLRSEPGAALTVGQQVVAGAGAGVAVSFLACPTELIKCRLQAQSALATAAPAAAAPAAGGAAATVTATAAAAVKYGGPLDVARHVLRSEGGVRGLFKGLVPTMAREIPGNALMFGVYEATKQYIAGGQDTSELGRGSLILAGGVAGAAFWGSVYPTDVVKSKLQVDDFKNPKYSGSMDAFKKIIAADGARGLYRGFGPAMARSVPANGACFLAYEVTRSLL

SEQ ID NO: 4985 - protein, 296 aa, Secale cereale
MGDIAKDLTAGTVGGIANLVVGHPFDTIKVKLQSQPSPAPGQLPKYAGAFDAVKQTVAAEGPRGLYKGMGAPLATVAAFNALLFTVRGQMETLLRSEPGAPLTVKQQVVAGAGAGLAVSFLACPTELIKCRLQAQSSLAEAGAVSGVALPKGPMDVARHVIRDAGLKGLFKGIVPTMGREIPGNAIMFGVYEAVKQYMAGGRDTSGLGQGSLILAGGLAGGALWLTVYPTDVVKSVIQVDDYKKPRYSGSIDALKKIVAADGVKGLYKGFGPAMARSVPANAATFVAYEITRSAMG

SEQ ID NO: 4986 - protein, 296 aa, Triticum aestivum
MGDIAKDLTAGTVGGIANLVVGHPFDTIKVKLQSQPSPAPGQLPKYAGAFDAVKQTVAAEGPRGLYKGMGAPLATVAAFNALLFTVRGQMETLLRSEPGAPLTVKQQVVAGAGAGLAVSFLACPTELIKCRLQAQSSLAEAGAVSGVALPKGPMDVARHVMRDAGVKGLFKGIVPTMGREIPGNAIMFGVYEAVKQYMAGGRDTSGLGQGSLILAGGLAGGALWLTVYPTDVVKSVIQVDDYKKPRYSGSIDALKKIVAADGVKGLYKGFGPAMARSVPANAATFVAYEITRSAMG

SEQ ID NO: 4987 - protein, 85 aa, Secale cereale
MGDIAKDLTAGTVGGIANLVVGHPFDTIKVKLQSQPSPAPGQLPKYAGAFDAVKQTVAAEGPRGLYREWGLLSLPLQPSTLSCSL

SEQ ID NO: 4988 - protein, 296 aa, Brachypodium distachyon
MGNIAKDLTAGTVGGVANLVVGHPFDTIKVKLQSQPSPAPGHLPKYAGALDAVKQTIAAEGPRGLYKGMGAPLATVAAFNALLFAVRGQMESLLRSEPGAPLTVKQQVVAGAGAGFAVSFLACPTELIKCRLQAQSSLAEAAAASSVALPKGPLDVAKHVMKDAGLKGLFKGLVPTMGREIPGNAIMFGVYEAVKQYMAGGQDTSSLGQGSLILAGGLAGGALWLTVYPTDVVKSVIQVDDYKKPRFSGSIDALKKIVTADGVKGLYKGFGPAMARSVPANAATFVAYEITRSAMG

SEQ ID NO: 4989 - protein, 296 aa, Sorghum bicolor
MGDVARDLTAGTVGGVANLVVGHPFDTIKVKLQSQPTPAPGQLPKYAGAIDAVKQTIAAEGPRGLYKGMGAPLATVAAFNALLFSVRGQMEALLRSEPGVPLTVKQQVVAGAGAGIAVSFLACPTELIKCRLQAQSSLAEAAAASGVALPKGPIDVAKHVVRDAGAKGLFKGLVPTMGREVPGNAMMFGVYEATKQYLAGGPDTSNLGRGSQILAGGLAGAAFWLSVYPTDVVKSVIQVDDYKKPRYSGSLDALRKIVAADGVKGLYKGFGPAMARSVPANAATFVAYEITRSALG

SEQ ID NO: 4990 - protein, 296 aa, Zea mays
MGDVAKDLTAGTVGGAANLIVGHPFDTIKVKLQSQPTPAPGQLPKYAGAIDAVKQTVAAEGPRGLYKGMGAPLATVAAFNAVLFSVRGQMEAFLRSEPGVPLTVKQQVVAGAGAGIAVSFLACPTELIKCRLQAQSSLAEAATASGVALPKGPIDVAKHVVRDAGAKGLFKGLVPTMGREVPGNALMFGVYEATKQYLAGGPDTSGLGRGSQVLAGGLAGAAFWLSVYPTDVVKSVIQVDDYKKPKYSGSLDALRKIVAADGVKGLYKGFGPAMARSVPANAATFVAYEITRSALG

SEQ ID NO: 4991 - protein, 296 aa, Saccharum officinarum
MGDVAKDLTAGTEGGVANLIVGHPFDTIKVKLQSQPTPAPGQLPKYAGAIDAVKQTVAAEGPRGLYKGMGAPLATVAAFNAVLFSVRGQMEALLRSEPGVPLTVKQQVVAGTGAGIAVSFLACPTELIKCRLQAQSSLAEAAVASGVALPKGPIDVAKHVVRDAGAKGLFKGLVPTMGREVPGNAVMFGVYEATKQYLAGGPDTSNLGRGSQILAGGLAGAAFWLSVYPTDVVKSVIQVDDYKKPRYSGSLDALRKIVAADGVKGLYKGFGPAMARSVPANAATFVAYEITRSALG

SEQ ID NO: 4992 - protein, 296 aa, Panicum virgatum
MGDVVKDLTAGTVGGAANLVVGHPFDTIKVKLQSQPTPAPGQLPKYAGAIDAVKQTIAAEGPRGLYKGMGAPLATVAAFNALLFSVRGQMEALLRSEPGAPLTVKQQVVAGGGAGIAVSFLACPTELIKCRLQAQSSLAEAAAASGVALPKGPIDVAKHVVRDAGARGLFKGLVPTMGREIPGNALMFGVYEAAKQYLAGGPDTSNLGIGSQILAGGLAGASFWLSVYPTDVVKSVIQVDDYKNPRYSGSLDALRKIMAADGVKGLYKGFGPAMARSVPANAATFVAYEITRSALG

SEQ ID NO: 4993 - protein, 314 aa, Setaria italica
MGDVAKDLAAGTVGGAAQLVVGHPFDTIKVKLQSQPTPPPGRPPLYAGAGDAVRQTLAAEGARGLYKGMGAPLATVAAFNAVLFTIRGQMEAVLRSEPGVPLTVGQQVVAGAGAGVAVSFLACPTELIKCRLQAQSALAAAAPAAAAAGAGGAAAATVAAPAVAVKYGGPMEVARHVLRSEGGTRGLFKGLFPTLAREVPGNAIMFGMYEAIKQALAGGQDTSQLGRGSLILAGGLAGASFWGPVYPADVVKSVLQVDDYKNPKYSGSMDAFRKILAADGVKGLYKGFGPAMLRSMPANGACFLAYEVTRSALG

SEQ ID NO: 4994 - protein, 296 aa, Panicum virgatum
MGDVVKDLTAGTVGGAANLVVGHPFDTIKVKLQSQPTPAPGQLPKYAGAIDAVKQTIAAEGPRGLYKGMGAPLATVAAFNALLFSARGQMEALLRSEPGAPLTVKQQVVAGGGAGIAVSLLACPTELIKCRLQAQSSLAEAAAASGVALPKGPIDVAKHVVRDAGARGLFKGLVPTMGREIPGNALMFGVYEAAKQYLAGGPDTSNLGIGSQILAGGLAGASFWLSVYPTDVVKSVIQVDDYKNPRYSGSLDALRKIMAADGVKGLYKGFGPAMARSVPANAATFVAYEITRSALG

SEQ ID NO: 4995 - protein, 296 aa, Panicum virgatum
MGDVVKDLTAGTVGGAANLVVGHPFDTIKVKLQSQPTPAPGQLPKYAGAIDAVKQTIAAEGLRGLYKGMGAPLATVAAFNALLFSVRGQMEALLRSEPGAPLTVKQQVVAGGGAGIAVSFLACPTELIKCRLQAQSSLAEAAAASGVALPKGPIDVAKHVVRDAGTRGLFKGLVPTMGREVPGNALMFGVYEAAKQYLAGGPDTSNLSIGSQILAGGLAGATFWLSVYPTDVVKSVIQVDDYKNPRYSGSLDAVRKIVGADGVKGLYKGFGPAMARSVPANAATFVAYEITRSALG

SEQ ID NO: 4996 - protein, 296 aa, Panicum virgatum
MGDVVKDLTAGTVGGAANLFVGHPFDTIKVKLQSQPTPAPGQLPKYAGAIDAVKQTIAAEGPRGLYKGMGAPLATVAAFNALLFTVRGQMEAVLRSEPGAPLTVGQQVVAGAGAGVAVSFLACPTELIKCRLQAQSSLAEAAAASGVAVPKGPIDVAKHVVRDAGARGLFKGLVPTLGREVPGNAVMFGVYEAAKQYLAGGPDTSGLGRGSQVLAGGLAGAALWLSVYPTDVVKSVIQVDDYRNPRYAGSLDALRKIVAADGVKGLYKGFGPAMARSVPANAATFVAYEITRSALG

SEQ ID NO: 4997 - protein, 523 aa, Oryza sativa
MLPGSAAPAAGSGMFVPTQTVGTVLCCICGVAMQPNPANMCARCIRARVDITEGVPRHAAVVYCPDCTSYLQPPRSWLRAGPESPELMQILLRRLNRPLARLRVSLSAAEFVFSEPHSKRLRLKLRLRREVFNAVVLEQTHPVEFTVHDRLCDACARAQSNPDQWVAVVQLRQHVPHRRTFLYLEQLLLKHGQASLALRVAAAPGGLDFFFGSRSHAARLVDFLATVAPVQTQTAKQLVSHDTKSNVYNYKHTFSVEICPICREDLIALSPQVSRDLGGLGPIVLCIKVTNAIALLDPLTLRVHHLEEKKYRVYNFKAALTSKQLVEYIVLDIEHESPEITIDGSRYQLAYAQVARVSDFGKNDTMFTVRTHLGHLLNPGDLALGYDLYGANLNDDDMDTAMMRHSLPEVILVKKSFAKRPRTRRWKLKRLPMEEDAVNKAKGELEKRADEYEEFLRDLEHNSDIRFQIDLYKDEDYRSEMASTIGDDVPTVPIEELIEDLSLGDDEEEDEGGEGNQHAVMVG

SEQ ID NO: 4998 - protein, 85 aa, Eragrostis curvula
MGDVAKDLTAGTVGGAANLIVGHPFDTIKVKLQSQPTPAPGQLPKYSGAIDAVKQTIAAEGPRGLYKGMGRRSPPSRPSTLSCSV

SEQ ID NO: 4999 - protein, 296 aa, Panicum virgatum
MGDVVKDLTAGTVGGAANLFVGHPFDTIKVKLQSQPTPAPGQLPKYAGAMDAVKQTISAEGPRGLYKGMGAPLATVAAFNALLFTVRGQMEAVLRSEPGAPLTVGQQVVAGAGAGVAVSFLACPTELIKCRLQAQSSLAEAAPASGLVLPKGPIDVAKHVVRDAGARGLFKGLVPTMGREVPGNAVMFGVYEAAKQYLAGGPDTSNLGRGSQILAGGLAGAFFWLSVYPTDVVKSVIQVDDYKNPRYSGSLDALRKIVAADGVKGLFKGFGPAMARSVPANAATFVAYEITRSALG

SEQ ID NO: 5000 - protein, 400 aa, Triticum aestivum
MEALHEEMPFDLSFHPSAPLVATSLITGELHMFRYADGLPLERLFVAKPHKDSCRAVRFVDSGTAILTGSADMSIVASDVETGKVIARLDNAHDDAINRLVCLTETTVASGDDDGYIKVWDTRQRSCCNTFHRHEDYISDMTYVAGSNQILATSGDGTLSVNNLRGNRVKSQSEFSEDELLSVVVMKNGQKVVCGTPSGALLLYSWGHFKDCSDRFLGHAQSVDNLLKLDEETLISAAADGVIRLVGILPNQIIQPLAEHSEFPIEALGFSHDRKYLGSISHDKMIKLWDMEELLGGPQLNHQNDMPEANAAVHHDELPEANAAIHHDELPEANAAAGQHDELPAANAAAVNHNQPAEADSDDDGMDVDMEPSSSNVSRSKKKGKGKRLDGFAPDFFADL

SEQ ID NO: 5001 - protein, 66 aa, Secale cereale
MEALHEEMPFDLSFHPSAPLVATSSSPASSTCSATPTVCRSRGCSWQNLTRSHVGLFALWTQELRF

SEQ ID NO: 5002 - protein, 362 aa, Secale cereale
LPLERLFVAKPHKESCRAVRFVDSGTAILTGSADMSIVASDVETGKVIARLDNAHDDAINRLVCLTETTVASGDDDGYIKVWDTRQRSCCNTFHRHEDYISDMTYVAGSNQILATSGDGTLSVNNLRGNRVKSQSEFSEDELLSLVVMKNGQKIVCGTPSGALLLYSWGHFKDCSDRFLGHAQSVDNLLKLDEETLISAAADGVIRLVGILPNQIIQPLAEHSEFPIEALGFSHDRKYLGSISHDKMIKLWDMEELLGGPQLNHQNDMPEANAAVHHDELPEANAAIHHDELPEANAAAGQHDELPEANAAAANPNQLAEADSDDDGMDVDMEPSSSNVSRSKKKGKGKRLDGFAPDFFADL

SEQ ID NO: 5003 - protein, 625 aa, Secale cereale
MADPVELVRHVCLRFPPRRSRVPPPQPRCLVMARLRLPGSALSLRCRALDASKSSAVKGEPSEEYDDDDEEPYFSVTSSRLSEVDYLGESTKGDLNVRRRHLDALGGNGKSTLHGPIEEIAWKEARQAETLLSDLGIADPLTVRHSPRGIFCTRTLNLRSISVIGYDMDYTLIHYNVMAWEGRAYDYGMANLKSMGFLVDDLEFDPDLVIRGLIMDKVKGNLVKADRFGYIKRVMHGTQMLPTRAVSEIYGRELVDLRKEDTWEFLNTLFSVSEAVMFMQMVDKLDQGLVPAELGPLDYKGLYNAVSKALFRAHVEGQLKSEIMAEPERFVEPDPELPLALLDQKEAGKRLLLITNSDYHYTNKMMNHAFNRFLPNDMGWRDLFEMVIVSARKPEFFQISHPLYEVVTDNGLLRPCFKANSGGLYSGGCAQMVEKSLDIHGDEILYVGDHIFTDVSQSKVHLRWRTALICRELEDEFEALIQSHAQKEKLVTLIQQKEIVGDLFNQLRLALQRRTNSRPAQTLAATCMNDQELAESMQKLLIVMQRLDEKIVPLLESDGELFNKRWGWLSRAGLWDKSHLTRQIEKYADIYTSRVSNFLHYTPFMYFRSQEQTLAHDVHSYSRGQ

SEQ ID NO: 5004 - protein, 592 aa, Triticum aestivum
ARLRLPGSVLSLRCRALDASKPSAVKGEPSEEYDDDEEPYFSVTSSRLSEVDYLGESTKGDLNVRRRHLDALGGNGQSTLHGPIEQIAWKEARQAETLLSDLGIADPLTVRNSPRGIFCTRTLNLRSISVIGYDMDYTLIHYNVMAWEGRAYDYGMANLKSMGFLVDDLEFDPDLVIRGLIMDKVKGNLVKADRFGYIKRVMHGTQMLPTRAVSEIYGRELVDLRKEDTWEFLNTLFSVSEAVMFMQMVDKLDQGLVPAELGPLDYKGLYNAVSKALFRAHVEGQLKSEIMAEPERFVEPDPELPLALLDQKEAGKRLLLITNSDYHYTNKMMNHAFNRFLPNDMGWRDLFEMVIVSARKPEFFQISHPLYEVVTDDGLLRPCFKANSGGLYSGGSAQMVEKSLDIHGDEILYVGDHIFTDVSQSKVHLRWRTALICRELEDEFDALIKSHAQKEKLVTLIQQKEIVGDLFNQLRLALQRRTNSRPAQTLAATCMNDQELTESMQKLLIVMQRLDEKIVPLLESDGELFNKRWGWLSRAGLWDKSHLTRQIEKYADIYTSRVSNFLHYTPFMYFRSQEQTLAHDVHSYSRDQ

SEQ ID NO: 5005 - protein, 1122 aa, Brachypodium distachyon
MADPVDLVQRHCLRLSTRLPPPPQPRCLVGARLRLPGSPLSLRCRALDASKPVAVEGDKSEEDDESYFSVISSRLSDVDYHGESTKGDLNVRREHIDALGGNGKSTLHGPIEEIAWKEAKEAETLLSDMGIADPLTLRHSPRGIFCTRTLNLRSISVIGYDMDYTLVHYNVMAWEGRAYDFGMANLKSMGFPVDDLEFDPDLVIRGLIMDKVKGNLVKADRFGYIKRVMHGTKMLSTRAVSEIYGRELVDLRKESTWEFLNTLFSVSEAVMFMQMVDKLDQGLVPPELGPLDYTGLYNAVSKALFRAHVEGQLKSEIMAEPERFVEPDPELPLALLDQKEAGKKLLLITNSDYLYTNKMMNHAFNRFLPNDMGWRDLFEMVIVSARKPEFFQISHPLYEVVTNDGLMRPCFKATSGGLYSGGSAQMVEKSLDIHGDEILYVGDHIFTDVSQSKVHLRWRTALICRELEDEFEALIQSHVQKEKLVTLIQQKEIVGDLFNQFRLALQRRTNSRPAQTVAATSMNDQELTESMQKSLIVMQRLDEKIAPLMESDGDLFNKRWGWLSRAGLWDKSHLTRQIEKYADIYTSRVSNFLHYTPFMYFQSQEQVLSKFVICHIGTLAVLRSSLRGSSLPILLAHRNSCTVRRNAKRKSAARRKRGAAAMLRQMRWMTDREGRWELDVESPATMEGTARPVPGDPLPLGLSRGPRVTRTKQLDFFHRFMASPLVPAFSPYRSGLSLDHAHLFHLAENWSFTILEQLHVKKLVEVVKEKLSNRQEGVPWTNDLKRQLHDVMSLGVGTELLITPDTTLLLELYNIKKGERGKAIINHKLPQQNLKLEASWPGLFVDKQGVYWDVPLSLSADFASVGSSSGLSYRLLVQQNSGEPKCFGGDETNDVPLALLPGLCVKAAFSIKKSIDVWRKKEDKLKMVQPYDVFLSDPHVSFTRIVGAVASGSLGDCSKRISVQDERSNAFRVFNDRNKFAAFADLFASVTFTAQHGNFQRLFLDLTRVSARLDISSGSLFLRGASRLAQDFFFSRRPDLETFCDVCPNTIVSLQQQIVGPFSFRVESSVAIDPRSQDRLVRVDDSVFAIDWALKVLGSAKATAWYSPKHQEAMVELRFFEA

SEQ ID NO: 5006 - protein, 634 aa, Setaria italica
MADAAELVRLLRLRAAPLPSPPQRSGPSSRPQRLLRALPRRRPPLSLRCRALDASRPAAVEGERGEEDVFEDEEESYFSVTSSGLSQVDYLGQSTRGDLNVRRERLEALGGNGESTLHGPIEEIAWKEAGEAETLLHDLGIADPFSVRHSPRGIFCTRTLNLRSISVIGYDMDYTLIHYNVMAWEGRAYDYGMDNLKSMGFPVDDLKFDPDLVIRGLVIDKEKGNLVKADRFGYIKRAMHGTQMLSTSSVSEIYGRELVDLRKESRWEFLNTLFSVSEAVMFMQMVDKLDQGLVPAELGPLDYKGLYNAVSKALFRAHVEGQLKREIMAEPERFVEPDPELPLALLDQKEAGKKLLLITNSDYHYTNKMMNHAFNRFLPNDVGWRDLFEMVIVSARKPEFFQLSHPLYEVVTDDGLMRPCFKANSGGLYSGGSAQMVEKSLEIHGDEILYVGDHIYTDVSQSKVHLRWRTALICRELEDEFDALVQSYDQKEKLVTLIQQKEIVGDLFNQLRLAQQRRSNSRPAQTLAATCMDDHELTESMQKLLIVMQRLDEKIGPMLESDGELFNKRWGWLSRAGLWDKSHLTRQIEKYADIYTSRVSNFLHYTPFMYFQSQEQTLAHDGHSYARGENIKVQ

SEQ ID NO: 5007 - protein, 635 aa, Panicum virgatum
MADAAELVRLLRLRAAQRPSPPQRPGPSPRAQRLLRALPRRRRPPLSLRCRALDASGPAAVEGERGEEDVFEDEEESYFSVTSSGLSQVDYLGQSTRGDLNVRRERLEALGGNGESTLHGPIEEIAWKEAEEAETLLHDLGIADPFSVRHSPRGIFCTRTLNLRSISVIGYDMDYTLIHYNVMAWEGRAYDYGMDNLKSMGFPVDDLKFDPDLVIRGLIIDKEKGNLVKPDRFGYIKRAMHGTQMLSTPSVSEIYGRELVDLRKESRWEFLNTLFSVSEAVMFMQMVDKLDQGLVPAELGPLDYKGLYNAVSKALFRAHVEGQLKREIMAEPERFVEPDPELPLALLDQKEAGKKLLLITNSDYHYTNKMMNHAFNRFLPNDVSWRDLFEMVIVSARKPEFFQLSHPLYEVVTDDGLMRPCFKANSGGLYSGGSAQMVEKSLNIHGDEILYVGDHIYTDVSQSKVHLRWRTALICRELEDEFDALVQSHGQKEKLVALIQQKEIVGDLFNQLRLAQQRRSNSRPAQTLAATCMDDQELTESMQKLLIVMQRLDEKIGPMLESDGELFNKRWGWLSRAGLWDKSHLTRQIEKYADIYTSRVSNFLHYTPFMYFQSQEQTLAHDAHSYFREESIKVQ

SEQ ID NO: 5008 - protein, 637 aa, Oryza sativa
MADSIELARRLCLQPPARRTGTGRCRPRGRLGAPSLRVPRPPLSLSLSLWSSLRCRALDSTRPVAVEGGLGDEEDEDEEGESYFALTSSRLSRVDYLGESTKGDLNVRREHLDAFGGNGKSTLHGPIEEIAWQEAREAESLLRELGIADPFSVRHSPRGIFCTRTLNLRSISVIGYDMDYTLIHYNVMAWEGRAYDYGMANLKGMGFPVDDLEFDPDLVIRGLIMDKDKGNLVKADRFGYIKRAMHGTQMLSTSAVSEIYGRELVDLRKESRWEFLNTLFSVSEAVMFMQMVDKLDQGLVPAELGPLDYKGLYNAVSRALFRAHVEGQLKSEIMAEPERFVEPDPELPLALLDQKEAGKRLLLITNSDYHYTNKMMNHAFNRFLPNDMAWRDLFEMVIVSARKPEFFQISHPLYEVVTNDGLMRPCFKANSGGLYSGGSAQMVEKSLDIHGDEILYVGDHIYTDVSQSKVHLRWRTALICRELEDEFDALIRSHVQKEQLITLIQQKEVVGDLFNQLRLALQRRTNSRPAQTLAATCMDDQELTESMQKLLIVMQRLDEKIAPMLESDGELFNKRWGWLSRTGLWDKSHLTRQIEKYADIYTSRVSNFLHYTPFMYFQSQEQTLGHDVHSYSRRQQH

SEQ ID NO: 5009 - protein, 633 aa, Zea mays
MADAAEMVRLLYLRTPPRPLLPQFAVHTHRPQSLLRVSPRFRPPIRLRCRALDASRPVAVEGERDEEDGLEDEEESYFSVTSSGLSEVDYLGESTRGDLNVRRERLEALGNSKSTLHGPIEEIAWKEAGEAETLLHDLGIADPFSVRHSPRGIFCTRTLNLRSISVVGYDMDYTLIHYNVMAWEGRAYDYGMDNLKSMGFPVDDLKFDPDLVIRGLVIDKEKGNLVKADRFGYIKRAMHGTQMLSTRAVSEIYGRELVDLRKEIRWEFLNTLFSVSEAVMFMQMVDKLDQGLVPAELGPLDYKGLYNAVSKALFRAHVEGQLKREIMAEPDRFVEPDPELPLALLDQKEAGKKLLLITNSDFHYTNKMMNHAFNRFLPNDVGWRDLFEMVIVSARKPEFFQLSHPLYEVVTDDGLMRPCFKVNSGGLYSGGSAQMVEKSLDIHGDEILYVGDHIYTDVSQSKVHLRWRTALICRELEDEFNALVKSHDQKEKLVTLIQQKEIVGDLFNQLRLALQRRSNSRPAQTLAATCMDDQELTESMQKLLIVMQRLDEKIGPMLEADGELFNKRWGWLSRAGLWDKSHLTRQIEKYADIYTSRVSNFLHYTPFMYFQSQEQTLAHDAHSYSGGKDIKVH

SEQ ID NO: 5010 - protein, 561 aa, Sorghum bicolor
MADAGAELVLLLCPRAPPRPSLPHSSVYPLRPRSLLRAPPRLRPPICLRCRALDASRPVAVERERERDEEDGLEDEEESYFSVTSSGLSDVDYLGESTRGDLNVRRERLEALGGNGKSTLHGPIEEIAWKEAGEAETLLHDLGIAAPFSVRHSSRGIFCTRTLNLRSISVVGYDMDYTLIHYNVMAWEGRAYDYGMDNLKSMGFPVDDLKFDPELVIRGLIIDKEKGNLVKADRFGYVKRAMHGTQMLSTRAVSEIYGRELVDLRKESRWEFLNTLFSVSEAVMFMQMVDKLDQGLVPAELGPLDYKGLYNAVSKALFRAHVEGQLKREIMAEPERFVEPDPELPLALLDQKEAGKKLLLITNSDFHYTNKMMNHAFNRFLPNDVGWRDLFEMVIVSARKPEFFQLSHPLYEVVTDDGLMRPCFKVKSGGLYSGGSAQMVEKSLDIHGDEILYVGDHIYTDVSQSKVHLRWRTALICRELEDEFDALVKSYDQKEKLVTLIQQKENVGDLFNQLRLALQRRSNSRPAQTLAATCMDEQELTESMQKLLIVMQRLDEKIGKC

SEQ ID NO: 5011 - protein, 192 aa, Triticum aestivum
METLVISQQRSHHHHHHSGRRRKPSPHTSSPQPMRGYHAFNCRAFHSSISIGILPSPPPPPPPPAPRARTYSPEPKTPKQQLHNDKKRSRAIPITPSGSPPSRPELWAGPAYSNSPPPSSLPIPKFSLHQKRSVSLELPPADRPEHVEVLVHAKSAPSTPTAGSGFGFFGDNDTAIATENLRRILNLEITED

SEQ ID NO: 5012 - protein, 192 aa, Triticum aestivum
METLVISQHRSHHHHHHSGRRRKPSPHTSSPQPMRGYHAFNCRAFHSSISIGILPSPPPPPPPPAPRARTYSPEPKTPKQQLHNGKKRSRAIPITPSGSPPSRPELWAGPAYSNSPPPSSLPIPKFSLHQKRSVSLELPPADRPEHVEVLVHAKSAPSTPTAGSGFGFFGDNDTAIATENLRRILNLEITED

SEQ ID NO: 5013 - protein, 193 aa, Triticum aestivum
METLVISQQRSHHHHHHHSGRRRKPSPHTSSPQPMRGYHAFNCRAFHSSISIGILPSPPPPPPPAAPRARTYSPEPKTPKQQLHNGKKRSRAIPITPSGSPPSRPELWAGPAYSNSPPPSSLPIPKFSLHQKRSVSLELPPADRPEHVEVLVHAKSAPSTPTAGSGFGFFGDNDTAIATENLRRILNLEITED

SEQ ID NO: 5014 - protein, 190 aa, Secale cereale
METLVISQQRSHHHHHHSGRRRKPSPHSSSPQPMRGYHAFNCRAFHSSISIGILPSPPPPPPAPRARTYSPEPKTPKQQLHNGKKRSRAIPITPSGSPPSRPELWAGPAYSNSPPPSSLPIPKFSLHQKRSVSLELPPADRPEHVEVLVHAKSAPSTPTAGSGLGFFGDSDTAIATENLRRILNLEITED

SEQ ID NO: 5015 - protein, 192 aa, Secale cereale
METLVISQQRSHHHHHHSGRRKKPSQHSSSPQPMRGYHAFNCRAFHSSISIGILPSPPPPPPPPAPRARTYSPEPKTPKQQLHNGKKRSRAIPITPSGSPPSRPELWAGPAYSNSPPPSSLPIPKFSLHQKRSVSLELPPADRPEHVEVLVHAKSAPSTPTAGSGLGFFGDSDTAIATENLRRILNLEITED

SEQ ID NO: 5016 - protein, 192 aa, Secale cereale
METLVISQQRGHHHHHHSGRRRKPSPHSSQPQPMRGYHAFNCRAFHSSISIGILPSPPPPPPPPAPRARTYSPEPKTPKQQMHNAKKRSRAIPITPSGSPPSRPELWAGPAYSNSPPPSSLPIPKFSLHQKRSVSLELPPADRPEHVEVLVHAKSAPSTPTAGSGLGFFGDSDTAIATENLRRILNLEITED

SEQ ID NO: 5017 - protein, 189 aa, Avena sativa
METLVISQQRSHHHHHSGRRRKQSPHFSSPHPVRGYQAFNCRAFHSSVSIGILPSPPTPPPARPARTYSPEPKTPKQQHQLHNGKKRSRAIPISPSRSPPSPPELWAGPAYSNSPPPSSLPIPKFSLHQKRSVSLELPAADRSEHVEVLVHAKSAPSTPTAGSGAGFFSDSDTAIATENLRRILHLEIA

SEQ ID NO: 5018 - protein, 184 aa, Brachypodium distachyon
METLVISQQRSHHHHSGRRRKPSSHFSSPQSMRGYNCRAFHSTVSIGILRSPPPPPPTAPARTRSSPEPKTPKQQQLGKKRSRVIPITPSGSPPSRPELWAGPAYSNSPPPSSLPIPKFSLHQKRSVSLELPPTGPSVHVEVLVHAKSAPSTPTAGSGSDFFGNDTAIATENLRRILNLEIADH

SEQ ID NO: 5019 - protein, 158 aa, Triticum aestivum
RGYHAFNCRAFHSSISIGILPSPPPPPPPPAPRARTYSPEPKTPKQQLHNGKKRSRAIPITPSGSPPSRPELWAGPAYSNSPPPSSLPIPKFSLHQKRSVSLELPPADRPEHVEVLVHAKSAPSTPTAGSGLGFFGDNDTAIATENLRRILNLEITED

SEQ ID NO: 5020 - protein, 267 aa, Secale cereale
MPRRSQSSAPIDLDEEDECKTKRSRASIRPAPKVPGSSNRIASSRRDKENQDKLDTRIFDLYMEDLWKRTNEDQKNTYAYLDPLWFNSYVNGANDQKSRILRWTKKLKIFSRKCVFVPIVRWGHWNLLVLCHFDETDCSDAKKGPRMLLLDSLNTTDPKRLAPEIRRFIRGIYEIEEREESVHFINKIRLEFPKVPQQNGEECGIYVLYFIHCFLQNGKLAEVLQNKTLEEDFSQLFDDGTFDPEELENFRKDVHAFQVERSTETGQ

SEQ ID NO: 5021 - protein, 267 aa, Triticum aestivum
MPRRSQSSAPIDLDEEDECKTKRSRASIRPAPKVPGSSNRIASSRRDKENQDKLDTRIFDLYMENLWKRTDEDQKNACAYLDPLWFNSYVNGDKEQKSRILRWTKKLKIFSRKYVFVPIVRWGHWNLLVLCHFDETDCSDAKKGPRMLLLDSLNTTDPKRLAPEIRGFIRGIYEIEEREESVHFIKKIRLEFPKVPQQNGEECGIYVLYFIHCFLQNGKLAQVLENKTLEEDFSQLFDDGTFDPEELENFRKDVHAFQVERSTETGQ

SEQ ID NO: 5022 - protein, 280 aa, Leymus cinereus x Leymus triticoides
ATVRHLGRLAVVAMPRRSQSSAPIDLDEEDECKSKHSRGSTRPAPKMPGSSNRIASSRRDKENQDKLDTRIFDLYMEDLWKRTDEDQKNAYAYFDSLWFNSYVNAGNEKKSRILRWIKKLKIFSRKYVFVPIVRWGHWNLLILCHFDETECSDAKKGPRMLLLDSLKTTDPKRLEGDIRRFIRGIYEIEEQEESVHFINKIRLEFPKVPQQNGEECGIYVLYFIHCFLQNGKLAEVLQKKTLKEDFSQLFDDGTFDPEELENFRKDVHAFQVERSTETGQ

SEQ ID NO: 5023 - protein, 492 aa, Brachypodium distachyon
MSSPRHPPPPPPARVRLDDVAVHDGAAAPAYARSVAALADSLARRNAAVLELPAHDAAVVRCALESARAFFRGRASVYVYRAGRTLEDGELSPACMSDAFRCLGKAARVALCAIARHLRLRTDVFNHLLDDTPLPINEVSSSELLVAYSHEQLQSGQAPMGFLRSSMPEVDRGFVTLVASDCPGIEVCDPNGHWYLADGGSGPTDLLLLTGRALSHVTAGLRPISQYRASNENRASLTFRLMPHANAVLGCSPILAAGHCIGQIHQPIPASQFMDDSCAEEHAVSSRLEEPSESQGNFVSDPSLRSVLSDPLSGAFLEDAMVLSCGHSFGGLMLKKVVEMARCTICHGEVDPASLFPNLALRAVATVVKMEDDRRLFHNAALRKRRKDVTGHTDVPKRAGSSKDNGELVLDAESSAPFKGVQYPFVVGERVLIMGNKRTPEKFVGKEAVITSQCLNGWYLVKAVDSGESIRLQYRSLKKVMELQMQALAFLR

SEQ ID NO: 5024 - protein, 434 aa, Triticum aestivum
AFFRGRHAAYLYRSGRTLEDGELSPACMADAFRCLGKAARAALCAIARHLRLRTDVFNQLLDDTPLPVNEVSSSELLVAYSHEQLQSGHTLMGCPSRSSMPQVDRGFVTLVASDYPGIEVCDPNGHWYLADGVSGPNNLLLLTGRALSHVTAGLCPISQYRVTNENRASLTFRLVPHANAILDCSPILAAGHCIRQVYQPIPASQFMDDSYAEEHAVSSHLEEPSESQGNFVSDPSLRSVLSDPLSGAFLEDAMVLQCGHSFGGVMLKKVIEMARCTICNGEVDPSSLFPNLALRAVATVVKMEDDRRLFHNAALRKRRKDVTEHTDVPKRTGSRKDNSELALDAESPVAFKGVQYPFVVGERVLIMGNKRTPEKFIGKEAVITSQCLNGWYLVKALDSGESTRLQYRSLKKVPELQLQTQARLQPLAFLGGRQ

SEQ ID NO: 5025 - protein, 580 aa, Triticum aestivum
KLLRRTKELDACFMVPSEEMSELNMLRDKRLNSTDIMQLVLSLIEDRKQLALELSSQIKARLTERFAAKEQYNRSRVELDSRTRRLENEKTDVQTTLERELDRRSNDWSARLARFQAEEQRLRDRVMELAEQNVSFQREVNLLESNRVEVSNRITSLELQNKQLNNELEKVKGEHTSLYRSSVELHDSFTKAAEERDQIQECLKSKEDNSRALHKVIARLQRESNEQEKTINGLRQGFSAELEKRSAGSSESITRTQMELLRLAGVEQKLRKEIQSCNLEVESLQQENIGILNHLESSGNGLSLSLLRVDLELHARVDNLQMQGLSLLEDTSCLCGKLLDVMKSKSENIRSVDALAAIEYTLKYQNIRQGMDNLALSLRKVKSVLVEKHNEEDNTVGVPVRHDTLYRDDFEIKLKEEALLNRVLKEKLLSRELDIEQLQADVASFVRIQDAMENEIHRTQDELCRATHKFKHFELQVLKKDESINQMQQDFQESAKELTTLRCTLKSVSDERDALWQETKHLRKTVSVLQNDVASLKQKIKSLDKDIQLKEGEILLREGEISILQDSIDRPLDIICSPHQ

SEQ ID NO: 5026 - protein, 334 aa, Secale cereale
MEAPLLLPVSTTAASSTSITVDDDSHGAAGASVSPSRASPSGRSIAARYLAVALVAAVSLFAQHEASKGFRIDVVRGGGTAGAAGKRFDLLFVANGRAERVLHRASRRIEEALFPDPSFPRRRVARVTVRLMAGGNLTADDATVDAVTDGEYVISLSPRLLSPSSGAGAAEAVAAAVRRAVARMWLWDGRGAAPARVTESMVEYLATAVPDEPSSPAEEHASASNTQCISAAVPGAPGAAARRVRGAAEQGNEGPVERRRGGRRPGGASPARLRRLPRGGDGNRRPTTGGWLRGGGLSQQGVGTAHEGWFARDRTCTPCLSRDSVGQSLVRKCN

SEQ ID NO: 5027 - protein, 297 aa, Secale cereale
MEAPLLLPVSTAAFSDSTSITVDDDSHGAAGASVSPSRASPSARSIAARYLAVALVAAVSLFAQHEASKGFRIDVVRGGGTAGAAGKRFDMLFVANGRAERVLHRASRRVEEALFPDPSFPRRRVARVTVRLMAGGNLTADDATVDAVRDGEYVISLSPRLLSPSSGAGAAEAVAAAVRQAVARMWLWDGRGAAPARVTESMVEYLATAVPDEPSSPAEEHASASNTQCISPRFLEHLERRRAGFVARLNRAMRDRWSDAAVDAALGSPARPVCAAYLAAATETGGQRPVVGSAVAV

SEQ ID NO: 5028 - protein, 296 aa, Avena sativa
MEAPLLLPVSTAASCSSSYITVDDDTASVVPPSPKPSSPSGLSILARYLAVLLVASVSLFAHHEASKGFRIDVVSAAPQGSVAGRRFDLLFVSNGRAERVLHRASRAVEDALFPDPSFPRRRVTRVTVRMAGGGNLTAADATLDAAADGEYVISLSPRLLSDAKAVDAVAAAVRRAVARMWLWDARGAAPARVTESMVEYLATAVPDAAEAESSSPADASNTHCISPRFLKHLERRRAGFVARLNRAMRDRWSDAAVDAALGAPARPVCAAYLAASVQRPVVGSAPVADGSTVAVV

SEQ ID NO: 5029 - protein, 295 aa, Avena sativa
MEAPLLLPVSTAASCSSSYITVDDNTASAAPPSPKPSSPSGLSIAARYLAVLLVASVSLFAHHEASKGFRIDVVSAAPQGTLAGRRFDLLFVSNGRAERVLHRASRAVEDALFPDPSFPRRRVTRVTVRMDGGGNLTAADANLDAAADGEYVISLSPRLLSDAVAAAVRRSVARMWLWDARGAAPARVTESMVEYLATAVPDAAADVESSSPADAHDASNTRCISPRFLKHLERRRAGFVARLNRAMRDRWSDAAVDAALGAPARPVCAAYLAASVQRPVVGSASATDGSTVAVV

SEQ ID NO: 5030 - protein, 222 aa, Triticum aestivum
MRPPLASSSSSSIAAAAATAPSSSSAPPATTRRALLLSTSALTLAAVVPAVAQAAANPFSTPYSQSRTLQLGLDTNGKIRTCPSTNPGCVCTNPTVGASSSVASPLIIPESTSADAAAQMLRQAILKTQKNVSFNVDQRTPHGQYIQAEVDGGFGRDVMEFLVKKDAGVVAYRCVATKVTFVYPFTTAIGDSRGQEQRVAAVAQELGWYAPDIRSSVDDVAT

SEQ ID NO: 5031 - protein, 202 aa, Secale cereale
TAPSSAPPATTRRALLLSTSPLTLAAVVPAVAQAAANPFSTPYSQSRTLQLGLDTNGKIRTCPSTNPGCVCTNPTVGASSSVASPLIIPESTTADAAAQLLRQAILKTQKNVSFNVDQQTPHGQYIQAEVDGGFGRDVMEFLVKKDAGVVAYRCVATKVTFVYPFTTAIGDSRGQEQRVAAVAQELGWYAPDIRSSVDDVAT

SEQ ID NO: 5032 - protein, 244 aa, Secale cereale
MESDGSASPNGGAACAVCGGAAALYCPADAAALCVPCDAAVHSANPLASRHDRVPLAAAVAATSGVYDLFAADEEGAASWPTPGQGSPNSGSSSGFSNGGGVEMSLFDLLSDVDLLATGAGGSMLSDGSVAPLWLPPSLAADGSAAWTSSWSQSEAVVVPSAADRAERVRRYREKRKNRKFQKTIRYASRKAYAEARPRIKGRFVKRPAAPASDDGDNTAKFWLSFSDNSVGFQVASHGVVPSF

SEQ ID NO: 5033 - protein, 245 aa, Secale cereale
MESDGSASPNGGAACAVCGGAAALYCPADAAALCVPCDAAVHSANHLASRHERVPLAAAVAATSGVYDLFAADEEGGSSWPAPGQGQGSPSSGSSGFSNRGGVEMSMFDLLSDVDLLATGAGGSMLSDGGVAPLWLPPSLSADGSAAWTSSWPPSEAVVVPSAADRAERVRRYREKRKNRKFQKTIRYASRKAYAEARPRIKGRFVKRPAAPASDDGDNTAKFWLSFSDKSVGFQVASHGVVPSF

SEQ ID NO: 5034 - protein, 144 aa, Leymus cinereus x Leymus triticoides
MDAKKRSPPTPSADGAAPPAANGYFSSVFSSSPAANPRDARQMDLYTLLNKQNPKGQSGGGIADAKSQGSPTIGRVAYKDGKQFYPNESSESPYFGSSVHYGGRDFYDSSPHKQANESSRNYKEDNTDGSLATRGDWWQGSLYY

SEQ ID NO: 5035 - protein, 144 aa, Avena sativa
MDAKKKSPPTPAAAGAAPAAANGYFSSVFSASPAANPRDARQTDLYTMLNKQNPKGQSGGGIADGKSQVSPTKGCVAYKDGKQFYPNESSESPYFGSSVHYGGRDFYDSSSIKQANEPSRNYKEDNPDGSLATRGDWWQGSLYY

SEQ ID NO: 5036 - protein, 146 aa, Triticum aestivum
MDAKKRSPPTPAAAGAAPPAANGYFSSVFSASPSPAANPRDARQMDLYTILNKQNPKGQSGGGIADAKSQGSPTIGRVAYKDGKQFYPNESSESPYFGSSVHYGGRDFYDSSPHKQADESSRNYKEDNADGSLATRGDWWQGSLYY

SEQ ID NO: 5037 - protein, 146 aa, Secale cereale
MDAKKRSPPAPSAAGAAPPAASGYFSSVFPASASPAANPRDARQMDLYTILNKQNPKGQSGGGIADAKSQGSPTIGRVAYKDGKQFYPNESSESPYFGSSVHYGGRDFYDSSPHKQADESFRNYKEDNADGSLATRGDWWQGSLYY

SEQ ID NO: 5038 - protein, 146 aa, Triticum aestivum
MDAKKRSPPAPSAAGAAPPAANGYFSSVFSAPASPAANPRDARQMDLYTILNKQNPKGLSGGGIADAKSQGNPTNGRVAYKDGKQFYPNESSESPYFGSSVHYGGRDFYDSSPHKQADESSRNYKEDNADGSLATRGDWWQGSLYY

SEQ ID NO: 5039 - protein, 147 aa, Triticum aestivum
MDAKKRSPPAPSAAGAAPPAANGYFNSVFSAPASPAANPRDARQMDLYTILNKQNPKGQSGGGIAGNAKSQGSPTIGRVAYKDGKQFYPNESSESPYFGSSVHYGGRDFYDSSPHKQADESSRNYKEDNADGSLATRGDWWQGSLYY

SEQ ID NO: 5040 - protein, 146 aa, Pseudoroegneria spicata
MDAKKRSPPTPSAAGAAPPAANGYFNSVFSASASPAANPRDARQIDLYTILNKQNPKGQSGGGIAEAKSQGSPTIGRVAYKDGKQFYPNESSEPPYFGSSVHYGGRDFYDSSPHKQANESSRNYKEDNADDSLATRGDWWQGSLYY

SEQ ID NO: 5041 - protein, 146 aa, Secale cereale
MDAKKRSPPAPSAAGAAPPAVSGYFSSVFPASASPAANPRDARQMDLYTILNKQNPKGQSGGGIADAKSQGSPTNGRVGYKDGKQFYPNESSESPYFGSSVHYGGRDFYDSSPRKQADESSRNYKEDNADGSLATRGDWWQGSLYY

SEQ ID NO: 5042 - protein, 146 aa, Triticum aestivum
MDAKKRSPPAPSAAGAAPPAANGYFNSVFSAPASPAANPRDARQMDLYTILNKQNPKGQSGGGIADAKSHGSPTIGRVAYQDGKQFYPNESSESPYFGSSVHYGGRDFYDSSPHKQADESPRNYKEDNADGSLATRGDWWQGSLYY

SEQ ID NO: 5043 - protein, 114 aa, Hordeum vulgare
MEAKKSPPTPASTGSAAAGNGYFSSVFSASPAANPRDARQMDLYTMLNKQNPKGQSGGGTADGKSQGSPAKGRVAYKDGKQFYPNESSESPYCGSAVHYGGRGFYDSSPHKAGQ

SEQ ID NO: 5044 - protein, 211 aa, Secale cereale
MATAMMAAATTSCSPRRALLKPVASSSSPPPPRPQPRSFLKQLPGLAATAAAAAVASVPLPALAVEMEKAALFDFNLTLPAITIEFLLLMVALDKLYFSPLGKFMDERDAKIRAELGGVKDASEEVRQLEEQAQAILKAARAEIAAALNKMKKETTKELEAKLDEGRRRVEAELVEALASLEGQKEEAIKALDAQIVSLSDEIVKKVLPSA

SEQ ID NO: 5045 - protein, 211 aa, Leymus cinereus x Leymus triticoides
MATAMMAAATTSCSPRRALLKPVASSSSAPPPRPQPRSFLKQLPGLAATAAAAAVASVPLPALAVEMEKAALFDFNLTLPAITIEFLLLMVALDKLYFSPLGKFMDERDAKIRAELGGVKDASEEVRQLEEQAQAILKAARAEIAAALNKMKKETTAELEAKLDEGRRRVEAELVEALASLEGQKEEAIKELDAQIVSLSDEIVKKVLPSA

SEQ ID NO: 5046 - protein, 211 aa, Triticum aestivum
MATAMMAAATTSCSPRRALLKPAASSSSAPPPRPQPRSFLKQLPGLAATAAAAAVASVPLPALAVEMEKAALFDFNLTLPAITIEFLLLMVALDKLYFSPLGKFMDERDAKIRAELGGVKDASEEVRQLEEQAQAILKAARAEIAAALNKMKKETTTELEAKLDEGRRRVEAELVEALASLEGQKEEAIKALDAQIVSLSDEIVKKVLPSA

SEQ ID NO: 5047 - protein, 206 aa, Avena sativa
MATAMMAAATTSCRALLKPLASSSSAPPPRPRSLLKQLPGLVATAAAAAVASAPLPALAVEMEKAALFDFNLTLPAITIEFLLLMVALDKLYFSPLGKFMDERDAKIRSELGGVKDASEEVRQLEEQAQAILKAARAEIAAALNKMKKETTTELEAKLDEGRRRVEAELVEALSSLEAQKEEAVKALDAQIASLSDEIVKKVLPSA

SEQ ID NO: 5048 - protein, 206 aa, Avena sativa
MATAMMAAATTSCRALLKPVASSSSAPPPRPRSLLKQLPGLVATAAAAAVAAAPLPALAVEMEKAALFDFNLTLPAITIEFLLLMVALDKLYFSPLGKFMDERDAKIRSELGGVKDASEEVRQLEEQAQAILKAARAEIAAALNKMKKETTTELEAKLDEGRRRVEAELVEALSSLEAQKEEAVKALDAQIASLSDEIVKKVLPSA

SEQ ID NO: 5049 - protein, 217 aa, Brachypodium distachyon
MATAMMAAATTSCSPRRAPLALKPVASSSSAPPPPRPQPRRSFKQLPGLVSTAAAAAAAAVVSAPLPALAADIEKAALFDFNLTLPFITIEFLLLMVALDKLYFSPLGKFMDDRDAKIRAELGGVKDASEELRQLEEQAQAVLKAARAEIAAALNKMKKETTTELEAKLDEGRRAVEAELVEALGNLEAQKEEAIKALDAQIASLSDEIVKKVLPSA

SEQ ID NO: 5050 - protein, 211 aa, Oryza sativa
MATAMMAATATSCSPRRAPVVASSSVQPPRRQQQQQPRRGLKQLPGLVATAAVAVAAAPLPALAEQMEKAALFDFNLTLPLIATEFLLLMVALDKLYFTPLGKFMDERDAKIRAELGGVKDASEEVRQLEEQAAAVLKAARAEIAAALNKMKKETTQELEAKLDEGRRRVEAELVEALANLEAQKEEAVKALDAQIASLSDEIVKKVLPSA

SEQ ID NO: 5051 - protein, 152 aa, Oryza sativa
MAPKAEKKPAEKKPAAGEEKSAEKAPAGKKPKAEKRLPASKASSKEGGAGDKKGRKKAKKSVETYKIYIFKVLKQVHPDIGISSKAMSIMNSFINDIFEKLAQEAARLARYNKKPTITSREIQTSVRLVLPGELAKHAVSEGTKAVTKFTSN

SEQ ID NO: 5052 - protein, 209 aa, Panicum virgatum
MATALMAAATTSCSPRRAAPLLKPVASSSSSSARPRRPSAQQLPRLLATATAAVAAAPLPALAEQMEKAALFDFNLTLPAIAIEFLLLMVALDKLYFTPLGKFMDERDAKIRGELGDVKDASEEVKQLEEQAAAILKAARAEIGGAQQDEEGDHRGLEAKLDEGRRRVEAELVEALANLESQKEEAVKALDAQIASLSDEIVKKVLPSA

SEQ ID NO: 5053 - protein, 212 aa, Setaria italica
MATALMAAATTSCSPRRAAPLLKPMASSSSSPSSARARRPLAQQLPRLLATAAAAVAAAPLPALAEQMEKAALFDFNLTLPAIATEFLLLMVALDKLYFTPLGKFMDERDAKIRGELGDVKDASEEVKQLEEQAAAIMKAARAEIAAALNKMKKETTAELEAKLDEGRRRVEAELVEALANLEAQKEEAVKALDAQIASLSDEIVKKVLPSA

SEQ ID NO: 5054 - protein, 212 aa, Pennisetum glaucum
MAPALMAAATTSCSPRRAAPILKPVASSSSSPNSARPRRPLAQQLPRLLATAAAVVAAAPLPALAEQMEKAQLFDFNLTLPAIATEFLLLMVALDKLYFTPLGKFMDERDAKIRGELGDVKDASEEVKQLEEQAAAIMKAARAEIAAALNKMKKETTAELEAKLDEGRRRVEAELVEALANLEAQKEEAIKALDAQIASLSDEIVKKVLPSA

SEQ ID NO: 5055 - protein, 246 aa, Panicum virgatum
MATTLMAAATTSCSPRRAAPLLMKPVASSSSSSARPRRPLAQQLPRLLATAAAAVAAAPLPALAEQMEKAALFDFNLTLPAIATEFLLLMVALDKLYFTPLGKFMDERDAKIRGELGDVKDASEEVKQLEEQAAAIMKAARAESPGAQQDEEGDHRRAGGQAGRGPPPRRGRARRGARQPRIPEGGGRQGARRADRLAQRRDRQEGAPIRVRGNRNSEPAFFLAQLSDLCVYACWAAVRCRPCFIL

SEQ ID NO: 5056 - protein, 145 aa, Zea mays
MEKAALFDFNLTLPAIATEFLLLMVALDKLYFTPLGKFMDERDAKIRGELGDVKGASEEVKQLEDQAAAIMKAARAEIAAALNKMKKETTAELEAKLDEGRSRVEAELVEALANLEAQKEEAVKALDAQIASLSDEIVKKVLPSA

SEQ ID NO: 5057 - protein, 214 aa, Sorghum bicolor
MATAMMAASTTSCSPRRAAPVLKPVASSSSSSSSSSARPRRPLAQQLPRLLATAAAAVAAAPLPVLAEQMEKAQLFDFNLTLPAIATEFLLLMVALDKLYFTPLGKFMDERDAKIRGELGDVKDASEEVKQLEDQAAAIMKAARAEIAAALNKMKKETTAELEGKLEEGRSRVEAELVEALANLEAQKEEAVKALDAQIASLSDEIVKKVLPSA

SEQ ID NO: 5058 - protein, 310 aa, Triticum aestivum
MSHSTLLVRPPAPANPSLPLRRCAPVSAAAATLRTFPAASSVAQFSRLRTKCRFAAPGVREDYSSTPIDVVADVKTEKIVVLGGSGFVGSAICRAAVAKGIEVVSLSRSGRPSYSDPWADEVTWLAGDVFYARWEDVLVGATAVVSTLGGFGNEEQMKRINGEANTIAVDAAKEFGIPKFILISVHDYNLPSFLLTSGYFTGKRKAESEVLSKYPSSGVVLRPGFIYGKRKVDGYEIPLDIVGQPLEKLLSSVENFTKPLSALPGSDLVLASPVNVDDVAYAVINAVIDDSFFGVFTIEQIKEAAASARV

SEQ ID NO: 5059 - protein, 310 aa, Leymus cinereus x Leymus triticoides
MSPSTLLVRPPVPANPSLPPRRCVPVSAAAATLRTSPAASSVAQFSRLQTKCRFAAPGVREDYSSTPIDVVADVKTEKIVVLGGSGFVGSAICRAAVAKGIEAVSLSRSGRPSYSDPWADEVTWLAGDVFYARWEDVLVGATAVVSTIGGFGNEEQMKRINGEANTIAVDAAKEFGIPKFILISVHDYNLPSFLLTSGYFTGKRKAESEVLSKYPSSGVVLRPGFIYGKRKVDGYEIPLDIVGQPLEKLLSSVENFTKPLSALPGSDLVLASPVNVDDVAYAVINAVIDDSFFGVFTIEQIKEAAASARV

SEQ ID NO: 5060 - protein, 310 aa, Secale cereale
MSPSTLLVRPPAPANPSLPHRRCAPVSAASATLRTSPAASSVAQFSRLRTKCRFAATGVREDYSSTPIDVVADVKTEKIVVLGGSGFVGSAICRAAVAKGIEVVSLSRSGRPSYSDPWADEVTWLAGDVFYARWEDVLVGATAVVSTLGGFGNEEQMKRINGEANTIAVDAAKEFGIPKFILISVHDYNLPSFLLTSGYFTGKRKAESEVLSKYPSSGVVLRPGFIYGKRKVDGYEIPLDIVGQPLEKLLSSVENFTKPLSALPGSDLVLAPPVNVDDVAYAVINAVINDNFFGVFTIEQIKEAAANARV

SEQ ID NO: 5061 - protein, 308 aa, Avena sativa
MSPSALLVRPPAPTSPSVPPRRCAAASASAAAATLRTSPAVSHFSRLRTKCRFAAPGVSEDYSAPIDVVADVKTEKIVVLGGSGFVGSAICRAAVAKGIEVVSLSRSGRPSYSDPWADEVTWLAGDVFYARWEDILVGATAVVSTLGGFGNEEQMKRINGEANAIAVDAAKEFGVPKFILISVHDYNLPSFLLTSGYFTGKRKAESEVLSKYPSTGVVLRPGFIYGKRKVDGFEIPLDFVGQPLEKLLSSVENFTRPLSALPGSDLVLAPPVSVDDVAYAVINAVIDDTFFGVFTIEQIKEAAANVRV

SEQ ID NO: 5062 - protein, 309 aa, Brachypodium distachyon
MSPSTLPLVRPPAPANPSLPPRRCPPLSAATLRAAPAASALAQFSRLRTKCRFSASGVREDYSSTPIDVVADVKTEKIVVLGGSGFVGTAICKAAVAKGIEVVSFSRSGRPSSYDPWADEVTWLAGDVFYARWDEVLVGATAVVSTLGGFGNEEQMKRINGEANTIAVDAAKEFGIPKFILISVHDYNLPSFLLTSGYFTGKRKAESEVLSKYPSSGVVLRPGFIYGKRKVDGFEIPLDIVGKPLEQLLSSVENFTKPLSALPASDLILAPPVNVDDVAYAVINAVIDDSFFGVFTIEQIKEAAASARV

SEQ ID NO: 5063 - protein, 1011 aa, Oryza sativa
MEAEPPPENRHDDHHPSTSGGGLGYFHLRLLCPAAPLLLLLRSDRLYSLSLSRRRGPRLRLLASPRRRHGRRRRALLLSTSGCALRLTHRSSSADAVRVNGRPLLRGGCPADLAVGDEVSLLRRGTRYGFLVEKFVSCERPKLAAAEPCGEVLVLRAESLRKRLRAISESHDPLSFLRDSHCVENGSDDVRVKKAREEDVFLPLNLNAPIDPVAVEGLLREDCNLGQGKLEHCTDSAIAKNETDELIQRSKGSCDGNTEQKEYSNENTEQQHNENEGCYSDGSTFFLNRLIGIGSDMRVEQRSGVTLPQLLHPMDSLERVFIATFTSDVSWFLDYCKVPQNLPVTIACHNKERCWSASRESRTAAPFGSYPNLLLVYPQFPEEIAFGKDRKKQGVACHHPKLLVLQRKDSMRVIVTSANLVPRQWHLITNTVWWQDFPCRTSTDYSALFSKVEESKSDFATQLVSFIAFLINEVPSQSYWINEIAKYNFEGAAGYLIASVPGIYARNPHYLESNYCLSRKQILHTKSAHRMFLGSVQTSVVGLSHRFHIPSDAGSKLKALSVLLSKCHVNMHGTTEVILKRNTNIPADANAVSVLVADLDKFTEEDSVHLGFLPREVAKWVSPLSDLGFFTFSGFIYPREALEAAYGATNTKVQLLLYVSKGPEFSQISRLIQDEHFPLLCSLVASLKRSLGLWRLEEVLSHFKWPETLETDFFYSASSIGTSINPQFIASFASAAGKRCNQDLDSEESDPEWGCWTANHELKKPSINLLFPTIDRVKNGACGIQLSRHLLSLPERTWQRLRSTGIFRDAIPHPYERIGHPMHVKVAQRRFESRLGRHSFGWTYCGSHNFSPAAWGQQLPPPKANPTEARAVSSGPRLHICNYELGIILIIPPSAMSKQISGRRHEINDIVLPFVVPPPQYKLGDRPATSLAMREAMAEARILQSNDLVLDLSQDTDEDIPDEDDEHVIELSDCSPEEKEEEKIYAETLWEQVDSSQRPGWPVKLKSRCFG

SEQ ID NO: 5064 - protein, 306 aa, Zea mays
MAPSPILVRPPALANSPLPPPRCVAAVAAAPAVRTAPAAPFSRLRTKCRFAASDVREDYSSTPIDIVADVKTEKIVVLGGSGFVGSAICRAAVSKGIEVVSFSRSGRPSYSDPWVDQVNWLPGDVFYARWDEVLVGATAVVSTLGGFGNEEQMKRINGEANVIAVNAAKENGVPKFILISVHDYNLPSFLLTSGYFTGKRKAESEVLSKYPASGVVLRPGFIYGKRKVNGFEVPLDAVGQPLEKLLSSVENFTKPLSSLPASDLILAPPVSVDDVAYAVINGVIDDSFFGVFTIEQIKEAASKVRV

SEQ ID NO: 5065 - protein, 307 aa, Oryza sativa
MSPSPLLARPPAPSSPSTYPSLPPRRCAPAVASAALRVAPATASRAPFSRLVTKRNFAASDIREDYSTPIDVVADIVVLGGSGFVGSAICKAAVSKGIEVVSLSRSGRPSYSDPWVDQVTWLAGDVFYARWDEVLVGATAVVSTLGGFGNEEQMKRINGEANVTAVDAAKEFGIPKFILISVHDYNLPSFLLNSGYFTGKRKAESEVLSKYPTSGVVLRPGFIYGKRKVDGFEIPLDVVGQPLEKLLSSVENFTKPLSSLPASDLLLAPPVSVDDVAYAVINGVIDDSFFGVFTIEQIKEAAAKVRV

SEQ ID NO: 5066 - protein, 306 aa, Sorghum bicolor
MAPSPLLVRPPAMANSPLPPPRCAAAVAAAPAVRTAPAAPLSRLRTKCRFAASDVREDYSSTPIDIVADVKTEKIVVLGGSGFVGSAICKAAVATGIEVVSFSRSGRPAYSDPWVDQVNWLAGDVFYARWDEVLVGSTAVVSTLGGFGNEEQMKRINGEANVIAVNAAKEYGVPKFILISVHDYNLPSFLLTSGYFTGKRKAESEVLSKYPASGVVLRPGFIYGKRKVNGFEVPLDAVGQPLERLLSSVENFTKPLNSLPASDLILAPPVSVDDVAYAVINGVVDDSFFGVFTIEQIKEAAAKVRV

SEQ ID NO: 5067 - protein, 310 aa, Panicum virgatum
MAPSPLLFRPLALASSPLSPRRCPPAVTAAASVRAAPAPTAASPFSRLRNKCRFAASDVREDYSSTPIDIVADVKTEKIVVLGGSGFVGSAICKAAVSKGIEVVSLSRSGRPSYSDSWVDQVNWQAGDVFYARWDEVLVGATAVVSTLGGFGNEEQMKRINGEANIIAVNAAKEYGVPKFILISVHDYNLPSFLLTSGYFTGKRKAESEVLAKYPGSGVVLRPGFIYGKRKVNGFEIPLDAVGQPLEKLLSSVENFTKPLSSLPASDLVLAPPVSVDDVAYAAINAVVDDSFFGVFTIEQIKEAAAKVRV

SEQ ID NO: 5068 - protein, 354 aa, Festuca arundinacea
  misc_feature (98)..(98): Xaa can be any naturally occurring amino acid
  misc_feature (215)..(215): Xaa can be any naturally occurring amino acid
ARGHTAVRPLPAAPPFPSPTRESVRGGRRARSLHPARDPPMSPSTLLVRPPAPAPASPSLPPRRYAPASAAAAPATLRTSPAVSSVAQFSRLRTKCRXAAPGVREDYSSTPIDVVADVKTEKIVVLGGSGFVGSSICKAAVAKGIEVVSLSRSGRPSYSDPWADEVTWLAGDVFYARWEDVLVGATAVVSTLGGFGNEEQMKRINGEANAIAVDXAKEFGIPKFILISVHDYNLPSFLLTSGYFTGKRKAESEVLSKYPSTGVVLRPGFIYGKRKVDGFEIPLDLVGQPLEKLLSSVENFTRPLSALPGSDLVLAPPVSVDDVAYAVINAVIDDSFFGVFTIEQIKEAAANVRV

SEQ ID NO: 5069 - protein, 481 aa, Secale cereale
MGDYGNAMMRNQDAGVQSRVKAQRRANLLQLKLIGQSHPTGLTTNLLKLFEPRPPLEHKPPLEKRKLPAYSGMSQFVSRFAEPGDPEYAPPVPTCETRAEKKDRIRQLKLEEGAAKVAEELQKYDPQNDPNVTGDPYKTLFVARLGYETSEQKVKRDFEAYGPIKRVRLITDKVTNKPRGYAFVEYAHTRDMKSAYKQADGRKVDNKRVLVDVERGRTVPNWRPRRLGGGLGSSRIGGEDAAQKHSAREQQNAAGRPRSEEPRRDDRPADRDREKSRDRVRERDRDEKTRERSHDRTRDRDPREDRHHHRDRERTRDRDRERDQDRDRGRDRRDRDRHKDHGRDRDQDRDRKRERSHGRGRDRDRDYERASHEQDPGRDRDYKRARHEHDRGHLQESDADYGNGELGYNQHEHHRSHEQYGYGLDGHERSKRHEHYRDDSHSKMATNHQGQPENAEPAVPEEGEAYEEGDYQHIQAGEYRN

SEQ ID NO: 5070 - protein, 478 aa, Brachypodium distachyon
MGDYGNAMMRNQDAGVQSRTKAQSRANLLQLKLIGQSHPTGLTTNLLKLFEPRPPLEHKPPVEKRKLPAYTGMAQFVSRFAEPGDTEYAPPVPTCETRAEKKDRIRQLKLEQGAAKVAEELQKYDPQNDPNVTGDPYKTLFVARLNYETSEQKVKRDFEAYGPIKRVRLVTDKVTNKPRGYAFVEYVHTRDMKSAYKQADGRKVDNKRVLVDVERGRTVPNWRPRRLGGGLGSSRIGGEDASQKHSAREQQNAAGRPRSEEPRRDDRPADRDREKSRERVRERDRDERTRERSHDRTRDRDPREEKHHHRDRERTRDRDRERDQERDRGRDRRDRDRHKDHGRDRDQDRDRKRERSHGRGRDRDRDYEHVSHEQDPARDRDRDYKRARHEHDRGHFQESDADYGNGDPSYNQHRSHEQYGYSQGHGHETERSKRDNSHSKMANNYLGQPNDAEPEVPEEGEAYEEGDYQHNRPDEYRN

SEQ ID NO: 5071 - protein, 109 aa, Triticum aestivum
MAGLQRSSLTFRRSGSSGMVWGERLMSDEHSQWTSGEPEFRELRHSRSVGSVGAQRRRNDGTERGSQAFRTRRVAPAMDPPSPKVPGCIFCGIFRKTAPSQPSKARRYH

SEQ ID NO: 5072 - protein, 109 aa, Secale cereale
MAGLQRSSLTFRRSGSSGLVWDEMLMSDEHSQWTSGEPEFRELRHSRSVGSVSAQRRRNDSAERGGQAFRTRRVAPAMDPPSPKVPGCIFCGIFRKAGPSQTSKARRYR

SEQ ID NO: 5073 - protein, 125 aa, Leymus cinereus x Leymus triticoides
  misc_feature (73)..(73): Xaa can be any naturally occurring amino acid
  misc_feature (76)..(76): Xaa can be any naturally occurring amino acid
  misc_feature (80)..(80): Xaa can be any naturally occurring amino acid
  misc_feature (96)..(96): Xaa can be any naturally occurring amino acid
  misc_feature (109)..(109): Xaa can be any naturally occurring amino acid
  misc_feature (115)..(115): Xaa can be any naturally occurring amino acid
MAGLQRSSLTFRRSGSSGLVWGERLMSDEHSQWTSGEPEFRELRHSRSVGSVGRNDGVERGSQAFRTRRVAPXWIXLRPXFLAASSVGFSGRQDLXSHLRPEGTTRVIXVFFDLXCDRVTRFLSL

SEQ ID NO: 5074 - protein, 126 aa, Hordeum vulgare
MAGLQRSSLTFRRSGSSGMVWGERLMSDEHSQWTSGEPEFRELRHSRSVGSVGAQRRRNDGTEHGGQAFRTRRVAPAIDPPSPKVPGCIFCGIFRKAGPSQPSKARRRYIGELERDQFMNRHMFTL

SEQ ID NO: 5075 - protein, 267 aa, Triticum aestivum
MSLALLGGYSSAEDDDPAAGAGVELSDSGDSSAEEAGSDGDEKSAPSKPAAKPRPRVNPSPGDGDSSLPSALDVFAEISGPPAFLNRRVAQPEEVGEALGVLDRRSNSKRRKPPPPGAVVAAKPQMVAIRERVSSDVKNGANPPVAVVSAKPQLVAGHERVSSDMKNGANPPGSVEGKRKIGAANPGPEDAAELLRMCLQCGIPKTYSHAQGMVCPVCNDRPVQAKEPEKKKGSAVKDKEKVKRMRGQSSHASWKSETEMALRQQFD

SEQ ID NO: 5076 - protein, 266 aa, Leymus cinereus x Leymus triticoides
LALLGGYSSAEDDDPAAGAGAELSDSGDSSAEEAGSDGDEKSAPPKPVAKPRPRVNPSPGDGDSSLPSALDVFAEISGPPAFLNRRVAQPEEVGEALGVLDRRSNSKERRKPPPPGAVVAAKSQMVAIRERVSSDVKNGANPPVAVVTAKPQLVAGHERVSSDMKNGANPPGSVEGKRKIGAANPGPEDAAELLRMCLQCGIPKTYSHAQGMVCPVCNDRPVQAKEPEKKKGSAVKDKEKVKRMRGQSSHASWKSETEMALRQQFD

SEQ ID NO: 5077 - protein, 268 aa, Secale cereale
MSLALLGGYSSAEDDDPAAGAGAELSDSGDSSAEEAGSASDEESAPRKPAAKPRPRVNPSPGDGDSSLPSALDVFAEISGPPAFLNRRVAQPEEVGEALGVLDRRSNSRERRKPPPPGAVVAAKPQMVAIRERVSSDVKNGANPPVAVVSAKPQLVAGHERVSSDMKNGANPPDSVDGKRKIGAANPGPEDAAELLRMCLQCGIPKTYSHAQGMVCPVCNDRPVQAKEPEKKKGSAVKDKEKVKRMRGQSSHASWKSETEMALRQQFD

SEQ ID NO: 5078 - protein, 263 aa, Festuca arundinacea
  misc_feature (161)..(161): Xaa can be any naturally occurring amino acid
  misc_feature (167)..(168): Xaa can be any naturally occurring amino acid
MSLALLGGYSSAEDDDPAAADLSDSGGSSAEEAGSDVDEAPAPPKPAARPSRRVNPSPGDGDSSLPSALDVFAEISGPPDFLNRRVAQPEEVREALGVLDRRSKQGRKPPPPGAVVAAKPQLVAIRERVSSDMKNGANPQGAVVSAKPQLIADHERVNSDXKTGANXXGSVEGKRKIGAANPGPEDAAELLRMCLQCGIPKTYSHAQGMVCPVCNDKPMQTKEPEKKKTSAVKDKEKVKRMRGQSSHASWKSETEMALRQQFD

SEQ ID NO: 5079 - protein, 270 aa, Brachypodium distachyon
MSLALLGGYSSAEDDDPAAGAGAELSDSGGSSLEEAGSDGEEDSAPPKPAAKPRRGANPSTGADGGGGDSSLPSALDVFAEISGPPDFLNRRVAEPEEAREALGVLDRRSKEGRKLPPPGAVVAAKPQMVAIRERVSSDMKNGANPPGTVVKAKPQLVATHERVSSDTNSGADPPGSIEGKRKLGATNPGPEDAADLLRMCLQCGIPKTYSHAQGMVCPVCNDRPAQTKEPEKKKGSGIKDKEKVKRMRGQSSHASWKSETEMALRQQFD

SEQ ID NO: 5080 - protein, 240 aa, Triticum aestivum
MGRSPCCEKAHTNKGAWTREEDERLVAHVRAHGEGCWRSLPGAAGLLRCGKSCRLRWINYLRPDLKRGNFTRDEDDLIVKLHSLLGNKWSLIAARLPGRTDNEIKNYWNTHIRRKLLGRGIDPVTHRPLTHAASATTVSFLHPAEPPKTQPATELSKPPRCPDLNLDLCISLPFQQEEERPPARACAKPVKMEQLQQGGGGLCFRCSILRVRGAATECSCGSNFLGLRAGMLDFRGLRMK

SEQ ID NO: 5081 - protein, 234 aa, Triticum aestivum
MGRSPCCEKAHTNKGAWTREEDERLVAHVRAHGEGCWRSLPSAAGLLRCGKSCRLRWINYLRPDLKRGNFSRDEDELIVKLHSLLGNKWSLIAARLPGRTDNEIKNYWNTHIRRKLLGRGIDPVTHRPLTDAATVSFVHPAEATKQQATEERKPPRCPDLNLDLCISLPFQQEEERPPARACAKPVKMEQLQQGGICFRCSILRVRGAATECSCGSNFLGLRAGMLDFRGLEMK

SEQ ID NO: 5082 - protein, 217 aa, Secale cereale
LVAHVRAHGEGCWRSLPSAAGLLRCGKSCRLRWINYLRPDLKRGNFSRDEDELIVKLHSLLGNKWSLIAARLPGRTDNEIKNYWNTHIRRKLLGRGIDPVTHRPLSDAPGTTTTVSFVHPAEPPKQPATEERKPPRCPDLNLDLCISLPFQQEEERPSARACAKPVKMEQLLQGGGGGLCFRCSILRVRGAAMECSCSSNFLGLRAGMLDFRGLEMK

SEQ ID NO: 5083 - protein, 446 aa, Triticum aestivum
MADNRSAAAAAVGPLLLPRKKSSSAAQYTRSASHAGDELRSFRACLRWMCIDHTDGPRSAGSWAVFFLLAVAAPAAVTLALPASAPPRPLDGQVQVSLTLAATLAFLSLCSLLRVGLRRLLCIDRLRHDSDEVRAGYTAQLNRSFRVLACFLAPCSLADAAYKVYWYWAAAPFRSPWWNAAACALEAASWVYRTAVFFMICVLFRVICYLQVLRMVGFAREFGRFADVAVVLEHHRRIRDQLRRISHRYRRFIIFCLVLVTASQFSALLATTRPHARINIATAGELALCSVSLVAGLLVCLHSAAKITHKTQAITSVAAAWHADATIHAFDNDLEDPDPALPAATGYLAPANAYRVAPGEKSDGYGDDDDDDDNMSEGSIDDSKLVPFQVNNMCFQKRQALVNYLENNRAGITVYGFVVDRTWLHALFMIEFSLVMWLLGKTVGIS

SEQ ID NO: 5084 - protein, 436 aa, Brachypodium distachyon
MADTSSAPLLPRKKSPSSAAQYTRCASHAGDELRSFRACLRWMCVDHTDGLRSAGSWAVFFLLAVAAPSAVTLALPASAPQRPFDGQVQASLTLAAALAYFSLSSFLRVGLRRLLCIDRLRHDSDEVRAGYTAQLNRSFRILACFLVPCSLAEAAYEAYWYWAAAPFRSPWWNAAVCALDVASWVYRTAIFFMICVLFRVICYLQVLRMVGFAREFGRFAEVAVVLEHHRRIREQLRRISHRYRRFIILCLVLVTASQFAALLATTRPHATINLATAGELALCSVSLVVGLLVCLHSAAKITHKTQSITSVAAAWHADATIHAFDNDLEDPDPALPASTGYMAPANAYRLASGEESDDDDDDDARSEDSLDDSKLVPFQVNNMCFQKRQALVTYLENNRAGITVYGFVVDRTWLHALFMIEFSLVMWLLGKTVGIS

SEQ ID NO: 5085 - protein, 311 aa, Triticum aestivum
MDADADTVVFEAPAHFRFYKSGRIERLHRPPILPAGDDEATGVTSKDVVLDADTGLSVRLYLPKLQEPSTKLPVLVYFHGGSFLIESADSSTYHNYVNALAAAAGVLAVSVDYRLAPEHPLPAAYDDSWAALQWAALAQDEWIREHGDTARLFLAGDSAGANIVHDMLMRVASNDGSPRVEGAILLHPWFGGSKPVEGEHPAAPMVTGMLWSYACPGAVGGADDPRMNPLAPGAPALERLGCVRMLVTAGLADGLAARDRAYHDAVAGSAWGGTAAWHGSDGEGHVFFLEKPGCDNAKQLMDRVVAFIAGA

SEQ ID NO: 5086 - protein, 311 aa, Pseudoroegneria spicata
MDANADTVVFEAPAHFRFYKSGRIERLNRPPILPAGVDEATGVTSKDVVLDADTGLSVRLYLPELQDPSAKLPVLVYFHGGSFLIESADSSTYHNYVNALAAAAGVLAVSVDYRLAPEHPLPAAYDDSWAALQWAASAEDDWLREHGDTARLFLAGDSAGANIVHDMLMRAASNDGSPRVEGAILLHPWFGGSKPVEGEHPAAPMITGMIWSYACPGAVGGADDPRMNPLAPGAPALERLGCVRMLVTAGLADGLAARDRAYHDAVAGSAWGGTAAWHGSDGEGHVFFLEKPGCDNAKQLMDRVVAFIAGA

SEQ ID NO: 5087 - protein, 286 aa, Secale cereale
RLNRPPILPAGVDEATGVTSKDVVLDADTGLSVRLYLPKLQDPSTKLPVLVYFHGGSFLIGSADDATYHSYVNALAAAAGVLAVSVDYRLAPEHPLPAAYDDSWAALQWAASAQDEWIREHGDTARLFLAGDSAGANIVHHMLMRAASNDGRPRVEGAILLHPWFGGSKPVEGEHPAAPMVTGMLWSYACPGAVGGADDPRMNPLAPGAPALEKLGCVRMLVTAGLADGLAARDRAYHDAVAGSAWGGTAAWHGSDGEGHVFFLEKPGCDNAKQLMDRVVAFIAGA

SEQ ID NO: 5088 - protein, 62 aa, Triticum aestivum
MASRAAVVVVAVTALLFAAASAQEMDASMPPAPAPVTGAAAGAAASVLAVACSAVLSLLVAQ

SEQ ID NO: 5089 - protein, 75 aa, Triticum aestivum
MARRDSCLARIGAGVAIGGAVGGAVGAVYGTYAAIRLRVPGLLKIRHIGQATVGSAAVFGLFLGAGSLIHCGKNY

SEQ ID NO: 5090 - protein, 75 aa, Brachypodium distachyon
MARGDSCLVRVGAGVAIGGAVGGAVGAVYGTYEAVRLRVPGLLKIRHIGQTTIGSAAIFGLFLGAGSLIHCGKNY

SEQ ID NO: 5091 - protein, 75 aa, Brachypodium distachyon
MARGDSCLVRVGAGVAIGGAVGGAVGAVYGTYEAVRLRVPGLLKIRHIGQTTIGSAAIFGVFLGAGSLIHCGKNY

SEQ ID NO: 5092 - protein, 74 aa, Musa acuminata
MARDSCLARVTAGVAIGGAVGGAVGAVYGTYEAIRYKVPGLLKIRYIGQTTLGSAAVFGLFLGAGSLIHCGKSY

SEQ ID NO: 5093 - protein, 74 aa, Cirsium arvense
MARDSCLARVTAGVAVGGAVGGAVGAVYGTYDAIRNKVPGLLKIRYIGQATVGSAAIFGLFLGAGSLIHCGKSY

SEQ ID NO: 5094 - protein, 74 aa, Cynara scolymus
MARDSCLARVTAGVAVGGAVGGAVGAVYGTYDAIRNKVPGLMKIRYIGQATVGSAAVFGLFLGAGSLIHCGKSY

SEQ ID NO: 5095 - protein, 74 aa, Allium cepa
MARDSCLTRIAAGAAIGGAVGGAVGAVYGTYEAIRYKVPGLLKIRHIGQTTIGSAAVFGLFLGAGSLIHCGKSY

SEQ ID NO: 5096 - protein, 74 aa, Salvia sclarea
MARDSCLTRITAGVAIGGAVGGAVGAVYGTYDAIRSKVPGLLKVRYIGQTTVGSAAVFGLFLGAGSLIHCGKSY

SEQ ID NO: 5097 - protein, 83 aa, Zostera marina
RRKSTTMGNNRKDSCLARIGAGVAIGGAVGGAVGAVYGTYEAFRFKVPGLLKIRHIGQTTIGSAAIFGLFLGAGSLIHCGKSY

SEQ ID NO: 5098 - protein, 74 aa, Unknown
  Sequence found in Organisms: Centaurea maculosa, Cirsium arvense
MARDSCLARITAGVAVGGAVGGAVGAVYGTYEAVRHKVPGLMKIRYIGQATVGSAAIFGLFLGAGSLIHCGKSY

SEQ ID NO: 5099 - protein, 74 aa, Manihot esculenta
MARDSCLARVTAGVAVGGAVGGAVGAVYGTYEAIRYKVPGLLKIRHIGQTTLGSAAIFGLFLGAGSLIHCGKSY

SEQ ID NO: 5100 - protein, 74 aa, Vitis vinifera
MARDSCLARVTAGVAVGGAVGGAVGAVYGTYEAIRYKVPGLLKIRYIGQTTLGSAAVFGLFLGAGSLIHCGKSY

SEQ ID NO: 5101 - protein, 75 aa, Avena sativa
MARGDSCLARVAVGVGVGGAVGGAVGAVYGTYGAIRYRIPGLLKIRHIGQSTIGSAALFGLFLGAGSLIHCGKNY

SEQ ID NO: 5102 - protein, 74 aa, Allium cepa
MARDSCLTRIVAGAAVGGAVGGAVGAVYGTYEAIRYKVPGLLKIRHIGQTTVGSAAIFGLFLGAGSLIHCGKSY

SEQ ID NO: 5103 - protein, 74 aa, Populus trichocarpa
MARDSCLARVTAGVAVGGAVGGAVGAVYGTYEAIRNRVPGLLKVRYIGQTTVGSAAIFGLFLGAGSLIHCGKSY

SEQ ID NO: 5104 - protein, 74 aa, Salvia sclarea
MARDSCLTRITAGFAIGGAVGGAVGAVYGTYDAIRSKVPGLLKVRYIGQTTVGSAAVFGLFLGAGSLIHCGKSY

SEQ ID NO: 5105 - protein, 74 aa, Senecio madagascariensis
MAKDSCLARITAGVAVGGAVGGAVGAVYGTYEAIRYKVPGLLKVRHIGQTTVGSAAIFGLFLGAGSLIHCGKSY

SEQ ID NO: 5106 - protein, 74 aa, Nicotiana benthamiana
MAKDSCLARITAGVAVGGAVGGAVGAVYGTYEAIRYRVPGLMKIRYIGQTTLGSAAIFGLFLGAGSLIHCGKSY

SEQ ID NO: 5107 - protein, 74 aa, Ricinus communis
MARDSCLTRVTAGVAIGGAVGGAVGAVYGTYEAIRYKVPGLLKIRYIGQTTLGSAAIFGLFLGAGSLIHCGKSY

SEQ ID NO: 5108 - protein, 74 aa, Cicer arietinum
MARDSCLARVTAGAAVGGAVGGAVGAVYGTYEAIRYKVPGLLKIRHIGQTTLGSAAIFGLFLGAGSLIHCGKSY

SEQ ID NO: 5109 - protein, 73 aa, Cirsium arvense
ARDSCLARITAGVAVGGAVGGAVGAVYGTYEAVRHKVPGLMKIRYIGQATVGSAAIFGLFLGAGSLIHCGKSY

SEQ ID NO: 5110 - protein, 74 aa, Unknown
  Sequence found in Organisms: Gossypium hirsutum, Euphorbia peplus, Gossypium raimondii
MARDSCLARVTAGVAVGGAVGGAVGAVYGTYEAIRYKVPGLLKIRYIGQTTLGSAAIFGLFLGAGSLIHCGKSY

SEQ ID NO: 5111 - protein, 74 aa, Unknown
  Sequence found in Organisms: Cucurbita pepo, Cucumis melo, Momordica charantia, Citrullus lanatus
MARDSCLARVTAGVAVGGAVGGAVGAVYGTYEAIRFKVPGLLKIRYIGQTTLGSAAIFGLFLGAGSLIHCGKSY

SEQ ID NO: 5112 - protein, 74 aa, Unknown
  Sequence found in Organisms: Euonymus alatus, Tripterygium wilfordii
MARDSCLARITAGVAVGGAVGGAVGAVYGTYEAIRYKVPGLLKVRYIGQTTLGSAAIFGLFLGAGSLIHCGKSY

SEQ ID NO: 5113 - protein, 75 aa, Zea mays
MARSDSCLARVGAGVAIGGAVGGAVGACYGTFEAFRYKIPGLLKIRHIGQTTVGSAAIFGLFLGAGSLIHCGKSY

SEQ ID NO: 5114 - protein, 74 aa, Phalaenopsis aphrodite
MARDSCMARIAAGAAVGGAVGGAVGAVYGTYEAIRYKVPGLLKIRHIGRTTLGSAAVFGLFLGAGSLIHCGKSY

SEQ ID NO: 5115 - protein, 74 aa, Unknown
  Sequence found in Organisms: Glycine max, Cajanus cajan
MARDSCLARVTAGAAMGGAVGGAVGAVYGTYEAIRYKVPGLLKIRHIGQTTLGSAAIFGLFLGAGSLIHCGKSY

SEQ ID NO: 5116 - protein, 74 aa, Plantago ovata
MARDSCLSRVGAGCAIGGALGGAVGAVYGTYEAIRFKVPGFLKIRHIGQTTLGSAAVFGLFLGAGSLIHCGKSY

SEQ ID NO: 5117 - protein, 74 aa, Unknown
  Sequence found in Organisms: Solanum tuberosum, Solanum phureja
MARDSCLARVTAGVAIGGAVGGAVGAVYGTYEAVRFKVPGLLKIRYIGQTTLGSAAIFGLFLGAGSLIHCGKSY

SEQ ID NO: 5118 - protein, 75 aa, Sorghum bicolor
MARGDSCLARVGAGVAIGGAVGGAVGACYGTFEAFRYKIPGLLKIRYIGQTTVGSAAIFGLFLGAGSLIHCGKSY

SEQ ID NO: 5119 - protein, 93 aa, Euphorbia esula
FEFKIQNTSIQFFPSVLIGMARDSCLARVTAGVAVGGAVGGAVGAVYGTYEAIRYKVPGLLKIRYIGQTTLGSAAIFGLFLGAGSLIHCGKSY

SEQ ID NO: 5120 - protein, 100 aa, Tamarix hispida
  misc_feature (75)..(75): Xaa can be any naturally occurring amino acid
  misc_feature (78)..(78): Xaa can be any naturally occurring amino acid
  misc_feature (82)..(82): Xaa can be any naturally occurring amino acid
  misc_feature (84)..(84): Xaa can be any naturally occurring amino acid
MQRDSCLARVTAGVAIGAGVGGAVGAVYGTYEAIRYKVPGLLKIRHIGQTTVGSAAIFGLFLGAGSLIHCGKSYXCSXLTVXTXPGFSVRKHYVPKTVRP

SEQ ID NO: 5121 - protein, 74 aa, Eutrema halophilum
MAKDSCLARITAGVAVGGAVGGAVGAVYGTYEAIRFKVPGLMKIRFIGQTTLGSAAVFGLFLGAGSLIHCGKSY

SEQ ID NO: 5122 - protein, 74 aa, Eutrema halophilum
MAKDSCLARITAGVAVGGAVGGAVGAVYGTYEAIRFKVPGLMKIRFIGQTTIGSAAVFGLFLGAGSLIHCGKSY

SEQ ID NO: 5123 - protein, 82 aa, Nicotiana tabacum
GEREREREMAKDSCLARITAGVAVGGAVGGAVGAVYGTYEAIRYRVPGLMKIRYIGQTTLGSAAIFGLFLGAGSLIHCGKSY

SEQ ID NO: 5124 - protein, 74 aa, Triphysaria pusilla
MARDSCLARVTAGVAVGGAVGGAVGAVYGTYEAIRYKVPGLLKVRYIGQTTLGSAAVFGLFLGAGSLIHCGKSY

SEQ ID NO: 5125 - protein, 77 aa, Zostera marina
MGNNRKDSCLARIGAGVAIGGAVGGAVGAVYGTYEAFRFKVPGLLKIRHIGQTTIGSAAIFGLFLGAGSLIHCGKSY

SEQ ID NO: 5126 - protein, 74 aa, Mimulus guttatus
MARDSCLTRIAAGVAVGGAVGGAVGAVYGTYEAIRYKVPGLMKVRYIGQTTLGSAAVFGLFLGAGSLIHCGKSY

SEQ ID NO: 5127 - protein, 74 aa, Olea europaea
MARDSCLARVTAGVAVGGGIGGAVGAVYGTYEAIRYKVPGLLKIRYIGQTTLGSAAVFGLFLGAGSLIHCGKSY

SEQ ID NO: 5128 - protein, 74 aa, Arabidopsis lyrata
MARDSCLAKITAGVAVGGALGGAVGAVYGTYEAIRYRVPGLMKVRYIGQTTLGSAAVFGLFLGAGSLIHCGKGY

SEQ ID NO: 5129 - protein, 74 aa, Unknown
  Sequence found in Organisms: Arnica chamissonis, Taraxacum officinale, Lactuca sativa, Scabiosa columbaria
MARDSCLARITAGVAVGGAVGGAVGAVYGTYEAVRYKVPGLMKIRYIGQTTLGSAAIFGLFLGAGSLIHCGKSY

SEQ ID NO: 5130 - protein, 74 aa, Unknown
  Sequence found in Organisms: Vaccinium corymbosum, Linum usitatissimum
MARDGCLARVTAGVAVGGAVGGAVGAVYGTYEAIRYKVPGLLKIRYIGQTTLGSAAIFGLFLGAGSLIHCGKSY

SEQ ID NO: 5131 - protein, 74 aa, Bruguiera gymnorhiza
MARDSCLTRVTAGVAVGGAVGGAVGAVYGTYEAIRYKVPGLLKIRYIGQTTLGSAAIFGLFLGAGSLIHCGKSY

SEQ ID NO: 5132 - protein, 74 aa, Castanea mollissima
MARDSCLARVTAGVAVGGAVGGAVGAVYGTYEAIRFKVPGLMKIRYIGQTTLGSAAIFGLFLGAGSLIHCGKSY

SEQ ID NO: 5133 - protein, 74 aa, Unknown
  Sequence found in Organisms: Cleome gynandra, Carica papaya
MARDSCLARVTAGVAVGGAVGGAVGAVYGTYEAIRYKVPGLLKVRYIGQTTLGSAAIFGLFLGAGSLIHCGKSY

SEQ ID NO: 5134 - protein, 74 aa, Cleome spinosa
MARDSCLARVTAGVAVGGAVGGAVGAVYGTYEAIRYKVPGLMKIRYIGQTTLGSAAIFGLFLGAGSLIHCGKSY

SEQ ID NO: 5135 - protein, 74 aa, Solanum melongena
MARDSCLARVTAGVAVGGAVGGAVGAVYGTYEAVRYKVPGLLKIRYIGQTTLGSAAIFGLFLGAGSLIHCGKSY

SEQ ID NO: 5136 - protein, 74 aa, Euonymus alatus
MARDSCLARITAGVALGGAVGGAVGAVYGTYEAIRYKVPGMLKVRYIGQTTMGSAAIFGLFLGAGSLIHCGKSY

SEQ ID NO: 5137 - protein, 74 aa, Fagopyrum esculentum
MARDSCLARVGAGVALGGALGGAVGAVYGTYEAVRFKVPGLLKIRYIGQTTLGSAAVFGVFLGAGSLIHCGKSY

SEQ ID NO: 5138 - protein, 74 aa, Fraxinus spp
MARDSCLARVTAGVALGGGIGGAVGAVYGTYEAIRYKVPGLLKIRYIGQTTLGSAAVFGLFLGAGSLIHCGKSY

SEQ ID NO: 5139 - protein, 74 aa, Gossypium raimondii
MARDSCLARVTAGVAVGGAVGGAVGAVYGTYEAIRYKVPGLLKIRYIGQTTLGSAAIFGLFLGAGSLIHCGKSH

SEQ ID NO: 5140 - protein, 74 aa, Carpinus betulus
MARDSCLARVGAGVAIGGAIGSAVGAVYGTYEAIRFKVPGLMKIRHIGRTTLGSAALFGLFLGAGSLIHCGKSY

SEQ ID NO: 5141 - protein, 74 aa, Lotus japonicus
MARDSCLTRIAAGAAIGGAVGGAVGAVYGTYEAIKYKVPGFLKIRHIGQTTLGSAAIFGLFLGAGSLIHCGKSY

SEQ ID NO: 5142 - protein, 74 aa, Medicago truncatula
MARDSCLARVTAGAAVGGAVGGAVGAVYGTYEAIRYKVPGFLKIRHIGQTTLGSAAIFGLFLGAGSLIHCGKSY

SEQ ID NO: 5143 - protein, 74 aa, Tropaeolum majus
MARDSCLARITAGVAVGGAVGGAVGAVYGTYEAIRYKVPGFHKIRYIGQTTLGSAAIFGLFLGAGSLIHCGKSY

SEQ ID NO: 5144 - protein, 74 aa, Quercus alba
MARDSCLARVTAGVAVGGAVGGAVGAVYGTYEAIRIKVPGLMKIRYIGQTTLGSAAIFGLFLGAGSLIHCGKSY

SEQ ID NO: 5145 - protein, 74 aa, Orobanche aegyptiaca
MARDSCLARVTAGFAVGGAVGGAVGAVYGTYEAIRYKVPGLLKVRYIGQTTLGSAAVFGLFLGAGSLIHCGKSY

SEQ ID NO: 5146 - protein, 74 aa, Plantago ovata
MAKDGCLARITAGVAVGGAVGGAVGAVYGTYEAIRFKVPGLLKVRYIGQTTLGSAAVFGLFLGAGSLIHCGKSY

SEQ ID NO: 5147 - protein, 74 aa, Populus trichocarpa
MARDSCLARITAGVAVGGAIGGAVGAVYGTYEAVRYKVPGLLKIRYIGQTTLGSAAIFGLFLGAGSLIHCGKSY

SEQ ID NO: 5148 - protein, 74 aa, Sarracenia psittacina
MARDSCTARVTAGVAVGGAVGGAVGAVYGTYEAIRYKVPGLLKIRYIGQTTLGSAAIFGLFLGAGSLIHCGKSY

SEQ ID NO: 5149 - protein, 74 aa, Silene vulgaris
MARDSCLARVGAGVAVGGAVGGAVGAVYGTYEAVRSKIPGLLKIRYIGQTTVGSAAIFGLFLGCGSLIHCGKSY

SEQ ID NO: 5150 - protein, 74 aa, Glycine max
MARDSCLTRVTAGAAMGGAVGGAVGAVYGTYEAIRYKVPGLLKIRHIGQTTLGSAAIFGLFLGAGSLIHCGKSY

SEQ ID NO: 5151 - protein, 65 aa, Primula obconica
MGRDSCLTRVTAGVAVGGAVGGAVGAVYGTYEAIRYKVPGLLKIRHIGQTTLGSAAYFRSLLGCW

SEQ ID NO: 5152 - protein, 84 aa, Ambrosia trifida
MARDSCLARVTAGVAVGGAVGGAVGAVYGTYEAVRFKVPGLMKIRYIGQTTLGSAAIFGLFSWRWELDTLWEVLLIELEFAWII

SEQ ID NO: 5153 - protein, 66 aa, Gossypium hirsutum
MARDSCLARVTAGVAVGGAVGGAVGAVYGTYEAIRYKVPGLLKIRYIGQTTLGSAAIFGLFWVLEA

SEQ ID NO: 5154 - protein, 53 aa, Panax ginseng
TRVTGKAIHCSEMARDSCLARITPGVAVGGAVGGAVGAVYGTYEVVRYKVPGS

SEQ ID NO: 5155 - protein, 74 aa, Antirrhinum majus
MARDSCLARVAAGCAVGGALGGAVGAVYGTYEAVRFKVPGLLKIRYIGQTTLGSAAVFGLFLGAGSLIHCGKSY

SEQ ID NO: 5156 - protein, 74 aa, Beta vulgaris
MARDSCLARVGAGVAVGGAVGGAVGAVYGTYEAVRCKIPGLLKLRYIGQTTVGSAAIFGLFLGCGSLIHCGKSY

SEQ ID NO: 5157 - protein, 74 aa, Theobroma cacao
MARDSCLARVTAGAAVGGAVGGAVGAVYGTYEAIRYKVPGMLKIRYIGQTTLGSAAIFGLFLGAGSLIHCGKSY

SEQ ID NO: 5158 - protein, 74 aa, Catharanthus roseus
MARDSCLNRVLAGVAVGGAVGGAVGAVYGTYEAVRFKVPGLLKIRYIGQTTLGSAAIFGLFLGAGSLIHCGKSY

SEQ ID NO: 5159 - protein, 74 aa, Chelidonium majus
MARDSCLARVTTGVAVGGAVGGAVGAVYGTYEAVRYKVPGLLKIRYIGQTTLGSAAIFGLFLGAGSLIHCGKSY

SEQ ID NO: 5160 - protein, 75 aa, Unknown
  Sequence found in Organisms: Citrus clementina, Citrus sinensis
MARETSCLARVTTGVAVGGAVGGAVGAVYGTYEAIRYKVPGLLKIRYIGQTTLGSAAIFGLFLGAGSLIHCGKSY

SEQ ID NO: 5161 - protein, 74 aa, Vigna unguiculata
MARDSCLTRVVAGAAMGGAVGGAVGAVYGTYEAIRYKVPGLMKIRHIGQTTLGSAAIFGLFLGAGSLIHCGKSY

SEQ ID NO: 5162 - protein, 74 aa, Curcuma longa
MGRDSCLARVTAGVAIGGSIGGAVGAVYGTYEAIRYKVPGLLKIRYIGQTTLGSAAVFGLFMGAGSLIHCGKSY

SEQ ID NO: 5163 - protein, 74 aa, Epimedium sagittatum
MARDSCLARVTTGVAVGGAVGGAVGAVYGTYEAIRYKVPGLLKIRYVGQTTLGSAAIFGLFLGAGSLIHCGKSY

SEQ ID NO: 5164 - protein, 74 aa, Flaveria ramosissima
MARDSCLARVTAGVAVGGAVGGAVGAVYGTYEAVRYKVPGLMKIRYIGQTTLGSAAIFGLFLGAGSLIHCGKSY

SEQ ID NO: 5165 - protein, 72 aa, Linum usitatissimum
MARDSCLTRVVAGVAIGGGVGGAVGAVYGTYEAIRHKVPGLLKIRYIGQTTVSSAAIFGLFLGAGSLIHCGK

SEQ ID NO: 5166 - protein, 74 aa, Humulus lupulus
MARDSCMTRVAAGVAVGGAVGGAVGAVYGTYEAIRYKVPGLLKIRYIGQTTLGSAAIFGLFLGAGSLIHCGKSY

SEQ ID NO: 5167 - protein, 75 aa, Ipomoea batatas
MARESSCLARVAAGAAVGGAVGGAVGAVWGTVEAIRYKVPGLLKIRHIGQTTVGSAAIFGLFLGAGSLIHCGKSY

SEQ ID NO: 5168 - protein, 75 aa, Zea mays
MARSDSCLARVGAGIAIGGAVGGAVGACYGTFEAFRYKIPGLLKIRYIGQTTVGSAAIFGLFLGAGSLIHCGKSY

SEQ ID NO: 5169 - protein, 74 aa, Elaeis guineensis
MARDSCLARVTTGAALGGAIGGAVGAVYGTYEAIRYKVPGLLKIRYIGQTTLGSAAVFGLFLGAGSLIHCGKSY

SEQ ID NO: 5170 - protein, 74 aa, Elaeis guineensis
MARDSCLARVAAGAAVGGAVGGAVGAVYGTYEAIRYKVPGFLKIRYIGQTTLGSAAVFGLFLGAGSLIHCGRSY

SEQ ID NO: 5171 - protein, 74 aa, Lippia dulcis
MARDSCLARVTAGFAVGGAVGGAVGAVYGTYEAVRFKVPGLLKVRYIGQTTLGSAAVFGLFLGAGSLIHCGKSY

SEQ ID NO: 5172 - protein, 74 aa, Populus trichocarpa
MARDSCLARVTAGVAVGGAIGGAVGAVYGTYEAVRYKVPGLLKIRYIGQTTLGSAAIFGLFLGAGSLIHCGKSY

SEQ ID NO: 5173 - protein, 75 aa, Panicum virgatum
MARTDSCLARVGAGAAIGGAVGGAVGACYGTFEAFRYKIPGLLKIRYIGQTTVGSAAIFGLFLGAGSLIHCGKSY

SEQ ID NO: 5174 - protein, 74 aa, Vinca minor
MARDSCLTRVMAGVAVGGAVGGAVGAVYGTYEAVRFKVPGLLKIRYIGQTTLGSAAIFGLFLGAGSLIHCGKSY

SEQ ID NO: 5175 - protein, 221 aa, Artemisia annua
MATSLHTSQLGSAFLGERNGLCVSTVPVARLGFRRNTVECKESRIGKQPIEVPSNVVITMEGQDMKVKGPLGELALSYPREIMIDRQEAVLKVCKAVETRRANQMHGLFRTLTSNMVIGVSKGFEKKLQLVGVGYRATVEGKELILSLGFSHPVKMTIPDDLKVKVEDNTRITVSGYDKSNIGQFAATIRKWRPPEPYKGKGVKYADEIIRRKEGKAGKKK

SEQ ID NO: 5176 - protein, 74 aa, Amsonia hubrichtii
MARDSCLTRVMAGAAVGGAVGGAVGAVYGTYEAVRFKVPGLLKIRYIGQTTLGSAAIFGLFLGAGSLIHCGKSY

SEQ ID NO: 5177 - protein, 73 aa, Brassica rapa
MARETSCLTRITAGVAIGGALGGAVGAVYGTYEAVRFRVPGLMKIRYIGQTTLGSAAIFGLFLGAGSLIHCGK

SEQ ID NO: 5178 - protein, 74 aa, Fagus grandifolia
MARDSCLARVTAGVAVGGAIGGAVGAVYGTYEAIRFKVPGIMKIRYIGQTTLGSAAIFGLFLGAGSLIHCGKSY

SEQ ID NO: 5179 - protein, 73 aa, Brassica napus
MARETNCLTRITAGVAIGGALGGAVGAVYGTYEAIRFRVPGLMKIRYIGQTTLGSAAIFGLFLGAGSLIHCGK

SEQ ID NO: 5180 - protein, 92 aa, Cichorium intybus
QEFGTRPRAASRINHTSRLARDSCLARVTAGVAVGGAVGGAVGAVYGTYEAVRYKVPGLMKIRYIGQTTLGSAAIFGLFLGAGSLIHCGKSY

SEQ ID NO: 5181 - protein, 74 aa, Eucalyptus grandis
MARDSCLARVGAGVAVGGAIGGAVGAVYGTYEAIRYKVPGMMKIRYVGQTTLGSAAIFGLFLGAGSLIHCGKSY

SEQ ID NO: 5182 - protein, 66 aa, Flaveria ramosissima
MARDSCLARVTAGVAVGGAVGGAVGAVYGTYEAVRYKVPGLMKIRYIGQTTLGSAAIFGLFLVLGA

SEQ ID NO: 5183 - protein, 75 aa, Setaria italica
MARTDSCLARVGAGAVIGGAVGGAVGACYGTFEAFRYKIPGLLKIRYIGQTTVGSAAIFGLFLGAGSLIHCGKSY

SEQ ID NO: 5184 - protein, 74 aa, Capsicum annuum
MARDGCLARVTAGVAVGGAVGGAVGAVYGTYEAVRFKVPALLKIRYIGQTTLGSAAIFGLFLGAGSLIHCGKSY

SEQ ID NO: 5185 - protein, 74 aa, Papaver somniferum
MARDGCLTRVATGVAVGGAVGGAVGAVYGTYEAIRYKVPGLLKIRYIGQTTLGSAAIFGLFLGAGSLIHCGKSY

SEQ ID NO: 5186 - protein, 74 aa, Unknown
  Sequence found in Organisms: Solanum lycopersicum, Solanum tuberosum, Solanum phureja
MARDSCLARVTAGVAVGGAIGGAVGAVYGTYEAVRYKVPGLMKIRYIGQTTLGSAAIFGLFLGAGSLIHCGKSY

SEQ ID NO: 5187 - protein, 74 aa, Sesamum indicum
MARDGCLARVTAGFAVGGAVGGAVGAVYGTYEAVRFKVPGILKIRYIGQTTLGSAAVFGLFLGAGSLIHCGKSY

SEQ ID NO: 5188 - protein, 66 aa, Tabernaemontana elegans
MARDSCLTRVMAGVAVGGAVGGAVGAVYGTYEAVRFKVPGLLKIRYIGQTTLGSAAIFGLFLVLEA

SEQ ID NO: 5189 - protein, 74 aa, Valeriana officinalis
MARDGCLARVTAGVAVGGAVGGAVGAVYGTYEAVKFKVPGLLKIRYIGQTTLGSAAIFGLFLGAGSLIHCGKSY

SEQ ID NO: 5190 - protein, 498 aa, Secale cereale
MGKGNKDDRLSALPDDILVNILDRLNVRDAARTSVLSRRWSQLCAKLSRLVISALDFLPKGASRSSANISDDELVRINAAVVQATNSILVRRNPGEHTIGLLSTTFHLIDDIPISIGQVVGRAIATHLVKNAKFCVRTRKDDDDEIDDDEELVIWARRFMLFFHASPVAFAGLTSLNIGNLRFGESDMSSILTTCKRLKRMHLYNCDCGDSSTLQVEHANLSELCIVYCRLEQVKLNWLPRLTRIDFDGWIDFQDPLLLGHVPLLESVSLTNVALSYNKMVKLSRFLGGASPRVLKLGFRSEKIWVQPECPTQDLASVFRQLRFVNLVKLPEGYDLTWTMFILQAAPLLKELYMTVWDDLCSMEMDEEKRKKGSYSENKGVEWGVAAADFQHHNLVTLVIFGFESEDYAVDYVRRVMVAAVNLEDVFLYSRLELECGNCQDKKPTRFAWTKRQKISLKKRITAGIESFAIIHSNKTIRADHKAKMLYPKCSHFDTASG

SEQ ID NO: 5191 - protein, 219 aa, Secale cereale
MVKLSRFLGGASPRVLKLGFRSEKIWVQPECPTQDLASVFRQLRFVNLVKLPEGYDLTWTMFILEAAPLLKELYMTVWNDLCSMEMDEEKRKKGSYSENKGVEWGAAAADFQHHNLVTLVIFGFESEDYAVDYVRRVMVAAVNLEDVFLYSRLELECGNCQDKKPTRFAWTKRQKISLKKRITAGIESFAIIHSNKTIRDDHKAKMLYPKCSHFDTTSG

SEQ ID NO: 5192 - protein, 334 aa, Secale cereale
MLFFDACPNAFGGLTSLNLNNLRFGESDISSILTTCKRLKHLHLYNCDCGDGSTLQVEHANLSELCIISCLLVQVTLSWLPQLTRLAFDGWIEFQDPLVLGHVPLLEAVSLSNIALSVNKMVKLSTFLSSTSVRVLKLGFSSEKIWVQPECPRQSLASVFRQLRFVNLVKLPEGCDLTWTMFILEAAPLLKELYMTVWDDLCSMEMDEEKRKKQLYSENKGVEWGSAAADFQHHSLVTLVIFGFESEDYLVSYVRRVMEAAVNLEDVFLYSRLELECGHCQDKKPTRFPWTKRQKISLKKRIIAGIESFAIIHSNKTIRADHEAKMIYPQCLLD

SEQ ID NO: 5193 - protein, 308 aa, Secale cereale
MEGATPSITRIAVVTGGSKGIGLEACKQLAGGGAITVVLTARDETRGTAAVEQIKRLGHADVIFHQLDITDASSIARLADFLKTRFGKLDILVNNAATDGIEHVIDPVYGLMPGDETFNGMDADQRMDWMWTTCRQTYETAKQGLQTNYYGTKRVTVALLPLLRSSSDGRIVNVSSNFGLLSFFRNEELKQELNGVDSLTEERLDELLAMFLKDFESGGAEARGWPAEFSAYKVAKAAMNAYSRILAKRHPELRVNCAHPGYVKTDITRNSGILTPEEGARNITSVALLPEGGPTGKYFSEGEEASFL

SEQ ID NO: 5194 - protein, 308 aa, Secale cereale
MEGATPSITRIAVVTGGSKGIGLEACKQLAGSGPITVVLTARDETRGTAAVEQIKRLGYADVIFHQLDITDAPSIARLADFIKTRFGKLDILVNNAATDGIEHVIDPVYGLMPGDETFNGMDADQRIDWMWTSCRETYETAKQGLQTNYYGTKRVTEALLPLLRSSSDGRIVNVSSNFGLLSFFRNEELKQELNDVDSLTEERLDELLAMFLKDFESGGAEARGWPAEFSAYKVAKAAMNSYSRILAKRHPELRVNCAHPGYVKTDITRNSGILTPEEGARNITSVALLPEGGPTGKYFSEGEEASFL

SEQ ID NO: 5195 - protein, 299 aa, Triticum aestivum
RIAVVTGGSKGIGLEACKQLAGGGAITVVLTARDETRGTAAVEQIKRLGHADVIFHQLDITDASSIARLADFLKTRFGKLDILVNNAATDGIEHVIDPVYGLTPGDETFNGMDAGQRIDWMWTSCRQTYETAKQGLQTNYYGTKRVTEALLPLLRSSSDGRIVNVSSNFGLLSFFRNEELKQELNDVDSLTEERLDELLAMFLKDFESGGAEARGWPAEFSAYKVAKAAMNAYSRILAKRHPELRVNCAHPGYVKTDITRNSGILTPEEGARNITSVALLPEGGPTGKYFSEGEEASFV

SEQ ID NO: 5196 - protein, 311 aa, Leymus cinereus x Leymus triticoides
MKGATPIPSNTRIAVVTGGSKGIGLEVCKQLAGSGAITVVLTARDETRGTAAAEQIKRLGHSDVIFHQLDITDASSIAGLADFVKTRFGKLDMLVNNAATDGIEHVIDPVYGLMPGDETFNGMDADQRIDWMWTTCRQTYETAKQGLQTNYYGTKRVTEALLPLLRSSSDGRIVNVSSNFGLLSFFRNEELKQELNGVDSLTEERLDELLAMFLKDFEAGGVEARGWPAEFSAYKVAKATMNAYSRILAKRHPELRVNCAHPGYVKTDITRNSGILTPEEGARNITSVALLPEGGPTGKYFSEGEEAASFV

SEQ ID NO: 5197 - protein, 309 aa, Brachypodium distachyon
MEGAIPISWNTRIAVVTGGSKGIGLEVCKQLAGSGITVVLTARDETRGTAAVEQIVRLGHSDVIFHQLDITDALSIARLTDFLKARFGKLDILVNNAATDGIEQVLDPVYGSIPGDEKFDGMDAYQRIDWMWANCRETYETAKQGLQTNYYGTKRVTEALLPLLQSSSDGRIVNVSSNFGLLSLFRNEELKQELNDVERLTEERLDELLAIFLQDFEAGAAEARGWPAEFSAYKVAKAAMNAYSRILAKRHPELRLNCAHPGYVRTDITRNSGILTPEEGARNVVKVALLPEDGPTGVYFHEGQEASFV

SEQ ID NO: 5198 - protein, 268 aa, Secale cereale
MGGSSTSTFVIRWINFLTMILAILVVGFGFWMSTHNDECRRSLTIPVMGLGGVIFLMSLAGFVGAWKNISCLLWTYLIMLFVVLVAIMVFTVLAFIITNTGTGHAVPGSRYKEYRLRDYSSWFVKQLNDTDKWTHLRSCLVKSDDCNSLSKRYKSLKQYKLADLTPIESGCCRPPAECGYPPLNASNFDLSYHPVSTNVDCKLYKNDRSLRCYDCNSCKAGVAQYMKTEWRVVAIFNVILFVILSFVYFVGCCARRHAGGSDSKVPGR

SEQ ID NO: 5199 - protein, 268 aa, Triticum aestivum
MAGSSTSTFVIRWINFLTMILAILVVGFGFWMSTHNDECRRSLTIPVMGLGGVIFLMSLAGFVGAWKNISCLLWTYLIMLFVVLVAIMVFTVLAFIITNTGTGHAVPGSRYKEYRLQDYSSWFVKQLNDTDKWTHLRSCLVKSDDCNSLSKRYKTLKQYKLAELTPIESGCCRPPAECGYPALNASNFDLSYHPVSTNVDCKLYKNDRFLRCYDCNSCKAGVAQYMKTEWRVVAIFNVILFIILSFVYFVGCCARRHAGGSDSKVPRR

SEQ ID NO: 5200 - protein, 266 aa, Brachypodium distachyon
MGSSTSTFVIRWINFLTMVLAILVVGFGFWMSTHNDECRRSLTIPVMALGGVIFLMSLVGFVGAWKNIACLLWTYLIMLFVVLVAIMVFTVLAFIITNTGTGHAVPGARYKEYRLQDYSSWFIKQLNDTEKWTSLRSCLVKSDDCNSLSKRYKTLKQYRLADLTPIESGCCRPPAECGYPALNASNFDLSYHPVSTNVDCKLYKNDRSIKCYDCNSCKAGVAQYMKKEWQVVAIFNVILFVILSFVYFVGCCARRHAGGSDSKVPF

SEQ ID NO: 5201 - protein, 266 aa, Panicum virgatum
MGSTSAFVIRWINFFTMILALLVVGFGFWMSTHNDECRRSLTIPVIALGGVIFLISLIGFLGAWKNISCLLWTYLIMLFVVLVAIMVFTVLAFIITNTGTGHVVPGARYKEYRLQDYSSWFVKQLNNTEKWTHLRSCLVKSDDCNNLSKRYKTLKQYKLAELTPMESGCCRPPAECGYPALNASYFDLSYHPMSTNIDCKLYKNARSVRCYDCDSCKAGVAQYMKTEWRVVAIFNVILFVILLFVYFVGCCARRNAGGSDAKGNGR

SEQ ID NO: 5202 - protein, 263 aa, Setaria italica
MGSTSGFVIRWINFFTMILALLVVGFGFWMSTHNDECRRSLTIPVIALGGVIFLISLVGFLGAWKNISCLLWTYLIMLFVVLVAIMVFTVLAFIITNTGTGHVVPGARYKEYRLQDYSSWFLNDTEKWTHLRSCLVKSDDCNNLSKRYKTLKQYKLAELTPMESGCCCPPAECGYPALNASYFDLSYHPVSTNIDCKLYKNARSVKCYDCDSCKAGVAQYMKTEWRVVAIFNVILFVILSFVYFVGCCARRNAGGSDAKGRGR

SEQ ID NO: 5203 - protein, 266 aa, Pennisetum glaucum
MGSTSGFVIRWINFFTMILALLVVGFGFWMSTHNDECRRSLTVPVIALGGAIFLISLVGFLGAWKNISCLLWTYLIMLFVVLVAIMVFTVLAFIITNTGTGHVVPGARYKEYRLQDYSSWFVKQLNDTEKWTHLRSCLVKSDDCNNLSKRYKTLKQYKLAELTPVESGCCRPPTECGYPALNASYFDLSFHPVSTNIDCKLYKNAPSVKCYDCDSCKAGVAQYMKTEWRVVAIFNVILFVILSFVYFVGCCARRNTGGNDAKGRGR

SEQ ID NO: 5204 - protein, 132 aa, Panicum virgatum
MAAPARRHQVDQLLHHDTGTAGGGFGFWMSTHNDECRRSLTIPVIALGGVIFLISLIGFLGAWKNISCLLWTYLIMLFVVLVAIMVFTVLAFIITNTGTGHVVPGARYKEYRLQDYSSWFVKQLNNTEKWTH

SEQ ID NO: 5205 - protein, 270 aa, Oryza sativa
MGSSTSAFVIRWINFFTMILALLVVGFGFWMSTHNDECRRSLTIPVMGLGGVIFLISLVGFLGAWKKIACLLWTYLVMLFVVLVAIMVFTVLAFIITNTGTGHSVSGVRYKEYRLQDYSSWFIKQLNDTEKWTHLRSCLVKSDDCNGLSRRYKTLKQYKLADLTPMESGCCRPPAECGYPAVNASYFDLSYHPVSTNVDCKLYKNARSVLCYDCDSCKAGVAQYMKTEWRVVAIFNVILFVILSFVYFVACCARRNTGESDSKVPTRWHA

SEQ ID NO: 5206 - protein, 266 aa, Sorghum bicolor
MGSASAFVIRWINFFTMILALLVVGFGFWMSTHNDECRRSLTVPVIALGGVIFLISLVGFLGAWKNVSCLLWTYLIMLFVVLVAIMVFTVLAFIITNSGSGHTVPGARYKEYRLQDYSSWFVKQLDDTEKWARLKSCLVKTDDCNNLSKRYKTAKEYKLADLTPMESGCCRPPAECGYPALNASYFDLSFHPVSTNVDCKLYKNTRSVRCYDCNSCKAGVAQYMKTEWRVVAIFNVILFVILSFVYFVGCCARRNTGGSDAKGRGR

SEQ ID NO: 5207 - protein, 266 aa, Zea mays
MGSTSAFVIRWINFFTMILALLVVGFGFWMSTHDDECRRTLTVPVIALGGVIFLISLVGFLGAWKNISCLLWTYLIMLFVVLVAIMVFTVLAFIITNSGSGHTVPGARYKEYRLQDYSSWFVKQLDDTEKWARLKSCLVKTDDCNSLSRRYKTAREYKLADLTPMESGCCRPPAECGFPALNASYFDLSYHPASANADCKLYRNARSVRCYDCSSCKAGVAQYMKTEWRVVAIFNVILFVILSFVYFVGCCARRNAGGGDAKGRGR

SEQ ID NO: 5208 - protein, 289 aa, Panicum virgatum
MGSASAFVIRWINFFTMILALLVVGFGFWMSTHNDECRRSLTIPVIALGGVIFLISLIGFLGAWKNISCLLWTYLITLFVVLVAIMVFTVLAFIITNTGTGHVVPGARYKEYRLQDYSSWFVKQLNNTEKWTHLRSCLVKSDDCNNLSKRYKTLKQYKLAELTPMESGCCRPPAECGYPALNASYFDLSYHPASTNIDCKLYKNVRSVRCYDCDSCKAGVAQYMKTEWRVVAIFNVILFIILSFVYFVGCCARRNAGGSNAKGSGRGKKHSVGCCGGMMEVAMQKVCGR

SEQ ID NO: 5209 - protein, 204 aa, Secale cereale
MAMATARLIHPCMVVSKSPRAPPAPLFLHTHKPLTTALTSSHFTLHSVDVSKDDKPLDTALETKQEDATAAGGDLTTPLPGELDAEEDGPKLDPRRFEEQFAVLNTGVHECRSCGYLYDQAKGDPSYPVPPGLPFSKVPDDWRCPTCGAAQSFFDSKSVEIAGFAQNQQFGLGGNSLTSGQKTLLIYGSLLVGFAFFLSGYFLQ

SEQ ID NO: 5210 - protein, 206 aa, Triticum aestivum
MAMATARLIHPSMVVSKSPRAPPAPLLLHTHKPLTTALTSSFHFTLHSVDVSKDDKPLDTALETKQEDATAAAAGDLATPLPGELDAEEDRPKLDPRRFEEQFAVLNTGVHECRSCGYLYDQAKGDPSYPVPSGLPFNKLPDDWRCPTCGAAQSFFDSKSVEIAGFAQNQQFGLGGNSLTSGQKTLLIYGSLLVGFAFFLSGYFLQ

SEQ ID NO: 5211 - protein, 195 aa, Pseudoroegneria spicata
CMVVSKSPRTPPAPLLLHTHKPLTTALTSSSHFTLHSVDVSKDDKPLDTALETKQEDATAADAGDLATPLPGELDAEEDGPKLDPRRFEEQFAVLNTGVHECRSCGYLYDQAKGDPSYPVPPGLPFAKVPDDWRCPTCGAAQSFFDSKSVEIAGFAQNQQFGLGGNSLTSGQKTLLIYGSLLVGFAFFLSGYFLQ

SEQ ID NO: 5212 - protein, 198 aa, Avena sativa
MALATARLIHPCTVVSKNPRTPQPPFFIHTHKPLTTRLTSSSHFWLQSVDVSKDDKPLDTAAETKQEDLSAPLRGELDEEDGGEKLDPRRFEEQFAVLNTGVYECQSCGYMYDQAAGDPFYPVPRGLPFAKLPDDWRCPTCGAAQSFFDSKSVEIAGFAQNQQFGLGGNSLTSGQKTLLIYGSLLVGFAFFLSGYFLQ

SEQ ID NO: 5213 - protein, 132 aa, Pseudoroegneria spicata
MATYYPSGASALLLPVPRTRAAFPQRFPGPASGRSSPCAVVRRQRRGRGAVGVVRACFNPFGDERILREALKEPVAFMGGVFAGLLRLDLNEDPLKEWVTRTVEASGIAEENTTEESNEGAQNDGPQQIEIE

SEQ ID NO: 5214 - protein, 129 aa, Triticum aestivum
MATYYPSGASALLLPVPRTRAARFPGPASGRSSPCAAVRPQRRGRGAVGVVRACFNPFGDERILREALKEPVAFMGGVFAGLLRLDLNEDPLKEWVTRTVEASGIAEENSAEESDEGAQNDGPQQIEIE

SEQ ID NO: 5215 - protein, 132 aa, Secale cereale
MATCYPSGASALLLPAPRTRAAFPQRFAGPASGRSSPRAAVRRQRTGRGAVGVVRACFNPFGDERILREAFKEPVAFMGGVFAGLLRLDLNEDPLKEWVTRTVEASGIAEENSAEESNEGAQNDGPQQIEIE

SEQ ID NO: 5216 - protein, 132 aa, Triticum aestivum
MATYCPSGASALLLSAPRTRAAFPQRFPGPASGRSSPCAAARRQRRGRGAVGAVRACFNPFGDERILREALKEPVAFMGGVFAGLLRLDLNEDPLKEWVTRTVEASGIAEENSTEESNEGAQNDGPQQIEIE

SEQ ID NO: 5217 - protein, 128 aa, Secale cereale
YPSGASALLLPVPRTRAAFPQRFPGPASGRSSPRAAVRQQRTGRGAAGVVRACFNPFGDERILREAFKEPVAFMGGVFAGLLRLDLNEDPLKEWVTRTVEASGIAEENSAEESNEGAQNDGPQQIEIE

SEQ ID NO: 5218 - protein, 128 aa, Brachypodium distachyon
MATCYPSGVSALLLPNPRTPASRFSGPASGSVPCAVFRRESRRRKAVGIARACFNPFGDERILREAMKEPVAFMGGVFAGLLRLDLNEDPLKEWVTRTVEASGIAEENSTEESNEGAQNDAPQQIEIE

SEQ ID NO: 5219 - protein, 131 aa, Avena sativa
MATYSPSGASALLLPAPRTSATRCPGPSFSSRRSSPCAAVRRERRRRGAVVAVRACFNPLGDERILREALKEPVAFLGGVFAGLLRLDLNEDPLKEWVTRTVEASGISEESSSEESNEGAQDDGPQQIEIE

SEQ ID NO: 5220 - protein, 311 aa, Triticum aestivum
MVLPATLSRDAGAHSCPAQDGQGEAGPPRPRRPPAFYSSVFAQIEEVGWGQLVSATGDDGVSCLTFRVVDEQRRQHLLEITLPMNYPACPPSIAADVPYLPKLQWSKSSRLKDVLCQFQEHLKVLQDYWSTMDGIDKALWVVDPTKPTYAMSHHRIALGDDCYILLHVDTHKPNSLPECRFLGTDGKLERLIKNWRKNRKRWSADRKFHENLATVLDFALPQPPSVSIKDDQQADCGICYATHLPVDDELGTQSGCAADYKCENPSCSRAFHSVCLRDWLRTITTTRQSFDVLFGNCPYCSEPVAVKSTDS

SEQ ID NO: 5221 - protein, 105 aa, Secale cereale
MVLPANLSRDAGAHSCPAQDGQGEAGPPRPRRPPAFYSSVFAQIEEVGWGQLVSATGDDGVSCLTFRVMDEQHRHHLLEITLPMNYPACPPSIAADVPYLPKLQW

SEQ ID NO: 5222 - protein, 311 aa, Brachypodium distachyon
MVLPTTISRDSEARSAPPQNFQEEAEPPRPRRPPAFYSSVFAQIEEVGWGRLVTATGDDGVSCLAFRVMDEQGRQHLLEVTLPMNYPACPPSISADVPCLPKLQWSKLSRLKDVVCQFQEHLKNLQNYWCTMDDIDKALWVVDPTKPSYAMSHRRIALGDDCYILLHVDAHKPSSLPECRFLGTDGKLERLIKNWRKNRKRWTADKKFHENLSTVLDFELPQPPSVSIKDDQQADCGICYATHLPIDDELGTDSGCATDYTCENSSCDRAFHSVCLRDWLCTITTTRQSFDVLFGNCPYCSEPVAVKIAEH

SEQ ID NO: 5223 - protein, 208 aa, Triticum aestivum
MWSGAAAAAARTVSPPLHAPTSLTGRRGAGRPSTVSVRAGGGGLMDFVGGDLVKPDLGRWLDDVEEHKALAIYPPHEGGYEGRYLNRLRYQGYYFLDLSARGLGDPESTLTKIHPVCPPSLGRQPVARWYFPPEVDYRLSLLHPDAKGLIVWVYEAKVLSKAELQFLAMLPDLRPKVRVIAECGNWRKFIWKPLKQISGLEPDPDAEE

SEQ ID NO: 5224 - protein, 209 aa, Avena sativa
MWSGAAAAAAAARAVSPPLHAPTSLSGRRGAGRPSTVSMRAGGGLMDFVGGDLVKPDLGRWLDDVEEHKALAVYSPHEGGYEGRYLNRLRYQGYYFLDLSARGLGDPETTLTKIHPVCPPSLGRQPVARWYFPPEVDYRLSLLHPDAKGLVVWVLEAKVLSKAELQFLAMLPDLRPKVRVIAECGNWRKFIWKPLKQISGLEPDPDAEQ

SEQ ID NO: 5225 - protein, 210 aa, Brachypodium distachyon
MWSGSAPAAARTASPRLPAPSHSSSRRAVRPGLSSVVRAGGGGGGLMDFVGGDLVKPDLGRWLEDVEKHKALAIYPPHEGGYEGRYLNRLRYQGYYFLDLSARGLGDPESTLTKIHPVCPPSLGRQPIARWYFPPEVDYRLSLLHPDAKGLVVWVLEAKVLSKAELQFLAMLPDLRPKVRVIAECGNWRKFIWKPLKQISGLEPDPDAEQ

SEQ ID NO: 5226 - protein, 210 aa, Setaria italica
MWSATAARAVVSPLPAPSLLGGRGRRGGSARGGGGRAATVSVRSTLWDFVGGDLVKPDMARWLDDVEKHKALAIYPPHEGGYEGRYLNNLRYQGYYFLDLTARGLGDPETTLTKIHPVCPPSLGRQPVARWYFPPEVDYRLSLLHPDAKGLVVWVIEAKVLSKAELQFLAMLPDLRPKVRVIAECGNWRKFIWKPLKQIAGLEPDPDAEK

SEQ ID NO: 5227 - protein, 174 aa, Secale cereale
VSVRAGGGGLMDFVGGDLVKPDLGRWLDDVEKHKALAIYPPHEGGYEGRYLNRLRYQGYYFLDLSARGLGDPESTLTKIHPVCPPSLGRQPVARWYFPPEVDYRLSLLHPDAKGLIVWVYEAKVLSKAELQFLAMLPDLRPKVRVIAECGNWRKFIWKPLKQISGLEPDPDAEE

SEQ ID NO: 5228 - protein, 209 aa, Sorghum bicolor
MWSAAAAAARAVSVPVSPVPAPSLLSGRRGGPRGGRGAVSVRSSLLDFVGGDLVRPDLGKWLDDVEKHKALAIYPPHEGGYEGRYLNRLRYQGYYFLDLSARGLGDPETTLTKIHPVCPPSLGRQPVARWYFPPEVDYRLSLLHPDAKGLVVWIHEAKVLSKAELQFLAMLPDIRPKVRVLAEVGNWRSFVWKPLKQIAGLEQNPDAEE

SEQ ID NO: 5229 - protein, 204 aa, Panicum virgatum
MWSVAAVRAVSPLPAPSLRGGGAARGGGGGSRAATVSVRSTLWDFVGGDLVKPDLGQWLDDVEEHKALAIYPPHEGGYEGRYLNQLRYKGYYFLDLSARGLGDPETTLTKIHPVCPPSLGRQPVARWYFPPEVDYRLSLLHPDAQGLVVWIMEAKVLSKAELQFLAMLPDLRPKVRVIAECGNWRKFVWKPLKQIAGLEPNPDA

SEQ ID NO: 5230 - protein, 211 aa, Oryza sativa
MWSAAAARTVTPLPAASPLQQHQQRRGAWARVGNGRAASTTAARAGLWDFVGGDLVKPDMGRWLDDVEKHKSLAIYPPHEGGYEGRYLSRLSYQGYYFLDLSARGLGDPETTLTKIHPVCPPSLGRQPVARWYFPPEVDYRLSLLHPDAKGLVVWVMEAKVLSKAELQFLAILPDIRPKVRVIAECGNWRKFVWKPLKQIAGLEPDPDAEE

SEQ ID NO: 5231 - protein, 527 aa, Triticum aestivum
MAPAAMAFQALTFSPLPLHLPATRRRARVLAVAADQTPPPPQASPSEPANSPSRLLRELAQRKKAVSPKKKHPPRRFILKPPLDDERLTQRFLNSPQLSLKSLPLLSSCLPSSPLSAADRTWMDEYLLEAKQALGYPLAPSETLGEGDDCPARHFDVLLYLAFQHLDPSSERTRTRHVRNGHSRLWFLGQFVLELAFCEFFLQRYPRESPGPMRERVFALIGKKMLPKWIKAASLHNLVFPYDDLDKMIRKDREPPTKAVFWALFGAIYLCFGMPEVYRVLFEAFGMDPEEESCQPKLRRQLEDVDYVSVEFEKRQLAWQDVAAYRPPADALFAHPRLFRACVPPGMHRFRGNIWDFDNRPKIMNILGYPLPANDKIPEITEARNIELGLGLQLCFMHPSKYKFEHPRFCFERLEYVGQKIQDLVLAERLLMKHLDAPGRWLSEKHRRLLMNKYCGRYLRDKHLHHYIIYGETVQDRFEHNRRLRNPSTTAVQQAIHGLSYCVYGKPDVRRLMFEVFDFEQVQPKAV

SEQ ID NO: 5232 - protein, 529 aa, Brachypodium distachyon
MAPPAMACQALTYAPLPLHLPTARRRVRVRVLAVAADQTPAPQASPSSEPANSPSRLLRELAERKKAVSPKKKHPPRRFILKPPLDDERLTQRFLSSPQLSLKSLPLLSSCLPSSPLSAADRTWMDEYLLEAKQALGYPLAPSETLGDGDDCPARHFDVLLYLAFQHLDPSCERTRTRHVRNGHSRLWFLGQFVLELAFSEFFLQRYPRESPGPMRERVFALIGKRMLPRWLKAASLHNLVFPYDNLDRMIRKDREPPTKAVFWALFGAIYLCFGMPEVYRVLFEAFGMDPEEESCQPKLRRQLEDVDYVSVEFEKRQLTWQDVAAYRPPADALFAHPRLFRACVPPGMHRFRGNIWDFDNRPKVMNILGYPLPMNDRIPEITEARNIELGLGLQLCFLHPSKHKFEHPRFCFERLEYVGQKIQDLVLAERLLMKHLDAPGRWLGEKHRRMLMNKYCGRYLRDKHLHHYIIYGESVQDRFEHNRRLRNPSTTAVQQAIHGLAYCVYGKPDVRRLMFEVFDFEQVQPKAI

SEQ ID NO: 5233 - protein, 533 aa, Oryza sativa
MAPPAMAFQALALGPLPLPLPAARRRRRVRVLAVAADHTPPPPPSPSSPPEPANSPSRLLRELAERKKAVSPKKKHPPRRFILKPPLDDERLTQRFLSSPQLSLKALPLLSSCLPSAPLSAADRTWMDEYLLEAKQALGYPLAPSETLGDGDDDGCPARHFDVLLYLAFQHLDTSCERTRTRHVRSGHSRLWFLGQYVLELAFCEFFLQRYPRESPGPMRERVFALIGKRAIPKWIKAASLHNLVFPYDDLDKMIRKDREPPAKAVFWALFGAIYLCFGMPEVYRVLFEAFGMDPEDESCQPKLRRQLEDVDYVSVEFEKRQLTWQDVAAYRPPPDALFAHPRLFRACVPPGMHRFRGNIWDFDNRPKVMNTLGYPLPMNDRIPEITEARNIELGLGLQLCFLHPSKHKFEHPRFCLERLEYVGQKIQDLVMAERLLMKHLDAPGRWLAEKHRRLLMNKYCGRYLRDKHLHHYIIYGESVQDRFEHNRRLRNPSTTAVQQAIHGLAYCVYGKPDVRRLMFEVFDFEQVQPKAV

SEQ ID NO: 5234 - protein, 543 aa, Secale cereale
WPLGTSSRNPTRATTHGTGRHGVPGARLPRPSPSHLPATRRRVRVLAVAADPDPSAPAGLPSEPANSPSRLLRELAQRKKAVSPKKKHPPRRFILKPPLDDERLTQRFLNSPQLSLKSLPLLSSCLPSAPLSAADRTWMDEYLLEAKQALGYPLAPSETLGEGDDCPARHFDVLLYLVFQHLDPSSERTRTRHVRNGHSRLWFLGQFVLELAFCEFFLQRYPRESPGPMRERVFALIGKKMLPKWIKAASLHNLVFPYDDLDKMIRKDREPPTKAVFWALFGAIYLCFGMPEVYRVLFEAFGMDPEEESCQPKLRRQLEDVDYVSVEFEKRQLAWQDVAAYRPPADALFAHPRLFRACVPPGMHRFRGNIWDFDNRPKVMNILGYPLPANDKIPEITEARNIELGLGLQLCFMHPSKYKFEHPRFCFERLEYVGQKIQDLVLAERLLMKHLDAPGRWLSEKHRRLLMNKYCGRYLRDKHLHHYIIYGETVQDRFEHNRRLRNPSTTAVQQAIHGLSYCVYGKPDVRRLMFEVFDFEQVQPKAV

SEQ ID NO: 5235 - protein, 529 aa, Panicum virgatum
MAPPAMALQALTLTPLPLSLPSSRRRVRVRVLAVAADQTPPPPPVPPSEPANSPSRLLRELAQRKKAVSPKKKHPPRRFILKPPLDDERLTRRFLSSPQLSLKALPLLSSCLPSAPLSTADRTWMDEYLLEAKQALGYPLAPSETLGEGDDCPARHFDVLLYLAFQHLDPSCERTRTRHVRNGHSRLWFLGQYVLELAFCEFFLQRYPRESPGPMRERVFALIGKKVLPKWLKAASLHNLVFLYDDLDKMIRKDREPPSKAVFWALFGAIYLCFGMPEVYRVLFEAFGMDPDDESCQPKLRRQLEDVDYVSVEFEKRQLTWQDVAAYRPPPDALFAHPRLFRACVPPGMHRFRGNIWDFDSRPKVMDTLGYPLPMNDRIPEITEARNIELGLGLQLCFLHPSKHKFEHPRFCFERLEYVGQKIQDLVLAERLLMKHLDAPGRWLAEKHRRMLMNKYCGRYLRDKHLHHYVIYGESVQDRFEHNRRLRNPSTTSVQQALHGLAYCVYGKPDVRRLMFEVFDFEQVQPKAV

SEQ ID NO: 5236 - protein, 529 aa, Setaria italica
MAPPAMAFQVLTLTPLPLSLPSSNRRFRVRVLAVAADQTPPPPPVPPSEPANSPSRLLRELAQRKKAVSPKKKHPPRRFILKPPLDDERLTRRFLSSPQLSLKALPLLSSCLPSAPLSTADRTWMDEYLLEAKQALGYPLAPSETLGEGDDCPARHFDVLLYLAFQHLDPSCERTRTRHVRNGHSRLWFLGQYVLELAFCEFFLQRYPRESPGPMRERVFALIGKKVLPKWLKAASLHNLVFPYDDLDKMIRKDREPPSKAVFWALFGAIYLCFGMPEVYRVLFEAFGMDPDDESCQPKLRRQLEDVDYVSVEFEKRQLTWQDVAAYRPPPDALFAHPRLFRACVPPGMHRFRGNIWDFDSRPKVMNTLGYPLPMNDRIPEITEARNIELGLGLQLCFLHPSKHKFEHPRFCFERLEYVGQKIQDLVLAERLLMKHLDAPGRWLAEKHRRMLMNKYCGRYLRDKHLHHYVIYGESVQEKFEHNRRLRNPSTTSVQQALHGLAYCVYGKPDVRRLMFEVFDFEQVQPKAV

SEQ ID NO: 5237 - protein, 529 aa, Sorghum bicolor
MGPPAMAFQALTLTPVPFSLHSSSRRVRVRVLAVAADQTPPPPAVPPSEPANSPSRLLRELAQRKKAVSPKKKHPPRRFILKPPLDDERLTRRFLSSPQLSLKALPLLSSCLPSAPLSTADRTWMDEYLLEAKQALGYPLAPSETLGEGDDCPARHFDVLLYLAFQHLDPSSERTRTRHVRNGHSRLWFLGQYVLELAFCEFFLQRYPRESPGPMRERVFALIGKKVLPRWLKAASLHNLVFPYDDLDKMIRKDREPPSKAVFWALFGAIYLCFGMPEVYRVLFEAFGMDPDDESCQPKLRRQLEDVDYVSVEFEKRQLTWQDVAAYRPPPDALFAHPRLFRACVPPGMHRFRGNIWDFDSRPKVMNTLGYPLPMNDRIPEITEARNIELGLGLQLCFLHPSKHKFEHPRFCYERLEYVGQKIQDLVMAERLLMKHLDAPGRWLAEKHRRTLMNKYCGRYLRDKHLQHYIIYGETVQDRFEHNRRLRNPSTTSVQQALHGLAYCVYGKPDVRRLMFEVFDFEQVQPKAV

SEQ ID NO: 5238 - protein, 529 aa, Panicum virgatum
MAPPAMAFQALTLTPLPLSLPNSRRRVRVRVLAVAADQTPPPPPVPSSEPANSPRRLLRELAQRKKAVSPKKKHPPRRFILKPPLDDERLTRRFLSSPQLSLKALPLLSSCLPSAPLSTADRTWMDEYLLEAKQALGYPLAPSETLGEGDDCPARHFDVLLYLAFQHLDPSCERTRPRHVRNGHSRLWFLGQYVLELAFCEFFLQRYPRESPGPMRERAFALIGKKVLPKWLKAASLHNLVFPYDDLDKMIRKDREPPSKAVFWALFGAIYLCFGMPEVYRVLFEAFGMDPDDESCQPKLRRQLEDVDYVSVEFEKRQLTWQDVAAYRPPPDALFAHPRLFRACVPPGMHRFRGNIWDFDSRPKVMDTLGYPLPMNDRIPEITEARNIELGLGLQLCFLHPSKHKFEHPRFCFERLEYVGQKIQDLVLAERLLMKHLDAPGRWLAEKHRRMLMNKYCGRYLRDKHLHHYVIYGESVQDRFEHNRRLRNPSTTSVQQALHGLAYCVYGKPDVRRLMFEVFDFEQVHPKAV

SEQ ID NO: 5239 - protein, 424 aa, Secale cereale
MVILCAGHPAPSVHSEFLSRWLSLNSPKMPYALNSTGRKLGKQNRHRRMITFAKSSSLQDSLASVKPSRLLPTVEPKTFPSSVPDEILSKLRLEESDAFYILELCTSRELSSSLLDKNSAILICLIDVDGDSLLQRVPAIYGNQPAHGTKASQFLPFQSGSVDIITFKGPKLQTIKEIWIGLESGSWRLDGLSLKVIHGARNTPEDLEGTLELKFSGLQYMFDKLGALLGEDGASVVEARPIAVTDLSGISISDLQEGQLSSARTASSIKELKEDGLREYADLKQSLLLYDISIVITGFSAFTLASNDGAAYSFLVGGIGGFLYLLLLQRSVDGLPAINSPSEASSSEPTVNFSGVRRPWLILSIVMVAGAVALKYGAGGDSFELTPTELFVGAAGFLANKVAVLLAAFKPLQSNLESDDGSVD

SEQ ID NO: 5240 - protein, 424 aa, Secale cereale
MVILCAGHPAPSVHSEFLSRWLSLNSPKMPYALNSAGRKLGKQNRHRRMVTFAKSSSLQDSVASVKPSRLLPTVEPKTFPNSVPDEILSKLRLEESDAFYILELCTSRELSSSLLDKNSAILICLIDVNGDSLLQRVPAIYGNQPAHGTKASQFLPFQNGSVDIITFKGPKLQTIKEIWIGLESGSWRLDGLSLKAIHGAWNTPEDLEGTLELKFSGLQYTFDKLGALLGEDGASVVEARPIAVTDLSGISISDLQEGQLSSARTASSIKELKEDGLREYADLKQSLLLYDISIVITGFSAFTLASNDGAAYSFLVGGIGGFLYLLLLQRSVDGLPAINSPSEASSSEPTVNFSGVRRPWLILSIVMVAGAVALKYGAGGDSFELTPTELFVGAAGFLANKVAVLLAAFKPLQSNLESDNGSVD

SEQ ID NO: 5241 - protein, 424 aa, Triticum aestivum
MVILCAGHPAPSVHSEFLSRWLSLNSPKMPYALNSTGRKLRKHNRHRGMTTFANSSSLQDSLASVKPSRLLPTVEPKTFPNSVPDEILSKLRLEESDAFYILELCTSGELSSSLQDKNSAILVCLIDVEGDSLLQRVPAIYGDQPAYGTKTSQFLPFQSGSVDIITFKGPKLQTIKEIWIGLESGSWRLDGLSLKVIHGARNTPEDLEGTLGLKFSGLQYTFDKLGALLGEDGASVVEARPIAVTDFSGISISDLQEGQLSSARTDSSIKELKEDGLREYADLKQSLLLYDISIVITGFSAFTLASNDGAAYSFLVGGIGGFLYLLLLQRSVDGLPAISSPSEASSSEPSMNFSGVRRPWLILSIVMVAGAVALKYGAGGDSFELTPTELFVGAAGFLANKVAVLLAAFKPLQSNLESDDGSVD

SEQ ID NO: 5242 - protein, 424 aa, Triticum aestivum
MVILCAAQPAPSVHSEFLSRWLSLNSPKMPYALNSTATKLRKQNRRRRIITYAKSSSLQDSVASVKPSRLLPTVEPKTFPNSVPDEILLKLRLEESDAFYILELCTSRELSSSLLDKNSAILVCLIDVDGDSLLQRVPAIYGDQPAHVTKPLQFLPFQSGSVDIVTFKGPKLQTIKEIWIGLESGSWRLDGLSLKVIHGARNTPEDLEGTLEPKFSGLRYTFDKLGALLGEDGASVVEARPTAVTDLSGISISDLQEGQLSSAKTASSIKELKEDGLREYADLKQSLLLYDISIVITGFSAFTLALNDGAAYSFLVGGIGGFLYLLLLQRSVDGLPAISSPSEASSSEPTMNFSGVRRPWLILSIVMVAGAVALKYGAGGDSFELTPTELFVGAAGFLANKVAVLLAAFKPLQSNLESDDGSVD

SEQ ID NO: 5243 - protein, 163 aa, Triticum aestivum
MVILCAAQPAPSVHSEFLSRWLSLNSPKMPYALNSTGRKLRKHNRHRGMTTFANSSSLQDSLASVKPSRLLPTVEPKTFPNSVPDEILSKLRLEESDAFYILELCTSGELSSSLQDKNSAILVCLIDVEGDSLLQRVPAIYGDQPAYGTKTSQFLPFKVVQLI

SEQ ID NO: 5244 - protein, 424 aa, Brachypodium distachyon
MVILCNGHAAPSVHTEFISGWLSLNTSKMRCRLNSTGRKLRNRNRHQKMISFAKSSSLQDSMASVKPSRLLPTVEPRTFPSSVPEEIISRVRLQESDAFYMLELSTSREFSSSLLDKNAAILICLIDVDGDSLLQRIPAIYWDQPAQSMKALQPIPFQSGSVDIITFKGPKLQRIKEVWIGLESGSWRLDGLSLKMIHGPLNTPNDLEVTLELKFNGLQYTFDRLNALLGEDGASVVEAKPMSLTDLSGISISDLQEGQLSSASTASSIVELEDGLREYADLKQSLLLYDIAIVITGFSAFTLASNDAAAYSFLVGGIGGFLYLLLLQRSVDGLPATSSPSEAGSPEPSVKGFSGVRRPWLILSLAMVAGAVALKYGAGGETFELTPTELFVGAAGFLANKISVLLAAFKPLQTNLKREDGSGD

SEQ ID NO: 5245 - protein, 116 aa, Triticum aestivum
METKAARCLCLLAMLLVAGLGAARGAGECGRVPADRMALKLAPCAAATQNPGAKVAPGCCAQIRSIGRSPKCLCAVMLSATARQAGVKPAVAMTIPKRCAIANRPIGYKCGPYTLP

SEQ ID NO: 5246 - protein, 116 aa, Triticum aestivum
MESKAARCLCMLAMLLVAGLGAARGAGECGRVPADRMALKLAPCAAATQNPRAKVAPGCCAQIRSIGRSPKCLCAVMLSSTARQAGVKPAVAMTIPKRCALANRPIGYKCGPYTLP

SEQ ID NO: 5247 - protein, 148 aa, Secale cereale
MEPKRSSPQAQPQPRAATKKSPPRATAAAGADSPLSSLFHPAPYGVNGKEQDLYAILFKGQNGNAQASMTDGKSQWSPARGRTTYTKDNKYDSVGTSSCFGSSVHYGGREYYGSSAPKQAAEYSDYKVDKKDPVADSHGDWWQGSFYY

SEQ ID NO: 5248 - protein, 155 aa, Secale cereale
MEPKRSSPQAQPQPRAATKKSPPRAAAAAAVDAVAAGADSPLSSLFHPAPYGVNGKEQDLYAILFKGQNGNAQASMTDGKSQWSPARGRTAYSKDNKYDSVGTSSCFGSSVHYGGREYYGSSAPKQAAEYSDYKVDKKDPVSDSHGDWWQGSFYY

SEQ ID NO: 5249 - protein, 229 aa, Avena sativa
MADDDDCPPLAVELPPQTTSPLAPASSSASVPVGVTVITGYLGAGKSTLVNYILSAQHGKRIAVILNEFGEEIGVERAMINEGQGGALVEEWVELANGCVCCTVKHSLVQALEQLVQSKERMDHILLETTGLADPAPLVSILWLDDQLESSIRLDSIITVIDAKNFRRQIDEHTNSSSFPEAFHQIAFADVVILNKIDLVKDDLEDLERKIHDVNALVTVVRSVRCQLT

SEQ ID NO: 5250 - protein, 348 aa, Triticum aestivum
QTTSPLVPASSSASAPVGVTVITGYLGAGKSTLVNYILSGQHGKRIAVILNEFGEEIGVERAMINEGQGGAVVEEWVELANGCVCCTVKHSLVQALEQLVQTKERMDHILLETTGLADPAPLVSILWLDDQLESSIRLDSIITVIDAKNFRRQIDEHTNSSSFPEAFHQIAFADVVILNKIDLVKDDLEDLERQIHDVNALVTVVRSVRCQVDLNTIFDRQAYGVKNSSQLQELLEYSKSAPPNSRHDNSISTLCIYEQDPVYLTKVESWLEDLLWEKKSNMDIYRCKGILNIHNSNQLHTLQAVREVYEVVPAREWSETQSRMNKIVFIGRDLDISILQDSFSRCKH

SEQ ID NO: 5251 - protein, 345 aa, Secale cereale
PVPAPSSASASVPVGVTVITGYLGAGKSTLVNYILSGQHGKRIAVILNEFGEEIGVERAMINEGQGGAVVEEWVELANGCVCCTVKHSLVQALEQLVQTKERMDHILLETTGLADPAPLVSILWLDDQLESSIRLDSIITVIDAKNFRRQIDEHTNSSSFPEAFHQIAFADVVILNKIDLVKDDLEDLERQIHDVNALVTVMRSVRCQVDLNTIFDRQAYGVKNSSQLQELLEYSKSAPPNSRHDNSISTLCIYEQDPVNLAKVESWLEDLLWEKKSNMDIYRCKGILNIHDSNQLHTLQAVREVYEVVPAREWSETQSRMNKIVFIGRDLDISTLQDSFSRCKH

SEQ ID NO: 5252 - protein, 363 aa, Panicum virgatum
MEDNDDCPPLAVELPPQVPSPPAPAPPDASPVGVTVITGYLGAGKSTLVNYILNEQHGKRIAVILNEFGEEIGVERAMINEGQGGALVEEWVELANGCVCCSVKHSLVQALEQLVQRKDRMDHILLETTGLADPAPLVSVLWLDDQLESSIRLDSIITVIDAKNFRVQIDEHKNSSSFPEAFHQIAFADVVILNKIDLVKDNVEDLEKHIHDVNALVTVVRSVRCQVDLNEIFNRQAYGAKNSSHLQELLDYSKSIPPNRRHDNSISTLCIYEQDPVNLAKVESWLEDLLWEKKSSMDIYRCKGILHIHDSDQVHTLQAVREVYEVMPARKWSETESRMNKIVFIGRNLDINALQDSFSGCKG

SEQ ID NO: 5253 - protein, 363 aa, Sorghum bicolor
MEDDDDCPPLAVELPPQVPSPPAQAPSDASPVGVTVITGYLGAGKSTLVNYILNEQHGKRIAVILNEFGEEIGVERAMINEGQGGALVEEWVELANGCVCCSVKHSLVQALEQLVQRKDRMDHILLETTGLADPAPLVSVLWLDDQLESSIRLDSIITVIDAKNFRVQIDEHKNSSSFPEAFHQIAFADVVILNKIDLVEDNLEDLEKHIHDVNALVTVVRSVRCQVDLNEVFNRQAYGVKDSSHLQELLDYSKSVPPSRRHDNNISTLCIYEQDSVNLAKVESWLEDLLWEKKSSMDIYRCKGILYIHDSDQVHTLQAVREVYEVVPARKWSETESRMNKIVVIGRNLDINVLQDSFSVCKS

SEQ ID NO: 5254 - protein, 363 aa, Cenchrus ciliaris
MEEDDDCPPLAVELPPRAPSPPAPGSSEASPVGVTVITGYLGAGKSTLVNYILNEQHGKRIAVILNEFGEEIGVERAMINDGQGGALVEEWVELANGCVCCSVKHSLVQALEQLVQRKDKMDHILLETTGLADPAPLVSVLWLDDQLESSIRLDSIITVIDAKNFRVQIDEHKNSSSFPETFHQIAFADVVILNKIDLVKDNLEDLEKHIHDANALVTVVRSVRCQVDLNEIFNRQAYGAKNSSHLQELLDYSKTIPPNRRHDNSISTLSIYEQDPVNLAKVESWLEDLLWEKNFSMDIYRCKGILHIHDSDQVHTLQAVREVYEVVPARKWSETESRMNKIVVIGRNLDINVLQDSFSGCKG

SEQ ID NO: 5255 - protein, 212 aa, Saccharum officinarum
MEVDDDCPPLAVELPPRVPSPPAQAPSDASPVGVTVITGYLGAGKSTLVNYILNEQHGKRIAVILNEFGEEIGVERAMINEGQGGALVEEWVELANGCVCCSVKHSLVQALEQLVQRKDRMDHILLETTGLADPAPLVSVLWLDDQLESSIRLDSIITVIDAKNFKVQIDEHKDSSSFPEAFHQIAFADVVILNKIDLVEDNLEDLENTFMM

SEQ ID NO: 5256 - protein, 363 aa, Zea mays
MEDDDDCPPLAVELPPRVPSPPEQSPSDASPVGITVITGYLGAGKSTLVNYILNEQHGKRIAVILNEFGEEIGVERAMINEGQGGALIEEWVELANGCVCCSVKHSLVQALEQLVQRKDRMDHILLETTGLADPAPLVSVLWLDDQLESSIVLDSIITVIDAKNFRVQIDEHKNSSSFPEAFHQIAFADVVILNKIDLVEDSLEDLEKHIRDVNALVTVVRSVRCQVDLNEVFNRQAYGAKNSSHLQELLDYSKSVPPSRRHDNSISTLCIYEQDSVNLAKVESWLEDLLWEKKSIMDIYRCKGILYIHDSDQVHTLQAVREVYEVVPARKWSETESRMNKIVVIGRNLDINVLQDSFSGCKS

SEQ ID NO: 5257 - protein, 980 aa, Brachypodium distachyon
MEDDEDCPPLAVELPAQTTSPPVTAPSSASAPVGVTVITGYLGAGKSTLVNYILSAQHGKRIAVILNEFGEEIGVERAMINEGQGGALVEEWVELANGCVCCTVKHSLVQALEQLVQSKERMDHILLETTGLADPAPLVSILWLDDQLESSIRLDSIITVIDAKNFRQQIDEHTNSSSFPEAFHQIAFADVVILNKIDLVKDDLEDLEKQIHDVNALVTVVRSVRCQVDLNTIFDRQAYGTKNSSQLQELLEYSKSVPPNSRHDNSISTLCISEQDPVHLAKVESWLEDLLWEKKSTMDIYRCKGILHIHNSNQLHTLQDIVTKLPFNVPFSRFHSALPISSRRLPLPATPRTPTKTLTHNTMAAAAAASSLLLRRHHRTPARLPIILRAAISSTRALPQQPELSPPPTEPAAASTSPLPPNPSSGSPFYGENWRNPAASSPASSLLPAVVSASPFTHHRMAAFSATLGAAELKETFAEWMTEQRWDEMKQLFEFWVRSLDASTGKPNRPDVDLFNHYLRANFMSGALPHEMLDLADQMREFEISPNTASHNLILKSMVRAREVEGAEKLVERMLLTGTVPDDESYNLVVDLLIKQNRVDSALKYLDLMLKSGYMISSTVFADCVRECIRSGRLDTLASVIEKCKATDKNKVLCPQWAWCIGIAEAAFEANNSKLAMFALEFLARWMARGERASPPIHLSVDEGLVLSALSAAGRTCSTDLLNAAWSILRKSLRQKRAPTPEAYLAKIYAHSSIGQLQRAFGTLREFENAYGNSENIDIELFSPFMSLQPLVVACCKDGFTTLDSVYVQLENLSSADPPYKSVAALNCVIVGCANIWDLERAYETFEALKEKFGLTPDIHSYNALLYAFGKLKKTEEACNVFQHLVSLDVKPNSTTYSLLVDAHLVNRDPKAALAVIDEMVDVGFTPSKETLKKVRRRCSRESDFDSDEKLQSLCKQLNCRMGGEGRRELLYNIEYSAEY

SEQ ID NO: 5258 - protein, 240 aa, Leymus cinereus x Leymus triticoides
  misc_feature (17)..(17): Xaa can be any naturally occurring amino acid
  misc_feature (23)..(23): Xaa can be any naturally occurring amino acid
  misc_feature (38)..(38): Xaa can be any naturally occurring amino acid
  misc_feature (192)..(192): Xaa can be any naturally occurring amino acid
  misc_feature (232)..(232): Xaa can be any naturally occurring amino acid
MASPQCCANPPTLNPAXGEGKVXDSFGGIKAYVAGAQXSKAAVVLISDVYGFEAPNLRKIADKVASSGYFVVVPDFLHGDPYVPEDADRPIAVWIKEHTQGKAFEEAKPVIAALKEQGASSVGAAGYCWGAKVVAELAKANEIQAAVMSHPSFVTVDDIKEVKCPIAILGAETDVMSPPELVKEFEQVLSSXSGIAHFVKIFPGVSHGWTVRYKSEDAAAVKSAEEALADMXDWFNKNLK

SEQ ID NO: 5259 - protein, 240 aa, Secale cereale
MASPQCCANPPTLNPAAGEGKVVDSFGGIKAYVAGAQESKAAVVLISDVYGFEAPNLRKIADKVASSGYFVVVPDFLHGDPFVPEDADRPIAVWIKEHTPGKAFEEAKPVIAALKEQGASSVGAAGYCWGAKVVAELGKANDIQAAVMSHPSFVTVDDIEEVKCPIAILGAETDVMSPPELVKKFEQVLSSNSGIAHFVKIFPGVSHGWTVRYKSEDAAAVKSAEEALADMVDWFNKNLK

SEQ ID NO: 5260 - protein, 240 aa, Triticum aestivum
MASPQCCANPPALNPAAGEGKVVDSFGGIKAYVAGAKESKAAVVLISDVYGFEAPNLRKIADKVASSGYFVVVPDFLHGDPFVPEDADRPIAVWIKEHTPGKAFEEAKPVIAALKEQGASSVGAAGYCWGAKVVAELAKANEIQAAVMSHPSFVTVNDIEEVKCPIAILGAETDVMSPPELVKKFEQVLSSNSGIAHFVKIFPGVSHGWTVRYKSEDAAAVKSAEEALADMIDWFNKNLK

SEQ ID NO: 5261 - protein, 241 aa, Triticum aestivum
MASPQCCANPPTLNPAAGEGKVVDSFGGIKAYVAGAQESKAAVVLISDVYGFDAPNLRKIADKVASSGYFVVVPDFLHGDPFVPEDADRPIAVWIKEHTPGKAFEEAKPVIAALKEQGASSVGAAGYCWGAKVVAELAKANEIQAAVMSHPSFVTVDDIKEVKCPIAILGAETDKTSPPELVKQFEQVLASSNSGIANFVKIFPGVSHGWTVRYKSEDAAAVKSAEEALVDMVDWFNKNLK

SEQ ID NO: 5262 - protein, 240 aa, Pseudoroegneria spicata
MASPQCCANPPTLNPAAGEGKVVDSFGGIKAYVAGAQESKAAVLLISDVYGFEAPNLRKIADKVASSGYFVVVPDFLHGDPYVPEDTDRPIAVWIKEHTPGKAFEEAKPVIAALKEQGVSSVGAAGYCWGAKVVAELAKSNEIQAAVMSHPSFVTVDDIKEVKCPIAILGAETDVMSPPELVKKFEQVLSSNSGIAHFVKIFPGVSHGWTVRYKSEDAAAVKSAEEALADMVDWFNKSLK

SEQ ID NO: 5263 - protein, 240 aa, Secale cereale
MASPQCCANPPTLHPAAGEGKVVDSFGGIKAYVAGAQESKAAVVLISDVYGFEAPNLRKIADKVASSGYFVVVPDFLHGDPFVPEDADRPIAVWIKEHTPGKAFEEAKPVIAALKEQGASSVGAAGYCWGAKVVAELGKANDIQAAVMSHPSFVTVDDIEEVKCPIAILGAETDVMSPPELVKKFEQVLSSNSGIAHFVKIFPGVSHGWTVRYKSEDAAAVKSAEEALADMVDWFNKNLK

SEQ ID NO: 5264 - protein, 237 aa, Triticum aestivum
PQCCANPPTLNPAAGEGKVVDSFGGIKAYVAGAQESKAAVVLISDVYGFEAPNLRKIADKVASSGYFVVVPDFLHGDPFVPEDADRPIAVWIKEHTPGKAFEEAKPVIAALKEQGASSVGAAGYCWGAKVVAELGKANEIQAAVMSHPSFVTVNDIKEVKCPISILGAETDVMSPPELVKEFEQVLSSNSGIAHFVKIFPGVSHGWTVRYKSEDAAAVKSAEEALADMIDWFNKNLK

SEQ ID NO: 5265 - protein, 240 aa, Triticum aestivum
MASPQCCAKPPALNPAAGEGKVVDSFGGIKAYVAGAQDSKAAVVLISDVYGFEAPNLRKIADKVASSGYFVVVPDFLHGDPFVPENADRPIAVWIKEHTPGKAFEEAKPVIAALKEQGASSVGAAGYCWGAKVVAELGKANEIQAAVMSHPSFVTVDDIKEVKCPISILGAETDVMSPPELVKEFEQVLSSNSGIAHFVKIFPGVSHGWTVRYKSEDAAAVKSAEEALADMVDWFNKNLK

SEQ ID NO: 5266 - protein, 96 aa, Triticum aestivum
MSHPSFVTVDDIKEVKCPIAILGAETDKTSPPELVKQFEQVLASSNSGIANFVKIFPGVSHGWTVRYKSEDAAAVKSAEEAWWTWLTGLTRTSSEP

SEQ ID NO: 5267 - protein, 240 aa, Avena sativa
MASPQCCANPPTPSPAGGEGKVVDSFGGIKAYVAGGQDSKAAVVLISDIFGFEAPNLRKVADKVASSGYFVVVPDFLHGDPYKPEDADRPIQVWIKEHAPLKAFEEAKPVIAALKEQGVSSVGAAGYCWGAKVVAELAKANEIEAAVMSHPSFVTVDDIKEVKCPIAVLGAETDRTSPPELVKQFEQVLSSNSEIGHFVKIFPGVSHGWTVRYDSDDAAAVKSAEEALTDMTNWFNKNLK

SEQ ID NO: 5268 - protein, 240 aa, Avena sativa
MASPQCCANPPTPSPAGGEGKVVDSFGGIKAYVAGGQDSKAAVVLISDIFGFEAPNLRKVADKVASSGYFVVVPDFLHGDPYKPEDADRPIQVWIKEHAPQKAFEEAKPVIAALKEQGVSSVGAAGYCWGAKVVAELAKANEIQAAVMSHPSFVTVDDIKEVKCPIAVLGAETDRTSPPELVRQFEQVLSTNSEIAHFIKIFPGVSHGWTVRYGSDDAAAVKSAEEALTDMTDWFNKNLK

SEQ ID NO: 5269 - protein, 240 aa, Hordeum vulgare
MATPQCCADPPTLNPAGGEGKVVDSFGGITAYVSGARESKAAVVLISDVFGFEAPNLRKIADKVASSGYLVVVPDFLHGDPYVPENADRPIQVWLKEHAPGKAFEEAKPVIAALKEQGVSTVGAAGYCWGAKVVAELAKANEIHAAVMSHPSFVTVEDIKEVKCPIAVLGAEIDKTSPPELVKQFEQVLSSNSGIAHFVKIFPGVSHGWTVRYKSEDAGAVKSAEEALSHMIDWFSKNLQ

SEQ ID NO: 5270 - protein, 240 aa, Secale cereale
MATPQCCADPPTLNPAGGEGKVVDSLGGIAAYVAGSTESKAAVVLISDVFGFEAPNLRKIADKVASSGYFVVVPDFLHGDPYVPENADRPIQVWLKEHAPGKAFEQAKPVIAALKEQGVSTVGAAGYCWGAKVVAELAKANEIQAAVMSHPSFVTVDDIKEVKCPIAVLGAEIDKTSPPELVKQFEQILSSNTGIAHFVKIFPGVSHGWTVRYKSEDAGAAKSAEEALSDMVDWFNKNLK

SEQ ID NO: 5271 - protein, 240 aa, Secale cereale
MASPQCCADPPTLNPAGGEGKVVDSLGGIAAYVAGSTESKAAVVLISDVFGFEAPNLRKIADKVASSGYFVVVPDFLHGDPYVPENADRPIQVWLKEHAPGKSFEEAKPVIAALKEQGVSTVGAAGYCWGAKVVAELAKANEIQAAVMSHPSFVTVDDIKEVKCPIAVLGAEIDKTSPPELVKQFEQILSSNTGIAHFVKIFPGVSHGWTVRYKSEDAGAAKSAEEALSDMVDWFNKKLK

SEQ ID NO: 5272 - protein, 240 aa, Avena sativa
MASPQCCANPPTLSPAAGEGKVVDSFGGLRAYLAGAQESKAAVVLISDVYGFEAPNLRNIADKVASSGYFVVVPDFLHGDPFVPADADRPLQVWIKEHAPEKGFEEAKPVIAALKEQGVSVVGAAGYCWGAKVVAELAKANEIQAAVMSHPSFVTVDDIKEVKCPIAILGAETDVMSPPELVKQFKQVLSSNAGIGSFVKIFPGVSHGWTVRYDSNDAAAVKNAEEALADMIEWFNKNLK

SEQ ID NO: 5273 - protein, 240 aa, Avena sativa
MASPQCCANPPTLSPAAGEGKVVDSFGGLRAYLAGAQESKAAVVLISDVYGFEAPNLRNIADKVASSGYFVVVPDFLHGDPFVPADADRPIQVWIKEHAPDKGFEEAKPVIAALKEQGVSVVGAAGYCWGAKVVGELAKANEIQAAVMLHPSFVTVDDIKEVKCPIAILGAETDVMSPPELVKQFKQVLSSNSGIGSFVKIFPGVSHGWTVRYDSNDAAAVKNAEEALADMIEWFNKNLK

SEQ ID NO: 5274 - protein, 241 aa, Triticum aestivum
MASPQCCADPPTLDPAGGEGRVVDSFGGITAYVAGARESKAAVILVSDIFGFEAPNLRKITDKVASSGYFVVVPDFLHGDPYVPENADRPIQVWLKEHAPGKAFEEAKPVIAALKEQGVSTVGAAGYCWGAKGVAELAKANEIQAAVMSHPSFVTVDDIEEVKCPIAILGAETDKTSPPELVKQFEQVLSSSNSGIAHFVKIFPGVSHGWTVRYKSEDAGAVKSAEEALSDMIDWFNKNLK

SEQ ID NO: 5275 - protein, 240 aa, Secale cereale
MASSQCCADPPTLNPAGGEGRVVDSLGGIAAYVAGSTESKAAVVLISDVFGFEAPNLRKIADKVASSGYFVVVPDFLHGDPYVPENADRPIQVWLKEHAPGKAFEQAKPVIAALKEQGVSTVGAAGYCWGAKVVAELAKANEIQAAVMSHPSFVTVDDIKEVKCPIAVLGAEIDRTSPPKLVKQFEQILSSNTGIAHFVKIFPGVSHGWTVRYKSEDAGAAKSAEEALSDMVDWFNKNLK

SEQ ID NO: 5276 - protein, 240 aa, Triticum aestivum
MASPQCCADPPTLNPAGGEGRVVDSLGGVTAYVAGVRESNAAVVLISDIFGFEAPILRKIADKVASSGYFVVVPDFLHGDPFVPENADRPIQVWIKEHPLGKAFEEAKPVIAALKEQGVSTVGAAGYCWGAKVVAELAKANEIQAAVMSHPSAVTVDDIKEVKCPIAVLGAENDKTSPPELVKQFEQVLSSNTGIAHFVKIFPGVSHGWAVRYKSEDAGAVKSAEEALSDMIDWFNKNLK

SEQ ID NO: 5277 - protein, 220 aa, Lolium multiflorum
MASPQCCANPPSLSPAGGEGKVVDSFGGIRAYVAGAQDSKAAVVLIADVFGFEAPKLRKIADKVASFGYFVVVPDLLHGDPYVPEDADRTIQVWLKEHNPIKAFELAKPVIAALKEQGVSSVGAAGYCWGAKVVAELAKANEIQAAVMSHPSFVTVDDIKEVKCPIAVLGAELTERPHQNWSSSSSRFYPLIQRLAPLLRFFLGFLMDGLSDTIAMTRLL

SEQ ID NO: 5278 - protein, 93 aa, Avena sativa
MSHPSFVTVDDIKEVKCPIAILGAETDVMSPPELVKQFEQVLSSNAGIGSSVKIFPGVSHGWTVRYDSNDAAAVKNAEEALADMIEWFNKNLK

SEQ ID NO: 5279 - protein, 240 aa, Brachypodium distachyon
MASPQCCANPPTLNPAGGEGKVVDSFGGIRAYVAGAQESKAAVILVSDVFGFEAPNLRKIADKVALSGYFVVVPDFIHGDPYVPESVDKPIAVWIKEHAPEKAFEEAKPVIAALKKQGASSVGAAGYCWGAKVVVELAKANEIQAAVMLHPSFVTVDDIKEVKCPIAILGAEIDKMSPPEVVKQFEQVLSSNSGVGHFVKIFPGVAHGWTVRYNSDDASAVKSAEEALADMTSWFDQNLK

SEQ ID NO: 5280 - protein, 240 aa, Avena sativa
MASPQCCADPPALNPAGGEGKVVDGFGGVPAYVAGARESKAAVVLISDVFGFEAPILRKIADKVASSGYFVVVPDFLHGDPYVPENADRPIQAWLKEHAPGKAFEDAKPVIAALKEQGVSTVGAAGYCWGAKVVAELAKANEIQAAVMSHPSFVTVDDIKEVKCPIAILGAETDKTSPPELVNQFEQVLSSNSAIAHFVKIFPGVSHGWTVRYDSEDAAAVKCAEEALADMTSWFDKNLK

SEQ ID NO: 5281 - protein, 240 aa, Oryza sativa
MASPQCCANPPTLNPAGGEGKVVESFGGIKAYVAGAAESKAAVVLISDVFGFEAPNLRKIADKVASSGYFVVVPDFLHGDPLVPESTEKPFQMWIKEHGPDKAFEEAKPIIAALKEKGVSSIGAVGYCWGAKVVVELVKAHEIQAAVMCHPSFVTVDDMKEVKCPIAILGAEIDRMSPPEVVKQFEQVLSSKSGIGHFVKIFPGVEHGWTVRYKNDDAAAVKSAEEALADMIDWFNKNLK

SEQ ID NO: 5282 - protein, 240 aa, Panicum virgatum
MASPQCCENPPTLNPAGGAGKVVDSFGGLKAYVAGPEDSKAAVVLVADVFGFEAPNLRKIADKVALSGYFVVVPDFFHGDPYVPENTERPIPEWLKSHTPEKGFEDAKPVIAALKEKGVSAVGAAGYCWGAKVVVELAKAKEIQAAVMLHPSFVSVDDIKEVKCPISVLGAEIDKTSPPELVKQFEQVLSANSGVGHFVKIFPGVSHGWSVRYSEDDAAAVKSAEEALADMIDWFNKNLK

SEQ ID NO: 5283 - protein, 240 aa, Panicum virgatum
MASSQCCENPPTLNPAGGAGKVVDSFGGLKAYVAGPEDSKAAVVLVADVFGFEAPNLRKIADKVALSGYFVVVPDFFRGDPYAPENTERPIPEWLKSHTPEKGFEDAKPVIAALKEKGVSAVGAAGYCWGAKVVVELAKAKEIQAAVLLHPSFVSVDDIKEVKCPISVLGAEIDKMSPPELVKQFEQVLSANSGVGHFVKIFPGVSHGWSVRYSEDDAAAVKSAEEALADMIDWFNKNLK

SEQ ID NO: 5284 - protein, 240 aa, Brachypodium distachyon
MASPQCCANPPTLNPAGGEGKVVDSFGGTRAYVAGAEESKAAVILISDIFGFEAPKLRKIADKVASCGYFVIVPDFLHGEPFAHENADRPFPVWIEAHAPGKAYEEAKPIIAALKEHGMSTVGAAGYCWGAKVVAELAKAHEIQAAVMLHPSFVTIDDIKEVKCPTAILGADIDKMSPPELVKQFKEVLSSNSGIGHFVKIYPGVAHGWTVRYNSDDAAAVKSAREALADMTDWYNKNLK

SEQ ID NO: 5285 - protein, 633 aa, Secale cereale
MSSSGKRLDQSPSPSRPVLAMSHSSNRLDQPPGRPVLAMSRSSNRLDHSPSSSSPTPAKGPALVMSGSSKRLEQSLASPSPSPKAGAAAPPVLVLSNSGKRMDQAGRKKYVKQVTGRHNDTELHLAAQRGDLDAVRQIIAEIDAQMTGTGEEFDSEVAEIRAAVLNEPNEVGETALLIAAEKGFIDVVVELLKHSDKESLAGKNKSGFDALHVAAKEGHQDIVKVLLDHDPSLGKTFGQSNVTPLITAAIRGHLEVVNLLLERVSGLVELSKANGKNALHFAARQGHVEIVKSLLVSEAQLARKTDKKGQTALHMAVKGTSAAVVRALVNADPAIVMLPDKNGNLALHVATRKKRSEIVNELLLLPDMNVNALTRDRKTAFDIAEGLPLSEESADIKDCLSRAGAVRANDLNQPRDELRKTVTEIKKDVHTQLEQARKTNKNVHGIAKELRKLHREGINNATNSVTVVAVLFATVAFAAIFTVPGGNDDHGVAIVVHAVSFKVFFIFNAIALFTSLAVVVVQITLVRGETKAERRVVEVINKLMWLASVCTTVAFISSSYIVVGRHFKWAALLVTLIGGVIMASVLGTMTYYVVKSKRTRSIRKKVKSTRRSGSNSWNHNSESDSEIDRIYAI

SEQ ID NO: 5286 - protein, 614 aa, Triticum aestivum
MSHSSKRLDQPPGRPVLAMSRSSNRLDHSPASSSSPTPAKGPALVMSGSSKRLEQSLASPSPSPKAGAAAPPVLVLSNSGKRMDQAGRKKYVKQVTGRHNDTELHLAAQRGDLDAVRQIIAEIDAQMTGTGEEFDSEVAEIRAAVLNEPNEVGETALLIAAEKGFIDVVVELLKHSDKESLARKNKSGFDALHVAAKEGHRDIVKVLLDHDPSLGKTFGQSNVTPLITAAIRGHLEVVNLLLERVSGLVELSKANGKNALHFAARQGHVEIVKSLLVSEAQLARKTDKKGQTALHMAVKGTSAAVVRALVNADPAIVMLPDKNGNLALHVATRKKRSEIVNELLLLPDMNVNALTRDRKTAFDIAEGLPLSEESADIKDCLSRAGAVRANDLNQPRDELRKTVTEIKKDVHTQLEQARKTNKNVHGIAKELRKLHREGINNATNSVTVVAVLFATVAFAAIFTVPGGNDDHGVAIVVHAVSFKVFFIFNAIALFTSLAVVVVQITLVRGETKAERRVVEVINKLMWLASVCTTVAFISSSYIVVGRHFKWAALLVTLIGGVIMASVLGTMTYYVVKSKRTRSIRKKVKSTRRSGSNSWNHNSESDSEIDRIYAI

SEQ ID NO: 5287 - protein, 635 aa, Brachypodium distachyon
MSNSGKRLDQSPLSSPSRPVLLMSHSSNRLEYQAPGRPALVMSRSSNRLDQSPASSPTPTKGPALVMSGSSKRLEQSLASPSPSPKAGAAAPPVLVLSNSGKRMDQAGRKKYVKQVTGRQNDTELHLAAQRGDLDAVRQIIAEIDAQMTGTGEEFDSEVAEIRAAVVNETNEVEETALLIAAEKGFLDIVIELLKHSDKESLARKNKSGFDALHVAAKEGRRDVVKVLLDHDPSLGKTFGQSNVTPLITAAIRGHIEVVNLLLERVSGLVELSKANGKNALHFAARQGHVEIVQSLLDSDPQLARRTDKKGQTALHMAVKGTSAGVVRALVNADPAIVMLPDRNGNLALHVATRKKRSEIVNVLLLLPDMNVNALTRDRKTAFDIAEGLPLSEESAEIKDCLSRAGAVRANDLNQPRDELRKTVTEIKKDVHTQLEQARKTNKNVHGIAKELRKLHREGINNATNSVTVVAVLFATVAFAAIFTVPGGNDDHGVAIAVHAVSFKVFFLFNAVALFTSLAVVVVQITLVRGETKAERRVVEVINKLMWLASVCTTVAFISSSYIVVGRHFRWAALLVTLIGGVIMTGVLGTMTYYVVKSKRTRLIRKKVKSRRSGSHSWQHNSEFSDSEIDRIYAI

SEQ ID NO: 5288 - protein, 486 aa, Avena sativa
MSSSGKRLDQSSPASPSRPVLVMSHSSNRLDQPSPGRPVLVMSRSSNRLDQPSSPASSPSPTPTKGPALVMSGSSKRMDHSPSPSPKAVPPVLVLSNSGKRMDQAGRKKYVKQVTGRHNDTELHLAAQRGDLDAVRQIIAEIDAQMTGTGEEFDSEVAEIRAAVVNEGNEMDETALLIAAEKGFIDIVIELLKHSDKDSLARKNKSGFDALHVAAKEGHRDIVKVLLDHDPSLGKTFGQSNVTPLITAATRGHLEVVNLLLERVSGLVDLSKANGKNALHFSARQGHVEIVKALLECDRQLARRTDKKGQTALHMAVKGTSAGVVKALVNADPAIVMLPDRNGNLALHVATRKKRSEIVNELLLLPDMNVNALTRDRKTAFDIAEGLPLSEESADIKDCLSRAGAVRANDLNQPRDELRKTVTEIKKDVHTQLEQARKTNKKCIWNSKGAEEAPQGRHQQRDKLRHGCGRALCHGRICRDLHGARR

SEQ ID NO: 5289 - protein, 634 aa, Panicum virgatum
MSFSGKRLDQSPSRPVLVMSHSSNRLDQSPARPVLVMSRSSNRLDQSSPASSPSLAPARGPVLVMSGSSNRLDSSQPSPSPSPTAAAAAAPVLVLSNSGKRMDQAGRKKYVKQVTGRHNDTELHLAAQRGDLEAVRQIIAEIDAQMTGTGEEFDSEVAEIRAAIVNETNEMEETALLIAAEKGFLDIVVELLKHSDKDSLTRKNKSGFDALHVAAKEGHRDIVKVLLDHDPSLGKTFGQSNVTPLITAAIRGHTEVVNLLLERVSGLVELSKANGKNALHFAARQGHVEIVKALLDADPQLARRTDKKGQTALHMAVKGTSAEVVQGLVNADPAIVMLPDRNGNLALHVATRKKRSEIVNVLLLLPDMNVNALTRDRKTAFDIAEGLPLSEESQEIKECLSRAGAVRANDLNQPRDELRKTVTEIKKDVHTQLEQAKKTNKNVYGIAKELRKLHREGINNATNSVTVVAVLFATVAFAAIFTVPGGNDDHGVAIAVHAAAFKVFFIFNAIALFTSLAVVVVQITLVRGETKAERRVVEIINKLMWLASVCTTVAFISSSYIVVGRHFRWAALLVTLIGGVIMTGVLGTMTYYVVKSKRTRKIRKKVKSTRRSGSNSWQHNSEFSDSEIDRIYAI

SEQ ID NO: 5290 - protein, 635 aa, Setaria italica
MSFSGKRLDQSPAASPSRPLLVMSHSSNRLDSSPARPVLVMSRSSNRLDQSSPASSPATARGPVLVMSGSSNRLDSSQPSPSPSPSPTAAAAVLVLSNSGKRMDQAGRKKYVKQVTGRHNDTELHLAAQRGDLEAVRQIIAEIDAQMTGTGEEFDSEVAEIRAAIVNETNEVEETALLIAAEKGFLDIVVELLKHSDKESLTRKNKSGFDALHVAAKEGHRDIVKVLLDHDPSLGKTFGQSNVTPLITAAIRGHTEVVNLLLDRVSGLVELSKANGKNALHFAARQGHVEIVKALLDADTQLARRTDKKGQTALHMAVKGTSAEVVQALVNADPAIVMLPDRNGNLALHVATRKKRSEIVNVLLLLPDMNVNALTRDRKTAFDIAEGLPLSEESQEIKECLARAGAVRANDLNQPRDELRKTVTEIKKDVHTQLEQARKTNKNVYGIAKELRKLHREGINNATNSVTVVAVLFATVAFAAIFTVPGGNDDHGVAVAVHAAAFKVFFIFNAIALFTSLAVVVVQITVVRGETKAERRVVEVINKLMWLASVCTTVAFISSSYIVVGRHFQWAALLVTLIGGVIMAGVLGTMTYYVVKSKRTRKIRKKVKSTRRSGSNSWQHNSEFSDSEIDRIYAI

SEQ ID NO: 5291 - protein, 638 aa, Panicum virgatum
MSFSGKRLDQSPAASPSRPVLVMSHSSNRLDQSPARPVLVMSRSSNRLDQSSPASSPSLAPARGPVLVMSGSSNRFDSSQPSPSPSPTAAAAAAPVLVLSNSGKRMDQAGRKKYVKQVTGRHNDTELHLAAQRGDLEAVRQIIAEIDAQMTGTGEEFDSEVAEIRAAIVNETNEMEETALLIAAGKGFLDIVVELLKHSDKDSLTRKNKSEFDALHVAAKEGHRDIVKVLLDHDPSLGKTFGQSNVTPLITAAIRGHTEVVNLLLERVSGLVELSKANGKNALHFAARQGHVEIVKALLDADPQLARRTDKKGQTALHMAVKGTSAEVVQGLVNADPAIVMLPDRNGNLALHVATRKKRSEIVNVLLLLPDMNVNALTRDRKTAFDIAEGLPLSEESQEIKECLSRAGAVRANDLNQPRDELRKTVTEIKKDVHTQLEQARKTNKNVYGIAKELRKLHREGINNATNSVTVVAVLFATVAFAAIFTVPGGNDDHGVAIAVHAAAFKVFFIFNAIALFTSLAVVVVQITLVRGETKAERRVVEIINKLMWLASVCTTVAFISSSYIVVGRHFRWAALLVTLIGGVIMTGVLGTMTYYVVKSKRTRKIRKKVKSTRRSGSNSWQQNSEFSDSEIDRIYAI

SEQ ID NO: 5292 - protein, 640 aa, Zea mays
MSFSGKRLDQSPAGSPSPSPSSSRPVLVMSHSSNRLDQSPARPVLVMSRSSNRLDQSSPASSPAAVKGPALVMSGSSNRLDSSHPSPSPTAAAAAAPLLVLSNSGKRMDQAGRKKYVKQVTGRHNDTELHLAAQRGDLEAVRQIIAEIDAQMTGTGEEFDSDVAEIRAAIVNEANEMEATALLIAAEKGFLDIVVELLKHSDKDSLTRKNKSGFDALHVAAKEGHRDIVKVLLDHDPSLGKTFGQSNVTPLITAAIRGHIEVVNLLLERVSGLVELSKANGKNALHFAARQGHVEIVEALLHADTQLARRTDKKGQTALHMAVKGTSPEVVQALVNADPAIVMLPDRNGNLALHVATRKKRSEIVNVLLLLPDMNVNALTRDRKTAFDIAEGLPLSEESQEIKECLSRAGAVRANDLNQPRDELRKTVTEIKKDVHTQLEQARKTNKNVYGIAKELRKLHREGINNATNSVTVVAVLFATVAFAAIFTVPGGNANDGVAVAVHATAFKVFFIFNAVALFTSLAVVVVQITLVRGETKAERRVVEIINKLMWLASVCTTVAFISSSYIVVGRHFRWAALLVTLIGGVIMAGVLGTMTYYVVKSKRTRKIRKKVKSTRRSGSSSWQHNSEFSDSEIDRIYAI

SEQ ID NO: 5293 - protein, 644 aa, Zea mays
MSFSGKRLDQSPAGSPSPSPSLSRPVLVMSHSSNRLDQSPARPVLVMSRSSNRLDQSSPASSPAPVKAPVLVMSGSSNRLDSSHPSPSPSPSPTAAAAAAPVLVLSNSGKRMDQVGRKKYVKQVTGRHNDTELHLAAQRGDLEAVRQIIAEIDAQMTGTGEEFDNEVAEIRAAIVNEANEMEATALLIAAEKGFLDIVVELLKHSDKDSLTRKNKSGFDALHVAAKEGHRDIVKVLLDHDPSLGKTFGQSNVTPLITAAIRGHTEVVNLLLERVSGLVELSKANGKNALHFAARQGHVEIVKALLDADTQLARRTDKKGQTALHMAVKGTNPEVVQALVNADPAIVMLPDRNGNLALHVATRKKRSEIVNVLLLLPDMNVNALTRDRKTAFDIAEGLPLSEESQEIKECLSRAGAVRANELNQPRDELRKTVTEIKKDVHTQLEQARKTNKNVYGIAKELRKLHREGINNATNSVTVVAVLFATVAFAAIFTVPGGNTDDGVAVAVHATSFKVFFIFNAVALFTSLAVVVVQITVVRGETKAERRVVGVINKLMWLASVCTTVAFISSSYIVVGRHFKWAALLVTLIGGVIMAGVLGTMTYYVVKSKRVRKIRKKVKSTRRSGSNSWHHNSELSDSEVDRIYAI

SEQ ID NO: 5294 - protein, 636 aa, Sorghum bicolor
MSFSGKRLDQSPGGSPSQSRPVLVMSHSSNRLDQSPARPVLVMSRSSNRLDQSSPASSPARVRGPVLVMSGSSNRLESSSPSPSPTAAAAAAPVLVLSNSGKRMDQAGRKKYVKQVTGRHNDTELHLAAQRGDLEAVRQIIAEIDAQMTGTGEEFDSEVAEIRAAIVNESNEMEATALLIAAEKGFLDIVVELLKHSDKDSLTRKNKSGFDPLHVAAREGHRDIVKVLLDHDPSLGKTFGQSKVTPLITAAIRGHTAVVNLLLERVCGLVELSKANGKNALHFAARQGHVEVVKALLDADTQLARRTDKKGQTALHMAVKGTNPLVVQALVNADPAIVMLPDRNGNLALHVATRKKRSEIVNVLLLLPDMNVNALTRDRKTAFDIAEGLPLSEESQEIKECLARAGAVRANDLNQPRDELRKTVTEIKKDVHTQLEQARKTNKNVYGIAKELRKLHREGINNATNSVTVVAVLFATVAFAAIFTVPGGNTNDGVAVAVHATAFKVFFIFNAIALFTSLAVVVVQITLVRGETKAERRVIEIINKLMWLASVCTTVAFISSSYIVVGRRLKWAALLVTLIGGVIMAGVLGTMTYYVVKSKRTRKIRRKVKSTRRSGSNSWQHNSEFSDSEIDRIYAI

SEQ ID NO: 5295 - protein, 532 aa, Secale cereale
MDQAGRKKYVKQVTGRHNDTELHLAAQRGDLDAVRQIIAEIDAQMTGTGEEFDSEVAEIRAAVLNEPNEVGETALLIAAEKGFIDVVVELLKHSDKESLAGKNKSGFDALHVAAKEGHQDIVKVLLDHDPSLGKTFGQSNVTPLITAAIRGHLEVVNLLLERVSGLVELSKANGKNALHFAARQGHVEIVKSLLVSEAQLARKTDKKGQTALHMAVKGTSAAVVRALVNADPAIVMLPDKNGNLALHVATRKKRSEIVNELLLLPDMNVNALTRDRKTAFDIAEGLPLSEESADIKDCLSRAGAVRANDLNQPRDELRKTVTEIKKDVHTQLEQARKTNKNVHGIAKELRKLHREGINNATNSVTVVAVLFATVAFAAIFTVPGGNDDHGVAIVVHAVSFKVFFIFNAIALFTSLAVVVVQITLVRGETKAERRVVEVINKLMWLASVCTTVAFISSSYIVVGRHFKWAALLVTLIGGVIMASVLGTMTYYVVKSKRTRSIRKKVKSTRRSGSNSWNHNSESDSEIDRIYAI

SEQ ID NO: 5296 - protein, 578 aa, Triticum aestivum
MGGGNGIVDGFRRLFHRRTPSGSVLGSSNQSSAGEDSSDAEAAEDLDLVGLRPIRVPKRKMPLPVESHKKNIMEKEFFTEYGEASQYQIQEVVGKGSYGVVAAAIDTRTGERVAIKKINDVFEHVSDATRILREVKLLRLLRHPDVVEIKHIMLPPSRREFQDIYVVFELMESDLHQVIRANDDLTAEHYQFFLYQLLRALKYIHGANVFHRDLKPKNILANADCKLKICDFGLARVSFNDAPSAIFWTDYVATRWYRAPELCGSFFSKYTPAIDIWSIGCIFAELLTGRPLFPGKNVVHQLDIITDLLGTPSSETLSRIRNEKARRYLSCMRKKHPVPLTQKFPNADPLAVRLLGRLLAFDPKDRPSAEEALADPYFASLANVEREPSRHPISKLEFEFERRKVTKDDVRELIYREILEYHPQMLEEYMKGGDQISFLYPSGVDRFKRQFAHLEEHYSKGERGSPLQRKHASLPRQRVGASNDGNNEQHISDQEMSAEPDAHGAVSPQKSQDAPGVGQNGLSPTSLSSRTYLKSASISASKCVVVNPNKQPEYDDAISEETEGAVDGLSEKVSKMHA

SEQ ID NO: 5297 - protein, 578 aa, Secale cereale
MGGGNGIVDGFRRLFHRRTPSGSVLASSNQSSAGEDPSDVEAVEDLDLVGLRPIRVPKRKMPLPVESHKKNIMEKEFFTEYGEASQYQIQEVVGKGSYGVVAAAIDTRTGERVAIKKINDVFEHVSDATRILREVKLLRLLRHPDVVEIKHIMLPPSRREFQDIYVVFELMESDLHQVIRANDDLTAEHYQFFLYQLLRALKYIHGANVFHRDLKPKNILANADCKLKICDFGLARVSFNDAPSAIFWTDYVATRWYRAPELCGSFFSKYTPAIDIWSIGCIFAELLTGRPLFPGKNVVHQLDIITDLLGTPSSETLSRIRNEKARRYLSCMRKKHPVPLTQKFPNADPLAVRLLGRLLAFDPKDRPSAEEALADPYFASLANVEREPSRHPISKLEFEFERRKVTKDDVRELIYREILEYHPQMLEEYMKGGDQISFLYPSGVDRFKRQFAHLEEHYSKGERGSPLQRKHASLPRQRVGASNDGNNEQHISDQEMSAEPDAHGTESPQKAQDAPGVGQNGLSPTSLSSRTYLKSASISASKCVVVNPNKQPEYDDAISEEAEGAVDGLSEKVSKMHA

SEQ ID NO: 5298 - protein, 578 aa, Secale cereale
MGGGNGIVDGFRRLFHRRTPSGSVLASSNQSSAGEDPSDVEAVEDLDLVGLRPIRVPKRKMPLPVESHKKNITEKEFFTEYGEASQYQIQEVVGKGSYGVVAAAIDTRTGERVAIKKINDVFEHVSDATRILREVKLLRLLRHPDVVEIKHIMLPPSRREFQDIYVVFELMESDLHQVIRANDDLTAEHYQFFLYQLLRALKYIHGANVFHRDLKPKNILANADCKLKICDFGLARVSFNDAPSAIFWTDYVATRWYRAPELCGSFFSKYTPAIDIWSIGCIFAELLTGRPLFPGKNVVHQLDIITDLLGTPSSETLSRIRNEKARRYLSCMRKKHPVPLTQKFPNADPLAVRLLGRLLAFDPKDRPSAEEALADPYFASLANVEREPSRHPISKLEFEFERRKVTKDDVRELIYREILEYHPQMLEEYMKGGDQISFLYPSGVDRFKRQFAHLEEHYSKGERGSPLQRKHASLPRQRVGASNDGNNEQHISDQEMSAEPDAHGTESPQKAQDAPGVGQNGLSPTSLSSRTYLKSASISASKCVVVNPNKQPEYDDAISEEAEGAVDGLSEKVSKMHA

SEQ ID NO: 5299 - protein, 339 aa, Triticum aestivum
MGGGNGIVDGFRRLFHRRTPSGSVLGSSNQSSAGEDSSDVEAAEGLDLVGLRSIRVPKRKMPLPVESHKKNIMEKEFFTEYGEASQYQIQEVVGKGSYGVVAAAIDTRTGERVAIKKINDVFEHVSDATRILREVKLLRLLRHPDVVEIKHIMLPPSRREFQDIYVVFELMESDLHQVIRANDDLTAEHYQFFLYQLLRALKYIHGANVFHRDLKPKNILANADCKLKICDFGLARVSFNDAPSAIFWTDYVATRWYRAPELCGSFFSKYTPAIDIWSIGCIFAELLTGRPLFPGKNVVHQLDIITDLLGTPSSETLSRIRNEKARRYLSCMRKNTLYP

SEQ ID NO: 5300 - protein, 569 aa, Secale cereale
GFRRLFHRRTPSGSVLASSNQSSAGEDPSDVEAVEDLDLVGLRPIRVPKRKMPLPVESHKKNIMEKEFFTEYGEASQYQIQEVVGKGSYGVVAAAIDTRTGERVAIKKINDVFEHVSDATRILREVKLLRLLRHPDVVEIKHIMLPPSRREFQDIYVVFELMESDLHQVIRANDDLTAEHYQFFLYQLLRALKYIHGANVFHRDLKPKNILANADCKLKICDFGLARVSFNDAPSAIFWTDYVATRWYRAPELCGSFFSKYTPAIDIWSIGCIFAELLTGRPLFPGKNVVHQLDIITDLLGTPSSETLSRIRNEKARRYLSCMRKKHPVPLTQKFPNADPLAVRLLGRLLAFDPKDRPSAEEALADPYFASLANVEREPSRHPISKLEFEFERRKVTKDDVRELIYREILEYHPQMLEEYMKGGDQISFLYPSGVDRFKRQFAHLEEHYSKGERGSPLQRKHASLPRQRVGASNDGNNEQHISDQEMSAEPDAHGSVSPQKSQDAPGVGQNGLSPTSLSSRTYLKSASISASKCVVVNPNKQPEYDDAISEEAEGAVDGLSEKVSKMHA

SEQ ID NO: 5301 - protein, 560 aa, Triticum aestivum
TPSGSVLGSSNQSSAGEDSSDVEAVEDLDLVGLRPIRVPKRKMPLPVESHKKNIMEKEFFTEYGEASQYQIQEVVGKGSYGVVAAAIDTRTGERVAIKKINDVFEHVSDATRILREVKLLRLLRHPDVVEIKHIMLPPSRREFQDIYVVFELMESDLHQVIRANDDLTAEHYQFFLYQLLRALKYIHGANVFHRDLKPKNILANADCKLKICDFGLARVSFNDAPSAIFWTDYVATRWYRAPELCGSFFSKYTPAIDIWSIGCIFAELLTGRPLFPGKNVVHQLDIITDLLGTPSSETLSRIRNEKARRYLSCMRKKHPVPLTQKFPNADPLAVRLLGRLLAFDPKDRPSAEEALADPYFASLANVEREPSRHPISKLEFEFERRKVTKDDVRELIYREILEYHPQMLEEYMKGGDQISFLYPSGVDRFKRQFAHLEEHYSKGERGSPLQRKHASLPRQRVGASNDGNNEQHISDQEMSAEPDAHGAVSPQKSQDAPSVGPNGLSPTSLSSRTYLKSASISASKCVVVNPNKQPEYDDAISEETEGAVDGLSEKVSKMHA

SEQ ID NO: 5302 - protein, 529 aa, Secale cereale
ASAPIRVPKRKMPLPVESHKKNIMEKEFFTEYGEASQYQIQEVVGKGSYGVVAAAIDTRTGERVAIKKINDVFEHVSDATRILREVKLLRLLRHPDVVEIKHIMLPPSRREFQDIYVVFELMESDLHQVIRANDDLTAEHYQFFLYQLLRALKYIHGANVFHRDLKPKNILANADCKLKICDFGLARVSFNDAPSAIFWTDYVATRWYRAPELCGSFFSKYTPAIDIWSIGCIFAELLTGRPLFPGKNVVHQLDIITDLLGTPSSETLSRIRNEKARRYLSCMRKKHPVPLTQKFPNADPLAVRLLGRLLAFDPKDRPSAEEALADPYFASLANVEREPSRHPISKLEFEFERRKVTKDDVRELIYREILEYHPQMLEEYMKGGDQISFLYPSGVDRFKRQFAHLEEHYSKGERGSPLQRKHASLPRQRVGASNDGNNEQHISDQEMSAEPDAHGTESPQKAQDAPGVGQNGLSPTSLSSRTYLKSASISASKCVVVNPNKQPEYDDAISEEAEGAVDGLSEKVSKMHA

SEQ ID NO: 5303 - protein, 581 aa, Brachypodium distachyon
MVGGGGIVDGFRRLFHRRTPSGSGPSSNQSSAGEESSDIDAVVEDLDLVGLRAIRVPKRKMPLPVESHKKNILEKEFFTEYGEASQYQIQEVIGKGSYGVVAAAVDTRTGERVAIKKINDVFEHVSDATRILREVKLLRLLRHPDVVEIKHIMLPPSRREFQDIYVVFELMESDLHQVIRANDDLTPEHYQFFLYQLLRALKYIHAANVFHRDLKPKNILANSDCKLKICDFGLARVSFNDAPTAIFWTDYVATRWYRAPELCGSFFSKYTPAIDIWSIGCIFAELLTGRPLFPGKNVVHQLDIITDLLGTPSSETLSRIRNEKARRYLSCMRKKHPVPLTQKFPNVDPLALRLLGRLLAFDPKDRPSAEEALADPYFAVLANVEREPSRNPISKLEFEFERRKVTKDDVRELIYREILEYHPQMLQEYMQGGEQLSFLYPSGVDRFKRQFAHLEENYSKGERGSPLQRKHASLPRQRVGASNDNNDQHASDQERGADSIAPATGNPPGSQDAGQQHVSGGQNGVGSTNISPRSYQKSASISASKCVVVNANKNPEYDDDISEEMEGAVDGLSEKVSRMHP

SEQ ID NO: 5304 - protein, 574 aa, Panicum virgatum
MGGGGTIVDGFRRLFHRRNGSTSNSHQSSVAGEGEEGSPDLEVIEDPDLVGLRAIRVPKRKMPLPVESHKKNSVEMEFFTEYGEASQYQIQEVIGKGSYGVVAAAVDTRTGERVAIKKINDVFEHVSDATRILREIKLLQLLRHPDIVEIKHIMLPPSRREFQDIYVVFELMESDLHQVIKANDDLTPEHHQFFLYQLLRALKYIHAANVFHRDLKPKNILANSDCKLKICDFGLARASFNDAPSAIFWTDYVATRWYRAPELCGSFFSKYTPAIDIWSIGCIFAELLTGRPLFPGKNVVHQLDLITDLLGTPSSETLSRIRNEKARRYLSCMRKKYPVPFTQKFRNADPLALRLLERLLAFDPKDRPSAEEALANPYFASLANVELEPSRQPISKLEFEFERRKLAKDDVRELIYREILEYHPQMLEEYMKGGEQISFLYPSGVDRFKRQFAHLEEHYSKGERGSPLQRKHASLPRERVAASKDGNNEQHIGDQERSADSVAHTTVSPTRSEDVGQDGSKSTSLSSRSYLKSASISASKCVVVADKHPEDDEIPEEMEGVVDGLSEKVSRMHS

SEQ ID NO: 5305 - protein, 574 aa, Panicum virgatum
MGGGGTIVDGFRRLFHRRNGSTSNSHQSSVAGEGEEGSSDLEVIEDPDLVGLRAIRVPKRKMPLPVESHRKNSVEMEFFTEYGEASQYQIQEVIGKGSYGVVAAAVDTRTGERVAIKKINDVFEHVSDATRILREIKLLRLLRHPDIVEIKHIMLPPSRREFQDIYVVFELMESDLHQVIKANDDLTPEHHQFFLYQLLRALKYIHAANVFHRDLKPKNILANSDCKLKICDFGLARASFNDAPSAIFWTDYVATRWYRAPELCGSFFSKYTPAIDIWSIGCIFAELLTGRPLFPGKNVVHQLDLITDLLGTPSSETLSRIRNEKARRYLSCMRKKQPVPFTQKFRNADPLALRLLERLLAFDPKDRPTAEEALADPYFASLANVEREPSRQPISKLEFEFERRKLAKDDVRELIYREILEYHPQMLEEYMKGGEQISFLYPSGVDRFKRQFAHLEEHYSKGERGSPLQRKHASLPRERVAMSKDGNNEQHIGEQERSADSVARTTVSPPRSEDVGQDGLKSTSLSSRSYLKSASISASKCVVIADKHPEDDEIPEEMEGVVDGLSEKVSRMHS

SEQ ID NO: 5306 - protein, 574 aa, Setaria italica
MGGGGTIVDGFRRLFHRRNGSTSNSNQSSVAGEGEEGSPDLEVIEDPDLVGLRAIRVPKRKMPLPVESHRKNSVEMEFFTEYGEASQYQIQEVIGKGSYGVVAAAVDTRTGERVAIKKINDVFEHVSDATRILREIKLLRLLHHPDIVEIKHIMLPPSRREFQDIYVVFELMESDLHQVIKANDDLTPEHHQFFLYQLLRALKYIHAANVFHRDLKPKNILANSDCKLKICDFGLARASFNDAPSAIFWTDYVATRWYRAPELCGSFFSKYTPGIDIWSIGCIFAELLTGRPLFPGKNVVHQLDLITDLLGTPSSETLSRIRNEKARRYLSCMRKKHAVPFTHKFRNADPLALRLLERLLAFDPKDRPTAEEALADPYFASLANVEREPSRHPISKLEFEFERRKLAKDDVRELIYREILEYHPQMLDEYMKGGEQISFLYPSGVDRFKRQFAHLEEHYSKGERGSPLQRKHASLPRERVVVSKDGNNEQHIGDQERSADSVARTTVSPPRSEDVGQDGVKSPSLSSRSYLKSASISASKCVVVSNKHPEDDEIPEEMEGVVDGLSEKVSRMHS

SEQ ID NO: 5307 - protein, 574 aa, Pennisetum glaucum
MGGGGTIVHGFRRLFHRRNGSTSTSNPSSVTGEGEEGSPDLEVIEDPDLVGLRAIRVPKRKMPLPIESHKKNSVEMEFFTEYGEASQYQIQEVIGKGSYGVVAAAVDTRTGERVAIKKINDVFEHVSDATRILREIKLLRLLRHPDIVEIKHIMLPPSRREFQDIYVVFELMESDLHQVIKANDDLTPEHHQFFLYQLLRALKYIHAANVFHRDLKPKNILANSDCKLKICDFGLARASFNDAPSAIFWTDYVATRWYRAPELCGSFFSKYTPAIDIWSIGCIFAELLTGRPLFPGKNVVHQLDIITDLLGTPSSETLSRIRNEKARRYLSCMRKKHAVPFTHKFRNADPLALRLLERLLAFDPKDRPTAEEALADPYFASLANVEREPSRHPISKLEFEFERRKLAKDDVRELIYREILEYHPQMLDEYMKGGEQISFLYPSGVDRFKRQFAHLEEHYSKGERGSPLQRKHASLPRERVVVSKDGSNEQHIGDQERSADSVARTTVSPPRSEDVGQDGVKSPSLSSRSYLKSASISASKCVVVSNKHPEDDEIPEEMEGTVDGLSEKVSRMHS

SEQ ID NO: 5308 - protein, 580 aa, Oryza sativa
MGGGGTLVDGFRRLFHRRTASGSNQSSNAGEEAASSDLEVADDPDLVALRSIRIRVPKRKMPLPVESHKKNTVEMEFFTEYGEASQYQIQEVIGKGSYGVVAAAVDTRTGERVAIKKINDVFEHVSDATRILREIKLLRLLRHPDIVEIKHIMLPPSRREFQDIYVVFELMESDLHQVIRANDDLTPEHYQFFLYQLLRALKYIHAANVFHRDLKPKNILANSDCKLKICDFGLARASFNDAPSAIFWTDYVATRWYRAPELCGSFFSKYTPAIDIWSIGCIFAELLTGRPLFPGKNVVHQLDIITDLLGTPSSETLSRIRNEKARRYLSTMRKKHAVPFSQKFRNTDPLALRLLERLLAFDPKDRSSAEEALADPYFASLANVEREPSRHPISKLEFEFERRKLTKDDVRELIYREILEYHPQMLQEYMKGGEQISFLYPSGVDRFKRQFAHLEENYSKGERGSPLQRKHASLPRERVGVSKDGYNQQNTNDQERSADSVARTTVSPPMSQDAQQHGSAGQNGVTSTDLSSRSYLKSASISASKCVAVKDNKEPEDDYISEEMEGSVDGLSEQVSRMHS

SEQ ID NO: 5309 - protein, 574 aa, Sorghum bicolor
MGGGGAIVHGFRRWFHRRNGSTSGSNQSSVAGEGDDGSSDLEVIEDPDLVALRAIRVPKRKMPLPVESHRKNSVEMEFFTEYGEASQYQIQEVIGKGSYGVVAAAVDTRTGERVAIKKINDVFEHVSDATRILREIKLLRLLRHPDIVEIKHIMLPPSRREFQDIYVVFELMESDLHQVIKANDDLTPEHHQFFLYQLLRALKYIHAANVFHRDLKPKNILANSDCKLKICDFGLARASFNDAPSAIFWTDYVATRWYRAPELCGSFFSKYTPAIDIWSIGCIFAELLTGRPLFPGKNVVHQLDLITDLLGTPSSETLSRIRNEKARRYLSCMRKKYPVPFTHKFRNADPLALRLLERLLAFDPKDRPTAEEALADPYFASLANVEREPSRHPISKLEFEFERRKLAKDDVRELIYREILEYHPQMLEEYMKGGEQISFLYPSGVDRFKRQFAHLEEHYSKGERGSPLQRKHASLPRERVVVSKDGNTEQHINDQERSADSVARTTVSPPRSEDADMNDVKSTSLSSRSYLKSASISASKCVVVKNKHPEDDEIPEEMEGVVDGLSEQVSRMHS

SEQ ID NO: 5310 - protein, 579 aa, Zea mays
MGGGGAIVHGFRRWFHRRSEGSTSNSNQSSLAGEGEADDGSSDLEVIEDPDLLGLRAIRVPKRKMPLPVESHRKNSVEMEFFTEYGEASQYQIQEVIGKGSYGVVAAAVDTRTGERVAIKKINDVFEHVSDATRILREIKLLRLLRHPDIVEIKHIMLPPSRREFQDIYVVFELMESDLHQVIRANDDLTPEHHQFFLYQLLRALKYIHAANVFHRDLKPKNILANSDCKLKICDFGLARASFNDAPSAIFWTDYVATRWYRAPELCGSFFSKYTPAIDIWSIGCIFAELLTGRPLFPGKNVVHQLDIITDLLGTPSSETLSRIRNEKARRYLSCMRKKYPVPFTHKFRHADPLALRLLERLLAFDPKDRPSAEEALADPYFASLANVEREPSRHPISKLEFEFERKKLAKDDVRELIYREILEYHPQMLEEYMKGGEQISFLYPSGVDRFKLQFAHLEEHYSKGERGSPLQRKHASLPRERVVVSKDGNTEQQINDQERSADSVARTTVSPPRSEDADMDDVKPTSLSSRSYLKSASISASKCVVVRNKHPEPEDDGIPEEMEGTVDGLSEKVSRMHS

SEQ ID NO: 5311 - protein, 576 aa, Zea mays
MGGGGAIVHGFRRWFHRRSGSTSNQSSIAGDGEGEADGGSPDLEIVDDPDLLGLRAIRVPKRKMPLPVESHRKDSVEMEFFTEYGEASQYQIQEVIGKGSYGVVAAAVDTRTGERVAIKKINDVFEHVSDATRILREIKLLRLLRHPDIVEIKHIMLPPSRREFQDIYVVFELMESDLHQVIKANDDLTPEHHQFFLYQLLRALKYIHAANVFHRDLKPKNILANSDCKLKICDFGLARASFNDAPSAIFWTDYVATRWYRAPELCGSFFSKYTPAIDIWSIGCIFAELLTGRPLFPGKNVVHQLDIITDLLGTPSSETLSRIRNEKARRYLSCMRKKYPVPFTHKFRNADPLALRLLERLLAFDPKDRPTAEEALADPYFASLANVEREPSRHPISKLEFEFERRKLAKDDVRELIYREILEYHPQMLEEHMQGGEQISFLYPSGVDRFKRQFAHLEEHYSKGERGSPLQRKHASLPRERVVVSKDGDTDQHINDQERSADSVARTTVSPPRSEDDDMSDVKSTSLSSRSYLKSASISASKCVVATKKHPEDDGIAEEMEGAVNGLSEKVSRMHS

SEQ ID NO: 5312 - protein, 555 aa, Panicum virgatum
MGGGGTIVDGFRRLFHRRNGSTSNSHQSSVAGEGEEGSSDLEVIEDPDLVGLRAIRVPKRKMPLPVESHRKNSVEMEFFTEYGEASQYQIQEVIGKGSYGVVAAAVDTRTGERVAIKKINDVFEHVSDATRILREIKLLRLLRHPDIVEIKHIMLPPSRREFQDIYVVFELMESDLHQVIKANDDLTPEHHQFFLYQLLRALKYIHAANVFHRDLKPKNILANSDCKLKICDFGLARASFNDAPSAIFWTDYVATRWYRAPELCGSFFSKYTPAIDIWSIGCIFAELLTGRPLFPGKNVVHQLDLITDLLGTPSSETLSRIRNEKARRYLSCMRKKQPVPFTQKFRNADPLALRLLERLLAFDPKDRPTAEEALADPYFASLANVEREPSRQPISKLEFEFERRKLAKDDVRELIYREILEYHPQMLEEYMKGGEQISFLYPSGVDRFKRQFAHLEEHYSKGERGSPLQRKHASLPRERVAMSKDGNNEQHIGEQERSADSVAHTTVSPTRSEDVGQDGSKSTSLSSRSYLKSASISASKCVVIADKHPEDDEIP

SEQ ID NO: 5313 - protein, 516 aa, Saccharum officinarum
MGGGGAIVHGFRRWFHRRNGSTSGSNQSSVAGEGDDGSSDLEVNEDPDLVGLRAIRVPKRKMPLPVESHRKNSVEMEFFTEYGEASQYQIQEVIGKGSYGVVAAAVDTRTGERVAIKKINDVFEHVSDATRILREIKLLRLLRHPDIVEIKHIMLPPSRREFQDIYVVFELMESDLHQVIKANDDLTPEHHQFLLYQLLRALKYIHAANVFHRDLKPKNILANSDCKLKICDFGLARASFNDAPSAIFWTDYVATRWYRAPELCGSFFSKYTPAIDIWSIGCIFAELLTGRPLFPGKNVVHQLDLITDLLGTPSSETLSRIRNEKARRYLSCMRKKYPVPFTHKFRNADPLALRLLERLLAFDPKDRPTAEEALADPYFASLANVEREPSRHPISKLEFEFERRKLAKDDVRELIYREILEYHPQMLEEYMKGGEQISFLYPSGVDRFKRQFAHLEEHYSKGERGSPLQRKHASLPRERVVVSKDGNTEQHINDQERSADSVARTTVSPPRPKMLT

SEQ ID NO: 5314 - protein, 177 aa, Triticum aestivum
MLAATAACRAPARPLPAARPGSSYLLGSVLLPKRRAPAARRRGRSAAVRCGLLPVDPWAPGVDSQSIASQLFAVSLFPYLGFLYFMTRSKTAPGLTLFGFYFLLAFVGATIPAGIYAKVHYGTSLSNVDLLHGTAESLLTLTNLFIVLGLRGALRNLDKAEESSPEAPQDSKEKSSV

SEQ ID NO: 5315 - protein, 171 aa, Secale cereale
MLAAAAACRAPARPLPAARPGSGYLHGRVLLPKRRAPAARRRGRSAAVRCGLLPVDPWAPGVDSQSIASQLFAVSLFPYLGFLYFMTRSKTAPGLTLFGFYFLLAFVGATTKVHYGTSLSNVDLLHGTAESLLTLTNLFIVLGLRGALRNLDKAEESSPEAPQDSKEKSSV

SEQ ID NO: 5316 - protein, 177 aa, Pseudoroegneria spicata
  misc_feature (77)..(77): Xaa can be any naturally occurring amino acid
MLATAATCRTPAPAHPSARPGSSYLLGHVLLPKRRAPAAKRRGRSAAVRCGLLPVDPWAPGVDSQSIASQLFAVSLXPYLGFLYFMTRSKTAPGLTLFGFYFLLAFVGATIPAGIYAKVHYGTSLSNVDLLHGTAESLLTLTNLFIVLGLRGALRNLDKTEENSPEAPQDSKEKSSV

SEQ ID NO: 5317 - protein, 156 aa, Secale cereale
SSYLLGRVLLPKRRAPAARRRGRSAAVRCGLLPVDPWAPGVDSQSIASQLFAVSLFPYLGFLYFMTRSKTAPGLTLFGFYFLLAFVGATIPAGIYAKVHYGTSLSNVDLLHGTAESLLTLTNLFIVLGLRGALRNLDKAEESSPEAPQDSKEKSSV

SEQ ID NO: 5318 - protein, 170 aa, Avena sativa
MLATAASRAPAPAARPGGCCLLGRVRVSKRRAPTRRGRAVVRCGMLPVDPWAPTMDSQSIASQLFAVSLFPYLGFLYFMTRSKTAPGLTLFGFYFLLAFVGATIPAGIYAKVHYGTSLSNVDLLHGTAESLLTLTNLFIVLGLRGALRKLKDGEESNSEAPRDSKEKSSV

SEQ ID NO: 5319 - protein, 99 aa, Triticum aestivum
MASFSKQAALFLLAALLLCLLCTRGQAARPTPGSSHQQSQGAGSATSHEKSAAGTGMEMEQVDQEAMRGCEGGEGAEECLMRRTLVAHTDYIYTQGKHN

SEQ ID NO: 5320 - protein, 99 aa, Triticum aestivum
MASFSKQAALFLLAALLLCLLCTRGQAARPTPGSSLQKSQGAGSATSHEKSAAGTGMEMEQVDLEAMRGCEGGEGAEECLMRRTLVAHTDYIYTQGKHN

SEQ ID NO: 5321 - protein, 101 aa, Secale cereale
MASFSKQTALFLLAALLMCLLCTRGQAARPTPGSSHHKSQGTGSAISHEKSVAGAGMEMEQEQEDQEAMRGCEGGEGAEECLMRRTLVAHTDYIYTQGKHN

SEQ ID NO: 5322 - protein, 130 aa, Unknown
  Sequence found in Organisms: Leymus cinereus x Leymus triticoides, Pseudoroegneria spicata
MASQLSAMTSVPQFHGLRSYSSPRSMATLPSLRRRSQGIRCDYIGSSTNLIMVTTTTLMLFAGRFGLAPSANRKATAGLKLEARESGLQTGDPAGFTLADTLACGAVGHIMGVGIVLGLKNTGVLDQIIG

SEQ ID NO: 5323 - protein, 130 aa, Unknown
  Sequence found in Organisms: Festuca arundinacea, Lolium multiflorum
MASQLSAMTSVPQFHGLRTYSSPRSMAALPSLRKRSQGIRCDYIGSSTNLIMVTTTTLMLFAGRFGLAPSANRKATAGLKLEARESGLQTGDPAGFTLADTLACGSVGHILGVGIVLGLKNTGVLDQIIG

SEQ ID NO: 5324 - protein, 130 aa, Avena sativa
MASQLSAMTSVPQFHGLRTYSSPRSMATLPSLRKRSQGIRCDYIGSSTNLIMITTTTLMLFAGRFGLAPSANRKATAGLKLEARESGLQTGDPAGFTLADTLACGSVGHILGVGIVLGLKNTGVLDQIIG

SEQ ID NO: 5325 - protein, 129 aa, Secale cereale
SQLSAMTSVPQFHGLRSYSSPRSMATLPSLRRRRSQGIRCDFIGSSTNLIMVTTTTLMLFAGRFGLAPSANRKATAGLKLEARESGLQTGDPAGFTLADTLACGAFGHIMGVGIVLGLKNTGVLDQIIG

SEQ ID NO: 5326 - protein, 131 aa, Triticum aestivum
MASQLSAMTTVPQFHGLRSYSSPRSMATLPSLRRKRSQGIRCDYIGSSTNIIMVTTTTLMLFAGRFGLAPSANRKATAGLKLEARESGLQTGDPAGFTLADTLACGSFGHILGVGIVLGLKNTGVLDQIIG

SEQ ID NO: 5327 - protein, 130 aa, Triticum aestivum
MASQLSAMTSVPQFHGLRSYSSPRSMATLPSLRKRSQGIRCDYIGSSTNIIMVTTTTLMLFAGRFGLAPSANRKATAGLKLEARESGLQTGDPAGFTLADTLACGSFGHILGVGIVLGLKNTGVLDQIIG

SEQ ID NO: 5328 - protein, 130 aa, Triticum aestivum
MASQLSAMTSVPQFHGLRSYSSPRSIATLPSLRKRSQGIRCDYIGSSTNIIMVTTTTLMLFAGRFGLAPSANRKATAGLKLEARESGLQTGDPAGFTLADTLACGSFGHILGVGIVLGLKNTGVLDQIIG

SEQ ID NO: 5329 - protein, 124 aa, Secale cereale
MTSVPQFHGLRSYSSPRSMATLPSLRRRRSQGIRCDFIGSSTNLIMVTTTTLMLFAGRFGLAPSANRKATAGLKLEARESGLQTGDPAGFTLADTLACGAFGHIMGVGIVLGLKNTGVLDQIIG

SEQ ID NO: 5330 - protein, 133 aa, Oryza sativa
MASQLSAATSVPQFHGLRTYSSPRSMVTLPSLRMSKKRSQGIRCDYIGSATNVIMVTTTTLMLFAGRFGLAPSANRKSTAGLKLEARDSGLQTGDPAGFTLADTLACGAVGHIMGVGVVLGLKNIGVLDQIIG

SEQ ID NO: 5331 - protein, 134 aa, Brachypodium distachyon
MASQLSAMASVPQFHGLRSYSAPRSSMAMLPTLRASRKRSQGIRCDFIGSSTNLIMVTTTTLMLFAGRFGLAPSANRKATAGLKLEARESGLQTGDPAGFTLADTLACGTVGHMLGVGIVLGLKNTGVLDQIVG

SEQ ID NO: 5332 - protein, 131 aa, Sorghum bicolor
MASQLSAAVPQFHGLRGYASPRSVVAMPSVRVGRKRSQGIRCDYIGSATNLIMVTTTTLMLFAGRFGLAPSANRKATAGLKLEARDSGLQTGDPAGFTLADTLACGAVGHILGVGIVLGLKNTGALDQIIG

SEQ ID NO: 5333 - protein, 132 aa, Saccharum officinarum
MASQLSAAAVPQFHGLRGYASPRSAVAMPSVRVGRKRSQGIRCDYIGSATNLIMVTTTTLMLFAGRFGLAPSANRKATAGLKLEARDSGLQTGDPAGFTLADTLACGAVGHILGVGIVLGLKNTGALDQIIG

SEQ ID NO: 5334 - protein, 131 aa, Triticum aestivum
SAMTSVPQFHGLRSYSSPRSMATLPSLRKRSQGIRCDYIGSSTNIIMVTTTTLMLFAGRFGLAPSANRSDGGLKLEARESGCRRATRPASLSPTRSHAAPSATSWASASCSASRTPASSTRSSARTFLFRR

SEQ ID NO: 5335 - protein, 134 aa, Zea mays
MASQLSAAVPRFHGLRGYAAPRSAVAALPSVRVGRKRSSSQGIRCDYIGSATNLIMVTTTTLMLFAGRFGLAPSANRKATAGLKLEARDSGLQTGDPAGFTLADTLACGAVGHILGVGIVLGLKNTGALDQIIG

SEQ ID NO: 5336 - protein, 133 aa, Eragrostis curvula
MASQLSAAATVPQFHGLRGYASPRSVVAVPSMRVGRKRSQGIRCDYIGSATNQIMVVTTTLMLVAGRFGLAPSANRKATAGLKLEARDSGLQTGDPAGFTLADTLACGAVGHILGVGIVLGLKNTGALDQIIG

SEQ ID NO: 5337 - protein, 79 aa, Triticum aestivum
MVTTTTLMLFAGRFGLAPSANRKATAGLKLEARESGLQTGDPAGFTLADTLACGSFGHILGVGIVLGLKNTGVLDQIIG

SEQ ID NO: 5338 - protein, 197 aa, Panicum virgatum
MASQLSAAVPQFHGLRGYASPRSVAALPPVRAGRKRAQGIRCDYIGSATNQIMVLSTTLMLVAGRFGLAPSANRKATAGLKLESRDSGLQTGDPAGFTLADTLACGAVGHIIGVGIVLGLRTPARSTRSSARYIVCLVSLAAGRCPCNHASRFVSMDIACCFFCPPELSGSVRSLHSFDRCEFTDFFLTKQFEVSSD

SEQ ID NO: 5339 - protein, 133 aa, Cynodon dactylon
MACQLSAATSMAAVPQFNGLRGYASPRSAVAMPSLRKRSQGIRCDYIGSATNQIMVLSTTLMLVAGRFGLAPSANRKATAGLRLEARDSGLQTGDPAGFTASDTLACGAVGHIIGVGIVLGLKNTGVLDQIIG

SEQ ID NO: 5340 - protein, 137 aa, Panicum virgatum
MASQLSAAASMSAAVPQFHGLRGYASPRSVAALPPVRAGRKRAQGIRCDYIGSATNQIMVLSTTLMLVAGRFGLAPSANRKATAGLKLESRDSGLQTGDPAGFTLADTLACGAVGHIIGVGIVLGLKNTGALDQIIG

SEQ ID NO: 5341 - protein, 587 aa, Secale cereale
MEPSTGFRASVWSCFKFLPFFCGLLLLGIIKGVLFGPWAWLIMAIGISALVLGLWPMHVIWTYYCIFRTKLVGPVVKLLLLISVSGILILWLIVGIVGSVFAGLAYGFLAPVMATFDALGEGKERPLVHCFVDGTWSTITGGCTVVRDLKDMLFHSYLAYMDDLRFHEPPGGKPFEIRVLDIPGAVLAAACGLLMDGIMFTVIALYKFPVMLFKGWKRLIEDLVGREGPFLETVCVPFAGLAILLWPFAVLGAFLASMISSVPLGAYAAIVVYQESSLFMGLSYAVSSVSIFDEYTNDVLDMAPGSCFPRFAYRKNQASVESGPLSRPASFRDKQDGKKAPARVTSFKSSFDEFNPFKLLDHLFEECQHRGEALVAEGVITPKDIEETKSGKGGSGVLNVGLPAYVILNALLRSAKADSDGLILRDGCEITSDNRPKNTLFDWFFDPLMVIKDQIKAENFTEEEEAYLQKRVLLISDPKRLKATLPHLPSLNERKQAEIDAFARRLQGITKSISRYPTFKRRFDDLVKALSEELERAMGGSRSVGGSQFQKLRSGLVRMLSQRSLGKTTSIRGYDQEAQLTSNTRAA

SEQ ID NO: 5342 - protein, 587 aa, Brachypodium distachyon
MEPSTGLWVSVWSCFKFLPFFCGLLLLGIIKGVLFGPWAWLIMTVGISAIILGLWPMHVVWTYYCIIRSKLVGPVVKLLLLISASGILVLWLIVGIVGSVIAGLVYGFLAPVMATFDAAGEGKERPLVHCLVDGTWSTITGSCTVVRDLKDMLFHSYFSIMDDLRFHAPPGGTPFEIRVLDIPGAVFAAACGLLTDGIMFTVIALYKLPVMLFKGWKRLIEDLVGREGPFLETACVPFAGLAILLWPFAVLGAFLASIISSVPLGVYAAIVVYQESSLLMGLFYVISSVSIFDEYTNDVLDMAQGSCFPRFAYRKNEVSTQSGPLSRPASFKDRQDEKKAPARMTSFKSSFDEFNPFKMLDHLFAECKHHGETLVSEGVITSKDIEETKSGKVGSGVINVGLPAYVILNALLRSVKANSDGLLLSDGCEITSDNRPKNTVFDWFFDPLMVIKDQIKAENFTEEEEAYLKKRVLLISDPKRLKATLPHLASLNERQQAEIDAFARRLQGITKSISRYPTSKRRFDDLVKALSEELERAMGGSQSVSGSQFQRLRSGVARMLSQRSMGKTAIIRGDDQEAQLTSNGRDT

SEQ ID NO: 5343 - protein, 482 aa, Triticum aestivum
MAAWAEQLQRELAGRGLAVASVPGKGRGLVAARSFFPGEVIICQEPYASTPNRISVGSSCDHCFASGNLRKCSVCRVAWYCGSVCQKEEWKLHQLECQAISALTEERKKMLTPTIRLMVKLILRRKLQSEKAIPSSATDNYDLVDALESHISKVDDNQLVLYAQMANLVQLILPSIELDLKEIAHTFSKFTCNAHTICDPELRPLGTGLFPAISIINHSCVPNAVLLFEGRTAYVRALQPLSSNTEVSISYIETAATTLKRHNDLKQYFFTCTCTRCIKDSEEDALLEGYRCKDQKCDGFLLPDSGKKAYTCQKCSISRDEEEVKKVSSEILLLSDKASSLLSSGNNSEAGSVYKIIEQLEQQHYHSFSITLLHTRETLLKIYMELQDWQTALMYCRMTIPVYERVYPPFHPMVGLQFYTCGKLEWLLEYTEDALKSLTRAADVLRITHGTQSQFMKELFGKLEEARAEVSFRLSSGDEQIS

SEQ ID NO: 5344 - protein, 482 aa, Triticum aestivum
MASWAEQLQRELAGRGLAVASVPGKGRGLLAARSFFPGEVIICQEPYASTPNRISVGSSCDHCFASGNLRKCSVCRVAWYCGSVCQKEEWKLHQLECQAISALTEERKKMLTPTIRLMVRLILRRKLQSEKAIPSSATDNYDLVDALESHISKVDDNQLVLYAQMANLVQLILPSIELDLKEIAHTFSKFACNAHTICDPELRPLGTGLFPAISIINHSCVPNAVLLFEGRTAYVRALQPLSSNTEVSISYIETAATTLKRHNDLKQYFFTCTCPQCIKDSEEDALLEGYRCKDQKCDGFLLPDSGKKAYTCQKCSISRDEEEVKKVSSEILLLSDKASSFLSSGNNSEAGSVYKIIEQLEQKHYHSFSITLLHTRETLLKIYMELQDWQTALMYCRMTIPVYERVYPPFHPMVGLQFYTCGKLEWLLEYTEDALKSLTRAADVLRITHGTQSQFMKELFGKLEEARAEVSFRLSSGDEQIS

SEQ ID NO: 5345 - protein, 507 aa, Triticum aestivum
KSASLLPARWGPTVSALIFPAARDGGVGGAAAARARRPRPRRRLRSRPGKGRGLVAARSFFPGEVIICQEPYASTPNRISVGSSCDHCFASGNLRKCSVCRVAWYCGSVCQKEEWKLHQLECQAISALTEERKKMLTPTIRLMVKLILRRKLQSEKAIPSSATDNYDLVDALESHISKVDDNQLVLYAQMANLVQLILPSIELDLKEIAHTFSKFACNAHTICDPELRPLGTGLFPAISIINHSCVPNAVLLFEGRTAYVRALQPLSSNTEVSISYIETAATTLKRHNDLKQYFFTCTCPRCIKDSEEDALLEGYRCKDQKCDGFLLPDSGKKAYTCQKCSISRDEEEVKKVSSEILLLSDKASSFLSSGNNSEAGSVYKTIEQLEQKHYHSFSTTLLHTRETLLKIYMELQDWQTALMYCRLTIPVYERVYPPFHPMVGLQFYTCGKLEWLLEYTEDALKSLTRAADVLRITHGTQSQFMKELFGKLEEARAEVSFRLSSGDEQIS

SEQ ID NO: 5346 - protein, 482 aa, Brachypodium distachyon
MVSLPEQLERELSGRGLAIASIPGKGRGLVTTRRFFPGEVILCGEPYASTPNKILVGSNCDHCFTSSNLRKCSVCRVAWYCGSVCQKEEWKLHQLECRAISALTDDRKKMLTPTIRLMVRLILRRKLQNEKVIPSTGTDNYGLVDALESHISEVDDKQLVLYAQMANLVQLILPAIELDLKETAHIFSKFSCNAHTICDPELRPVGTGLFPAISTINHSCVPNAVLLFEGRTAYVRALQPLSNNTEVSISYIETAATTLKRHNDLKHYFFTCTCPRCIKGSEEDPLLEGYRCKDQNCDGFLLPDSGKKAYTCQKCSMCRDGEEVKKLSSEILLLSDKASSFVSSGNNNEAGSVYKIIEQLERKLYHSFSITLLHTRETLLKLYMELQDWRSALMYCRSTIPVYERVYPPFHPMVGLQFYTCGKLEWLLEYTEDALKSLTRAADVLRITHGTNSQFMKELFGKLEEARAEVSFRLSPGNEQIS

SEQ ID NO: 5347 - protein, 480 aa, Oryza sativa
MASWEEQLRDELAGRDLAVASVPGKGRGLFAARSFFPGEVVISQEPYASTPNKISVGSNCDNCFASRNLRKCSVCRVAWYCGSACQREEWKLHQLECRAIAALTEDRKKMLTPTIRLMVRLVLRRKLQDDKAIPSSGTDNYNLVDALESHISEVDKNQLVLYAQMANLVQLILPSFELDLKEITHTFSKFACNAHTICDPELRPLGTGLYPVLSIINHSCVPNAVLIFEGRTAYVRALQPISKNEEVSISYIETAATTMKRQDDLKHYYFTCTCPRCVKDSEEDALLEGYRCNDQKCDGFLLPNAGNKGYTCQKCSTSRDGEELQKMASDVLLLSDKVSSLVSSGNNSEVGSMYKTIEELERKLYHPLSITLLHTRETLLKIYMELQDWQTALMYCRLTIPVYERIYPPFHPMIGLQFYTCGKLEWLLEYTEDALMSLTRAADILRITHGTKSEFMKELLGKLEEVRAEASFRLSAGDEQ

SEQ ID NO: 5348 - protein, 485 aa, Panicum virgatum
MANWAEQLQRELAGRGLAVASIPGKGRGLVASRTFFPGEVIISQEPYASTSNKILVGSSCDHCFASDNLRKCSVCRVTWYCSSDCQKVEWKLHQLECRAMAALTEDRKKMLTPTIRLMVRLVLKRKLQNEKVIPSSCIDNYYLVDALESHISEVDENQLVLYAQMANLVDLILPSVELDLKEIAHTFSKFACNAHTICDSELRPLGTGLYPVISIINHSCVPNAVLTFDGRTAYVRALQPIGKDEEVSISYIETAAVTKKRQNDLKQYFFTCTCPRCVKGSEDDALLESYRCKNQACDGFLLPESGEKAYTCQKCSISRDEEEVKKMTREIVLLSDKASSLLKSGNTTEAGSIYKTIEQLEQKLYHAFSITLLHTRETLLKIYMELQDWQTALTYCKSTIPVYERVYPPFHPMIGLQFYTCGKLEWLLECTEDALKSLTKAADILRITHGTKSQFMKELFGKIEEARAEVSFRLSSGPGHDEQFS

SEQ ID NO: 5349 - protein, 485 aa, Setaria italica
MASWAEQLQRELAGRGLAVASIPGKGRGLVASRTFFPGEVIISQEPYTSTPNKILVRSSCDHCFASSNLRKCSACRVTWYCSSDCQKEEWKLHQLECRVMAALTEDRKKMLTPTIRLMVRLVLKRKLQNEKAIPSSNIDNYYLVEALESHISKVDENQLVLYAQMANLVSLILPSHELDLKEIAHTFSKFACNAHTICDPELRPLGTGLYPVISIINHSCVPNAVLIFDGRTAYVRALQPIGKDEEVSISYIETAAVTKKRQNDLKQYFFTCTCPRCLKDSEEDAILESYRCKNQACDGFLLPESGGKSYTCQKCSISRDEEEIKKMTREILLLSDKASSFVSSGNTTEAGSIYEKIEQLEQNLYHAFSITLLHTRETLLKVHMELQDWQTALTYCRLTIPVYERVYPPSHPMIGLQFYTCGKLEWLLECTEDALKSLTRAADILGITHGTKSQFMKELFGKLEEARAEVSFKLSSSRGHDEQFS

SEQ ID NO: 5350 - protein, 492 aa, Panicum virgatum
MANWAEQLQRELAGRGLAIASIPGKGRGLVASRTFFPGEVIISQEPYTSTSNKILVGSSCDHCFASSNLRKCSVCRVTWYCSSDCQKAEWKLHQLECRAMAALTEDRKKMLTPTIRLMVRLVLKRKLQYEKVIPSSCIDNYYLVDALESHISEVDENQLVLYAQMANLVDLILPSVELDLKEIAHTFSKFACNAHTICDSELRPLGTGLYPVISIINHSCVPNAVLTFDGRTAYVRALQPIGKDEEVSISYIETAAVTKKRQNDLKQYFFTCTCPRCVKGSEEDALLESYRCKNQACDGFLLPESGEKAYTCQKCSISRDEEEVKKMTREIVLLSDKASSLLSSGNTTEAGSIYKTIEQLEQKLYHAFSITLLHTRGTLLKIYMELQDWQTALTYCRSTIPVYERVYPPFHPMIGLQFYTCGKLEWLLEYTEDALKSLTRAADILRITHGTKSQFMKQLFGKLEEARAEVSFRLSTGCGHDEQFSSGTAGQL

SEQ ID NO: 5351 - protein, 482 aa, Sorghum bicolor
MASWLEQLQRELAGRGLAVASIPGKGRGLIATRTFFPGDVILNQEPYASTPNKILVGSSCDHCFTSGNLRKCSMCQVTWYCSTNCQKEEWKLHQLECRAMAALTEDRKKMLTPTIRLMVRLVLKRKLQNEKVIPSSSIDNYNLVDALESHIWKVDENHLVLYAQMANLVSLILPLIELDLKEIAHTFSKFACNAHTICDPELRPLGTGLYPVISIINHSCVPNAVLIFDGRTAYVRALQPIGKNEEVSISYIETAAVTKKRHNDLKQYFFTCSCPRCVKGSEEDALLEGFRCKNQTCDGFLLPDSGKKAYTCQKCSVSRDEEEIQKMRSEILQLSDKASSFLSSGNKAEAGSVYKTIEQLEQNLYHAFSTTLLHTCETLLKIYMELQDWRTALAYCRLTVPVYERVYPPFHPMIGLQFYTCGKLEWLLECTEDALKSLTRATDILKVTHGTKSQFMKELFGKLEEARAEVSFRISSRHGHDE

SEQ ID NO: 5352 - protein, 482 aa, Zea mays
MASWLEQLQRELAARGLTVASIPGKGRGLIATCTFFPGDVILNQEPYASTPNKILVGSSCDHCFTSGNLRKCSMCRVTWYCSSNCQKEEWKLHQLECRAMAALTEDRKKMLTPTIRLMVRLALKRKLQNEKVIPSSSIDNYNLVDGLESHISKVDENQLVLYAQMANLVSLILPFIELDLKEIAQTFSKFACNAHTICDPELRPLGTGLYPVISIINHSCVPNAVLIFDGRTAYVRALQPINKDEEVSISYIETATVTKKRNNDLKQYFFTCTCPRCVKGFDEDALLEGFRCKNQACDGFLLPNSGKKAYTCQKCGASRDVEEIKNMRSEILQLSDKASSFLSSGNKAEAGSIYKIIEQLERNLYHAFSTTLLHTCETLLKIYLELQDWWTALTYCRLTIPVYERVYPPFHPMIGLQFYTCGKLEWLLEFTEDALKSLTRAADILKVTHGVKSQFMKELFGKLEEARAEVSFRLSSRHGHDE

SEQ ID NO: 5353 - protein, 467 aa, Pennisetum glaucum
MASWLEQLQRELAGRGLAVASIPGKGRGLVASRTFFPGEVIVSQEPYASTPNKILVGSSCDHCFTSSNLRKCSVCRVTWYCSSDCQKEEWKLHQLECRVMAALTEDRKKMLTPTIRLMVRLVLKRKLQNEKAIPSSNIDNYNLVDALESHISKVDENQLVLYAQMANLASLILPSLELDLNEIAHTFSKFACNAHTICDPELRPLGTGLYPVISIINHSCVPNAVLIFDGRTAYVRALQPIGKDEEVSISYIETAAVTKKRQNDLKQYFFTCTCPRCLKDSEDALLESYRCKNQACDGFLLPESGEKGYTCQKCGISRDEEEVKKMTREILLLSDKASSFVSSGNTTVAGSIYKKIEQLEQNLYHAFSITLLHTRETLLKVYMELQDWLTALTYCRLTIPVYERVYPPFHPMIGLQFYTCGKLEWLLECTEDALKSLTRAADILGITHGTKSQFMKELFGKARGSKG

SEQ ID NO: 5354 - protein, 480 aa, Secale cereale
ANGALWCAVLVLISLASCRVRRRRAAGGGGVTTTAGWAGRRRGSGVVPAAPGASLAERARDDRHRHAYISRRLASASPSRRRAAETSTAPGPEASAFAMPLTSGAYSGTGQYFVRFRVGTPAQPFVLVADTGSDLTWVKCRGASPSPSATPAASPRVFRPADSKSWAPIPCSSDTCKSYVPFSLANCSAGATPPAPCAYDYRYKDNSSARGVVGTDAATIALSGSSGGSGGGADRKAKLQEVVLGCTTSYDGQSFQASDGVLSLGNSNISFASRAAARFGGRFSYCLVDHLAPRNATSYLTFGPDNSAASSSRTPLLLDAQVAPFYAVTVDAVSVAGEALDIPAEVWDVKKNGGAILDSGTSLTILATPAYKAVVAALSKQLVGVPRVTMDPFEYCYNWTATSTPPAVPRLEVRFAGSARLRPPTKSYVIDAAPGVKCIGLQEGVWPGVSVIGNILQQEHLWEFDLANRWLRFKESRCAH

SEQ ID NO: 5355 - protein, 348 aa, Pseudoroegneria spicata
MEDAANATQTTSTTSSVAAVAAAAQHQQLQRQLFLMQQAQAQAQAQPHPQAQQLSQQAMSRFPSNIDAHLRPLGPHRFQQPAPSQLQTPPQPHSQGQPHPQPSPQQAAQARVRSPEVEMALQDAMRVCNPDIKTPFHSLEDAVSRLLPYHVVADYEAEEDDRILDSDATGQIPSRLQQWDHNILVKIAEFTTTFEKQVLAYNIMTKKRAIGEFRSEERLMLEQALLQEEKQASMELRAEIESREKAGREAAEAKMRMAMAEHARVEAQAHPEVIGHGPLRANAAASQGDDGPSHDMAQEQVEDGWENTQRDDDDPSEDFLNDENEPENGNSDMQEEWRRSGEFDLNSR

SEQ ID NO: 5356 - protein, 348 aa, Triticum aestivum
MEDAANATQTTSTTSSVAAVAAAAQHQQLQRQLFLMQQAQAQAQAQPHPQAQQLSQQAMSRFPSNIDAHLRPLGPHRFQQPAPSQLQTPPQPHSQGQPHPQPSPQQAAQARVRSPEVEMALQDAMRVCNPDIKTPFHSLADAVSRLLPYHVVADYEAEEDDRILDSDATGQIPSRLQQWDHNILVKIAEFTTTFEKQVLAYNIMTKKRAIGEFRSEERLMLEQALLQEEKQASMELRAEIESREKAGREAAEAKMRMAMAEHARVEAQAHAEVIGHGPLRANAAASQGDDGPSHDMAQEQVEDGWENTQRDDDDPSEDFLNDENEPENGNSDMQEEWRRSGEFDLNSR

SEQ ID NO: 5357 - protein, 355 aa, Brachypodium distachyon
MEDAANPNQTSSTSAAAAAAAAAQHQQLQRQLFLMQQAQAQAQAQAQSHPPAQQLSQQAMSRFPSNIDAHLRPLGPHRFQQPPPSQPQPQPHSQGPSQPQPQSQPQAPPQQQLAAQARGRSPEVEMALQDAMRVCNPDIKTPFQSLEDAVSRLLPYHVVADYEAEEDDRILDSDATGQIPSRLQQWDHNILVKIAEFTTTFEKQVLAYNIMTKKRAIGEFRSEERLMLEQALLQEEKQAMMELRAEIESREKAGREAAEAKMRMAMAEQARVEAQAHSDMIGQGPLRSNAAASQGDDGPSHDMVQEQGEEGWENAQRDGDDPSEDFLNDENEPENGNSDMQEDWRRSGEFDLNSR

SEQ ID NO: 5358 - protein, 308 aa, Leymus cinereus x Leymus triticoides
  misc_feature (40)..(40): Xaa can be any naturally occurring amino acid
  misc_feature (101)..(101): Xaa can be any naturally occurring amino acid
MEDAANATQTSSTSSVAAVAAAAQHQQLQRQLFLMQQAQXQAQAQPHPQAQQLSQQAMSRFPSNIDAHLRPLGPHRFQLPAPSQLQTPPQPHSQGQPHPQXSPQQAAQGRVRSPEVEMALQDAMRVCNPDIKTPFHSLEDAVSRLLPYHVVADYEAEEDDRILDSDATGQIPSRLQQWDHNILALLQEEKQASMELRAEIESREKAGREAAEAKMRMAMAEHARVEAQAHPEVIGHGPLRANAAASQGDDDPSHDMAQEQVEDGWENTQRDDDDPSEDFLNDENEPENGNSDMQEEWRRSGEFDLNSR

SEQ ID NO: 5359 - protein, 310 aa, Triticum aestivum
SPSRVAADFAMGGAAAVVAKTGAAPVERVKLLLQNQAEMLRRGALTRPYRGIADAFARVLREEGAAALWRGNQANVIRYFPTQACNFAFKGYFKSFFGYDKEKDGKWKWLAGNVACGSAAGATTSSLLYHLDYARTRLATDAIESRANKRQFRGLLDVYKKTLATDGIRGLYRGFSVSIVGITLYRGLYFGIYDTMKPIVLVGPLEGNFLASFALGWTITTFSGACAYPFDTLRRRMMLTSGQPFKYRSAFHAVKQIVSTEGFFTLFRGVGANILSGMAGAGVLAGYDQLQRFAGQHDYKIENKMKGALK

SEQ ID NO: 5360 - protein, 333 aa, Brachypodium distachyon
MAAAATKGGADACRREQERARRPKPSRVAADFAMGGAAAVVAKTGAAPVERVKLLLQNQAEMLRRGGLTRPYKGIADAFARVLREEGAAALWRGNQANVIRYFPTQACNFAFKGYFKSLFGYDKERDGKWKWLASNVACGSAAGATTSSLLYHLDYARTRLATDAIESRGNKRQFRGLLDVYKKTLASDGIPGLYRGFSVSIVGITLYRGLYFGIYDTMKPLVLVGPLEGNFLASFALGWAITTFSGACAYPFDTIRRRMMLTSGQPFKYRNAFHAVKQIVSTEGFFTLFRGVGANILSGMAGAGVLAGYDQLQRFAGQHDYRFGSKMKGALK

SEQ ID NO: 5361 - protein, 300 aa, Secale cereale
MGGAAAVLAKTGAAPVEHVKLLLQNQAEMLRRGALTRPYRGIADAFARVLREEGAAALWRGNQANVIRYFPTQACNFAFKGYFKSFFGYDKEKDGKWKWLAGNVACGSAAGATTSSLLYHLDYARTRLATDAIESRANKRQFRGLLDVYKKTLATDGIRGLYRGFSVSIVGITLYRGLYFGIYDTMKPIVLVGPLEGNFLASFALGWTITTFSGACAYPFDTLRRRMMLTSGQPFKYRSALHAVKQIVSTEGFFTLFRGVGANILSGMAGAGVLAGYDQLQRFAGRHDYKIENKMKGALK

SEQ ID NO: 5362 - protein, 328 aa, Zea mays
MAATPDERKQERPMRPATSPASVVADFAMGGAAAVVAKTGAAPVERVKLLLQNQAEMLRRGTLTRPYRGIADAFTRILREEGPAALWRGNQANVIRYFPTQAFNFAFRGYFKSFFGYDREKDGKWKWLAGNVASGSAAGATTSLLLYHLDYARTRLATDAIESRGTKRQFRGLLDVYKKTLTTDGMSGLYRGFSVSITGISLYRGLYFGIYDSMKPLVLVGPLEGNFFASFVLGWTITTFSGACAYPFDTVRRRMMLTSGEPFKYKNGFHAVKLIVSTEGFFTLFRGVGANILSGLAGAGVLSGYDQLQRLASRHDQNFEHNMKGALK

SEQ ID NO: 5363 - protein, 329 aa, Panicum virgatum
MGAAPVPPRQREEERPPMRSARSPASVAADFAMGGAAAVVAKTGAAPVERVKLLLQNQGEMLRRGTLTRPYKGIADAFARVLREEGAAALWRGNQANVIRYFPTQAFNFAFRGYFKSFFGCDREKDGKWKWLAGNVASGSAAGATTSLLLYHLDYARTRLATDAIESRGNKRQFRGLLDVYKRTLTTDGVSGLYRGFSVSIVGITLYRGLHFGIYDTMKPLVLVGPLEGNFFASFALGWAVTTFSGACSYPFDTVRRRMMLTSGQPFKYRNGFHAVKQIVLTEGFFTLFRGVGANILSGMAGAGVLSGYDQLQKFASQHGQILSARWGH

SEQ ID NO: 5364 - protein, 315 aa, Panicum virgatum
MRPARSAASVAADFAMGGAAAVVAKTGAAPVERVKLLLQNQGEMLRRGTLTRPYKGIADAFARVLREEGAAALWRGNQANVIRYFPTQAFNFAFRGYFKSFFGCDREKDGKWKWLAGNVASGSAAGATTSLLLYHLDYARTRLATDAVESRGNKRQFRGLLDVYKRTLTTDGVSGLYRGFSVSIVGITLYRGLHFGIYDTMKPLVLVGPLEGNFFASFALGWAVTTFSGACSYPFDTVRRRMMLTSGQPFKYRNGFHAVKQIVLTEGFFTLFRGVGANILSGMAGAGVLSGYDQLQRFASRHGKNFDRKMEGALK

SEQ ID NO: 5365 - protein, 329 aa, Sorghum bicolor
MAAAPPDERKQERPLTPATSAASVAADFAMGGAAAVVAKTGAAPVERVKLLLQNQSEMLRRGTLTRPYKGIADAFARVLHEEGAAALWRGNQANVIRYFPTQAFNFASRGYFKSFFGYDREKDGQWKWLAGNVASGSAAGATTSLLLYHLDYARTRLATDAIESRGTKRQYRGLLDVYKKTLATDGMSGLYRGFSVSIMGITLYRGLYFGIYDSMKPLVLVGPLEGNFFASFALGWAITTFSGACAYPFDTVRRRMMLTSGQPFKYKNGFHAVKLIVSNEGFFTLFRGVGANILSGLAGAGVLSGYDQLQQLASRHGHNFERKMKGALK

SEQ ID NO: 5366 - protein, 349 aa, Setaria italica
SPSIYDPDRRRGAMGAAAAAPVPPNQREEATPPPVRSARSPASVAADFAMGGAAAAVAKTGAAPVERVKLLLQNQGEMLRRGTLTRPYEGIAHAFARVLREEGAAALWRGNQANVIRYFPTQAFNFAFKGYFKSFFGYDREKNGKWKWLAGNVASGSAAGATTSLLLYHLDYARTRLATDAIESRGNKRQFRGLLDVYKKTLTTDGISGLYRGFSVSIVGITLYRGLYFGIYDTMKPLVLVGPLEGNFFASFALGWAITTFSGACAYPFDTVRRRMMLTSGQPFKYRNGFHAVKQIVLTEGFFTLFRGVGANILSGMAGAGVLSGYDQLQQFASRHGHNFERKMKGVLK

SEQ ID NO: 5367 - protein, 345 aa, Avena sativa
MRPFLLTPVGARLASPPSPSTLSRLLLPLNLQNRHAHTCPTPSARANRPSSSLLLRPRRRSGRLFASSSAPQMAAPADAPGGSADAFEVIRAHQAKAARLPPVEEIRTILDQSVRGVLMTHSQEHVGYPSGSMVDFACDQDGSPILAVSSLAVHSKNLSGSTKCSLLVAKDPEDRTDTVITVYGDATPVSDEEKDAVRSAYLRRHPEAFWVDFGDFRFLHIKPKAVRYVSGVATALLGSGEFSAAEFKEAKVDPISQFSTPITGHMNKDHADETKLIVQHSTNVKVDFAHMLDVDSLGINVKAGYDGSVLKLRIPFPRRAQDRKDVKTLIVEMLQAAKASSSHSE

SEQ ID NO: 5368 - protein, 346 aa, Leymus cinereus x Leymus triticoides
  misc_feature (104)..(104): Xaa can be any naturally occurring amino acid
  misc_feature (142)..(142): Xaa can be any naturally occurring amino acid
  misc_feature (155)..(155): Xaa can be any naturally occurring amino acid
  misc_feature (164)..(164): Xaa can be any naturally occurring amino acid
MRPFLLTPVGAQLASLPSPSTLSRLLRPLHLQNRHAHAIPTPAPHARTSSSSPLLHPSRRSSGRRGDRFLTSSSPSQMAAPADAPGGSADAFEVIRAHQVKAAXLPPVEEIRTILDQSVRGVLATHSQEHVGYPSGSMVDFXCDQDGSPILAVSXLAVHSKNLXGSTKCSLLVAKDPEDRTDTVITVYGDATPVPDEEKDAVRTAYLRRHPEAFWVDFGDFRFLHIKPKAVRYVSGVATAILGSGEFSAAEFKEAKVDPISQFSTPIAGHMNKDHADDTKLIVQHSTSVKVDFASILDVDSLGINVKAGYDGTVLKLRIPFPRRAQDRKDVKTLIVEMLQAAKASS

SEQ ID NO: 5369 - protein, 341 aa, Secale cereale
MRPFLLTPVGAQLASLPSPSTLSRLLRPLHLQNRHAHAIPAPTSPSSPLLHPPRRSSSRRGDRFLASSSPSQMAAPADAPGGSADAFEVIRAHQVKAARLPPVEEIRTILDQSVRGVLATHSQEHVGYPSGSMVDFACDQDGSPILAVSSLAVHSKNLLGSTKCSLLVAKDPEDRTDTVITVYGDATPVPDEEKDAVRTAYLQRHPEAFWVDFGDFRFLHIKPKAVRYVSGVATAILGSGEFSAAEFKEAKVDPISQFSSPIAGHMNKDHADDTKLIVQHSTSVKVDFASILDVDSLGINVKAGYDGTVLKLRIPFPRRAQDRKDVKTLIVEMLQAAKASS

SEQ ID NO: 5370 - protein, 343 aa, Secale cereale
MRPFLLTPVGAQLASLPSPSTLSRLLRPLHLQNRHAHAIPILTPTSSSSPLLHPPRRSSSRRGDRFLASSSPSQMAAPADAPGGSADAFEVIRAHQVKAARLPPVEEIRTILDQSVRGVLATHSQEHVGYPSGSMVDFACDQDGSPILAVSSLAVHSKNLLGSTKCSLLVAKDPEDRTDTVITVYGDATPVPDEEKDAVRTAYLRRHPEAFWVDFGDFRFLHIKPKAVRYVSGVATAILGSGEFSAAEFKEAKVDPISQFSSPIAGHMNKDHADDTKLIVQHSTSVKVDFASILDVDSLGINVKAGYDGTVLKLRIPFPRRAQDRKDVKTLIVEMLQAAKASS

SEQ ID NO: 5371 - protein, 343 aa, Triticum aestivum
MRPFLLTPVGAQLASLPSPSTLSRLLRPLHLQNRHAHAIPAPTSSSSSSPLLHPPRRSSGRRGDRFLASSSPSQMAAPADAPGGSADAFEVIRAHQVKAARLPPVEEIRTILDQSVRGVLATHSQEHVGYPSGSMVDFACDQDGSPILAVSSLAVHSKNLAGSTKCSLLVAKDPEDRTDTVITVYGDATPVPDEEKDAVRTAYLRRHPEAFWVDFGDFRFLHIKPKAVRYVSGVATAILGSGEFSAAEFKEAKVDPISQFSAPIAGHMNKDHADDTKLIVQHSTSVKVDFASILDVDSLGINVKAGYDGTVLKLRIPFPRRAQDRKDVKTLIVEMLQAAKASS

SEQ ID NO: 5372 - protein, 342 aa, Oryza sativa
MKPLLLTPAARLAAAAPSTLSRLLRLQSGRHHAHASSSSNRLLPPLLRPPRDGFRGGRLIASSSSSSSQMAAPADAPGGSADAFEVIRAHQEKAARLPPVEEIRTILDQSVRGVLATHSQGHVGYPSGSMVDFACDQDGSPILAVSSLAIHSKNLSENPKCSLLVAKDPEDRTDTVITVYGDATPVSDQEKDAVRSAYLRRHPEAFWVDFGDFRFLHIKPKAVRYVSGVATAILGSGEFSAAEFKEAKVDPISQFSTPITSHMNKDHSDDTKLIVQYSTTVKVDFAYMLDVDSLGFNVKAGYDGSVLKLRIPFPRRAQDRKDVKTLIVEMLQAAKASSSSAE

SEQ ID NO: 5373 - protein, 346 aa, Setaria italica
MMPFLLTPGAARIASAPCPSPSTLSRLLLPLHLQINGRHNHHHRHHVHASSTPSPLVYPRLRNRRGRFFASSQMAAPADAPGGSADAFEVIRAHQAKAARLPPVEEIRTILDQSVRGVLATHSQEHDGYPSGSMVDFACDQDGSPILAVSSLAVHSKNLSGNPKCSLLVAKDPEDRTDTVITVYGDAVPVSDEQKDSVRSAYLRRHPNAFWVDFGDFSFLRIKPKAVRYVSGVATALLGSGEFSAAEYREAKVDPISQFSTPITSHMNKDHADDTKLIVQHSTNVKVDFAFMLDVDSLGFNVKAGYDGSVLKLRIPFPRQAQDRKDVKTLIVEMLQAAKAASSHAD

SEQ ID NO: 5374 - protein, 343 aa, Saccharum officinarum
MPFLLTPGARAAPSPSTLSRLLRPLHLQITNGRHNHQHRHISVSASASPLLYPRLRNRRDRFFASSSSSQMAAPADAPGGSSDAFEVIRVHQAKAARLSPVEEIRTILDRSVRGVLATHSQDHAGYPSGSMVDFACDQDGSPILAVSSLAIHSKNLSGNPKCSLLVAKDPEDRTDTVITVYGDAVPVSDEEKDSVRSAYLRRHPDAFWVDFGDFSFLHIKPKAVRYVSGVATALLGSGEFSAAEFKEAKVDPISQFSTPITSHMNKDHADDTKLIVQHSTTVKVDFAYMLDVDSLGFNVKAGCDGSVLKLRIPFPRQAQDRKDVKTLIVEMLQAARASSSDPE

SEQ ID NO: 5375 - protein, 342 aa, Panicum virgatum
RPFLLTPGARAAPSPSTLSRLLLPLHLQNNGRRNHLRRHVNASSVSPPLINPRFRNRRARFFAASSSSQMAAPADAPGGSADAFEVIRAHQAKAARLSPVEEIRTILDRSVRGVLATHSQEHAGYPSGSMVDFACDQDGSPILAVSSLAVHSKNLSGNPKCSLLVAKDPEDRTDTVITIYGDAVPVSDEQKDSVRSSYLRRHPDAFWVDFGDFSFLHIKPKAVCYVSGVATALLGSGEFSAAEYKEAKVDPISQFSTPITSHMNKDHADDTKLIVQHSTTVKVDFAYMLDVDSLGFNVKAGYDGSVLKLRIPFPRQAQDRKDVKTLIVEMLQAAKAASSHAD

SEQ ID NO: 5376 - protein, 340 aa, Sorghum bicolor
MPLLLTPGARAAPSPSTLSRLLLPLHLQITNGRHNHRHGHVSASPLLYPRLRNRRGRFFASSSSSSQMAAPADAPGGSSDAFEVIRVHQAKAARLSPVEEIRTILDRSVRGVLATHSQDHAGYPSSSMVDFACDQDGSPILAVSSLAVHSKNLSGNPKCSLLVAKDPEDRTDTVITVYGDAVPVSDEEKDSVRSAYLRRHPDAFWVDFGDFSFLHIKPKAVRYVSGVATALLGSGEFGAAEYKEANVDPISQFSTPITSHMNKDHADDTKLIVQHSTTVKVDFAYMLDVDSLGFNVKAGYDGSVLKLRIPFPRQAQDRKDVKTLIVEMLQAARASSSDPE

SEQ ID NO: 5377 - protein, 348 aa, Panicum virgatum
MRPFLLTPGARAAPSPSTLSRLLLSLHLQINGRRNHLRRHVHASSASPPLLINPRLRNRRARFFAGAASSSSPSQMAAPADAPGGSADAFEVIRAHQAKAARLSPVEEIRTIMDRSVRGVLATHSQEHAGYPSGSMVDFACDQDGSPILAVSSLAVHSKNLSGNPKCSLLIAKDPEDRTDTVITVYGDAVPVSDEQKDSVRSAYLRRHPDAFWVDFGDFSFLHIKPKAVRYVSGVATALLGSGEFSPTEYKEAKVDPISQFSTPITSHMNKDHADDTKLIVQHSTTVKVDFAYMLDVDSLGFNVKAGYDGSVLKLRIPFPRQAQDRKDVKTLIVEMLQAAKAASSHAD

SEQ ID NO: 5378 - protein, 304 aa, Pseudoroegneria spicata
ATPTPTSSSSPLLHPPRRSSGRRGDRFLASSSPSQMAAPADAPGGSADAFEVIRAHQVKAARLPPVEEIRTILDQSVRGVLATHSQEHVGYPSGSMVDFACDQDGSPILAVSSLAVHSKNLAGSTKCSLLVAKDPEDRTDTVITVYGDATPVPDEEKDAVRTAYLRRHPEAFWVDFGDFRFLHIKPKAVRYVSGVATAILGSGEFSAAEFKEAKVDPISQFSTPIAGHMNKDHADDTKLIVQHSTSVKVDFAYILDVDSLGINVKAGYDGTVLKLRIPFPRRAQDRKDVKTLIVEMLQAAKASS

SEQ ID NO: 5379 - protein, 342 aa, Zea mays
MPFLLTPGARAVPSPSTLSRLLLPLHLQITNGRHNHQHGHVPASPLLYPRLRNRRSRFFAASSSSSSPQMAAPADAAGGSSDAFEVIRVHQAKAVRLSPVEEIRTIMDRSVRCVLATHSQDHAGYPSGSMVDFACDQDGYPILAVSSLAVHSKNLSGNPKCSLLVAKDPEDRTDTVITVYGDAVPVSDEEKDSVRSAYLRRHPDAFWVDFGDFSFLHIKPKAVRYVSGVATALLGSGEFNVAEYKEAKVDPISQFSTPITSHMNKDHANDTKLIVQHSTTVKVDFAYMLDVDSLGFNVKAGYDGSVLKLRIPFPRQAQDRKDVKTLIVEMLQAARASSSDPE

SEQ ID NO: 5380 - protein, 203 aa, Avena sativa
MATSTCHLPPLLPGPASLRHLHLQPSPPPFARHLRPSPPIRLLRAARRRHPDAVVVVPDARPWVGDLSGAASYRDGSEEDGDEVESEDEGEDDRSLDLLARFLHSVFRKASRRARRAARSVLPPSVPAELVKFSVNGVLALTFLWILKGLLEVVCTFGSMVFISILLVRGIWSGVTYIRENRYSYIQQLKDDDSRWSRVQTAG

SEQ ID NO: 5381 - protein, 203 aa, Triticum aestivum
MATITCHLPPLLPGPASGHHRHLKPSPPPFNRHLRAPPPTRLLRAARRRHPDAVVVVPDARPWVGDLSGAASYRDGREEDGDEEDDADEDDDDRSLDLLARFLHSVFRKASRRARRAARSVLPPSVPAELVKFSVNGVLVLTFLWILKGLLEVVCTFGSMVFISILLVRGIWSGVTYIRENRYSYIQQLKDDDSRWSRVQPAG

SEQ ID NO: 5382 - protein, 358 aa, Leymus cinereus x Leymus triticoides
  misc_feature (141)..(141): Xaa can be any naturally occurring amino acid
MELAPCSFSCSTYTHCSIGFTPARVRAGAWKIRAGAHQGGGDGVEPRRPAGRLAADGPPVVDVPAVVGAEGFGGARDAELAMWEKLGAVVRLSYGIGIYAGMALAGRAICDMAGIDSSGGFHPSLTALVEGLGYASPPIMXLLFILDDEVVKYSPHARAIRDVEDEELRTFFAGMSPWQFILVVAASSVGEELFYRAAVQGALADIFLRGTELMKDARGIVSLSGMVPPFVPFAQTFAAAITAALTGSLYYIATAPKDPTYVVTPVMRSHAGRQNMKKLFSAWYERRQMRKIYSPLLEGILAFYLGFEWIQTGNILAPMITHGIYSAVVLGHGLWKIQDHRRRLRQRVQEIRRSSDGL

SEQ ID NO: 5383 - protein, 360 aa, Hordeum vulgare
MELAPCSFSRSSYTQQHCSIGFTPARVGGWKVRAGAHQGGGDGVEPRRPAGRLAADGPPVVDVPVVVGGGEGFGGARDAELAMWEKLGAVVRLSYGIGIYAGMALAGRAICDMAGIDSSGGFHPSLTALVEGLGYASPPIMVLLFILDDEVVKYSPHARAIRDVEDEELRTFFAGMSPWQFILVVAASSVGEELFYRAAVQGALADIFLRGTELMKDARGIVSLSGMVPPFVPFAQTFAAAITAALTGSLYYIATAPKDPTYVVTPVMRSHAGRQNMKKLFSAWYERRQMRKIYSPLLEGILAFYLGFEWIQTGNILAPMITHGIYSAVVLGHGLWKIQDHRRRLRQRVQEIRQSSDDEL

SEQ ID NO: 5384 - protein, 361 aa, Triticum aestivum
MELAPPCSFSCSSYTNCSIGFTPARVLRAGPWRVRAGAHQGGGDGVEPGRPAGRLAADGPPVVDVPAVVGAADGFGGARDAELAMWDKLGAVVRLSYGIGIYAGMALAGRAICDMAGIDSSGGFHPSLTALVEGLGYASPPIMALLFILDDEVVKYSPHARAIRDVEDEELRTFFAGMSPWQFILVVAASSVGEELFYRAAVQGALADIFLRGTELMKDARGIVSLSGMVPPFVPFAQTFAAAITAALTGSLYYIATAPKDPTYVVTPVMRSHAGRQNMKKLFSAWYERRQMRKIYSPLLEGILAFYLGFEWIQTGNILAPMITHGIYSAVVLGHGLWKIQDHRRRLRQRVQEIRRGSDRL

SEQ ID NO: 5385 - protein, 361 aa, Triticum aestivum
MELAPPCSFSCSSYTNCSIGFTPARVLRAGPWRVRAGAHQGGGDGVEPGRPAGRLAADGPPVVDVPAVVGAADGFGGARDAELAMWDKLGAVVRLSYGIGIYAGMALAGRAICDMAGIDSSGGFHPSLTALVEGLGYASPPIMALLFILDDEVVKYSPHARAIRDVEDEELRTFFAGMSPWQFILVVAASSVGEELFYRAAVQGALADIFLRGTELMKDARGIVSLSGMVPPFVPFAQTFAAAITAALTGSLYYIATAPKDPTYVVTPVMRSHAGRQNMKKLFSAWYERRQMRKIYSPLLEGILAFYLGFEWIQTGNILAPMITHGIYSAVVLGHGLWKIQDHRRRLRQRVQEIRRGSDGL

SEQ ID NO: 5386 - protein, 121 aa, Secale cereale
MARPRAWAPLPGPALSLLSVLLLLVGRRGAAGGAAAAGEAPCTRPPSSTRTTPDRSPGIPGSSSTRTSSPTTRPTTSSPSPGRSSRGLRSPMKRRARASSARSAPAPAPSSARARIQLLLV

SEQ ID NO: 5387 - protein, 120 aa, Triticum aestivum
MARPRAWAPFPGSALSLLSVLLLLVGRRGAAGGGGGRGSSVYPAPVVYPHHSRQISWYPRAFLYPHFLTDDEANHLVSLARAELKRSAVADETSARASSARSAPAPAPSSARARIQLLLV

SEQ ID NO: 5388 - protein, 308 aa, Triticum aestivum
MARAPLPGPALSLLSVILLLVGRRGAAGAGGGGGGRGSSVYPAPVVYPHHSRQISWYPRAFLYPHFLTDDEANHLVSLARAELKRSAVADDTSGKSKLSEVRTSSGTFISKGQDPIVAGIEDKIAAWTFLPKENGEDMQVLRYKRGEKYEPHHDFFTDSVNTIRGGHRVATVLLYLTDVAEGGETVFPLAKARKGSHHKDLSECAQKGLAVKPRKGDALLFFNLRPDAETDPSSLHGGCEVIKGEKWSATKWIRVASFDKVYHTPGNCTDNSNSCSQWAALGECTKNPAYMVGTVALPGHCRRSCNVC

SEQ ID NO: 5389 - protein, 131 aa, Festuca arundinacea
  misc_feature (44)..(44): Xaa can be any naturally occurring amino acid
MATISAAAATTVVARAVITRPQALGLPQLRTRSQRVRCSYSKDXKEATPAAVVRGAGASLLAAAGAVTASAAPALALVDERMSTEGTGLSLGLSNNLLGWILLGVFGLIWSLYTVYTSGLDEDEESGGLSL

SEQ ID NO: 5390 - protein, 131 aa, Unknown
  Sequence found in Organisms: Festuca arundinacea, Lolium multiflorum
MATISAAAATTVVARAVITRPQALGLPQLSTRSQRVRCSYSKDAKEATPAAAVRGAGASLLAAAGAVTASAAPALALVDERMSTEGTGLSLGLSNNLLGWILLGVFGLIWSLYTVYTSGLDEDEESGGLSL

SEQ ID NO: 5391 - protein, 131 aa, Secale cereale
MATISAAAATTVVARAAITRPQALGLPQLRTRSERVRCSYSKDAKEATPAAAVRGAGASLLAAAGAVTASAGPALALVDERMSTEGTGLSLGLSNNLLGWILLGVFGLIWSLYTVYTSGLDEDEESGGLSL

SEQ ID NO: 5392 - protein, 108 aa, Triticum aestivum
HLIASDYATGMEIESYDGQLLHLSVDLAQRLLPAFDTPTGIPFGSVNLLYGVDDDESKITSTAGGGTLTLEFGVLSRLTNNTVFEQVAKNQCVGYGHAGRNSTLLVPI

SEQ ID NO: 5393 - protein, 672 aa, Triticum aestivum
MQPMRLRLRRQGRASPLLCLSAAILAAALLPGAAVADGVTPSEARLLRDEVKDMFYHAFDGYMQHAFPLDELRPLSCQGEDSLGGYALTLIDSLDTLALLGDKERFAAGVEWVGKNVRFDINKTVSVFETNIRILGGLLSAHLIASDYATGMEIESYDGQLLHLSVDLAQRLLPAFDTPTGIPFGSVNLLYGVDDDESKITSTAGGGTLTLEFGVLSRLTNNTVFEQVAKNSVRGIWARRSKLNLVGAHINVFTGEWTQKDAGIGTSIDSFYEYVLKAYLLFGDEEYLYVFQEAYKAAMHYLHHDPWYIEVNMNSGATVWPLFNSLQAFWPGLQVLAGDVDPAIRTHAAFFSVWKKYGFTPEGFNLATSTVQNGQRSYPLRPELIESTYWLFKATRDYRYLDVGRDILASLQYAAKCPCGYCHISDVETHKQDDHMESFFLAETVKYLWLLFDLAVGPDNIVENGPYKYIFSTEGHLLPATPEITLVDEHCLHFGDRGYSSGDGSSIQQSANCAQFDERRTVSSQNSLSNVLFTTRGYIKGVCPGLSHAQKLGISYHGEEDNTQNSRSHEHPDESYVDQSSVQIQSSSVILISHPATSPPDEPSKTRSRAQHLENIVVTGDSEPIEVTDATGGSSEGNTEIFSEVTLSISEQIEVTAEEIASQDNHIEDSTS

SEQ ID NO: 5394 - protein, 131 aa, Unknown
  Sequence found in Organisms: Secale cereale, Triticum aestivum
MATISAAAATTVVARAAIARPQALGLPQLRTRSERVRCSYSKDAKEATPAAAVRGAGASLLAAAGAVTASAGPALALVDERMSTEGTGLSLGLSNNLLGWILLGVFGLIWSLYTVYTSGLDEDEESGGLSL

SEQ ID NO: 5395 - protein, 131 aa, Secale cereale
MATISAAAATTVVARAAITRPQALGLPQLRTRSERVRCSYSKDAKEVTPAAAVRGAGASLLAAAGAVTASAGPALALVDERMSTEGTGLSLGLSNNLLGWILLGVFGLIWSLYTVYTSGLDEDEESGGLSL

SEQ ID NO: 5396 - protein, 132 aa, Leymus cinereus x Leymus triticoides
  misc_feature (73)..(73): Xaa can be any naturally occurring amino acid
MATISAAAATTVVARAAITRPQALGLPQLRTRSERVRCSYSKGAKEATPAAAAVRGAGASLLAAAGAVTASAXPALALVDERMSTEGTGLSLGLSNNLLGWILLGVFGLIWSLYTVYTSGLDEDEESGGLSL

SEQ ID NO: 5397 - protein, 132 aa, Avena sativa
MATISAAAATTVVARAVVTRPQALGLPQLRTRSQRVRCSYSKDAKEATPAAAAVRGAGASLLAAATAVTVSAAPALALVDERMSTEGTGLSLGLSNNLLGWILLGVFGLIWSLYTVYTSGLDEDEESGGLSL

SEQ ID NO: 5398 - protein, 131 aa, Pseudoroegneria spicata
MATISAAAATTVVARAAIARPQALGLPQLRTRSERVRCSYSKGAKEATPAAAVRGAGASLLAAAGAVTASAGPALALVDERMSTEGTGLSLGLSNNLLGWILLGVFGLIWSLYTVYTSGLDEDEESGGLSL

SEQ ID NO: 5399 - protein, 131 aa, Triticum aestivum
MATISAAAATTVVARAAIARPQALGLPQLRTRSERVRCSYSKDAKEATPAATVRGASASLLAAAGAVTASAGPALALVDERMSTEGTGLSLGLSNNLLGWILLGVFGLIWSLYTVYTSGLDEDEESGGLSL

SEQ ID NO: 5400 - protein, 131 aa, Triticum aestivum
MATISAAAATTVVARAAIARPQALGLPQLRTRSERVRCNYSKDAKEATPAAAVRGAGASLLAAAGAVTASAGPALALVDERMSTEGTGLSLGLSNNLLGWILLGVFGLIWSLYTVYTSGLDEDEESGGLSL

SEQ ID NO: 5401 - protein, 131 aa, Triticum aestivum
MATISATAGTTVVARAAIARPQALGLPQLRTRSERVRCNYSKDAKEATPAAAVRGAGASLLAAAGAVTASAGPALALVDERMSTEGTGLSLGLSNNLLGWILLGVFGLIWSLYTVYTSGLDEDEESGGLSL

SEQ ID NO: 5402 - protein, 130 aa, Setaria italica
MATISAAVATTVVARAAIARPNALGLPQLRARSERVRCGYSKDGRNAAAVSAKGAGASLLAAAGAVTASAGPALALVDERMSTEGTGLSLGLSNNLLGWILLGVFGLIWSLYTVYTSDLDEDEESGGLSL

SEQ ID NO: 5403 - protein, 125 aa, Panicum virgatum
MATVSAAAATTVVARAALGLPQLRARSERVRCGYSRDARSAAAAVSARGAGASLLAAAGAVTASAGPALALVDERMSTEGTGLSLGLSNNLLGWILLGVFGLIWSLYTVYTSDLDEDEESGGLSL

SEQ ID NO: 5404 - protein, 125 aa, Eragrostis curvula
  misc_feature (47)..(47): Xaa can be any naturally occurring amino acid
  misc_feature (66)..(66): Xaa can be any naturally occurring amino acid
MATVSAATATTVVARATLGLPPLRARSDRVRCSYSKDAKSAAPAVSXKGAGASLLAAAGAVTASAXPALALVDERMSTEGTGLSLGLSNNLLGWILLGVFGLIWSLYTVYTSDLDEDEESGGLSL

SEQ ID NO: 5405 - protein, 126 aa, Sorghum bicolor
MATVSAAAATTVVARAAIARPNALGLPQLRARSERVRCSYAKDAAAVSAKAAGASLLAAAGAVTASAGPALALVDERMSTEGTGLSLGLSNNLLGWILLGVFGLIWSLYTVYTSDLDEDEESGLSL

SEQ ID NO: 5406 - protein, 131 aa, Pennisetum glaucum
MATVSAAAATTVVARAAIARPNALGGLPQLRARSERVRCGYSKDGRNSAAAVSAKGAGASLLAAAGAVTASAGPALALVDERMSTEGTGLSLGLSNNLLGWILLGVFGLIWSLYTVYTSDLDEDEESGLSL

SEQ ID NO: 5407 - protein, 127 aa, Zea mays
MATVSAAVVTTIVARAAIARPNALGLPALRARSERVRCSYAKDAAPVSTKGAGASLLAAAGAVTASAGPALALVDERMSTEGTGLSLGLSNNLLGWILLGVFGLIWSLYTIYTSDLDEDEESGGLSL

SEQ ID NO: 5408 - protein, 127 aa, Saccharum officinarum
MAPVSAAAATTVVARAAIARPNALGLPQLRARSERVRCSYAKNAAAVSAKAAGASLLAAAGAVTASAGPALALVDERMSTEGTGLSLGLSNNLLGWILLGVFGLIWSLYTIYTSDLDEDEESGGLSL

SEQ ID NO: 5409 - protein, 124 aa, Cynodon dactylon
MATLSTAVVARAAIAKPNGLPQLKARSDRMRCSYSKDAKSAAPVSIKSAGASLLAAAGAVTASAAPALALVDERMSTEGTGLSLGLSNNLLGWILLGVFGLIWSLYTVYTSDLDEDEESGGLSL

SEQ ID NO: 5410 - protein, 569 aa, Secale cereale
MAAAGESAGELLRRAAALVPAEHYALAALVAVSVLAYRFLELHVVGDLLRGLRGRRVELTFHPASEIYHCVASKCRSLHGRYLATPWLASPHLQTLFLGIHGRPPSFTYKRQLYTVRDGGTIALDWLLAFDLEDADGIISNDSSTPLLVVVPGLTSDSDAAYAKHLVHAMARKGWNVVVSNHRGLGGVSITSDCLYNGGWTEDVREVINYLHRKYPKAPMFCVGTSIGANILVKYLGEEGESTPVAGAASICSPWDLVVCDRFIARKLVQRFYDKALAFGLKGYAKLHQPVLARLANWEGIKQSRSIREFDHHATCIVAKYETVDTYYRRCSSASFVGNVSVPLLCISALDDPLCTREAIPWDECRANKNIVLATTQDGGHLAFFQGLTAGKLWWVGAVSEFLCALHDSSYMHRQKAEEHVLHSSLESSIDKSPYVNILGDGMIAPVRNDGPPSSQITDDLKPNATVNSTQEDEQAKEVENKSGTDVDAVPVQSPAAAGSAKLQGEERYADKIRDAIAPVKRSLSKLTRYQGRSVWLLAYVALVTSWPLLGSLAFMLFRKKSRNPLSAK

SEQ ID NO: 5411 - protein, 571 aa, Hordeum vulgare
MAAAASGESAGELLLRAAALVPAEHYALAALVAVSVLAYRFVELHAIGDLLRGLRGRRVELTFHPASEIYHRVASKCRSLHGRYLATPWLASPHLQTLFLGIHGRPPSFTYKRQLYTVRDGGTIALDWLLAFDLEDADGIISKDSSTPLLVVVPGLTSDSDAAYAKHLVHSMARKGWNVVVSNHRGLGGVSITSDCLYNAGWTEDVRETINYLHCKYPKAPMFCVGTSIGANIVVKYLGEEGKSTPVAGAASICSPWDLVVGDRFISRKLVQRLYDKALAFGLKGYAKLHQPILARLANWEGINKSRSIREFDHHATCIVAKYETVDTYYRRCSSASFVGNVSVPLLCVNALDDPVCTREAIPWDECRANKNIVLATTQNGGHLAFFQGLTAGKLWWVGAVSEFLCALHDSSYMHRQKAEDHVLHSSLESSIDKSPYVSILGDGMIAPVINEGPPSSQITDDLKPNAVINSTQEDEQAKEVENKSVTDADTVPAQSPAVPGSAKQQGEERYADKIRDAIAPVKRSLSKLTRYQGRSVWLLAYVALVTSWPLLGSLAFMVFRKKSRNPLSAK

SEQ ID NO: 5412 - protein, 477 aa, Secale cereale
MEHIIAGKFKLGRKIGSGSFGELYLGINIQNGEEVGIKLEPVKSKHPQLHYESKVYMLMQGGSGIPHLKWYGVEGEYNVMVIDLLGPSLEDLFNSCNRKFTMKTTLMLADQLITRVEYMHSKGFLHRDIKPDNFLMGLGRKANQVYIIDYGLAKKYKDLQTHKHIPYRENKNLTGTARYASVNTHLGIEQSRRDDLESVGYLLLYFLRGSLPWQGLKAGTKKQKYDRISEKKMLTPAEVLCKSYPSEFISYFHYCRSLRFEDRPDYSYLKKLFRDVFVREGYQFDYVFDWTALKYPHMSSSNKLVRQPSGRLAGVGPSVERTERPSVGQEIRDRFTGAVEAFARRNSSSGRHGHGDHSRHKSIADSFSSSREALAADTEKTHILSRTGSSSKMAATPSSRPTSSGDCTGRLFSGSGGSSSRPSSSTVQRIHQSGGSGAENGSSSPVARNAPGRSSRRDSHAALRSFERLSISADRRK

SEQ ID NO: 5413 - protein, 450 aa, Triticum aestivum
QNGEEVGIKLEPVKSKHPQLHYESKVYMLMQGGSGIPHLKWYGVEGEYNVMVIDLLGPSLEDLFNSCNRKFTMKTTLMLADQLITRVEYMHSKGFLHRDIKPDNFLMGLGRKANQVYIIDYGLAKKYKDLQTHKHIPYRENKNLTGTARYASVNTHLGIEQSRRDDLESVGYLLLYFLRGSLPWQGLKAGTKKQKYDRISEKKMLTPAEVLCKSYPSEFISYFHYCRSLRFEDRPDYSYLKKLFRDVFVREGYQFDYVFDWTALKYPHMSSSNKLVRQPSGRLAGVGPSVERTERPSVGQEIRDRFTGAVEAFARRNSSSGRHGHGDHSRHKSTADSFSSSREALAADTEKTHILSRTGSSSKMAGTPSSRPTSSGDCTGRLFSGSGGSSSRPSSSTVQRLHQSGGSGAENGSSSPIPVARNAPGRSSRRDSHSAFRSFERLSISADRRK

SEQ ID NO: 5414 - protein, 479 aa, Sorghum bicolor
MEHVIGGKYKLGRKIGSGSFGELYLGVNIQNGEEVGIKLEPVKTKHPQLHYESKVYMLLQGGNGIPHLKWYGVEGEYNVMVIDLLGPSLEDLFNCCNRKFSMKTVLMLADQLINRVEYMHSKGFIHRDIKPDNFLMGLGRKANQVYIIDYGLAKKYKDLQTHKHIPYRENKNLTGTARYASVNTHLGIEQSRRDDLESVGYLLLYFLRGSLPWQGLKAGTKKQKYDKISEKKMLTSAEVLCKSYPSEFISYFHYCRSLRFEDRPDYSFLKKLFRDVFIREGYQFDYVFDWTALKYPQMGSNNKLVQQPSARMAGVGPSVERTDKASVGQEIRERFTGAVEAFARRNPGSGRHGDHSRHKSLADSFGTSNEAVAADSEKTRILSRGGSSSKMPAANSSGRPTSSGDCSDQNRRWVSGSSGGSGRPSTAQRLHHSGGAENSRSSPRSPVARNAAGRGGSGSRDNTTFRSLERLSITTSRRK

SEQ ID NO: 5415 - protein, 479 aa, Panicum virgatum
MEHVIGGKYKLGRKIGSGSFGELYLGVNIQNGEEVGIKLEPVKTKHPQLHYESKVYMLLQGGNGIPHLKWYGVEGEYNVMVIDLLGPSLEDLFNCCNRKLSMKTVLMLADQLINRVEYMHSKGFIHRDIKPDNFLMGLGRKANQVYIIDYGLAKKYKDLQTHKHIPYRENKNLTGTARYASVNTHLGIEQSRRDDLESVGYLLLYFLRGSLPWQGLKAGTKKQKYDKISEKKMLTSAEVLCKSYPSEFISYFHYCRSLRFEDRPDYSFLKKLFRDVFIREGYQFDYVFDWTALKYPQMSSNNKLVQQPSARITGAGPSGERTDKPSVGQEIRDRFTGAVEAFARRNPGSGRHGEHSRHKSHADSFGTSNEAVADSEKTRILSRGGSSSKMPAGPSSRPTSSGDCSGDQNRRWVSGSSGGSGRPSTAQRLHPSGGAENSRSSPRSPVSRNAAQGRGGSGSRDNTTFRSLERLSISTSRRK

SEQ ID NO: 5416 - protein, 480 aa, Setaria italica
MEHVIGGKYKLGRKIGSGSFGELYLGVNIQNGEEVGIKLEPVKTKHPQLHYESKVYMLLQGGNGIPHLKWYGVEGEYNVMVIDLLGPSLEDLFNCCNRKLSMKTVLMLADQLINRVEYMHSKGFIHRDIKPDNFLMGLGRKANQVYIIDYGLAKKYKDLQTHKHIPYRENKNLTGTARYASVNTHLGIEQSRRDDLESVGYLLLYFLRGSLPWQGLKAGTKKQKYDKISEKKMLTSAEVLCKSYPSEFVSYFHYCRSLRFEDRPDYSFLKKLFRDVFVREGYQFDYVFDWTALKYPQMSSNNKLVQQPSARIAGAGPSAERTDKASVGQEIRDRFTGAVEAFARRNPGSGRHGDHSRHKSHADSFGTSNEAVADSEKSRFLSRGGSSSKMPAGSSSRPTSSGDCSDQNRRWVSGSSGGSGRPSTAQRLHHSGGAENSRSSPRSPVARGAAPGRGGGGSGSRNNTTFRSLERLSISTSRRK

SEQ ID NO: 5417 - protein, 268 aa, Zea mays
MERVIGGKYKLGRKIGSGSFGELYLGVNIQNGEEVGIKLEPVKTKHPQLHYESKVYMLLQGGNGIPHLKWYGVEGEYNVMVIDLLGPSLEDLFNSCHRNFSMKTVLMLADQLINRVEYMHSKGFIHRDIKPDNFLMGLGRKANQVYIIDYGLAKKYKDLHTHKHIPYRENKNLTGTARYASVNTHLGIEQSRRDDLESAGYLLLYFLRGSLPWQGLKAGTKKQKYDKISEKKMLTSAEVLCNLTRRSSSHISTIVAPCDLKTGQTTLF

SEQ ID NO: 5418 - protein, 370 aa, Panicum virgatum
MEHVIGGKYKLGRKIGSGSFGELYLGVNIQNGEEVGIKLEPVKTKHPQLHYESKVYMLLQGGNGIPHLKWYGVEGEYNVMVIDLLGPSLEDLFNCCNRKLSMKTVLMLADQLINRVEYMHSKGFIHRDIKPDNFLMGLGRKANQVYIIDYGLAKKYKDLQTHKHIPYRENKNLTGTARYASVNTHLGIEQSRRDDLESVGYLLLYFLRGSLPWQGLKAGTKKQKYDKISEKKMLTSPEVLCKSYPPEFISYFHYCRSLRFEDRPDYSFLKKLFRDIFIREGYQFDYVFDWTALKYPQMSSNNKLVQQPSARITGAGPSGERTDKPSMGQEIRDRFTGAVEAFARRNPGSGRGSPWRTFQAQKPCRFLWNI

SEQ ID NO: 5419 - protein, 458 aa, Triticum aestivum
MVAHQEAEATTTTTVDPMRLASRWRSPAEWVATAAALDSEPMPSELNTANSSGLFAVVSVDKMSVKYLGVNHHGHDVGVVQADCPAPMHRAVYYFEMTVRNAGLKGQTSIGFTTESFKMRRQPGWESQSCGYHGDDGYLYRGPGKSESFGPKFTSGDIIGAGINYIEQLLFFTKNGSLIGAFPKDIKGPLYPTIAVHSQDEELTVNFGKEQFCFDIEGYILEQKMTQQSISDKLYLQPDISHWIVRSYLLHYGYQDTLNSFDAASETDPPANHQTGYGEPPEMYGLSHRKMLRQLIMNGDIDSAFKRLEEWYPQVLKDEISVICFLLHSQRFIEYIRAEQLEGAVKYARANLANFLAHKAFEGLLKESVALLAYEKPSESCIGYLLESPQREFVADAVNAAILSTNPKMKDPESCLYSCLEKLLRQLTVCSSELRAFNSDQGDVFLLHKEIYERSRRP

SEQ ID NO: 5420 - protein, 456 aa, Secale cereale
MVAHQEAEATTTVDAMRLASRWRSPAEWVATAAALDTEPMPSELNTANSSGLFAVVSVDKMSVKYLGVNHHGHDVGVVQADRPAPMHRAVYYFEMTVRNAGLKGQTSIGFTTESFKMRRQPGWESQSCGYHGDDGYLYRGPGKSESFGPKFTSGDIIGAGINYVEQILFFTKNGSLIGSFPKDIKGPLYPTIAVHSQDEELTVNFGKEQFCFDIEGYILEQKMTQQSISDKLYLQPDISHWIVRSYLLHYGYQDTLNSFDAASETDPPANHQTGYGEPPEMYGLSHRKMLRQLIMNGDIDSAFKMLEEWYPQVLKDEISVICFLLHSQRFIEYIRAEQLEGAVKYARANLANFLTHKAFEGLLKESAALLAYEKPSECCIGYLLESPQREFVADAVNAAILSTNPKMKDPESCLHSCLEKLLRQLTVCSSELRAFNSDQGDVFLLHKEIYERSRRP

SEQ ID NO: 5421 - protein, 466 aa, Panicum virgatum
MVANQEAEAASAAAPGAGTTVDPMRLASRWRSPAEWECAAAELDAEPLPSELNTVNSSGLFAVVSIDKLSVKYLGSHHHGHDVGVVQADRPAPTRRAVYYFEMGVKNAGYKGQTSIGFTSESFKMRRQPGWESNSCGYHGDDGYLYRGQGKGESFGPKFTSGDTIGAGINYLSQEFFFTKNGSLVGAFPKEIKGPLYPTVAVHSQGEELTVNFGKEPFCFDIEGYILEEKMRQQSMTDKLKLEENISHVIVRSYLLHYGYQDTLNSFDMANATDPPGSRQNGHREPPEMYGLSHRKLLRQLIMSGDIDSTFKRLEEWYPQVIKDEKSVICFLLHSQRFIEYIRAEQLEDAVKYARANLASFLTHKAFEGLLKESVALLAYEKPAESCIGYLLDSPQREFVADAVNAAVLSTNPAMKDPESCLYSCLERLLRQLTVCSFERRTFNNDQGDAFLLHKEVRNCERSRRS

SEQ ID NO: 5422 - protein, 469 aa, Oryza sativa
MVANEVVAAAAVVEEPAPASAGAVDPMRLASRWRSPAEWGAAAAEMEAEPAPSELNTTNSSGLFAVVSTDRMSVRYLGVNQHGHDVGVVQANRPAPTRRAVYYFEMGVKNAGQKGQTSIGFTTENFKMRRQPGWESNSCGYHGDDGYLYRGPGKSESFGPKFTSGDTIGAGINYFSQEFFFTKNGSLVGSFQKEIKGPLYPTIAVHSQDEEVTVNFGKEPFCFDIEGYIFEEKMKQQSVSDKLDLQPDISHWIVRSYLLHYGYQDTLNSFDMASETDPPSNHQNGYGEPPEMYGLSHRKLLRQLIMSGDIDSAFKKLGEWYPQVIKDETSIICFLLHSQRFIEFIGAGQLEDAVKYARSNLANFLTHKAFDGLLKESVALLAYEKPAESCIGYLLDSPQREFVADAVNAAVLSTNPNMKDPESCLYSCLEKLLRQLTVCSFERRAFSGDQGDAFLLHKEVQSCDRSRCS

SEQ ID NO: 5423 - protein, 423 aa, Panicum virgatum
MLSRSRPSSTPSTALDFSPSSPPTSCPSNTSAAITMATTSGSCKPTAPRPRAGPCTTLRCGSRTPATRGRPQSGSQSESFKMRRQPGWEPNSCGYHGDDGHLYRSQGKGEPFGPKFTSGDTIGAGINYLSQEFFFTKNGSLVGAFPKEIKGPLYPTVAVHSQGEELTVNFGKEPFCFDIEGYILEEKMRQQSMTNKLKLEENISHVIVRSYLLHYGYQDTLNSFDMANATDPPGSRQNGHREPPEMYGLSHRKLLRQLIMSGDIDSTFKRLEEWYPQVIKDEKSVICFLLHSQRFIEYIRAEQLEDAVKYARANLASFLTHKAFEGLLKESVALLAYEKPAESCIGYLLDSPQREFVADAVNAAVLSTNPAMKDPESCLYSCLERLLRQLTVCSFERRTFNNDQGDAFLLHKEVRNCERSRRS

SEQ ID NO: 5424 - protein, 466 aa, Panicum virgatum
MVANQEAEAASAAAPGAGTPVDPMRLASRWRSPAEWECAAAELDAEPLPSELNTVNSSGLFAVVSTDKLSVKYLGSHHHGHDVGVVQADRPAPTRRAVYYFEMRVKNAGYKGQTSIGFTSESFKMRRQPGWEPNSCGYHGDDGHLYRGQGKGEPFGAKFTSGDTIGAGINYLSQEFFLTKNGSLVGAFPKEIKGPLYPTVAVHSQGEELTVNFGKEPFCFDIEGYILEEKMRQQSMTNKLKLEENISHVIVRSYLLHYGYQDTLNSFDLANATDPPGSRQNGHREPPETYGLSHRKLLRQLIMSGDIDSTFKRLEEWYPQVIKDDKSVICFLLHSQRFIEYIRAEQLEDAVKYARANLASFLTHKAFEGLLKESVALLAYEKPAESCIGYLLDSPQREFVADAVNAAVLSTNPAMKDPKSCLYSCLERLLRQLTVCSFERRTFNNDQGDAFLLHKEVRNCERSRRS

SEQ ID NO: 5425 - protein, 466 aa, Sorghum bicolor
MVTNQDAEAASAAAPGAGATVDAMRLASRWRSQAEWACAAAELESEPAPSELNTVNSSGLFSVVSTDKLSVKYLGSHHHGHDVGVVQADRPAPTRRAVYYFEMSVRNAGYKGQTSIGFTNESFKMRRQPGWESNSCGYHGDDGQLYVGQGKGQSFGPKFTSGDIIGAGINYLSQEFFFTKNGAQVGAIPKEIKGPLYPTIAVHSQGEELTVNFGKEPFCFDIEGYILEEKMRQQSVSDKLNLEPDISHWIVRSYLLHYGYQDTLNAFDMANATDPPTNRQNGHAEPPEMYGLSHRKLLRQLIMSGDIDSAFKRLGEWYPQVIKDEKSVICFLLHSQRFIEYIRAEQLEDAVKYGRANLASFLTHKAFEGLLKDSVALLAYEKPAESCMGYLMDSPQREFVADAVNAAVLSTNPTMKDPESCLYSCLERLLRQLTVCSFERRAFNNDQGDAFLLHKEVQNYERSRRS

SEQ ID NO: 5426 - protein, 466 aa, Saccharum officinarum
MVTNQEAEAASAAAPGAGATVDPMRLASRWRSQAEWACAAAELEAEPAPSELNTVNSSGLFSVVSTDKLSVKYLGSHHHGHDVGVVQADRPAPTRRAVYYFEMSVRNAGHKGQTSIGFTNESFKMRRQPGWESNSCGYHGDDGQLYVDQRKGQAFGPKFTSGDIIGAGINYLSQEFFFTKNGAQVGSIPKEIKGPLYPTIAVHSQGEELTVNFGKEPFCFDIEGYIFEEKMRQQSVSDKLNLEPDISHWIVRSYLLHYGYQDTLNAFDMASATDPPTNRQNGHAEPPEMYGLSHRKLLRQLIMSGDIDSTFKRLGEWYPQVIKDEKSVICFLLHSQRFIEYIRAEQLEDAVKYGRANLASFLTHKAFEGLLKDSVALLAYEKPAESCIGYLMDSPQREFVADAVNAAVLSTNPTMKDPESCLYSCLERLLRQLTVCSFEQRAFNNDQGDAFLLHKEVQNYERSRRS

SEQ ID NO: 5427 - protein, 464 aa, Setaria italica
MVANQEAEAGSPGAGTTVDPMRLASRWRCPTEWDRAAAELDAEPLPSELNTVNSSGLFAVVSTDKLSVRYLGSHNHGHDVGVVQANRPAPTRRPVYYFEMGVKNAGYKGQTSIGFTTDSFKMRRQPGWESNSCGYHGDDGHLYRGQGKGESFGPKFTSGDTIGAGINYLSQELFFTKNGSLVGAVPKDLKGPLYPTVAVHSQGEELTVNFGKEPFCFDIEGYILEEKMRQQSVTDKVKLEEPNISHWIVRSYLLHYGYQDTLNSFDLANATDPPASRQNGHREPPPEIYGLSHRKLLRQLIMSGDIDTTFKRLGEWYPQVIKDEKSVICFLLHSQRFIEYIRAEQLEDAVKYARANLASFLTHKAFEGLLKESVALLAYEKPAESCIGYLLDAPQREFVADAVNAAVLSTNPAMKDPESCLYSCLERLLRQLTVCSFERRTFNNDQGDAFLLHKEVRSCERSRR

SEQ ID NO: 5428 - protein, 466 aa, Zea mays
MVTNQDAEAASAAAPGPGATVDPMRLASRWRSQTEWDRAVPELEAEPEPSELNTVNSSGLFSVVSTDKLSVKYLGSHHHGHDVGVVQADRPAPTRRAVYYFEMAVRNAGYKGQTSIGFTSESFKMRRQPGWESNSCGYHGDDGHLYRGLGKGEPFGPKFTSGDIIGAGINYLSQEFFFTKNGAPVGAIPKEIKGPLYPTIAVHSQGEELTVNFGKEPFCFDIEGYILEEKMKQQSVSDKLNLETDISHWIVRSYLLHYGYQDTLNAFDMANATDPPTNRQNGHAEPPETYGLSHRKLLRQLIMSGDIDSTFKRLGEWYPQVIKDEKSVICLLLHSQRFIEYIRAEQLEDAVHYGRANLASFLTHEAFEWLLKDSVALLAYEKPAESCLGYLMGSPQREFVADAVNAAVLSTNPTMKDPESCLYSCLERLLRQLTVCSLERRAFNNDQGDAFLLHKEMQNYERSRRS

SEQ ID NO: 5429 - protein, 461 aa, Zea mays
MVTNQDADAAAPGAGATVDPMRLASRWRSRPEWNCASAELEAEPSELNTVNSSGLFSVVSTDKLSVKYLGSHHHGHDVGVVQADRPAPTRRAVYYFEMGVRNAGYKGQTSIGFTSESFKMRRQPGWETNSCGYHGDDGHLYRGQGKGESFGPKFTSGDIIGAGINYLSQEFFFTKNGTLVGAIPKEIKGPLYPTIAVHSYGEELTVNFGKEPFCFDVEGYILEDKMRQQSVSDKLNLEPDISHWIVRSYLLHYGYQDTLNAFDMANATDRPTSRQNGNAEPPEMYGLSHRKLLRQLIMSGDIDSTFKRLREWYPQVIKDEQSVICFLLRSQRFIEYIRAEQLEVAVKYGRANLASFFTHKAFEGLLKDSVALLAYEKPTESCLGYLMDSSQREFVADAVNAAVLSTNPTVKDPESCLYSCLERLLKQLTVCSFERRAFNNYQGDAFLLHKEVQNYERSRRS

SEQ ID NO: 5430 - protein, 668 aa, Hordeum vulgare
MAEAAPPKLLYIAVADGGGRRAFRYTRPVLQSTLQLMGCKARHAFKISKKVFSVIRNEFLDASRSDRAVKEENARSHIGEDADMLNTEIPDASSSSMPFELYKTQTTILISREKFLNIVCDALSSYKYVGPNQKADLLLACRIKEKKESVTVLLCGTSGCGKSTLSSLLGSRLGITTVVSTDSIRHMMRSFADEKQNPLLYASTYHAGEHLDPVAVAKSKAKKLSTASHTNEGKDGTSDVKSQHGSSDLPPRAELVGNKQMAIEGFKAQSEMVIDSLDRLITSWEEQKQSVIVEGVHLSLNFVMGLMKKHPSIIPFMVYIANEEKHMERFAVRAKYMTLDPAKNRYIKYIRNIRAIQEYLCNRADKHLVPKINNTNVDQSVAAIHATVFSCLRRREVGEQLYDLNTNTVSVVDEEYRNQRASNSLGSKGMFQFIQRKGSSRNLMALLNPDGSVTKAWHVDSCDGNANGSRSSDKSVGKVNPSQIGKVESVNLQFGSFGISAWLSDTGGTSHTGSVDDLRADGNEAGGRYYSSCCSSPKTSDCASKEHMEDYSVYGSEEEADDPPDAETDEDLTDEERDIHEIEAGSVDEHSTKSDEEYNDLAMQDMMGNGNCSDDDDEQAAGFGNRSSPSLDESILGAADGDDAARYHHNLDLFTISKDIAARQMPCA

SEQ ID NO: 5431 - protein, 580 aa, Secale cereale
MAEAAPPKLLYIAVADGGGRRAFRYTRPVLQSTLQLMGCKARHAFKISKRVFSVMRSEFLDASRSDRAVKEENASSMGIREDAKMLNTEIPDASSSSLPFELYKTQTTILVSRERFLNIVCDALSSYKYVGPNQKADLLLACRIKEKKESVTVLLCGTSGCGKSTLSSLLGSRLGITTVVSTDSIRHMMRSFADEKQNPLLYASTYHAGEYLDPVAVAKSKAKRQAKKLAMVSNPNTNEGQDNTSDVKSRHGSVLPPRTELIGSKQMAIEGFKAQSEMVIDSLDRLITSWEEQKQSVIVEGVHLSLNFVMGLMKKHPSIIPFMVYIANEEKHMERFAVRAKYMTLDPAKNRYIKYIRNIRAIQEYLCNRADKHLVPKINNTNVDQSVAAIHATVFSCLRRREVGEQLYDLNTNTVPVVDEEYRSQRAANSLGSKGMFQFIQRKGSSRNLMALLNPDGSVTKAWHVDSSDGNANGSTSSGRSVGNRMVNPSQIGKAESVNLQFGSFGISAWLSDTGGGTSHAGSVDDLRADGIETGGRYFSSCCSSPKTSDCASKEHMEDYSVYGSEEEADDHLTLKLMKI

SEQ ID NO: 5432 - protein, 685 aa, Oryza sativa
MAEEAPPPPPPPKLLYIAVSDAAARRAFRYTRPVLQGTLQLMGCKARHAFKISKRVFNVMRSEFLDASKSDTADNEENAPSLVKDVEMLKPKILEATLSSIPFELYKTQTTIVVSREKFLSVVCDALSSYKYVGPNQKADFLLACRIKERKESVTVLLCGTSGCGKSTLSSLLGSRLGITTVVSTDSIRHMMRGFTDEKQNPLLYASTYHAGECLDPVAVAQAKAKRKAQKLDIVSHPNTNEGRDDTSDDKAHHGSSELPPRTELIGSKQMAIEGFKAQSEMVIDSLDRLITSWEEQKQSVIVEGVHLSLNFVMGLMKKHPSIIPFMVYIANEEKHMERFAVRAKYMTLDPAKNRYIKYIRNIRAIQDYLCNRADKHLVPKINNTNVDQSVAAIHATVFSCLRRREAGEQLYDLNTNTVAVVNEEYRNQRAANSLGSKGMFQLIQRQGSSRNLMAILNTDGSVTKAWHVDKNNGNGSLDGTSSDKSTKNPMYDTFGKAEPVNLQFGSFGISAWMSDTGGTSHTGSVDDLRADGIETGGRYYSSCCSSPKVSDCPSKELMEDDYSVFGSEEDADDPPDAGTDEDLTDEERDMHEIEAGSVDEHSTKSDEEYDDLAMQDVMENGYWSDDEQAASSTKNSSNQEKNIHGAADGDVVDDEGSGNDRFHHNLAFFLKMSKKVAATELPCA

SEQ ID NO: 5433 - protein, 173 aa, Panicum virgatum
MSMALSRFTQWLWPGGAAARVATHELPGTALTSSSFPDFPSGFREPDTVTFYTAGRRTRPRRARNRRRSRGEPRVDREYDMVIVPSDGGGCLSGSDSDDSDWSIGWLEPQAPELQTDGDPENCFAVLVPCYRHGRPEQPERREGRFLGAGALADGGLSDGKNFVEQWLSSLQN

SEQ ID NO: 5434 - protein, 178 aa, Panicum virgatum
MSMALGRFTQWLWPGGAAARVATHELPGTALTSSSFPDFPSGFREPDTVTFYTAGGGAAGRRTRPRRARNRRRSRGEPRVDREYDMVIVPSDGGGCLSGSDSDDSDWSIGWLEPQAPELQTDGDPENCFAVLVPCYRHGRQEQPERREGRFLGAGALADGGISDGKNFVEHWLSSLKN

SEQ ID NO: 5435 - protein, 178 aa, Panicum virgatum
MSMALGRFTQWLWPGGAAARVATHELPGTALTSSSFPDFPSGFREPDTVTFYTAGGGAAGRRTRPRRARNRRRSRGEPRIDREYDMVIVPSDGGGCLSGSDSDDSDWSIGWLEPQAPELQTDGDPENCFAVLVPCYRHGRQEQPERREGRFLGAGALADGGISDGKNFVEHWLSSLKN

SEQ ID NO: 5436 - protein, 174 aa, Avena sativa
MAMGLGRFTHWLWPATSARVSHHELPTTALTSSSFPDFPSGFREPDTVTFSSAAAGRRARQRKVRNQRRSRGECRVDREHDMVIVPSDGGGCLSGSESDDSDWSIGWLEPQAPEMQTDGDPETGFAVLVRCYSRGRAEQPGKAQGRFLGAGALADGGLSDGNNFVEQWLSSLQN

SEQ ID NO: 5437 - protein, 179 aa, Setaria italica
MSMALSRFTQWLWPGGAAARVSTHELSSAGLTSSSFPDFPSGFREPDTVTFYTGGGGGAGGRRTRPRRVRNRRRSRGESRVDREYDMVIVPSDGGGCLSGSDSDDSDWSIGWLEPQAPELQTDGDPENCFAVLVPCYRHGRQEQPGRREGRFLGAGALADGGLSDEKNFVEQWLSSLQN

SEQ ID NO: 5438 - protein, 179 aa, Sorghum bicolor
MSMALSRFTQWLWPGGAAARVAATHEHPSAGLTSSSFPDFPSGFREPDTVTFYTGGGAGGRRARPRRVSNRRRSRGEARVDREYDMVIVPSDGGGCLSGSDSDDSDWSIGWLEPQAPELQTDGDPENCFAVLVPCYRHGRQEQQPRRHEGRFLGAGALTDGGLSDGKNFVEQWLSSLQN

SEQ ID NO: 5439 - protein, 174 aa, Triticum aestivum
MAMGLGRFTHWLWPGNAARVGNHELPGIALTGASFPEFPSGFREADAIAFSSAAAGRRTRPRRVKNQRRSRGEPRIDREYDMVIVPSDGGGCLSGSESDDSDWSIGWLEPQAPEMQTDGDQETSFAVLVPCYRHGRAEQPAMPQGRFLGAGPLADGGLSDGKNFVEQWLSSLQN

SEQ ID NO: 5440 - protein, 118 aa, Triticum aestivum
MAMGLGRFTHWLWPGNAARVGHHELPGIALTGASFPEFPSGFREADAIAFSSRRRPPHAAEEGQEPAAQSRGAQDRQGVRHGHRAVRRRRVPFRVRVRRLRLVHRLAGAAGAGDADGR

SEQ ID NO: 5441 - protein, 191 aa, Setaria italica
MSMALSRFTQWLWPGGAAARVSTHELSSAGLTSSSFPDFPSGFREPDTVTFYTGGGGGAGGRRTRPRRVRNRRRSRGESRVDREYDMVIVPSDGGGCLSGSDSDDSDWSIGWLEPQAPELQTDGDPENCFAVLVPCYRHGRQEQPGRREGRFLGAGALADGGLSGEHGEEFCRAVAFFAPELIAQASPSYV

SEQ ID NO: 5442 - protein, 178 aa, Zea mays
MSMALSRFTQWLWPGSAAAPVAAHEHPNEGLTSSSFPDFPSGFREPDTVTFYTGRGAGGRRARPRRVRNRRRSRGEPRVDREYDMVIVPSDGGGCLSGSDSDDSDWSIGWLEPQAPELQTDGDPENCFAVLVPCYRHGRQEQQPGRHEGRFLGAGTLTNGGFSDGKNFVEQWLSSLQN

SEQ ID NO: 5443 - protein, 174 aa, Zea mays
MSMALSRFTQWLWPGGAAARVDTHEHPSGGLTSSSFPDFPSGFREPDTVTFYTGRQRARPRRVRNRRRSRGEARVDREYDMVIVPSDGGGCLSGSDSDDSDWSIGWLEPQAPELQTDGDPENCFAVLVPCYRHGRQEQQPRRQEGRFLGAGALTDGGPSDGKNFVEQWLSSFQN

SEQ ID NO: 5444 - protein, 370 aa, Triticum aestivum
MAKAVAKEVGAQEAAQGSAALGWAARDASGVLSPFDFSRRAQKDDDVTIKVLYCGICHTDLYTIKNEWGTAMYPVVPGHEILGVVTSVGAGVSKFKAGDTVGVGYFVGSCRSCECCGNGYENYCSGMVLTSNGIDPEHGGAVTQGGFSDVMLVNEDYVVRVPDGLPLDKAAPLLCAGVTVYSPMMRFGLNAPGKHLGVVGLGGLGHVAVKFGKAFGMRVTVISTSPGKREEALERLGADEFLVSRDPEQMQAAVGTMDGILDTVSAWHPISPLFALMKPMGQMVFVGGPTKPLELPAYAIVPGGKGIAGNCVGGIRDCQAMLEFAAKHGITAEVEVIKMDYVNTALERLAKNDVRYRFVIDVAGSLGSTS

SEQ ID NO: 5445 - protein, 370 aa, Secale cereale
MAKAVAKEVGAQEAAQGSAALGWAARDSSGVLSPFDFTRRAQKDDDVTIKVLYCGICHTDLYTIKNEWGTAMYPVVPGHEILGVVTSVGSGVSKFKAGDTVGVGYFVGSCRSCECCGNGYENYCSGMVLTSNGIDPEHGGAVTQGGFSDVMLVNEDYVVRVPDGLPLDKAAPLLCAGVTVYSPMMRFGLNAPGKHLGVVGLGGLGHVAVKFGKAFGMRVTVISTSPGKREEALERLGADEFLVSRDPEQMQAAVGTMDGILDTVSAWHPISPLFALMKPMGQMVFVGGPTKPLELPAYAIVPGGKGIAGNCVGGMRDCQAMLEFAAKHGITAEVEVIKMDYVNTALERLQKNDVRYRFVIDVAGSLGSTS

SEQ ID NO: 5446 - protein, 370 aa, Hordeum vulgare
MAKAVAKEVGAQEAAQGSAALGWAARDASGVLSPFDFSRRAQKDDDVTIRVLYCGICHTDLYTIKNEWGTAMYPVVPGHEILGVVTSVGSGVSKFKAGDTVGVGYFVGSCRSCECCGNGYENYCSGMVLTSNGIDPEHGGAVTQGGFSDVMLVNEDYVVRVPDGLPLDKAAPLLCAGVTVYSPMMRFGLNAPGKHLGVVGLGGLGHVAVKFGKAFGMRVTVISTSPGKREEALERLGADEFLVSRDPEQMQAAVGTMDGILDTVSAWHPISPLFALMKPMGQMVFVGGPTKPLELPAYAIVPGGKGIAGNCVGGIRDCQAMLEFAAKHGITAEVEVIKMDYVNTALERLAKNDVRYRFVIDIAGSLGSTS

SEQ ID NO: 5447 - protein, 421 aa, Leymus cinereus x Leymus triticoides
  misc_feature (18)..(18): Xaa can be any naturally occurring amino acid
  misc_feature (28)..(28): Xaa can be any naturally occurring amino acid
  misc_feature (52)..(52): Xaa can be any naturally occurring amino acid
  misc_feature (56)..(56): Xaa can be any naturally occurring amino acid
  misc_feature (70)..(70): Xaa can be any naturally occurring amino acid
  misc_feature (76)..(76): Xaa can be any naturally occurring amino acid
HEDHFHLRSSVLPLSFFXGELGARFSPXEPRHLASSVGVAVASPSRALRPHXAKAXAKEVGAQEAAQGSXALGWAXRDASGVLSPFDFSRRAQKDDDVTIKVLYCGICHTDLYTIKNEWGTAMYPVVPGHEILGVVTSVGSGVSKFKAGDTVGVGYFVGSCRSCECCGNGYENYCSGMVLTSNGIDPEHGGAVTQGGFSDVMLVNEDYVVRVPDGLPLDKAAPLLCAGVTVYSPMMRFGLNAPGKHLGVVGLGGLGHVAVKFGKAFGMRVTVISTSPGKREEALERLGADEFLVSRDPEQMQAAVGTMDGILDTVSAWHPISPLFALMKPMGQMVFVGGPTKPLELPAYAIVPGGKGIAGNCVGGIRDCQAMLEFAAKHGITAEVEVIKMDYVNTALQRLEKNDVRYRFVIDVAGSLGSTS

SEQ ID NO: 5448 - protein, 425 aa, Avena sativa
MSHHFQLRSSVLPLRFFPGGLGARFSRTEPRYLGSSGSSGAFAVASPARTLQRHRATATAKEVGVQAETAQGSAAVGWAARDASGVLSPFDFSRRAQKDDDVTIKVLYCGICHTDLYTIKNEWGTAMYPVVPGHEILGVVTSVGSGVTKFKAGETVGVGYFLGSCRSCECCGNGYENYCSGMVLTSNGIDREHGGAVTQGGFSDAIVVNQDYVVRVPDGLPLDGAAPLLCAGVTVYSPMMRFGLNAPGKHLGVVGLGGLGHVAVKFGKAFGMKVTVISTSPGKREEALERLGADEFLVSRDPEQMQKAVGTMDGILDTVSAWHPISPLFALMKPMGQMIFVGGPTKPLELPAYAIVPGGKGIAGNCVGGIRDCQAMLDFARKHGITAEVEVIKMDYVNTALERLEKNDVRYRFVIDVAGSLGSTA

SEQ ID NO: 5449 - protein, 370 aa, Pseudoroegneria spicata
MAKAVAKEVGAQEAAQGSAALGWAARDASGVLSPFDFSRRAQKDDDVTIKVLYCGICHTDLYTIKNEWGTAMYPVVPGHEILGVVTSVGSGVSKFKAGDTVGVGYFVGSCRSCECCGNGYENYCSGMVLTSNGIDPEHGGAVTQGGFSDVMLVNEDYVVRVPDELPLDKAAPLLCAGVTVYSPMMRFGLNAPGKHLGVVGLGGLGHVAVKFGKAFGMRVTVISTSPGKREEALERLGADEFLVSRDPEEMQAAVGTMDGILDTVSAWHPISPLFALMKPMGQMVFVGGPTKPLELPAYAIVPGGKGIAGNCVGGIRDCQAMLEFAAKHGITAEVEVIKMDYVNTALERLAKNDVRYRFVIDVAGSLGSTS

SEQ ID NO: 5450 - protein, 403 aa, Triticum aestivum
MAKAVAKEVGAQEAAQGSAALGWAARDASGVLSPFDFSRRAQKDDDVTIKVLYCGICHTDLYTIKNEWGTAMYPVVPGHEILGVVTSVGSGVSKFKAGDTVGVGYFVGSCRSCECCGNGYENYCSGMVLTSNGIDPEHGGAVTQGGFSDVMLVNEDYVVRVPDGLPLDKAAPLLCAGVTVYSPMMRFGLNAPGKHLGVVGLGGLGHVAVKFGRRSHEGHRHQHLAREARGGAGAAGRGRVPGEPGRRADAGGGGHHGRHPRHGVGVAPHLAAVRADEADGADGVRGRADQAAGAAGVRHRAGREGHRRELRRRHEGLPGHVGIRGKARHHRGGGGDQDGLRQHGARAARQERRPLPLRHRRRRQPRLNLVSWNSHLVDGCVNLLRRMRADLELLVTVPVKSPL

SEQ ID NO: 5451 - protein, 141 aa, Unknown
  Sequence found in Organisms: Secale cereale, Triticum aestivum
MENLAMLWGIIGPGVAGALFGAGWWFWVDAVVCSAVQVSFIHYLPGIFASLAALMFNCVDKDAIGNDYYSSYGDDSEWRVKLWLFVAYVVSFVCLAGSVGLLVQDALTDKGPSVWTGVAGVLQCVFVLISGLTYWTCHTED

SEQ ID NO: 5452 - protein, 142 aa, Avena sativa
MENLAMLWAIIGPGVAGALFGAGWWFWVDAVVCSAVQVSFIHYLPGIFASLAALMFNCVNKNDIGNDYYSSYGDDNEWRLKLWLFIAYVVSFVCLAASVGLLVQDALTEKGPSVWTGVAGVLQCVFVLISGLTYWTCHSSDD

SEQ ID NO: 5453 - protein, 141 aa, Setaria italica
MENLALLWGIIGPGVAGAIFGAGWWFWVDAVVCSAVSVSFLHYLPGIFASLAALMFNCVNKDEIGYDYYSPYGDDSEWRVKLWLFVAYVVSFVCLAGSVGLLVQDALTDKGPSVWTGVAGVLQCVLVLISGLTYWTCHSED

SEQ ID NO: 5454 - protein, 141 aa, Unknown
  Sequence found in Organisms: Zea mays, Sorghum bicolor, Saccharum officinarum
MENLALLWGIIGPGVSGAIFGAGWWFWVDAVVCSAVQVSFLHYLPGIFASLAALMFNCVNKDEIGYDYYSPYGDDSEWRVKLWLFVAYVVSFVCLAGSVGLLVQDALTNKGPSVWTGVAGVLQCVLVLISGLVYWTCHSED

SEQ ID NO: 5455 - protein, 141 aa, Pennisetum glaucum
MENLALLWGIIGPGVAGAVFGAGWWFWVDAVVCSGVSVSFLHYLPGIFASLAALMFNCVNKDEIGYDYYSPYGDDSEWRVKLWLFVAYVVSFVCLAGSVGLLVQDALTDKGPSVWTGVAGVLQCVLVLISGLIYWTCHSED

SEQ ID NO: 5456 - protein, 141 aa, Panicum virgatum
MENLALLWGIIGPGVAGAVFGAGWWFWVDAVVCSAVPVSFLHYLPGIFASLAALMFNCVNKDEIGYDYYSPYGDDSEWRVKLWLFVAYVVSFVCLAGSVGLLVQDALTDKGPSVWTGVAGVLQCVLVLISGLIYWTCHYED

SEQ ID NO: 5457 - protein, 141 aa, Panicum virgatum
MENLALLWGIIGPGVAGAVFGAGWWFWVDAVVCSAVSVSFLHYLPGIFASLAALMFNCVNKDEIGYDYYSPYGDDSEWRVKLWLFVAYVVSFVCLAGSVGLLVQDALTDKGPSVWTGVAGVLQCVLVLISGLIYWTCHYED

SEQ ID NO: 5458 - protein, 75 aa, Festuca arundinacea
MENLAMLWGIIGPGVAGALFGAGWWFWVDAVVCSAVKVSFIHYLPGIFASVSALMFNCVSKEDLGGDYYSAYGRG

SEQ ID NO: 5459 - protein, 141 aa, Cenchrus ciliaris
  misc_feature (112)..(112): Xaa can be any naturally occurring amino acid
MENLALLWGILGPGVAGAVFGAGWWFWVDAVVCSAVSVSFLHYLPGIFASLAALMFNCVNKDEIGYDYYSPYGDDSEWRVKLWLFVAYVVSFVCLAGSVGLLVQDALTDKGXSVWTGVAGVLQCVLVLISGLIYWTCHSED

SEQ ID NO: 5460 - protein, 141 aa, Oryza sativa
MENLALLWGIIGPGVAGAVFGAGWWFWVDAVVCSSVQVSFLHYLPGIFASLAALMFNAVNKDEIGYDYYSPYGDDSEWRVKLWLFVAYVVSFVCLAGSVGMLVQDALTDKGPSVWTGVAGVLQCVLVLISGLIYWTCHSED

SEQ ID NO: 5461 - protein, 142 aa, Eragrostis curvula
  misc_feature (116)..(116): Xaa can be any naturally occurring amino acid
MENLALLWGIIGPGVAGAVFGAGWWFWVDAIVCSAVQVSFLHYLPGIFASLAALMFNAVSKDEIGYDYYSPYGDDSEWRAKLWLFVAYVVSFVCLAGSVGLLVQDALTDKGPSVWXGVAGVLQCVLVLISGLIYWTCHSEEY

SEQ ID NO: 5462 - protein, 140 aa, Allium cepa
MDHNCGLMWEIMGPGVAGAVFGAGWWFWVDAVVCSSVKVSFLHYLPGIFASLAALMFNCVNKEDISYDYSPYGDSEWRIKLWLFIAYVVSFVSLAGSVGLLVQDALTDKGPSAWTGVAGILQCVFVLISGLMYWTCHSEE

SEQ ID NO: 5463 - protein, 140 aa, Elaeis guineensis
MDNLSLMWEIMGPGIAGAVFGAGWWFWVDAVVCSAVKVSFLHYLPGIFASLAALMFNCVNRDDVSYDYYSPYGDSEWRLKLWLFVAYVVSFVSLAAAVGLLIQDALTDKGPSVWTGVAGVLQCVFVLISGLIYWTCHSED

SEQ ID NO: 5464 - protein, 140 aa, Musa acuminata
MDNLGLMWEIMGPGIAGAVFGAGWWFWVDAVVCSAVKISFLHYLPGIFASLAALMFNCVDKNEIGYDYYSPYGETEWRVKLWLFVAYVVSFVSLAGAVGLLVQDALTEKSPSVWTGVAGVLQCVFVLISGLIYWTCHSED

SEQ ID NO: 5465 - protein, 140 aa, Elaeis guineensis
MDNLSLMWEIMGPGIAGAVFGAGWWFWVDAVVCSAVKVSFLHYLPGIFASLAALMFNCVNRDDVSYDYYSPYGDSEWRLKLWLFVAYVVSFVSLAAAVGLLIQDSLTDKGPSVWTGVAGVLQCVFVLISGLIYWTCHSED

SEQ ID NO: 5466 - protein, 141 aa, Ananas comosus
MDNNLSLMWEIMGPGIAGAVFGAGWWFWVDAVVCSAVKVSFLHYLPGIFASLAALMFNCVSRDDVSYGSYSPYDDTEWRVKLWLFVAYVVSFVSLAGAVGLLIQDALTDKGPSVWTGVAGVLQCVFVLISGLIYWTCHSED

SEQ ID NO: 5467 - protein, 1421 aa, Triticum aestivum
MASHAEMTGSNMLRLQSFPSNMGKQRSSFISTRHPPLRRPRVVRHCLDLRHLCRLPNQRAIVPNIRTMPALTAAVSRGVNSPLIEASGDDMGLVSRIIHFYRKPFLQESEAKELLRKVQAKVSSNIIDIKTEQCFNVELEDALGSTKLATLQWLLAETYEPDNLQTGSFLEEEVSRSPYCFLVEVGPRMTFSTAFSTNAVSICKALSLMEVTRLERSRRYLLCLQPGSDPLDESQLNSFAALIHDRMTECVYPSKLTSFRSDVVPEPVSVIPVMEKGREALEEINLKMGLAFDEQDIKYYTHLFRDDIKRNPTTVELFDIAQSNSEHSRHWFFNGKLEIDGETMPSTLFQLVKSPLKANPNNSIIGFKDNSSAIKGTLVNHLRPALPGSTSPLSLMMRELGILFTAETHNFPCAVAPYPGAETGAGGRIRDTHATGKGSFVVASTAGYCVGNLQIEESYAPWEDSSFSYPSNLASPLQILIDASDGASDYGNKFGEPLIQGFTRNFGSRLPNGERREWLKPIMFSGAIGQIDHAHISKGDPEIGMLVVKIGGPAYRIGMGGGAASSMVSGQNDAELDFNAVQRGDAEMAQKLYRVIRACVEMGEKNPIISIHDQGAGGNCNVVKEIIYPKGAEIDIRSIVVGDHTLSVLEIWGAEYQEQDALLVKPESRNLLQSLCDRERVSMAVLGEIDGSGKIVLIDSAAVEHAMLSGLPPPPPAVDLELEKVLGDMPQKTFDFKRVPRSSEPLDIAPEITLMDVLKRVLKLPSVCSKRFLTTKVDRCVTGLVAQQQTVGPLQLPLADVAVVAQTYTDLTGGACAIGEQPIKGLLNPEAMARLAVGEALTNLVWAKVTSLADVKASGNWMYAAKIDGEGADMYDAAVAMADCMIQLGIAIDGGKDSLSMAAQCDGELVKAPGNLVISAYVTCPDITLTVTPDLKLVKDGVLLHVDLAKGKRRLGCSALAQAFDQIGNDCPDIEDVPYLKKVFEVVQELLSERLISAGHDISDGGLIVTILEMAFAGNCGVNLNIELKDNDLLQTLFAEELGLVVEVHLDDLDVVKQKLHAAGVSANVIGKVTAAPEIELCVDGEVRLKERTSDLRDLWEETSFQLEELQRLKSCVKLEKEGLKSRTSPSWHLSFTPKFTDKKLLSASSKPKVAIIREEGSNSDREMSAAFHAAGFEPWDITMSDLLNQKTSLTEFRGLAFVGGFSYADVLDSAKGWAASIRFNQPLIQQFQEFYNRPDTFSLGVCNGCQLMALLGWVPGPDIGGSLGAGGDMSQPRFTHNESGRFECRFISVAIGDSPSIMFKGMEGSTLGIWSAHGEGRAFFPDENVLSDVVKSNLAPLRYCDDANNVTEVYPFNPNGSPLGIAALCSPNGRHLALMPHPERSFMMWQYPWYPKEWQVEKSGPSPWLRMFQNAREWCS

SEQ ID NO: 5468 - protein, 899 aa, Triticum aestivum
MFSGAVGQIDHAHISKGDPEIGMLVVKIGGPAYRIGMGGGAASSMVSGQNDAELDFNAVQRGDAEMAQKLYRVIRACVEMGEKNPIISIHDQGAGGNCNVVKEIIYPKGAEIDIRSIVVGDHTLSVLEIWGAEYQEQDALLVKPESRNLLQSLCDRERVSMAVLGEIDGSGKIVLIDSAAVEHAMLSGLPPPPPAVDLELEKVLGDMPQKTFDFKRVPRSSEPLDIAPEITLMDVLKRVLKLPSVCSKRFLTTKVDRCVTGLVAQQQTVGPLQLPLADVAVVAQTYTDLTGGACAIGEQPIKGLLNPEAMARLAVGEALTNLVWAKVTSLDDVKASGNWMYAAKIDGEGADMYDAAVAMADCMIQLGIAIDGGKDSLSMAAQCDGELVKAPGNLVISAYVTCPDITLTVTPDLKLVKDGVLLHVDLAKGKRRLGCSALAQAFDQIGNDCPDIEDVPYLKKVFEVVQELLSERLISAGHDISDGGLIVTILEMAFAGNCGVNLNIELKDNDLLQTLFAEELGLVIEVHLDDLDLVKQKLNAAGVSADVIGEVTAAPEIELLVDGEVRLKERTSDLRDLWEETSFQLEELQRLKSCVKLEKEGLKGRTSPLWHLSFTPKFTDEKLLSASSKPKVAIIREEGSNSDREMSAAFHAAGFEPWDTTMSDLLNQKADLMKFRGIAFVGGFSYADVLDSAKGWAASIRFNQPLIQQFQEFYNRPDTFSLGVCNGCQLMALLGWVPGPDIGGSLGAGGDMSQPRFTHNESGRFECRFISVAIGVSPSIMFKGMEGSTLGIWSAHGEGRAFFPDENVLSDVVKSNLAPLRYCDDANNVTEVYPFNPNGSPLGIAALCSPNGRHLALMPHPERSFMMWQYPWYPKEWQVEKSGPSPWLRMFQNAREWCS

SEQ ID NO: 5469 - protein, 666 aa, Brachypodium distachyon
MHIVELSPNDTFFPVCNNYYVCPPQVKQRHSFISARQSSLRRSRMVRGCLDLRHFCWLPNQRFALSNTRPMPALNAAVSRDVNSPLVEESVDDVKLFSRIIHLYRRPFLQESETKDLLRKVQAKVSSNIIDIKTEQCFNVELESALSSEKLTALQWLLAETYEPENLQSGSFLEEEVLRSPYSFLVEVGPRMTFSTAFSTNAVSICKALSLMEVTRLERSRRYLLCLQPGSGPLDESQLNSFAALIHDRMTECVYPSKLTSFRSDVVPEPVSVIPVIERGREALEEINIRMGLAFDEQDIKYYTHLFRDDIKRNPTTVELFDIAQSNSEHSRHWFFNGKLEIDGETMERTLFQLVKSPLKANPNNSIIGFKDNSSAIKGNPVNHLRPAVPGSTSPLSLMMRELGILFTAETHNFPCAVAPYPGAETGAGGRIRDTHATGKGSFVVASTAGYCVGNLLMEESYAPWEDSSFSYPLNLASPLQILIDASDGASDYGNKFGEPLIQGFTRTFGMRLPNGERREWLKPIMFSGAIGQIDHAHISKGDPEIGMLVVKIGGPAYRIGMGGGAASSMVSGQNDAELDFNAVQRGDAEMAQKLYRVIRACAEMGEKNPIISIHDQGAGGNCNVVKEIIYPKGASLHLTKIIVGDHTLSVLEIWGAEYQEQMHYW

SEQ ID NO: 5470 - protein, 1418 aa, Setaria italica
MSYPGEMTGSNIIRLQCFPSNMVNQRSGFIPARNRRSRMTRHCLDPRHLCRLPTQRVNVPNIRPLPTPNAAVSRDINTPLVEESVTEVESTPHVFHFYRKPFLQESESEELLRKVQQKVACNIIDIKTEQCFNVELQKALTSEKLATLQWLLSETYEPEKLQTCSFLEDEVSRSPYSVIVEVGPRMAFSTAFSTNAVSICKALSLTEVTRLERSRRYLLFLQPGSGPLDESQLNSFAALIHDRMTECIYPSKLTSFLVDVVPEPVSAIPVIERGREALEEINVRMGLAFDEQDIKYYTHLFRDDIKRNPTTVELFDIAQSNSEHSRHWFFNGKLVIDGETMARTLFQLVKSPLKANPNNSVIGFKDNSSAIKGYQVNQLRPALPGSTSPLSLMMRELDILFTAETHNFPCAVAPYPGAETGAGGRIRDTHATGQGSFIVASTAGYCVGNLRIEESYAPWEDSSFSYPSNLASPLQILIDASDGASDYGNKFGEPLIQGFTRNFGTRLPNGERREWLKPIMFSGAIGQIDHVHISKGDPEIGMLVVKIGGPAYRIGMGGGAASSMVSGQNDAELDFNAVQRGDAEMAQKLYRVIRACAEMGEKNPIISIHDQGAGGNCNVVKEIIYPKGAEIDIRSIVVGDHTLSVLEIWGAEYQEQDALLVKPESRRLLESLCERERVSMAVIGEIDGSGKIVLIDSVAVEQAKLNGLPPPPPVVDLELEKVLGDMPQKTFEFNRVTRLGEPLDIAPEVTLMDVLKRVLKLPSVCSKRFLTTKVDRCVTGLVAQQQTVGPLQLPLADVAVIAQTYTDLTGGACAIGEQPIKGLLNPKAMARLAVGEALTNLVWAKVTSLADVKASGNWMYAAKLDGEGADMYDAGVALADCMVELGIAIDGGKDSLSMAAQCDGEVVKAPGNLVISAYVTCPDITLTVTPDLKLGDDGVLLHIDLAKGKRRLGCSALTQAFDQIGNDCPDIEDVPYLKKVFDAVQELLSERLISAGHDISDGGLIVTVLEMAFAGNCGVNLNVGLGDYDLLQVLFAEELGLVLEVHSNDLDVVKQKLHVAGVSANVIGKVTTAPDIGLVVDGEVRLKEKTSDLRDLWEETSFQLEELQRLKSCVKLEKEGLKSRTSPSWRLSFTPKFTEKKILTTATKPKVAIIREEGSNSDREMAAAFHSAGFEPWDITMSDLLTQKISLTEFRGLAFVGGFSYADVLDSAKGWAASIRFNQPLIQQFQEFYNRPDTFSLGVCNGCQLMALLGWVPGPDVGGSLGVGGDISQPRFIHNESGRFECRFTSVAIGDSPAIMFKGMEGSTLGIWSAHGEGRAFFPDENILSGVVKSNLAPLRYCDDYNNVTEVYPFNPNGSPLGIAALCSPDGRHLAMMPHPERSFMMWQYPWYPKDWQVEKSGPSPWLRMFQNAREWCS

SEQ ID NO: 5471 - protein, 1354 aa, Secale cereale
MPALTAAVSRGVNSPLTEASVDDMEVLSRIIHFYRKPLLQESEAKELLRKVQAKVSSNIIDIKTEQCFNVELEDSLSSAKLATLQWLLAETYEPDNLQTGSFLEEEVSMSPYSFLVEVGPRMTFSTAFSTNAVSICKALSLMEVTRLERSRRYLLCLQPGSDPLDESQLNSFAALVHDRMTECVYPSKLTSFRSDVVPEPVSVIPVMERGREALEEINLKMGLAFDEQDIKYYTHLFRDDIKRNPTTVELFDIAQSNSEHSRHWFFNGKLEIDGETMPSTLFQLVKSPLKANPNNSIIGFKDNSSAIKGTLVNHLRPSLPGSTSPLSLMMRELGILFTAETHNFPCAVAPYPGAETGAGGRIRDTHATGKGSFVVASTTGYCVGNLQIEDSYAPWEDSSFSYPSNLASPLQILIDASDGASDYGNKFGEPLIQGFTRNFGSRLPNGERREWLKPIMFSGAIGQIDHAHISKGDPEIGMLVVKIGGPAYRIGMGGGAASSMVSGQNDAELDFNAVQRGDAEMAQKLYRVIRACAEMGEKNPIISIHDQGAGGNCNVVKEIIYPKGAEIDIRSIVVGDHTLSVLEIWGAEYQEQDALLVKPESRNLLQSLCERERVSMAVLGQIDGSGKIVLIDGAAVEHAKLSGLPPPPPVVDLELEKVLGDMPQKTFEFKRVSRLSEPLDIAPEVTLMDVLKRVLKLPSVCSKRFLTTKVDRCVTGLVAQQQTVGPLQLPLADVAVIAQTYTDLTGGACAIGEQPIKGLLNPEAMARLAVGEALTNLVWAKVTSLADVKASGNWMYAAKIDGEGADMYDAAVAMADCMIQLGIAIDGGKDSLSMAAQCDGELVKAPGNLVISAYVTCPDITLTVTPDLKLGKDGVLLHVDLAEGKRRLGCSALAQAFDQIGNDCPDIEDVPYLKKVFEVVQELLSERLISAGHDISDGGLIVTILEMAFAGNCGVNLNIESKDNGLLQTLFAEELGLVIEVHLDDLDLVKQKLNAAGVSANVIGEVTASPEIELLVDGEVCLKERTSDLRDLWEETSFQLEELQRLKSCVKLEKEGLKSRTSPLWHLSFTPKFTDKKLLSASSKPKVAIIREEGSNSDREMSAAFHAAGFEPWDITMSDLLNQKADLMEFRGIAFVGGFSYADVLDSAKGWAASIRFNQPLIQQFQEFYNRPDTFSLGVCNGCQLMALLGWVPGPDIGGSLGAGGDMSQPRFTHNASGRFECRFISVAIGDSPSIMFKGMEGSTLGIWSAHGEGRAFFPDENVLSDVVKSNLAPLRYCDDANNVTEVYPFNPNGSPLGIAALCSPNGRHLALMPHPERSFMMWQYPWYPKEWQVEKSGPSPWLRMFQNAREWCS

SEQ ID NO: 5472 - protein, 1348 aa, Triticum aestivum
AVSRGVNSPLIEASVDDMELVSRIIHFYRKPLLQESEAKELLRKVQAKVSSNIIDIKTEQCFNVELEDSLSSAKLATLKWLLAETYEPDNLQTGSLLEEEVSMSPYSFLVEVGPRMTFSTAFSTNAVSICKALSLMEVTRLERSRRYLLCLQPGSDPLDESQLNSFAALIHDRMTECVYPSKLTSFRSDVVPEPVSVIPVMEKGREALEEINLKMGLAFDEQDIKYYTHLFRDDIKRNPTTVELFDIAQSNSEHSRHWFFNGKLEIDGETMPSTLFQLVKSPLKANPNNSIIGFKDNSSAIKGTLVNHLRPALPGSTSPLSLMMRELGILFTAETHNFPCAVAPYPGAETGAGGRIRDTHATGKGSFVVASTAGYCVGNLQIEESYAPWEDSSFSYPSNLASPLQILIDASDGASDYGNKFGEPLIQGFTRNFGSRLPNGERREWLKPIMFSGAIGQIDHAHISKGDPEIGMLVVKIGGPAYRIGMGGGAASSMVSGQNDAELDFNAVQRGDAEMAQKLYRVIRACAEMGEKNPIISIHDQGAGGNCNVVKEIIYPKGAEIDIRSIVVGDHTLSVLEIWGAEYQEQDALLVKPESRNLLQSLCDRERVSMAVLGEIDGSGKIVLIDSAAVEHAMLSGLPPPPPAVDLELEKVLGDMPQKTFAFKRVPRSSEPLDIAPEITLMDVLKRVLKLPSVCSKRFLTTKVDRCVTGLVAQQQTVGPLQLPLADVAVVAQTYTDLTGGACAIGEQPIKGLLNPEAMARLAVGEALTNLVWAKVTSLADVKASGNWMYAAKIDGEGADMYDAAVAMADCMIQLGIAIDGGKDSLSMAAQCDGELVKAPGNLVISAYVTCPDITLTVTPDLKLVKDGVLLHVDLAKGKRRLGCSALAQAFDQIGNDCPDIEDVPYLKKVFEVVQELLSERLISAGHDISDGGLIVTILEMAFAGNCGVNLNIELKDNDLLQTLFAEELGLVIEVHFDDLDVVKQKLHAAGVSANVIGEVTAAPEIELLVDGEVCLKERTSDLRDLWEETSFQLEELQRLKSCVKLEKEGLKSRTSPSWHLSFTPKFTDKKLLSASSKPKVAIIREEGSNSDREMSAAFHAAGFEPWDITMSDLLNKKASLTEFRGIAFVGGFSYADVLDSAKGWAASIRFNQPLIQQFQEFYNRPDTFSLGVCNGCQLMALLGWVPGPDIGGSLGAGGDMSQPRFTHNESGRFECRFISVAIGDSPSIMFKGMEGSTLGIWSAHGEGRAFFPDENVLSDVVNSNLAPLRYCDDANNVTEVYPFNPNGSPLGIAALCSPNGRHLALMPHPERSFMMWQYPWYPKEWQVEKGGPSPWLRMFQNAREWCS

SEQ ID NO: 5473 - protein, 1367 aa, Secale cereale
MASHAEMTGSNMLRLQSFPSNVGKQRSSFISTRHPSLRRSRVVRHCLNLRHLCHLPNQRATVPNIRPMPALTAAVSRGVSSPLIEASVNDMELVSRIIHFYRKPFLQESEAKELLRKVQAKVSSNIINIKTEQCFNVELEDALGSTELATLQWLLAETYEPDNLQTGSFLEKEVSRSPYCFLVEVGPRMTFSTAFSTNAVSICKALSLMEVTRLERSRRYLLCLQPGSDPLDESQLNSFAALIHDRMTECVYPSKLTSFRSDVVPEPVSVIPVMEKGREALEEINLKMGLAFDEQDIKYYTHLFRDDIKRNPTTVELFDIAQSNSEHSRHWFFNGKLEIDGETMPSTLFQLVKSPLKANPNNSIIGFKDNSSAIKGTLVNHLRPTLPGSTSPLSLMMRELGILFTAETHNFPCAVAPYPGAETGAGGRIRDTHATGKGSFVVASTAGYCVGNLQIEESYAPWEDSSFAYPSNLASPLQILIDASDGASDYGNKFGEPLIQGFTRNFGSRLPNGERREWLKPIMFSGAIGQIDHAHISKGDPEIGMLVVKIGGPAYRIGMGGGAASSMVSGQNDAELDFNAVQRGDAEMAQKLYRVIRACAEMGEKNPIISIHDQGAGGNCNVVKEIIYPKGAEIDIRSIVVGDHTLSVLEIWGAEYQEQDALLVKPESRNLLQSLCERERVSMAVLGEIDGSGKIVLIDSAAVEHAVLNGLPPPPPAVDLELEKVLGDMPQKTFDFKRVPRSSEPLDIAPEITLMDVLKRVLKLPSVCSKRFLTTKVDRCVTGLVAQQQTVGPLQLPLADVAVVAQTYTDLTGGACAIGEQPIKGLLNPEAMARLAVGEALTNLVWAKVTSLADVKASGNWMYAAKIDGEGADMYDAAVAMADCMIQLGIAIDGGKDSLSMAAQCDGELVKAPGNLVISAYVTCPDITLTVTPDLKLPKDGVLLHVDLAKGKRRLGCSALAQAFDQIGNDCPDIEDVPYLKKVFEVVQELLSERLISAGHDISDGGLIVTILEMAFAGNCGVNLNIELKDNDLLQTLFAEELGLVIEVHLDDLDVVKQKLHAAGVSANVIGEVTAAPEIELLVDGEVCLKERTSDLRDLWEETSFQLEELQRLKSCVKLEKEGLKSRTSPSWHLSFTPKFTDKKLLSASSKPKVAIIREEGSNSDREMSAAFHAAGFEPWDITMSDLLNQKTSLTEFRGLAFVGGFSYADVLDSAKGWAASIRFNQPLIQQFQEFYNRPDTFSLGVCNGCQLMALLGWVPGPDIGGSLGAGGDMSQPRFTHNESGRFECRFISVAIGDSPSIMFKGMEGSTLGIWSAHGEGRAFFPDENVLSDVVNSNLAPLRYCDDANNITEVYPFNPNGSPLGIA

SEQ ID NO: 5474 - protein, 1419 aa, Oryza sativa
MVSPGEMSVSNPLRFQGFPCNVGKRNVFIAARSSGLGRSRIAQQCFQQHHICYPGVRRASVPNVRMLPAPGALVSRGVDSSLVPKTGNASEAGVIQLYRIPYLQESETIELLRQVQAKVSSNIVGIKTEQCFNIQLDNALTPEKLATLQWLLAETYEPDKLQAQSFLEEEISRSPYSVIVEVGPRMTFSTAFSTNAVSICKSLSLMEVTRLERSRRYLLCLDPGNGPLDESQLNDFAALVHDRMTECVYPNKLTSFHSDVVPEPVRIVPVIERGREALEEINVKMGLAFDEQDIKYYTHLFRDDIKRNPTTVELFDIAQSNSEHSRHWFFNGKLVIDGETMPKTLFQLVKSPLKANPDNNSVIGFKDNSSAIKGYPANQLRPTIPGSTSPLSVMMRELDILFTAETHNFPCAVAPYPGAETGAGGRIRDTHATGKGSFVVASTAGYCVGNLRMEGSYAPWEDPSFSYPSNLASPLQILVDASDGASDYGNKFGEPLIQGFTRNFGMRLLNGERREWLKPIMFSGAIGQIDHAHISKGDPEIGMLVVKIGGPAYRIGMGGGAASSMVSGQNDAELDFNAVQRGDAEMAQKLYRVVRACAEMGESNPIISIHDQGAGGNCNVVKEIIYPKGAEIDIRSIVVGDHTLSVLEIWGAEYQEQDALLVKPESRSLLESLCERERVSMAVIGTIDGCGKIVLIDSAAMEHAKINGLPPPTPVEDLELEKVLGDMPQKTFEFKRVSLVSEPLDIAPGVTIMDALKRVLSLPSICSKRFLTTKVDRCVTGLVAQQQTVGPLQLPLADVAVIAQTYTDLTGGACAIGEQPAKGLLNPKAMARLAVGEALTNLVWAKVSSLSDVKASGNWMYAAKLDGEGADMYDAAVALADCMIQLGIAIDGGKDSLSMAAQCDGEVVKAPGNLVISAYVTCPDITLTVTPDLKLGNDGVLLHIDLGKGKRRLGGSALAQAFDQIGNDCPDIDDVPYLKKAFEAVQELLSQRLISAGHDISDGGLIVSVLEMAFAGNCGVKLNIDSEDSGLLQALFAEELGLLLEVHLKDLSVVKQKLEAGGISANVIGQVTASPDIELVVDGRLHLKEKTSDLRDIWEETSFQLEGLQRLKSCVRLEKEGLKHRTSPSWSLSFTPKFTDEKLLTASSKPKVAIIREEGSNGDREMAAAFYAAGFEPWDITMSDLLAGKSSLEEYRGIAFVGGFSYADVLDSAKGWAASIRFNQPLIQQFQNFYNRPDTFSLGVCNGCQLMALLGWVPGSDVGSSLGSGGDMSQPRFIHNESGRFECRFTSVSIGTSPAIMFKGMEGSTLGIWSAHGEGRAFFPDENVLASVVNSNLAPVRYCDDANNITEVYPFNPNGSPLGIAALCSPDGRHLAMMPHPERCFMMWQYPWYPKEWQLEKCGPSPWLRMFQNAREWCL

SEQ ID NO: 5475 - protein, 1415 aa, Oryza sativa
MASPGEMSVSNPLRFQGFPCNLGKRNGFIAARSSGLRRSQQCFHRHLCWPGVRRASVPNVRLLPTPGALVSRGLDSSLVHKSDNASEAGVIQLYRIPYLQDSETIELLRQVQAKVSSNIVGIKTEQCFNIQLDNALASEKLATLQWLLAETYEPDKLQAQSFLEEEVARNPYSVIVEVGPRMTFSTAFSTNAVSICKSLSLMEVTRLERSRRYLLCLDPGYGPLDESQLNDFTALVHDRMTECVYPKKLTSFHSDVVPEPVRIVPVIERGREALEEINVKMGLAFDEQDIKYYTHLFRDDIKRNPTTVELFDIAQSNSEHSRHWFFNGKLVIDGETMPRTLFQLVKSPLKANPDNNSVIGFNDNSSAIKGYPANQLRPTVPGSTSPLSVMMRELDILFTAETHNFPCAVAPYPGAETGAGGRIRDTHATGKGSFVVASTAGYCVGNLRIEGAYAPWEDPSFSYLSNLASPLQILIDASDGASDYGNKFGEPLIQGFTRNFGTRLLNGERREWLKPIMFSGAIGQIDHAHISKGDPEIGMLVVKIGGPAYRIGMGGGAASSMVSGQNDAELDFNAVQRGDAEMAQKLYRVVRACAEMGESNPIISIHDQGAGGNCNVVKEIIYPKGAEIDIRSIVVGDHTLSVLEIWGAEYQEQDALLVKPESRSLLESLCERERVSMAVIGTINGCGKIVLIDSAAVEHAKLNGLPPPTPVEDLELEKVLGDMPQKTFEFKRVSVVSEPLDIARGVTIMDALKRVLSLPSVCSKRFLTTKVDRCVTGLVAQQQTVGPLQLPLADVAVIAQTYTDLTGGACAIGEQPTKGLLNPKAMARLAIGEALTNLVWAKVSSLSDVKASGNWMYAAKLDGEGADMYDAAVALADCMIQLGIAIDGGKDSLSMAAQCDGEVVKAPGNLVISAYVTCPDITLTVTPDLKLGKDGVLLHIDLSKGKRRLGGSALAQAFDQIGNDCPDIDDVLYLKKAFEAVQELLGERLISAGHDISDGGLIVSVLEMAFAGNCGVKLNIDSEDSSLLQALFAEELGLLLEVHLKDLSVVKQKLQAGGISANVIGKVTASPDIELVVDGRLHLKEKTSDLRDIWEETSFQLEGLQRLKSCVRLEKEGLKHRTSPSWSLSFTPKFTDEKLLTASSKPKVAILREEGSNGDREMAAAFYAAGFEPWDITMSDLLAGKSSLEDYRGIAFVGGFSYADVLDSAKGWAASIRFNQPLIQQFQNFYNRPDTFSLGVCNGCQLMALLGWVPGSDVGGSLGSGGDMSQPRFIHNESGRFECRFTSVSIGASPAIMFKGMEGSTMGIWSAHGEGRAFFPDENVLASVVKSNLAPVRYCDDANNITEVYPFNPNGSPLGIAALCSPDGRHLAMMPHPERCFMMWQYPWSPKDWQLEKSGPSPWLRMFQNAREWCS

SEQ ID NO: 5476 - protein, 1275 aa, Triticum aestivum
KLATLKWLLAETYEPDNLQTGSLLEEEVSMSPYSFLVEVGPRMTFSTAFSTNAVSICKALSLMEVTRLERSRRYLLCLQPGSDPLDESQLNSFAALVHDRMTECVYPSKLTSFRSDVVPEPVSVIPVMEKGREALEEINLKMGLAFDEQDIKYYTHLFRDDIKRNPTTVELFDIAQSNSEHSRHWFFNGKLEIDGETMPSTLFQLVKSPLKANPNNSIIGFKDNSSAIKGTLVNHLRPALPGSTSPLSLMMRELGILFTAETHNFPCAVAPYPGAETGAGGRIRDTHATGKGSFVVASTAGYCVGNLQIEESYAPWEDSSFSYPSNLASPLQILIDASDGASDYGNKFGEPLIQGFTRNFGSRLPNGERREWLKPIMFSGAIGQIDHAHISKGDPEIGMLVVKIGGPAYRIGMGGGAASSMVSGQNDAELDFNAVQRGDAEMAQKLYRVIRACAEMGEKNPIISIHDQGAGGNCNVVKEIIYPKGAEIDIRSIVVGDHTLSVLEIWGAEYQEQDALLVKPESRNLLQSLCERERVSMAVLGEIDGSGKIVLIDGAAVEHAKLSGLPPPLPVVDLELEKVLGDMPQKTFEFKRVSRSSEPLDIAPEVTLMDVLKRVLKLPSVCSKRFLTTKVDRCVTGLVAQQQTVGPLQLPLADVAVIAQTYTDLTGGACAIGEQPIKGLLNPEAMARLAVGEALTNLVWAKVTSLADVKASGNWMYAAKIDGEGADMYDAAVAMADCMIQLGIAIDGGKDSLSMAAQCDGELVKAPGNLVISAYVTCPDITLTVTPDLKLGKDGVLLHVDLAKGKRRLGCSALAQAFDQIGNDCPDIEDVPYLKKVFEVVQELLSERLISAGHDISDGGLIVTILEMAFAGNCGVNLNIESKDNDLLQTLFAEELGLVIEVHLDDLDLVKQKLNAAGVSADVIGQVTAAPEIELLVDGEVRLKERTSDLRDLWEETSFQLEELQRLKSCVKLEKEGLKSRTSPLWHLSFTPKFTDKKLLSASSKPKVAIIREEGSNSDREMSAAFHAAGFEPWDITMSDLLNQKASLTEFRGIAFVGGFSYADVLDSAKGWAASIRFNQPLIQQFQEFYNRPDTFSLGVCNGCQLMALLGWVPGPDIGGSLGAGGDMSQPRFTHNESGRFDCRFISVAIGDSPSIMFKGMEGSTLGIWSAHGEGRAFFPDENVLSDVVKSNLAPLRYCDDANNVTEVYPFNPNGSPLGIAALCSPNGRHLALMPHPERSFMMWQYPWYPKEWQVEKSGPSPWLRMFQNAREWCS

SEQ ID NO: 5477 - protein, 1418 aa, Sorghum bicolor
MASPGQMTASNLLRTEGFPGNMGKRCGLIPARSLGSRRLRMTQHCFHQQHICWPRLQRVMTRNIRLPSSPGAVASKGFDSPLVEKPDTALDVGIIHLYRIPFLQGSETMELLRKVKAKVSANIVDILTEQCFNIQLDNPLTPEKLSTLHWLLAETYEPEKLQTRSFLEDEESRNSCTVIVEVGPRMTFSTAFSTNAVSICKSLSLVEVTRLERSRRYLLCLEPGSDPLDESQLKEFTALVHDRMTECIYPNKLTSFQSDVVPEPVHVVPVIERGEKALEEINVRMGLAFDKQDIDYYTHLFRDDIKRNPTTVELFDIAQSNSEHSRHWFFNGKLVIDGEIMPATLFQLVKSPLKANPNNSVIGFKDNSSAIKGFPVNQLRPTIPGFTSPLSIIMRELDILFTAETHNFPCAVAPYPGAETGAGGRIRDTHATGKGSFVVASTAGYCVGNLRIDNSNAPWEDPSFSYPVNLASPLQILVDASDGASDYGNKFGEPLIQGYTRTFGMRLLNGERREWLKPIMFSGAIGQIDHAHISKDDPEIGMLVVKIGGPAYRIGMGGGAASSMVSGQNDAELDFNAVQRGDAEMAQKLYRVVRACAEMGESNPIISIHDQGAGGNCNVVKEIIYPKGAEIDIRSIVVGDHTLSVLEIWGAEYQEQDALLVKPESRSLLESLCERERVSMAVIGKIDGCGKIVLIDSAAVEHSKLNGLPPPTPVEELELEKVLGDMPQKTFEFRRVSQVTEPLDIAPGVTLLDALKRVLRLPSVCSKRFLTTKVDRCVTGLVAQQQTVGPLQLPLADVAVIAQTYTDLTGGACSIGEQPIKGLLNPKAMARLAVGEALTNLVWAKVTSLADVKASGNWMYAAKLDGEGADMYDAAVALADCMIELGIAIDGGKDSLSMAAQCDGEVVKAPGNLVISTYVTCPDITLTVTPDLKLGKDGVLLHIDLAKGNRRLGGSALAQAFDQIGNDCPDIDDVLYLKKVFEAIQELLSQRLISAGHDISDGGLIVSVLEMAFAGNCGFKLDIDLEDRSLIEGLFAEELGLIIEVHSKYLNIVKQKLEIAGISANVIGEVTTSPEIEVFVDGNLHLKEKTSDLRDLWEETSFQLEELQRLKSCVKLEKEGLKCRTSPSWSLSFTPKFTDGKLLTASSKPKVAIIREEGSNGDREMAAAFHAAGFEPWDITMSDLLAGKSSLKEFRGIAFVGGFSYADVLDSAKGWAASIRFNQPLIQQFQDFYHRPDTFSLGVCNGCQLMALLGWVPGPRVGGSLGTGGDMSQPRFIHNESGRFECRFTSVSIGDSPAIMFKGMEGSTLGVWSAHGEGRAFFPDENVLATVVKSNLVPVRYCDDSNNITETYPFNPNGSPLGIAALCSPDGRHLAMMPHPERCFMMWQYPWYPKEWQVEKSGPSPWLRMFQNAREWCS

SEQ ID NO: 5478 - protein, 1418 aa, Setaria italica
MASPGQMMASNLLRTEGFPGNMGKKSGLIAARSLGSRRLRMTRHCFHQQHLCWPRALRVAVHNIRLSSCPGAVVSKGFDSPLVDNSDTALDVGIIHLYRIPFLQESETMELLRKVKAKVSANIVDIMTEQCFNVQLDNPLTSEKLSTLHWLLAETYEPEKLLTRSFLEEEVSGSSCTVIVEVGPRMAFSTAFSTNAVSICKSLSLVEVTRLERSRRYLLRLEPGSGPLDENQLKEFVLLVHDRMTECVYPNKLTSFQSEVVPEPVRVVPVIERGKEALEEINVKMGLAFDKQDIDYYTHLFRDDIKRNPTTVELFDIAQSNSEHSRHWFFNGKLVIDGETMPNTLFQLVKRPLKANLNNSVIGFKDNSSAIKGFPVNQLRPTIPGSTSPLSIMMRELDILFTAETHNFPCAVAPYPGAETGAGGRIRDTHATGKGSFVVASTAGYCVGNLRIDNAYTPWEDPSFSYPVNLASPLRILVDASDGASDYGNKFGEPLIQGYTRTFGMRLLNGERREWLKPIMFSGAIGQIDHAHISKGDPEIGMLVVKIGGPAYRIGMGGGAASSMVSGQNDAELDFNAVQRGDAEMAQKLYRVVRACAEMGENNPIISIHDQGAGGNCNVVKEIIYPKGAEIDIRSIVVGDHTLSVLEIWGAEYQEQDALLVKPESRSLLESLCQRERVSMAVIGKIDGCGKIVLIDSAAMEHAKLNGLPPPTPVEELELEKVLGDMPQKTFEFKRVSQVTEPLDIAPEVTLLDALKRVLRLPSVCSKRFLTTKVDRCVTGLVAQQQTVGPLQLPLADVAVIAQTYTDLTGGACSIGEQPIKGLLNPKAMARLAVGEALTNLVWAKVTSLADVKASGNWMYAAKLDGEGADMYDAAVALADCMVELGIAIDGGKDSLSMAAQCDGEVVKAPGNLVISTYVTCPDITLTVTPDLKLGKDGILLHIDLANGNRRLGGSALAQAFDQIGNDCPDVDDVGYLKKVFEAIQELITQRLISAGHDISDGGLIVSALEMAFAGNCGFKLDIDLEGRSLLEGLFAEELGLVIEVHSEYLDIVKQKLEAAGVSANVIGEVTSSPEIKVFVDGNLHLKEKTSDLRDLWEETSFQLEELQRLKACVKLEKEGLKIRTSPSWSLSFTPKFTDEKLLIASSKPKVAIIREEGSNGDREMAAAFHAAGFEPWDITMSDLLAGKSSLTEFRGIAFVGGFSYADVLDSAKGWAASIRFNQPLIQQFQDFYHRPDTFSLGVCNGCQLMALLGWVPGSDVGGSLGIGGDMSQPRFIHNESGRFECRFTSVSIGNSPAIMFKGMEGSTLGVWSAHGEGRAFFPDENVLATVVQSNLAPVRYCDDANNITETYPFNPNGSPLGIAALCSPDGRHLAMMPHPERCFMMWQYPWYPKEWQVEESGPSPWLRMFQNAREWCS

SEQ ID NO: 5479 - protein, 1418 aa, Panicum virgatum
MASPGQMTASNLLHTKGFPGNMGKQYGLIGARSLGSRSLRMSQRCFHQQHLCWPRAQRVMVRNIRMSSSPGTVVSEGFDSPLVEKSDSALNGGIIHLYRIPFLQESETMELLKKVKAKVSANIADIMTEQCFNIQLDNPLTPEKLSTLHWLLAETYEPEKLQTRSFLEEEVSRISSAVIVEVGPRMTFSTAFSSNAVSICKSISLVEVARLERSRRYLLRLEPGSDPLDESQLKEFSALVHDRMTECVYPNKLTSFQSDVVPEPVRVVPVIERGKEALEEINVKMGLAFDKQDIDYYTHLFRDDIKRNPTTVELFDIAQSNSEHSRHWFFNGKLLIDGETMPNTLFQLVKRPLKANPNNSVIGFKDNSSAIKGFPVNQLRPTIPGSTSPLSIMMRELDILFTAETHNFPCAVAPYPGAETGAGGRIRDTHATGKGSFVVASTAGYCVGNLRIESSYAPWEDPSFSYPVNLASPLQILVDASDGASDYGNKFGEPLIQGYTRTFGMRLLNGERREWLKPIMFSGAIGQIDHAHISKGDPEIGMLVVKIGGPAYRIGMGGGAASSMVSGQNDAELDFNAVQRGDAEMAQKLYRVVRACAEMGENNPIVSIHDQGAGGNCNVVKEIIYPKGAEIDIRSVVVGDHTLSVLEIWGAEYQEQDALLVKPESRSLLESLCQRERVSMAVIGKIDGCGKIVLIDSAAVEHAKLNGLPPPNPVEELELEKVLGDMPQKTFEFKRVSQVTEPLEIAPEVTLLDTLKRVLRLPSVCSKRFLTTKVDRCVTGLVAQQQTVGPLQIPLADVAVIAQTYTDLTGGACSIGEQPIKGLLNPKAMARLAVGEALTNLVWAKVTSLADVKASGNWMYAAKLDGEGADMYDAAVALADCMIELGIAIDGGKDSLSMAAQCDGEVIKAPGNLVISTYVTCPDITLTVTPDLKLGNDGILLHIDLAKGNRRLGGSALAQAFDQIGNDCPDIDDVPYLKKVFEAIQELITQRLISAGHDISDGGLIVSVLEMAFAGNCGLKLDIDLEDRSLLEGLFAEELGLVIEVKSQYLNVVKQKLEAAGVSANVIGEVTSSPDIEVFVDGNLHLKEKTSDLRDLWEETSFQLEESQRLKSCVKLEKEGLKSRTSPSWSLSFTSKFTDENLLIASLKPKVAIIREEGSNGDREMAAAFHAAGFEPWDITMSDLLAGKSSLTDFRGIAFVGGFSYADVLDSAKGWAASIRFNQPLIQQFQDFYHRPDTFSLGVCNGCQLMALLGWVPGSDIGGSLGLGGEMSQPRFIHNKSGRFECRFTSVSIGNSPAIMFKGMEGSTLGVWSAHGEGRAFFPDEDVLATVVKSNLAPVRYCDDANNITETYPFNPNGSPLGIAALCSPDGRHLAMMPHPERCFMMWQYPWYPKEWQVEKSGPSPWLRMFQNAREWCS

SEQ ID NO: 5480 - protein, 1418 aa, Panicum virgatum
MASPGQMTSSNLLHTKGFPGNMGKRYGLIGATSLGSGRLRMSQRCFHQQHLFWPRAQRVKVLNIRMSSSPGAVASKGFDSPLVEKSDSALNGGIIHLYRVPFLQESETMELLKKVKAKVSASIADIMTEQCFNIQLDNPLTPEKLSTLHWLLAETYEPEKLQTRSFLEEEVSGSSSAVIVEVGPRMTFSTAFSSNAVSICKSISLVEVTRLERSRRYLLRLEPGSDPLDEIQLKEFAALVHDRMTECVYPNKLKSFQSDVVPEPVRVVPVIERGKEALEEINVRMGLAFDKQDIDYYTHLFRDYIKRNPTTVELFDIAQSNSEHSRHWFFNGKLLIDGETMPNTLFQLVKRPLKANPNNSVIGFKDNSSAIKGFPVNQLRPTIPGSTSPLSIMMRELDILFTAETHNFPCAVAPYPGAETGAGGRIRDTHATGKGSFVVASTAGYCVGNLRIESSYAPWEDPSFSYPVNLASPLQILVDASDGASDYGNKFGEPLIQGYTRTFGMRLLNGERREWLKPIMFSGAIGQIDHAHISKGDPEIGMLVVKIGGPAYRIGMGGGAASSMVSGQNDAELDFNAVQRGDAEMAQKLYRVVRACAEMGQNNPIISIHDQGAGGNCNVVKEIIYPEGAEIDIRSIVVGDHTLSVLEIWGAEYQEQDALLVKPESRSLLESLCQRERVSMAVIGKIDGCGKIVLIDSAAVEHAKLNGLPPPNPVEELELEKVLGDMPQKTFEFKRVSQVTEPLDIAPEVTLLDALKRVLRLPSVCSKRFLTTKVDRCVTGLVAQQQTVGPLQIPLADVAVIAQTYTDLTGGACSIGEQPIKGLLNPKAMARLAVGEALTNLVWAKVTSLADVKASGNWMYAAKLDGEGADMYDAAVALADCMIELGIAIDGGKDSLSMAAQCDGEVVKAPGNLVISTYVTCPDITLTVTPDLKLGNDGILLHIDLAKGNRRLGGSALAQAFDQIGNDCPDIDDVPYLKKVFEAIQELITQRLISAGHDISDGGLIVSVLEMAFAGNCGLKLDIDLEDRSLLEGLFAEELGLIIEVNSEYLNVVKQKLEAASVSANVIGEVTSSPDIEVFVDGNLHLKEKTSDLRDLWEETSFQLEELQRLKSCVKLEKEGLKSRTSPSWSLSFTPKFTDENLLIASSKPKVAIIREEGSNGDREMAAAFHAAGFEPWDITMSDLLAGKSSLMDFRGIAFVGGFSYADVLDSAKGWAASIRFNQPLIQQFQDFYHKPDTFSLGVCNGCQLMALLGWVPGSDIGGSLGLGGEMSQPRFIHNESGRFECRFTSVSIGNSPAIMFKGMEGSTLGVWSAHGEGRAFFPDENVLAAVVKSNLAPVRYCDDGNNITETYPFNPNGSPLGIAALCSPDGRHLAMMPHPERCFMMWQYPWYPKEWQVEKSGPSPWLRMFQNARDWCS

SEQ ID NO: 5481 - protein, 1340 aa, Setaria italica
MTGSNIIHLRCFPSNMLCTHQRSGFIPGRNRRSRMTPYCLDLRHLCQLPTQSVNVPNIRPLPTSTAAVSRGINTPLVEESVSEPFLQENEYEELLRKVQEKVACNIVGIRTEQCFNVELEKALTPEKLATLKWLLAETYEPEKLQTCRFLEGEVCGSPYSVIVEVGPRMAFSTAFSTNAVSICKALSLTEVARLERSRRYHLSLQPGTLLHDRMTEYVHPGKLTSFQSDLVPEPVSAIPVIERGREALEEINVKMGLAFDEQDIKYYTHLFRDDIKHNPTTVELFDIAQSNSEHSRHWFFNGKLVIDGETMARTMFQLVKSPLKANPNNSVIGFKDNSSAIKGYQVNQLHPALPGSTSPLSLMMRELDILFTAETHNFPCAVAPYPGAETGAGGHIRDTHATGRGSFVVASTAESNAPWENPSFSYPSNLASPLQILIDASDGASDYGNRFGEPLIQGFTRNFGTRLPNGERREWLKPIMFSGAIGQIDHAHILKGDPEIGMLVVKIGGPAYRIGMGGELDFNAVQRGDAEMAQKLYRIIRACAEMGEKNPIISIHVQGAGENCNVVKEIIYPKGAEIDIRSIVVGDHTLSVLEIWGAEYQEQDVLLVKPESRRLLESFCERERVSMAVFGEIDGSGKIVLTDSAAVEQAKLTGLPSPPPVVDLELEKVLGDMPQKTFEFNRVPRLGKPLDIAPEVMVMDVLKRILKLPSICSKRFLTTKVDRCVTGLVAQQQTVGPLQLPLADVAVIAQTYTDLTGGACAIGEQPIKGLLNPKAMGRLAVGEALTNLVWAKVSSLADVKASGNWMYAAKLDGEGADMYDAGVALADCMIELGIAIDGGKDSLSMAAQCDGEVVKAPGNLVISAYVACPDITLTVTPDLKLVFDQIGNDCPDIEDIPYLKKVFDAVQELLSERLISAGHDISDGGPIVTVLEMAFAGNCGVNLNIGLGDYDLLPVLFAEELGLILEVHSNDLNVVKQKLHAAGVSTNVIGKVTTAQQTDLVVDGEVRLKEKTSDLRDLWEETSFQLEELPPLKSCVKLEKEGLKSRTSPSWRLSFTPKFTEKKLLTTAIKPKVAIIREEGSNSDREMSAAFHAAGFEPWDITMSDLLTQKISLTEFRGLAFVGGFSYADVLDSAKRWAASIRFNQPLIQQFQEFYNRPDTFSLGVCNGCQLMALLGWVPGPDVGGSLGVGGDISQPRFIHNESGRFECRFTSVAIGDSPAIMFKGMEGSTLGIWSAHGEGRAFFPDENILSGIVKSNLAPLRYCDDSNNVTEVYPFNPNGSPLGIAALCSPDGMHLAMMPHPERSFMMWQYLWYPKEWQVEKSGPSPWLRMFQNAREWCS

SEQ ID NO: 5482 - protein, 1418 aa, Zea mays
MASPGQMTASNLLRTEGFPGNMVKICGLNPARSLGSRRLRMTQHSFHQQHLCCPRLQRVMTHNIRLLSSPGAVASKGFDSPLVEKPDTASDVKIIHLYRIPFLQESETMELLRKVKAKVSANIVDILTEQCFNIQLDNSLTPEKLTMLHWLLAETYEPEKLQTRSFLEDEVSRNSCTVIVEVGPRMTFSTAFSTNAVSICKSLSLVEVTRLERSRRYLLCLEPGSDPLDEGQLKEFTALVHDRMTECIYRNKLTSFQSDVVPEPVCIVPVIERGEEALKEINVKMGLAFDKQDIDYYTHLFRDDIKRNPTTVELFDIAQSNSEHSRHWFFNGKLVIDGETMPTTLFQLVKSPLKANLNNSVIGFKDNSSAIKGFPVNQLRPTIPGFTSPLSIIMRELDILFTAETHNFPCAVAPYPGAETGAGGRIRDTHATGKGSFVVASTAGYCVGNLRIDNSNAPWEDPSFSYPVNLASPLQILVDASDGASDYGNKFGEPLIQGYTRTFGMRLLNGERREWLKPIMFSGAIGQIDHAHISKGDPEIGMLVVKIGGPAYRIGMGGGAASSMVSGQNDAELDFNAVQRGDAEMAQKLYRVVRACAEMGESNPIISIHDQGAGGNCNVVKEIIYPKGAEIDIRSIVVGDHTLSVLEIWGAEYQEQDALLVKLESRSLLESLCERERVSMAVIGKIDGSGKIVLIDSAAVEYSKLNDLPPPTPVEELELEKVLGDMPQKTFEFRRVSQVTEPLDIAPGVTLLDALKRVLRLPSVCSKRFLTTKVDRCVTGLVAQQQTVGPLQLPLADVAVIAQTYTDLTGGACSIGEQPIKGLLNPKAMARLAVGEALTNLVWAKVTSLADVKASGNWMYAAKLDGEGADMYDAAVALADCMIELGIAIDGGKDSLSMAAQCDGEVIKAPGNLVISTYVTCPDITLTVTPDLKLGEDGILLHIDLAKGNRRLGGSALAQAFDQIGNDCPDIDDVLYLKKVFEAIQELLSQRLISAGHDISDGGLIVCVLEMAFAGNCGFKLDIDLEDRSLIEGLFAEELGLIIEVHSKYLNIVKQKLEIAGISANVIGEVTNSPEIEVFIDGNLHLKEKTSDLRDLWEETSFQLEELQRLKSCVKLEKEGLKCRTSPSWSLSFTPKFTDGKLLTASLKPKVAIIREEGSNGDREMAAAFHAAGFEPWDITMSDLLAGKSSLKEFRGIAFVGGFSYADVLDSAKGWAASIRFNQPLIQQFQDFYHRPDTFSLGVCNGCQLMALLGWVPGSGVGGSLGTGGDMSQPRFIHNESGRFECRFTSVSIGDSPAIMFKGMEGSTLGVWSAHGEGRAFFPDENVLATVVKSNLAPVRYCDDSNNITETYPFNPNGSPLGIAALCSPDGRHLAMMPHPERCFMMWQYPWYPKEWQVEKSGPSPWLRMFQNAREWCS

SEQ ID NO: 5483 - protein, 1439 aa, Sorghum bicolor
MASPVQMMASNLLRTEGFSGNMGQRYGLIAARSLGLRRLRMTQHCFHQQHLCWRHVQSGVVHNIRSSSSPGAVVSKGFDSPLVEKPDTSLDVGIIHLYRVPFLQESETMELLKKVKAKVSANIVDILTEQCFNIQLDNPLTPEKLSTLHWLLAETYEPDKLQSRSFLEEEESSSSYAVIVEVGPRMTFSTAFSTNAVSICKSLSLVEVSRLERSRRYLLRLEPGSDPLDESQLKEFAALVHDRMTECIYPKKLTSFQSDIVPEPVRVVPVIERGEEALEEINVKMGLAFDKQDIDYYTHLFRDDIKRNPTTVELFDIAQSNSEHSRHWFFNGKLVIDGQTMPATLFQLVKRPLKANPNNSVIGFKDNSSAIKGFPVNHLRPTIPGSTSPLSIMMRELDILFTAETHNFPCAVAPYPGAETGAGGRIRDTHATGKGSFVVASTAGYCVGNLRIDNSNAPWEDPSFSYPVNLASPLQILVDASDGASDYGNKFGEPLIQGYTRTFGMRLPNGERREWLKPIMFSGAIGQIDHAHISKCDPEIGMLVVKIGGPAYRIGMGGGAASSMVSGQNDAELDFNAVQRGDAEMAQKLYRVVRACAEMGENNPIISIHDQGAGGNCNVVKEIIYPKGAEIDIRSIVVGDHTLSVLEIWGAEYQEQDALLVQPGSRSLLESLCDRERVPMAVIGKIDGCGKIVLIDSAAVEHAKLNGLPPPPPVEELELEKVLGDMPQKTFEFKRVSHATEPLDIAPEVTLLDALKRVLRLPSVCSKRFLTTKVDRCVTGLVAQQQTVGPLQLPLADVAVIAQTYTDLTGGACSIGEQPIKGLLNPKAMARLAVGEALTNLVWAKVTSLSDVKASGNWMYAAKLDGEGADMYDAAVALADCMIELGIAIDGGKDSLSMAAQCDGEVVKAPGNLVISTYVTCPDITLTVTPDLKLGNDGILLHIDLSKGNRRLGGSALAQAFDQIGNDCPDIDDVLYLKKVFEAIQELLSQRLISAGHDISDGGLIVSVLEMAFAGNCGFKLDIDLEDRSLLEGLFAEELGLVIEVHSKCLNIVKQKLEATGISANVIGEVTCSPEIEVFVDGNLHLKEKTSDLRDLWEETSFQLEELQRLKSCVKLEKEGLKCRTSPSWSLSFTPKFTDEKLLIASSKPKVAIIREEGSNGDREMAAAFHAAGFEPWDITMSDLLAGKSSLTEFRGIAFVGGFSYADVLDSAKGWAASIRFNKPLIQQFQDFYHRPDTFSLGVCNGCQLMALLGWVPGSDVGGSLGKGGDMSQPRFIHNESGRFECRFTNISPSPGFIHNESGRFECRFTSVSIGDSPAIMFKGMEGSTLGVWSAHGEGRAFFPDENVLSTVVKSNLAPVRYCDDFNNITETYPFNPNGSPLGIGALCSPDGRHLAMMPHPERCFMMWQYPWYPKEWQVEKSGPSPWLRMFQNAREWCS

SEQ ID NO: 5484 - protein, 226 aa, Panicum virgatum
METTSSTNEHTGRGTMWELERNLDQPMDAEAGRLRNMYREKTYPTLVLLQLAFQSLGVVFGDLGTSPLYVFYNIFPREIEDTEQVIGALSLIIYSLTLIPLVKYVFIVLRANDNGQGGTFALYSLLCRHAKINTIPNQHRTDEDLTTYSRHIYDEKSLAAKIKRWLEGHQFRKNAILILVLFGTCMAVGDGILTPAISVLSATGGIQVEEPKMRNDVGCHRLCGSY

SEQ ID NO: 5485 - protein, 787 aa, Panicum virgatum
METTSSTNEHTGRGTMWELERNLDQPMDAEAGRLRNMYREKTYPTLVLLQLAFQSLGVVFGDLGTSPLYVFYNIFPREIEDTEQVIGALSLIIYSLTLIPLVKYVFIVLRANDNGQGGTFALYSLLCRHAKINTIPNQHRTDEDLTTYSRHIYDEKSLAAKIKRWLEGHQFRKNAILILVLFGTCMAVGDGILTPAISVLSATGGIQVEEPKMRNDVVVIVSVVILIGLFSMQHFGTDKVSWLFAPIVFVWYILIGILGAVNISKYDQSVLKAFNPIYVYRYFKRGKTSWASLGGIMLSITGTEALFADLSYFPVQAIQIAFTVVVFPCLLLQYTGQAAYIAQNRSSVVHAFYYSLPDSVRWPSFIVATAAAVVASQATISMTYSIIKQALALGCFPRVRIIHTSKKYLGQIYSPDINWILLIFCIAVTAGFKNQSQIANAYGTAVIMVMLVTTFLMVPIMLLVWRSHWSLVVLFTALSLVVEIPYFSAVVRKIDQGGWVPLVFAVAFLIIMYIWHYGTLKRYEFEMHSKVSMAWILGLGPSLGLVRVPGMGLVYTELASGVPHIFSHFITNLPAIHSTLVFVCVKYLPVYTVPPDERFLVKRIGPKNFHMFRCVARYGYKDIHKKDDDFEQMLFNSLMLFVRLESMMEEYTDSDEYSTRELNQAGNANPRINGINASSNMDLSYTSHDSIIQVQSPNHTGNSQAMSSGQTYQTVGDEIAFLNACREAGVVHILGNTIIRARRDSGFLKKFAINYMYAFLRKICRENSVIFNVPHESLLNVGQVFYV

SEQ ID NO: 5486 - protein, 789 aa, Panicum virgatum
METTSSTNEHTGRGTMWELERNLDQPMDAEAGRLRNMYREKTYPTLVLLQLAFQSLGVVFGDLGTSPLYVFYNIFPGESEIKDTEQVIGALSLIIYSLTLIPLVKYVFIVLRANDNGQGGTFALYSLLCRHAKINTIPNQHRTDEDLTTYSRHIYDEKSLAAKIKRWLEGHQFRKNAILILVLFGTCMAVGDGILTPAISVLSATGGIQVEEPKMRNDVVVIVSVVILIGLFSMQHFGTDKVSWLFAPIVFVWYILIGILGAVNISKYDRSVLKAFNPVYVYRYFKRGKTSWVSLGGIMLSITGTEALFADLSYFPVQAIQIAFTVVVFPCLLLQYTGQAAYIAQNRNSVVHAFYYSLPDSVRWPSFIVATAAAVVASQATISMTYSIIKQALALGCFPRVRIIHTSKKYLGQIYSPDINWILLIFCIAVTAGFKKQSQIANAYGTAVIMVMLVTTFLMVPIMLLVWRSHWSLVILFTALSLVVEIPYFSAVVRKIDQGGWVPLVFAGAFLIIMYVWHYGTLKRYEFEMHSKVSMAWILGLGPSLGLVRVPGMGLVYTELASGVPHIFSHFITNLPAIHSTLVFVCVKYLPVYTVPPDERFLVKRIGPKNFHMFRCVARYGYKDIHKKDDDFEQMLFNSLMLFVRLESMMEEYTDSDEYSTRELNQAGNANPRINGTNAGSNMDLSYTSHDSIIQVQSPNHTGNSQVMLSGQTYQTVGDEIAFLNACREAGVVHILGNTIIRARRDSGLLKKIAINYLYAFLRKICRENSVIFNVPHESLLNVGQVFYV

SEQ ID NO: 5487 - protein, 787 aa, Sorghum bicolor
METTSTTNEQPGRGAMWELERNLDQPMDAEAGRLRNMYREKTYPTIVLLQLAFQSLGVVFGDLGTSPLYVFYNIFPREIEDTEQVIGALSLIIYSLTLIPLVKYVFIVLRANDNGQGGTFALYSLLCRHAKINIIPNQHRTDEDLTTYSRHTYDEKSLAAKIKRWLEGHQIRKNAILILVLFGTCMAVGDGILTPAISVLSATGGIQVEQPRMRNDVVVIVSVVILIGLFSMQHFGTDKVSWLFAPIVFVWFILIGVLGAVNISKYDQSVLKAFNPIYVYRYFKRGKTSWASLGGIMLSITGTEALFADLSYFPVQAIQIAFTVVVFPCLLLQYTGQAAYIAQNKDHVSHAFYFSLPDSVLWPSFIVATAAAVVASQATISMTYSIIKQALALGCFPRVRIIHTSKKYLGQIYSPDINWILLIFCIAVTAGFKNQSQIANAYGTAVIMVMLVTTFLMIPIMLLVWRSHWTLVILFTTLSLVIEIPYFTAVVRKIDQGGWVPLVFAVAFLIIMYVWHYGTLKRYEFEMHSKVSMAWILGLGPSLGLVRVPGVGLVYTELASGVPHIFSHFITNLPAIHSTLVFVCVKYLPVYTVPLDERFLVKRIGPKNFHMFRCVARYGYKDIHKKDDDFEQMLFNSLMLYIRLESMMEEYTDSDDYSTRELNQAGNANQRINGISTSSNMDLSYTSHDSIIQVQSPNHIGNSQVVSSGQMYQTVGDEIAFLNACRDAGVVHILGNTIVRARRDSGFIKKFAINYMYAFLRKICRENSAIFNVPHESLLNVGQVFYV

SEQ ID NO: 5488 - protein, 787 aa, Zea mays
METTSTTNEQTDRGAMWELERNLDQPMDAEAGRLRNMYREKSYPTLVLLQLAFQSLGVVFGDLGTSPLYVFSNIFPHEIEDTEQIIGALSLVIYSLTLIPLVKYVFIVLRANDNGQGGTFALYSLLCRHAKINTIPNQHRTDEELTTYSRHTYDEKSLAAKIKRWLEGHQFRKNVILILVLFGTCMAVGDGILTPAISVLSATGGIQVEEKKMKNDAVVIVSVVILIGLFSMQHFGTDKVSWLFAPIVFVWFILIGVLGAVNISKYDQSVLKAFNPIYVYRYFKRGKTSWASLGGIMLSITGTEALFADLSYFPVQAIQIAFTVVVFPCLLLQYTGQAAYIAQNKDHVSHAFYFSLPDSVLWPSFIVATAAAIVASQATISMTYSIIKQALALGCFPRVRIIHTSKKYLGQIYSPDINWILLVFCIAVTAGFKNQSQIANAYGTAVIMVMLVTTFLMIPIMLLVWRSHWTLVILFTVLSLFVEIPYFTAVVRKIDQGGWVPLVFAVAFLIIMYVWHYGTLKRYEFEMHSKVSMAWILGLGPSLGLVRVPGVGLVYTELASGVPHIFSHFITNLPAIHSTLVFVCVKYLPVYTVPLDERFLVKRIGPKNFHMFRCVARYGYKDIHKKDDDFEQMLFDSLMLFVRLESMMEEYTDSDEYSTRETNLSGSANPRINGISAGSNMDLSYTSHDSIIQVQSPNYTGNSQAVSPGQLYHTVGDEIAFLNACRDAGVVHILGNTVIRARRDSGFIKKIAINYLYAFLRKICRENSAIFNVPHESLLNVGQVFYV

SEQ ID NO: 5489 - protein, 793 aa, Oryza sativa
METRTNEYSRKGAMWELERNLDQPMDAEAGRLRNMYREKTYPTILLLRLAFQSLGVVFGDLGTSPLYVFYNIFPHGIEDTEQVIGALSLIIYSLTLIPLVKYVFIVLRANDNGQGGTFALYSLLCRHAKINIIPNQHRTDQDLTTYSRRTYEEKSLAAKIQRWLEGHQFRKNLILILVLFGTCMAVGDGILTPAISVLSATGGIQVEEGRMRNDVVVIISVLILIGLFSMQHYGTDKVSWLFAPIVFVWFILIGILGAVNICKYDHSVLKAFNPVYVYRYFKRGKTSWTSLGGIMLSITGTEALFADLSYFPVQAIQIAFTVVVFPCLLLQYTGQAAFIAANTNQVSHAFYISLPAPILWPAFAVATAAAIVASQATISATYSIIKQALALGCFPRVKIIHTSKKYLGQIYSPDINWILMVFCIAVTAGFKNQSQIANAYGTAVIMVMLVTTFLMIPIMLLVWRSHWTLVVAFTVLSLLVEIPYFSAVVRKIDQGGWVPLVFAAGFMIIMYVWHYGTLKRYEFEMHSKVSMAWILGLGPSLGLVRVPGIGLVYTELASGVPHIFSHFITNLPAIHSTLVFVCVKYLPVYTVPPDERFLVKRIGPKNFHMFRCVARYGYKDIHKKDDDFEKMLFDSLILFVRLESMMEEYSDSDEYSTLMMSLPNNPGISNGGVTTTGTNNVMEVMSCTSTHDSIVPVNSRSDDTGSSQVMPASGQMAFQSVGDEIAFLNACRDAGVVHILGNTVIRARRDSGFVKKIVINYMYAFLRKICRENSAIFNVPHESMLNVGQVFYV

SEQ ID NO: 5490 - protein, 785 aa, Secale cereale
METVSTNEDTGKGAMWELEKSLDQPMDAEAGRLRNMYREKTYPTVLMLQLAFQSLGVVFGDLGTSPLYVFYNIFPEEIEDTEQIIGALSLIIYSLTLIPLVKYVFIVLRASDNGQGGTFALYSLLCRHAKISIIPNQHKTDEDLTTYSRQTYDEKSLAAKIKRWLEGNQFRKNVILILVLFGTCMAVGDGILTPAISVLSATGGIKVEEPRMGNDVVVIVSVVILIGLFSMQHYGTDKVSWLFAPIVFVWFILIGVLGAVNIYTYDRSVLKAFNPIYVYRYFKRGKTSWASLGGIMLSITGTEALFADLSYFPVQAIQIAFTTVVFPCLLLQYTGQAAYIATHKDKVSHSFYFSLPARILWPAFAVATAAAIVSSQATISATYSIIKQALAVGCFPRVKIIHTSKKYLGQIYSPDINWILMILCIAVTAGFKNQSQIANAYGTAVIMVMLVTTFLMVPIMLLVWRSHWALVVLFTTLSLVIEIPYLTAVMKKIDQGGWVPLVFAAAILLIMYVWHYGTLKRYEFEMHSKVSMAWILGLGPSLGLVRVPGIGLVYTELASGVPHIFSHFITNLPAIHSTLVFVCVKYLPVYTVPLDERFLVKRIGPKNFHMFRCVARYGYKDIHRKDDDFEKMLFSSLLLFVRLESMMEEYSDSDEYSALDQQELVDEASSDARSAADLSYASRDSIVPVRSPNRLGAMSSAQTTTATPGFETVGDEVAFLNSCRDAGVVHILGNTVIRARRDSGPLKKLAIDYLYAFLRKICRENSAIFNVPHESLLNVGQVFYV

SEQ ID NO: 5491 - protein, 785 aa, Secale cereale
METVSTNEDTGKGAMWELEKSLDQPMDAEAGRLRNMYREKTYPTVLMLQLAFQSLGVVFGDLGTSPLYVFYNIFPEEIEDTEQIIGALSLIIYSLTLIPLVKYVFIVLRASDNGQGGTFALYSLLCRHAKISIIPNQHKTDEDLTTYSRQTYDEKSLAAKIKRWLEGNQFRKNVILILVLFGTCMAVGDGILTPAISVLSATGGIKVEEPRMGNDVVVIVSVVILIGLFSMQHYGTDKVSWLFAPIVFVWFILIGVLGAVNIYTYDRSVLKAFNPIYVYRYFKRGKTSWASLGGIMLSITGTEALFADLSYFPVQAIQIAFTTVVFPCLLLQYTGQAAYIATHNDKVSHSFYFSLPARILWPAFVVATAAAIVSSQATISATYSIIKQALAVGCFPRVKIIHTSKKYLGQIYSPDINWILMILCIAVTAGFKNQSQIANAYGTAVIMVMLVTTFLMVPIMLLVWRSHWALVVLFTTLSLVIEIPYLTAVMKKIDQGGWVPLVFAAAILLIMYVWHYGTLKRYEFEMHSKVSMAWILGLGPSLGLVRVPGIGLVYTELASGVPHIFSHFITNLPAIHSTLVFVCVKYLPVYTVPLDERFLVKRIGPKNFHMFRCVARYGYKDIHRKDDDFEKMLFSSLLLFVRLESMMEEYSDSDEYSALDRQELADEASSDARSAADLSYASRDSIVPVRSPNRLGAMSSAQTTTATPGFETVGDEVAFLNSCRDAGVVHILGNTVIRARRDSGPLKKLAIDYLYAFLRKICRENSAIFNVPHESLLNVGQVFYV

SEQ ID NO: 5492 - protein, 788 aa, Brachypodium distachyon
METISSSTNEHPHKGAMWELERNIDPPMDAEAGRLRNMYRQKTYPTILLLQLAFQSLGVVFGDLGTSPLYVFSNIFPHEIEDTEQIIGALSLIIYSLTLIPLVKYVFIVLRANDNGQGGTFALYSLLCRHAKINIIPNQHRTDEELTTYSRHTYDEKSLAAKIKRWLEGHQFRKNAILILVLFGACMAVGDGILTPAISVLSATGGIQVEEPRMINDVVVIVSVVILIGLFSMQHYGTDKVSWLFAPIVFIWFILIGVLGAVNIYTYDRSVLKAFNPIYVYRYFKRGKTSWASLGGIMLSITGTEALFADLSYFPVQAIQIAFTTVVFPCLLLQYTGQAAYIATYKKNVSHAFYYSLPDRILWPAFAVATAAAIVSSQATISATYSIIKQALAVGCFPRVKIIHTSKKYLGQIYSPDINWILMVLCIAVTAGFKKQSQIANAYGTAVIMVMLVTTFLMIPIMLLVWRSHWTLVVLFTVFSLVVEIPYLTAVMRKIDQGGWVPLVFAVAILLVMYVWHYGTLKRYEFEMHSKVSMAWILGLGPSLGLVRVPGIGLVYTELARGVPHIFSHFITNLPAIHSALVFVCVKYLPVYTVPTDERFLVKRIGPKNFHMFRCVARYGYKDIHKKDDDFEKMLFDSLLLFVRLESMMEEYTDSDEYSALADQQELNEVSSNARSIAELSSYASHDSIVPVRSPENNNGRVMLSGQTTTAAFETVGDEVAFLNSCRDAGVVHILGNTVIRARRDSGLVKKIAINYLYAFLRKICRENSVIFNVPHESLLNVGQVFYV

SEQ ID NO: 5493 - protein, 785 aa, Triticum aestivum
METVSTNEDTGKGAMWELEKSLDQPMDAEAGRLRNMYREKTYPTVLMLQLAFQSLGVVFGDLGTSPLYVFYNIFPEKIEDTEQIIGALSLIIYSLTLIPLVKYVFIVLRASDNGQGGTFALYSLLCRHAKISIIPNQHKTDEDLTTYSRQTYHEKSLAAKIKRWLEGHQFRKNVILILVLFGTCMAVGDGILTPAISVLSATGGIKVEEPRMGNDVVVIVSVVILIGLFSMQHYGTDKVSWLFAPIVFVWFILIGILGAVNIYTYDRSVLKAFNPVYVYRYFKRGKTSWASLGGIMLSITGTEALFADLSYFPVQAIQIAFTTVVFPCLLLQYTGQAAYIATHKDKVSHSFYFSLPERILWPAFVVATAAAIVSSQATISATYSIIKQALAVGCFPRVKIIHTSKKYLGQIYSPDINWILMILCIAVTAGFKNQSQIANAYGTAVIMVMLVTTFLMVPIMLLVWRSHWALVVLFTALSLVVEIPYLTAVMKKIDQGGWVPLVFAAAILLVMYVWHYGTLKRYEFEMHSKVSMAWILGLGPSLGLVRVPGIGLVYTELASGVPHIFSHFITNLPAIHSTLVFVCVKYLPVYTVPLDERFLVKRIGPKNFHMFRCVARYGYKDIHRKDDDFEKMLFSSLLLFIRLESMMEEYSDSDEYSALDQQELIDEASSDARSAADLSYASRDSIVPVRSPNRLGAMSSAQATTATPGFETVGDEVAFLNSCRDAGVVHILGNTVIRARRDSGPLKKLAIDYLYAFLRKICRENSAIFNVPHESLLNVGQVFYV

SEQ ID NO: 5494 - protein, 336 aa, Panicum virgatum
MDSSRSPRLLLLLLPALLAPSSAGVIRLPSGKAGARACAAPPDPAAYDRPVIGIVSHPGDGAGGRISNTTATSYIGASYVKFVEAAGARVIPLVYNEPEERLLEKLSLVNGVLFTGGSEKQGVYFETIKKVFQYVLDRNDAGEPFPLFAQCLGFELVSMIVSKDNNILETFDAHDQASTLQFPSYSFEGTVFQRFDSDLIKKVSTSCLVMQNHMYGISPKRLRENDELSSFFRVLTTSSDENGKVYVSTVQANKYPITCTQWHPEKAIFEWRKPMIPHSEDAVQVTQHFANHFISQARKSPNRPPADKVLDNLIYNYNPTFSGKTSKSFEVVYIFS

SEQ ID NO: 5495 - protein, 339 aa, Saccharum officinarum
MDSRCPHLLLLLPLLLPPSSGVAAAAGVIRLPTGGRAGALACAPRDPAVYDRPVIGIVSHPGDGAGGRISNTTATSYIGASYVKFVEAAGARVIPLVYNEPEERLREKLSLLNGVLFTGGSEKQGVYFETIKKVFQYVLDKNDAGEPFPLFAQCLGFELVSMIVSKDNNILETFDAQNQASTLQFPSYALEGSVFQRFDPDLIKKVSTSCLVMQNHRYGISPKRYRENGALSSFFKILTTSPDENGKVYVSTVQANNYPITCTQWHPEKAIFEWRKPMIPHSEDAVQVTQHFANHFISQARKSPNRPPADKVLDNLIYNYSPTFSGKKSKSFEEVYIFA

SEQ ID NO: 5496 - protein, 221 aa, Panicum virgatum
LPALLAPSSAGVIRLPSGKAGARECAAPPDPAAYGRPVIGIVSHPGDGAGGRISNGTATSYIGASYVKFVEAAGARVIPLVYNEPEERLLEKLSLVNGVLFTGGSEKQGVYFETIKKVFQYVLDRNDAGEPFPLFAQCLGFELVSMIVSKDNNILETFDAHNQASTLQFPTILLKAQCFKDLTLTSSRKLALAVLSCKITDMVYHQSVCERMMNYQVSLDS

SEQ ID NO: 5497 - protein, 209 aa, Pennisetum glaucum
MDDSSRAPHLLLPLLLAALLVLAPSSRAAAEPGVIRLPSGKAGARACAAPPDPAAGYDRPVVGIVSHPGDGAGGRISNGTATSYIGASYVKFVEAAGARVIPLVYNEPEDRLLEKLSLVNGVLFTGGSEKQGVYFETIKKAFQYALDKNDAGEPFPVFAQCLGFELVSMIVSKTIGAKCCGLLFQEDIIISVQFAKTGQWALIVVFLWC

SEQ ID NO: 5498 - protein, 342 aa, Zea mays
MDSRCPHLLLLLPLLLLAALLPPPSSGVPEVIWLPTSGGAGPLSCAPPDPAVYDRPVIGIVSHPGDGAGGRISNTTATSYIGASYVKFVEAAGSRVIPLVYNEPEDRLLEKLSLLNGVLFTGGSEKEGVYFDTIKRVFQYVLDKNDAGEPFPLFAQCLGFELVSMIVSKDNNILEAFDAQDQASTLQFPSYALEGSVFQRFDTDLIKKVSTNCLVMQNHRYGISPRRYRENDALSSFFKILTTSPDENGKVYVSTVQANNYPITCTQWHPEKAIFEWRKPMIPHSEDAVQVTQHFANHFISQARKSPNRPPADKVLDNLIYNYSPTFTGKKSKSFEEVYIFS

SEQ ID NO: 5499 - protein, 344 aa, Sorghum bicolor
MDSRCPNLLLPLLFLAAALAPPSSEATAAPAGVIRLRTSGKRGLQPAPPAPADPAVYDRPVIGIVSHPGDGAGGRISNTTATSYIAASYVKFVEAGGARVIPIIYNEPEEQLLEKLSLVNGVLFTGGSAKQGLYFETIKKVFQYVLDKNDAGEQFPLFAQCLGFELVSMIVSKDNNILEKFDALNQASTLQFPSYDFEGSVFQRFDPDLIKKVSTSCLVMQQHRYGISPRRLQEKDALSSFFKILTTSPDENGKVYVSTVQAHKYPITCTQWHPEKAIFEWRNPVIPHSKDAVQVTQHFANHFISQARKSPNRPPADKVLDYLIYNYSPTGKKLKSFEEVYVFS

SEQ ID NO: 5500 - protein, 333 aa, Brachypodium distachyon
MASPHLLPFLPLLLLLAPSSAATGVIQLPSARACAAPPDPAVYDRPVIGIVSHPGDGASGKISNGTATSYIAASYVKFIESAGARVIPLIYNEPEERLLEKLSLVNGVLFTGGSQKSGIYFETIKKVFQYVVDKNDAGVILPLFAQCLGFELISMIVSKDNNILESFSASNQASTLQFPNYSSLEGSVFERFHPDLIKKLSTSCLVMQNHKYGISPKRLRENGALSSFFRILTTSPDENGEVYVSTVQAQKYPITCTQWHPEKAIFEWGKPMIPHSEDAVQVTQNFANYFVSQARKSPNRPPADKVLDNLIYNYSPTFSGKTSKSFDEVYIFS

SEQ ID NO: 5501 - protein, 337 aa, Oryza sativa
MGSPPPHRLLLLLAVAAVLHRSAAAAEGVIRLPRGRACAAPTDPAAYDRPVIGIVSHPGDGAGGRVSNGTAASYIAASYVKFVESAGARVVPLIYNEPEERLLEKLSLVNGVLFTGGSVKSGPYFETIKKVFQYVLDKNDAGIPFPLFAQCLGFELVSMIVSKDNNILESFSATNQASTLQFPNYSSLEGSVFERFDPDLIKKLSTSCLVMQNHKYGISPKTLRENVALSSFFKILTTSPDENGEVYVSTVQANKYPITCTQWHPEKAIFEFGKQMIPHSEEAVQVTQNFANYFISQARKSQNRPPADKVLDNLIYNYSPTFIGKKSKSFDVVYIFS

SEQ ID NO: 5502 - protein, 335 aa, Pseudoroegneria spicata
  misc_feature (67)..(67): Xaa can be any naturally occurring amino acid
MASPPRHLLPLLLLALLAPSSSAAPGVIRLPRAGACAAPADPAVYDRPVIGIVTHPGDGAAGRIDNXTSTSYIGASYVKFVEAGGARVIPLIYNEPDERLLEKLSLVNGVLFTGGSVKRGPYFETIKKVFQYVLDKNDAGVPFPLFAQCLGFELVSMIVSKDNNILESFHASDQASTLQFPNYSSLQGSVFERFHPDLIKKLSTSCLVMQNHKYGISPKRLRENDALSSFFKILTTSPDENGEVYVSTVEAQKYPITCTQWHPEKAIFEWRKPMIPHSEDAVQVTQNFANYFISQARKSPNRPPADKVLDNLIYNYIPTFSGKTSKSFELVYLFS

SEQ ID NO: 5503 - protein, 336 aa, Triticum aestivum
MASPRHLLPLLLLLALLAPSSSAAAPGVIRLPRAGACATPADPAVYDRPVIGIVTHPGDGAAGRIDNGTSTSYIGASYVKFVEAGGARVIPLIYNEPDERLLEKLSLVNGVLFTGGSVKRGPYFETIKKVFQYVLDKNDAGVPFPLFAQCLGFELVSMIVSKDNNILESFHASDQASTLQFPNYSSLQGSVFERFHPDLIQKLSTSCLVMQNHKYGISPKRMRENDALSSFFKILTTSPDENGEVYISTVEAQKYPITCTQWHPEKAIFEWGKPMIPHSEDAVQVTQNFANYFISQARKSPNRPPADKVLDNLIYNYSPTFSGKTSKSFELVYLFS

SEQ ID NO: 5504 - protein, 332 aa, Avena sativa
PPPLPLLLLLLLAFLAPSSAVPPVIRLPRAGACAAPADPALYDRPVIGIVTHPGDGAAGRIDNGTATSYIGASYVKFVEAGGARVIPLIYNEPEERILEKLSLVNGVLFTGGSVKRGPYFETIKKVFQYVLDKNDAGIPFPLFAQCLGFELVSMIVSKDINILESFHASNQASTLQFPNYSSLEGSVFGSFQPDLIKKLSTSCLVMQNHKWGISPKRYRENGALSSFFKILTTSPDENGEVYVSTVEALKYPITCTQWHPEKAIFEWGKPMIPHSEDAVQVTQNFANYFISQARKSPNRPPADKVQDNLIYNNPPTFSGKTSKSFEQVYLFS

SEQ ID NO: 5505 - protein, 336 aa, Secale cereale
MASPPRHLLPLLLLLALLAPSSSAAPGVIRLPRAGACAAPADPAVYDRPVIGIVTHPGDGAAGRIDNGTSTSYIGASYVKFVEAGGARVIPLIYNEPDERILEKLSLVNGVLFTGGSVKSGPYFETIKKVFQYVLDKNDAGIPFPLFAQCLGFELVSMIVSKDNNILESFHASDQASTLQFPNYSSLQGSVFERFHPDLIKKLSTSCLVMQNHKYGISPKRLRENDALSNFFKILTISPDENGEVYVSTVEAQNYPITCTQWHPEKAIFEWRKPMIPHSEDAVQVTQNFANYFISQARKSPNRPPADKVLDNLIYNYIPTFSGKTSKSFELVYLFS

SEQ ID NO: 5506 - protein, 336 aa, Secale cereale
MASPPQHLLPLLLLLALLVPSSSAAPGVIRLPRAGACAAPADPAVYDRPVIGIVTHPGDGAAGRIDNGTSTSYIGASYVKFVEAGGARVIPLIYNEPDERLLEKLSLVNGVLFTGGSVKSGPYFETIKKVFQYVLDKNDAGVPFPLFAQCLGFELVSMIVSKDNNILESFHASDQASTLQFPNYSSLQGSVFERFHPDLIKKLSTSCLVMQNHKYGISPKRLRENDALSNFFKILTISPDENGEIYVSTVEAQNYPITCTQWHPEKAIFEWRKPMIPHSEDAVQVTQNFANYFISQARKSPNRPPADKVLDNLIYNYIPTFSGKTSKSFELVYLFS

SEQ ID NO: 5507 - protein, 1547 aa, Panicum virgatum
MRAPQERTMRDLYDRTRHKDLAAPEEPAEGRGGGRAEGSGHRELVAKMEDKAAVRKRVVSSNNTRVKAESGTCNVCYAPCSSCLHRSLAVEDSNAECASSQTCSTRSEVRNNSLVRCEKGLRNKGGENDDEFSATSGHVSYSVTGGNNKVFARSSIADDSSEVDMPAKRRRLLNQDTRLSRAEHHDDSNSCVTGTSAEGKVHVDRKKLSTSASSRDLTANDPKDNSMACHSRLRNQCVDESKKGSDVRDLRPSASGRLFPADSPSISTKKLLRTQSSVSASDRLSPNKQDHESGKAHDNLSHQDCEKVSLSKNNIEQRRGGKLNTCVHDGDNQGMLAGYSNGNENKDGFSSKDLDNGTLCPKDEIQEPAGIQSSDGVTRNEGDKKDWDQDCSLDICSDGKLNIQHDMATEGGNSEGLIDVNVCDICGDVGREYLLATCTRCLEGAEHTYCMQVKLDKVPDGEWLCEECEHREDQNNTRSNHGVMAVNMSEGKNQSSESRSKPKALQIVVPELDAPQSTCSTPTAVQCDGKNKKLHLASADTQTRKLKVATPTAERLDVKSKKLLSIANRNKLQVLTSDLDARSHSNGTPTSGGSNKKSQSSEFLLNRKKLRVSTDMESPLSSEGLRSPPISCKRQVENTSSPKPRLFKTDSLRKHDVISHENSFKKANKGGLSSVDNAPVRTTQAGKSSQVFSRSYSMGNMVNAKTPVPSPRGLSKQLSFNNTNNGPKVKQLVEGVSRKLKPAKYSPRDPRDKGPIRKLVQSGSFKREGAVCLDAGSSKQKQTFHLSQDEKPVILKPVKEKNLIERRASFSFKKPNIPSSPRPDSCMKLGERKIDQDISKSVPSILKSSKRPGNVEKKQSSDLSKGDNDKQDVTVHPKPMGVVSGKDAHAHAMKISDPPVPSQCVKKDSSNDVEDDDLFVSVKNSNRMPNGSAEMVPTISTATTCESDLRDVARASTSEDSAPKVVCYQQKLLEITGDDSCKIVEVVQTLGDISNEIPHGVQMAHNLYPPNDILDKPDLKQEAFVYQSSALENPLRDLVIPELSYIWQGRFEVSRHGNSPEMFDGFQAYLSTCASSKAREISEQLPNKIQLAEVPRHSSWPLQFKEVNPTEDNIALFFFAKDVESYRMAYGKLLENMLLGDLSLTANISGTELLIFPSDKLPERSQRWNGSLFFWGIFYARKASSPTEVPLSETNSCPLEQITGPVILHDMGSPKALQSLGIDLNECPNDDISDPVISLESESEKSGASVDHNILLESKQEDRKVNASEIHYEETAGTKKIVPEHPTATPHGTQPPTLSTGEDHDMIPDYPTVAKGSTRTADTNKMEEEDKNKALFCVAQQPGAIRLISDEIKPKKHGILPSIEVSKLHFIGSKICGGPSESIPNSDMSSLDPDLIYKRQKTSYGKNSTCSFGDEMPPSKCLSKIHPLPAGQHTPFDDLQYSYRGPPDPGSLKKSAPDHIIHVLSSDDEDFPEPSTSLNKASLKADESSSPLLSLSLSMVATKHNLSGSDIVDDEPLSLSLGLPSVVEGSRALEMKQFLPEKPGINT

SEQ ID NO: 5508 - protein, 1543 aa, Panicum virgatum
MRAPQERTMRDLYDRTRHKDLAAPEEPAEGRGGGRAEGSGHCELVAKMEEKAAVRKRVVSSNNTRVKAESGTCNVCYAPCSSCLHRSLAVEDSNAECASSQTCSTRSEVRNNSLVRSEKGLRNKGGENDDEFSATSGHVSYSVTGGNNKVFARSSIADDSSEVDMPAKRRRLLNQDTRLSKAEHHDDSNSCVTGTSAGGKVHMDRKKLSTSASSRDLTANDYKDNSMACYSSLRNQCVDESKKGSDLRNLRPSASGRLFPADSPSMSTKKLLQTKSSVSESSRLSPKKQDHESGKAHDNLSHQACEKVSLSNNNIEQRRGGKLNPDGVNQGTLAGYSIGNENKDGFSSKDLDNGTLCPKDGIQEPAGIQSNDGVTRNKGDKQDWDQDCSMDICSDGKLNIQHDMTTEGGNLEGLIDVNVCDICGDVGREYLLATCTRCLEGAEHTYCMRVKLDKVPDGEWLCEECQLREDQNNTSSNHGVMAVNMSEGKNQCSESQSKPKALQIVVPELDAPQSTYSTPTADQCDGKNKKLHLASADTQTRKVKVATPAAERLDVKSKKLLGIANRNKMQVLTSDLDARPHTYGTPTSGGSNKKSQSSEFLLNRKELRVSTDMESPLSSEGLRSPPISCKRQVENTSSPKPRLFKTDSLRKHDVISRDNSFKKSNKGGLSSVDNAPVRITQAGKSSQVLSRSYSLGNMVNAKTPVPSPRGLSKQLSFNNTNNGPKVKQLVEGVSSKLKPAKYSPRDPRDKGPIRKLVQSGSFKREGAVCLDAGSSKQKQTFPLSQDEKPVILKPVKEKNLIERRASFSFKKPNIPSSPRPDSCMKLGERKIDQDISKSVPIILKSSRRPGNVEKKQSSDLSKGDNDKQDVTVHPKPMGVVSGKDAHAMKISDPPVPSQCVKKDSSNDVEDEDLFVSVKNGNRMPNGSAEMVPTISTATTCESDLLDVARASTSEDSAPKVVCFQQKLLESTGDDSCKIVEVAQASGDINMLNEVPHCVQMAHNLYPTNNKLDKPDLKQQAFVDQSSALENPLRDLVIPELSYIWQGSFEVSRHGNSPEMFDGFQAYLSTCASSKAHEIGEQLPDKIQLAEVPRHSSWPPQFKEVNPTEDNIALFFFAKDVESYAMAYGKLLENMLLGDLSLTANISGTELLIFPSDKLPERIQRWNGLLFFWGVFYDRKASSPTEVPLSERNNCSLEQVTGPVIRHDMGSPKALQSLGIDLNECPNDDISDPAISLGSESEKSGTSVDHNILLESKHEDMKVNASEIHHEETADTKEIVPEHPTAAPYGTQPPTLSTGGHDMIPDYPTAAKGSTRTAGRNKMEEEDQNEAVFCVLQQPGAMRSISNETKPKKHGILPSIEVSKLHFIGSKICGGPSESILNSDTSSLDPDLTYKRQKTSYEKNSTCSFGDQMPPSKCLSKIHPLPAGQHTPFDDLQCSYRGPSDPGSLKKSVPDRIIHVLSSDDEDSPEPSTSLNKASLKADESSSPLLSLSLSMVATKRNLSGSDIVDDEPLSLSLGLPSVVEGSRAPEMKQFLPEKPGINT

SEQ ID NO: 5509 - protein, 593 aa, Zea mays
MEMSAMEEALPKAMERRKGGLRTIPFIILNEIFEKVATFGLSANMILYLTERYLMTNAFATVVLYFWHAFSNFLPILGAVLADARLGRFRVITLGSCVSLFGMCLLWLTAILPVYKNTPECAPGRPVGCAVLPWQLPLLFTSFAFMSLGSGGIRPCTLAFGADQLDKRDNSANNVRTLQTFFNWYYTVLGLSIVFASTVIVYIQQARGWVVGFAVPVVLMVTALTLFLLGSPFYIKAAANSSVVIGFVQVLVASYNNRHEPLPPETADSSSFYNKAGCKPRTPTNKLMYLNRACVLRNPSKEISPDGAACDPWRLCTVQQVEDTKAVIRVLPIWSTGIMPGVVVGQQMFPTLQAKTMERRVGKLEIPPASFGVFAILTLTVWVAVYDRVLVRPLSRLTGHARGLSLRQRMGAGLVLFAVAMAVAAHTESVRRAAALAEGLRDSNPLTGERPVRMSAMNLVPQHCLTGLAEGLNLIGQIEFYYSEFPKTMSSIGVSLLALGLGFGAVLGSAIVGVIDAGTRSGGSHDGWLPSNLNRGHYDYYYLVLAVLCAANVLYFAVCGWAYGDEGQNRVVAADAAVDDVDDKEEEQKAVII

SEQ ID NO: 5510 - protein, 582 aa, Sorghum bicolor
MEVSAMEDAFPKATARRKGGLRTIPFIISNEIFEKVATFGLTANMILYLIERYLMSSAVATEVLYFWNAISNFLPIFGGVLADVRLGRFRVIALGSCVSLCGMCLLCLTAILPVYKKTPECAAGSGCVVLPWQLPLLFTSFALMSLGSGGIRPCTLAFGADQLDKRDNSAKNVRTLQTFFNWYYTVLGLSIVFAATVIVYIQQARGWVVGFAVPVVLMVTALTLFLLGSPFYVKEAADRSVIIGFVQVLVASYKNRREPLPPETADSSSFYNKAGCKPRTPTNKLRYLNRACVLRNPGKVDGAACDPWRLCTVQQVEDAKAVIRVLPIWSTGIMPGVVVGQQMFPTLQAKTMERRVGKLDIPAASFGVFAILTLTVWVAVYDRVLVRPLSRLTGHARGLSLRQRMGAGLALFAVAMAVAAHTESVRRAAAIAQGLLDRGKEKEEPVVHMSAMKLVPQHCLTGLAEGLNLIGQIEFYYSEFPKTMSSIGVSLLALGLGFGAVLGSAIVGVIHAGTAWLPSNLNEGHYDRYYLVLAVLCAANVVYFVVCGWAYGEEGKNRVVAADAAAAEDDQEEEEEHKAGII

SEQ ID NO: 5511 - protein, 480 aa, Panicum virgatum
MMALHEALRNVCLSSDWTYSVFWTIRPRPRCRGGNGCKVGDDNGSLMLMWEDGFCRPRVAECLEDIDGEDPVRKAFIKMSIQLYNYGEGLMGKVASDKCHKWVFKEPSECEPNISNYWQSSFDALPPEWTDQFASGIQTIAVIQAGHGLLQLGSCKIIPEDLHFVLRMRHMFESLGYQSGFFLSQLFSSSRGASPTPPFPLKQPAPPAARPPPQLFNWPGHQPPQLPPAAGASPLFPPGPAAAFHASAARPMPPFPGPGGGKDEAHMFHLPPGHHGGKPPHMDEQQQAMGPGGGEAPDGDLRWPNGLSFFTALTGRADDAKLLFGGPGGGGGGGADDRREGGGGRRADRARRGRERGGVPEPGEPLEQGEEGGERRPDPEHQVQAELHVAGADELLGVDVPVRVGLDGAAAARDGVPRPARGRRLLGPDGDVPGVALVRGMHAWSIERWLNFFKVATRSARFVSFSFFLSLPAPKLCLRF

SEQ ID NO: 5512 - protein, 459 aa, Sorghum bicolor
MVGSGAAAGGGGDHARSKEAAGMMALHEALRNVCLSSDWTYSVFWTIRPRPRCRGGNGCKVGDDNGSLMLMWEDGFCRPRVAECLEDIDGEDPVRKAFIKMSIQLYNYGEGLMGKVASDKCHKWVFKEPSECEPNISNYWQSSFDALPPEWTDQFASGIQTIAVIQAGHGLLQLGSCKIIPEDLHFVLRMRHMFESLGYQSGFFLSQLFSSSRGASPTPPFPLKQQPPPAAARAPQQLFNWAGHHQPQLPPSPGAGASPLFPPGPGAFHPSSAARSMPPYPGGGKDEGGHMFHLPAAHHGSSKPPHMDEHQQTMGPGGEAPDGELRWPNGLSFFTALTGRADDAKLLFGGPGGGAGAADDEKAAADNAQTGHGGAENVEEYLSLESHSNKARKVESAAQSTKFKRSFTLPARMGSSTSPSPSPSVSASTAPAPPQQQGMEYRGPHEGGVYSDLMETFLE

SEQ ID NO: 5513 - protein, 463 aa, Zea mays
MVGSGAAGGGADHARSKEAAGMMALHEALRNVCLSSDWTYSVFWTIRPRPRCRGGNGCKVGDDNGSLMLMWEDGFCRPRVAECLEDMDGEDPVRKAFIKMSIQLYNYGEGLMGKVASDKCHKWVFKEPSECEPNISNYWQSSFDALPPEWTDQFASGIQTIAVIQAGHGLLQLGSCKIIPEDLHFVLRMRHMFESLGYQSGFFLSQLFSSSRGASPTPTPPFPLKQPPAAPAARAPPQLFSWPGHHQPQQLPSPAGASPLFPPGPGAFHPSSARPMPPFPGGKDEGHMFHLPPAAHHGTNKQPPQHMDEHHHHQQQPMVGAGGDAPDGDLRWPNGLSFFTALTGRADDAKLLFGGPGAGAGAADDDDKAAPDAHGGAENVEEYLSLESHSNKARKVESPAAQSTNKFKRSFTLPARMSSSSSTSAFPSVSASTAPPQQQQAGMEYRGPHEGGVYSDLMETFLE

SEQ ID NO: 5514 - protein, 447 aa, Hordeum vulgare
MVGSGAAGGGGGDHARSKEAAGMMALHEALRNVCLNSDWTYSVFWTIRPRPRCRGGNGCKVGDDNGSLMLMWEDGFCRPRMAECLEDMDGEDPVRKAFSKMSIQLYNYGEGLMGKVASDKCHKWVFKEPSECEPNIANYWQSSFDALPTEWTDQFASGIQTIAVIQAGHGLLQLGSCKIIPEDLHFVLRMRHMFESLGYQSGFFLSQLFSSSRGTSSTPSFPLKQPPPPARPPPQLFNWPGQPQLPHAAASPLFPPGPAAFHPSARSSMPHYPGNKDESHMYHLAPSQHGKPPHMDEHQHHQQQMAPGETPDGDLKWPNGMSFFTALTGRSDDPKLLFGGPGGGGGGADDGKPAQDAQTGHGGAENVEEYLSLESHSNKARRMESAQSAKFKRSFTLPARMSSSNSPSPSVSASTGPAPPPQQQQGMEYRAQHEGSVYSDLMETFLE

SEQ ID NO: 5515 - protein, 455 aa, Secale cereale
MVGSGAAGGGGGDHARSKEAAGMMALHEALRNVCLNSDWTYSVFWTIRPRPRCRGGNGCKVGDDNGSLMLMWEDGFCRPRMAECLEDMDGEDPVRKAFSKMSIQLYNYGEGLMGKVASDKCHKWVFKEPSECEPNIANYWQSSFDALPTEWTDQFASGIQTIAVIQAGHGLLQLGSCKIIPEDLHFVLRMRHMFESLGYQSGFFLSQLFSSSRGASSTPSFPLKQPPPARPPPQLFNWPGQPQLPHAAASPLFPPGPAAFHPSARSSMPHYPGGGGNKDESHMYHLAPSQHGKPPHMDEHHQHQQQMQPGETPDGDLKWPNGLSFFTALTGRSDDSKLLYGGPGGGGGGGGGGGGADDGKPAQDAQTGHGGAENVEEYLSLESHSNKARRMENTQSAKFKRSFTLPARMSSSNSPSPSVSASTGPAPQQQQQQGMEYRAQHEGSVYSDLMETFLE

SEQ ID NO: 5516 - protein, 446 aa, Brachypodium distachyon
MVGSGAAGGGGDHARSKEAAGMMALHEALRNVCLNSDWTYSVFWTIRPRPRCRGGNGCKVGDDNGSLMLMWEDGFCRPRVAECLEDIDGEDPVRKAFSKMSIQLYNYGEGLMGKVASDKCHKWVFKEPSECEPNIANYWQSSFDALPTEWTDQFASGIQTIAVIQAGHGLLQLGSCKIIPEDLHFVLRMRHMFESLGYQSGFFLSQLFSSSRGTSPSPSSFPLKQQPPARAVPPQLFNWPGGQPQQQLPHAASPLFPPGPAASFHPSARSPMPHFPGGGAKDESHMYHHLPPSSHSHHANEHHHHHQQQMGEAPEGDLKWPNGLSFFTALTGRADDAKLLFEGGGDGKQQQDAAQTGHGGAENVEEYLSLESNSNKARRMESAQAQSNKFKRSFTLPARMSASTTSTSPSVSASTGPAPPQQQQQGMDQYRAEGGVYSDLMETFLE

SEQ ID NO: 5517 - protein, 434 aa, Zea mays
MVGSGADGGGGGDDARSKEAAGMMALHEALRNVCLDSDWTYSVFWTIRPRPRCRGGNGCMVGDDNGSLMLMWEDGFCRPRVAECLADMSGGEDPVRKAFIKMSIQLYNYGEGLMGKVASDKCHKWVFKEPSECEPNISNYWQSSFDALPPEWTDQFASGIQTIAVIQAGHGLLQLGSCKIIPEDLHFVLRMRHTFESLGYQSGFFLSQLFSSARGASPTPPPPAARPPPAQLFNWPGAHQPQLFPPGPGAFHHPSARAMPPLFPGGGKDEGHMFHIPPAHHGSKPLHMDELQHRHQQTMGAGGEAPDGELRWPNGLSFFTALTGRDDDAKLLFGGPGAADDEKAAPDAQTGHGGAGNVEEYLSLESHSDKAPSKVENGAQHSTKSKRSFTLPARVSSSTTTSPSVSASTAPQGMEYRGTHEGGVYSDLMETFLE

SEQ ID NO: 5518 - protein, 258 aa, Panicum virgatum
MGGSKHIVLVHGACLGGWSWFKVATRLRAAGYRVDAPDLAASGADPRPLREVPTFRDYTAPLLDLLAALPAGDRVVLVGHSLGGLSVALAAELFPDKVAAAVFLCAFMPDCAARPSHVLEKFVEGKWLDWMDTEMKPQDAEGKLPTSMMFGPRILREKFYQLCSPEDITLASSLMRVSSMFVEDLAAQQPFTAGGYGSVRRVYVVCSEDYGIVEGFQRWMVENNPVEEVREIAADHLVMLSRPDELARCLADIADKYA

SEQ ID NO: 5519 - protein, 259 aa, Panicum virgatum
MGGGSKHIVLVHGACLGGWSWFKVATRLRAAGHRVDAPDLAASGVDPRPLREVPTFRDYAAPLLDLLAALPAGDRVVLVGHSLGGVSVALAAELFPDKVAAAVFLCAFMPDCAAPPSHVLEKFVEGKWLDWMDTEMKPQDAEGKLPTSMLFGPRILREKFFQLCSPEDMTLASSLLRVSSLFLEDLAAQQPFTEGGYGSVRRVYVVCSEDYAIVEGFQRWMVENNPVEEVREIAADHLVMLSRPEELARCLADIADKYA

SEQ ID NO: 5520 - protein, 267 aa, Zea mays
MDAPAAAEGCGKHIVLVHGACLGGWSWYKVATLLRAAGYRVDAPDMAASGADPRPLREVPTFRDYTRPLLDLLASLPDGDRVVLVGHSLGGVNVALAAETFPDKVSAVVFLCAFMPDCTARPSHVLEKFIEGKWLDWMDTEMKPQDQDGEGKLPTSMLFGPRIIREKFFQLCSPEDLTLSASLMRVSSMFVEDLALRQPYSKERYGSVRRVYVVCTEDYAIVEGFQRWMVDNSPVDEVKEIAADHVVMLSRPDELVRCLTDIADKYA

SEQ ID NO: 5521 - protein, 195 aa, Panicum virgatum
MVASAAPFTSGFLCPTTKPRTPPLPSSSSRPSRSRLHFRIRSPDPKNPAAAPVSSRMEAAQPQTRDAQGRAESAMKLLFVEMGVGYDQHGQDITAAAVRACKDAISSNSIPAFRGGSIPGVNTDQMKLQIKLGVPRSTQHLLDAERVKAVFPYGEIISFEVVDGGMICSSGVCLEAMGDKNDDCYIVNAAVYVGY

SEQ ID NO: 5522 - protein, 194 aa, Pennisetum glaucum
MVTSAAPFTSGFLYPTKPRTAPLPSSSTTSRSSHSRLHFRIRSPNPKNPAVAPVSSRMEAAQPQDAQGGAESAMKLLFVEMGVGYDQHGQDITAAAVRACKDAISSNSIPAFRGGSIPGVNTDQMKLQIKLGVPKSTQHLLDAERVKAVFPYGEIISFEVVDGGMICSSGVCLEAMGDKNDDCYIVNAAVYVGY

SEQ ID NO: 5523 - protein, 178 aa, Panicum virgatum
SPRTPPPPSSSSRPSRSRPHFRIRSPNPKNPAAAPVSSRMEAAQPQTRDAQGRAESAMKLLFVEMGVGYDQHGQDITAAAVRACKDAISSNSIPAFRGGSIPGVNTDQMKLQIKLGVPRSTQHLLDAERVKAVFPYGEIISFEVVDGGMICSSGVCLEAMGDKNDDCYIVNAAVYVGY

SEQ ID NO: 5524 - protein, 194 aa, Zea mays
MTSAASFPSSLFPFPTRASTPPLPSSSSRPSHSRPHLRIRSPKPNNPTVAPASSRMEVAQPQASNAQGGAEPAMKLLFVEMGVGYDQHGQDITAAAVRACKDAITSNSIPAFRGGSIPGVNTDQMKLQIKLGVPRSTQHLLDAERVKAVFPYGKIISFEVVDGGMICSSGVCLEAMGDKNDDCYIVNAAVYVGY

SEQ ID NO: 5525 - protein, 191 aa, Sorghum bicolor
MASAAAFPSSLFLFPTRPSTPPLPSSSSRPSHSHSRPHLRIRSPPIPNYPAALPASSRMEVAQGGAEEPAMKLLFVEMGVGYDQHGQDITAAAVRACKDAITSNSIPAFRGGSIPGVNTDQMKLQIKLGVPRSTQHLLDAERVKAVFPYGKIISFEVVDGGMICSSGVCLEAMGDKNDDCYIVNAAVYVGY

SEQ ID NO: 5526 - protein, 362 aa, Panicum virgatum
MELHKYWGVGGRRCGGCEAAPAAVHCRSCPAGGAFLCTACDARPGHARLGHERVWMCEVCELAPAAVTCKADAAVLCAACDADIHDANPLARRHARVPVAPIGSEAAAAAVEAMLFGTGEPAASEAEEPQNAAAGHNHQHALNLNVEAKDMKLDYLFSDLDPYLSVDIPRFQHADSVVPSGVGAGAAGTVELDFTCGIGVKPSSYSSYTATSLAHSGSSSEVGVVPEAFCGGGGSFELDFTRPKPQAYMPYTATPQSHSVSSVDVEVVPERGDMMAAARPVPLVGESREARLMRYREKRKNRRFEKTIRYASRKAYAETRPRIKGRFAKRADHDADDAEAEAAVPSPASYVLDFGYGVVPSF

SEQ ID NO: 5527 - protein, 366 aa, Saccharum officinarum
MELHKYWGVGGRRCGSCEAAPAAVHCRTCVGGSFLCTTCDARPAHARLGHERVWMCEVCELAPAAVTCKADAAVLCAACDADIHDANPLARRHARVPVAPIGSEAAAAAVEAMLFGTGEAAAASEADEHNAAAAEQQQHAHAHALNLNVEAKDMKLDYLFSELDPYLSVEIPRFQHADSVVPNGAGAAAVELDFTCGIGVKHSSYSSYTATSLDLAHSGSSSEVGVVPEAFGGGGGSFELDFTRPKPQAYMPYTATPQSHSVSSVDVEVVPERGDLPAVRPVPLMGESREARLMRYREKRKNRRFEKTIRYASRKAYAETRPRIKGRFAKRADHDGDADADDAEAEAAVPSSYVLDFGYGVVPSFA

SEQ ID NO: 5528 - protein, 318 aa, Panicum virgatum
MCEVCELAPAAVTCKADAAVLCAACDADIHDANPLARRHARVPVAPIGSEAAASAVEAMLFGTGDGDPAAPEAEEPQDAAAGHGHGQLQHHHQHALNLNVEAKDMKLDYLFSDLDPYLSVDIPRFQHADSVVPSGVGAGAAAGAVELDFTCGIGVKPSSYSSYTATSFAHSGSSSEVGVVPEAFCGGGAGTFELDFTRPKPQAYMPYTATPQSHSVSSVDVEVAAAERGDMAAARPVPLVGESREARLMRYREKRKNRRFEKTIRYASRKAYAETRPRIKGRFAKRADHDADDAEAEAAVPSPASYVLDFGYGVVPSF

SEQ ID NO: 5529 - protein, 376 aa, Sorghum bicolor
MELHKYWGVGGRRCGSCEAAPAAVHCRTCVGGSSSFLCTTCDARPAHARLAHERVWVCEVCELAPAAVTCKADAAVLCAACDADIHDANPLARRHARVPVAPIGSEAAAAAVEAMLFGTGDAAEADDQHNNAAAAAEQHQHQHHAHHAHALNLNVEAKDMKLDYLFSELDPYLSVEIPRFHHADSVVPNGAGAAGAVELDFTCGIGVKHSSYSSYTATSLDLAHSGSSSEVGVVPEAFGGGGGGGGGSFELDFTRPKPQAYMPYTATPQSHSVSSVDVEVVPERGDLPAVRPVPLMGESREARLMRYREKRKNRRFEKTIRYASRKAYAETRPRIKGRFAKRADHDGDGDADDAEAEAAVPSSYVLDFGYGVVPSF

SEQ ID NO: 5530 - protein, 365 aa, Zea mays
MELHKYWGVGGRRCGSCEGAPAAVHCRTCVGGSFLCTTCDARPAHARLGHERVWMCEVCELAPAAVTCKADAAVLCAACDSDIHDANPLARRHARVPVAPIGSEAAAAAVEAMLFGTGEAAASEADEQHAAAEHAHAHAHALNLNVEAKDMKLDYLFSELDPYLSVEIPRFQHADSVVPNGAGAAVELDFTCGIGVKHSSYSSYTATSLAHSGSSSEVGVVPEAFGGSGSGGGSFELDFTRPKPQAYMPYTGTPQSHSVPSADVEVVPERGDLAAVRPVPLMGESREARLMRYREKRKNRRFEKTIRYASRKAYAETRPRIKGRFAKRADHDGDADADADADAEAEAAVPMSYVLDFGYGVVPSF

SEQ ID NO: 5531 - protein, 372 aa, Pennisetum glaucum
MGSCLGKNAEQAVQGDQDVHSVKVFSYNELRKATQDFSGANKIGEGGFGSVFRGVLKDGTVVAVKVLSATSRQGIREFLTELTAISDIKHENLVTLIGCCAEGSHRILIYNYLENNSLAQTLLGARYSNIRFNWRSRVKIAVGVARGLAFLHEEIRPPIIHRDIKASNILLDKDLTPKISDFGLARLLPPNATHVSTRVAGTLGYLAPEYAIRGQVTKKSDIYSYGVLLLEIVSGRCNTNTRLPSEDQFLLERTWALYEEERLEEIIDFDIGDDLDVEEACRFMKIGLLCTQDAMARRPNMTNVVRMLTGEKRINVDKITRPAMITDFADLKVSNKEPRSSETRSPTTAPTTKSFTTTEPFSSSETHTQSSM

SEQ ID NO: 5532 - protein, 370 aa, Panicum virgatum
MGCCFMFGKKAEQAVQGDDDVHSVKVFSYNELRKATQDFSGGNKIGEGGFGSVFRGVLKDGTVVAVKVLSATSRQGIREFLTELTAISDIKHENLVTLIGCCAEGSHRILVYNYLENNSLAQTLLGTRYSNIRFNWRTRVKIAMGVARGLAFLHEEIRPPIIHRDIKASNILLDKDLTPKISDFGLARLLPPDATHVSTRVAGTLGYLAPEYAIRGQVTKKSDIYSYGVLLLEIVSGRCNTNTRLPSEDQFLLERTWGLHEEGRLEEIIDIDIGDDLDVEEACRFLKIGLLCTQDAMARRPNMTNVVRMLTGEKRIPVDKITRPAMITDFADLKVSSKEQRSSETRSPTTKSFTTTEHFSSSETPTQSSM

SEQ ID NO: 5533 - protein, 370 aa, Panicum virgatum
MGCCFMFGKKAEQAVQGDDDVHSVKVFSYNELRKATQDFSGGNKIGEGGFGSVFRGVLKDGTVVAVKVLSATSRQGIREFLTELTVISDIKHENLVTLIGCCAEGSHRILVYNYLENNSLAQTLLGTRYSNIRFNWRTRVKIAVGVARGLAFLHEEIRPPIIHRDIKASNILLDKDLTPKISDFGLARLLPPNATHVSTRVAGTLGYLAPEYAIRGQVTKKSDIYSYGVLLLEIVSGRCNTNTRLPSEDQFLLERTWGLHEDGRLEEIIDIDIGDDLDVEEACRFLKIGLLCTQDAMARRPNMTNVVRMLTGERRIPVDKITRPAMITDFADLKVSSKEQRSSETRSPTTKSFTTTEPFSSSETPTQSSM

SEQ ID NO: 5534 - protein, 374 aa, Sorghum bicolor
MACCFLFGKKAKQAVEGDEDLHSVKVFSYNDLRKATQDFSGANKIGEGGFGSVFRGVLKDGTVVAVKVLSATSRQGIREFLTELTAISDIKHENLVTLIGCCAEGSHRILVYNYLENNSLAQTLLGSRYSNIRFNWRARVKIAVGIARGLAFLHEEIRPPIIHRDIKASNILLDKDLTPKISDFGLARLLPPNATHVSTRVAGTLGYLAPEYAIRGQVTKKSDIYSYGVLLLEIVSGRCNTNTRLPSEDQFLLERTWVLYEQGRLEEIVDIDIGDDLDVEEACRFLKIGLLCTQDAMARRPNMTNVFRMLSGEKRINIDKITRPAMITDFADLKISNKEQRSGETRSPTTAPTTKSFTSTEPFSSSETPTQSSM

SEQ ID NO: 5535 - protein, 374 aa, Zea mays
MGCCFMFGKKAKQAVEGDEDLHSVKVFSYNDLRKATQDFSDANKIGEGGFGSVFRGVLKDGTLVAVKVLSATSRQGVREFLTELTAISDIKHANLVTLIGCCAEGSHRILVYNYLENNSLAQTLLGSRYSNIRFNWRARVKIAVGIACGLAFLHEEIRPHIIHRDIKASNILLDKDLTPKISDFGLARLLPPNATHVSTRVAGTLGYLAPEYAIRGQVTKKSDIYSYGVLLLEIVSGRCNTNTRLPSEDQFLLERTWALYEEGRLEDIIDIDIGDDLDVDEACRFMKIGLLCTQDAMARRPSMTNVVRMLSGEKRINVDQITRPAMITDFADLKISNKEQRPGETRSPTTTPTTKSFTTTEPFSSSETPTQSSM

SEQ ID NO: 5536 - protein, 374 aa, Zea mays
MACCFLFGKKAKQTTEGDEDLHSVKVFSYSELRKATQDFSGANKIGEGGFGSVFRGVLKDGTVVAVKVLSATSRQGIREFLTELTAISDIKHENLVTLIGCCAEGSRRILVYNYLENNSLAQTLLGSRHSNIRFNWHARARIAVGVARGLAFLHEEIRPPIIHRDIKASNILLDKDLTPKISDFGLARLLPPNATHVSTRVAGTLGYLAPEYAIRGQVTKKSDIYSYGVLLLEIVSGRCNTNTRLPSEDQFLLERTWALYEQGRLEDIVDMDIGGDRDVEEACRFLKIGLLCTQDAMARRPNMTNVVRMLSGERRISVEKITRPAMISDFAELKVSSKERRPGEARSPTTAPTTKSFTTTEPFSSSETPTQSSM

SEQ ID NO: 5537 - protein, 373 aa, Brachypodium distachyon
MSCCFLFGKRAQHVVEGDDDVHSVKVFSYNELRKATQDFSGANKIGEGGFGSVFRGMLKDGTLVAVKVLSATSRQGVREFLTELTAISDIKHENLVTLVGCCAEGSHRILVYNYLEKNSLSQTLLGSSYSNIQFNWRARVKIAVGVARGLAFLHEEIRPPIIHRDIKASNILLDKDLTPKISDFGLARLLPPNATHVSTRVAGTLGYLAPEYAIRGQVTKKSDIYSFGVLLLEIVSGRCNTNTRLPHEDQFLLEKTWALYEQGHLDEIVDVDIGDDLDVEEACLFLKVGLLCTQDAMARRPHMTTVVRMLTGSKNISMEKITRPALITDFAELKVSSKPQGASETRSYPSRSFTTTEVTEPFSSSETTTQTSM

SEQ ID NO: 5538 - protein, 372 aa, Oryza sativa
MDCCFMFRKKQPVEGDDGEHRVKIFSYSELRKATHDFSGANKIGEGGFGSVFRGVLRDGTTVAVKVLSATSRQGVREFLTELTAISDIKHENLVTLIGCCAEGSHRILVYNYLENNSLAQTLLGSRGSNIRFDWRTRVKIAVGVARGIAFLHEEIRPPIIHRDIKASNILLDKDLTPKISDFGLARLLPPNATHVSTRVAGTLGYLAPEYAIRGQVTKKSDIYSFGVLLLEIVSGRCNTNTRLPYEDQFLLERTWVRYEQERLAEIIDADLGNDLDVDEACRFLKIGLLCTQDAMARRPNMSTVVRMLTGEKHFSVHRITRPAMITDFADLKVSSSQQKENETTRSSNMRSFSTTDETEPFSSSETPTQTSI

SEQ ID NO: 5539 - protein, 373 aa, Triticum aestivum
MDCCFMFGRRSQHAVEGDDGEHSVKVFSYNELRKATQDFSGANKIGEGGFGSVFRGMLKDGTLIAVKVLSATSRQGVREFLTELTAISDIKHENLVTLVGCCAEGSHRILVYNYLEKNSLSQTLLGSGYSSIQFNWRARVKIAVGVARGLAFLHEEIRPHIIHRDIKASNILLDKDLTPKISDFGLARLLPANATHVSTRVAGTLGYLAPEYAIRGQVTKKSDIYSYGVLLLEIVSGRCNTNTRLPCEDQFLLEKTWAFYEQERLEEIIDADIDEDLDIEEACRFLKIGLLCTQDAMARRPHMPTVVRMLTGSKSISMEKITRPAMITDFAELKVSTKPHGANQARSNTSRSFSTTEISEPFSSSENHTQTSV

SEQ ID NO: 5540 - protein, 373 aa, Secale cereale
MDCCFMFGRRSQHAVEGDDGEHSVRVFSYNELRKATQGFSGANKIGEGGFGSVFRGMLKDGTLIAVKVLSATSRQGVREFLTELTAISDIKHENLVTLVGCCAEGSHRILVYNYLEKNSLSQTLLGSGYSSIQFNWSARVKIAVGVARGLAFLHEEIRPHIIHRDIKASNILLDKDLTPKISDFGLARLLPANATHVSTRVAGTLGYLAPEYAIRGQVTKKSDIYSYGVLLLEIVSGRCNTNTRLPYEDQFLLEKTWAFYEQERLDEIIDADIDEDLDIEEACRFLKIGLLCTQDAMARRPHMPTVVRMLTGSKSISMEKITRPAMITDFAELKVSTKPQGASQARSNTSRSFSTTEISEPFSSSENHTQTSV

SEQ ID NO: 5541 - protein, 373 aa, Hordeum vulgare
MDCCFMFGRRSQHVVEGDDGEHSVRVFSYNELRKATQDFSGANKIGEGGFGSVFRGMLKDGTLVAVKVLSATSRQGVREFLTELTAISDIKHENLVTLVGCCAEGSHRILVYNYLEKNSLSQTLLGSGYSSIQFNWRARVKIAVGVARGLAFLHEEIRPHIIHRDIKASNILLDKDLTPKISDFGLARLLPANATHVSTRVAGTLGYLAPEYAIRGQVTKKSDIYSYGVLLLEIVSGRCNTNTRLPYEDQFLLEKTWAFYEQERLDEIIDADIDNDLDIEEACRFLKIGLLCTQDAMARRPHMPTVVRMLTGSKNVSMEKITRPAMITDFAELKVSTKPQGANQGRPNTSRSFSTTEISEEPFSSENHTQASV

SEQ ID NO: 5542 - protein, 501 aa, Sorghum bicolor
MAGHGEKRRRTGGAHEEEPEEEDRISDLPDVLRLQILSLLPLKSAIRTGALSSRWRRLWAYRWPEPSSVTIRLPPGGGAAGAGAVAAAAARAEALAGIDRRGRRRVDGFSLSFHGGQLTQADLNRCVHYAAACEAEDLHLRVDGGAGAGRGSRGGTRRPGMLSVQFPVGSPLLARLSVRGLNLTAVNNAMVVTLEVIHLHSVFLTDAALRRMVAACPRLRELDLRYCRRLRRVDFSNVGVPNLRSFTVVDCSRTTELRVPVALRLRSFRFSGAFLSSNILSGAKGSLEHLYLCSGGPETGLPTTNLLYAVPRLSNLTVLTLCSIALQYVSSTAKAVTESNLHSLRELHLLMFGMANSNLADIYSFLKTCPCPQLERLFVQLPTNTGDAFTENFLKVAEEDPPKGGLENLCLAKMTNFKGHRNEMQLVGFLLRKSSSLKKLFLIAPKEDHPQGLRKIQSDMLPDLLKKEILHLERASANTQIFFSEPDAQTQPLHSEVFVRF

SEQ ID NO: 5543 - protein, 307 aa, Pennisetum glaucum
MAASTSAAAAAAAAPPSSCEIARITEDLLAASIARATPRDASRAAAVSPAFRAAADSDAVWASFLPGDLPPLADGELPPAPPSKKALFMRLTDSNRPVLLADRLMSMWLDRDTGAKCYMLSARALGIVWGDTPQYWQWIPLADSRFSEGAELLDVCWLEIRGKIHCKMLSRNSTYAVYMVFKISDESYGLDYPPQEAAVAIGENKFTRQVCLLGHEDEGEGSEEVPQNYRSLMVPAIRRRLTRRHRPLPPGVTVPKKRGDGWMEMEMGEFNNEEGDDGEVSISLTEIKGGRWKKGLIVQGIEVRAKK

SEQ ID NO: 5544 - protein, 296 aa, Panicum virgatum
MAATTAPPSCEIARLPEDLLAASIARTTPRDACRAAAVSPAFRDAADSDAVWARFLPRDLPPLADGELSPAPPSKKALFMRLTDSPVLLADGLMSTWLDRETGAKCYMLSARALCIIWGDTPQYWRWIPLTDSRFSEGAELRVVCWLEIRGKIHCKMLSQNSTYTTYMVFKISDESYGLDSPLQEAAVIIGENKFTRQVCLQGHENEGEDEEEVPQNYRSLMVPDIRRRLRRRNCRIPPGVIVPKKRADGWMEIEMGEFKNEEGEDGEVSISLMETIGGNWKKGLILQGIEIRAKK

SEQ ID NO: 5545 - protein, 297 aa, Panicum virgatum
MAATTAPPSCEIARLPEDLLAASIARTTPRDACRAAAVSPAFRDAADSDVVWARFLPRDLPPLADGELSPAPPSKKALFMRLTDSPGVLLADGLISTWLDRETGAKCYMISARALCIIWGDTPQYWRWIPLTDSRFSEGAELRAVCWLEIRGKIHCKMLSQNSTYTAYMVFKISDESYGLDSPLQEAAVIIGENKLTRQVCLQGHENEGEDGEEVPQNYRSLMVPAIGRRLRRRNRRMPPGVIVPKKRADGWMEMEMGEFKNEEGEDGEVSISLMETRGGNWKKGLILQGIEIRAKK

SEQ ID NO: 5546 - protein, 297 aa, Panicum virgatum
MAATTAPPSCEIARLPEDLLAASIARTTPRDACRAAAVSPAFRDAADSDVVWARFLPRDLPPLADGELSPAPPSKKALFMRLTDSPGVLLADGLISTWLDRETGAKCYMISARALCIIWGDTPQYWRWIPLTDSRFSEGAELRAVCWLEIRGKIHCKMLSQNSTYTAYMLFKISDESYGLDSPLQEAAVIIGENKLTRQVCLQGHENEGEDEEEVPQNYRSLMVPAIRRRLRRRNRRMPPGVIVPKKRADGWMEMEMGEFKNEEGEDGEVSISLMETRGGNWKKGLILQGIEIRAKK

SEQ ID NO: 5547 - protein, 83 aa, Pennisetum glaucum
MAAGGGMVFEPHAGAGGGDVVFCVAIALLTLLSTVIFAAAGEGKRPRRGGRGSGANGPVFVGGKGCGCGGCRAGAGVCGTYLS

SEQ ID NO: 5548 - protein, 82 aa, Panicum virgatum
MAGGGGMVFEPRAGVAGGDVVFCVAIACLSLLSLIIFAAAGSSSAGGGGKRGRASGPVFVGGKGCGCGGCRAGAGVCGTYLS

SEQ ID NO: 5549 - protein, 464 aa, Panicum virgatum
MALTGRLLAVAALSILCLLGLVRDSEAAFAQTHLPPHRIVHAGENDGGLMPELPPGGLMPMPELSPSGSPKPFVPFLAPAPLAPFFNNSTPKLSGKCTLNFTAVDKLMTTTAVDCFTSFAPFLANVICCPQLQATLTILIGQSSKQTGSLALDPTVANYCLSDVQELLLSQGASDNLHSLCSVHLSNVTEGSCPVSTMDSFESVVDSSKLLEACRKIDPVNECCSQTCQNAINEAAQKISSKDGGLTSYSVSPKIDSCRNVVLRWLSSRLDPPSAKQMLRQISNCNVNGVCPLSFPDTSKVAKECGGTIKNSTTCCKAMLSYVAHLQKQSFITNLQALNCASFLGAKLQKMNVSTNVYSSCQITLKDFSLQVGSQESGCLLPSMPSDASFDHISGISFTCDLNDNIAAPWPSSTQAPSSSCNKSVNIPERPAATSAQNGGNHKNLRLRLLVSLASLVLVLLIQA

SEQ ID NO: 5550 - protein, 465 aa, Zea mays
MAPTGRLLAVAALSFLCLQGPWGDSGSAFAQSQPPLHRTVRAEANDGGGLMPELPPSGLMPMPELSPSGSPTPFVPFLAPAPLAPFFNNSTPKLSGKCTLNFTAVDKLMTTTAVDCFTSFAPFLANVICCPQLQATLTILIGQSSKQTGSLALDPTVANYCLSDVQELLLSQGASDNLHSLCSVHLSNVTEGSCPVSTVDAFESAVDSSKLLEACRKIDSVNECCSQTCQNAINEAAQKISSKDAGLTSYTGSPKTDSCRNVVLRWLSSRLDPRSAKEMLRQISNCNVNGVCPLSFPDTSKVAKECGGTMTNSTACCKAMLTYVAHLQKQSFITNLQALNCASFLGAKLQKMNVSMNVYSSCQITLKDFSLQVGSQESGCLLPSMPSDASFDSTSGISFTCDLNDNIAAPWPSSMQAPSSSCNKSVNIPERPAATSAQSGVNHKNLKLRLLASLVSLLLVLLVQV

SEQ ID NO: 5551 - protein, 469 aa, Sorghum bicolor
MAPAGRLLAVAALSFLCLQGLWGDSGSALAQSQPPLHRIVRAEANDGGGGGLMPELPPSGFMPMPDLSPSPSGSPRPFVPFLAPAPLAPFFNNSTPKLSGKCTLNFTAVDKLMTTTAVDCFTSFAPFLANVICCPQLQATLTILIGQSSKQTGSLALDPTVANYCLSDVQELLLSQGASDNLHSLCSVHLSNVTEGSCPVSTVDSFESVVDSSKLLEACRKIDSVNECCSQTCQNAINEAAQKISSKDGGLTTYPGSPKVDSCRNVVLRWLSSRLDPQSAKEMLRQISNCNVNGVCPLSFPDTSKVAKECGGTMKNSTACCKAMLTYVAHLQKQSFITNLQALNCASFLGAKLQKMNVSTNVYSSCQITLKDFSLQVGSQESGCLLPSMPSDASFDSTSGISFTCDLNDNIAAPWPSSMQAPSSSCNKSVNIPERPAATSAQNGVNHKNLKLRLLASLVSLLLVLLVQV

SEQ ID NO: 5552 - protein, 390 aa, Pennisetum glaucum
PFLAPAPLAPFLNNSTPKLSGKCTLNFTAVDKLMTTTAVDCFTSFAPFLANVICCPQLQATLTILIGQSSKQTGSLALDPTAASYCLSDVQELLLSQGASDNLRSLCSVHLSNVTEGSCPVSTVDAFESVVDSSKLLEACRKIDTVNECCSQTCQGAVNEAAQKISSKDGGFTSYTGSPKIDSCRNVVLRWLSSRLDPPSAKQMLRQISNCNVNGVCPLSFPDTSKVAKECGGIIKNSTTCCKAMLSYVAHLQKQSFITNLQALNCASFLGAKLQKMNVSTNVYSSCQITLKDFSLQVGSQESGCLLPSMPSDASFDRISGISFTCDLNDNIAAPWPSSMQAPSSSCNKSVNIPERPAATSAQNGVNHRNLRLSLLVSLVSLVLALAVRV

SEQ ID NO: 5553 - protein, 460 aa, Triticum aestivum
MGPAGRLSVAAALLSCLCLHGLLGNSGQAFAQGPPVLHRIDHAEEDDDSGGLMPELSPTGSPQPFVPFLAPAPLAPFYNNSTPKLSGKCSLNFTAINGLMTTTAVDCFASFAPFLANVICCPQLQATLTILIGQSSKQTGSLALDPTLANYCLSDVQQLLMSQGASDNLHSICSVHLSNATEGSCPVSTVDAFESVVDSSKLLEACRKVDPVNECCSQTCQSAISDAARKISSKDAALTSDTASPKVDSCRNVVLRWLSSRLEPSSATKMLRQISNCNVNGVCPLSFPDTSKVAKECGGTVKNITVCCKAMDSYVSHLQKQSFITNLQALNCASVLGAKLQEMKVSTNVYSSCQVTLKDFSLQVGSQESGCLLPSMPSDASFDPSSGISFTCDLNDNIAAPWSPSLQASASTCNKSAAPGPTIPERPAATSAQNGVNHNRLELSLAVCFGALVATILLQV

SEQ ID NO: 5554 - protein, 1317 aa, Sorghum bicolor
MPSLQLLQLTDRGRGLLASRRRTLAVVSGAVLAGGALAYARSSQSRRRRRSEANHGGETSALATNGDGAGGGLAAAKQKRSGLKSLHFLAAILLKKIGPSGTRFLLGLVLTAVLRTAVGHRLARVQGFLFKAAFLRRVPTFTRLIIENLMLCFLQSTLYQTSKYLTGSLSLRFKKILTDIAHTDYFENMVYYKISHVDHRISNPEQRIASDIPKFSSELSELVQDDLAAVAEGLIYTWRLCSYASPKYVFWIMAYVLVAGGVIRNFSPAFGKLKSTEQQLEGDYRQLHSRLRTHAESVAFYGGENREASHIMQRFEALVEHLNLVRHENWWFGMIQDFFLKYFGATVAVVLIIEPFFSGNLRPDSSTLGRAEMLSNLRYHTSVIISLFQSLGILSISTRRLNILSGYADRIRELLDVSRELSGVCDRSLNHNSPGNYVSEANHIEFSDVKVVTPAGNVLVDDLTLRVETGSNLLITGPNGSGKSSLFRVLGGLWPLVSGYIVKPGVGSDLNKEIFYVPQRPYTAVGTLREQLIYPLTADQEIEPLTYDGMVDLLKNVDLEYLLERYPLDKEVNWGDELSLGEQQRLGMARLFYHKPKFAILDECTSAVTTDMEERFCKKVRAMGTSCITISHRPALVAFHDIVLSLDGEGGWNVQHRRDDSSFSTEESDFSSSETDRKSDALTVQRAFMSRAKSNASLGSKDHSYCTEVIATSAKVEIEHAARRIPHLRCHPRPLPLRVAAMLKILVPRLFDKQGGQLLAVAVLVFSRTWISDRIASLNGTTVKFVLEQDKAAFIRLIGVSILQSGANSFVAPSLRTLTAKLALGWRIRMTNHLLRYYLKRNAFYKVFNMSGKSIDADQRLTLDVDKLTTDLAGLVTGMVKPLVDILWFTWRMKLLSGRRGVAILYAYMLLGLGFLRAISPDFGHLSGQEQELEGTFRFMHSRLRTHAESIAFFGGGSREKAMVEAKFVKLINHSKILLRKQWLYGIVDDFVTKQLPHNVTWGLSLLYALEHKGDRALTSTQGELAHALRFLASVVSQSFIAFGDILELHKKFLELSGGINRIFELEEFTRFAQRNTAVSPNAISAASEEIISFHEVDIVTPSQKLLARKLSCNVVQGKSLLLTGPNGSGKSSIFRVLRDLWPTFSGRVTKPSEGMFHVPQRPYTSLGTLRDQIIYPLSREEAKIKVLSLHRSGNNSSASVLLDDHLKTILENVRLLYLLEREGWDSTPNWEDVLSLGEQQRLGMARLFFHHPKFGILDECTNATSVDVEEHLYRLATSMGITVITSSQRPALIPFHALELKLIDGEGNWELCAIQQ

SEQ ID NO: 5555 - protein, 1325 aa, Zea mays
MPSLQLLQLTDRGRGLLASRRRTLAFVSGAVLAGGALAYARSSQSRRRRRRPEASRSGGAGALAANGDGFSQNGAGGGLAAADQRRSGLKSLHFLASILLKKMGPSGTRYLLCLVLTSVLRTAVGHRLARVQGFLFKAAFLRRIPTFTRLIIENLTLCFLQSTLYQTSKYLTGSLSLRFKKILTDIAHADYFENMVYYKISHVDHRISNPEQRIASDIPKFSSELGELVQDDLAAVAEGLIYTWRLCSYASPKYVFWIMAYVLVAGGVIKNFSPAFGKLKSTEQQLEGDYRQLHSRLRTHAESVAFYGGENREASHIMQRFEALVEHLNLVRHENWWFGMIQDFFLKYFGATVAVVLIIEPFFSGNLRPDSSTLGRAEMLSNLRYHTSVIISLFQSLGILSISTRRLNILSGYADRIRELLDVSRELSGVRDRSLDHSSPGNYVSEANHIEFSDVKVVTPAGNVLVDDLTLRVETGSNLLITGPNGSGKSSLFRVLGGLWPLVSGHIVKPGVGSDLNKEIFYVPQRPYTAVGTLREQLIYPLTADQGIEPLTYDGMVDLLKNVDLEYLLERYPLDKEVNWGDELSLGEQQRLGMARLFYHKPKFAILDECTSAVTTDMEERFCKKVRAMGTSCITISHRPALVAFHDIVLSLDGEGGWNVQHRRDDSSFSTEESDFSSSETDRKSDALTVQRAFMSRAKSNASLGSKDHPYCTEVIATSPEVEIEHPARTPRIPHLRCHPRPLPLRVAAMLKILVPRLFDKQGGQLLAVAVLVFSRTWISDRIASLNGTTVKFVLEQDKDAFIRLIGVSILQSGANSFVAPSLRTLTAKLALGWRIRMTNHMLRYYLKRNAFYKVFNMSGKSIDADQRLTLDVDKLTTDLAGLVTGMVKPLVDILWFTWRMKLLSGRRGVAILYAYMLLGLGFLRAISPDFGHLSGQEQELEGTFRFMHSRLRTHAESIAFFGGGSREKAMVEAKFVKLINHSKILLRKQWLYGIVDDFVTKQLPHNVTWGLSLLYALEHKGDRALTSTQGELAHALRFLASVVSQSFIAFGDILELHKKFLELSGGINRIFELEEFTRFAQRNTVVSPNAISAASKETISFHEVDIVTPSQKLLARKLSCDVVQGKSLLLTGPNGSGKSSIFRVLRDLWPTFSGRVTKPSEGMFHVPQRPYTSLGTLRDQIIYPLSREEAKIKVLSLHRSGNNSSASMLLDDHLKTILENVRLVYLLEREGWDSTPNWEDVLSLGEQQRLGMARLFFHHPKFGILDECTNATSVDVEEHLYRLATSMGITVITSSQRPALIPFHALELKLIDGEGNWELCAIQQ

SEQ ID NO: 5556 - protein, 119 aa, Triticum aestivum
MSGKTIDADQRLTLDVDKLTTDLAGLVTGMVKPVVDIIWFTWRMKLLSGRRGVAILYAYMLLGLGFLGAVSPDFGRLSGQEQELEGTFRFMHSRLRTHAESIAFLVVVQERKLWLRLNS

SEQ ID NO: 5557 - protein, 1321 aa, Oryza sativa
MPSLQLLQLTERGRGLLASRRKTLAVVSGALLAGGALAYARSSQGQRRRRSEGDDATTALARNGDRMGQNGVDGRLAGTKRRKGGLRSLHFLAAILLKKIGPNGTRYLLGLTLTAVLRTAVGHRLARVQGYLFRAAFLRRVPTFTRLIIENLILCFLQSAVYQTSKYLTGSLSLRFKKILTDLVHADYFQNMVYYKISHVDHRISNPEQRIASDIPKFCSELSELVQDDLAAVAEGLIYTWRLCSYASPKYMLWIVGYILVAGGAIRNFSPAFGKLKSTEQQLEGDYRQLHSRLRTHAESVAFYGGENREAYYIMQRFQALIGHLNCVLHENWWFGMIQDFFLKYFGATVAVVLIIEPFFSGHLRPDSSTLGRAEMLSNLRYHTSVIISLFQSLGILSISTRRLNILSGYADRIRELLDVSRELSGVRDKSLNHNSSAGNYISEANHIEFSGVKVVTPASNVLVDDLTLRVERGSNLLITGPNGSGKSSLFRVLGGLWPLVSGHIVKPGVGSDLNKEIFYVPQRPYTAVGTLREQLIYPLTADQEIEPLSYDGMVDLLKNVDLEYLLERYPLDKEVNWGDELSLGEQQRLGMARLFYHKPKFAILDECTSAVTIDMEERFCKKVRAMGTSCITISHRPALVAFHDIVLSLDGEGGWDVQHRRDDSSFSTEESDYTLLETDRKSDALTVQRAFMGRAKSNASSRSKEHCYTTKVIATSPKLEIEQTIQTHRVPHLRCFPRPLPARVAAMVKILVPKLLDKQGGQLLAVALLVFSRTWISDRIASLNGTTVKFVLEQDKAAFIRLIGISVLQSSANSFVAPSLRTLTGRLALGWRIRLTNHLLQYYLKRNAFYKVFNMSGKSIDADQRLTLDVDKLTTDLAGLVTGMVKPLVDILWFTWRMKLLSGRRGVAILYAYMLLGLGFLRAVSPDFGHLAGQEQELEGTFRFMHSRLRTHAESIAFFGGGSREKAIVEAKFMKLLDHSKILLRKQWLYGIVDDFVTKQLPHNVTWGLSLLYALEHKGDRALTSTQGELAHALRFLASVVSQSFIAFGDILDLHKKFLELSGGINRIFELEELLRVSQRDTFVPSDATSAEETISFHEVDIVTPSQKLLASKLSCNVVQGKSLLLTGPNGSGKSSIFRVLRDLWPVCSGRVTKPSDGMFHVPQRPYTSLGTLRDQIIYPLSREEAEMKICSLYNDGNGSSASNLLDDHLKTILVNVRLVYLLEREGWDSTSNWEDVLSLGEQQRLGMARLFFHHPKFGILDECTNATSVDVEEHLYKLATSMGITVITSSQRPALIPFHSLELKLIDGEGNWELCEIHQ

SEQ ID NO: 5558 - protein, 1324 aa, Brachypodium distachyon
MPSLQLLKLTEHGRGLLASRRRTLAVVSGALVAGGALAYARSARGRRRRSGSEGGDDGDALARNGGRLGQNGVDGRLAGTKRRKSALKSLHFLAAILLKKIGPNGTRYLLGLMLTAVLRTAVGHRLAKVQGYLFKAAFLRRVPTFTRLIIENLILCFLQSAVYQTSKYLTGSLNLRFKKILTDLVHADYFQNMVYYKISHVDHRISNPEQRIASDIPKFCSELSELVQDDLAAVAEGLIYTWRLCSYASPKYMIWILAYILVAGGAIRNFTPAFGKLKSTEQHLEGEYRQLHSRLRTHAESVAFYGGENREASHIMQRFKALVRHLNHVIHENWWFGMIQDFFLKYFGATVAVVLIIEPFFSGDLRPDSSTLGRADMLSNLRYHTSVIISLFQSLGTLSISTRRLNILSGYADRIRELLDVSRELSGVRDRSLNHNFSAGNYISEANHIEFSGVKVVTPAGNVLVDDLTLRVETGSNLLITGPNGSGKSSLFRVLGGLWPLVSGHIVKPGVGSDLNKEIFYVPQRPYTAVGTLREQLIYPLTADQEIEPLSYDGMMDLLKNVDLEYLLQRYPLDKEVNWGDELSLGEQQRLGMARLFYHKPKFAILDECTSAVTIDMEERFCKKVRAMGTSCITISHRPALVAFHNIVLSLDGEGGWDVQHRRDDSSFSTEESDFTSLETDRKSDALTVQRAFMNKSKSNASLRAKEHSYSTKVIATSPKLETEQTVRTPLIPHLQCSPRPLPLRAASMLKILVPKLLDKQGGQLLAVTLLIFSRTVISDRIASLNGTTVKFVLEQDKAAFIRLVGVSVLQSAANSFVAPSLRTLTARLALGWRIRMTNHLLQYYLRRNAFYKVFNMSGKSIDADQRLTLDVDKLSTDLAGLVTGMVKPLVDILWFTWRMKLLSGRRGVGILYAYMLLGLGFLRAVSPDFGHLASQQQELEGTFRFMHSRLRTHAESIAFFGGGSREKAMVEAKFMKLLNHSKVMLRKQWLYGIVDDFVTKQLPHNVTWGLSLLYALEHKGDRALTSTQGELAHALRFLASVVSQSFIAFGDILELHKKFLELSGGVNRIFELEEILRAAQRDTVVPSSAISSASEEIISFHEVDIVTPTQKLLANKLSCNVVQGKSLLLTGPNGTGKSSVFRVLRNLWPVFSGRVNKPSEGVFHVPQSPYTSLGTLRDQIIYPLSREEAEIKILSLHKAGNMSSAPELLDDHLKTVLVNVRLVYLLEREGWDSTPNWEDVLSLGEQQRLGMARLFFHHPKFGILDECTNATSVDVEEHLYRLATSMGITVITSSQRPALIPFHSVELKLIDGEGNWELCEIQH

SEQ ID NO: 5559 - protein, 1263 aa, Secale cereale
MPSLQLLQLTERGRGLLASRRRTLAVVSGALVAGGALAYARSGRGQRRRGRPEAANNGDDALARNGERPGHNGTDGRLAGTTKRRKSALKSLHFLAAILLKKIGPNGTRYLLGLMLTAVLRTAVGHRLAKVQGFLFKAAFLRRVPTFTRLIIENLILCFLQSAVYQTSKYLTGSLNLRFKKILTDLVHADYFQNMVYYKISHVDHRISNPEQRIASDIPKFCSELSELVQDDLAAVAEGLIYTWRLCSYASPKYMLWILGYILVAGGAIRNFSPAFGKMKSTEQHLEGEYRQLHSRLRTHAESVAFYGGEQREEYHIMQRFRALVGHLKHVLHENWWFGMIQDFFLKYFGATVAVVLIIEPFFSGDLRPDSSTLGRADMLSNLRYHTSVIIALFQSLGTLSISSRRLNILSGYADRIRELLDVSRELSGVRDRSLNHNSSAGNYISEANHIEFSGVKVVTPAGNVLVDDLTLRVETGSNLLITGPNGSGKSSLFRVLGGLWPLVSGHIVKPGVGSDLNKEIFYVPQRPYTAVGTLREQLIYPLTADQETEPLSYDGMVDLLKNVDLEYLLERYPLDKEVNWGDELSLGEQQRLGMARLFYHKPKFAILDECTSAVTIDMEERFCKKVRAMGTSCITISHRPALVAFHNIVLSLDGEGGWDVQHRRDDSSFYTEESELTSLETERKSDALTVQRAFMNRAKSNASLRSKDSYSTKVIANSPKLETGHTVRTPVVPHLQCSPRPLPLRAAAMLKILVPKLLDKQGGQLLSVALLIFSRTVISDRIASLNGTTVKFVLEQDKAAFVRLVGVSVLQSAANSFVAPSLRTLTSRLALGWRIRLTNHLLQYYLRRNAFYKVFNMSGKSIDADQRLTLDVDKLTTDLASLVTGMVKPLVDILWFTWRMKLLSGRRGVGILYAYMLLGLGFLRAISPDFGHLASEEQELEGTFRFMHSRLRTHAESIAFFGGGSREKAMVEAKFMKLLKHSKVLLRKQWLYGIVDDFVTKQLPHNVTWGLSLLYALEHKGDRALTSTQGELAHALRFLASVVSQSFIAFGDILELHKKFLELSGGINRIFELEEILRVAQKDTPVPSSAITAASDEIIEFHEVDIVTPSQKLLARKLSCSVVQGKSLLLTGPNGTGKSSVFRVLRDLWPAFSGRVTKPAEGMFHVPQSPYTSLGTLRDQIIYPLSREEAEMKILSLYKSSNRSSAPELLDEHLKTVLVNVRLVYLLEREGWDSTPTWEDVLSLGEQQRLGMARLFFHHPKF

SEQ ID NO: 5560 - protein, 1324 aa, Setaria italica
MSSLQLLQLTERGRNLLSSRRRTLAVVSGALLAGGTLAYTQSGRWNKQQKENACSDGNAHTGTKDRNGQNGIDGKLVKPRKKKSGLKSLHFLAAILLKKIGPNGSNYLLGLIITAVLRTAVGHRLAKVQGYLFRAAFLRRVPTFTHLIIENLLLCFLQSTIYQTSKYLTGSLGLRFKKILTDLVHADYFENMVYYKISHVDHRISNPEQRIASDIPKFCSELSDLVQDDLAAIAEALIYIWRLCSYASPKYVLWILAYVIGAGGTIRKFSPAFGKLKSMEQQLEGEYRQVHSRLRTHAESVAFYGGENREASHIMQRFGALVKHLNVVLHENWWFGMIQDFLLKYLGATVGVILIIEPFFAGNLRPESSTLGRAEMLSNLRYHTSVIISLFQSLGTLSISSRRLNILSGYANRIHELLEVSRELSGVRDRLMTQNSSAANYISEANYIEFSGVKVVTPSGNVLVDDLTLRLESGSNLLITGPNGSGKSSLFRVLGGLWPLVSGHIVKPGVGSNLNKEIFYVPQRPYTAVGTLRDQLIYPLTADQETEPLNYSGMVDLLKNVDLEYLLERYPLDKEVNWGDELSLGEQQRLGMARLFYHKPKFAILDECTSAVTIDMEERFCKRVRAMGTSCITISHRPALVAFHEIVLSLDGEGGWNVQDNRNGSSFSPEVEVDVLKSSETDRKSDALTVQRAFVTSTKGNASSKLKKQSYSTEVIASSPSMEIEHTVQAPIVTQLKCSPRPLPVRVAAMSQILVPKLFDKQGGQLLAVAVLVFSRTWISDRIASLNGTSVKYVLEQDKAAFIRLTGISVLQSAANSIVSPSLRNLTSRIALGWRIRMTNHLLQYYLKRNAFYKVFNISGMNMDADQRITHDVEKLTNDLAGLVTGMVKPLVDILWFTWRMKLLSGRRGVAILYAYMFLGLGFLRAVSPDFGDLANQEQELEGTFRFMHSRLRTHAESIAFFGGGSREKAMIDAKFTTWLNHSKVLLRKKWLYGIFDDFVTKQLPHNVTWGLSLLYALEHKGDRALTSTQGELAHALRFLASVVSQSFIAFGDILELHKKFLELSGGINRIFELEELLQAAQSNPAVPSDAIKAASEEIISFRNVDIVTPSQKLLASQLSCDVSQGKSLLVTGPNGSGKSSIFRVLRGLWPIASGRLTKPSEGIFNVPQRPYTCLGTLRDQIIYPLSREEAELKMLSHETSDKSAASKMLDDHLKMILENVRLVYLLEREGWDATPNWEDILSLGEQQRLGMARLFFHCPKYGILDECTNATSVDVEEHLYRLATNMGITVITSSQRPALIPFHSLELKLIDGEGKWKLCAIHQ

SEQ ID NO: 5561 - protein, 1325 aa, Oryza sativa
MPSLQLLQLTEHGRNLLSSRRRTLAVVSGALLAGGTLAYAHSARRQKRQEEYSHSDASTQTTGNQSICQNGVDGKLVKTRKKKNGLKSLQFLAAILLKKIGPNGINHLLGLMITAVLRTAVGHRLAKVQGYLFRVAFLRRVPTFTRLIIENLLLCFLQSTIYQTSKYLTGSLGLHFKKILTDLVHADYFENMVYYKLSHVDHRISNPEQRIASDIPKFCSELSGLVQDDLTAVADGLIYIWRLCSYASPKYVLWILAYVLGAGGAIRKFSPAFGKLKSMEQQLEGEYRQVHSRLRTHAESVAFYGGENREASHIMQRFQALVKHLNVVLHENWWFGMIQDFLLKYLGATVGVILIVEPFFAGNLKPESSTLGRAEMLSNLRYHTSVIISLFQSLGTLSISSRRLNLLSGYADRIRELLDVSRELSGVRDLSMNKKSSVDNYISEANYIEFSGVKVVTPSGNVLVDDLTLRVESGSNLLITGPNGSGKSSLFRVLGGLWPLMSGHIVKPGVGSNLNKEIFYVPQRPYTAVGTLRDQLIYPLTADQETEPLSYGGMVDLLKNVDLEYLLERYPLDKEVNWGDELSLGEQQRLGMARLFYHRPKFAILDECTSAVTTDMEERFCKRVQAMGTSCITISHRPALVAFHDIVLSLDGEGGWTVQENRNGSFISAEPEFDALNSSETDRKSDALAVQRAFIANTKGNALMGPKDHSYSTQLIATSPNMEIEHTERSNLVPQLQCSPRPLPLRAAAMSKILVPKLFDKQGGQLLAVALLVFSRTWISDRIASLNGTSVKYVLEQDKAAFLRLIGISVLQSAANSIVSPSLRNLTSKIALGWRIRMTNHLLQYYLKRNAFYKVFNMSGIDIDADQRITHDVEKLTNDLAGLVTGMVKPLVDILWFTWRMKILSGRRGVAILYAYMLLGLGFLRAVSPDFGDLANQEQELEGTFRFMHSRLRTHAESIAFFGGGSREKAMVEAKFTTMLNHSRTLLRKRWLYGIFDDFVTKQLPHNVTWGLSLLYALEHKGDRALTSTQGELAHALRFLASVVSQSFIAFGDILELHKKFLELSGGINRVFELEELLQTSQSNAAMPSNPIIAASEEIISFHDVDIVTPSQKLLATQLSCDVSQGKSLLVTGPNGSGKSSIFRVLRGLWPIASGRLTMPSDGIFHVPQRPYTCLGTLRDQIIYPLSHEEAELKVLSLYKSGDKAITSGSLDDHLKTILENVRLVYLLEREGWDATPNWEDILSLGEQQRLGMARLFFHCPKFGILDECTNATSVDVEEHLYKIATSMGITVITSSQRPALIPFHSLELKLIDGEGKWELCTINQ

SEQ ID NO: 5562 - protein, 1324 aa, Sorghum bicolor
MSSLQLLQLTERGRNLLSSRRRTIAIVSGAVLAGGTLAYAQSGRWKKHQEVNSCSDANSHSSNNGRTSQNGIDGKLVKTRKKKSGLKSLHFLAAILLKKIGPNGTNYLIGLILTAVLRTAVGHRLAKVQGYLFRSAFLRRIPTFTRLIIENLFLCFLQSTLYQTSKYLTGSLGLHFKKILTDLVHADYFENMVYYKISHVDHRISNPEQRIASDIPKFCSELSDLVQDDLAAIIEGLIYIWRLCSYASPKYVLWILAYVLGAGGTIRKFSPAFGKLKSMEQQLEGEYRQLHSRLRTHAESVAFYGGENREASHIKQRFRALVKHLNVVLHENWWFGMIQDFLLKYLGATVGVILIIEPFFAGNLKPESSTLGRAEMLSNLRYHTSVIISLFQSLGTLSIGSRRLNILSGYANRIHELLDVSRELSGGRDRLITQNSSDGNYISEANYIEFSGVKVVTPSGNVLVDNLNLHLESGSNLLITGPNGSGKSSLFRVLGGLWPMVSGHIVKPGVGSNLNKEIFYVPQRPYTAVGTLRDQLIYPLTADQETEPLSYGGMVDLLKNVDLEYLLERYPLDKEVNWGDELSLGEQQRLGMARLFYHKPKFAILDECTSAVTTDMEERFCKRVRAMGTSCITISHRPALVAFHEIVLSLDGEGGWNIQDNRNGSSFSPELEFDVLESSESDRKSDALTVQRAFITSTKGNSSMKPKKLSYSTEVIASSPIVEIEHTVQSSIVTQLQCSPRPLPVRVAAMSQILVPKLFDKQGGQLLAVALLVFSRTWISDRIASLNGTSVKYVLEQDKAAFIRLAGISVLQSAANSIVSPSLRNLTSRIALGWRIRMTNHLLQYYLKRNAFYKVFNISGMSMDADQRMTHDVEKLTNDLAGLLTGMVKPLVDIIWFTWRMKLLSGRRGVAILYAYMFLGLGFLRAVSPDFGDLANKEQELEGTFRFMHSRLRTHAESIAFFGGGSREKAMIDAKFTTLLNHSKVLLRKKWLYGIFDDFVTKQLPHNVTWGLSMLYALEHKGDRALTSTQGELAHALRFLASVVSQSFIAFGDILELHKKFLELSGGINRIFELEELLQASQSNPVVPSDAINATSEEIISFRGVDIVTPSQKLLASQLSCDVSQGKSLLVTGPNGSGKSSIFRVLRGLWPIASGRLTKPSEGIFNVPQRPYTCLGTLRDQVIYPLSHEEAKLKMLSYETSDKSTASKMLDDHLKTILENVRLVYLLEREGWDATPNWEDILSLGEQQRLGMARLFFHCPKYGILDECTNATSVDVEEHLYRLATNMGITVITSSQRPALIPFHSLELKLIDGEGKWELCSIHQ

SEQ ID NO: 5563 - protein, 1211 aa, Triticum aestivum
MLTAVLRTAVGHRLAKVQGFLFKAAFLRRVPTFTRLIIENLILCFLQSAVYQTSKYLTGSLNLRFKKILTDLVHADYFQNMVYYKISHVDHRISNPEQRIASDIPKFCSELSELVQDDLAAVAEGLIYTWRLCSYASPKYMLWILGYILVAGGAIRNFSPAFGKMKSTEQHLEGEYRQLHSRLRTHAESVAFYGGEKREEYHIMHRFRALVGHLKHVLHENWWFGMIQDFFLKYFGATVAVVLIIEPFFSGDLRPDSSTLGRADMLSNLRYHTSVIIALFQSLGTLSISSRRLNILSGYADRIRELLDVSRELSGVRDRSLNHSSSVGNYISEANHIEFSGVKVVTPAGNVLVDDLTLRVETGSNLLITGPNGSGKSSLFRVLGGLWPLVSGHIVKPGVGSDLNKEIFYVPQRPYTAVGTLREQLIYPLTADQETEPLSYDGMVDLLKNVDLEYLLERYPLDKEVNWGDELSLGEQQRLGMARLFYHKPKFAILDECTSAVTIDMEERFCKKVRAMGTSCITISHRPALVAFHNIVLSLDGEGGWDVQHRRDDSSFYTEESELTSLETERKSDALTVQRAFMNRAKSNASLRSKDSYSTKVIANSPKLETGQAVRTPVIPHLQCSPRPLPLRAAAMLKILVPKLLDKQGGQLLSVALLIFSRTVISDRIASLNGTTVKFVLEQDKAAFVRLVGVSVLQSAANSFVAPSLRTLTSRLALGWRIRLTNHLLQYYLRKNAFYKVFNMSGKSIDADQRLTLDVDKLTTDLASLVTGMVKPLVDILWFTWRMKLLSGRRGVGILYAYMLLGLGFLRAISPDFGHLASEEQELEGTFRFMHSRLRTHAESIAFFGGGSREKAMVEAKFMKLLNHSKVLLRKQWLYGIVDDFVTKQLPHNVTWGLSLLYALEHKGDRALTSTQGELAHALRFLASVVSQSFIAFGDILELHKKFLELSGGINRIFELEEILRVAQKDTPVPSSAITAASDEIIEFHEVDIVTPSQKLLARKLSCSVVQGKSLLLTGPNGTGKSSVFRVLRDLWPAFSGRVTKPSEGMFHVPQSPYTSLGTLRDQIIYPLSREEAEMKILSLYKASNRSSAPELLDDHLKTVLVNVRLVYLLEREGWDSTPNWEDVLSLGEQQRLGMARLFFHHPKFGILDECTNATSVDVEEHLYRLATNMGITVITSSQRPALIPFHSVELKLIDGEGNWELCEIQH

SEQ ID NO: 5564 - protein, 1207 aa, Hordeum vulgare
VLRTAVGHRLAKVQGFLFKAAFLRRVPTFTRLIIENLILCFLQSAVYQTSKYLTGSLNLRFKKILTDLVHADYFQNMVYYKISHVDHRISNPEQRIASDIPKFSSELSELVQDDLAAVAEGLIYTWRLCSYASPKYMLWILAYILVAGGAIRNFSPAFGKMKSTEQHLEGEYRQLHSRLRTHAESVAFYGGEKREEYHIMQRFRALVGHLKHVLHENWWFGMIQDFFLKYFGATVAVVLIIEPFFSGDLRPDSSTIGRADMLSNLRYHTSVIIALFQSLGTLSISSRRLNILSGYADRIRELLDVSRELSGVRDRSLNHSSSVGNYISEANHIEFSGVKVVTPAGNVLVDDLTLRVETGSNLLITGPNGSGKSSLFRVLGGLWPLVSGHIVKPGVGSDLNKEIFYVPQRPYTAVGTLREQLIYPLTADQETEPLTYDGMVDLLKNVDLEYLLERYPLDKEVNWGDELSLGEQQRLGMARLFYHKPKFAILDECTSAVTIDMEERFCKKVRAMGTSCITISHRPALVAFHNIVLSLDGEGGWDVQHRRDDSSFYTEDSELTSLETERKSDALIVQRAFMNRAKSNASLRSKDSYSTKVIANSTKLETGQTVRTPVIPHLQCSPRPLPLRATAMLKILIPKLLDKQGGQLLAVALLIFSRTVISDRIASLNGTTVKFVLEQDKAAFVRLVGVSVLQSAANSFVAPSLRTLTSRLALGWRIRLTNHLLQYYLRRNAFYKVFNMSGKSIDADQRLTLDVDKLTTDLAGLVTGMVKPLVDILWFTWRMKLLSGRRGVGILYAYMLLGLGFLRAISPDFGHLASEEQELEGTFRFMHSRLRTHAESIAFFGGGSREKAMVEAKFMKLLNHSKVLLRKQWLYGVVDDFVTKQLPHNVTWGLSLLYALEHKGDRALTSTQGELAHALRFLASVVSQSFIAFGDILELHKKFLELSGGINRIFELEEILRVAQKDTPVPSSAISAASDEIIEFHEVDIVTPSQKLLARKLSCSVVQGKSLLLTGPNGTGKSSVFRVLRDLWPAFSGRVTKPSEGMFHVPQSPYTSLGTLRDQIIYPLSREEAEMKILSLYKSSNRSSAPELLDDHLKTVLVNVRLVYLLEREGWDSTPNWEDVLSLGEQQRLGMARLFFHHPKFGILDECTNATSVDVEEHLYRLATDMGITVITSSQRPALIPFHSVELKLIDGEGNWELCEIQH

SEQ ID NO: 5565 - protein, 1325 aa, Brachypodium distachyon
MSSLQLLKLTEQGRNLLSSRRKTLVIVSGALLAGGTLTYAQSCRRKKYREENSRGDASTHTRNKESNGQNGVDGKLVKPRKKKNLLKSLHFLAAILLKKIGPSGTNYLLGLMLTAVIRTAIGHRLAKVQGYLFRSAFLRRVPTFMRLIIENLLLCFLQSTVYQTSKYLTGSLGLRFKKILTDLIHADYFENMVYYKISHVDHRISNPEQRIASDIPKFCSELSELVQDDLIAVADGLIYIWRLCSYASPKYVLWILAYVLGAGGTIRKFSPSFGKLKSTEQQLEGEYRQVHSRLRTHAESVAFYGGENREASHIMQRFQALVRHLNVVLHENWWFGMIQDFLLKYLGATVGVILIVEPFFAGNLKPDTSTLGRAEMLSNLRYHTSVIISLFQSLGTLSISSRRLNLLSGYADRIHELLEVSRDLSGVRDRSISQNSSVRNYISEANYIEFSGVKVVTPSGNVLVDDLTLRVESGSNLLITGPNGSGKSSLFRVLGGLWPLVSGHIVKPGVGSNLNKEIFYVPQRPYTAVGTLRDQLIYPLTADQETEPLSYSGMVDLLKNVDLEYLLERYPLDKEVNWGDELSLGEQQRLGMARLFYHKPKFAILDECTSAVTTDMEERFCNRVRAMGTSCITISHRPALVAFHDIVLSLDGEGGWKVQDNRNGSFLPTESEFDVLKSSETDRKSDALAVQRAFRANTKDNAFSGSKEHSYSTQVIATSPNMEIEPTEQPRLIPQLQCSPRPLPVRAAAMSKILVPKIIDKQGGQLLAVALLVLSRTWISDRIASLNGTSVKYVLEQDKAAFLRLIGVSVMQSAANSIVAPSLRNLTSRIALGWRIRMTNHLLAYYLKRNAFYKVFNMSGMNIDADQRITRDVEKLTNDLAGLVTGMVKPLVDILWFTWRMKLLSGRRGVAILYAYMLLGLGFLRAVSPDFGDLANQEQELEGSFRFMHSRLRTHAESIAFFGGGSRERAMVEARFTTLLNHSKVLLRKKWLYGIFDDFVTKQLPHNVTWGLSMLYALEHKGDRALTSTQGELAHALRFLASVVSQSFIAFGDILELHKKFLELSGGINRIFELEELLHASQSNAAMPSNASSVASEEIISFRDVDIVTPSQKLLASQLSCDVSQGKSLLVTGPNGSGKSSIFRVLRGLWPIASGRLAMPSEGIFHVSQRPYTCLGTLRDQIIYPLSREEAELKMVSLVKTSDRFTTSGSLDDHLKTILENVRLVYLLEREGWDATPNWEDILSLGEQQRLGMARLFFHCPKFGILDECTNATSVDVEEHLYRLATDMGITVVTSSQRPALIPFHSSELKLIDGEGKWELCAINQ

SEQ ID NO: 5566 - protein, 1211 aa, Triticum aestivum
MLTAVLRTAIGHRLAKVQGYLFKSAFLRRVPTFTRLIIENLLLCFLQSTVYQTSKYLTGSLSLRFKKILTDLIHADYFENMVYYKISHVDHRISNPEQRIASDIPKFCAGLSDLVQDDLIAVADGLIYIWRICSYASPKYVLWILAYVLGAGGTIRKFSPSFGKLKAMEQQLEGEYRQVHSRLRTHAESVAFYGGENREESHIMQRFQALVRHVNVVLHENWWFGMIQDFLLKYLGATVGVILIVEPFFAGDLKPDTSTLGRAEMLSNLRYHTSVIISLFQSLGTLSTSSRRLNLLSGYADRIHELLDVSRELSGVRDRSMNRNSSAKNYISEANYIEFSGVKVVTPSGNVLVDDLTLRVESGSNLLITGPNGSGKSSLFRVLGGLWPLVSGHIVKPGVGSNLNKEIFYVPQRPYTAVGTLRDQLIYPLTADQETEPLSYGGMVDLLKNVDLEYLLERYPLDKEVNWGDELSLGEQQRLGMARLFYHKPKFAILDECTSAVTTDMEERFCNRVRAMGTSCITISHRPALVAFHDVVLSLDGEGGWKVQDNRNGSFLPTESEFDALKSSETDRKSDALAVQRAFSANTKENTLSGPKEHSYSTQVIATSPNMEIESTEQPHLIPQLQCSPRPLPVRVAAMSKILVPKIIDKQGAQLLAVAVLVLSRTWISDRIASLNGTSVKYVLEQDKAAFIRLIGTSVMQSAANSIVAPSLRHLTSKIALGWRIRMTNHLLAYYLKRNAFYKVFNMTGMEIDADQRITRDVEKLTNDLAGLVTGMVKPSVDILWFTWRMKLLSGRRGVAILYAYMLLGLGFLRAVSPDFGDLSNQEQELESSFRFMHSRLRTHAESIAFFGGGSRERAMVEAKFATLLNHSKILLRKRWLYGIFDDFVTKQLPHNVTWGLSLLYALEHKGDRALTSTQGELAHALRFLASVVSQSFIAFGDILELHKKFLELSGGVNRIFELEELLKASQSNAVMPSNVISVPSEETISFRNVDIVTPSQKLLASQLSCDVSQGKSLLVTGPNGSGKSSIFRVLQSLWPVASGRLTVPSEGIFHVPQRPYTCLGTLRDQIIYPLSREEAELKMLTLSKTSDRSRSLDDHLRTILENVRLVYLLEREGWDATPNWEDILSLGEQQRLGMARLFFHSPKFGILDECTNATSVDVEEHLYRLATDMGITVVTSSQRPALIPFHSLELKLIDGEGKWELCSINH

SEQ ID NO: 5567 - protein, 1322 aa, Hordeum vulgare
MSSLQLLQLTEHGRNLFSSRRRTLAVVSGALLAGGTLAYAQTSRRRKHREENPCNDANVHSRSEENISQNGVDGKVVKTRKKKNLLKSLHFLAAILLKKIGPSGTNYLLGLMLTAVLRTAIGHRLAKVQGYLFKSAFLRRVPTFTRLIIENLLLCFLQSTVYQTSKYLTGSLSLRFKKILTDLIHADYFENMVYYKISHVDHRISNPEQRIASDIPKFCAGLSDLVQDDLIAVADGLIYIWRICSYASPKYVLWILAYVLGAGGTIRKFSPSFGKLKAMEQQLEGEYRQVHSRLRTHAESVAFYGGENREESHIMQRFQALVRHLNVVLHENWWFGMIQDFLLKYLGATVGVILIVEPFFAGDLKPDTSTLGRAEMLSNLRYHTSVIISLFQSLGTLSTSSRRLNLLSGYADRIHELLDVSRELSGVRDRSMSRNSSAKNYISEANYIEFSGVKVVTPSGNVLVDDLTLRVESGSNLLITGPNGSGKSSLFRVLGGLWPLVSGHIVKPGVGSNLNKEIFYVPQRPYTAVGTLRDQLIYPLTADQETEPLSYGGMVDLLKNVDLEYLLERYPVDKEVNWGDELSLGEQQRLGMARLFYHKPKFAILDECTSAVTTDMEERFCNRVRAMGTSCITISHRPALVAFHDVVLSLDGEGGWKVQDNRNGSFLPTESEFDALKSSETDRKSDALAVQRAFSANTKENTLSGPKDHSYSTQVIATSPNMEIESTEQPHLIPQLQCSPRPLPVRVAAMSKILVPKVIDKQGAQLLAVALLVLSRTWISDRIASLNGTSVKYVLEQDKAAFIRLIGTSVMQSAANSIVAPSLRHLTSKIALGWRIRMTNHLLAYYLKRNAFYKVFNMTGTDIDADQRITRDVEKLTNDLAGLVTGMVKPSVDILWFTWRMKLLSGRRGVAILYAYMLLGLGFLRAVSPDFGDLSNQEQELESSFRFMHSRLRTHAESIAFFGGGSRERAMVEAKFATLLNHSKILLRKRWLYGIFDDFVTKQLPHNVTWGLSLLYALEHKGDRALTSAQGELAHALRFLASVVSQSFIAFGDILELHKKFLELSGGVNRIFELEELLKASQSNAVMPSNVISVPSEQTISFRDVDIVTPSRKLLASQLSCDVSQGKSLLVTGPNGSGKSSIFRVLQSLWPVASGRLTVPSEGIFHVPQRPYTCLGTLRDQIIYPLSREEAELKMVTLSKTSDRSTPLDDHLRTILENVRLVYLLEREGWDATPNWEDILSLGEQQRLGMARLFFHSPKFGILDECTNATSVDVEEHLYRLATDLGITVVTSSQRPALIPFHSLELKLIDGEGKWELCSINH

SEQ ID NO: 5568 - protein, 1274 aa, Secale cereale
MKHREENHCNDANVHTGSKESISQNGVDGKVVKPRKKKNLLKSLHFLAAILLKKIGPSGTNYLLGLMLTAVLRTAIGHRLAKVQGYLFKSAFLRRVPTFTRLIIENLLLCFLQSTVHQTSKYLTGSLSLRFKKILTDLIHADYFENMVYYKISHVDHRITNPEQRIASDIPKFCAGLSDLVQDDLIAVADGLIYIWRICSYASPKYVLWILAYVLGAGGTIRKFSPSFGKLKAMEQQLEGEYRQVHSRLRTHAESVAFYGGENREESHIMQRFQALVRHVNVVLHENWWFGMIQDFLLKYLGATVGVILIVEPFFAGDLKPDTSTLGRAEMLSNLRYHTSVIISLFQSLGTLSTSSRRLNLLSGYADRIHELLDVSRELSGVRDRSMSRNSSAKNYISEANYIEFSGVKVVTPSGNVLVDDLTLRVESGSNLLITGPNGSGKSSLFRVLGGLWPLVSGHIVKPGVGSNLNKEIFYVPQRPYTAVGTLRDQLIYPLTADQETEPLSYGGMVDLLKNVDLEYLLERYPLDKEVNWGDELSLGEQQRLGMARLFYHKPKFAILDECTSAVTTDMEERFCNRVRAMGTSCITISHRPALVAFHDVVLSLDGEGGWKVQDNRNGSFLPTESEFDALKSSETDRKSDALAVQKAFSANTKDNTSSGPREHSYSTQVIATSPNMEIESTEQPHLVPQLQCSPRPLPVRVAAMSKILVPKIVDKQGAQLLAVALLVLSRTWISDRIASLNGTSVKYVLEQDKAAFIRLIGTSVMQSAANSIVAPSLRHLTSKIALGWRIRMTNHLLAYYLKRNAFYKVFNMTGMEIDADQRITRDVEKLTNDLAGLVTGMVKPSVDILWFTWRMKLLSGRRGVAILYAYMLLGLGFLRAVSPDFGDLSNQEQELESSFRFMHSRLRTHAESIAFFGGGSRERAMVEAKFATLLNHSKILLRKRWLYGIFDDFVTKQLPHNVTWGLSLLYALEHKGDRALTSTQGELAHALRFLASVVSQSFIAFGDILELHKKFLELSGGVNRIFELEELLKASQSNAVMPSNVISVPSEETISFRNVDIVTPSQKLLASQLSCDVSQGKSLLVTGPNGSGKSSIFRVLQSLWPVASGRLTVPSEGIFHVPQRPYTCLGTLRDQIIYPLSREEAELKMVKTGDRSTSLDDHLRTILENVRLVYLLEREGWDATPNWEDILSLGEQQRLGMARLFFHSPKFGILDECTNATSVDVEEHLYRLATDMGITVVTSSQRPALIPFHSLELKLIDGEGKWELCSINH

SEQ ID NO: 5569 - protein, 1319 aa, Secale cereale
MSSLQLLQLTEHGRNLFSSRRRTLAVVSGALLAGGTLAYAQSGRRRKHREENHCNDANVHTGSKESISQNGVDGKVVKPRKKKNLLKSLHFLAAILLKKIGPSGTNYLLGLMLTAVLRTAIGHRLAKVQGYLFKSAFLRRVPTFTRLIIENLLLCFLQSTVHQTSKYLTGSLSLRFKKILTDLIHADYFENMVYYKISHVDHRITNPEQRIASDIPKFCAGLSDLVQDDLIAVADGLIYIWRICSYASPKYVLWILAYVLGAGGTIRKFSPSFGKLKAMEQQLEGEYRQVHSRLRTHAESVAFYGGENREESHIMQRFQALVRHVNVVLHENWWFGMIQDFLLKYLGATVGVILIVEPFFAGDLKPDTSTLGRAEMLSNLRYHTSVIISLFQSLGTLSTSSRRLNLLSGYADRIHELLDVSRELSGVRDRSMSRNLSAKNYISEANYIEFSGVKVVTPSGNVLVDDLTLRVESGSNLLITGPNGSGKSSLFRVLGGLWPLVSGHIVKPGVGSNLNKEIFYVPQRPYTAVGTLRDQLIYPLTADQETEPLSYGGMVYLLKNVDLEYLLERYPLDKEVNWGDELSLGEQQRLGMARLFYHKPKFAILDECTSAVTTDMEERFCNRVRAMGTSCITISHRPALVAFHDVVLSLDGEGGWKVQDNRNGSFLPTESEFDALKSSETDRKSDALAVQKAFSANTKDNTSSAPREHSYSTQVIATSPNMEIESTEQPHLIPQLQCSPRPLPVRVAAMSKILVPKIVDKQGAQLLAVALLVLSRTWISDRIASLNGTSVKYVLEQDKAAFIRLIGTSVMQSAANSIVAPSLRHLTSKIALGWRIRMTNHLLAYYLKRNAFYKVFNMTGMEIDADQRITRDVEKLTNDLAGLVTGMVKPSVDILWFTWRMKLLSGRRGVAILYAYMLLGLGFLRAVSPDFGDLSNQEQELESSFRFMHSRLRTHAESIAFFGGGSRERAMVEAKFATLLNHSKILLRKRWLYGIFDDFVTKQLPHNVTWGLSLLYALEHKGDRSLTSTQGELAHALRFLASVVSQSFIAFGDILELHKKFLELSGGVNRIFELEELLKASQSNAVMPSNVISVPSEETISFRNVDIVTPSQKLLASQLSCDVSQGKSLLVTGPNGSGKSSIFRVLQSLWPVASGRLTVPSEGIFHVPQRPYTCLGTLRDQIIYPLSREEAELKMVKTGDRSTSLDDHLRTILENVRLVYLLEREGWDATPNWEDILSLGEQQRLGMARLFFHSPKFGILDECTNATSVDVEEHLYRLATDMGITVVTSSQRPALIPFHSLELKLIDGEGKWELCAINH

SEQ ID NO: 5570 - protein, 1131 aa, Triticum aestivum
MVYYKISHVDHRISNPEQRIASDIPKFCSELSELVQDDLAAVAEGLIYTWRLCSYASPKYMLWILGYILVAGGAIRNFSPAFGKMKSTEQHLEGEYRQLHSRLRTHAESVAFYGGEKREEYHIMQRFRALVGHLKHVLHENWWFGMIQDFFLKYFGATVAVVLIIEPFFSGDLRPDSSTLGRADMLSNLRYHTSVIIALFQSLGTLSISSRRLNILSGYADRIRELLDVSRELSGVRDRSLNHSSSVGNYISEANHIEFSGVKVVTPAGNVLVDDLTLRVETGSNLLITGPNGSGKSSLFRVLGGLWPLVSGHIVKPGVGSDLNKEIFYVPQRPYTAVGTLREQLIYPLTADQETEPLSYDGMVDLLKNVDLEYLLERYPLDKEVNWGDELSLGEQQRLGMARLFYHKPKFAILDECTSAVTIDMEERFCKKVRAMGTSCITISHRPALVAFHNIVLSLDGEGGWDVQHRRDDSSFYTEESELTSLETERKSDALTVQRAFMNRAKSNASLRSKDSYSTKVIANSPKLETGQTVRTPVIPHLQCSPRPLPLRAAAMLKILVPKLLDKQGGQLLSVALLIFSRTVISDRIASLNGTTVKFVLEQDKAAFVRLVGVSVLQSAANSFVAPSLRTLTSRLALGWRIRLTNHLLQYYLRRNAFYKVFNMSGKSIDADQRLTLDVDKLTTDLAGLVTGMVKPLVDILWFTWRMKLLSGRRGVGILYAYMLLGLGFLRAISPDFGHLASEEQELEGTFRFMHSRLRTHAESIAFFGGGSREKAMVEAKFMKLLNHSKVLLRKQWLYGIVDDFVTKQLPHNVTWGLSLLYALEHKGDRALTSTQGELAHALRFLASVVSQSFIAFGDILELHKKFLELSGGINRIFELEETLRAAQKDALVPSSAISAASDEIIEFHEVDIVTPSQKLLARKLSCSVVQGKSLLLTGPNGTGKSSVFRVLRDLWPAFSGRVTKPSEGMFHVPQSPYTSLGTLRDQIIYPMSREEAEMKILSLYKASNRSSAPELLDDHLKTVLVNVRLVYLLEREGWDSTPNWEDVLSLGEQQRLGMARLFFHHPKFGILDECTNATSVDVEEHLYRLATNMGITVITSSQRPALIPFHSVELKLIDGEGNWELCEIQH

SEQ ID NO: 5571 - protein, 175 aa, Pennisetum glaucum
MVREVAESCVDGVVMEMVAAYCGRFYAAKPELAARRIEAIGFQVGHQLSERYTMERPRFSDHLEAIKFICKDFWSELFKKQIDNLKTNHRGTFVLQDNRFRWLTRVSLDPSAESTDATDNDSAPLGDTAAQTTSMLLYFPCGLIRGALTNLGLSCSVSADMSNLPACSFVVRIKT

SEQ ID NO: 5572 - protein, 175 aa, Panicum virgatum
MVREVAESCVDGVVMEMVAAYCGRFYAVKPELAARRIEAIGFQVGHQLSERYTMERPRFSDHLEAIKFICKDFWSELFKKQIDNLKTNHRGTFVLQDNRFRWLTRVSLDPSAESTDATDNDSAPLGDTAAQTTSMLLYFPCGLIRGALTNLGISCSVSADMSNLPACSFVVRIKT

SEQ ID NO: 5573 - protein, 175 aa, Oryza sativa
MVREVAESCVDGVVMEMVAAYCGRFYAAKPELAARRIEAIGFQVGHQLTERYTMERPRFSDHLEAIKFICKDFWSELFKKQIDNLKTNHRGTFVLQDNRFRWLTRVSIDPSVESMDATDNDSATLGDSAAQTTSMLLYFPCGIIRGALTNLGISCSVTADMSNLPACSFVVRIKT

SEQ ID NO: 5574 - protein, 175 aa, Unknown
  Sequence found in Organisms: Secale cereale, Triticum aestivum
MGREVSESCVDGVVMEMVAAYCGRFYAAKPELAAGRIEAIGFQVGHQLSERYTMERPRFTDHLEAIKFICKDFWSELFKKQIDNLKTNHRGTFVLQDNHFRWLTRVSLDPAVESTDATENDSGSLGDSAAQTTSMLLYFPCGLIRGALTNLGIPCAVSADMSNLPACSFVVRIKT

SEQ ID NO: 5575 - protein, 175 aa, Hordeum vulgare
MGREVSESCVDGVVMEMVAAYCGRFYAAKPELAAGRIEAIGFQVGHQLSERYTMERPRFTDHLEAIKFICKDFWSELFKKQIDNLKTNHRGTFVLQDNHFRWLTRVSLDPAVENTDATENDSGSLGDSAAQTTSMLLYFPCGLIRGALTNLGIPCAVSADMSNLPACSFVVRIKT

SEQ ID NO: 5576 - protein, 175 aa, Avena sativa
MGREVSESCVDGVVMEMVAAYCGRFYASKPELAAGRIEAIGFQVGHQLSERYTMERPRFSDHLEAIKFICKDFWSELFKKQIDNLKTNHRGTFVLQDNHFRWLTRVSLEPSVESTDTTENDSASLGDSAAQTTSMLLYFPCGLIRGALTNLGIPCAVSADMSNLPACSFVVRIKT

SEQ ID NO: 5577 - protein, 175 aa, Oryza sativa
MGREVAESCVDGVVMQMVAAYCGGFYAAKPELAARRIEAIGFQVGHQLTERYTMERPRFSDHLEAIKFICKDFWSELFKKQIDNLKTNHRGTFVLQDNHFRWLTRVSVDPSVESMDATENDSTTLGDSAAQTTSMLLYFPCGIIRGALTNLGISCSVTADMSNLPACSFVVRIKT

SEQ ID NO: 5578 - protein, 175 aa, Brachypodium distachyon
MGREVAESCLDGVVMEMVSAYCSRFYAAKPELAAGRIEAIGFQVGHQLSERYTMDRPRFSDHLEAIKFICKDFWSELFKKQIDNLKTNHRGTFVLQDNHFPWLTRVSLDPSMESTDATESDSASLGDTAAQTTTMLLYFPCGIIRGALTNLGITCAVSADMSNLPACSFVVRIKT

SEQ ID NO: 5579 - protein, 173 aa, Zea mays
MAIAESCVDAVVMEMVAVYCGGLYTAKPELAARRIEAIGFQVGHQLSERYTMERPRFSDHLEAIKFICKDFWSELFKKQIDNLKTNHRGTFVLQDNRFRWLTRVSLDPRTENTDSTENDSAALGDTAAQTTTMLLYFPCGLIRGALTNLGISCSVSADMSNLPACSFVVRIKT

SEQ ID NO: 5580 - protein, 165 aa, Sorghum bicolor
MRWLWRWWLSTAVASTPPSLSLLPAALRPSASRSGTSSLRDIPWSALDLRDHLEAIKFICKDFWSELFKKQIDNLKTNHRGTFVLQDNRFRWLTRVSLDPYTENTDSTENDSAALGDTAAQTTTMLLYFPCGLIRGALTNLGIPCSVSADMSNLPACSFVVRIKT

SEQ ID NO: 5581 - protein, 173 aa, Zea mays
MAIAESCVDAVVMEMVAVYCGGLYAAKPELAARRIEAIGFQVGHQLSERYTMERPRFSDHLEAIKFICKDFWSELFKKQIDNLKTNHRGTFVLQDNRFRWLTRVSLDPYTENRDSTENDSAALGDTAAQTTTMLLYFPCGLIRGALTNLGIPCSVSADMSNLPACSFVVRIKT

SEQ ID NO: 5582 - protein, 175 aa, Brachypodium distachyon
MGREVAGSCLDGVVMEMVSAYCGRFYAAKPELAAGRIEAIGFQVGHQLSERYTMDRPRFTDHLEAIKFICKDFWSELFKKQIDNLKTNHRGTFVLQDNCFPWLTHVSLDPSMESTDATESDPALLGDTAAQTTSMLLYFPCGIIRGALTNLGIPCAVSADMSNLPACSFVVRIKT

SEQ ID NO: 5583 - protein, 176 aa, Elaeis guineensis
MGREVAESCVDGVVMEMVSAYCNRFYSSQPELAARRIEAIGFQVGHQLSERYTMERPRFTDHLEAIKFICKDFWSELFKKQIDNLKTNHRGTFVLQDNQFRWLTRISIDASPDNVDASPQDDSLPAPNNAAQFTSMHLYFPCGIIRGALTNLGIPCAVSADISNLPACSFVVRIKA

SEQ ID NO: 5584 - protein, 176 aa, Aristolochia fimbriata
MGREVAESCVDSVVIEMVSAYCSRLYSTHPEIAARRIEAIGFQVGHQLSERYTMERPRFSDHLEAIKFICKDFWSELFKKQVDNLKTNHRGTFVLQDNRFRWLTRVSYDPTPANSDVSPASDPSQVVDKAAQATSMHLYFPCGIIRGALTNLGIPCAVSADISNLPACSFVVRIKV

SEQ ID NO: 5585 - protein, 171 aa, Cucumis melo
MGREVAESCVDSLLTEMVSTYCHRFYANKPELAARRIEAIGYQVGHQLSERYTMERPRFTDHLEAIKFICKDFWSELFKKQIDNLKTNHRGTFVLQDNRFRWLTRMSVDPQNESQDNSADGENKAAQATSMHLYFPCGIIRGALSNLGIPCAVSADISNLPACSFVVRIKA

SEQ ID NO: 5586 - protein, 171 aa, Cucumis sativus
MGREVAESCVDSLLTEMVSTYCHRFYANKPELAARRIEAIGYQVGHQLSERYTMERPRFTDHLEAIKFICKDFWSELFKKQIDNLKTNHRGTFVLQDNRFRWLTRMSVDPQNESQDNSADGENKVAQATSMHLYFPCGIIRGALSNLGIPCAVSADISNLPACSFVVRIKA

SEQ ID NO: 5587 - protein, 737 aa, Sorghum bicolor
MRLLVPDGARRQRLLQCEARAPSPAPPSPSPSTSLARTVVVGIRRDAASRELLTWALVKVANAGDRVVALHVATADADGLLVGLDERSRAADSLASVLAVYDGFCNLKQINLELKVCGGSSIRKTLVKEAAACGAAHLILGVANNSRSFGSSFTSVAKYCSKRVPASCSVLAVNNGKVVYHKDAGHGLQHELYQSTSAIPETPRRSYRKLLSSMIGDKLWDENGKDKRCMSRAITMPMRSPARPKEVSLALVPVKGCRHESPEVATGWPLLRKKFLPDRKASVPDKSKMSVVQWAMRLPGRYSAVSPVHSEYRTTRPDSTSASHVLRDRVVVPSRSNSGKSCVVIEELEKETPEELTLLKEKFSSIYSSFSYSELAKITSDFSQECVVGQGGTSQVYRGCLANGKELAVKILKYSDEVLKEFVTEIEILSSLNHKNVISLVGFCFKNDDLLLVYEYLQRGSLEEILHGEKECKSIFGWTERFSVAVGVAHALDYLHSDNNSRPVIHRDVKSSNILISECFEPKLSDFGLAVWAADVTSQMTCNDVAGTFGYLAPEYFMHGKVNNKIDVYAFGVVLLELISGRKPLCTGCPKGQESLVMWANSIVQEGKLTQLVDPNLPTEGHTDEVERMTLAASLCIRQAPQSRPEIDVVLKLLEGDNDILKWARSQVGLSCESSDSDEFVMTPPAPRSNANIQSYINLAFDVDDDSASVSSNDFIAANTSLEEYLKGRWSRSSSFD

SEQ ID NO: 5588 - protein, 739 aa, Zea mays
MRLLVPDGARRQRLLQCEAPPSPSPPSPSPYPSSSPSRTVVVGIRRDAASRELLTWALVKVANAGDRVVALHVATAAAADGLLVRLDERSRAADSLASVLAVYDGFCNLKQINLELKVCGGSSIRKTLVKEAAACGAAHLILGVTNNSRSFGSSLTSVAKYCSKRVPASCSVLAVNNGKVVYHKDAGHGLQHELYQSNTTIPETPRRSYRKLLSTMIGDKLWDENGKDRRCVSRAVTMPMRSPARPKEFSLALVPVKGCQHESPAVATGWPLLRKKFLPDRKASAPDKSKMSVVQWAMRLPSRYSAVSPVHSEYRTTKPDSTSASHILRDRVIVPSRSNSGKSCVVIEELEKETPEELTLLKEKFSSIYSSFSYSELAKITSDFSPECVVGQGGTSQVYRGCLANGKELAVKILKYSDEVLKEFVSEIEIVSSLSHKNVISLVGFCFKNDDLLLVYEYLQRGSLEEILHGKKECKSIFGWTERFSVAMGVARALDYLHSDNNSRPVIHRDVKSSNILISKCFEPKLSDFGLAVWAADVTSQMTCNDVAGTFGYLAPEYFMHGKVGNKIDVYAFGVVLLELISGRKPLCTGCPKGQESLVMWANSIIQGGKLRQLVDPNLPTEGHVDEVERMTLAASLCIRQTPQNRPEIDAVLKLLHGDNDTLKWARSQVGLSCESSDIDEFVMTPPAPRSNTNIQSYINLAFDVDDDSASVSSNDFIAANTSLEEYLKGRWSRSSSFD

SEQ ID NO: 5589 - protein, 634 aa, Pennisetum glaucum
INLELKICGGSSIRKTLVKEAASCGAAHLILGVAQNSRSFGSSSTSVAKYCSKRVPVGCSVLAVNNGKVVYHKDGGHGMQHELYQSTIPETPRRSYRKLLSSMIGEKLWDEHGKDSRSISRAVTMPMRPPPSSMPMRSPARSKEAALALVPVKACRRESAEVATGWPLLRKKFLPDRKASLPDKSKMSVVQWAMRLPSRYSGVSPVHSECRTTRPDSLSTSHILRDRLVVPLRSNSGKSSVVIEELDKETPEELTLLKEKFSSIYSSFSYSELAKITSDFSPECVVGQGGTSQVYRGCLADGRELAVKILKYSDEVLKEFVSEIEIVSSLRHKNVISLVGFCFKNDDLLLVYEYLQRGSLEEILHGEKECKNKFGWTERFSVAVGVAHALDYLHGNDNSRPVIHRDVKSSNILISECFEPKLSDFGLAVWAADVTSQMSCNDVAGTFGYLAPEYFMHGKVNNKIDVYAFGVVLLELISGKKPLCNGCPKGQESLVMWANSIIQGGKLTQLVDPNLRTEGHTNEVERMTLAASLCIRQAPQNRPQIDAVLKLLEGDNDILKWARSQVGLAYEVDGDECVMTPPAPGSNANIQSYINLAFDVDDDAASVSSTDFIAANTSLEEYLKGRWSRSSSFD

SEQ ID NO: 5590 - protein, 654 aa, Panicum virgatum
MGLDERSRAADSLSSVLAIYDGFCNLKQINLELKVCGGSSIRKTLVKEAASCGAAHLILGVAKNSRSFGSSSTSVAKYCSKRVPAGCSVLAVNNGKVVYHKDAGHGMLPELYQSTIPETPRRSYRKLLSSMIGEKLWEEHGKDNRSISRAITMPMRSPALPKEVSLALVPVKGCRRESQEVATGWPLLRKKFLPDRKASLPDKSKMSVVQWAMRLPSRYSAVSPVHSECNRTTRPDSMSTSHILRDRVVVPLRSNSGKSSVVIEELEKETPEELTLLKEKFPSIYSSFSYRELAKITSNFSTECVIGEGGTSHVYRGCLANGRELAVKILKYSDEVLKEFVSEIEIVSSLRHKNVISLISFCFENDDLLLVYEYLQRGSLEEILHGEKGCKNIFGWTERFSVAVGVAHALDYLHGNDNSHQVIHRDVKSSNILISDCFEPKLSDFGLAVWAADVTSQMTCNDVAGTFGYLAPEYFMHGKVNNKIDVYAFGVVLLELISGRKPLCTGCPKGQESLVMWANSIIQGGKLAQLVDPNLPTEGRSDEVERMTLAASLCIRQAPQNRPQIDVVLKLLKGDIDILKWARSQVGLSYEVDADECVMTPPVKGSNANIQSYINLAFDVDDDSASVTSTDFIAANTSLEEYLKGRWSRSSSFD

SEQ ID NO: 5591 - protein, 604 aa, Panicum virgatum
MISLLRRALAPSPPPAASRWRRTLLAALLSPPPAPPGPVRRAPAQEPPRRSFRGTPSPLWFRATAASWAGSGLDAGVASGEDGGLEIAKLGISGRIVEKLAARGITRLFPIQRAVLEPAMQGKDMIGRARTGTGKTLAFGIPIMDRIISYNEKNGSSRNPLAIVLAPTRELARQVEKEFRESAPLDTLCVYGGVPINQQIRVLNYGVDIVVGTPGRIIDLLRRGVLNLSEIQFLVLDEADQMLAVGFDEDVEVIMEQLPQNRQSMLFSATMPSWIRKISNKYLKDPVIIDLVGDSDQKLPEGISLYSIASDNFGKPSLLGPLIKEHAKGGKCIVFTQTKREADRLAYAMGRSYPCQALHGDISQNQRERTLSGFRDGRFNILVATDVAARGLDIPNVDLVVHYEIPNTSELFVHRSGRTARAGKKGSAILIYTYEQTRAVRVIEQDIGCRFTELPKMAVADEAADMFNVMRDTRSRSVGSRRTGGSFGRESYGGFGNHRSRAFGDFDSFGGSFDRGGGFSDSGSRYRGGSGGFRRPSNEFGRSSFGRSDRFGDFGEGDFSRHDSSDFGRSRSSDDPGSSRYGRGSGGFGASDFGNFGGFKDSKR

SEQ ID NO: 5592 - protein, 602 aa, Sorghum bicolor
MISLLRRALASSPAATCRRPLLAALLSPPSAPPGPCQAPTPGSPAPPRRALHGSPNPLGFRSTPASWTRPGPGEGVGVDTGAEEGLEIARLWISPRIVEKLAARGITKLFPIQRAVLEPAMQGKDMIGRARTGTGKTLAFGIPIMDKILSHNEKNGNGRNPLAIVLAPTRELARQVEKEFRESAPLDTLCVYGGVPINQQMRVLNYGVDIVVGTPGRIIDLLRRGVLNLSQIQFVVLDEADQMLAVGFDEDVEVIMEQLPQNRQSMLFSATMPSWIRKISNKYLNDPVIIDLVGDSDQKLPEGISLYSIASDNFGKQSILGPLIKEHANGGKCIVFTQTKRDADRLAYVMGRSYPCQALHGDISQNQRERTLSGFRDGRFNILVATDVAARGLDIPNVDLVVHYEIPNTSELFVHRSGRTARAGKKGSAILIYTYEQTRAVRVIEQDIGCRFTELPKMPVSDEAADMFNVTRDTRSRSAGSRRTGGPFSREGYGGFGDHRSSSFGDFGGSSDRSGGFRDSGSRYRGGSGGLRRSSSELGRPSFSRSDRFGDFGDSDFSRRGNTDFGRSRSSDDSGSSRYGRGSSGFGTSGSGNLGGFKDSKR

SEQ ID NO: 5593 - protein, 415 aa, Sorghum bicolor
MEVSSRLQSLLRPLLLCRSRAAGRAFQTLALRSPPPPPPPPPRLPSSFLLRTRRLPPSHPYGAPSRVLFHRPFASVSPAPAPVPGSDHLNSKDQGPPPAPLPPPPPEDLASEDESYYHEHLLEVAQENQSRVVPVKAFFLCTSIDLRSLQSQNSFNVIPPTSRATNYVVLRYYDVKGDPEGFKSGVIDESHCHYMVVFQYGSIVLFNVSDHEADGYLKIVEKHASGLLPEMRKDDYAVVEKPTLETWMQGGLDYIVLRDLSIDGIRTIGSVLGQSIALDYYIRQVDGMVAEFTDINRGMEKTGTFTMERKKLFQLVGKANSNLADVILKLGLFERSDIAWKNANYAQIWEYLRDEYELTQRFGNLDFKLKFVEHNIRFLQEILQNRKSDFLEWLIIILISVEILISVYNIIQEQM

SEQ ID NO: 5594 - protein, 411 aa, Zea mays
MEVSSRLQSLLRPFLLCRSRAAGMTLQTLALCSPPPPPRIPSSFLLRTRRLPPPFPHGGPSRLLFHSTFASVSPAPAPAPGRDHLNSKEQGPPPAPLPPPPPEELASEDESYYHEHLLEVAQENQSRVVPVKAFFLCTSIDLRSLQSQNSFNVIPPTSRATNYVVLRYYDVKGDPEGFKSGVIDESHCHYMVVFQYGSIVLFNVSDHEADGYLKIVEKHASGLLPEMRKDDYAVVEKPTLETWMQGGLDYIVLRDLSIDGIRTIGSVLGQSIALDYYIRQVDGMVAEFTDINRGMEKTGTFTMERKKLFQLVGKANSNLADVILKLGLFERSDIAWKNANYAQIWEYLRDEYELTQRFGNLDFKLKFVEHNIRFLQEILQNRKSDFLEWLIIILISVEILISVYNIIQEQM

SEQ ID NO: 5595 - protein, 364 aa, Pennisetum glaucum
MEVSSRLQSLLRPLLRLPSRTTGRALQTLAPVPGRDHLDSKDQGPSPAPLPPPPPEELASDDEAYYHEHLLEVAQENQTRVVPVKAFFLCTSIDLRSLQSQNSFNVIPPTSRATNYVVLRYYDVKGDPEGFKSGVIDESHCHYMVVFQYGSIVLFNVSDHEADGYLKIVEKHASGLLPEMRKDDYAVVEKPTLETWMQGGLDYIVLRDLSIDGIRTIGSVLGQSIALDYYIRQVDGMVAEFTDINRGMEKTGTFTMERKKLFQLVGKANSNLADVILKLGLFERSDIAWKNANYAQIWEYLRDEYELTQRFGNLDFKLKFVEHNIRFLQEILQNRKSDFLEWLIIILISVEILISVYNIVQEQM

SEQ ID NO: 5596 - protein, 399 aa, Brachypodium distachyon
MELSRMRTLERRILRPLLLLPARSRTFQTLARSPPPRIPSLLLLLRTRHLPPPRSASLPLLRSFASVSPGRDLRCNDDGLPPAPLPPPPPEELASDDDAYYQEQLLEYAQEDQTRLVPVKAYFPCTSINLKSLQSQNSFNVIPPTSRATNYVVLRYYDVKGDPEGFKTGVIDESHCHYMVVFQYGSIVLFNVSDHEADGYLKIVERHASGLLPEMRKDDYAVVEKPTLETWMEGGLDFIILKDLSIDGIRTIGSVLGQSIALDYYIRQVDGMVAEFTDINRGMEKTGTFTMERKKLFQLVGKANSNLADVILKLGLFERSDIAWKNANYAQIWEFLRDEYELTQRFGNLDFKLKFVEHNIRFLQEILQNRKSDFLEWLIIILISVEILISVYNIVHEQM

SEQ ID NO: 5597 - protein, 411 aa, Leymus cinereus x Leymus triticoides
MELSRIRTFEKRLLRPLLSLPARSRAFQTLARSTPPPPRAPSLLLLLRTRHFPPHPHPPRRASLPPLRSFASVSPAPAPGKDLQGNSNDDEGLPPAPLPPPPEELGSDDDAYYQEQLLEYTQEDDTRLVPVKAYFPCTSINLKSLQSQNSFNVIPPTSRATNYVVLRYYDVKGDPEGFKTGVIDESHCHYMVVFQYGSIVLFNVSDHEADGYLKIVERHASGLLPEMRKDDYAVVEKPTLETWMEGGLDFIILKDLSIDGIRTIGSVLGQSIALDYYIRQVDGMVAEFTDINRGMEKTGTFTMERKKLFQLVGKANSNLADVILKLGLFERSDIAWKNANYAQIWEFLRDEYELTQRFGNLDFKLKFVEHNIRFLQEILQNRKSDFLEWLIIILISVEILISVYNIVQEQM

SEQ ID NO: 5598 - protein, 412 aa, Triticum aestivum
MELSRIRTFEKRLLRPLLSLPSRSRAFQTLARASPPPPRAPSLLLLLRTRHLAPHPHRRASLPPLRSFASVSPAPSAPGKDLQGSNGNDDDDGLPPAPLPPPPEELGSDDDAYYQEQLLEYAQEDEARLVPVKAYFPCTSINLKSLQSQNSFNVIPPTSRATNYVVLRYYDVKGDPEGFKTGVIDESHCHYMVVFQYGSIVLFNVSDHEADGYLKIVERHASGLLPEMRKDDYAVVERPAMEKWMEGGLDFIILKDLSIDGIRTIGSVLGQSIALDYYIRQVDGMVAEFTDINRGMEKTGTFTMERKKLFQLVGKANSNLADVILKLGLFERSDIAWKNANYAQIWEFLRDEYELTQRFGNLDFKLKFVEHNIRFLQEILQNRKSDFLEWLIIILISVEILISVYNIVQEQM

SEQ ID NO: 5599 - protein, 393 aa, Oryza sativa
MELCRIRTFQKSLLRPLLLLQHAPCRTLQTLGRSPSPSVFRPPRRRPPLLLLLLRSSFASVSPGPAPGSGTGECPPPPPAPLPPDELASDDDAYYHEHILEATQEDQSRLVPVKAYFPCTSINLKSLQSQNSFNVIPPTSRATNYVVLRYYDVKGDPEGFKAGIIDESHCHYMVVFQYGSIVLFNVSDHEADGYLKIVEKHASGLLPEMRKDDYAVVEKPTLETWMQGGLDFIILRDLSIDGIRTIGSVLGQSIALDYYIRQVDGMVAEFTDINRGMEKTGTFTMERKKLFQLVGKANSNLADVILKLGLFERSDIAWKNANYAQIWEYLRDEYELTQRFGNLDFKLKFVEHNIRFLQEILQNRKSDFLEWLIIILISVEILISVYNIVQEQM

SEQ ID NO: 5600 - protein, 1228 aa, Panicum virgatum
MEDDEYEEGMEMGYGGHHQHRGGHAGYAEDEDEVGYGGGDGDEMDEDGDGDAEQRDEEEITQEDAWAVISAYFEEKGLVRQQLDSFDEFIQNTMQEIVDESADIEIRPESQHNPGRQAEFAETLHKISFGQIYLSKPMMTEADGETATLFPKSARLRNLTYSAPLYVDVSYRVMKKGHDCEEVTETADYPKVFIGKVPIMLRSSYCTLYQQSEKDLTELGECPYDQGGYFIINGSEKVLIAQEKMSTNHVYVFKKRQPNKYAYVAEVRSMAENQNRPASSMFVRMLSRAGAKGGSSGQYIRATLPYIRADIPIIIVFRALGFVADKDILEHICYDFSDTQMMELLRPSLEEAFVIQNQQVALDYIGKRGATVGVTREKRIKYAKEILQKEMLPHVGVGEFCETKKAYYFGYIIHRLLMCALGRRAEDDRDHYGNKRLDLAGPLLGGLFRMLFRKLTRDVRSYVQKCVDNGKEVNLQFAIKAKTVTSGLKYSLATGNWGQANQAGTRAGVSQVLNRLTYASTLSHLRRLNSPIGREGKLAKPRQLHNSHWGMMCPAETPEGQACGLVKNLALMVYITVGSAANPILEFLEEWGTENFEEISPAVIPQAAKIFVNGCWVGIHRNADLLVKTLRRLRRQIDVNTEVGVVRDIRLKELRLYTDYGRCSRPLFIVENQRLLIKKAHIRALQQRETPDEGWHELVSKGYIEYIDTEEEETTMISMTINDLINARQNPDEAYSETYTHCEIHPSLILGVCASIIPFPDHNQSPRNTYQSAMGKQAMGIYVTNYQLRMDTLAYVLYYPQKPLVTTRAMEHLHFRQLPAGINAIVAIACYSGYNQEDSVIMNQSSIDRGFFRSLFFRSYRDEEKKMGTLVKEEFGRPNRENTMGMRHGSYDKLDDDGLAPPGTRISGEDVIIGKTSPIPQDDAQGQASRYSKRDHSTSLRHSESGMVDQVLLTTNADGLRFVKVRMRSVRIPQIGDKFSSRHGQKGTVGMTYTQEDMPWTIEGITPDIIVNPHAIPSRMTIGQLIECIMGKVAAHMGKEGDATPFTDVTVDNISKALHKCGYQMRGFETMYNGHTGRKLTAMIFLGPTYYQRLKHMVDDKIHSRGRGPVQILTRQPAEGRSRDGGLRFGEMERDCMIAHGAAFFLKERLFDQSDAYRVHVCEKCGLIAIANLKKNSFECRGCKNKTDIVQVHIPYACKLLFQELMAMAIAPRMLTHDIKTGKDQKKR

SEQ ID NO: 5601 - protein, 1222 aa, Oryza sativa
MEDDEYEEGMEMEMGGHHHPHHGGGYGAEEYGAVGGEEMEDEEADGDAPDEEEITQEDAWAVISAYFEEKGLVRQQLDSFDEFIQNTMQEIVDESADIEIRPESQHNPGRQAEFAETLHKISFGQIYLSKPMMTEADGETATLFPKSARLRNLTYSAPLYVDVSYRVMKKGHDCEEVTETMEYPKVFIGKVPIMLRSSYCTLFQQSEKDLTELGECPYDQGGYFIINGSEKVLIAQEKMSTNHVYVFKKRQPNKYAYVAEVRSMAENQNRPASSMFVRMLSRAGAKGGSSGQYIRATLPYIRADIPIIIVFRALGFVADKDILEHICYDFSDTQMMELLRPSLEEAFVIQNQQVALDYIGKRGATVGVTKEKRIKYAKEILQKEMLPHVGVGEFCETKKAYYFGYIIHRLLMCALGRRAEDDRDHYGNKRLDLAGPLLGGLFRMLFRKLTRDVRSYVQKCVDNGKEVNLQFAIKAKTITSGLKYSLATGNWGQANQAGTRAGVSQVLNRLTYASTLSHLRRLNSPIGREGKLAKPRQLHNSHWGMMCPAETPEGQACGLVKNLALMVYITVGSAANPILEFLEEWGTENFEEISPAVIPQAAKIFVNGCWVGIHRNPDLLVKTLRRLRRQIDVNTEVGVVRDIRLKELRLYTDYGRCSRPLFIVENQRLLIKKRHIRALQQRETPEEGWHDLVAKGFIEYIDTEEEETTMISMTINDLIGARHNPEEAYSETYTHCEIHPSLILGVCASIIPFPDHNQSPRNTYQSAMGKQAMGIYVTNYQLRMDTLAYVLYYPQKPLVTTRAMEHLHFRQLPAGINAIVAIACYSGYNQEDSVIMNQSSIDRGFFRSLFFRSYRDEEKKMGTLVKEEFGRPNRENTMGMRHGSYDKLDDDGLAPPGTRVSGEDVIIGKTSPIPQDDAQGQATRYTKRDHSTSLRHSESGMVDQVLLTTNADGLRFVKVRMRSVRIPQIGDKFSSRHGQKGTVGMTYTQEDMPWTIEGITPDIIVNPHAIPSRMTIGQLIECIMGKVAAHMGKEGDATPFTDVTVDNISKALHKCGYQMRGFETMYNGHTGRKLTAMIFLGPTYYQRLKHMVDDKIHSRGRGPVQILTRQPAEGRSRDGGLRFGEMERDCMIAHGAAFFLKERLFDQSDAYRVHVCEKCGLIAIANLKKNSFECRGCKNKTDIVQVHIPYACKLLFQELMAMAIAPRMLTQDNKTGKDQKKR

SEQ ID NO: 5602 - protein, 1228 aa, Brachypodium distachyon
MEDDEYEEGMEMEMGGHQQLHHRGYGADEEVDGGYGGGGDGVDMEDEDAEGEEARDEEEITQEDAWAVISAYFEEKGLVRQQLDSFDEFIQNTMQEIVDESADIEIRPESQHNPGRQAEFAETLHKISFGQIYLSKPMMTEADGETATLFPKSARLRNLTYSAPLYVDVSYRVVKKGHDCEEVTETMEYPKVFIGKVPIMLRSSYCTLFQQSEKDLTELGECPYDQGGYFVINGSEKVLIAQEKMSTNHVYVFKKRQPNKFAYVAEVRSMAENQNRPASSMFVRMLSRAGAKGGSSGQYIRATLPYIRADIPIIIVFRALGFVADKDILEHICYDFSDTQMMELLRPSLEEAFVIQNQQVALDYIGKRGATVGVTREKRIKYAKEILQKEMLPHVGVGEFCETKKAYYFGYIIHRLLMCALGRRAEDDRDHYGNKRLDLAGPLLGGLFRMLFRKLTRDVRSYVQKCVDNGKDVNLQFAIKAKTITSGLKYSLATGNWGQANQAGTRAGVSQVLNRLTYASTLSHLRRLNSPIGREGKLAKPRQLHNSHWGMMCPAETPEGQACGLVKNLALMVYITVGSAANPILEFLEEWGTENFEEISPAVIPQAAKIFVNGCWVGIHRNPDLLVKTLRRLRRQIDVNTEVGVVRDIRLKELRLYTDYGRCSRPLFIVDGQRLLIKKKHIRALQQRETPDEGWHDLVAKGFIEYIDTEEEETTMISMTINDLVSARNNPQEAYSETYTHCEIHPSLILGVCASIIPFPDHNQSPRNTYQSAMGKQAMGIYVTNYQLRMDTLAYVLYYPQKPLVTTRAMEHLHFRQLPAGINAIVAIACYSGYNQEDSVIMNQSSIDRGFFRSLFFRSYRDEEKKMGTLVKEEFGRPNRENTMGMRHGSYDKLDDDGLAPPGTRVSGEDVIIGKTSPIPQDDAQGQATRYSKRDHSTSLRHSESGMVDQVLLTTNADGLRFVKVRMRSVRIPQIGDKFSSRHGQKGTVGMTYTQEDMPWTIEGITPDIIVNPHAIPSRMTIGQLIECIMGKVAAHMGKEGDATPFTDVTVDNISKALHKCGYQMRGFETMYNGHTGRKLTAMIFLGPTYYQRLKHMVDDKIHSRGRGPVQILTRQPAEGRSRDGGLRFGEMERDCMIAHGAAFFLKERLFDQSDAYRVHVCEKCGLIAIANLKKNSFECRGCKNKTDIVQVHIPYACKLLFQELMAMAIAPRMLTHDIKSGKDQKKR

SEQ ID NO: 5603 - protein, 1214 aa, Zea mays
MEDDEYEDGMDMGYGGHHQRGGGHAGYGAEEDDEMGYGEGGGDGDEMEEEADGDAEQQEDITQDDAWAVISAYFEEKGLVRQQLDSFDEFIQNTMQEIVDESADIEIRPESQHNPGRQAEFAETLHKISFGQIYLSKPMMTEADGETATLFPKSARLRNLTYSAPLYVDVSYRVMKKGHDCEEVTETAEYPKVFIGKVPIMLRSSYCTLYQQSEKDLTELGECPYDQGGYFIINGSEKVLIAQEKMSTNHVYVFKKRQPNKFAYVAEVRSMAENQNRPASSMFVRMLSRAGAKGGSSGQYIRATLPYIRADIPIIIVFRALGFVADKDILEHICYDFSDTQMMELLRPSLEEAFVIQNQQVALDYIGKRGATVGVTREKRIKYAKEILQKEMLPHVGVGEFCETKKAYYFGYIIHRLLMCALSRRAEDDRDHYGNKRLDLAGPLLGGLFRMCVDNGKEVNLQFAIKAKTITSGLKYSLATGNWGQANQAGTRAGVSQVLNRLTYASTLSHLRRLNSPIGREGKLAKPRQLHNSHWGMMCPAETPEGQACGLVKNLALMVYITVGSAANPILEFLEEWGTENFEEISPAVIPQAAKIFVNGCWVGIHRNPDLLVKTLRRLRRQIDVNTEVGVVRDIRLKELRLYTDYGRCSRPLFIVEGQRLLIKKAHIRALQQRETPDEGWHELVSKGYIEYIDTEEEETTMISMTINDLQNARHNPEEAYSETYTHCEIHPSLILGVCASIIPFPDHNQSPRNTYQSAMGKQAMGIYVTNYQLRMDTLAYVLYYPQKPLVTTRAMEHLHFRQLPAGINAIVAIACYSGYNQEDSVIMNQSSIDRGFFRSLFFRSYRDEEKKMGTLIKEEFGRPNRENTMGMRHGSYDKLDDDGLAPPGTRVSGEDVIIGKTSPIPQDDAQGQASRYSKRDHSTALRHSESGMVDQVLLTTNADGLRFVKVRMRSVRIPQIGDKFSSRHGQKGTVGMTYTQEDMPWTIEGITPDIIVNPHAIPSRMTIGQLIECIMGKVAAQMGKEGDATPFTDVTVDNISKALHKCNYQMRGFETMYNGHTGRKLTAMIFLGPTYYQRLKHMVDDKIHSRGRGPVQILTRQPAEGRSRDGGLRFGEMERDCMIAHGAAFFLKERLFDQSDAYRVHVCEKCGLIAIANLKKNSFECRGCKNKTDIVQVHIPYACKLLFQELMAMAIAPRMLTHDMKTGKDQKKR

SEQ ID NO: 5604 - protein, 895 aa, Secale cereale
MLRFLRYTNDGIAAPIFGGSLCHSKSAGCSGLHWKAWCYSWCNSRKRIKYAKEILQKEMLPHVGVGEFCETKKAYYFGYIIHRLLMCALGRRAEDDRDHYGNKRLDLAGPLLGGLFRMLFRKLTRDVRSYVQKCVDNGKEVNLQFAIKAKTITSGLKYSLATGNWGQANQAGTRAGVSQVLNRLTYASTLSHLRRLNSPIGREGKLAKPRQLHNSHWGMMCPAETPEGQACGLVKNLALMVYITVGSAANPILEFLEEWGTENFEEISPAVIPQAAKIFVNGCWVGIHRNPDLLVKTLRRLRRQIDVNTEVGVVRDIRLKELRLYTDYGRCSRPLFIVENQRLLIKKKHIRALQQRETPDEGWHDLVAKGFIEYIDTEEEETTMISMTIRDLETSRHNPGEAYSETYTHCEIHPSLILGVCASIIPFPDHNQSPRNTYQSAMGKQAMGIYVTNYQLRMDTLAYVLYYPQKPLVTTRAMEHLHFRQLPAGINAIVAIACYSGYNQEDSVIMNQSSIDRGFFRSLFFRSYRDEEKKMGTLVKEEFGRPNRENTMGMRHGSYDKLDDDGLAPPGTRVSGEDVIIGKTSPIPQDDAQGQATRYSKRDHSTSLRHSESGMVDQVLLTTNADGLRFVKVRMRSVRIPQIGDKFSSRHGQKGTVGMTYTQEDMPWTIEGITPDIIVNPHAIPSRMTIGQLIECIMGKVAAHMGKEGDATPFTDVTVDNISKALHKCGYQMRGFETMYNGHTGRKLTAMIFLGPTYYQRLKHMVDDKIHSRGRGPVQILTRQPAEGRSRDGGLRFGEMERDCMIAHGAAFFLKERLFDQSDAYRVHVCEKCGLIAIANLKKNSFECRGCKNKTDIVQVHIPYACKLLFQELMAMAIAPRMLTHEVKGARDKHR

SEQ ID NO: 5605 - protein, 1218 aa, Sorghum bicolor
MEDDEYEEGMEMGYGGHQQHGGGHAGYGADEDDEMGYGGGGGDGDGDGEEMEEEADGDPDLRDEIGQDDAWAVISAYFEEKGLVRQQLDSFDEFIQNTMQEIVDESADIEIRPESQHNPGRQAEFAETLHKISFGQIYLSKPMMTEADGETATLFPKSARLRNLTYSAPLYVDVSYRVMKKGHDCEEVTETADYPKVFIGKVPIMLRSSYCTLYQQSEKDLTELGECPYDQGGYFIINGSEKVLIAQEKMSTNHVYVFKKRQPNKFAYVAEVRSMAENQNRPASSMFVRMLSRAGAKGGSSGQYIRATLPYIRADIPIIIVFRALGFVADKDILEHICYDFSDTQMMELLRPSLEEAFVIQNQQVALDYIGKRGATVGVTREKRIKYAKEILQKEMLPHVGVGEFCETKKAYYFGYIIHRLLMCALGRRAEDDRDHYGNKRLDLAGPLLGGLFRMCVDNGKEVNLQFAIKAKTITSGLKYSLATGNWGQANQAGTRAGVSQVLNRLTYASTLSHLRRLNSPIGREGKLAKPRQLHNSHWGMMCPAETPEGQACGLVKNLALMVYITVGSAANPILEFLEEWGTENFEEISPAVIPQAAKIFVNGCWVGIHRNPDLLVKTLRRLRRQIDVNTEVGVVRDIRLKELRLYTDYGRCSRPLFIVEGQRLLIKKAHIIALQHRETPDEGWHELVSKGYIEYIDTEEEETTMISMTISDLHNARHNPEDAYSETYTHCEIHPSLILGVCASIIPFPDHNQSPRNTYQSAMGKQAMGIYVTNYQLRMDTLAYVLYYPQKPLVTTRAMEHLHFRQLPAGINAIVAIACYSGYNQEDSVIMNQSSIDRGFFRSLFFRSYRDEEKKMGTLVKEEFGRPNRENTMGMRHGSYDKLDDDGLAPPGTRVSGEDVIIGKTSPIPQDDAQGQASRYSKRDHSTSLRHSESGMVDQVLLTTNADGLRFVKVRMRSVRIPQIGDKFSSRHGQKGTVGMTYTQEDMPWTIEGITPDIIVNPHAIPSRMTIGQLIECIMGKVAAQMGREGDATPFTDVTVDNISKALHRCNYQMRGFETMYNGHTGRKLTAMIFLGPTYYQRLKHMVDDKIHSRGRGPVQILTRQPAEGRSRDGGLRFGEMERDCMIAHGAAFFLKERLFDQSDAYRVHVCEKCGLIAIANLKKNSFECRGCKNKTDIVQVHIPYACKLLFQELMAMAIAPRMLTHDMKTGKDQKKR

SEQ ID NO: 5606 - protein, 1204 aa, Secale cereale
QHLQHRGYGAEEEVEGGYAGGGDGEDEEEEARDEEEITQEDAWAVISAYFEEKGLVRQQLDSFDEFIQNTMQEIVDESADIEIRPESQHNPGRQAEFAETLHKISFGQIYLSKPMMTEADGETATLFPKSARLRNLTYSAPLYVDVSYRVVKKGHDCEEVTETAEYPKVFIGKVPIMLRSSYCTLFQQSEKDLTELGECPYDQGGYFVINGSEKVLIAQEKMSTNHVYVFKKRQPNKFAYVGEVRSMAENQNRPASSMFVRMLSRAGAKGGSSGQYIRATLPYIRADIPIIIVFRALGFVADKDILEHICYDFSDTQMMELLRPSLEEAFVIQNQQVALDYIGKRGATVGVTREKRIKYAKEILQKEMLPHVGVGEFCETKKAYYFGYIIHRLLMCALGRRAEDDRDHYGNKRLDLAGPLLGGLFRMLFRKLTRDVRSYVQKCVDNGKEVNLQFAIKAKTITSGLKYSLATGNWGQANQAGTRAGVSQVLNRLTYASTLSHLRRLNSPIGREGKLAKPRQLHNSHWGMMCPAETPEGQACGLVKNLALMVYITVGSAANPILEFLEEWGTENFEEISPAVIPQAAKIFVNGCWVGIHRNPDLLVKTLRRLRRQIDVNTEVGVVRDIRLKELRLYTDYGRCSRPLFIVENQRLLIKKKHIRALQQRETPDEGWHDLVAKGFIEYIDTEEEETTMISMTIRDLETSRHNPGEAYSETYTHCEIHPSLILGVCASIIPFPDHNQSPRNTYQSAMGKQAMGIYVTNYQLRMDTLAYVLYYPQKPLVTTRAMEHLHFRQLPAGINAIVAIACYSGYNQEDSVIMNQSSIDRGFFRSLFFRSYRDEEKKMGTLVKEEFGRPNRENTMGMRHGSYDKLDDDGLAPPGTRVSGEDVIIGKTSPIPQDDAQGQATRYSKRDHSTSLRHSESGMVDQVLLTTNADGLRFVKVRMRSVRIPQIGDKFSSRHGQKGTVGMTYTQEDMPWTIEGITPDIIVNPHAIPSRMTIGQLIECIMGKVAAHMGKEGDATPFTDVTVDNISKALHKCGYQMRGFETMYNGHTGRKLTAMIFLGPTYYQRLKHMVDDKIHSRGRGPVQILTRQPAEGRSRDGGLRFGEMERDCMIAHGAAFFLKERLFDQSDAYRVHVCEKCGLIAIANLKKNSFECRGCKNKTDIVQVHIPYACKLLFQELMAMAIAPRMLTHEVKGARDKHR

SEQ ID NO: 5607 - protein, 1193 aa, Vitis vinifera
MYGEDEYDPTVVEEEEDDDEEITQEDAWAVISAYFEEKGLVRQQLDSFDEFIQNTMQEIVDESADIEIRPESQHNPGRQSDFLETIYKISFGQIYLSKPMMTESDGETATLFPKAARLRNLTYSAPLYVDVTKRIIKKGHDLEEVTETQEFTKVFIGKVPIMLRSSYCTVYQNSEKDLTELGECPYDQGGYFIINGSEKVLIAQEKMSTNHVYVFKKRQPNKYAYVAEVRSMAESQNRPPSSMFVRMLSRTSAKGGSSGQYIRATLPYIRTEIPIIIVFRALGFVADKDILEHICYDFSDTQMMELLRPSLEEAFVIQNQQVALDYIGKRGSTVGVTREKRIKYAKEILQKEMLPHVGVGEYCETKKAYYFGYIIHRLLLCALGRRPEDDRDHYGNKRLDLAGPLLGGLFRMLFRKLTRDVRAYVQKCVDNGKDVNLQFAIKAKTITSGLKYSLATGNWGQANAAGTRAGVSQVLNRLTYASTLSHLRRLNSPIGREGKLAKPRQLHNSHWGMMCPAETPEGQACGLVKNLALMVYITVGSAANPILEFLEEWSTENFEEISPAVIPQSTKIFVNGCWVGIHRNPDLLVKTLRQLRRQVDVNTEVGVIRDIRLKELRLYTDYGRCSRPLFIVEKQRLLIKKRDIRALQLRESPEDGGWHDLVSKGFIEYVDTEEEETTMISMTINDLISARLNPEEAYSETYTHCEIHPSLILGVCASIIPFPDHNQSPRNTYQSAMGKQAMGIYVTNYQLRMDTLAYVLYYPQKPLVTTRAMEHLHFRQLPAGINAIVAIACYSGYNQEDSVIMNQSSIDRGFFRSLFFRSYRDEEKKMGTLVKEDFGRPNRENTMGMRHGSYDKLDDDGLAPPGTRVSGEDVIIGKTTPISQDDSQGQASRYTRRDHSTSLRHSESGMVDQVLLTTNADGLRFVKVRMRSVRIPQIGDKFSSRHGQKGTVGMTYTQEDMPWTVEGITPDIIVNPHAIPSRMTIGQLIECIMGKVAAHMGKEGDATPFTDVTVDNISKALHKCGYQMRGFETMYNGHTGRRLTAMIFLGPTYYQRLKHMVDDKIHSRGRGPVQILTRQPAEGRSRDGGLRFGEMERDCMIAHGAAHFLKERLFDQSDAYRVHVCERCGLIAIANLKKNSFECRGCKNKTDIVQVHIPYACKLLFQELMAMAIAPRMLTKEVKPPKDQKKKGA

SEQ ID NO: 5608 - protein, 730 aa, Manihot esculenta
MEDDQEYDQPMNEEEEDDEEITQEDAWAVISAYFEEKGLVRQQLDSFDEFIQNTMQEIVDESADIEIRPESQHNPGHQSDFAETIYKICFGQIYLSKPMMTESDGETATLFPKAARLRNLTYSAPLYVDVTKRVIKKGHDGEEVTETQDFTKVFIGKVPIMLRSSYCTLYQNSEKDLTELGECPYDQGGYFIINGSEKVLIAQEKMSTNHVYVFKKRQPNKYAYVAEVRSMAESQNRPPSTMFVRMLSRTSAKGGSSGQYIRATLPYIRTEIPIIIVFRALGFVADKDILEHICYDFSDTQMMELLRPSLEEAFVIQNQQVALDYIGKRGATVGVTKEKRIKYAKEILQKEMLPHVGVGEYCETKKAYYFGYIIHRLLLCALGRRAEDDRDHYGNKRLDLAGPLLGGLFRMLFRKLTRDVRSYVQKCVDNGKDVNLQFAIKAKTITSGLKYSLATGNWGQANAAGTRAGVSQVLNRLTYASTLSHLRRLNSPIGREGKLAKPRQLHNSQWGMMCPAETPEGQACGLVKNLALMVYITVGSAAYPILEFLEEWGTENFEEISPAVIPQATKIFVNGCWVGIHRNPDMLVKTLRRLRRRVDVNTEVGVVRDIRLKELRIYTDYGRCSRPLFIVEKQRLLIKKKDIHALQQRESSEEGGWHDLVAKGFIEYIDTEEEETTMISMTIHDLVQARLNPEEAYADTYTHCEIHPSLILGVCASIIPFPDHNQAIST

SEQ ID NO: 5609 - protein, 1198 aa, Populus trichocarpa
MEDLDEYDQQPMNEDMEPEEEDADEEITQEDAWAVISAYFEEKGLVRQQLDSFDEFIQNTMQEIVDESADIEIRPESQHNPGHQSDFAETIYKISFGQIYLSKPMMTESDGETATLFPKAARLRNLTYSAPLYVDVTKRVIKKGHDGEEVTETQDFTKVFIGKVPIMLRSSYCTLYQNSEKDLTELGECPYDQGGYFIINGSEKVLIAQEKMSTNHVYVFKKRQPNKYAYVGEVRSMAESQNRPPSTMFVRMLSRTSAKGGSSGQYIRATLPYIRTEIPIIIVFRALGFVADKDILEHICYDFADTQMMELLRPSLEEAFVIQNQQVALDYIGKRGATVGVTREKRIKYAKEILQKEMLPHVGVGEYCETKKAYYFGYIIHRLLLCALGRRAEDDRDHYGNKRLDLAGPLLGGLFRMLFRKLTRDVRSYVQKCVDNGKDVNLQFAIKAKTITSGLKYSLATGNWGQANAAGTRAGVSQVLNRLTYASTLSHLRRLNSPIGREGKLAKPRQLHNSQWGMMCPAETPEGQACGLVKNLALMVYITVGSAAYPILEFLEEWGTENFEEISPAVIPQATKIFVNGGWVGIHRDPDMLVKTLRRLRRRVDVNTEVGVVRDIRLKELRIYTDYGRCSRPLFIVEKQKLLIRKKDIHALQQRETPDEGGWHDLVSKGFIEYIDTEEEETTMISMTIHDLVQARINPEEAYSDTYTHCEIHPSLILGVCASIIPFPDHNQSPRNTYQSAMGKQAMGIYVTNYQFRMDTLAYVLYYPQKPLVTTRAMEHLHFRQLPAGINAIVAIACYSGYNQEDSVIMNQSSIDRGFFRSLFFRSYRDEEKKMGTLVKEDFGRPDRSNTMGMRHGSYDKLDDDGLAPPGTRVSGEDVIIGKTTPIAQEEAQGQSARYTRRDHSISLRHSETGMVDQVLLTTNADGLRFVKVRVRSVRIPQIGDKFSSRHGQKGTVGMTYTQEDMPWTVEGITPDIIVNPHAIPSRMTIGQLIECIMGKVAAHMGKEGDATPFTDVTVDNISKALHKCGYQMRGFETMYNGHTGRRLSAMIFLGPTYYQRLKHMVDDKIHSRGRGPVQILTRQPAEGRSRDGGLRFGEMERDCMIAHGAAHFLKERLFDQSDAYRVHVCERCGLIAIANLKKNSFECRGCKNKTDIVQVHIPYACKLLFQELMAMAIAPRMLTKDIKQAKSQKKKGA

SEQ ID NO: 5610 - protein, 1189 aa, Unknown
  Sequence found in Organisms: Gossypium hirsutum, Gossypium raimondii
MEDDSEYDPQLMEDEDDEEITQEDAWAVISAYFEEKGLVRQQLDSFDEFIQNTMQEIVDESADIEIRPESQHNPGHQSDFAETIYKISFGQIYLSKPMMTESDGETATLFPKAARLRNLTYSAPLYVDVTKRVIKKGHDGEEVTETQDFTKVFIGKVPIMLRSSYCTLYQNSEKDLTELGECPYDQGGYFIINGSEKVLIAQEKMSTNHVYVFKKRQPNKYAYVAEVRSMAESQNRPPSTMFVRMLSRTSAKGGSSGQYIRATLPYIRTEIPIIIVFRALGFVADKDILEHICYDFSDTQMMELLRPSLEEAFVIQNQQVALDYIGKRGATVGVTREKRIKYAKEILQKEMLPHVGVGEFCETKKAYYFGYIIHRLLLCALGRRAEDDRDHYGNKRLDLAGPLLGGLFRMLFRKLTRDVRSYVQKCVDNGKDVNLQFAIKAKTITSGLKYSLATGNWGQANAAGTRAGVSQVLNRLTYASTLSHLRRLNSPIGREGKLAKPRQLHNSQWGMMCPAETPEGQACGLVKNLALMVYITVGSAAYPILEFLEEWGTENFEEISPAVIPQATKIFVNGCWVGVHRNPDMLVTTLRRLRRRVDVNTEVGVVRDIRLKELRIYTDYGRCSRPLFIVEKQRLLIKKKDIHALQQRETPEDGGWHDLVAKGFIEYIDTEEEETTMISMTINDLVQARINPEEAYSETYTHCEIHPSLILGVCASIIPFPDHNQSPRNTYQSAMGKQAMGIYVTNYQFRMDTLAYVLYYPQKPLVTTRAMEHLHFRQLPAGINAIVAIACYSGYNQEDSVIMNQSSIDRGFFRSLFFRSYRDEEKKMGTLVKEDFGRPDRATTMGMRHGSYDKLDDDGLAPPGTRVSGEDVIIGKTTPISQEEAQGQASRYSKRDHSISLRHSETGIVDQVLLTTNADGLRFVKVRVRSVRIPQIGDKFSSRHGQKGTVGMTYTQEDMPWTVEGITPDIIVNPHAIPSRMTIGQLIECIMGKVAAHMGKEGDATPFTDVTVDNISRALHKCGYQMRGFETMYNGHTGRRLTAMIFLGPTYYQRLKHMVDDKIHSRGRGPVQILTRQPAEGRSRDGGLRFGEMERDCMIAHGAAHFLKERLFDQSDAYRVHVCERCGLIAIANLKKNSFECRGCKNKTDIVQVHIPYACKLLFQELMAMAIAPRMLTKEPPKDQKKKGA

SEQ ID NO: 5611 - protein, 1196 aa, Eucalyptus grandis
MMEDEQEYDPAYAEGEGEEDDDEITQEDAWAVISAYFEDKGLVRQQLDSFDEFIQNTMQEIVDESADIEIRPESQHNPGHQPDFAETIYKINFGQIYLSKPMMTESDGETATLFPKAARLRNLTYSAPLYVDVSMRVIKKGHDGEELTEPQDLQKVFIGKVPIMLRSSYCTLYQNSEKDLTELGECPYDQGGYFIINGSEKVLIAQEKMSTNHVYVFKKRQPNKYAYVAEVRSMAESQNRPPSTMFVRMLSRTSAKGGSSGQYIRATLPYIRTEIPIIIVFRALGFVADKDILEHICYDFSDTKMMELLRPSLEEAFVIQNQQVALDYIGKRGATVGVTREKRIKYAKEILQKEMLPHVGVEEYCETKKAYYFGYIIHRLLLCALGRRPEDDRDHYGNKRLDLAGPLLGGLFRMLFRKLTRDVRGYVQKCVDNGKDVNLQFAIKAKTITSGLKYSLATGNWGQANAAGTRAGVSQVLNRLTYASTLSHLRRLNSPIGREGKLAKPRQLHNSQWGMMCPAETPEGQACGLVKNLALMVYITVGSAAYPILEFLEEWGTENFEEISPVVIPQATKIFVNGCWVGIHRDPDMLVKTLRRLRRRVDVNTEVGVVRDIRLKELRIYTDYGRCSRPLFIVEKQRLLIKKQHIHALQLREGSPDDVGWHELVAKGFIEYIDTEEEETTMISMTINDLVQARLNPEEAYSETYTHCEIHPSLILGVCASIIPFPDHNQSPRNTYQSAMGKQAMGIYVTNYQFRMDTLAYVLYYPQKPLVTTRAMEHLHFRQLPAGINAIVAIACYSGYNQEDSVIMNQSSIDRGFFRSLFFRSYRDEEKKMGTLVKEDFGRPDRANTMGMRHGSYDKLDDDGLAPPGTRVSGEDVIIGKTTPIAQDDAQGQASRYSRRDHSISLRHSETGIVDQVLLTTNADGLRFVKVRVRSVRIPQIGDKFSSRHGQKGTVGMTYTQEDMPWTVEGITPDIVVNPHAIPSRMTIGQLIECIMGKVAAHMGKEGDATPFTDVTVDNISKALHKCGYQMRGFETMYNGHTGRRLTAMIFLGPTYYQRLKHMVDDKIHSRGRGPVQILTRQPAEGRSRDGGLRFGEMERDCMIAHGAAHFLKERLFDQSDAYRVHVCERCGLIAIANLKKNSFECRGCKNKTDIVQVHIPYACKLLFQELMSMAIAPRMLTKDIKPAKDQKKKGA

SEQ ID NO: 5612 - protein, 1194 aa, Ricinus communis
MEDDQEYDQNLNEDYEDEDEDEITQEDAWAVISAYFEEKGLVRQQLDSFDEFIQNTMQEIVDESADIEIRPESQHNPGHQSDFAETIYKISFGQIYLSKPMMTESDGETATLFPKAARLRNLTYSAPLYVDVTKRVIKKGHDGEEVTETQDFTKVFIGKVPIMLRSSYCTLYQNSEKDLTELGECPYDQGGYFIINGSEKVLIAQEKMSTNHVYVFKKRQPNKYAYVAEVRSMAESQNRPPSTMFVRMLSRTSAKGGSSGQYIRATLPYIRTEIPIIIVFRALGFVADKDILEHICYDFSDTQMMELLRPSLEEAFVIQNQQVALDYIGKRGATVGVTKEKRIKYAKEILQKEMLPHVGVGEYCETKKAYYFGYIIHRLLLCALGRRAEDDRDHYGNKRLDLAGPLLGGLFRMLFRKLTRDVRSYVQKCVDNGKDVNLQFAIKAKTITSGLKYSLATGNWGQANAAGTRAGVSQVLNRLTYASTLSHLRRLNSPIGREGKLAKPRQLHNSQWGMMCPAETPEGQACGLVKNLALMVYITVGSAAYPILEFLEEWGTENFEEISPAVIPQATKIFVNGCWVGIHRDPDMLVKTLRRLRRRVDVNTEVGVVRDIRLKELRIYTDYGRCSRPLFIVEKQRLLIKKKDIHALQQRESSEEGGWHDLVAKGFIEYIDTEEEETTMISMTIHDLVQARINPEEAYSDTYTHCEIHPSLILGVCASIIPFPDHNQSPRNTYQSAMGKQAMGIYVTNYQFRMDTLAYVLYYPQKPLVTTRAMEHLHFRQLPAGINAIVAIACYSGYNQEDSVIMNQSSIDRGFFRSLFFRSYRDEEKKMGTLVKEDFGRPDRANTMGMRHGSYDKLDDDGLAPPGTRVSGEDVIIGKTTPIAQEEAQGQSARYTRRDHSISLRHSETGIVDQVLLTTNADGLRFVKVRVRSVRIPQIGDKFSSRHGQKGTVGMTYTQEDMPWTVEGITPDIIVNPHAIPSRMTIGQLIECIMGKVAAHMGKEGDATPFTDVTVDNISKALHKCGYQMRGFETMYNGHTGRRLTAMIFLGPTYYQRLKHMVDDKIHSRGRGPVQILTRQPAEGRSRDGGLRFGEMERDCMIAHGAAHFLKERLFDQSDAYRVHVCERCGLIAIANLKKNSFECRGCKNKTDIVQVHIPYACKLLFQELMAMAIAPRMLTKDVKPTKDQKKKGA

SEQ ID NO: 5613 - protein, 1194 aa, Cajanus cajan
MDLEEEQEYDQQMMEEEDDEDEITQEDAWAVISAYFEEKGLVRQQLDSFDEFIQNTMQEIVDESADIEIRPESQHNPGHQSDVAETIYKISFGQIYLSKPMMTESDGETATLFPKAARLRNLTYSAPLYVDVSKRVIKKGHDGEEVTETQDFTKVFIGKVPIMLRSSYCTLYQNSEKDLTELGECPYDQGGYFIINGSEKVLIAQEKMSTNHVYVFKKRQPNKYAYVAEVRSMAESQNRPPSTMFVRMLSRTSSKGGSSGQYIRATLPYIRTEIPIIIVFRALGFVADKDILEHICYDFSDTQMMELLRPSLEEAFVIQNQQVALDYIGKRGATVGVTKEKRIKYAKEILQKEMLPHVGVGEYCETKKAYYFGYIIHRLLLCALGRRAEDDRDHYGNKRLDLAGPLLGGLFRMLFRKLTRDVRAYVQKCVDNGKDVNLQFAIKAKTITSGLKYSLATGNWGQANAAGTRAGVSQVLNRLTFASTLSHLRRLNSPIGREGKLAKPRQLHNSQWGMMCPAETPEGQACGLVKNLALMVYITVGSAAYPILEFLEEWGTENFEEISPAVIPQATKIFVNGCWMGIHRDPDMLVRTLRKLRRRVDVNTEVGVVRDIRLKELRIYTDYGRCSRPLFIVDKQRLLIKKKDIHVLQQRESPEEGGWHDLVSKGFVEYIDTEEEETTMISMTINDLVQARLNPEDAYSDTYTHCEIHPSLILGVCASIIPFPDHNQSPRNTYQSAMGKQAMGIYVTNYQFRMDTLAYVLYYPQKPLVTTRAMEHLHFRQLPAGINAIVAIACYSGYNQEDSVIMNQSSIDRGFFRSLFFRSYRDEEKKMGTLVKEDFGRPDRTNTMGMRHGSYDKLDDDGLAPPGTRVSGEDVIIGKTTPISQEEAQGQNSRYSRRDHSISLRHSETGIVDQVLLTTNADGLRFVKVRVRSVRIPQIGDKFSSRHGQKGTVGMTYTQEDMPWTVEGITPDIIVNPHAIPSRMTIGQLIECIMGKVAAHMGKEGDATPFTDVTVDNISKALHKCGYQMRGFETMYNGHTGRRLSAMIFLGPTYYQRLKHMVDDKIHSRGRGPVQILTRQPAEGRSRDGGLRFGEMERDCMIAHGAAHFLKERLFDQSDAYRVHVCERCGLIAIANLKKNSFECRGCKNKTDIVQVYIPYACKLLFQELMAMAIAPRMLTKDIKSAKDQKKKGA

SEQ ID NO: 5614 - protein, 457 aa, Populus trichocarpa
MGKQAMGIYVTNYQFRMDTLAYVLYYPQKPLVTTRAMEHLHFRQLPAGINAIVAIACYSGYNQEDSVIMNQSSIDRGFFRSLFFRSYRDEEKKMGTLVKEDFGRPDRSNTMGMRHGSYDKLDDDGLAPPGTRVSGEDVIIGKTTPIAQEEAQGQSARYTRRDHSISLRHSETGMVDQVLLTTNADGLRFVKVRVRSVRIPQIGDKFSSRHGQKGTVGMTYTQEDMPWTVEGITPDIIVNPHAIPSRMTIGQLIECIMGKVAAHMGKEGDATPFTDVTVDNISKALHKCGYQMRGFETMYNGHTGRRLSAMIFLGPTYYQRLKHMVDDKIHSRGRGPVQILTRQPAEGRSRDGGLRFGEMERDCMIAHGAAHFLKERLFDQSDAYRVHVCERCGLIAIANLKKNSFECRGCKNKTDIVQVHIPYACKLLFQELMAMAIAPRMLTKDIKQAKSQKKKGA

SEQ ID NO: 5615 - protein, 1194 aa, Phaseolus vulgaris
MDLEEEQEYDQQMMEEEDDEDDITQEDAWAVISAYFEEKGLVRQQLDSFDEFIQNTMQEIVDESADIEIRPESQHNPGHQSDFAETIYRISFGQIYLSKPMMTESDGETATLFPKAARLRNLTYSAPLYVDVSKRVIKKGHDGEEVTETQDFTKVFIGKVPIMLRSSYCTLYQNSEKDLTELGECPYDQGGYFIINGSEKVLIAQEKMSTNHVYVFKKRQPNKYAYVAEVRSMAESQNRPPSTMFVRMLSRTSSKGGSSGQYIRATLPYIRTEIPIIIVFRALGFVADKDILEHICYDFSDTQMMELLRPSLEEAFVIQNQQVALDYIGKRGATVGVTKEKRIKYAKEILQKEMLPHVGVGEYCETKKAYYFGYIIHRLLLCALGRRAEDDRDHYGNKRLDLAGPLLGGLFRMLFRKLTRDVRGYVQKCVDNGKDVNLQFAIKAKTITSGLKYSLATGNWGQANAAGTRAGVSQVLNRLTFASTLSHLRRLNSPIGREGKLAKPRQLHNSQWGMMCPAETPEGQACGLVKNLALMVYITVGSAAYPILEFLEEWGTENFEEISPAVIPQATKIFVNGSWMGIHRDPDMLVRTLRKLRRRVDVNTEVGVVRDIRLKELRIYTDYGRCSRPLFIVDKQRLLIKKRDIHALQQRESPEEGGWHDLVSKGFIEYIDTEEEETTMISMTINDLVQARLNPEDAYSDTYTHCEIHPSLILGVCASIIPFPDHNQSPRNTYQSAMGKQAMGIYVTNYQFRMDTLAYVLYYPQKPLVTTRAMEHLHFRQLPAGINAIVAIACYSGYNQEDSVIMNQSSIDRGFFRSLFFRSYRDEEKKMGTLVKEDFGRPDRTNTMGMRHGSYDKLDDDGLAPPGTRVSGEDVIIGKTTPISQEEAQGQALRYTRRDHSISLRHSETGMVDQVLLTTNADGLRFVKVRVRSVRIPQIGDKFSSRHGQKGTVGMTYTQEDMPWTVEGITPDIIVNPHAIPSRMTIGQLIECIMGKVAAHMGKEGDATPFTDVTVDNISKALHKCGYQMRGFETMYNGHTGRRLSAMIFLGPTYYQRLKHMVDDKIHSRGRGPVQILTRQPAEGRSRDGGLRFGEMERDCMIAHGAAHFLKERLFDQSDAYRVHVCERCGLIAIANLKKNSFECRGCKNKTDIVQVYIPYACKLLFQELMAMAIAPRMLTKEIKSAKDQKKKGA

SEQ ID NO: 5616 - protein, 1195 aa, Unknown
  Sequence found in Organisms: Citrus clementina, Citrus sinensis
MMEDDYDYEEQHQQEEEDEEEEITQEDAWAVISAYFEEKGLVRQQLDSFDEFIQNTMQEIVDESADIEIRPESQHNPGQQSDFAETIYKISFGQIYLSKPMMTESDGETATLFPKAARLRNLTYSAPLYVDVTKRVIKKGHDGEEVTETQDFTKVFIGKVPIMLRSSYCTLYQNSEKDLTELGECPYDQGGYFIINGSEKVLIAQEKMSTNHVYVFKKRQPNKYAYVAEVRSMAESQNRPPSTMFVRMLSRTSAKGGSSGQYIRATLPYIRTEIPIIIVFRALGFVADKDILEHICYDFQDTQMMELLRPSLEEAFVIQNQQVALDYIGKRGATVGVTRDKRIKYAKEILQKEMLPHVGTGDFCETKKAYYFGYIIHRLLLCALGRRAEDDRDHYGNKRLDLAGPLLGGLFRMLFRKLTRDVRAYVQKCVDNGKDVNLQFAIKAKTITSGLKYSLATGNWGQANAAGTRAGVSQVLNRLTYASTLSHLRRLNSPIGREGKLAKPRQLHNSQWGMMCPAETPEGQACGLVKNLALMVYITVGSAAYPILEFLEEWGTENFEEISPAVIPQATKIFVNGCWVGIHRDPEMLVKTLRRLRRRVDVNTEVGVVRDIRLKELRIYTDYGRCSRPLFIVEKQRLLIKKRDIIALQQRESPEDGGWHDLVAKGFIEYIDTEEEETTMISMTINDLVQARLHPEEAYADTYTHCEIHPSLILGVCASIIPFPDHNQSPRNTYQSAMGKQAMGIYVTNYQFRMDTLAYVLYYPQKPLVTTRAMEHLHFRQLPAGINAIVAIACYSGYNQEDSVIMNQSSIDRGFFRSLFFRSYRDEEKKMGTLVKEDFGRPDRSNTMGMRHGSYDKLDDDGLAPPGTRVSGEDVIIGKTTPISQDEAQGQASRYTRRDHSISLRHSETGMVDQVLLTTNADGLRFVKVRVRSVRIPQIGDKFSSRHGQKGTVGMTYTQEDMPWTVEGITPDIIVNPHAIPSRMTIGQLIECIMGKVAAHMGKEGDATPFTDVTVDNISKALHKCGYQMRGFETMYNGHTGRRLTAMIFLGPTYYQRLKHMVDDKIHSRGRGPVQILTRQPAEGRSRDGGLRFGEMERDCMIAHGASHFLKERLFDQSDAYRVHVCEHCGLIAIANLKKNSFECRGCKNKTDIVQVHIPYACKLLFQELMAMAIAPRMLTKEDTKQSKDHKKKGA

SEQ ID NO: 5617 - protein, 1197 aa, Mimulus guttatus
MDMDEEFYEQGYPDEEFEEEDEEEITQEDAWAVISAYFEEKGLVRQQLDSFDEFIQNTMQEIVDESADIEIRPESQHNPGHQPDFAETIYKISFGQIYLSKPMMTESDGETATLFPKAARLRNLTYSAPLYVDVTKRVIKKGHDGEEVTETQDFTKVFIGKVPIMLRSSYCTLYQNSEKDLTELGECPYDQGGYFIINGSEKVLIAQEKMSTNHVYVFKKRQPNKYAYVAEVRSMAETQNRPPSTMFIRMLARTSAKGGSSGQYIRATLPYIRSEIPIIIVFRALGFVADKDILEHICYNFQDTQMMELLRPSLEEAFVIQNQQVALDYIGKRGATVGVTRDRRIKYAKEILQKEMLPHVGVGEYCETKKAYYFGYIIHRLLLCALGRRAEDDRDHYGNKRLDLAGPLLGGLFRMLFRKLTRDVRGYVQKCVDNGKDVNLQFAIKAKTITSGLKYSLATGNWGQANAAGTRAGVSQVLNRLTYASTLSHLRRLNSPIGREGKLAKPRQLHNSQWGMMCPAETPEGQACGLVKNLALMVYITVGSAAYPILEFLEEWGTENFEEISPAVIPQATKIFVNGCWVGIHRNPDMLVSTLRRLRRRVDVNTEVGVVRDIRLKELRIYTDYGRCSRPLFIVEKQRLLIKKKDIQALQQRESPDDGGWHDLVAKGFIEYIDTEEEETTMISMTINDLVSARINPGEAYSDTYTHCEIHPSLILGVCASIIPFPDHNQSPRNTYQSAMGKQAMGIYVTNYQFRMDTLAYVLYYPQKPLVTTRAMEHLHFRQLPAGINAIVAISCYSGYNQEDSVIMNQSSIDRGFFRSLFFRSYRDEEKKMGTLVKEDFGRPDRANTMGMRHGSYDKLDDDGLAPPGTRVSGEDVIIGKTTPITPDEAQGQANARYTKRDHSTSLRHSETGMVDQVLLTTNADGLRFVKVRVRSVRIPQIGDKFSSRHGQKGTVGMTYTQEDMPWTLEGINPDIIVNPHAIPSRMTIGQLIECVMGKVAAHMGKEGDATPFTDVTVDNISKALHKCGYQMRGYETMYNGHTGRKLTSMIFLGPTYYQRLKHMVDDKIHSRGRGPVQILTRQPAEGRSRDGGLRFGEMERDCMIAHGAAHFLKERLFDQSDAYRIHVCEKCGLIAIANLKKNSFECRACKNKTDIVQVHIPYACKLLFQELMSMAIAPRMLTKDIKQSKEQKKKGA

SEQ ID NO: 5618 - protein, 1197 aa, Petunia hybrida
MDMEEEYEEQQYDMNNEEEEEEEEEITQEDAWAVISAYFEEKGLVRQQLDSFDEFIQNTMQEIVDESADIEIRPESQHNPGHQSDFAETIYKINFGQIYLSKPMMTESDGETATLFPKAARLRNLTYSAPLYVDVTKRVIKKGHDGEEVTETQDFTKVFIGKVPIMLRSSYCTLYQNSEKDLTELGECPLDQGGYFIINGSEKVLIAQEKMSTNHVYVFKKRQPNKYAFVAEVRSMAESQNRPPSTMFVRMLSRTSAKGGSSGQYIRATLPYIRTEIPIIIVFRALGFVADKDILEHICYDFNDTQMMELLRPSLEEAFVIQNQQVALDYIGKRGATVGVTKEKRIKYAKEILQKEMLPHVGVGEYCETKKAYYFGYIIHRLLLCALGRRAEDDRDHYGNKRLDLAGPLLGGLFRMLFRKLTRDVRSYVQKCVDNGKDVNLQFAIKAKTITSGLKYSLATGNWGQANAAGTRAGVSQVLNRLTYASTLSHLRRLNSPIGREGKLAKPRQLHNSQWGMMCPAETPEGQACGLVKNLALMVYITVGSAAYPILEFLEERGTENFEEISPAVIPQATKIFVNGTWMGIHRDPDMLVRTLRRLRRRVDVNTEVGVVRDIRLKELRIYTDYGRCSRPLFIVEKQKLLIKKKDIQQLQQRETPEEGGWHDLVAKGYIEYIDTEEEETTMISMTINDLVQASINPEDAYSDTYTHCEIHPSLILGVCASIIPFPDHNQSPRNTYQSAMGKQAMGIYVTNYQFRMDTLAYVLYYPQKPLVTTRAMEHLHFRQLPAGINAIVAISCYSGYNQEDSVIMNQSSIDRGFFRSLFFRSYRDEEKKMGTLVKEDFGRPDRASTMGMRHGSYDKLDDDGLAPPGTRVSGEDVIIGKTTPISQDDAQGQASRYTRKDHSTSLRHSETGMVDQVLLTTNADGLRFVKVRVRSVRIPQIGDKFSSRHGQKGTVGMTYTQEDMPWTIEGITPDIIVNPHAIPSRMTIGQLIECIMGKVAAHMGKEGDATPFTDVTVDNISKALHKCGYQMRGFETMYNGHTGRRLPAMIFLGPTYYQRLKHMVDDKIHSRGRGPVQILTRQPAEGRSRDGGLRFGEMERDCMIAHGAAHFLKERLFDQSDAYRVHVCERCGLIAIANLKKNSFECRGCKNKTDIVQVHIPYACKLLFQELMAMAIAPRMLTKDVKQARDQKKKGA

SEQ ID NO: 5619 - protein, 1191 aa, Solanum phureja
MDLEDEYEPQYNVDDDEEEITQEDAWAVISAYFEEKGLVRQQLDSFDEFIQNTMQEIVDESADIEIRPESQHNPGHQSDFAETIYKINFGQIYLSKPMMTESDGETATLFPKAARLRNLTYSAPLYVDVTKRVIKKGHDGEEVTETQDFTKVFIGKVPIMLRSSYCTLYQNSEKDLTELGECPLDQGGYFIINGSEKVLIAQEKMSTNHVYVFKKRQPNKYAFVAEVRSMAESQNRPPSTMFVRMLSRTSAKGGSSGQYIRATLPYIRTEIPIIIVFRALGFVADKDILEHICYDFNDTQMMELLRPSLEEAFVIQNQQVALDYIGKRGATVGVTREKRIKYAKEILQKEMLPHVGVGEYCETKKAYYFGYIIHRLLLCALGRRAEDDRDHYGNKRLDLAGPLLGGLFRMLFRKLTRDVRGYVQKCVDNGKDVNLQFAIKAKTITSGLKYSLATGNWGQANAAGTRAGVSQVLNRLTYASTLSHLRRLNSPIGREGKLAKPRQLHNSQWGMMCPAETPEGQACGLVKNLALMVYITVGSAAYPILEFLEEWGTENFEEISPAVIPQATKIFVNGTWVGIHRDPDMLVRTLRRLRRRVDVNTEVGVVRDIRLKELRIYTDYGRCSRPLFIVEKQRLMIKKKDIQTLQQRESPDEGGWHDLVAKGYIEYIDTEEEETTMISMTINDLVQARLNPGDAYSDTYTHCEIHPSLILGVCASIIPFPDHNQSPRNTYQSAMGKQAMGIYVTNYQFRMDTLAYVLYYPQKPLVTTRAMEHLHFRQLPAGINAIVAISCYSGYNQEDSVIMNQSSIDRGFFRSLFFRSYRDEEKKMGTLVKEDFGRPDRATTMGMRHGSYDKLDDDGLAPPGTRVSGEDVIIGKTTPISQDDAQGQASRYTRKDHSTSLRHSETGMVDQVLLTTNADGLRFVKVRVRSVRIPQIGDKFSSRHGQKGTVGMTYTQEDMPWTVEGISPDIIVNPHAIPSRMTIGQLIECIMGKVAAHMGKEGDATPFTDVTVDNISKALHKCGYQMRGFETMYNGHTGRRLSAMIFLGPTYYQRLKHMVDDKIHSRGRGPVQILTRQPAEGRSRDGGLRFGEMERDCMIAHGAAHFLKERLFDQSDAYRVHVCERCGLIAIANLKKNSFECRGCKNKTDIVQVHIPYACKLLFQELMAMAIAPRMLTKDVKLAKDQKKKAA

SEQ ID NO: 5620 - protein, 1192 aa, Glycine max
MDLEEEQEYDEQMMEEEDDEEEITQEDAWAVISAYFEEKGLVRQQLDSFDEFIQNTMQEIVDESADIEIRPESQHNPGHQSDFAETIYKISFGQIYLSKPMMTESDGETATLFPKAARLRNLTYSAPLYVDVSKRVIKKGHDGEEVTEAQDFTKVFIGKVPIMLRSSYCTLYQNSEKDLTELGECPYDQGGYFIINGSEKVLIAQEKMSTNHVYVFKKRQPNKYAYVAEVRSMAESQNRPPSTMFVRMLSRTSSKGGSSGQYIRATLPYIRTEIPIIIVFRALGFVADKDILEHICYDFSYTQMMELLRPSLEEAFVIQNQQVALDYIGKRGATVGVTKEKRIKYAKEILQKEMLPHVGVGEYCETKKAYYFGYIIHRLLLCALGRRAEDDRDHYGNKRLDLAGPLLGGLFRMLFRKLTRDVRGYVQKCVDNGKDVNLQFAIKAKTITSGLKYSLATGNWGQANAAGTRAGVSQVLNRLTYASTLSHLRRLNSPIGREGKLAKPRQLHNSQWGMMCPAETPEGQACGLVKNLALMVYITVGSAAYPILEFLEEWGTENFEEISPAVIPQATKIFVNGCWMGIHRDPDMLVRTLKKLRRRVDVNTEVGVVRDIRLKELRIYTDYGRCSRPLFIVDKQRLLIKKKDIHALQQRESPEDGGWHDLVSKGFIEYIDTEEEETTMISMTINDLVQARINPEDAYSDTYTHCEIHPSLILGVCASIIPFPDHNQSPRNTYQSAMGKQAMGIYVTNYQFRMDTLAYVLYYPQKPLVTTRAMEHLHFRQLPAGINAIVSIACYSGYNQEDSVIMNQSSIDRGFFRSLFFRSYRDEEKKMGTLVKEDFGRPDRANTMGMRHGSYDKLDDDGLAPPGTRVSGEDVIIGKTTPISQEEAQGQALRYTRRDHSISLRHSETGIVDQVLLTTNADGLRFVKVRVRSVRIPQIGDKFSSRHGQKGTVGMTYTQEDMPWTVEGITPDIIVNPHAIPSRMTIGQLIECIMGKVAAHMGKEGDATPFTDVTVDNISKALHKCGYQMRGFETMYNGHTGRRLSAMIFLGPTYYQRLKHMVDDKIHSRGRGPVQILTRQPAEGRSRDGGLRFGEMERDCMIAHGAAHFLKERLFDQSDAYRVHVCERCGLIAIANLKKNSFECRGCKNKTDIVQVYIPYACKLLFQELMAMAIAPRMLTKEVKTTNQKKGA

SEQ ID NO: 5621 - protein, 1198 aa, Citrullus lanatus
MDDYEEYDRNMNDDDDIEAIPDDEEEITQEDAWAVISAYFEEKGLVRQQLDSFDEFIQNTMQEIVDESADIEIRPESQHNPGHQSDVAETIYKISFGQIYLSKPMMTESDGETATLFPKAARLRNLTYSAPLYVDVSKRVIKKGHDGEEVTETQDFTKVFIGKVPIMLRSSYCTLYQNSEKDLTELGECPYDQGGYFIINGSEKVLIAQEKMSTNHVYVFKKRQPNKYAFVAEVRSMAESQNRPPSTMFVRMLSRTSAKGGSSGQYIRATLPYIRNEIPIIIVFRALGFVADKDILEHICYDFSDTQMMELLRPSLEEAFVIQNQQVALDYIGKRGSTVGVTKEKRIKYAKEILQKEMLPHVGVGEFCETKKAYYFGYIIHRLLLCALGRRAEDDRDHYGNKRLDLAGPLLGGLFRMLFRKLTRDVRGYVQKCVDNGKDVNLQFAIKAKTITSGLKYSLATGNWGQANAAGTRAGVSQVLNRLTYASTLSHLRRLNSPIGREGKLAKPRQLHNSQWGMMCPAETPEGQACGLVKNLALMVYITVGSAAYPILEFLEEWGTENFEEISPAVIPQATKIFVNGCWVGIHRDPEMLVKTLRRLRRRVDVNTEVGVVRDIRLKELRIYTDYGRCSRPLFIVEKQRLLIKKKDIHALQQRESPEDGGWHDLVAKGFIEYIDTEEEETTMISMTISDLIQARINPVEAYSDTYTHCEIHPSLILGVCASIIPFPDHNQSPRNTYQSAMGKQAMGIYVTNYQFRMDTLAYVLYYPQKPLVTTRAMEHLHFRQLPAGINAIVAIACYSGYNQEDSVIMNQSSIDRGFFRSLFFRSYRDEEKKMGTLVKEDFGRPDRSNTMGMRHGSYDKLDDDGLAPPGTRVSGEDVIIGKTTPISQEEAQGQAARYSRRDHSISLRHSENGIVDQVLLTTNADGLRFVKVRVRSVRIPQIGDKFSSRHGQKGTVGMTYTQEDMPWTVEGITPDIIVNPHAIPSRMTIGQLIECIMGKVAAHMGKEGDATPFTDVTVDNISKALHKCGYQMRGFETMYNGHTGRRLSAMIFLGPTYYQRLKHMVDDKIHSRGRGPVQILTRQPAEGRSRDGGLRFGEMERDCMIAHGAAHFLKERLFDQSDAYRIHVCECCGLIAIANLKKSSFECRGCKNKTDIVQVYIPYACKLLFQELMAMAIAPRMFTKEIKPLKDQKKKGS

SEQ ID NO: 5622 - protein, 515 aa, Valeriana officinalis
MISMTINDLVSARDNPEEAYSGTYTHCEIHPSLILGVCASIIPFPDHNQSPRNTYQSAMGKQAMGIYVTNFQFRMDTLAYVLYYPQKPLVTTRAMEHLHFRQLPAGINAIVAISCYSGYNQEDSVIMNQSSIDRGFFRSLFFRSYRDEEKKMGTLVKEDFGRPDRANTMGMRHGSYDKLDDDGLAPAGTRVSGEDVIIGKTTPIAQDDAQGQASRYTRRDHSTSLRHSETGMVDQVLLTTNADGLRFVKVRVRSVRIPQIGDKFSSRHGQKGTVGMTYTQEDMPWTVEGITPDIIVNPHAIPSRMTIGQLIECIMGKVAAHMGKEGDATPFTDVTVDNISKALHKCGYQMRGFETMYNGHTGRRLTAMIFLGPTYYQRLKHMVDDKIHSRGRGPVQILTRQPAEGRSRDGGLRFGEMERDCMIAHGAAHFLKERLFDQSDAYRVHVCEICGLVAIANLKKNSFECRGCKNKTDIVQVYIPYACKLLFQELMSMAIAPRMMTKDIKQAKDLKKKGA

SEQ ID NO: 5623 - protein, 1191 aa, Nicotiana benthamiana
MDMEEEYEQQYNNDDDEEEITQEDAWAVISAYFEEKGLVRQQLDSFDEFIQNTMQEIVDESADIEIRPESQHNPGHQSDFAETIYKINFGQIYLSKPMMTESDGETATLFPKAARLRNLTYSAPLYVDVTKRVIKKGHDGEEVTETQDFTKVFIGKVPIMLRSSYCTLYQNSEKDLTELGECPLDQGGYFIINGSEKVLIAQEKMSTNHVYVFKKRQPNKYAFVAEVRSMAESQNRPPSTMFVRMLSRTSAKGGSSGQYIRATLPYIRTEIPIIIVFRALGFVADKDILEHICYDFNDTQMMELLRPSLEEAFVIQNQQVALDYIGKRGATVGVTREKRIKYAKEILQKEMLPHVGIGEYCETKKAYYFGYIIHRLLLCALGRRAEDDRDHYGNKRLDLAGPLLGGLFRMLFRKLTRDVRAYVQKCVDNGKDVNLQFAIKAKTITSGLKYSLATGNWGQANAAGTRAGVSQVLNRLTYASTLSHLRRLNSPIGREGKLAKPRQLHNSQWGMMCPAETPEGQACGLVKNLALMVYITVGSAAYPILEFLEEWGTENFEEISPAVIPQATKIFVNGTWVGIHRDPDMLVRTLRRLRRRVDVNTEVGVVRDIRLKELRIYTDYGRCSRPLFIVEKQRLLIKKKDIQTLQQRESPEEGGWHDLVAKGYIEYIDTEEEETTMISMTINDLVQARLNPEEAYSDTYTHCEIHPSLILGVCASIIPFPDHNQSPRNTYQSAMGKQAMGIYVTNYQFRMDTLAYVLYYPQKPLVTTRAMEHLHFRQLPAGINAIVAISCYSGYNQEDSVIMNQSSIDRGFFRSLFFRSYRDEEKKMGTLVKEDFGRPDRASTMGMRHGSYDKLDDDGLAPPGTRVSGEDVIIGKTTPISQDDAQGQASRYTRKDHSTSLRHSETGMVDQVLLTTNADGLRFVKVRVRSVRIPQIGDKFSSRHGQKGTVGMTYTQEDMPWTVEGITPDIIVNPHAIPSRMTIGQLIECIMGKVAAHMGREGDATPFTDVTVDNISKALHKCGYQMRGFETMYNGHTGRRLSAMIFLGPTYYQRLKHMVDDKIHSRGRGPVQILTRQPAEGRSRDGGLRFGEMERDCMIAHGAAHFLKERLFDQSDAYRVHVCERCGLIAIANLKKNSFECRGCKNKTDIVQVHIPYACKLLFQELMAMAIAPRMLTKDVKQAKDQKKKGA

SEQ ID NO: 5624 - protein, 1208 aa, Aquilegia formosa
MYGGGVEEDEVMMVGNNNNNNNNDDIELEEEEDEDNEDITQEDAWAVISAYFEEKGLVRQQLDSFDEFIQNSMQEIVDESDDIVIRPESQHNPGRQSDFQETVYKISFGQIYLSKPMMTESDGETATLFPKAARLRNLTYSAPLYVDVTKQVMKKGHDCEEVTEPPETIPKVFIGKVPIMLRSSYCTLFQNSEKDLTELGECPYDQGGYFIINGSEKVLIAQEKMSTNHVYVFKKRQPNKYAYVAEVRSMAESQNRPPSSMFVRMLSRTSAKGGSSGQYIRATLPYIRTEIPIIIVFRALGFVPDKDILEHICYDFADTQMMELLRPSLEEAFVIQNKQVALDYIGKRGSTVGVTREKRIKYAKEILEKEMLPHVGVGEHCETKKAYYFGYIIHRLLLCALGRRPEDDRDHYGNKRLDLAGPLLGGLFRMLFRKLTRDVRAYAQKCVDNGKDVNLQFAIKAKTITSGLKYSLATGNWGQANAAGTRAGVSQVLNRLTYASTLSHLRRLNSPIGREGKLAKPRQLHNSHWGMMCPAETPEGQACGLVKNLALMVYITVGSAANPILEFLEEWSTENFEEISPGVIPQATKIFVNGCWVGIHRNPELLVRTLRQLRRQVDVNTEVGVIRDIRLKELRLYTDYGRCSRPLFIVEKQRLLIKKKDIRALQQRESTEEIGWHDLVQKGYIEYVDTEEEETTMISMTINDLVTARLNPGEAYSETYTHCEIHPSLILGVCASIIPFPDHNQSPRNTYQSAMGKQAMGIYVTNYQLRMDTLAYVLYYPQKPLVTTRAMEHLHFRQLPAGINAIVAIACYSGYNQEDSVIMNQSSIDRGFFRSLFFRSYRDEEKKMGTLVKEDFGRPNRENTMGMRHGSYDKLDDDGLAPPGTRVSGEDVIIGKTTPIAQDESQGIASRYTRRDHSTSLRHSESGMVDQVLLTTNADGLRFVKVRMRSVRIPQIGDKFSSRHGQKGTVGMTYTQEDMPWTVEGITPDIIVNPHAIPSRMTIGQLIECIMGKVAAHMGKEGDATPFTDVTVDNISKALHKCGYQMRGFETMYNGHTGRRLTAMIFLGPTYYQRLKHMVDDKIHSRGRGPVQILTRQPAEGRSRDGGLRFGEMERDCMIAHGAAHFLKERLFDQSDAYRVHVCERCGLIAIANLKKNSFECRGCKNKTDIVQVHIPYACKLLFQELMAMAIAPRMLTKEVKDNKKKGK

SEQ ID NO: 5625 - protein, 841 aa, Trigonella foenum-graecum
MLPHVGVGEYCETKKAYYFGYIIHRLLLCALGRRAEDDRDHYGNKRLDLAGPLLGGLFRMLFRKLTRDVRGYVQKCVDNGKDVNLQFAIKAKTITSGLKYSLATGNWGQANAAGTRAGVSQVLNRLTYASTLSHLRRLNSPIGREGKLAKPRQLHNSQWGMMCPAETPEGQACGLVKNLALMVYITVGSAAYPILEFLEEWGTENFEEISPAVIPQATKIFVNGCWMGIHRDPDMLVRTLRKLRRRVDVNTEVGVVRDIRLKELRIYTDYGRCSRPLFIVDKQRLLIKKKDIHSLQQRESSEEGGWHDLVSKGFIEYIDTEEEETTMISMTINDLVQARLNPEEAYSDTYTHCEIHPSLILGVCASIIPFPDHNQSPRNTYQSAMGKQAMGIYVTNYQFRMDTLAYVLYYPQKPLVTTRAMEHLHFRQLPAGINAIVAIACYSGYNQEDSVIMNQSSIDRGFFRSLFFRSYRDEEKKMGTLVKEDFGRPDRANTMGMRHGSYDKLDDDGLAPPGTRVSGEDVIIGKTTPLSQEEQQGQAARYSKRDHSISLRHSETGIVDQVLLTTNADGLRFVKVRVRSVRIPQIGDKFSSRHGQKGTVGMTYTQEDMPWTVEGITPDIIVNPHAIPSRMTIGQLIECIMGKVAAHMGKEGDATPFTDVTVDNISKALHKCGYQMRGFETMYNGHTGRRLSAMIFLGPTYYQRLKHMVDDKIHSRGRGPVQILTRQPAEGRSRDGGLRFGEMERDCMIAHGAAHFLKERLFDQSDAYRVHVCERCGLIAIANLKKNSFECRGCKNKTDIVQVYIPYACKLLFQELMAMAIAPRMLTKEVKAIKDQKKKGA

SEQ ID NO: 5626 - protein, 1190 aa, Amborella trichopoda
MSGGEDDDYVNEDEEITQEDAWAVISAYFDEKGLVRQQLDSFDEFIQNTMQEIVDESADIEIRPESQHNPGRQADFVETIYKISFGQIYLSKPMMTESDGETATLFPKAARLRNLTYSAPLYVDVTKRVIKKGHDHEELAEQQELTKVFIGKVPIMLRSSYCTLFQNSEKDLTELGECPYDQGGYFIINGSEKVLIAQEKMSTNHVYVFKKRQPNKYAYVAEVRSMAESQNKPPSSMFVRMLSRTSSKGGSSGQYIRATLPYIRAEIPIIIVFRALGFVADKDILEHICYDFSDTQMMELLRPSLEEAFVIQNQQVALDYIGKRGSTVGVTKEKRIKYAKEILQKEMLPHVGVGEYCETKKAYYFGYIIHRLLVCALGRRPEDDRDHYGNKRLDLAGPLLGSLFRTMFRKLTRDVRSYVQKCVDNGKEVNLQFAIKAKTITSGLKYSLATGNWGQANAAGTRAGVSQVLNRLTFASTLSHLRRLNSPIGREGKLAKPRQLHNSHWGMMCPAETPEGQACGLVKNLALMVYITVGSAANPILEFLEEWSTENFEEISPAVIPQATKIFVNGCWVGIHRNPELLVKTLRQLRRQVDVNTEVGVIRDIRLKELRLYTDYGRCSRPLFIVEKQRLLIKKSDIRALQQRESPDEGWHDLVAKGFIEYVDTEEEETTMISMTISDLVSARLNPEEAYSETYTHCEIHPSLILGVCASIIPFPDHNQSPRNTYQSAMGKQAMGIYVTNYQLRMDTLAYVLYYPQKPLVTTRAMEHLHFRQLPAGINAIVAISCYSGYNQEDSVIMNQSSIDRGFFRSLFFRSYRDEEKKMGTLVKEDFGRPNRENTMGMRHGSYDKLDDDGLAPPGTRVSGEDVIIGKTTPITQEEMQGQASRYTRRDHSTSLRHSESGMVDQVLLTTNADGLRFVKVRMRSVRIPQIGDKFSSRHGQKGTVGMTYTQEDMPWTVEGITPDIIVNPHAIPSRMTIGQLIECIMGKVAAHMGKEGDATPFTDVTVDNISKALHKCGYQMRGFETMYNGHTGRRLSAMIFLGPTYYQRLKHMVDDKIHSRGRGPVQILTRQPAEGRSRDGGLRFGEMERDCMIAHGAAHFLKERLFDQSDAYRVHVCEQCGLIAIANLKKNSFECRGCKNKTDIIQVHIPYACKLLFQELMAMAIAPRMFTKEEKKPKDHKKKGAPGQS

SEQ ID NO: 5627 - protein, 1194 aa, Cicer arietinum
MDLDEEQEYDQQMMDEEDDEEEITQEDAWAVISAYFEEKGLVRQQLDSFDEFIQNTMQEIVDESADIEIRPESQHNPGHQSDFAETIYKISFGQIYLSKPMMTESDGETSTLFPKAARLRNLTYSAPLYVDVSKRVIKKGHDGEEVTETQDFTKVFIGKVPIMLRSSYCTLFQNSEKDLTELGECPYDQGGYFIINGSEKVLIAQEKMSTNHVYVFKKRQPNKYAYVAEVRSMAESQNRPPSTMFVRMLSRTSSKGGSSGQYIRATLPYIRTEIPIIIVFRALGFVADKDILEHICYDFSDTQMMELLRPSLEEAFVIQNQQVALDYIGKRGATVGVTKEKRIKYAKDILQREMLPHVGVGEYCETKKAYYFGYIIHRLLLCALGRRAEDDRDHYGNKRLDLAGPLLGGLFRMLFRKLTRDVRGYVQKCVDNGKDVNLQFAIKAKTITSGLKYSLATGNWGQANAAGTRAGVSQVLNRLTYASTLSHLRRLNSPIGREGKLAKPRQLHNSQWGMMCPAETPEGQACGLVKNLALMVYITVGSAAYPILEFLEEWGTENFEEISPAVIPQATKIFVNGCWMGIHRDPDMLVRTLRKLRRRVDVNTEVGVVRDIRLKELRIYTDYGRCSRPLFIVDKQRLLIKKKDIHSLQQRESPEEGGWHDLVSKGFIEYIDTEEEETTMISMTINDLVQARLNPEEAYSDTYTHCEIHPSLILGVCASIIPFPDHNQSPRNTYQSAMGKQAMGIYVTNYQFRMDTLAYVLYYPQKPLVTTRAMEHLHFRQLPAGINAIVAISCYSGYNQEDSVIMNQSSIDRGFFRSLFFRSYRDEEKKMGTLVKEDFGRPDRANTMGMRHGSYDKLDDDGLAPPGTRVSGEDVIIGKTTPLSQEEAQGQAARYSKRDHSISLRHSETGIVDQVLLTTNADGLRFVKVRVRSVRIPQIGDKFSSRHGQKGTVGMTYTQEDMPWTVEGITPDIIVNPHAIPSRMTIGQLIECIMGKVAAHMGKEGDATPFTDVTVDNISKALHKCGYQMRGFETMYNGHTGRRLSAMIFLGPTYYQRLKHMVDDKIHSRGRGPVQILTRQPAEGRSRDGGLRFGEMERDCMIAHGAAHFLKERLFDQSDAYRVHVCEHCGLIAIANLKKNSFECRGCKNKTDIVQVYIPYACKLLFQELMAMAIAPRMLTKEIKSIKDQKKKGA

SEQ ID NO: 5628 - protein, 1181 aa, Glycine max
MMEEDDDEEEITQEDAWAVISAYFEEKGLVRQQLDSFDEFIQNTMQEIVDESADIEIRPESQHNPGHQSDFAETIYKISFGQIYLSKPMMTESDGETATLFPKAARLRNLTYSAPLYVDVSKRVVKKGHDGEEVTETQDLTKVFIGKVPIMLRSSYCTLYQNSEKDLTELGECPYDQGGYFIINGSEKVLIAQEKMSTNHVYVFKKRQPNKYAYVAEVRSMAESQNRPPSTMFVRMLSRTSSKGGSSGQYIRATLPYIRTEIPIIIVFRALGFVADKDILEHICYDFSDTLMMELLRPSLEEAFVIQNQQVALDYIGKRGATVGVTKEKRIKYAKEILQKEMLPHVGVGEYCETKKAYYFGYIIHRLLLCALGRRAEDDRDHYGNKRLDLAGPLLGGLFRMLFRKLTRDVRGYVQKCVDNGKDVNLQFAIKAKTITSGLKYSLATGNWGQANAAGTRAGVSQVLNRLTYASTLSHLRRLNSPIGREGKLAKPRQLHNSQWGMMCPAETPEGQACGLVKNLALMVYITVGSAAYPILEFLEEWGTENFEEISPAVIPQATKIFVNGCWMGIHRDPDMLVRTLRKLRRRVDVNTEVGVVRDIILKELRIYTDYGRCSRPLFIVDKQRLLIKKKDIHALQQRESPEDGGWHDLVSKGFIEYIDTEEEETTMISMTINDLVQARINPEDAYAGTYTHCEIHPSLILGVCASIIPFPDHNQSPRNTYQSAMGKQAMGIYVTNYQFRMDTLAYVLYYPQKPLVTTRAMEHLHFRQLPAGINAIVAIACYSGYNQEDSVIMNQSSIDRGFFRSLFFRSYRDEEKKMGTLVKEDFGRPDRANTMGMRHGSYDKLDDDGLAPPGTRVSGEDVIIGKTTPISQEEAQGQALRYTRRDHSISLRHSETGIVDQVLLTTNADGLRFVKVRVRSVRIPQIGDKFSSRHGQKGTVGMTYTQEDMPWTVEGITPDIIVNPHAIPSRMTIGQLIECIMGKVAAHMGKEGDATPFTDVTVDNISKALHKCGYQMRGFETMYNGHTGRRLSAMIFLGPTYYQRLKHMVDDKIHSRGRGPVQILTRQPAEGRSRDGGLRFGEMERDCMIAHGAAHFLKERLFDQSDAYRVHVCERCGLIAIANLKKNSFECRGCKNKTDIVQVYIPYACKLLFQELMAMAIAPRMLTKEVKTTNQKKKGA

SEQ ID NO: 5629 - protein, 1191 aa, Solanum lycopersicum
MDMEDEYEPQYNVDDDEEEITQEDAWAVISAYFEEKGLVRQQLDSFDEFIQNTMQEIVDESADIEIRPESQHNPGHQSDFAETIYKINFGQIYLSKPMMTESDGETATLFPKAARLRNLTYSAPLYVDVTKRVIKKGHDGEEVTETQDFTKVFIGKVPIMLRSSYCTLYQNSEKDLTELGECPLDQGGYFIINGSEKVLIAQEKMSTNHVYVFKKRQPNKYAFVAEVRSMADTQNRPPSTMFVRMLSRTSAKGGSSGQYIRATLPYIRTEIPIIIVFRALGFVADKDILEHICYDFNDTQMMELLRPSLEEAFVIQNQQVALDYIGKRGATVGVTREKRIKYAKEILQKEMLPHVGVGEYCETKKAYYFGYIIHRLLLCALGRRAEDDRDHYGNKRLDLAGPLLGGLFRMLFRKLTRDVRGYVQKCVDNGKDVNLQFAIKAKTITSGLKYSLATGNWGQANAAGTRAGVSQVLNRLTYASTLSHLRRLNSPIGREGKLAKPRQLHNSQWGMMCPAETPEGQACGLVKNLALMVYITVGSAAYPILEFLEEWGTENFEEISPAVIPQATKIFVNGTWVGIHRDPDMLVRTLRRLRRRVDVNTEVGVVRDIRLKELRIYTDYGRCSRPLFIVEKQRLMIKKKDIQTLQQRESPDEGGWHDLVAKGYIEYIDTEEEETTMISMTINDLVQARLNPGDAYSDTYTHCEIHPSLILGVCASIIPFPDHNQSPRNTYQSAMGKQAMGIYVTNYQFRMDTLAYVLYYPQKPLVTTRAMEHLHFRQLPAGINAIVAISCYSGYNQEDSVIMNQSSIDRGFFRSLFFRSYRDEEKKMGTLVKEDFGRPDRASTMGMRHGSYDKLDDDGLAPPGTRVSGEDVIIGKTTPISQDDAQGQASRYTRKDHSTSLRHSETGMVDQVLLTTNADGLRFVKVRVRSVRIPQIGDKFSSRHGQKGTVGMTYTQEDMPWTVEGITPDIIVNPHAIPSRMTIGQLIECIMGKVAAHMGKEGDATPFTDVTVDNISKALHKCGYQMRGFETMYNGHTGRRLSAMIFLGPTYYQRLKHMVDDKIHSRGRGPVQILTRQPAEGRSRDGGLRFGEMERDCMIAHGAAHFLKERLFDQSDAYRVHVCERCGLIAIANLKKNSFECRGCKNKTDIVQVHIPYACKLLFQELMAMAIAPRMLTKDVKLAKDQKKKGA

SEQ ID NO: 5630 - protein, 1200 aa, Antirrhinum majus
  misc_feature (20)..(20): Xaa can be any naturally occurring amino acid
  misc_feature (447)..(447): Xaa can be any naturally occurring amino acid
  misc_feature (498)..(498): Xaa can be any naturally occurring amino acid
MDLEEEYYEQEYNNEAENEXDEEEEEEDISQEDAWAVISAYFEEKGLVRQQLDSFDEFIQNTMQEIVDESADIEIRPESQHNPGQQPDFAETIYKISFGQIYLSKPMMTESDGETATLFPKAARLRNLTYSAPLYVDVSKRVIKKGHDGEEVTETQDFTKVFIGKVPIMLRSSYCTLYQNSEKDLTELGECPLDQGGYFIINGSEKVLIAQEKMSTNHVYVFKKRQPNKYAYVAEVRSMAEAQNRPPSTMFVRMLSRTSAKGGSSGQYIRATLPYIRTEIPIIIVFRALGFVADKDILEHICFNSSDTQMMELLRPSLEEAFVIQNQQVALDYIGKRGSTVGVTKEKRIKYAKEILQKEMLPHVGVGEYCETKKAYYFGYIIHRLLLCALGRRAEDDRDHYGNKRLDLAGPLLGGLFRMLFRKLTRDVRSYVQKCVDNGKDVNLQFXIKAKTITSGLKYSLATGNWGQANAAGTRAGVSQVLNRLTYASTLSHLRRLXSPIGREGKLAKPRQLHNSQWGMMCPAETPEGQACGLVKNLALMVYITVGSAAYPILEFLEEWGTENFEEISPAVIPQATKIFVNGLWVGIHRNPDMLVSTLRRLRRRVDVNTEVGVVRDIRLKELRIYTDYGRCSRPLFIVEKQRLLIKKKDVQALQQRESPDDGGWHELVAKGFIEYIDTEEEETTMISMTINDLLSAKVNPTEAYSDTYTHCEIHPSLILGVCASIIPFPDHNQSPRNTYQSAMGKQAMGIYVTNYQFRMDTLAYVLYYPQKPLVTTRAMEHLHFRQLPAGINAIVAIACYSGYNQEDSVIMNQSSIDRGFFRSLFFRSYRDEEKKMGTLVKEDFGRPDRSNTMGMRHGSYDKLDDDGLAPPGTRCSGEDVIIGKTTPISPDDAQGQAARYTKRDHSTSLRHSETGMVDQVLLTTNADGLRFVKVRVRSVRIPQIGDKFSSRHGQKGTVGMTYTQEDMPWTVEGISPDIIVNPHAIPSRMTIGQLIECIMGKVAAHMGKEGDATPFTDVTVDNISKALHKCGYQMRGFETMYNGHTGRRLSSMIFLGPTYYQRLKHMVDDKIHSRGRGPVQILTRQPAEGRSRDGGLRFGEMERDCMIAHGAAHFLKERLFDQSDAYRIHVCEQCGLIAIANLKKNSFECRGCKNKTDIVQVHIPYACKLLFQELMSMAIAPRMLTKDIKQSKEQRKKAA

SEQ ID NO: 5631 - protein, 1193 aa, Theobroma cacao
MEDDSEYDPQLMDDEDDEEITQEDAWAVISAYFEEKGLVRQQLDSFDEFIQNTMQEIVDESADIEIRPESQHNPGHQSDFAETIYKISFGQIYLSKPMMTESDGETATLFPKAARLRNLTYSAPLYVDVTKRVIKKGHDGEEVTETQDFTKVFIGKVPIMLRSSYCTLYQNSEKDLTELGECPYDQGGYFIINGSEKVLIAQEKMSTNHVYVFKKRQPNKYAYVAEVRSMAESQNRPPSTMFVRMLSRTSAKGGSSGQYIRATLPYIRTEIPIIIVFRALGFVADKDILEHICYDFSDTQMMELLRPSLEEAFVIQNQQVALDYIGKRGATVGVTREKRIKYAKEILQKEMLPHVGVGDFCETKKAYYFGYIIHRLLLCALGRRAEDDRDHYGNKRLDLAGPLLGGLFRMLFRKLTRDVRSYVQKCVDNGKDVNLQFAIKAKTITSGLKYSLATGNWGQANAAGTRAGVSQVLNRLTYASTLSHLRRLNSPIGREGKLAKPRQLHNSQWGMMCPAETPEGQACGLVKNLALMVYITVGSAAYPILEFLEEWGTENFEEISPAVIPQATKIFVNGCWVGVHRNPDMLVTTLRRLRRRVDVNTEVGVVRDIRLKELRIYTDYGRCSRPLFIVEKQRLLIKKKDIHALQQRESPEDGGWHDLVAKGFIEYIDTEEEETTMISMTINDLVQARVNPEEAYSETYTHCEIHPSLILGVCASIIPFPDHNQSPRNTYQSAMGKQAMGIYVTNYQFRMDTLAYVLYYPQKPLVTTRAMEHLHFRQLPAGINAIVAIACYSGYNQEDSVIMNQSSIDRGFFRSLFFRSYRDEEKKMGTLVKEDFGRPDRANTMGMRHGSYDKLDDDGLAPPGTRVSGEDVIIGKTTPISQEEAQGQASRYSRRDHSISLRHSETGIVDQVLLTTNADGLRFVKVRVRSVRIPQIGDKFSSRHGQKGTVGMTYTQEDMPWTVEGITPDIIVNPHAIPSRMTIGQLIECIMGKVAAHMGKEGDATPFTDVTVDNISRALHKCGYQMRGFETMYNGHTGRRLSAMIFLGPTYYQRLKHMVDDKIHSRGRGPVQILTRQPAEGRSRDGGLRFGEMERDCMIAHGAAHFLKERLFDQSDAYRVHVCERCGLIAIANLKKNSFECRGCKNKTDIVQAILLVYIPYACKLLFQELMAMAIAPRMLTKEPPKDQKKKGA

SEQ ID NO: 5632 - protein, 1188 aa, Eutrema parvulum
MEYNEYEQDPPYIEEDDDEEITQEDAWAVISAYFEEKGLVRQQLDSFDEFIQNTMQEIVDESADIEIRPESQHNPGHQSDFAETIYKISFGQIYLSKPMMTESDGETATLFPKAARLRNLTYSAPLYVDVTKRVIKKGHDGEEVTETQDFTKVFIGKVPIMLRSSYCTLFQNSEKDLTELGECPYDQGGYFIINGSEKVLIAQEKMSTNHVYVFKKRQPNKYAYVGEVRSMAENQNRPPSTMFVRMLARASAKGGSSGQYIRCTLPYIRTEIPIIIVFRALGFVADKDILEHICYDFADTQMMELLRPSLEEAFVIQNQQVALDYIGKRGATVGVTKEKRIKYAKDILQKEMLPHVGVGEFCETKKAYYFGYIIHRLLLCALGRRPEDDRDHYGNKRLDLAGPLLGGLFRMLFRKLTRDVRSYVQKCVDNGKEVNLQFAIKAKTITSGLKYSLATGNWGQANAAGTRAGVSQVLNRLTYASTLSHLRRLNSPIGREGKLAKPRQLHNSQWGMMCPAETPEGQACGLVKNLALMVYITVGSAAYPILEFLEEWGTENFEEISPSVIPQATKIFVNGMWVGVHRDPDMLVKTLRRLRRRVDVNTEVGVVRDIRLKELRIYTDYGRCSRPLFIVDNQRLLIKKRDIYALQQRESAEEDGWHHLVAKGFIEYIDTEEEETTMISMTINDLVQARLSPSEAYSETYTHCEIHPSLILGVCASIIPFPDHNQSPRNTYQSAMGKQAMGIYVTNYQFRMDTLAYVLYYPQKPLVTTRAMEHLHFRQLPAGINAIVAISCYSGYNQEDSVIMNQSSIDRGFFRSLFFRSYRDEEKKMGTLVKEDFGRPDRASTMGMRHGSYEKLDDDGLAPPGTRVSGEDVIIGKTTPISQDEAQGQSSRYTRRDHSISLRHSETGMVDQVLLTTNADGLRFVKVRVRSVRIPQIGDKFSSRHGQKGTVGMTYTQEDMPWTIEGVTPDIIVNPHAIPSRMTIGQLIECIMGKVAAHMGKEGDATPFTDVTVDNISKALHKCGYQMRGFERMYNGHTGRPLTAMIFLGPTYYQRLKHMVDDKIHSRGRGPVQILTRQPAEGRSRDGGLRFGEMERDCMIAHGAANFLKERLFDQSDAYRVHVCETCGLIAIANLKKNSFECRGCKNKTDIVQVHIPYACKLLFQELMSMAIAPRMLTKDLKGTKGRK

SEQ ID NO: 5633 - protein, 1198 aa, Nicotiana benthamiana
MDMEEEYEQQYSNDEDEEEITQEDAWAVISAYFEEKGLVRQQLDSFDEFIQNTMQEIVDESADIEIRPESQHNPGHQSDFAETIYKINFGQIYLSKPMMTESDGETATLFPKAARLRNLTYSAPLYVDVTKRVIKKGHDGEEVTETQDFTKVFIGKVPIMLRSSYCTLYQNSEKDLTELGECPLDQGGYFIINGSEKVLIAQEKMSTNHVYVFKKRQPNKYAFVAEVRSMAESQNRPPSTMFVRMLSRTSAKGGSSGQYIRATLPYIRTEIPIIIVFRALGFVADKDILEHICYDFNDTQMMELLRPSLEEAFVIQNQQVALDYIGKRGATVGVTREKRIKYAKEILQKEMLPHVGIGEYCETKKAYYFGYIIHRLLLCALGRRAEDDRDHYGNKRLDLAGPLLGGLFRMLFRKLTRDVRAYVQKCVDNGKDVNLQFAIKAKTITSGLKYSLATGNWGQANAAGTRAGVSQVLNRLTYASTLSHLRRLNSPIGREGKLAKPRQLHNSQWGMMCPAETPEGQACGLVKNLALMVYITVGSAAYPILEFLEEWGTENFEEISPAVIPQATKIFVNGTWVGIHRDPDMLVRTLRRLRRRVDVNTEVGVVRDIRLKELRIYTDYGRCSRPLFIVEKQRLLIKKKDIQTLQQRESPEEGGWHDLVAKGYIEYIDTEEEETTMISMTINDLVQARLNPEEAYSDTYTHCEIHPSLILGVCASIIPFPDHNQSPRNTYQSAMGKQAMGIYVTNYQFRMDTLAYVLYYPQKPLVTTRAMEHLHFRQLPAGINAIVAISCYSGYNQEDSVIMNQSSIDRGFFRSLFFRSYRDEEKKMGTLVKEDFGRPDRASTMGMRHGSYDKLDDDGLAPPGTRVSGEDVIIGKTTPISQDDAQGQASRYTRKDHSTSLRHSETGMVDQVLLTTNADGLRFVKVRVRSVRIPQIGDKFSSRHGQKGTVGMTYTQEDMPWTVEGITPDIIVNPHAIPSRMTIGQLIECIMGKVAAHMGREGDATPFTDVTVDNISKALHKSTEALHKCGYQMRGFETMYNGHTGRRLSAMIFLGPTYYQRLKHMVDDKIHSRGRGPVQILTRQPAEGRSRDGGLRFGEMERDCMIAHGAAHFLKERLFDQSDAYRVHVCERCGLIAIANLKKISFECRGCKNKTDIVQVHIPYACKLLFQELMAMAIAPRMLTKDVKQAKDQKKKGA

SEQ ID NO: 5634 - protein, 362 aa, Zea mays
MGTLVKEEFGRPNRENTMGMRHGSYDKLDDDGLAPPGTRVSGEDVIIGKTSPIPQDDAQGQASRYSKRDHSTSLRHSESGMVDQVLLTTNADGLRFVKVRMRSVRIPQIGDKFSSRHGQKGTVGMTYTQEDMPWTIEGITPDIIVNPHAIPSRMTIGQLIECIMGKVAAQMGKEGDATPFTDVTVDNISKALHKCNYQMRGFETMYNGHTGRKLTAMIFLGPTYYQRLKHMVDDKIHSRGRGPVQILTRQPAEGRSRDGGLRFGEMERDCMIAHGAAFFLKERLFDQSDAYRVHVCEKCGLIAIANLKKNSFECRGCKNKTDIVQVHIPYACKLLFQELMAMAIAPRMLTHDMKTGKDQKKR

SEQ ID NO: 5635 - protein, 1189 aa, Arnica chamissonis
MDLEEEYDQGYNDEEEDITQEDAWAVISSYFEEKGLVRQQLDSFDEFIQNTMQEIVDESADIEIRPESQHNPGHQPDFAETIYKISFGQIYLSKPMMTESDGETATLFPKAARLRNLTYSAPLYVDVSKRAIKKGHDGEEVTETQDFAKVFIGKVPIMLRSSYCTLFQNSEKDLTELGECPYDQGGYFIINGSEKVLIAQEKMSTNHVYVFKKRQPNKYAYVAEVRSMAESQNRPPSTMFVRMLARTSAKGGSSGQYIRATLPYIRTEIPIIIVFRALGFVADKDILEHICYDFSDTLMMELLRPSLEEAFVIQNQQVALDYIGKRGATVGVTKEKRIKYARDILQKEMLPHVGVGEYCETKKAYYFGYIIHRLLLCALGRRAEDDRDHYGNKRLDLAGPLLGGLFRMLFRKLTRDVRGYVQKCVDNGKDVNLQFAIKAKTITSGLKYSLATGNWGQANAAGTRAGVSQVLNRLTYASTLSHLRRLNSPIGREGKLAKPRQLHNSQWGMMCPAETPEGQACGLVKNLALMVYITVGSAAYPILEFLEEWGTENFEEISPAVIPQATKIFVNGLWVGIHRDPDMLVRTLRRLRRRVDVNTEVGVVRDIRLKELRIYTDYGRCSRPLFIVEKQRLLIKKKDIQKLQQRETPEDGGWHDLVANGFIEYIDTEEEETTMISMTINDLVSARLNPEESYSGTYTHCEIHPSLILGVCASIIPFPDHNQSPRNTYQSAMGKQAMGIYVTNFQFRMDTLAYVLYYPQKPLVTTRAMEHLHFRQLPAGINAIVAISCYSGYNQEDSVIMNQSSIDRGFFRSLFFRSYRDEEKKMGTLVKEDFGRPDRANTMGMRHGSYDKLDDDGLAPPGTRVGGEDVIIGKTTPIAQEDAQGQASRYTRRDHSTSLRHSENGMVDQVLLTTNADGLRFVKVRVRSVRIPQIGDKFSSRHGQKGTVGMTYTQEDMPWTVEGITPDIIVNPHAIPSRMTIGQLIECIMGKVAAHMGKEGDATPFTDVTVDNISRALHKCGYQMRGFETMYNGHTGRRLPAMIFLGPTYYQRLKHMVDDKIHSRGRGPVQILTRQPAEGRSRDGGLRFGEMERDCMIAHGAAHFLKERLFDQSDAYRVHVCERCGLIAIANLKKNSFECRSCKNKTDIVQVHIPYACKLLFQELMSMAIAPRMLTKDVKQAKDSKKKGA

SEQ ID NO: 5636 - protein, 1195 aa, Medicago truncatula
MMMDLEEENEFDQQMEEEDDEEEITQEDAWAVISAYFEEKGLVRQQLDSFDEFIQNTMQEIVDESADIEIRPESQHNPGHQSDFAETIYKISFGQIYLSKPMMTESDGETATLFPKAARLRNLTYSAPLYVDVSKRVIKKGHDGEEVTETQDFTKVFIGKVPIMLRSSYCTLYQNSEKDLTELGECPYDQGGYFIINGSEKVLIAQEKMSTNHVYVFKKRQPNKYAYVGEVRSMAESQNRPPSTMFVRMLSRASAKGGSSGQYIRATLPYIRTEIPIIIVFRALGFVADKDILEHICYDFADTQMMELLRPSLEEAFVIQNQQVALDYIGKRGSTVGVTKEKRIKYAKDILQKEMLPHVGVGEYCETKKAYYFGYIIHRLLLCALGRRAEDDRDHYGNKRLDLAGPLLGGLFRMLFRKLTRDVRGYVQKCVDNGKDVNLQFAIKAKTITSGLKYSLATGNWGQANAAGTRAGVSQVLNRLTYASTLSHLRRLNSPIGREGKLAKPRQLHNSQWGMMCPAETPEGQACGLVKNLALMVYITVGSAAYPILEFLEEWGTENFEEISPAVIPQATKIFVNGCWMGIHRDPDMLVRTLRKLRRRVDVNTEVGVVRDIRLKELRIYTDYGRCSRPLFIVDKQRLLIKKKDIHSLQQRESPEDGGWHDLVSKGFIEYIDTEEEETTMISMTINDLVQARLNPEEAYSDTYTHCEIHPSLILGVCASIIPFPDHNQSPRNTYQSAMGKQAMGIYVTNYQFRMDTLAYVLYYPQKPLVTTRAMEHLHFRQLPAGINAIVAISCYSGYNQEDSVIMNQSSIDRGFFRSLFFRSYRDEEKKMGTLVKEDFGRPDRANTMGMRHGSYDKLDDDGLAPPGTRVSGEDVIIGKTTPLSQEEQQGQAARYSKRDHSISLRHSETGIVDQVLLTTNADGLRFVKVRVRSVRIPQIGDKFSSRHGQKGTVGMTYTQEDMPWTVEGITPDIIVNPHAIPSRMTIGQLIECIMGKVAAHMGKEGDATPFTDVTVDNISKALHKCGYQMRGFETMYNGHTGRRLSAMIFLGPTYYQRLKHMVDDKIHSRGRGPVQILTRQPAEGRSRDGGLRFGEMERDCMIAHGAAHFLKERLFDQSDAYRVHVCERCGLIAIANLKKNSFECRGCKNKTDIVQVYIPYACKLLFQELMAMAIAPRMLTKEVKAIKDQKKKGA

SEQ ID NO: 5637 - protein, 421 aa, Ambrosia trifida
MEHLQFRQLPAGINAIVAISCYSGYNQEDSVIMNQSSIDRGFFRSLFFRSYRDEEKKMGTLVKEDFGRPDRANTMGMRHGSYDKLDDDGLAPPGTRVGGEDVIIGKTTPIAQDDAQGQASRYTRRDHSTSLRHSENGMVDQVLLTTNADGLRFVKVRVRSVRIPQIGDKFSSRHGQKGTVGMTYTQEDMPWTVEGITPDIIVNPHAIPSRMTIGQLIECIMGKVAAHMGKEGDATPFTDVTVDNISRALHKCGYQMRGFETMYNGHTGRRLPAMIFLGPTYYQRLKHMVDDKIHSRGRGPVQILTRQPAEGRSRDGGLRFGEMERDCMIAHGAAHFLKERLFDQSDAYRVHVCERCGLIAIANLKKNSFECRGCKNKTDIVQVHIPYACKLLFQELMSMAIAPRMLTKDIKQAKDSKKKGA

SEQ ID NO: 5638 - protein, 1192 aa, Prunus persica
MDEEPEYDDQQYNDDDEDEITQEDAWAVISAYFEEKGLVRQQLDSFDEFIQNTMQEIVDESADIEIRPESQHNPGHQPDFAETTYRIKFGQIYLSKPMMTESDGETATLFPKAARLRNLTYSAPLYVDVSKSIVKKGHDGEEVTETQDFTKVFIGKVPIMLRSSYCTLYQNSEKDLTELGECPYDQGGYFIINGSEKVLIAQEKMSTNHVYVFKKRQPNKYAYVAEVRSMAESQNRPPSTMFVRMLARTSSKGGSSGQYIRATLPYIRAEIPIIIVFRALGFVADKDILEHICYDFSDTQMMELLRPSLEEAFVIQNQQVALDYIGKRGATVGVSREKRIKYAKEILQKEMLPHVGVGEFCETKKAYYFGYIIHRLLLCALGRRAEDDRDHYGNKRLDLAGPLLGGLFRMLFRKLTRDVRGYVQKCVDNGKELNLQFAIKAKTITSGLKYSLATGNWGQANAAGTRAGVSQVLNRLTYASTLSHLRRLNSPIGREGKLAKPRQLHNSQWGMMCPAETPEGQACGLVKNLALMVYITVGSAAYPILEFLEEWGTENFEEISPAVIPQATKIFVNGCWVGIHRDPEMLVKTLRKLRRRVDVNTEVGVVRDIRLKELRIYTDYGRCSRPLFIVDKQRLLIKKKDIHALQQRENPEDGGWHDLVAKGFIEYIDTEEEETTMISMTINDLVQARLNPEEAYSDTYTHCEIHPSLILGVCASIIPFPDHNQSPRNTYQSAMGKQAMGIYVTNYQFRMDTLAYVLYYPQKPLVTTRAMEHLHFRQLPAGINAIVAISCYSGYNQEDSVIMNQSSIDRGFFRSIFFRSYRDEEKKMGTLVKEDFGRPDRANTMGMRHGSYDKLDDDGLAPPGTRVSGEDVIIGKTTPMAQDEAQGQAASRYTRRDHSISLRHSETGIVDQVLLTTNADGLRFVKVRVRSVRIPQIGDKFSSRHGQKGTVGMTYTQEDMPWTVEGVTPDIIVNPHAIPSRMTIGQLIECIMGKVAAHMGKEGDATPFTDVTVDNISRALHSCGYQMRGFETMYNGHTGRRLSAMIFLGPTYYQRLKHMVDDKIHSRGRGPVQILTRQPAEGRSRDGGLRFGEMERDCMIAHGAAHFLKERLFDQSDAYRVHVCERCGLIAIANLKKNSFECRGCKNKTDIVQVYIPYACKLLFQELMSMAIAPRMLTKDIKPAKDQKKKGA

SEQ ID NO: 5639 - protein, 1192 aa, Prunus mume
MDEEPEYDDQQYNDDDEDEITQEDAWAVISAYFEEKGLVRQQLDSFDEFIQNTMQEIVDESADIEIRPESQHNPGHQPDFAETTYRIKFGQIYLSKPMMTESDGETATLFPKAARLRNLTYSAPLYVDVSKSIVKKGHDGEEVTETQDFTKVFIGKVPIMLRSSYCTLYQNSEKDLTELGECPYDQGGYFIINGSEKVLIAQEKMSTNHVYVFKKRQPNKYAYVAEVRSMAESQNRPPSTMFVRMLARTSSKGGSSGQYIRATLPYIRAEIPIIIVFRALGFVADKDILEHICYDFSDTQMMELLRPSLEEAFVIQNQQVALDYIGKRGATVGVSREKRIKYAKEILQKEMLPHVGVGEFCETKKAYYFGYIIHRLLLCALGRRAEDDRDHYGNKRLDLAGPLLGGLFRMLFRKLTRDVRGYVQKCVDNGKELNLQFAIKAKTITSGLKYSLATGNWGQANAAGTRAGVSQVLNRLTYASTLSHLRRLNSPIGREGKLAKPRQLHNSQWGMMCPAETPEGQACGLVKNLALMVYITVGSAAYPILEFLEEWGTENFEEISPAVIPQATKIFVNGCWVGIHRDPEMLVKTLRKLRRRVDVNTEVGVVRDIRLKELRIYTDYGRCSRPLFIVDKQRLLIKKKDIHALQQRENPEDGGWHDLVAKGFIEYIDTEEEETTMISMTINDLVQARLNPEEAYSDTYTHCEIHPSLILGVCASIIPFPDHNQSPRNTYQSAMGKQAMGIYVTNYQFRMDTLAYVLYYPQKPLVTTRAMEHLHFRQLPAGINAIVAISCYSGYNQEDSVIMNQSSIDRGFFRSIFFRSYRDEEKKMGTLVKEDFGRPDRANTMGMRHGSYDKLDDDGLAPPGTRVSGEDVIIGKTTPMAQDEAQGQAASRYTRRDHSISLRHSETGIVDQVLLTTNADGLRFVKVRVRSVRIPQIGDKFSSRHGQKGTVGMTYTQEDMPWTVEGVTPDIIVNPHAIPSRMTIGQLIECIMGKVAAHMGKEGDATPFTDVTVDNISRALHSCGYQMRGFETMYNGHTGRRLSAMIFLGPTYYQRLKHMVDDKIHSRGRGPVQILTRQPAEGRSRDGGLRFGEMERDCMIAHGAAHFLKERLFDQSDAYRVHVCERCGLIAIANLKKNSFECRGCKNKTDIVQVYIPYACKLLFQELMSMAIAPRMLTKDIKPAKDKKKKGA

SEQ ID NO: 5640 - protein, 1189 aa, Brassica napus
MDYNNEYEQEPTYIEEDDDEEITQEDAWAVISAYFEEKGLVRQQLDSFDEFIQNTMQEIVDESADIEIRPESQHNPGHQSDFAETIYKISFGQIYLSKPMMTESDGETATLFPKAARLRNLTYSAPLYVDVSKRVIKKGHDGEEVTETQDFTKVFIGKVPIMLRSSYCTLFQNSEKDLTELGECPYDQGGYFIINGSEKVLIAQEKMSTNHVYVFKKRQPNKYAYVGEVRSMAENQNRPPSTMFVRMLARASAKGGSSGQYIRCTLPYIKAEIPIIIVFRALGFVADKDILEHICYDFADNQMMELLRPSLEEAFVIQNQQVALDYIGKRGAPMGVTKEKRIKYAKDILQKEMLPHVGVGEFCETKKAYYFGYIIHRLLLCALGRRPEDDRDHYGNKRLDLAGPLLGGLFRMLFRKLTRDVRSYVQKCVDNGKEVNLQFAIKAKTITSGLKYSLATGNWGQANAAGTRAGVSQVLNRLTYASTLSHLRRLNSPIGREGKLAKPRQLHNSQWGMMCPAETPEGQACGLVKNLALMVYITVGSAAYPILEFLEEWGTENFEEISPSVIPQATKIFVNGMWVGVHRDPDMLVKTLRRLRRRVDVNTEVGVVRDIRLKELRIYTDYGRCSRPLFIVDNQRLLIKKRDIYALQQRESAEEDGWHHLVAKGFIEYIDTEEEETTMISMTISDLVQARLRPDEAYSETYTHCEIHPSLILGVCASIIPFPDHNQSPRNTYQSAMGKQAMGIYVTNYQFRMDTLAYVLYYPQKPLVTTRAMEHLHFRQLPAGINAIVAISCYSGYNQEDSVIMNQSSIDRGFFRSLFFRSYRDEEKKMGTLVKEDFGRPDRASTMGMRHGSYEKLDDDGLAPPGTRVSGEDVIIGKTTPISQDEAQGQSSRYTRRDHSISLRHSETGMVDQVLLTTNADGLRFVKVRVRSVRIPQIGDKFSSRHGQKGTVGMTYTQEDMPWTIEGVTPDIIVNPHAIPSRMTIGQLIECIMGKVAAHMGKEGDATPFTDVTVDNISKALHKCGYQMRGFERMYNGHTGRPLTAMIFLGPTYYQRLKHMVDDKIHSRGRGPVQILTRQPAEGRSRDGGLRFGEMERDCMIAHGAANFLKERLFDQSDAYRVHVCETCGLIAIANLKKNSFECRGCKNKTDIVQVHIPYACKLLFQELMSMAIAPRMLTKGLKNAKGRK

SEQ ID NO: 5641 - protein, 1192 aa, Tabernaemontana elegans
MEIDEEYEPQYNDEDEEITQEDAWAVISAYFEEKGLVRQQLDSFDEFIQNTMQEIVDESADIEIRPESQHNPGHQSDFAETIYKISFGQIYLSKPMMTESDGETATLFPKAARLRNLTYSAPLYVDVTKRVIKKGHDGEEVTETQDFGKVFIGKVPIMLRSSYCTLFQNSEKDLTELGECPYDQGGYFIINGSEKVLIAQEKMSTNHVYVFKKRQPNKYAFVAEVRSMAETQNRPPSTMFVRMLSRSSAKGGASGQYIRATLPYIRTEIPIIIVFRALGFVADKDILEHICYDFKDTQMMELLRPSLEEAFVIQNQQVALDYIGKRGATVGVTREKRIKYAKEILQKEMLPHVGVGEYCETKKAYYFGYIIHRLLLCALGRRAEDDRDHYGNKRLDLAGPLLGGLFRMLFRKLTRDVRAYVQKCVDNGKDVNLQFAIKAKTITSGLKYSLATGNWGQANAAGTRAGVSQVLNRLTYASTLSHLRRLNSPIGREGKLAKPRQLHNSQWGMMCPAETPEGQACGLVKNLALMVYITVGSAAYPILEFLEEWGTENFEEISPAVIPEATKIFVNGCWVGIHRDPDMLVRTLRRLRRRVDVNTEVGVVRDIRLKELRIYTDYGRCSRPLFIVEKQRLLIKKRDIQALQARESPEDGGWHELIAKGFIEYIDTEEEETTMISMTINDLLTARLNPEEAYTDTYTHCEIHPSLILGVCASIIPFPDHNQSPRNTYQSAMGKQAMGIYVTNYQFRMDTLAYVLYYPQKPLVTTRAMEHLHFRQLPAGINAIVAIACYSGYNQEDSVIMNQSSIDRGFFRSLFFRSYRDEEKKMGTLVKEEFGRPDRSNTMGMRHGSYDKLDDDGLAPPGTRVSGEDVIIGKTTPIHQDDAHVPASLSSRYTKRDHSTSLRHSENGIVDQVLLTTNADGLRFVKVRVRSVRIPQIGDKFSSRHGQKGTVGMTYTQEDMPFTGEGITPDIIVNPHAIPSRMTIGQLIECIMGKVAAHMGKEGDATPFTDVTVDNISKALHKCGYQMRGFERMYNGHTGRPLTATIFLGPTYYQRLKHMVDDKIHSRGRGPVQILTRQPAEGRSRDGGLRFGEMERDCMIAHGAAHFLKERLFDQSDAYRIHVCERCGLIAIANLKKNSFECRGCKNKTDIVQVHIPYACKLLFQELMSMAIAPRMLTRDIRQIKDQHKRGN

SEQ ID NO: 5642 - protein, 1188 aa, Eutrema halophilum
MDYNEYEQEPNYVEDDDDEEITQEDAWAVISAYFEEKGLVRQQLDSFDEFIQNTMQEIVDESADIEIRPESQHNPGHQSDFAETIYKISFGQIYLSKPMMTESDGETATLFPKAARLRNLTYSAPLYVDVTKRVIKKGHDGEEVTETQDFTKVFIGKVPIMLRSSYCTLFQNSEKDLTELGECPYDQGGYFIINGSEKVLIAQEKMSTNHVYVFKKRQPNKYAYVGEVRSMAENQNRPPSTMFVRMLARASAKGGSSGQYIRCTLPYIRTEIPIIIVFRALGFVADKDILEHICYDFADTQMMELLRPSLEEAFVIQNQQVALDYIGKRGATVGVTKEKRIKYAKDILQKEMLPHVGIGEYCETKKAYYFGYIIHRLLLCALGRRPEDDRDHYGNKRLDLAGPLLGGLFRMLFRKLTRDVRSYVQKCVDNGKEVNLQFAIKAKTITSGLKYSLATGNWGQANAAGTRAGVSQVLNRLTYASTLSHLRRLNSPIGREGKLAKPRQLHNSQWGMMCPAETPEGQACGLVKNLALMVYITVGSAAYPILEFLEEWGTENFEEISPSVIPQATKIFVNGMWVGVHRDPDMLVKTLRRLRRRVDVNTEVGVVRDIRLKELRIYTDYGRCSRPLFIVDNQRLLIKKRDIYALQQRESAEEDGWHHLVAKGFIEYIDTEEEETTMISMTINDLVQARLRPDEAYSETYTHCEIHPSLILGVCASIIPFPDHNQSPRNTYQSAMGKQAMGIYVTNYQFRMDTLAYVLYYPQKPLVTTRAMEHLHFRQLPAGINAIVAISCYSGYNQEDSVIMNQSSIDRGFFRSLFFRSYRDEEKKMGTLVKEDFGRPDRASTMGMRHGSYEKLDDDGLAPPGTRVTGEDVIIGKTTPISQDEAQGQSSRYTRRDHSISLRHSETGMVDQVLLTTNADGLRFVKVRVRSVRIPQIGDKFSSRHGQKGTVGMTYTQEDMPWTIEGVTPDIIVNPHAIPSRMTIGQLIECIMGKVAAHMGKEGDATPFTDVTVDNISKALHKCGYQMRGFERMYNGHTGRPLTAMIFLGPTYYQRLKHMVDDKIHSRGRGPVQILTRQPAEGRSRDGGLRFGEMERDCMIAHGAANFLKERLFDQSDAYRIHVCETCGLIAIANLKKNSFECRGCKNKTDIVQVHIPYACKLLFQELMSMAIAPRMLTKDLNSVKGRK

SEQ ID NO: 5643 - protein, 1196 aa, Phaseolus vulgaris
MELEDEYEEQMMEDEEEEDEITQEDAWAVISAYFEEKGLVRQQLDSFDEFIQNTMQEIVDESADIEIRPESQHNPGHQSDSAETVYKISFGQIYLSKPMMTESDGETASLFPKAARLRNLTYSAPLYVDVSKRVIKKGHDGEEVTETQDFTKVFIGKVPIMLRSSYCTLYQNSEKDLTELGECPYDQGGYFIINGSEKVLIAQEKMSTNHVYVFKKRQPNKYAYVAEVRSMAESQNRPPSTMFVRMLSRTSSKGGSSGQYIRATLPYIRTEIPIIIVFRALGFVADKDILEHICYDFSDTQMMDLLRPSLEEAFVIQNQQVALDYIGKRGSTVGVTKEKRIKYAKEILQKEMLPHVGIGEYCETKKAYYFGYIIHRLLLCALGRRAEDDRDHYGNKRLDLAGPLLGGLFRMLFRKLTRDVRAYVQKCVDNGKDVNLQFAIKAKTVTSGLKYSLATGNWGQANAAGTRAGVSQVLNRLTYASTLSHLRRLNSPIGREGKLAKPRQLHNSQWGMMCPAETPEGQACGLVKNLALMVYITVGSAAYPILEFLEEWGTENFEEISPAVIPQATKIFVNGCWMGIHRDPDMLVRTLRKLRRRVDVNTEVGVVRDIRLKELRIYTDYGRCSRPLFIVDRQRLLIKKKDIHALQQRESPEEGGWHDLVSKGFIEYIDTEEEETTMISMTINDLVQARINPEEAYSDTYTHCEIHPSLILGVCASIIPFPDHNQSPRNTYQSAMGKQAMGIYVTNYQFRMDTLAYVLYYPQKPLVTTRAMEHLHFRQLPAGINAIVAISCYSGYNQEDSVIMNQSSIDRGFFRSLFFRSYRDEEKKMGTLVKEDFGRPDRANTMGMRHGSYDKLDDDGLAPPGTRVSGEDVIIGKTTPISQEEAQGQALRYTRRDHSISLRHSETGIVDQVLLTTNADGLRFVKVRVRSVRIPQIGDKFSSRHGQKGTVGMTYTQEDMPWTVEGITPDIIVNPHAIPSRMTIGQLIECIMGKVAAHMGKEGDATPFTDVTVDSISKALHKCGYQMRGFETMYNGHTGRRLSAMIFLGPTYYQRLKHMVDDKIHSRGRGPVQILTRQPAEGRSRDGGLRFGEMERDCMIAHGAAHFLKERLFDQSDAYRVHVCEKCGLIAIANLKKNSFECRGCKNKTDIVQVFIPYACKLLFQELMAMAIAPRMLTKDVKSKKDQRRREPHKHV

SEQ ID NO: 5644 - protein, 1189 aa, Brassica rapa
MDYNNEYEQEPTYIEEDDDEEITQEDAWAVISAYFEEKGLVRQQLDSFDEFIQNTMQEIVDESADIEIRPESQHNPGHQSDFAETIYKISFGQIYLSKPMMTESDGETATLFPKAARLRNLTYSAPLYVDVSKRVIKKGHDGEEVTETQDFTKVFIGKVPIMLRSSYCTLFQNSEKDLTELGECPYDQGGYFIINGSEKVLIAQEKMSTNHVYVFKKRQPNKYAYVGEVRSMAENQNRPPSTMFVRMLARASAKGGSSGQYIRCTLPYIKAEIPIIIVFRALGFVADKDILEHICYDFADNQMMELLRPSLEEAFVIQNQQVALDYIGKRGAPMGVTKEKRIKYAKDILQKEMLPHVGVGEFCETKKAYYFGYIIHRLLLCALGRRPEDDRDHYGNKRLDLAGPLLGGLFRMLFRKLTRDVRSYVQKCVDNGKEVNLQFAIKAKTITSGLKYSLATGNWGQANAAGTRAGVSQVLNRLTYASTLSHLRRLNSPIGREGKLAKPRQLHNSQWGMMCPAETPEGQACGLVKNLALMVYITVGSAAYPILEFLEEWGTENFEEISPSVIPQATKIFVNGMWVGVHRDPDMLVKTLRRLRRRVDVNTEVGVVRDIRLKELRIYTDYGRCSRPLFIVDNQRLLIKKRDIYALQQRESAEEDGWHHLVAKGFIEYIDTEEEETTMISMTISDLVQARLRPDEAYSETYTHCEIHPSLILGVCASIIPFPDHNQSPRNTYQSAMGKQAMGIYVTNYQFRMDTLAYVLYYPQKPLVTTRAMEHLHFRQLPAGINAIVAISCYSGYNQEDSVIMNQSSIDRGFFRSLFFRSYRDEEKKMGTLVKEDFGRPDRATTMGMRHGSYEKLDDDGLAPPGTRVSGEDVIIGKTTPISQDEAQGQSSRYTRRDHSISLRHSETGMVDQVLLTTNADGLRFVKVRVRSVRIPQIGDKFSSRHGQKGTVGMTYTQEDMPWTIEGVTPDIIVNPHAIPSRMTIGQLIECIMGKVAAHMGKEGDATPFTDVTVDNISKALHKCGYQMRGFERMYNGHTGRPLTAMIFLGPTYYQRLKHMVDDKIHSRGRGPVQILTSQPAEGRSRDGGLRFGEMERDCMIAHGAANFLKERLFDQSDAYRVHVCETCGLIAIANLKKNSFECRGCKNKTDIVQVHIPYACKLLFQELMSMAIAPRMLTKGLKNAKGRK

SEQ ID NO: 5645 - protein, 1193 aa, Malus domestica
MEEEHEYDDQQYMEDDDEDEITQEDAWAVISAYFEEKGLVRQQLDSFDEFIQNTMQEIVDESADIEIRPESQHNPGHQPDFAETVCKISFGQIYLSKPMMTESDGETATLFPKAARLRNLTYSAPLYVDVSKRMIKKGHDGEELTETQDFTKVFIGKVPIMLRSSYCTLYQNSEKDLTELGECPYDQGGYFIINGSEKVLIAQEKMSTNHVYVFKKRQPNKYAYVAEVRSMAESQNRPPSTMFVRMLARTSSKGGSSGQYIKATLPYIKGEIPIIIVFRALGFVADKDILEHICYDFSDTQMMELLRPSLEEAFVIQNQQVALDYIGKRGANVGVSRDKRIKYAKEILQKEMLPHVGVGEFCETKKAYYFGYIVHRLLLCALGRRPEDDRDHYGNKRLDLAGPLLGGLFRNLFRKLTKDVRAYAQKCVDNGKDLNLQFAIKAKTITSGLKYSLATGNWGQANAAGTRAGVSQVLNRLTYASTLSHLRRLNSPIGREGKLAKPRQLHNSQWGMMCPAETPEGQACGLVKNLALMVYITVGSAAYPILEFLEEWGTENFEEISPAVIPQATKIFVNGCWVGIHRDPEMLVRTLRKLRRRVDVNTEVGVVRDIRLKELRIYTDYGRCSRPLFIVDKQRLLIKKRDIHALQQRESPEDAGWHDLVAKGYIEYIDTEEEETTMISMTINDLVQARLNPEEAYSDTYTHCEIHPSLILGVCASIIPFPDHNQSPRNTYQSAMGKQAMGIYVTNYQFRMDTLAYVLYYPQKPLVTTRAMEHLHFRQLPAGINAIVAISCYSGYNQEDSVIMNQSSVDRGFFRSLFFRSYRDEEKKMGTLVKEDFGRPDRANTMGMRHGSYDKLDDDGLAPPGTRVSGEDVIIGKTTPMAQDEAPGQATSRYTRRDHSISLRHSETGIVDQVLLTTNADGLRFVKVRVRSVRIPQIGDKFSSRHGQKGTVGMTYTQEDMPWTVEGVTPDIIVNPHAIPSRMTIGQLIECIMGKVAAHMGKEGDATPFTDVTVDNISKALHSCGYQMRGFETMYNGHTGRRLSAMIFLGPTYYQRLKHMVDDKIHSRGRGPVQILTRQPAEGRSRDGGLRFGEMERDCMIAHGAAHFLKERLFDQSDAYRVHVCERCGLIAIANLKKNSFECRGCKNKTDIVQVYIPYACKLLFQELMSMAIAPRMLTKDIKPAKNQKKKGG

SEQ ID NO: 5646 - protein, 1188 aa, Arabidopsis lyrata
MEYNEYEPEPQYVEDDDDEEITQEDAWAVISAYFEEKGLVRQQLDSFDEFIQNTMQEIVDESADIEIRPESQHNPGHQSDFAETIYKISFGQIYLSKPMMTESDGETATLFPKAARLRNLTYSAPLYVDVTKRVIKKGHDGEEVTETQDFTKVFIGKVPIMLRSSYCTLFQNSEKDLTELGECPYDQGGYFIINGSEKVLIAQEKMSTNHVYVFKKRQPNKYAYVGEVRSMAENQNRPPSTMFVRMLARASAKGGSSGQYIRCTLPYIRTEIPIIIVFRALGFVADKDILEHICYDFADTQMMELLRPSLEEAFVIQNQLVALDYIGKRGATVGVTKEKRIKYAKDILQKEMLPHVGIGEYCETKKAYYFGYIIHRLLLCALGRRPEDDRDHYGNKRLDLAGPLLGGLFRMLFRKLTRDVRSYVQKCVDNGKEVNLQFAIKAKTITSGLKYSLATGNWGQANAAGTRAGVSQVLNRLTYASTLSHLRRLNSPIGREGKLAKPRQLHNSQWGMMCPAETPEGQACGLVKNLALMVYITVGSAAYPILEFLEEWGTENFEEISPSVIPQATKIFVNGMWVGVHRDPDMLVKTLRRLRRRVDVNTEVGVVRDIRLKELRIYTDYGRCSRPLFIVDNQRLLIKKRDIYALQQRESAEEDGWHHLVAKGFIEYIDTEEEETTMISMTISDLVQARLRPEEAYTENYTHCEIHPSLILGVCASIIPFPDHNQSPRNTYQSAMGKQAMGIYVTNYQFRMDTLAYVLYYPQKPLVTTRAMEHLHFRQLPAGINAIVAISCYSGYNQEDSVIMNQSSIDRGFFRSLFFRSYRDEEKKMGTLVKEDFGRPDRGSTMGMRHGSYDKLDDDGLAPPGTRVSGEDVIIGKTTPISQDEAQGQSSRYTRRDHSISLRHSETGMVDQVLLTTNADGLRFVKVRVRSVRIPQIGDKFSSRHGQKGTVGMTYTQEDMPWTIEGVTPDIIVNPHAIPSRMTIGQLIECIMGKVAAHMGKEGDATPFTDVTVDNISKALHKCGYQMRGFERMYNGHTGRPLTAMIFLGPTYYQRLKHMVDDKIHSRGRGPVQILTRQPAEGRSRDGGLRFGEMERDCMIAHGAAHFLKERLFDQSDAYRVHVCEVCGLIAIANLKKNSFECRGCKNKTDIVQVYIPYACKLLFQELMSMAIAPRMLTKHLKSAKGRQ

SEQ ID NO: 5647 - protein, 1192 aa, Amsonia hubrichtii
MEIDEEYEQQYNDEEEEITQEDAWAVISAYFEEKGLVRQQLDSFDEFIQNTMQEIVDESADIEIRPESQHNPGHQSDFAETIYKICFGQIYLSKPMMTESDGETATLFPKAARLRNLTYSAPLYVDVTKRVIKKGHDGEEVTETQDFGKVFIGKVPIMLRSSYCTLYQNSEKDLTELGECPYDQGGYFIINGSEKVLIAQEKMSTNHVYVFKKRQPNKYAFVAEVRSMAETQNRPPSTMFVRMLSRSSAKGGASGQYIRATLPYIRTEIPIIIVFRALGFVADKDILEHICYDFKDTQMMELLRPSLEEAFVIQNQQVALDYIGKRGATVGVTREKRIKYAKEILQKEMLPHVGVGEYCETKKAYYFGYIIHRLLLCALGRRAEDDRDHYGNKRLDLAGPLLGGLFRMLFRKLTRDVRAYVQKCVDNGKDVNLQFAIKAKTITSGLKYSLATGNWGQANAAGTRAGVSQVLNRLTYASTLSHLRRLNSPIGREGKLAKPRQLHNSQWGMMCPAETPEGQACGLVKNLALMVYVTVGSAAYPILEFLEEWGTENFEEISPAVIPEATKIFVNGCWVGIHRDPDMLVRTLRRLRRRVDVNTEVGVVRDIRLKELRIYTDYGRCSRPLFIVEKQRLLIKKRDIQALQARESPEDGGWHDLIAKGFIEYIDTEEEETTMISMTISDLVTARLNPEEAYTDTYTHCEIHPSLILGVCASIIPFPDHNQSPRNTYQSAMGKQAMGIYVTNYQFRMDTLAYVLYYPQKPLVTTRAMEHLHFRQLPAGINAIVSIACYSGYNQEDSVIMNQSSIDRGFFRSLFFRSYRDEEKKMGTLVKEDFGRPDRSNTMGMRHGSYDKLDDDGLAPPGTRVSGEDVIIGKTTPIHQDDAHVPGSLSSRYTKRDHSTSLRHSENGIVDQVLLTTNADGLRFVKVRVRSVRIPQIGDKFSSRHGQKGTVGMTYTQEDMPFTGEGITPDIIVNPHAIPSRMTIGQLIECIMGKVAAHMGKEGDATPFTDVTVDNISKALHKCGYQMRGFERMYNGHTGRPLTATIFLGPTYYQRLKHMVDDKIHSRGRGPVQILTRQPAEGRSRDGGLRFGEMERDCMIAHGAAHFLKERLFDQSDAYRIHVCERCGLIAIANLKKNSFECRGCKNKTDIVQVHIPYACKLLFQELMSMAIAPRMLTRDIKQIKDQQKRGN

SEQ ID NO: 5648 - protein, 1201 aa, Plantago ovata
MYYGQEEYGGQEEELYDNNDNENPVDEEDEITQEDAWTVISAYFEEKGLVRQQLDSFDEFIQNTMQEIVDESSDIEIRPESQHNPGHQPDFAETIYKISFGQIYLSKPMMTESDGETATLFPKAARLRNLTYSAPLYVDVSKKVIKKGHDGEEVTETQDFTKVFIGKVPIMLRSSYCTLYQNSEKDLTELGECPYDQGGYFIINGSEKVLIAQEKMSTNHVYVFKKRQPNKYAYVAEVRSMAEAQNRPPSTMFVRMLSRTSAKGGSSGQYIRATLPYIRTEIPIIIVFRALGFVADKDILEHICYNFQDTQMMEMLRPSLEEAFVIQNQQVALDYIGKRGATVGVTKEKRIKYAKEILQKEMLPHVGVGEYCETKKAYYFGYIIHRLLLCAIGRRPEDDRDHYGNKRLDLAGPLLGGLFRMLFRKLTRDVRSYVQKCVDNGKDVNLQFAIKAKTITSGLKYSLATGNWGQANAAGTRAGVSQVLNRLTYASTLSHLRRLNSPIGREGKLAKPRQLHNSQWGMMCPAETPEGQACGLVKNLALMVYITVGSAAYPILEFLEEWGTENFEEISPAVIPKATKIFVNGCWVGIHRNPKMLVSTLKRLRRRVDVNTEVGVVQDIRLSELRIYTDYGRCSRPLFIVENQKLLIKKKDIVELQKRESDDGGWHDLVQKGFIEYIDTEEEEITMISMTISDLSSARNNPGEAYSETYTHCEIHPSLILGVCASIIPFPDHNQSPRNTYQSAMGKQAMGIYVTNYQFRMDTLAYVLYYPQKPLVTTRAMEHLHFRQLPAGINAIVAIACYSGYNQEDSVIMNQSSIDRGFFRSLFFRSYRDEEKKMGTLVKEDFGRPDRANTMGMRHGSYDKLDDDGLAPPGTRCSGEDVIIGKTTPISPEEATGPAARYTKRDHSTSLRHSETGMVDQVLLTTNADGLRFVKVRVRSVRVPQIGDKFSSRHGQKGTVGMTYTQEDMPWSVEGITPDIIVNPHAIPSRMTIGQLIECIMGKVAAHMGKEGDATPFTDVTVDNISKALHKCGYQMRGFETMYNGHTGRKLTSMIFLGPTYYQRLKHMVDDKIHSRGRGPVQILTRQPAEGRSRDGGLRFGEMERDCMIAHGAAHFLKERLFDQSDAYRIHVCEQCGLIAIANLKKNSFECRSCKNKTDIVQVHIPYACKLLFQELMSMAIAPRMLTKDIKQSKEQKKKGV

SEQ ID NO: 5649 - protein, 1188 aa, Arabidopsis thaliana
MEYNEYEPEPQYVEDDDDEEITQEDAWAVISAYFEEKGLVRQQLDSFDEFIQNTMQEIVDESADIEIRPESQHNPGHQSDFAETIYKISFGQIYLSKPMMTESDGETATLFPKAARLRNLTYSAPLYVDVTKRVIKKGHDGEEVTETQDFTKVFIGKVPIMLRSSYCTLFQNSEKDLTELGECPYDQGGYFIINGSEKVLIAQEKMSTNHVYVFKKRQPNKYAYVGEVRSMAENQNRPPSTMFVRMLARASAKGGSSGQYIRCTLPYIRTEIPIIIVFRALGFVADKDILEHICYDFADTQMMELLRPSLEEAFVIQNQLVALDYIGKRGATVGVTKEKRIKYARDILQKEMLPHVGIGEHCETKKAYYFGYIIHRLLLCALGRRPEDDRDHYGNKRLDLAGPLLGGLFRMLFRKLTRDVRSYVQKCVDNGKEVNLQFAIKAKTITSGLKYSLATGNWGQANAAGTRAGVSQVLNRLTYASTLSHLRRLNSPIGREGKLAKPRQLHNSQWGMMCPAETPEGQACGLVKNLALMVYITVGSAAYPILEFLEEWGTENFEEISPSVIPQATKIFVNGMWVGVHRDPDMLVKTLRRLRRRVDVNTEVGVVRDIRLKELRIYTDYGRCSRPLFIVDNQKLLIKKRDIYALQQRESAEEDGWHHLVAKGFIEYIDTEEEETTMISMTISDLVQARLRPEEAYTENYTHCEIHPSLILGVCASIIPFPDHNQSPRNTYQSAMGKQAMGIYVTNYQFRMDTLAYVLYYPQKPLVTTRAMEHLHFRQLPAGINAIVAISCYSGYNQEDSVIMNQSSIDRGFFRSLFFRSYRDEEKKMGTLVKEDFGRPDRGSTMGMRHGSYDKLDDDGLAPPGTRVSGEDVIIGKTTPISQDEAQGQSSRYTRRDHSISLRHSETGMVDQVLLTTNADGLRFVKVRVRSVRIPQIGDKFSSRHGQKGTVGMTYTQEDMPWTIEGVTPDIIVNPHAIPSRMTIGQLIECIMGKVAAHMGKEGDATPFTDVTVDNISKALHKCGYQMRGFERMYNGHTGRPLTAMIFLGPTYYQRLKHMVDDKIHSRGRGPVQILTRQPAEGRSRDGGLRFGEMERDCMIAHGAAHFLKERLFDQSDAYRVHVCEVCGLIAIANLKKNSFECRGCKNKTDIVQVYIPYACKLLFQELMSMAIAPRMLTKHLKSAKGRQ

SEQ ID NO: 5650 - protein, 783 aa, Malus domestica
MLFRKLTKDVRAYAQKCVDNGKDLNLQFAIKAKTITSGLKYSLATGNWGQANAAGTRAGVSQVLNRLTYASTLSHLRRLNSPIGREGKLAKPRQLHNSQWGMMCPAETPEGQACGLVKNLALMVYITVGSAAYPILEFLEEWGTENFEEISPAVIPQATKIFVNGCWVGIHRDPEMLVRTLRKLRRRVDVNTEVGVVRDIRLKELRIYTDYGRCSRPLFIVDKQRLLIKKRDIHALQQRESPEDAGWHDLVAKGYIEYIDTEEEETTMISMTINDLVQARLNPEEAYSDTYTHCEIHPSLILGVCASIIPFPDHNQSPRNTYQSAMGKQAMGIYVTNYQFRMDTLAYVLYYPQKPLVTTRAMEHLHFRQLPAGINAIVAISCYSGYNQEDSVIMNQSSVDRGFFRSLFFRSYRDEEKKMGTLVKEDFGRPDRANTMGMRHGSYDKLDDDGLAPPGTRVSGEDVIIGKTTPMAQDEAPGQATSRYTRRDHSISLRHSETGIVDQVLLTTNADGLRFVKVRVRSVRIPQIGDKFSSRHGQKGTVGMTYTQEDMPWTVEGVTPDIIVNPHAIPSRMTIGQLIECIMGKVAAHMGKEGDATPFTDVTVDNISKALHSCGYQMRGFETMYNGHTGRRLSAMIFLGPTYYQRLKHMVDDKIHSRGRGPVQILTRQPAEGRSRDGGLRFGEMERDCMIAHGAAHFLKERLFDQSDAYRVHVCERCGLIAIANLKKNSFECRGCKNKTDIVQVYIPYACKLLFQELMSMAIAPRMLTKDIKPAKNQKKKGA

SEQ ID NO: 5651 - protein, 1191 aa, Fragaria vesca
MEEEPEYEEQYNDDDDEDEITQEDAWAVISAYFEEKGLVRQQLDSFDEFIQNTMQEIVDEAADIEIRPESQHNPGHQPDFAETIYKISFGQIYLSKPMMTESDGETATLFPKAARLRNLTYSAPLYVDVSKRVIKKGHDGEEVTETQDFTKVFIGKVPIMLRSSYCTLYQNSEKDLTELGECPYDQGGYFIINGSEKVLIAQEKMSTNHVYVFKKRQPNKYAYVGEVRSMAESQNRPPSTMFVRMLSRTSSKGGSSGQYIRATLPYIRAEIPIIIVFRALGFVADKDILEHICYDFADTQMMELLRPSLEEAFVIQNQQVALDYIGKRGATAGVPRDKRIRYARDILQKEMLPHVGTGEFCETKKAYYFGYIIHRLLLCALGRRAEDDRDHYGNKRLDLAGPLLGSLFRSLFRKLTKDVKGYVQKCVDNGKDVNLQFAIKAKTITSGLKYSLATGNWGQANAAGTRAGVSQVLNRLTYASTLSHLRRLNSPIGREGKLAKPRQLHNSQWGMMCPAETPEGQACGLVKNLALMVYITVGSAAYPILEFLEEWGTENFEEISPAVIPQATKIFVNGCWVGIHRDPEMLVRTLRKLRRRVDVNTEVGVVRDIRLKELRIYTDYGRCSRPLFIVDKQRLLIKKKDIHALQQRENPEDGGWHDLVAKGFIEYIDTEEEETTMISMTINDLVQARLNPEEAYSDTYTHCEIHPSLILGVCASIIPFPDHNQSPRNTYQSAMGKQAMGIYVTNYQFRMDTLAYVLYYPQKPLVTTRAMEHLHFRQLPAGINAIVAISCYSGYNQEDSVIMNQSSIDRGFFRSLFFRSYRDEEKKMGTLVKEDFGRPDRANTMGMRHGSYDKLEDDGLAPPGTRVSGEDVIIGKTTPIAPEEAQGQAASRYSRRDHSISLRHSETGIVDQVLLTTNADGLRFVKVRVRSVRIPQIGDKFSSRHGQKGTVGMTYTQEDMPWTVEGVTPDIIVNPHAIPSRMTIGQLIECIMGKVAAHMGKEGDATPFTDVTVDNISKALHKCGYQMRGFETMYNGHTGRRLSAMIFLGPTYYQRLKHMVDDKIHSRGRGPVQILTRQPAEGRSRDGGLRFGEMERDCMIAHGAAHFLKERLFDQSDAYRVHVCERCGLIAIANLKKNSFECRGCKNKTDIVQVHIPYACKLLFQELMAMAIAPRMLTKDVKPIKDKKKGA

SEQ ID NO: 5652 - protein, 685 aa, Cucumis sativus
MNDDDDMDQAIPDDEEEITQEDAWAVISAYFEEKGLVRQQLDSFDEFIQNTMQEIVDESADIEIRPESQHNPGHQSDVAETIYKISFGQIYLSKPMMTESDGETATLFPKAARLRNLTYSAPLYVDVSKRVIKKGHDGEEVTETQDFTKVFIGKVPIMLRSSYCTLYQNSEKDLTELGECPYDQGGYFIINGSEKVLIAQEKMSTNHVYVFKKRQPNKYAFVAEVRSMAESQNRPPSTMFVRMLSRTSAKGGSSGQYIRATLPYIRNEIPIIIVFRALGFVADKDILEHICYDFSDTQMMELLRPSLEEAFVIQNQQVALDYIGKRGSTVGVTKEKRIKYAKEILQKEMLPHVGVGEFCETKKAYYFGYIIHRLLLCALGRRAEDDRDHYGNKRLDLAGPLLGGLFRMLFRKLTRDVRGYVQKCVDNGKDVNLQFAIKAKTITSGLKYSLATGNWGQANAAGTRAGVSQVLNRLTYASTLSHLRRLNSPIGREGKLAKPRQLHNSQWGMMCPAETPEGQACGLVKNLALMVYITVGSAAYPILEFLEEWGTENFEEISPAVIPQATKIFVNGCWVGIHRDPEMLVKTLRRLRRRVDVNTEVGVVRDIRLKELRIYTDYGRCSRPLFIVEKQRLLIKKKDIHALQQRESPEDGGWHDLVAKGFIEYIDTEEEETTMISMTISVSKQ

SEQ ID NO: 5653 - protein, 1191 aa, Brassica napus
MEYNNEYEQEPTYIEDDDDEEITQEDAWAVISAYFEEKGLVRQQLDSFDEFIQNTMQEIVDESADIEIRPESQHNPGQQSDFAETIYKISFGQIYLSKPMMTESDGETATLFPKAARLRNLTYSAPLYVDVSKRVIKKGHDGEEVTETQDFTKVFIGKVPIMLRSSYCTLFQNSEKDLTELGECPYDQGGYFIINGSEKVLIAQEKMSTNHVYVFKKRQPNKYAYVAEVRSMAENQNRPPSTMFVRMLARASAKGGSSGQYIRCTLPYIKAEIPIIIVFRALGFVADKDILEHICYDFADNQMMELLRPSLEEAFVIQNQLVALDYIGKRGQPMGVGVSKEKRIKYARDILQKEMLPHVGVGEFCETKKAYYFGYIIHRLLLCALGRRPEDDRDHYGNKRLDLAGPLLGGLFRMLFRKLTRDVRSYVQKCVDNGKEVNLQFAIKAKTITSGLKYSLATGNWGQANAAGTRAGVSQVLNRLTYASTLSHLRRLNSPIGREGKLAKPRQLHNSQWGMMCPAETPEGQACGLVKNLALMVYITVGSAAYPILEFLEEWGTENFEEISPSVIPQATKIFVNGMWVGVHRDPDMLVKTLRRLRRRVDVNTEVGVVRDIRLKELRIYTDYGRCSRPLFIVDNQRLLIKKKDIYALQQRESAEEDGWHHLVAKGFIEYIDTEEEETTMISMTINDLVQARLRPDEAYSETYTHCEIHPSLILGVCASIIPFPDHNQSPRNTYQSAMGKQAMGIYVTNYQFRMDTLAYVLYYPQKPLVTTRAMEHLHFRQLPAGINAIVAISCYSGYNQEDSVIMNQSSIDRGFFRSLFFRSYRDEEKKMGTLVKEDFGRPDRASTMGMRHGSYEKLDDDGLAPPGTRVSGEDVIIGKTTPISQDEAQGQSSRYTRRDHSISLRHSETGMVDQVLLTTNADGLRFVKVRVRSVRIPQIGDKFSSRHGQKGTVGMTYTQEDMPWTIEGVTPDIIVNPHAIPSRMTIGQLIECIMGKVAAHMGKEGDATPFTDVTVDNISKALHKCGYQMRGFERMYNGHTGRPLTAMIFLGPTYYQRLKHMVDDKIHSRGRGPVQILTRQPAEGRSRDGGLRFGEMERDCMIAHGAANFLKERLFDQSDAYRVHVCETCGLIAIANLKKNSFECRGCKNKTDIVQVHIPYACKLLFQELMSMAIAPRMLTKGLKSAKGRK

SEQ ID NO: 5654 - protein, 1191 aa, Brassica rapa
MEYNNEYEQEPTYIEDDDDEEITQEDAWAVISAYFEEKGLVRQQLDSFDEFIQNTMQEIVDESADIEIRPESQHNPGQQSDFAETIYKISFGQIYLSKPMMTESDGETATLFPKAARVRNLTYSAPLYVDVSKRVIKKGHDGEEVTETQDFTKVFIGKVPIMLRSSYCTLFQNSEKDLTELGECPYDQGGYFIINGSEKVLIAQEKMSTNHVYVFKKRQPNKYAYVAEVRSMAENQNRPPSTMFVRMLARASAKGGSSGQYIRCTLPYIKAEIPIIIVFRALGFVADKDILEHICYDFADNQMMELLRPSLEEAFVIQNQLVALDYIGKRGQPMGVGVSKEKRIKYARDILQKEMLPHVGVGEFCETKKAYYFGYIIHRLLLCALGRRPEDDRDHYGNKRLDLAGPLLGGLFRMLFRKLTRDVRSYVQKCVDNGKEVNLQFAIKAKTITSGLKYSLATGNWGQANAAGTRAGVSQVLNRLTYASTLSHLRRLNSPIGREGKLAKPRQLHNSQWGMMCPAETPEGQACGLVKNLALMVYITVGSAAYPILEFLEEWGTENFEEISPSVIPQATKIFVNGMWVGVHRDPDMLVKTLRRLRRRVDVNTEVGVVRDIRLKELRIYTDYGRCSRPLFIVDNQRLLIKKKDIYALQQRESAEEDGWHHLVAKGFIEYIDTEEEETTMISMTINDLVQARLRPDEAYSETYTHCEIHPSLILGVCASIIPFPDHNQSPRNTYQSAMGKQAMGIYVTNYQFRMDTLAYVLYYPQKPLVTTRAMEHLHFRQLPAGINAIVAISCYSGYNQEDSVIMNQSSIDRGFFRSLFFRSYRDEEKKMGTLVKEDFGRPDRASTMGMRHGSYEKLDDDGLAPPGTRVSGEDVIIGKTTPISQDEAQGQSSRYTRRDHSISLRHSETGMVDQVLLTTNADGLRFVKVRVRSVRIPQIGDKFSSRHGQKGTVGMTYTQEDMPWTIEGVTPDIIVNPHAIPSRMTIGQLIECIMGKVAAHMGKEGDATPFTDVTVDNISKALHKCGYQMRGFERMYNGHTGRPLTAMIFLGPTYYQRLKHMVDDKIHSRGRGPVQILTRQPAEGRSRDGGLRFGEMERDCMIAHGAANFLKERLVGQSDAYRGHVCGTCGLIAIANLKKNSFECRGCKNKTDIVQVHIPYACKLLFQELMSMAIAPRMLTKGLKSAKGRK

SEQ ID NO: 5655 - protein, 1155 aa, Papaver somniferum
LVRQQLDSFDEFIQNTMQEIVDESADIEIRPESQHNPGRQSDFVETVYKISFGQIYLSKPMMTESDGETATLFPRAARLRNLTYSAPLYVDVSKRIIKKGHDCEEVTETQDFTKVFIGKVPIMLRSSYCTLYQNSEKDLTELGECPYDQGGYFIINGSEKVLIAQEKMSTNHVYVFKKRQPNKYAYVAEVRSMAESQNRPPSGMFVRMLSRASAKGGSSGQYIRATLPYIRTEIPIIIVFRALGFVADKDILEHICYDFSDNQMMELLRPSLEEAFVIQNQQVALDYIGKRGSTVGVTREKRIKYAKEILQKEMLPHVGVGEYCETRKAYYFGYIIHRLLLCALGRRPEDDRDHYGNKRLDLAGPLLGGLFRMLFRKLTRDVRGYVQKCVDNGKDVNLQFAIRAKTITTGLKYSLATGNWGQANAAGTRAGVSQVLNRLTYASTLSHLRRLNSPIGREGKLAKPRQLHNSQWGIMCPAETPEGQACGLVKNLALMVYITVGSAANPILEFLEEFGMENFEEISPAVIPQSTKIFVNGCWVGIHRNPEPLVKTLRRLRRRVDVNTEVGVIREVRLKELRLYTDYGRCSRPLFIVEKQRLLIKKRDIRALQQRESPEEDGWHDLVAKGYIEYVDTEEEETTMISMTINDLVSARHNPEEAYSETYTHCEIHPSLILGVCASIIPFPDHNQSPRNTYQSAMGKQAMGIYVTNYQLRMDTLAYVLYYPQKPLVTTRAMEHLHFRQLPAGINAIVAIACYSGYNQEDSVIMNQSSIDRGFFRSLFFRSYRDEEKKMGTLIKEDFGRPNRENTMGMRHGSYDKLDDDGLAPPGTRVSGEDVIIGKTTPIAQDDAQQGQASRYTRRDHSTSMRHSESGMVDQVVLTTNADGLRFVKVRMRSVRIPQIGDKFSSRHGQKGTVGMTYTQEDMPWTVEGITPDIIVNPHAIPSRMTIGQLIECIMGKVAAHVGKEGDATPFTDVTVDNISKALHKCGYQMRGFETMYNGHTGRKLTAMIFLGPTYYQRLKHMVDDKIHSRGRGPVQILTRQPAEGRSRDGGLRFGEMERDCMIAHGAAHFLKERLFDQSDAYRVHVCEHCGLIAIANLKKNSFECRGCKNKTDIVQVYIPYACKLLFQELMSMAIAPRMLTKEVKQAKDTKKKGA

SEQ ID NO: 5656 - protein, 1187 aa, Abies balsamea
MYAGEEEEYVNEEEEITQEDAWAVISAYFEEKGLVRQQLDSFDEFIQNTMQEIVDESADIEIRPESQHNPGRQTDFTETVFKISFGQIYLSKPMMTESDGETATLFPKAARLRNLTYSAPLYVDVTKRVFKKGLDCEELAEKQELTKVFIGKVPIMLRSAYCTLSPTNEKDLQELGECPYDQGGYFIINGSEKVLIAQEKMSTNHVYVFKKRQPNKFSYVAEVRSMAEAQNRPPSSMFVRMLSRASAKGGSSGQFIRATLPYIRADIPIIIVFRALGFVADKDILEHICYDFSDAAMMELLRPSLEEAFVIQNQQVALDYIGKRGSTVGVTKEKRIKYAKDILQKEMLPHVGVGELYETKKAYFFGYIIHRLLLCALGRRPEDDRDHYGNKRLDLAGPLLGGLFRMLFRKLTRDVRSYLQKCVDAGKDVNLQFAIKAKTISSGLKYSLATGNWGQANAAGTRAGVSQVLNRLTFASTLSHLRRLNSPIGREGKLAKPRQLHNSHWGMMCPAETPEGQACGLVKNLALMVYITVGSSPNPILEFLEEWSTENFEEISPAVIPSATKIFVNGCWVGIHRDPELLVKTLRQLRRQVDVNPEVGVVRDIRLKELRLYTDYGRCSRPLFVVEKQRLSIKKSDINRLQERTSPDEGWHDLVTRGFIEYVDTEEEETTMISMTINDLVTARNNPAEAYSHTYTHCEIHPSLILGVCASIIPFPDHNQSPRNTYQSAMGKQAMGIYVTNYQLRMDTLAYVLYYPQKPLVTTRAMEHLHFRQLPAGINAIVAIACYSGYNQEDSVIMNQSSIDRGFFRSLFFRSYRDEEKRMGTLVKEEFGCPNRENTLGMRHGSYDKLDDDGLAPPGTRVSGEDVIIGKTTPVAPDETAGQQQRYTKRDQSTSLRHSESGMVDQVLLTTNQDGLRFVKVRMRSVRIPQIGDKFSSRHGQKGTVGMTYTQEDMPWTVEGITPDIIVNPHAIPSRMTIGQLIECIMGKVAAHMGKEGDATPFTDVTVDSISKALHKCGYQMRGFETMYNGHTGRKLTAMIFLGPTYYQRLKHMVDDKIHSRGRGPVQILTRQPAEGRSRDGGLRFGEMERDCMIAHGAAHFLKERLFDQSDAYRVHVCERCGLIAIANLKKNSFDCRGCKNKTDIVQVHIPYACKLLFQELMAMAIAPRMFTKEVKEIKDQKKKGGA

SEQ ID NO: 5657 - protein, 1184 aa, Cephalotaxus harringtonia
GGEEVEQVEDGREEITQEDAWVVISAYFDEKGLVRQQLDSFDEFIQNTMQEIVDESADIEIKPESQHNPGRQADFTETVFKISFGQIYLSKPMMTESDGETATLFPKAARLRNLTYSAPLYVDVTKRVFRKGLDCEELSEKQDLTKVFIGKVPIMLRSAYCTLSPTNEKDLHELGECPYDQGGYFIINGSEKVLIAQEKMSTNHVYVFKKRQPNKYSYVAEVRSMAEAQNRPPSSMFVRMLSRASAKGGSSGQFIRATLPYIRSDIPIIIVFRALGFVADKDILEHICYDFSDAAMMELLRPSLEEAFVIQNQQVALDYIGKRGSTVGVTREKRIKYAKDILQKEMLPHVGVGEHSETKKAYFFGYIIHRLLLCALGRRPEDDRDHYGNKRLDLAGPLLGGLFRMLFRKLTRDVRSYLQKCVDSGKDVNLQFAIKAKTISSGLKYSLATGNWGQANAAGTRAGVSQVLNRLTFASTLSHLRRLNSPIGREGKLAKPRQLHNSHWGMMCPAETPEGQACGLVKNLALMVYITVGSSANPILEFLEEWSTENFEEISPAAIPTSTKIFVNGCWVGIHRDPELLVRTLRQLRRQVDVNPEVGVVRDIRLRELRLYTDYGRCSRPLFVVENQRLKIKKVDINNLQASREDGWHELVTQGFIEYVDTEEEETTMISMTINDLVNARTNPEDAYSHTYTHCEIHPSLILGVCASIIPFPDHNQSPRNTYQSAMGKQAMGIYVTNYQLRMDTLAYVLYYPQKPLVTTRAMEHLHFRQLPAGINAIVAIACYSGYNQEDSVIMNQSSIDRGFFRSLFFRSYRDEEKRMGTLVKEEFGRPNRENTMGMRHGSYDKLDDDGLAPPGTRVSGEDVIIGKTTPIAQDESGGQVSKYTKRDQSTSLRHSESGMVDQVLLTTNQDGLRFVKVRMRSVRIPQIGDKFSSRHGQKGTVGMTYTQEDMPWTVEGITPDIIVNPHAIPSRMTIGQLIECIMGKVAAHMGKEGDATPFTDVTVDSISKALHKCGYQMRGFETMYNGHTGRKLSAMIFLGPTYYQRLKHMVDDKIHSRGRGPVQILTRQPAEGRSRDGGLRFGEMERDCMIAHGAAHFLKERLFDQSDAYRIHVCERCGLIAIANLKKNSFDCRGCKNKTDIVQVHIPYACKLLFQELMAMAIAPRMFTKEVIQLKDQKKKGGA

SEQ ID NO: 5658 - protein, 1147 aa, Euphorbia peplus
SFDEFIQNTMQEIVDESSDIEIRPESQHNPGHQSDFVETIFKISFGQIYLSKPMMTESDGETATLFPKAARLRNLTYSAPLYVDVSKKVIKKGHDGEEVTETQDFTKVFIGKVPIMLRSSYCTLFQNSEKDLTELGECPLDQGGYFIINGSEKVLIAQEKMSTNHVYVFKKRQPNKYSYVAEVRSMAESQNRPPSTMFVRMLSRTSAKGGSSGQYIRATLPYIRTEIPIIIVFRALGFVADKDILEHICYDFSRTNMMELLRPSLEEAFVIQNQQVALDYIGKRGATVGVTKEKRIKYAKEILQKEMLPHVGVGEYCETKKAYYFGYIIHRLLLCALGERPEDDRDHYGNKRLDLAGPLLGGLFRMLFRKLTRDVRSYVQKCVDVGKDVNLQFAIKAKTITSGLKYSLATGNWGQANAAGTRAGVSQVLNRLTYASTLSHLRRLNSPIGREGKLAKPRQLHNSQWGMMCPAETPEGQACGLVKNLALMVYITVGSAAYPILEFLEEWGTENFEEISPAVIPQSTKIFVNGCWVGVHRNPDMLVKTLRRLRRRVDVNTEVGVVRDIALKELRIYTDYGRCSRPLFIVENQRLLIKKKDIHALQQRETAEEAGWHDLVAKGFIEYIDTEEEETTMISMTIHDLVQARLNHEDAYSGTYTHCEIHPSLILGVCASIIPFPDHNQSPRNTYQSAMGKQAMGIYVTNYQFRMDTLAYVLYYPQKPLVTTRAMEHLHFRQLPAGINAIVAISCYSGYNQEDSVIMNQSSIDRGFFRSLFFRSYRDEEKKMGTLVKEDFCRPDRNNTMGMRHGSYDKLDDDGLAPPGTRVSGEDVIIGKTTPITQEESQGQSARYTRRDHSISLRHSETGMVDQVLLTTNADGLRFVKVRVRSVRIPQIGDKFSSRHGQKGTVGMTYTQEDMPWTVEGITPDIIVNPHAIPSRMTIGQLIECIMGKVAAHMGKEGDATPFTDVTVDNISKALHKCGYQMRGFETMYNGHTGRRLTAMIFLGPTYYQRLKHMVDDKIHSRGRGPVQILTRQPAEGRSRDGGLRFGEMERDCMIAHGAAHFLKERLFDQSDAYRVHVCERCGLIAIANLKKNSFECRGCKNKTDIVQVHIPYACKLLFQELMSMAIAPRMLTKEEKPSKDQKRKGA

SEQ ID NO: 5659 - protein, 1185 aa, Ceratodon purpureus
MFGGDEEYDEEEEEITQEDAWAVISAYFEEKGLVRQQLDSFDEFIQNTMQEIVDESSDIEIRPESQHNPGRNAEIGDVTYKINFGQIYLSKPMMTEADGETATLWPKAARLRNLTYSAPLYVDVTKFVTRKTEDGEEETEQEDLSKVYIGKVPIMLRSRYCTLFENSDKDLTELGECPYDQGGYFIINGSEKVLIAQEKMSTNHVYVFKKRQPNKYCYVAEVRSMAESQNRPPSGMFVRMLSRAGAKGGSSGQYIRATLPYIRTEIPIIVVFRALGFVADKDILEHICYDFSDTAMMELLRPSLEEAFVIQNQQVALDYIGKRGSTVGVTREKRIKYAKEILQKEMLPHVGVGEFCETKKAYFFGYIIHRLLLCAIGGAEDDRDHYGNKRLDLAGPLLGGLFRMLFRKLTKDVRGYLQKCVDNGKEINLAYAVKAKTITSGLKYSLATGNWGQANTAGVRAGVSQVLNRLTYASTLSHLRRLNSPIGREGKLAKPRQLHNSHWGMMCPAETPEGQACGLVKNLALMAYITVGSAANPILEFLEEWSTENFEEISPAVIPNSTKIFVNGLWVGIHRNPELLVRTLRQLRRQVDVNTEVGVVRDIRLKELRLYTDYGRCSRPLFIVEKQRLLIKKQDVRALQMKETSENGWYDLVSKGFIEYVDTEEEETTMISMTIADLVNARNNPDEAYSDTYTHCEIHPSMILGVCGSIIPFPDHNQSPRNTYQSAMGKQAMGIYVTNYQLRMDTLAYVLYYPQKPLVTTRAMEHLHFRQLPAGINAIVAIACYSGYNQEDSVIMNQSSIDRGFFRSIFYRSYRDEEKKQGTLIKEEFERPNRENTTGMRHGSYDKLDDDGLAPPGTRVSGEDVIIGKTTPLPQDDNASQAQRYTKRDQSTCLRHSESGMIDQVLLTTNADGLRFVKIRVRSIRIPQIGDKFSSRHGQKGTVGMTYTQEDMPWTQEGITPDIIVNPHAIPSRMTIGQLIECIMGKVAAHMGKEGDATPFTDVTVDNISKALHKCGYQMRGFEVMYNGHTGRRLTAHIFLGPTYYQRLKHMVDDKIHSRGRGPVQILTRQPAEGRSRDGGLRFGEMERDCMIAHGAAHFLKERLFDQSDAYRVHVCEHCGLIAIANLKKNTYECRGCKNNTDIVQVHIPYACKLLFQELMSMAIAPRMFTKELKMRSEHAKKAAA

SEQ ID NO: 5660 - protein, 1185 aa, Physcomitrella patens
MYGGDEEYDDEEEEITQEDAWAVISAYFEEKGLVRQQLDSFDEFIQNTMQEIVDESSDIEIRPESQHNPGRQAEIGDVTYKINFGQIYLSKPMMTEADGETATLWPKAARLRNLTYSAPLYVDVTKFVTRKTEDGEEETEQEDLSKVYIGKVPIMLRSRYCTLFENSDKDLTELGECPYDQGGYFIINGSEKVLIAQEKMSTNHVYVFKKRQPNKYCYVAEVRSMAENQNRPPSGMFVRMLSRAGAKGGSSGQYIRATLPYIRTEIPIIVVFRALGFVADKDILEHICYDFSDTAMMELLRPSLEEAFVIQNQQVALDYIGKRGSTVGVTREKRIKYAKEILQKEMLPHVGVGEFCETKKAYFFGYIIHRLLLCAIGGAEDDRDHYGNKRLDLAGPLLGGLFRMLFRKLTKDVRGYLQKCVDNGKEINLAYAVKAKTITSGLKYSLATGNWGQANTAGVRAGVSQVLNRLTYASTLSHLRRLNSPIGREGKLAKPRQLHNSHWGMMCPAETPEGQACGLVKNLALMAYITVGSAANPILEFLEEWSTENFEEISPAVIPNSTKIFVNGLWVGIHRNPELLVRTLRQLRRQVDVNTEVGVVRDIRLKELRLYTDYGRCSRPLFIVEKQRLLIKKQDVRALQMKESSENSWYDLVSKGFIEYVDTEEEETTMISMTIADLVNARNNPEEAYSDTYTHCEIHPSMILGVCGSIIPFPDHNQSPRNTYQSAMGKQAMGIYVTNYQLRMDTLAYVLYYPQKPLVTTRAMEHLHFRQLPAGINAIVAIACYSGYNQEDSVIMNQSSIDRGFFRSIFYRSYRDEEKKQGTLIKEEFERPNRENTTGMRHGSYDKLDDDGLAPPGTRVSGEDVIIGKTTPLPQDDNASQAQRYTKRDQSTCLRHSESGMIDQVLLTTNADGLRFVKIRVRSIRIPQIGDKFSSRHGQKGTVGMTYTQEDMPWTQEGITPDIIVNPHAIPSRMTIGQLIECIMGKVAAHMGKEGDATPFTDVTVDNISKALHKCGYQMRGFEVMYNGHTGRRLTAHIFLGPTYYQRLKHMVDDKIHSRGRGPVQILTRQPAEGRSRDGGLRFGEMERDCMIAHGAAHFLKERLFDQSDAYRVHVCEHCGIIAIANLKKNTYECRGCKNNTDIVQVHIPYACKLLFQELMSMAIAPRMFTKELKMRSEHAKKAAA

SEQ ID NO: 5661 - protein, 1203 aa, Petunia hybrida
MYGESEYVDENIDDRTTMAVDEQEDDYDDESQEITQDDAWAVISAYFEEKGLVRQQLDSFDEFIQNTMQEIVDETADIEIRPESQHNPARQSDFVDTIYKIKFTQIYLSRPMMTESDGETNTLFPKAARLRNLTYSSPLYVDVRKEVIKKGHDYEEVSECQEFTKVFIGKVPIMLRSSYCSLYNLSEKDLTELGECPYDQGGYFIVNGSEKVLIAQEKMSSNHVYVFKKRQPNKYAYVAEVRSIAEGQTKAPSTMFVRMLSRSNAKVGSSGQYIKATLPYIKNEIPIIIVFRALGFVADKDILAHICYDFADTQMMELLRPSLEEAFVIQNQQVALDYIGKRGSTVGFSRERRIKYAKEILQREMLPHVGTREYCETKKAYYFGYIIHRLLLCVLGRRPEDDRDHYGNKRLDLAGPLLGGLFRMLFRKLTRDVRSYVQKCVDSGKDVNLQFAIKAKTITSGLKYSLATGNWGQANAAGTRAGVSQVLNRLTFASTLSHLRRLNSPIGREGKLAKPRQLHNSHWGMMCPAETPEGQACGLVKNLALMVYITVGSAANPILEFLEEWSTENFEEISPAVIPQSTKIFVNGCWVGIHRNPDLLVRTLRQLRRQVDVNTEVGVVRNINLKELRLYTDYGRCSRPLFIVDKKKLIIKKKDILALQLRDSSEDSGWHDLIAKGFIEYVDTEEEETTMIAMTINDLTNSRLNPSEAYSETYTHCEIHPSLILGVCASIIPFPDHNQSPRNTYQSAMGKQAMGIYVTNYQFRMDTLAYVLYYPQKPLVTTRAMEHLHFRQLPAGINAIVAISCYSGYNQEDSVIMNQSSIDRGFFRSLFFRSYRDEEKKMGTLVKEDFGRPDRENTMGMRHGSYDKLDDDGFAPPGTRVSGDDVIIGKTTPISQDDAQGQSARYTRKDHSTSLRHSETGIVDQVLLTTNADGLRFVKIRMRSVRIPQIGDKFSSRHGQKGTIGMTYTQEDMPWTMEGITPDIIVNPHAIPSRMTIGQLVECVMGKVAAHMGKEGDATPFTDVTVDNISKALHKCGYQMRGFERMYNGHTGRILTAMIFLGPTYYQRLKHMVDDKIHSRGRGPVQILTRQPAEGRSRDGGLRFGEMERDCMIAHGAAHFLKERLFDQSDAYRIHVCQQCGLIAIANLKKISFECRSCKNKTDIVQVYIPYACKLLIQELMSMAIAPRMLTKEVKPSNGKKAT

SEQ ID NO: 5662 - protein, 1211 aa, Mimulus guttatus
MYGGGYQYPDPYPDPSNSGAAFVEGEGDDDDGGGEEPEDISQEDAWTVISSYFEEKGLVRQQLDSFDEFIQNTMQEIVDESSNIEIRPESQHNPGRSSDFVETVYRISFGQIYLSKPMMTESDGETNTLYPKAARLRNLTYSSPLYVDVTKRVVKKGYDHEEVIETQEFTKVFIGKVPIMLRSSYCSLYHLSEKDLMEMGECPYDQGGYFIINGSEKVLIAQEKMSTNHVYVFKKRQPNKYAYVAEVRSIAESQNKAPSGMFVRMLSRPGAKGGTSGQYIRATLPYIRTEIPIIIVFRALGFVADKYILEHICYDFNDTKMMELLRPSLEEAFVIQNQQVALDYIGKRGSTVGVTREKRIKYAKEILQREMLPHVGTDEYCETKKAYYFGYVINRLLLCALGRRPEDDRDHYANKRLDLAGPLLAGLFRMLFRKLTRDVRSYVQRGVDSGKEVNLQFAIKAKTITSGLKYSLATGNWGQANAAGTRAGVSQVLNRLTYASTLSHLRRLNSPIGREGKLAKPRQLHNSHWGMMCPAETPEGQACGLVKNLALMVYITVGSAANPILEFLDEWSTENFEEISPAVIPHATKIFVNGNWIGIHRDPELLVRTLRQLRRQVDVNTEVGIIRDIHLRELRLYTDYGRCSRPLFIVEKQELLIKKRDILALQQRESADEYGWHDLVRKGFIEYVDTEEEETTMISMSINDLVNSRRNPDDAYSETYTHCEIHPSLILGVCASIIPFPDHNQSPRNTYQSAMGKQAMGIYVTNYQLRMDTLAYVLYYPQKPLVTTRAMEHLHFRQLPAGINAIVSITCYSGYNQEDSVIMNQSSIDRGFFRSLFFRSYRDEEKKMGTLVKEDFGCPNRDTTLGMRHGCYDKLDDDGFAPPGTRVSGDDVIIGKTKPISQEDAQGKSARFTNKDHSTSLRHSESGIVDQVLLTTNADGLRFVKIRMRSVRIPQIGDKFSSRHGQKGTIGMTYTQEDMPWSIEGITPDIIVNPHAIPSRMTIGQLIECIMGKVAAHMGKEGDATPFTDVTVDSISKALHKCGYQMRGFETMYNGHTGRQLTAMIFLGPTYYQRLKHMVDDKIHSRGRGPVQILTRQPAEGRSRDGGLRFGEMERDCMIAHGAAHFLKERLFDQSDAYRIHACENCGIIAIANLKKLSFECRSCKNKTDIVQIYIPYACKLLIQELMSMAISPRLLTKGLDTSKEQKKKGG

SEQ ID NO: 5663 - protein, 1134 aa, Elaeis guineensis
SFDEFIQNTMQEIVDESANIEIRPESQHNPGRQSDFVETIYKISFGQIYLSRPMMTESDGETATLFPKAARLRNLTYSAPLYVDVTKKVIKKGHDCEEVTETQEFPKVFIGKVPIMLRSSYCTLYQNSEKDLTELGECPYDQGGYFIINGSEKVLIAQEKMSTNHVYVFKKRQPNKYAYVAEVRSMPESQSRPASTMFVRMLSRTSAKGGSSGQYIRATLPYIRADIPIIIVFRALGFVADKDILEHICYDFSDTQMMELLRPSLEEAFVIQNQQVALDYIGKRGATVGVTREKRIKYAKEILQKEMLPHVGVGEFCETKKAYYFGYIIHRLLLCALGRRPEDDRDHYGNKRLDLAGPLLGGLFRMLFRKLTRDVRSYVQKCVDNGKDVNLQFAIKAKTITSGLKYSLATGNWGQANQAGTRAGVSQVLNRLTYASTLSHLRRLNSPIGREGKLAKPRQLHNSHWGMMCPAETPEGQACGLVKNLALMVYITVGSAAHPILEFLEEWGTENFEEISPAVIPQASKIFVNGSWVGIHRNPDLLVRTLRRLRRQIDVNTEVGVVRDIRLKELRLYTDYGRCSRPLFIVENQRLLIKKKDIQALQQRESPEEGWHDLVAKGFIEYIDTEEEETTMIAMTINDLVNARQNPEEAYSETYTHCEIHPSLILGVCASIIPFPDHNQSPRNTYQSAMGKQAMGIYVTNYQLRMDTLAYVLYYPQKPLVTTRAMEHLHFRQLPAGINAIVAIACYSGYNQEDSVIMNQSSIDRGFFRSLFFRSYRDEEKKMGTLVKEDFGRPNRENTMGMRHGSYDKLDDDGLAPPGTRVSGEDVIIGKTSPIPQDDSQGQASRYTRRDHSTSVRHSESGMVDQVLLTTNADGLRFVKVRMRSVRIPQIGDKFSSRHGQKGTVGMTYTQEDMPWTVEGITPDIIVNPHAIPSRMTIGQLIECIMGKVAAHMGKEGDATPFTDVTVDNISKALHKCGYQMRGFETMYNGHTGRKLTAMIFLGPTYYQRLKHMVDDKIHSRGRGPVQILTRQPAEGRSRDGGLRFGEMERDCMIAHGAAHFLKERLFDQSDAYRVHVCERCGLIAIANSRRIPLSAEVARTRLTLFRCIYLTHVSCFFKSSWPWQLLPECSQKK

SEQ ID NO: 5664 - protein, 1205 aa, Solanum lycopersicum
MYGDNEYVDDRDMVQVEDEGGEGRGDVDEDEDEDESREITQDDAWAVISSYFEEKGLVRQQLDSFDEFIQNTMQEIVDETADIEIRPESQHNPSRQPDFVETIYKIKFTQIYLSRPMMTESDGETNTLFPKAARLRNLTYSSPLYVDVKKEVIKKGHDYEEVTENQEFTKVFIGKVPIMLRSSYCSLYNLSEKDLTELGECPYDQGGYFIVNGSEKVLIAQEKMSSNHVYVFKKRQPNKYAYVAEVRSISEGQNKAPSGMFVRMLSRSNSKVGAYGQYIRATLPYIRTEIPIIVVFRALGFVADKDILAHICYDFADTQMMELLRPSLEEAFVIQNQQVALDYIGKRGSTVGFTREKRIKYAKEILQREMLPHVGTREYCETKKAYYFGYIIHRLLLCVLGRRPEDDRDHYANKRLDLAGPLLGGLFRMLFRKLTRDVRSYVQKCVDGGKDVNLQFAIKAKTITSGLKYSLATGNWGQANAAGTRAGVSQVLNRLTFASTLSHLRRLNSPIGREGKLAKPRQLHNSHWGMMCPAETPEGQACGLVKNLALMVYITVGSAANPILEFLEEWSTENFEEISPAVIPQSTKIFVNGCWVGIHRNPDLLVRTLRQLRRQVDVNTEVGVVRNINLKELRLYTDYGRCSRPLFIVDKKRLRIKKNDIIALQMRESSEDSGWHDLVAKGFIEYVDTEEEETTMIAMTINDLTNSRVNPDEAYAETYTHCEIHPSLILGVCASIIPFPDHNQSPRNTYQSAMGKQAMGIYVTNYQFRMDTLAYVLYYPQKPLVTTRAMEHLHFRQLPAGINAIVAITCYSGYNQEDSVIMNQSSIDRGLFRSLFFRSYRDEEKKMGTLVKEDFGRPDREHTMGMRHGNYDKLEDDGFAPPGTRVSGDDVIIGKTTPISQDEAQGQSARYTRKDHSTSLRHSETGIVDQVLLTTNADGLRFVKIRMRSVRIPQIGDKFSSRHGQKGTIGMTYTQEDMPWSAEGITPDIIVNPHAIPSRMTIGQLVECIMGKVAAHIGKEGDATPFTDVTVDSISRTLHNCGYQMRGFERMYNGHTGRVLPAMIFLGPTYYQRLKHMVDDKIHSRGRGPVQILTRQPAEGRSRDGGLRFGEMERDCMIAHGAAHFLKERLFDQSDAYRVHVCQQCGLMAIANLKKMSFECRSCRNKTDNVQVYIPYACKLLIQELMSMAIAPRMLTKELKPSNRK

SEQ ID NO: 5665 - protein, 1198 aa, Antirrhinum majus
MYGGGDPYPDQNVVEVHDHDEEEKEDEDISQEDAWTVISSYFEEKGLVRQQLDSFDEFIQNTMQEIVDESSNIEIRPESQHNPGGNSDFAEAMYRISFGQIYLSKPMMTESDGETNTLFPKAARLRNLTYSSPLYVDVTKRVVKKGFDCEEVTETQEFAKVFIGKVPIMLRSSYCSLYHLPEKDLMDLGECPYDQGGYFIVNGSEKVLIAQEKMSTNHVYVFKKRQPNKYSYVAEVRSIAESQNKAPSGMFVRMLSRSGAKRGTSGQYIYATLPYIRTEVPIIIIFRALGFVADKDILEHICYDFNDSKMMELLRPFLEEAFVIQNQQVALDYIGKRGSTIGVTRDKRIKYAREILQREMLPHVGTEEYCETKKAYYFGYIINRLLLCALGRRPEDDRDHYANKRLDLAGPLLAGLFRMLFRKLTRDVRSYVQKCVDNGKDVNLQFAIKAKTITSGLKYSIATGNWGQANAAGTRAGVSQVLNRLTYASTLSHLRRLNSPIGREGKLAKPRQLHNSHWGMMCPAETPEGQACGLVKNLALMVYITVGSAANPILEFLDEWSTENFEEISPAVIPQATKIFVNGNWIGIHRNPELLVRTLRQLRRQVDVNTEVGIIRDIHLKELRLYTDYGRCSRPLFIVDKQRLVIKKKDILALQQRESADEYGWHDLVRNGSVEYVDTEEEETTMISMTINDLINSRHNPDAAYSETYTHCEIHPSLVLGVCASIIPFPDHNQSPRNTYQSAMGKQAMGIYVTNYQLRMDTLAYVLYYPQKPLVTTRAMEHLHFRQLPAGINAIVAIACYSGYNQEDSVIMNQSSIDRGFFRSLFFRSYRDEEKKMGTLVKEDFGCPNRDNTMGMRHGSYDKLEDDGFAPPGTRVSGDDVIIGKTTPFTPDENQNIRFTRQDHSSSLRHSESGVVDQVLLTTNADGLRFVKVRIRSVRIPQIGDKFSSRHGQKGTIGMTYTQDDMPWSIEGITPDIIVNPHAIPSRMTIGQLIECIMGKVAAHMGKEGDATPFTDVTVDNISKALHKCGYQMRGFETMYNGHTGRPLTSMIFLGPTYYQRLKHMVDDKIHSRGRGPVQILTRQPAEGRSRDGGLRFGEMERDCMIAHGAAHFLKERLFDQSDAYRVHVCERCGLMGIANLKKHSYECRSCKNKTDIVQIYIPYACKLLIQELMSMAIAPRLLTNDVKSVKGQSKTGG

SEQ ID NO: 5666 - protein, 1202 aa, Solanum phureja
MYGDNEYVDDRDMMQVEDEGGEGRGDGDEDEDESQEITQDDAWAVISSYFEEKGLVRQQLDSFDEFIQNTMQEIVDETADIEIRPESQHNPSRQADFVETIYKIKFTQIYLSRPMMTESDGETNTLFPKAARLRNLTYSSPLYVDVKKEVIKKGHDYEEVTENQEFTKVFIGKVPIMLRSSYCSLYNLSEKDLTELGECPYDQGGYFIVNGSEKVLIAQEKMSNNHVYVFKKRQPNKYAYVAEVRSISEGQNKAPSGMFVRMLSRSNSKGAYGQYIRATLPYIRAEIPIIVVFRALGFVADKDILAHICYDFADTQMMELLRPSLEEAFVIQNQQVALDYIGKRGSTVGFTREKRIKYAKEILQREMLPHVGTREYCETKKAFYFGYIIHRLLLCVLGRRPEDDRDHYGNKRLDLAGPLLGGLFRMLFRKLTRDVRSYVQKCVDGGKDVNLQFAIKAKTITSGLKYSLATGNWGQANAAGTRAGVSQVLNRLTFASTLSHLRRLNSPIGREGKLAKPRQLHNSHWGMMCPAETPEGQACGLVKNLALMVYITVGSAANPILEFLEEWSTENFEEISPAVIPQSTKIFVNGCWVGIHRNPDLLVRTLRQLRRQVDVNTEVGVVRNINLKELRLYTDYGRCSRPLFIVDKKRLRIKKKDIVALQMRESTEDSGWHDLVAKGYIEYVDTEEEETTMIAMTINDLTNSRLNPDEAYAETYTHCEIHPSLILGVCASIIPFPDHNQSPRNTYQSAMGKQAMGIYVTNYQFRMDTLAYVLYYPQKPLVTTRAMEHLHFRQLPAGINAIVAITCYSGYNQEDSIIMNQSSIDRGFFRSLFFRSYRDEEKKMGTLVKEDFGRPDREHTMGMRHGNYDKLEDDGFAPPGTRVSGDDVIIGKTTPISQDEAQGQSARYTRKDHSTSLRHSETGIVDQVLLTTNADGLRFVKIRMRSVRIPQIGDKFSSRHGQKGTIGMTYTQEDMPWSAEGITPDIIVNPHAIPSRMTIGQLVECIMGKVASHIGREGDATPFTDVTVDSISKTLLQCGYQMRGFERMYNGHTGRILSAMIFLGPTYYQRLKHMVDDKIHSRGRGPVQILTRQPAEGRSRDGGLRFGEMERDCMIAHGAAHFLKERLFDQSDAYRIHVCQQCGLMAIANLKKMSFECRSCRNKTDNVQVYIPYACKLLIQELMSMAIAPRMLTKELKPSNGK

SEQ ID NO: 5667 - protein, 364 aa, Tripterygium wilfordii
MGTLVKEDFGRPDRANTMGMRHGSYDKLDDDGLAPPGTRVSGEDVIIGKTTPISQEDAQGQGSRYTRRDHSISLRHSETGMVDQVLLTTNADGLRFVKVRVRSVRIPQIGDKFSSRHGQKGTVGMTYTQEDMPWTVEGITPDIIVNPHAIPSRMTIGQLIECIMGKVAAHMGKEGDATPFTDVTVDNISKALHKCGYQMRGFETMYNGHTGRRLTAMIFLGPTYYQRLKHMVDDKIHSRGRGPVQILTRQPAEGRSRDGGLRFGEMERDCMIAHGAAHFLKERLFDQSDAYRVHVCERCGLIAIANLKKNSFECRGCKNKTDIVQVHIPYACKLLFQELMAMAIAPRMLTKDEKPPKAPKKKGA

SEQ ID NO: 5668 - protein, 1195 aa, Brassica rapa
MDYKQNQTYIDADDKEITQEDDDEEITQEDAWTVISAYFEEKGLVRQQLDSFDEFIQNTMQEIVDESSDVEIRAESQHNPGHQPDFAERNYNISFGQIYLSKPTITESDGETATLFPKAARLRNLTYSAPLYVDVCKTVIMKGHDGEEITETQDFTKVFIGKVPIMLRSTYCTLHQNSEKDLTELGECPFDQGGYFIINGSEKVLIAQEKMSSNHVYVFKKRQPNKYLYVAEVRSMAEDQNKPPSTMFVRMLSGSKGGSSGQFIRCTLPYIKKEIPIIIVFRALGFVADKDILERICYEFGDTQMMELLRPSLEEAFVIQSQQVALDYIGKRGAPVGTSKEKRIKYARDILQKEMFPHIGVGEFETPKAYYFGLIIHRLLRCALGRNPEDDRDHYGNRRLDLAGPLLGGLFRMLFRKLTRDVRSYVQKCVDNGKEVNLHFAIKAKTITSGLKYALATGNWGQANAAGTRAGVSQVLNRLTYASPLSHLRRPNSPIGREGKLAKPRQLHNSQWGMMCPAETPEGQACGLVKNLALMVYVTVGSAASPILAILSDFWKNGDLRLSRSEISPADIPQATKIFVNGKWVGIHRIPDMLVRTLRLLRRRNDINTEVSVVRDIRLKELRIYTDYGRCSRPLFIVDNQRLLIKKKDIYSLQQRESAEEDGWHHLLVKGFIEYVDTEEEETTMISMTINDLVQARLRPDEAYSDTYTHCEIHPSLILGVCASIIPFPDHNQSPRNTYQSAMGKQAMGIYVTNYQFRMDTLAYVLYYPQKPLVTTRAMEHLHFRQLPAGINAIVAISCYSGYNQEDSVIMNQSSIDRGFFRSLFFRSYRDEERKMGTLIKENFGRPDRGNTLGMRHGSYEKLDDDGLAPPGTRVSGEDVIIGKTTPISQDEAQGQTSRYTRRDHSLSLRHSESGMVDQVLLTTNADGLKFVKVRVRSVRIPQIGDKFSSRHGQKGTVGMTYTQDDMPWTIEGVTPDIIVNPHAIPSRMTIGQLIECIMGKVAAQMGKEGDATPFTDVTVDNISKALHECGYQMRGFERMYNGHTGRPLPAMIFIGPTYYQRLKHMVDDKIHSRGRGPVQILTRQPAEGRSRDGGLRFGEMERDCMIAHGAASFLKERLFDQSDAYRVHVCETCGLIAIANLKNNTFECKGCKNTTDIVQVHIPYACKLLFQELMSMAIAPRMLTKDLKSAKGRK

SEQ ID NO: 5669 - protein, 1031 aa, Liriodendron tulipifera
MLRSSYCTLYQNSEKDLTELGECPYDQGGYFIINGSEKVLIAQEKMSTNHVYVFKKRQPNKYAYVAEVRSMAESQNRPPSSMFVRMLSRASAKGGSSGQYIRATLPYIRTEIPIIIVFRALGFVADKDILEHICYDFSDTQMMELLRPSLEEAFVIQNQQVALDYIGKRGQTVGVTKEKRIKYAKEILQKEMLPHVGVGEYCETKKAYYFGYIIHRLLLCALGRRPEDDRDHYGNKRLDLAGPLLGGLFRMLFRKLTRDVRGYVQKCVDNGKDVNLQFAIKAKTITSGLKYSLATGNWGQANAAGTRAGVSQVLNRLTFASTLSHLRRLNSPIGREGKLAKPRQLHNSHWGMMCPAETPEGQACGLVKNLALMVYITVGSAANPILEFLEEWSTENFEEISPAVIPQATKIFVNGCWVGIHRNPELLVKTLRQLRRQVDVNTEVGVIRDIRLKELRLYTDYGRCSRPLFIVEKQRLLIKKKHIRSLQQRETQDEGWHDLVAKGFIEYVDTEEEETTMISMTISDLVSARLNPDEAYSETYTHCEIHPSLILGVCASIIPFPDHNQSPRNTYQSAMGKQAMGIYVTNYQLRMDTLAYVLYYPQKPLVTTRAMEHLHFRQLPAGINAIVAIACYSGYNQEDSVIMNQSSIDRGFFRSLFFRSYRDEEKKMGTLIKEDFGRPNRENTMGMRHGSYDKLDDDGLAPPGTRVSGEDVIIGKTTPIAQDESQGQASRYTRRDHSTSLRHSESGMVDQVLLTTNADGLRFVKVRMRSVRIPQIGDKFSSRHGQKGTVGMTYTQEDMPWTVEGITPDIIVNPHAIPSRMTIGQLIECIMGKVAVHMGKEGDATPFTDVTVDNISKALHKCGYQMRGFETMYNGHTGRRLTAMIFLGPTYYQRLKHMVDDKIHSRGRGPVQILTRQPAEGRSRDGGLRFGEMERDCMIAHGAAHFLKERLFDQSDAYRVHVCERCGLIAIANLKKNSFECRGCKNKTDIVQVHIPYACKLLFQELMAMAIAPRMLTKEVKPLKDHKKKGA

SEQ ID NO: 5670 - protein, 684 aa, Vinca minor
MMCPAETPEGQACGLVKNLALMVYITVGSAAYPILEFLEEWGTENFEEISPAVIPGATKIFVNGCWVGIHRDPDMLVTTLRRLRRRVDVNTEVGVVRDIRLKELRIYTDYGRCSRPLFIVEKQRLLIKKRDIQALQARESPEDGGWHDLISKGYIEYIDTEEEETTMISMTISDLVTARLNPEEAYTDTYTHCEIHPSLILGVCASIIPFPDHNQSPRNTYQSAMGKQAMGIYVTNYQFRMDTLAYVLYYPQKPLVTTRAMEHLHFRQLPAGINAIVAISCYSGYNQEDSVIMNQSSIDRGFFRSLFFRSYRDEEKKMGTLVKEDFGRPDRSNTMGMRHGSYDKLDDDGLAPPGTRCSGEDVIIGKTTPISPDDTSVPAASAARYTKRDHSTSLRHSENGMVDQVLLTTNADGLRFVKVRIRSVRIPQIGDKFSSRHGQKGTVGMTYTQEDMPFTQEGISPDIIVNPHAIPSRMTIGQLIECIMGKVAAHMGKEGDATPFTDVTVDNISKALHKCGYQMRGFERMYNGHTGRPLTATIFLGPTYYQRLKHMVDDKIHSRGRGPVQILTRQPAEGRSRDGGLRFGEMERDCMIAHGAAHFLKERLFDQSDAYRIHVCERCGLIAIANLKKNSFECRGCKNKTDIVQVHIPYACKLLFQELMSMAIAPRMLTKDIKQVKDQQKKGR

SEQ ID NO: 5671 - protein, 1028 aa, Unknown
  Sequence found in Organisms: Secale cereale, Triticum aestivum
MLRSSYCTLFQQSEKDLTELGECPYDQGGYFVINGSEKVLIAQEKMSTNHVYVFKKRQPNKFAYVGEVRSMAENQNRPASSMFVRMLSRAGAKGGSSGQYIRATLPYIRADIPIIIVFRALGFVADKDILEHICYDFSDTQMMELLRPSLEEAFVIQNQQVALDYIGKRGATVGVTREKRIKYAKEILQKEMLPHVGVGEFCETKKAYYFGYIIHRLLMCALGRRAEDDRDHYGNKRLDLAGPLLGGLFRMLFRKLTRDVRSYVQKCVDNGKEVNLQFAIKAKTITSGLKYSLATGNWGQANQAGTRAGVSQVLNRLTYASTLSHLRRLNSPIGREGKLAKPRQLHNSHWGMMCPAETPEGQACGLVKNLALMVYITVGSAANPILEFLEEWGTENFEEISPAVIPQAAKIFVNGCWVGIHRNPDLLVKTLRRLRRQIDVNTEVGVVRDIRLKELRLYTDYGRCSRPLFIVENQRLLIKKKHIRALQQRETPDEGWHDLVAKGFIEYIDTEEEETTMISMTIRDLETSRHNPGEAYSETYTHCEIHPSLILGVCASIIPFPDHNQSPRNTYQSAMGKQAMGIYVTNYQLRMDTLAYVLYYPQKPLVTTRAMEHLHFRQLPAGINAIVAIACYSGYNQEDSVIMNQSSIDRGFFRSLFFRSYRDEEKKMGTLVKEEFGRPNRENTMGMRHGSYDKLDDDGLAPPGTRVSGEDVIIGKTSPIPQDDAQGQATRYSKRDHSTSLRHSESGMVDQVLLTTNADGLRFVKVRMRSVRIPQIGDKFSSRHGQKGTVGMTYTQEDMPWTIEGITPDIIVNPHAIPSRMTIGQLIECIMGKVAAHMGKEGDATPFTDVTVDNISKALHKCGYQMRGFETMYNGHTGRKLTAMIFLGPTYYQRLKHMVDDKIHSRGRGPVQILTRQPAEGRSRDGGLRFGEMERDCMIAHGAAFFLKERLFDQSDAYRVHVCEKCGLIAIANLKKNSFECRGCKNKTDIVQVHIPYACKLLFQELMAMAIAPRMLTHEVKGARDKHR

SEQ ID NO: 5672 - protein, 735 aa, Panicum virgatum
MARTNWEADKMLDVYIYDYLVKRNLQATAKAFIAEGKVATDPVAIDAPGGFLFEWWSIFWDIFHSSTAKASSSAGAPPPPHLDINKSREHQMRLQLLHQHNAQLHTRGAAPPPPASINALNSDVSAVLASKMMEDRIRNPNPGDSDASQHLLDANRIALLKSPPNHTGPPPMQQQIHPRNQQHDIKPDAAMPPRTVPADPSSLYASGLMHPKPPLLAAGLNQGGVGSVPLKGWPLTVPGIDQLRSNLGVQKQLVPSSNQFQLLSPQQQLIAQAQTPNDLTRMGSPAPSVQPNVRSDDPDYLMKLKMAQMQQSSGHRSMELQQPHQQSTRKRKPTSSGAANSTGTGNTVGPSPPSTPSTHTPGGGVPVVSNANILQKSSMICGADGTSGLASSSNQMDTLDSFVDFDENVDSFLSNDDGDGRDMFAGLKKGSSEHNSESLKGLSLSEVGNNRTSNNKVVCCHFSTDGKLLASAGHEKKVFLWNMDNFKMDTKIEDHTNFITDIRFKTNSTQLATSSSDGTVRLWNAADESGALQTFNGHSSHVTSLDFHPRLTEVLCSCDDNGEIRFWTVGQTTSSHVFRVKQGGTGRVRFQPRSGQLLAVAGGSMVNIFDVEKQANLPFPPKGHNSEVNCVCWDENGEYLASVSQDTLKVWSVSSGACIHELRSHGNQYQSCIFHPRYPKVLIVGGYQTLELWSLSDNQRNPIQAHEGLIAALAHSPFTGMIASASHDRYVKLWK

SEQ ID NO: 5673 - protein, 735 aa, Panicum virgatum
MARTNWEADKMLDVYIYDYLVKRNLQATAKAFIAEGKVATDPVAIDAPGGFLFEWWSIFWDIFHSSTAKASSSAAGAPPPPHLDINKSREHQMRLQLLHQHNAQLHTRGAAPPPASINALNSDVSAVLASKMMEDRIRNPNPGDSDASQHLLDANRIALLKSPPNHNGPPPMQQQIHPRNQQHDIKPDVAMPPRTVPADPSSLFASGLMHPKLPLLAAGLNQGGVGSVPLKGWPLTVPGIDQLRSNLGVQKQLVPSSNQFQLLSPQQQLIAQAQTPNDLTRLGSLAPSVQPNVRSDDPDYLMKLKMVQMQQSSGHRSMELQQPHQQNTRKRKPTSSGAANSTGTGNTVGPSPPSTPSTHTPGGGVPVVSNSNILQKSSMICGADGTSGLASSSNQMDTLDSFVDFDENVDSFLSNDDGDGRDMFAGLKKGSSEHNSESLKGLSLSEVGNNRTSNNKVVCCHFSTDGKLLASAGHEKKVFLWNMDNFKMDTKIEDHTNFITDIRFKTNSTQLATSSSDGTVRLWNAADESGALQTFNGHSSHVTSLDFHPRLTEVLCSCDDNGEIRFWTVGQTTSSHVFRVKQGGTGRVRFQPRSGQLLAVAGGSMVNIFDVEKQANLPFPPKGHNSEVNCVCWDENGEYLASVSQDTVKVWSVSSGACIHELRSHGNQYQSCIFHPRYPKVLIVGGYQTLELWSLSDNQRSPIQAHEGLIAALAHSPFTGMIASASHDRYVKLWK

SEQ ID NO: 5674 - protein, 754 aa, Zea mays
MARTNWVADKMLDVYIYDYLVKRNLQATAKAFIAEGKVATDPVAIDAPGGFLFEWWSIFWDIFHSSTAKASSTSTAAAFIDHTAKQQQPIGAGTGAPPPHPLHDSREHQMRLQQLLHQHNPHLHTTRDASPPASINALNSDVSAVLASKMMQDRVRNPNPIDSDASQHLLDANRIALLKSPPPSHTGPMPMQQQLHPRNQQLDIKPDVGMPQRTMPADPSSMYASGMMHPKPALLATGLNQGGVGSVPLKGWPLTVPGIDQLRSNLGVQKQLVPSSNQFQLLSPQQQLLAQAQTQNDLTRMGSPAPSASPNVRPDDPDYLMKLKMAQMQQSSGHRPMELQQPHQQNTRKRKPTSSGAANSSGTGNTVGPSPPSTPSTHTPGGGVPVASNVNILQKSSMICGVDATGGLASSSNQMDALDSFVDFDENVDSFLSNDDVDGRGMFAALEKGSSEHNTESLKGLSLSEVGNNRTSNNKVVCCHFSSDGKLLASAGHEKKVFLWNMDNFKMDTKIEDHTNFITDIRFRTNSTQLATSSSDGTVRLWNAADESGALQTFHGHRSHVTSVDFHPRLTEVLCSCDDNGEILFWTVGQTTSTHVLRVKQGGTGRVRFEPRSGQLLAVAAGSMVNIFDVEKQSSLPCPPKGHNSEVNFVSWDENGEYLASVSQDTVKVWSVSSGVCIHELRSNGNQYQSCTFHPRYPKVLIVGGYQTLELWSLSDNQRIPIQAHEGLIAALAHSPFTGMIASASHDRCVKLWK

SEQ ID NO: 5675 - protein, 621 aa, Pennisetum glaucum
QLQARGPDVSAVLASKMMEDRIRNPNPADSDASQHLLDANRAAALRKSPPNQTGPLPMQQQMHPRNQQLDIKPDVAMPQRTVPADHSSLYTSGMMHPKPPLLAAGLNQAGGSVPLKGWPLTVTGTIDQLRSNLGAQKQLVPSSNQFQLLSPQQQLIAQAQTPNDLTRMSSPAPAASPNVRSDDPDYLIKLKMVQMQQPSGYRPMELQQPQQQNTRKRKPTSSGAANSTGTGNTVGPSPPSTPSTHTPGGGVPVTSNSNILQKSSMICGADGTSGLASSSNQMDNLDSFVDFDENVDSFLSNDDGDGRDMFAALRKGSSEHNSESLKGLSLSEVGNNRTSNNKVVCCHFSTDGKLLASAGHEKKVFLWNMDNFKMDTKIEDHTNFITDIRFKTNSTQLATSSSDGTVRLWNAADESSTLQTFHGHTSHVTSLDFHPRLTEVLCSCDDNGEIRFWTVGQTTSTHVFRAKQGGTGRVRFQPRSGQLLAVAGGSMVNIFDVEKQANLPSPAKGHNSEVNCVCWDESGEYLASVSQDTVKVWSVSSGACIHELRSHGNQYQSCVFHPRHPKVLIVGGYQTLELWSLSDSQRNPIQAHEGLVAALAHSPFTGMIASASHDRYVKLWK

SEQ ID NO: 5676 - protein, 571 aa, Panicum virgatum
MLLSRRPLAAALHLAPLSPPLLLFFASASSSCSPAAASASGGSRGCSAVRMDSGAVETASTWAVWSTPSAEPRSISIGKEIFCNRSLNMRNITAVGFDMDYTLAQYKPETFESLAYYGTIEKLVKDLNYPEELLTWEFDWKYMVRGLVLDKKRGNILKMDRHKYVKVAYHGFRELSKEEKVAAYGSTLIRDSFDEPDYALIDTLFSLGEAYLFAQLVDFMDSNPGKVPAGTDYPLMYKDVRSAVDLCHRDGTLKRMVAKDPGRYINEDLAIVPMLEMIKKSGRSTFLVTNSLWDYTNVVMNYLCGPYTSDAGSGLNHKWLQYFDIVITGSSKPSFFHDDNRAGLFEVEPDSGKLLNADIQASKFIGSPRSSRQHAMPVHKVYQGGNVGHLHRLLSIASSSQILYVGDHIYGDILRSKKVLGWRTMLVIPELEHEVKLLSESKSTRKELRHLRMERDSIEDRIHHLEWSLKFDDLTENQKEKLFSEHVNLLQQREHARRLHQEAQRQHHQKFHKVWGQLMKTGYQNSRFAHQVERFACLYSSQVTNFGLYSPNKYYRPSEDYMPHEFDVLEL

SEQ ID NO: 5677 - protein, 565 aa, Panicum virgatum
MLFSRRPLAAALHLSRLSPPLLLLFASASSSCSPAAAASASGPRGCSAVRMDSGAVESTGAVWSTPSAEPRNISIGKEIFCNRSLNMRNITAVGFDMDYTLAQYKPETFEALAYYGTIEKLVKDLHYPEELLTWEFDWKYMVRGLVLDKKRGNILKMDRHKYVKVAYHGFRELSKEEKVAAYGSTLIRDSFDEPDYALIDTLFSLGEAYLFAQLVDFMDSNPGKVPAGTDYPLMYKDVRSAVDLCHRDGTLKRMVAKDPGRYINEDLAIVPMLEMIKKSGRSTFLVTNSLWDYTDVVMNYLCGPYTSDAGSGLNHKWLQYFDIVITGSSKPSFFHDDNRAGLFEVEPDSGKLLNADIQIGSPRSSHQHATPVHKVYQGGNVGHLHRLLSIASSSQILYVGDHIYGDILRSKKVLGWRTMLVIPELEHEVKLLSETKSTRKELRHLRMERDSIEDRIHHLEWSLKFDDLTENQKEKLFSEHVNLLQQREHARCLHQEAQRQHHQKFHKVWGQLMKTGYQNSRFAHQVERFACLYSSQVTNLGLYSPNKYYRPSEDYMPHEFDVLEL

SEQ ID NO: 5678 - protein, 570 aa, Zea mays
MLFSRRPLAAAFHLAPLSPPLLLFFASASSSCSPAASAAAASVSGSRGCTAARMDSGAVETASTGAVWSSPSAEPRSISVGKEVFCNRSLNMRNITAVGFDMDYTLAQYKPETFESLAYYGTIEKLVKDLRYPEELLTWEFDWKYMVRGLVLDKKRGNILKMDRHKYVKVAYHGFKELSKEEKVAAYGSTLIRDSFDEPDYALIDTLFSLGEAYLFAQLVDFIDKNPGKVPAGTDYPLMYRDVRSAVDLCHRDGTLKRMVAKDPARYINEDLAIVPMLEMIRKSGRSTFLVTNSLWDYTDVVMNYLCGPYTSGVGSGLNHKWLQYFDIVITGSSKPSFFHDDNRAGLFEVEPDSGKLLNADIQIGSPRSSHQHSTPVQKVYQGGNVGHLHRLLSVASSSQILYVGDHIYGDILRSKKVLGWRTMLVIPELEQELKLLSESKSTRKELRHLRMERDSIEDKIHHLEWSLKLDDISENQKEKLFSEHDNLLKQRGHVRGLHQEAQRQHHQKFHKVWGQLMKTGYQNSRFAHQVERFACLYSSQVTNFGLYSPDKYYRPSEDYMPHEFDVLGL

SEQ ID NO: 5679 - protein, 531 aa, Pennisetum glaucum
AAASASGGTRGGCSAVRMDSGAVESTGAVWSTPSAEPKSVSIGKAIFCNRSLNMRNITAVGFDMDYTLAQYKPETFEALAYYGTIEKLVKDLRYPEELLTWEFDWKYMVRGLVLDKKRGNILKMDRHKYVKVAYHGFRELSKEEKVAAYGSTLIRDSFDEPDYALIDTLFSLGEAYLFAQLVDFMDNNPGKVPAGTDYPLMYKDVRSAVDLCHRDGTLKRMVAKDPGRYINEDLAIVPMLEMLKKSGRSTFLVTNSLWDYTDVVMNYLCGPYTSDAGSGLNRKWLQYFDIVITGSSKPSFFHDDNRAGLFEVEPDSGKLLNADIQIGSPRSSLQHAAPVHKVYQGGNVGHLHRLLSVASSSQILYVGDHIYGDILRSKKVLGWRTMLVIPELEHEVKLLSESKLTRKELRHLRMERDSIEDRIHHLEWSLKFDDITENQKEKFSEHADLLQQREHVRRLHQEAQRQHHQKFHKVWGQLMKTGYQNSRFAHQVERFACLYSSQVTNFGLYSPNKYYRPSEDYMPHEFDVLGL

SEQ ID NO: 5680 - protein, 569 aa, Oryza sativa
MLFARRPLATAASHLAPFSPPLLLFFASASSSCSSAASPSSASGPRGCSAVRMETGAVEPASTGAIWSTPSVEPRTISVGKEIFCNRSLNMRNITAVGFDMDYTLAQYKPETFEALAYHGTIEKLVKDLGYPEELLTWQFDWKYMVRGLVLDKKRGNILKMDRHKYVKVAYHGFREMSKEEKVSAYGSTLIRDSFDEPDYALIDTLFSLGEAYLFAQLVDFMDNNPGKVPSGTDYPLMYRDVRSAVDLCHRDGTLKRMVAKDPSRYINEDLAIVPMLEMIRKSGRSTFLVTNSLWDYTDVVMNYLCRPYTSDVSSSHNHKWLGYFDVVITGSAKPGFFHDGNRAGLFEVEPDSGKLLNADLHIGSPRSGQQPSRPIHKIYQGGNVGHLHRLLSVASSSQILYVGDHIYGDILRSKKVLGWRTMLVIPELEQEVKLLSESKSTRKELRHLRMERDSIEDKIHRLEWSLKFENLTEDEKEKLFSEHDILLQKKEHVRRLHQEAQRQHHHKFHKVWGQLMKTGYQNSRFAHQVERFACLYSSQVTNFALYSPNKYYRPSEDYMPHEFDVLGL

SEQ ID NO: 5681 - protein, 563 aa, Hordeum vulgare
MLSRRPLAAALRLAPLSPPLLLFFASSSSSSPAASASGPRGCSALRMDSGAAEPASTGAIWSTPSVEPRSISIGKQIFCNRSLNMRNITAVGFDMDYTLAQYKPETFEALAYHGTIEKLVKDLNYPVELLTWQFDWKYMVRGLVLDKKRGNILKMDRHKYVKVAYHGFREMSKEEKVAAYGSTLIRDSFDEPDYALIDTLFSLGEAYLFAQLVDFMDSNPAKVPSGTDYALMYKDVRSAVDLCHRDGTLKRMVAKEPSRYINEDLAIVPMLEMLRKSGRSTFLVTNSLWDYTDVVMNYLCGPYMSDVSSSHNRKWLEYFDVVITGSSKPSFFHDDNRAGLFEVEPDSGKLLNADLQIGSPRSSQHQPKPIHKVYQGGNVGHLHRLLSVASSSQILYVGDHIYGDILRSKKVLGWRTMLVIPELEQEVKLLSESKSTRKELRHLRMERDSVEDTIHRLEWSLQFEDLTENEKGKLLSEHDNLLQKLKGIRCLLRDAQMQHHQKFHKVWGQLMKTGYQNSRFAHQVERFACLYCSQVTDFGLYSPNKYYRPSEDYMPHEFDVLGL

SEQ ID NO: 5682 - protein, 479 aa, Secale cereale
MRNITAVGFDMDYTLAQYKPETFEALAYHGTIEKLVKDLNYPEELLTWQFDWKYMVRGLVLDKKRGNILKMDRHKYVKVAYHGFREMSKEEKVAAYGSTLIRDSFDEPDYALIDTLFSLGEAYLFAQLVDFMDSNPAKVPSGTDYALMYRDVRSAVDLCHRDGTLKRMVAKEPSRYINEDLAIVPMLQMLRKSGRSTFLVTNSLWDYTDVVMNYLCGPYMSDVSSSHNHKWLEYFDVVITGSSKPSFFHDDNRTGLFEVEPDSGKLLNADLQIGSPRSSQHQPKPIHKVYQGGNVGHLHRLLSVASSSQILYVGDHIYGDILRSKKVLGWRTMLVIPELEHEVKLQSESKSTRKELRHLRMERDSVEDTIHRLEWSLQFEDLTENEKGKLLSEHDNLLQKLKGIRCLLRDAQMQHHQKFHKVWGQLMKTGYQNSRFAHQVERFACLYCSQVTDFGLYSPNKYYRPSEDYMPHEFDVLGL

SEQ ID NO: 5683 - protein, 574 aa, Brachypodium distachyon
MLCRRPLAAAAALHLAPLSPPLLLFFASSSSSASCSPAAAAAAATPASGHRGCSAVRMDTGAVEPASTGTIWSTPSVEPRSISIGKQIFCNRSLNMRNITAVGFDMDYTLAQYKPETFESLAYHGTIEKLVKDLNYPQELLTWQFDWKYMVRGLVLDKKRGNILKMDRHKYVKVAYHGFREMSKEEKVAAYGNTLIRDSFDEPDYALIDTLFSLGEAYLFAQLVDFMDNNPGKVPSGIDYALMYKDVRSAVDLCHRDGTLKRMVAMEPGRYINEDLAIVPMLEMLRKSGRSTFLVTNSLWDYTDVVMNYLCGPYISDVSSNHNRKWLEYFDVVITGSSKPSFFHDDNRTGLFEVEPDSGKLLNADLQIGSPRSSQHQSKPIHKVYQGGNVGHLHRLLSVASSSQILYVGDHIYGDILRSKKVLGWRTMLVIPELEQEVKLLSESKSTRKELRHLRMERDSIEDTIHRLEWSLQFEDLTENRKEKLFSEHDILLQKLKGIRCVLRDAQLQHHQKFHKVWGQLMKTGYQNSRFAHQVERFACLYCSQVTNFGLYSPNKYYRPSEDYMPHEFDVLGL

SEQ ID NO: 5684 - protein, 571 aa, Triticum aestivum
MLSRRPLAAALRLAPLSPPLLLFFASSSSSSSSPASCSSPAASASGPRGCSALRMDTGAVEPASTGAIWSTPSVEPRSISIGKQIFCNRSLNMRNITAVGFDMDYTLAQYKPETFEALAYHGTIEKLVKDLNYPEELLTWQFDWKYMVRGLVLDKKRGNILKMDRHKYVKVAYHGFREMSKEEKVAAYGSTLIRDSFDEPDYALIDTLFSLGEAYLFAQLVDFMDNNPAKVPSGTDYAHMYRDVRSAVDLCHRDGTLKRMVAKEPSRYINEDLAIVPMLQMLRKSGRSTFLVTNSLWDYTDVVMNYLCGPYMSDVSSSHNHKWLEYFDVVITGSSKPSFFHDDNRTGLFEVEPDSGKLLNADLQIGSPRSSQHQPKPIHKVYQGGNVGHLHRLLSVASSSQILYVGDHIYGDILRSKKVLGWRTMLVIPELEQEVKLQSESKSTRKELRHLRMERDSVEDTIHRLEWSLQFEDLTENEKGKLLSEHDNLLQKLKGIRCLLRDAQMQHHQKFHKVWGQLMKTGYQNSRFAHQVERFACLYCSQVTDFGLYSPNKYYRPSEDYMPHEFDVLGL

SEQ ID NO: 5685 - protein, 569 aa, Triticum aestivum
MLSRRPLAAALRLAPLSPPLLLFFASSSSSSPASCSSPAASASGPRGCSALRMDSGAVEPASTGAIWSTPSVEPRSISIGKQIFCNRSLNMRNITAVGFDMDYTLAQYKPETFEALAYHGTIEKLVKDLNYPEELLTWQFDWKYMVRGLVLDKKRGNILKMDRHKYVKVAYHGFREMSKEEKVAAYGSTLIRDSFDEPDYALIDTLFSLGEAYLFAQLVDFMDSNPAKVPSGTDYALMYRDVRSAVDLCHRDGTLKRMVAKEPSRYINEDLAIVPMLQMLRKSGRSTFLVTNSLWDYTDVVMNYLCGPHMSDVSSSHNQKWLEYFDVVITGSSKPSFFHDDNRTGLFEVEPDSGKLLNADLQIGSPSSSQHQPKPIHKVYQGGNVGHLHRLLSVASSSQILYVGDHIYGDILRSKKVLGWRTMLVIPELEQEVKLQSESKSTRKELRHLRMERDSVEDTIHRLEWSLQFEDLTENEKGKLLSEHDNLLQKLKGIRCLLRDAQMQHHQKFHKVWGQLMKTGYQNSRFAHQVERFACLYCSQVTDFGLYSPNKYYRPSEDYMPHEFDVLGL

SEQ ID NO: 5686 - protein, 571 aa, Triticum aestivum
MLSRRPLAAALRLAPLSPPLLLFFASSSSSSSSPASCSSPTASASAPRGCSALRMDSGAVEPASTGAIWSTPSVEPRSISIGKQIFCNRSLNMRNITAVGFDMDYTLAQYKPETFEALAYHGTIEKLVKDLNYPEELLTWQFDWKYMVRGLVLDKKRGNILKMDRHKYVKVAYHGFREMSKEEKVAAYGSTLIRDSFDEPDYALIDTLFSLGEAYLFAQLVDFMDSNPAKVPSGTDYAHMYRDVRSAVDLCHRDGTLKRMVAKEPSRYINEDLAIVPMLQMLRKSGRSTFLVTNSLWDYTDVVMNYLCGPYMSDVSSSHNHKWLEYFDVVITGSSKPSFFHDDNRTGLFEVEPDSGKLLNADLQIGSPRSSQHQPKPIHKVYQGGNVGHLHRLLSVASSSQILYVGDHIYGDILRSKKVLGWRTMLVIPELEQEVKLQSESKSTRKELRHLRMERDSVEDTIHRLEWSLQFEDLTENEKGKLLSEHDNLLQKLKGIRCLLRDAQMQHHQKFHKVWGQLMKTGYQNSRFAHQVERFACLYCSQVTDFGLYSPNKYYRPSEDYMPHEFDVLGL

SEQ ID NO: 5687 - protein, 531 aa, Triticum aestivum
AASASGPRGCSALRMDTGAVEPASTGAIWSTPSVEPRSISIGKQIFCNRSLNMRNITAVGFDMDYTLAQYKPETFEALAYHGTIEKLVKDLNYPEELLTWQFDWKYMVRGLVLDKKRGNILKMDRHKYVKVAYHGFREMSKEEKVAAYGSTLIRDSFDEPDYALIDTLFSLGEAYLFAQLVDFMDNNPAKVPSGTDYAHMYRDVRSAVDLCHRDGTLKRMVAKEPSRYINEDLAIVPMLQMLRKSGRSTFLVTNSLWDYTDVVMNYLCGPYMSDVSSSHNHKWLEYFDVVITGSSKPSFFHDDNRTGLFEVEPDSGKLLNADLQIGSPRSSQHQPKPIHKVYQGGNVGHLHRLLSVASSSQILYVGDHIYGDILRSKKVLGWRTMLVIPELEQEVKLQSESKSTRKELRHLRMERDSVEDTIHRLEWSLQFEDLTENEKGKLLSEHDNLLQKLKGIRCLLRDAQMQHHQKFHKVWGQLMKTGYQNSRFAHQVERFACLYCSQVTDFGLYSPNKYYRPSEDYMPHEFDVLGL

SEQ ID NO: 5688 - protein, 301 aa, Sorghum bicolor
MSSSASDSASSAAPFEKPRAVVKKLLAESQPEGQGATVRRSIGRHELRNLDPFLMLDEFSVSKPAGFPDHPHRGFETVTYMLEGAFTHQDFAGHKGTIKTGDVQWMTAGRGIVHSEMPAGDGVQKGLQLWINLSAKDKMIEPRYQELESKDISRGERDGVEARVIAGEALGAASPVYTRTPTMYVDFTMRPGSRLHQPVPEGWNAFVYVVDGEGVFGRDKAAPTAAHHCLVLGPGDGLSVWNRSDRPLRFVLVAGKPLGEPVVQHGPFVMNSRAEIQQAMEDYYYGKNGFERASQWSSSSA

SEQ ID NO: 5689 - protein, 232 aa, Panicum virgatum
MSRKNFRKRTIEPDADDRSDDEDTRRVALEEIKYIQKLRERKLGIPADPAAASTNGSSARGRVGGGGAAVGEAEKEDLVLQDTFAQETAVTIEDPNMLKYVETELGKKRGKMVDVGQKEEMDHVDELYTVPDHLKVKKKNSEESSTQWTTGIAEVQLPIEYKLRNIEETEAAKKMLQEKRLAGKPKSDSNIPSSYSADYFHRGKEYDEKLRRENPGCTKIKILGLMKVQGAK

SEQ ID NO: 5690 - protein, 270 aa, Sorghum bicolor
MPRNFRKRGIEPDTDDRSDDEDTRRVALEEIKYMQKLRERKLGIPAGTAAASTNGSSARGGRVGSGAAAAGEAEKEDLVLQDTFAQETAVTIEDPNMLRYVETELAKKRGKMVDVGHKEEMDHVDELYTVPDHLKVKKKNSEESSTQWTTGIAEVQLPIEYKLRNIEETEAAKKVLQEKRLASKPKSDANIPSSYSADYFHRGKEYDEKLRRENPGLYKDNDSRPRGSSGGKATDTKNPGGVGAGRREAASDEFMLERFRKREKFRALRR

SEQ ID NO: 5691 - protein, 269 aa, Zea mays
MPRNFRKRGIEQDTDDRSDDEDTRRIALEEIKYMQKLRERKLGIPADLAAASTNGSSARGLLGTGAAVAGEAEKEDLVLQDTFAQETAVTIEDPNMLRYVETELAKKRGKMVDVGHKEEMDHVDELYTVPDHLKVKKKNSEESSTQWTTGIAEVQLPIEYKLRNIEETEAAKKLLQEKRLARKPKPDANIPSSYSADYFHRGKEYDEKLRRENPGLYKDNDSRPSGNPGGKATDTKNPDGVGAGRREAASDELMLQRFRKREKFRALRR

SEQ ID NO: 5692 - protein, 251 aa, Panicum virgatum
SLPPPRSVALEEIKYMQKLRERKLGIPADPAAASTNGSSARGRVGVGGAAVGEAEKEDLVLQDTFAQETAVTIEDPNMLKYVETELAKKRGKMVDVGQKEEMDHVDELYTVPDHLKVKKKNSEESSTQWTTGIAEVQLPIEYKLRNIEETEAAKKMLQEKRLAGKPKSDSNIPSSYSADYFHRGKEYDEKLRRENPGLYKDKDSRANESAGGKVADSKNPDGAAAGRREAASDQFMLERFRKREKFRVMRR

SEQ ID NO: 5693 - protein, 249 aa, Panicum virgatum
MEEYGGGDLLSEAMGSAARVVVVEDCVEAPGAFVLHLLLKRALAGGGAAAFLALAQPFTHYDRILRKMGCNLSLHRRNERLHFFELQAFPGGAREGAIADCFVRLYSEIQRVVEATRTGENAGQFTIMLDDVSLLEVAAHGSVDNVLDFLYYCVTLTSEMNCSLVILIHEDIYAVEENMGLLLHLRHIADLVVKAAPLSTGLAADVHGQLSVINKGTFSEQRAKAQKVWSFHFKVKENGTDFFYPGSRH

SEQ ID NO: 5694 - protein, 249 aa, Panicum virgatum
MEEYGGGDLLSEMMGSAARVVVVEDCVEAPGAFVLHLLLKRALAGGGAAAFLALAQPFTHYDRILRKMGCNLSLHRRNERLHFFELQAFPGGARDGAIADCFVRLYSEIQRVVEATRTGKNAGPFTIMIDDVSLLEVAAHGSVDNVLDFLYYCVTLTSEMNCSLVILIHEDIYAVEENMGLLLHLRHIADRVVKAAPLSTGLAADVHGQLSVVNKGTFNEQRAKAQKVWSFHFKVKENGTDFFYPGSRH

SEQ ID NO: 5695 - protein, 249 aa, Cenchrus ciliaris
  misc_feature (94)..(95): Xaa can be any naturally occurring amino acid
  misc_feature (98)..(98): Xaa can be any naturally occurring amino acid
  misc_feature (109)..(110): Xaa can be any naturally occurring amino acid
MPEDGGGDLLSEAMGSAARVVVVEDCVEAPGAFVLHLILKRALAGGGAAAFLALAQPFTHYDRILRKMGCNLSLHRRNERLYFFELQEFPAGAXXVAXADNFVRLYSEXXRVAEASRGGEIAGPFTIVMDDVSLLEVAAHGSIGNVLDFLHYCVTLTSEMNCSLVILVHEDIYAGEENNGLLIHLRHIADLVVKAAPLSTGLAADVHGQLSVVNKGTFTEQRAKAQKVWNFHFKVKENGADFFYPGSRH

SEQ ID NO: 5696 - protein, 249 aa, Zea mays
MEEHGAEDLLCEAMGSAAQVVVVEDCVEAPGAFVLHLLLKRALAGCGSAAFLALAQPFSHYDRVLRKMGCNLSLHRRNERLHFFELLGFPGGAREGTIADSFALLYNEIQRLVEANRAGENEGQFTIVIDDASLLEVVALGSVSDVLDFLHYCFTLTSEMNCKLVILIHEDIYANEENMGLLLHLRYIADLVIKAAPLSTGLAADVHGQLAVVNKGTFSEQRAKAQKVWNFHFKVKENGADFFYPGSRH

SEQ ID NO: 5697 - protein, 249 aa, Sorghum bicolor
MEEYGGGDLLSEAMGSAARVVVVEDCVEAPGAFVLHLLLKRALASGGAAAFLALAQPFSHYDRVLRKMGCNLSLHRRNERLHFFELLGFPGGAREGTIADRFVQLYNEIQRLVEANRTGENAGQFTVIIDDASLLEIVALGSVNDVLDFLHYCFALTSEMNCTLVVLIHEDIYADEENIGLLLHLRYIADLVIKAAPLSTGLAADVHGQLSVVNKGTFGEQRAKAQKVWNFHFKVKENGADFFYPGTRH

SEQ ID NO: 5698 - protein, 227 aa, Panicum virgatum
  misc_feature (122)..(122): Xaa can be any naturally occurring amino acid
VEDCVEAPGAFVLHLLLKRALAGGGAAAFLALAQPFTHYDRILRKMGCNLSLHRRNERLHFFELQAFPGGARDGAIADCFVRLYSEIQRVVEATRTGKNAGPFTIMIDDVSLLEVAAHGSVXNVLDFLYYCVTLTSEMNCSLVILIHEDIYAVEENMGLLLHLRHIADRVVKAAPLSTGLAADVHGQLSVVNKGTFNEQRAKAQKVWSFHFKVKENGTDFFYPGSRH

SEQ ID NO: 5699 - protein, 250 aa, Hordeum vulgare
MQGYGGEDLLGEAMCAGARVVVVEDCVEAPAAFVLHLLLKRALAAGGGAALLALAHPFSHYDRVLRKMGCNLSVHRKSERLHFFDLQAFPGGTRGGVIADSLAQLYSGLQRVVEAYRTGENAGRFTVMIDDVSLLEVAANGSADDVLDFLHYCVTLTSEMNCSLVVLNHEDIYSSEDGVGLLLHLRYIADLVIKAAPLSTGLAADVHGQLSVVNKGMLIEQRPAKGQKVWNFHFKVKENGADFFYPGSRH

SEQ ID NO: 5700 - protein, 142 aa, Sorghum bicolor
MAHSLAASFSPAAAAARRQVTNVISSRSSVSFQSHRMTSVSIRSRPSSLRFKICCSAKKETVDKVCSIVKQQLALPDGTALTGESKFAELGADSLDTVEIVMGLEEAFNITVDETSAQDIATVQDAADLIEKLMQEAPPKVV

SEQ ID NO: 5701 - protein, 141 aa, Panicum virgatum
MAHSLATAAAASFSPAAARRQVTNVFSSRSSVSFQSHRMTSVSIRSRPSSLRLKICCSAKQETVDKVCSIVKEQLALPDGTALSGESKFAELGADSLDTVEIVMGLEEAFNITVDETSAQDIATVQDAADLIEKLVLEKAA

SEQ ID NO: 5702 - protein, 136 aa, Saccharum officinarum
LADCFSPAAARRQVTNVISSRSSVCFQSLRMTCVCIRSRPNYVRFKICCSAKKETVDKVCSIVKQQLALPDGTALTGESKFAELGADSLDTVEIVMGLEEAFNITADETSAQDIATVQDAADLIEKLMLEAPPKVV

SEQ ID NO: 5703 - protein, 142 aa, Pennisetum glaucum
MAHSLATAAAASSFSSAAARRQVTNVISSRSSVSFQSYRMASVSIRSRPSSLRFKICCSAKKETVDKVCNIVKEQLALPDGTAITGESKFAELGADSLDTVEIVMGLEEAFNITVDETSAQDIATVQDAADLIEKLVLEKSG

SEQ ID NO: 5704 - protein, 141 aa, Panicum virgatum
MAHSLATAAAASFSPAAARRQVTNVFSSRSSVSFQSHRMTSVSIRSRPSSLRLKICCSAKQETIDKVCSIVKEQLALPDGTALSGESKFAELGADSLDTVEIVMGLEEAFNITVDETSAQDIATVQDAADLIEKLVLEKAA

SEQ ID NO: 5705 - protein, 144 aa, Eragrostis curvula
MAHSLAAASASFSPVATRRQPSGQVTNVISSRSSVSFQSQRMNFVSIRSRPSSLWFRICCSAKQETVDKVCSIVKNQLALPDGTVVTGESKFSELGADSLDTVEIVMGLEEEFNITVDETSAQDIATVQDAANLIEKLVTEKTP

SEQ ID NO: 5706 - protein, 138 aa, Setaria italica
VIFIGTIHLWGQSHGPFQVTNVISSRNSVSFRSYRMTSVSIRSRPSSLRFKICCSAKKETVDKVCSIVKEQLALPDGTAITGESKFAELGADSLDTVEIVMGLEEAFNITVDETSAQDIATVQDAADLIEKLVLEKAS

SEQ ID NO: 5707 - protein, 144 aa, Cynodon dactylon
MAHSLAAASASFSPLASRRRASGQVTNVLSSRSSVSFQSQRMNFVSIRSRPSTLRFKIYCSAKQETVDKVCSIVKKQLALPDETAVTGESKFSELGADSLDTVEIVMGLEEEFNITVDETSAQDIATVQDAANLIEKLVTEKTP

SEQ ID NO: 5708 - protein, 144 aa, Oryza sativa
MAHSLAAAASSFSPPAARRRLPGQVTNVISRRSSVSFNSQRISFMSIRSRPSQLRFKICCSAKKETVDKVCNIVKTQLALPEGTAVTGESKFSELGADSLDTVEIVMGLEEEFNITVDETSAQDIATVQDAANLIEKLVLEKAA

SEQ ID NO: 5709 - protein, 174 aa, Sorghum bicolor
MLATTCGAPPCPCARSRRPPTAAFGGGYGIGRTRRSTRPRALRRAGVVRCGLLPVDPWAPTMDSQSVASQLFAVSLFPYLGFLYFMTRSKTAPGLTLFGFYFLLVFVGATTKVHYGTSLSNVDWLHGSAESLLTLTNLFIVLGLRGALRKLEEEEDTNGRVSEASQDSKEKSSV

SEQ ID NO: 5710 - protein, 1017 aa, Setaria italica
MTWFRAASGAARLALRRSLATRAPTAAAATRCARGFHSTALRPRSAAPAPRAVPLSRLSDSFLDGTSSVYLEELQRAWEVDPSSVDESWDNFFRNFVAQASPSAGVSGQTIQESMQLLLLVRAYQVNGHMMAKLDPLGLDDRAVPEDLHLGLYGFTDADLDREFFLGVWRMSGFLSENRPVLTLREILSKLQQAYCGPIGYEYMHIPDRDKCNWLREKIETAKPRDYDKERRLVMLDRLIWSTQFENFLATKWATAKRFGLEGGETLIPGMKEMFDRAADLGVENIVIGMPHRGRLNVLGNVVRKPLSQIFSEFTGGTRPVEGEDGLYTGTGDVKYHLGTSYDRPTRGGKRIHLSLVANPSHLEAVDPVVIGKTRAKQFYSNDADRTKNMGILIHGDGSFAGQGVVYETLHLSALPNYTTGGTIHIVVNNQVAFTTDPRAGRSSQYCTDVAKALNAPIFHVNGDDLEAVVRVCELAAEWRQTFHSDVVVDLICYRRFGHNEIDEPSFTQPKMYQVIKNHPSSLKLYEQKLLGTGEVSKEDVQRIHDKVNRILNEEFTKSKDYVPNKRDWLSAYWTGFKSPEQISRVRNTGVKPEILKRVGQAITTLPENFRPHRAVKKIFELRAAMIESGEGIDWAVAEALAFATLIVEGNHVRLSGQDVERGTFSHRHAVLHDQDTGAKYCPLDHVAMNQSEELFTVSNSSLSEFAVLGFELGYSMENPNSLVLWEAQFGDFANGAQVMFDQFLSSGEAKWLRQTGLVVLLPHGYDGQGPEHSSSRLERFLQMSDDNPFVIPEMEPTLRKQIQECNWQVVNVTTPANYFHVLRRQIHREFRKPLIVTAPKNLLRHKDCKSNLSEFDDVEGHLGFDKQGTRFKRLIKDRNDHKQVEEGINRLILCSGKVYYELDEERKKSERSDIAICRVEQLCPFPYDLIQRELKRYPNAEIVWCQEEPMNMGAYSYISPRLYTAMKALGRGSFEDIKYVGRAPSAATATGFLSVHVQEQSELVKKALQPEPIKFP

SEQ ID NO: 5711 - protein, 1008 aa, Oryza sativa
MAWLRAASGLARHALRRRVPVASRFFHSARPAWRSSAPVPRAVPLSRLTDSFLDGTSSVYLEELQRAWEADPSSVDESWDNFFRNFLGQAAPSSAGLSGQTIQESMQLLLLVRAYQVNGHMKAKLDPLRLDDRAVPDDLDLSLYGFTEADLDREFFLGVWRMAGFLSDNRPVLTLREILSKLEQAYCGPIGYEYMHIPDRDKCNWLRDKIETAKLKEYNKDRRLVMLDRLIWSTQFENFLATKWATAKRFGLEGGETLIPGMKEMFDRAADLGVENIVIGMPHRGRLNVLGNVVRKPLSQIFSEFTGGTRPVEGEDGLYTGTGDVKYHLGTSYDRPTRGGKRIHLSLVANPSHLEAVDPVVIGKTRAKQFYSNDLDRTKNMGILIHGDGSFAGQGVVYETLHLSALPSYTTGGTIHIVVNNQVAFTTDPRAGRSSQYCTDVAKALNAPIFHVNGDDLEAVVRVCELAAEWRQTFHSDVVVDLICYRRFGHNEIDEPSFTQPKMYQVIKNHPSSLKLYEQKLLGTGEVSKEDVQKIHEKVNRILNEEFAKSKDYVPNKRDWLSAYWTGFKSPEQISRVRNTGVNPGVLKRVGQAITTLPEDFKPHRAVKKIFEQRAAMIESGEGIDWAVAEALAFATLIVEGNHVRLSGQDVERGTFSHRHAVLHDQENGRKHCPLDHVVMNQNEELFTVSNSSLSEFAVLGFEMGYSMENPNSLVLWEAQFGDFSNGAQVMFDQFLSSGEAKWLRQTGLVVLLPHGYDGQGPEHSSARLERFLQMSDDNPFVIPEMEPTLRKQIQECNWQVVNVTTPANYFHVLRRQIHREFRKPLIVMAPKNLLRHKDCKSNLSEFDDVEGHPGFDKQGTRFKRLIKDRNDHKQVEEGIKRLVLCSGKVYYELDEERKKTERSDVAICRVEQLCPFPYDLIQRELKRYPNAEIVWCQEEPMNMGAYSYISPRLYASMKTLGRGSFDDIKYVGRAPSAATATGFLSVHAQEQTELVKKALQAEPIKFP

SEQ ID NO: 5712 - protein, 965 aa, Panicum virgatum
VPLSRLSDSFLDGTSSVYLEELQRAWEADPSSVDESWDNFFRNFVAQASPSAGVSGQTIQESMQLLLLVRAYQVNGHMMAKLDPLGLDDRAVPEDLRLGLYGFTDADLDREFFLGVWRMSGFLSENRPVLTLREILSKLQQAYCGPIGYEYMHIPDRDKCNWLREKIETAKPRDYDKDRRLVMLDRLIWSTQFENFLATKWATAKRFGLEGGETLIPGMKEMFDRAADLGVENIVIGMPHRGRLNVLGNVVRKPLSQIFSEFTGGTRPVKGEDGLYTGTGDVKYHLGTSYDRPTRGGKRIHLSLVANPSHLEAVDPVVIGKTRAKQFYSNDADRTKNMGILIHGDGSFAGQGVVYETLHLSALPNYTNGGTIHIVVNNQVAFTTDPRAGRSSQYCTDVAKALNAPIFHVNGDDLEAVVCVCELAAEWRQTFHSDVVVDLICYRRFGHNEIDEPSFTQPKMYQVIKNHPSSLKLYEQKLLGSGEVSKEDVQKIHDKVNRILNEEFTKSKDYVPNKRDWLSAYWTGFKSPEQISRVRNTGVKPEILKRVGQAITTLPENFKPHRAVKKIFELRAAMIQSGEGIDWAVAEALAFATLIVEGNHVRLSGQDVERGTFSHRHAVLHDQETGAKYCPLDHVAMNQSAELFTVSNSSLSEFAVLGFELGYSMENPNSLVLWEAQFGDFSNGAQVMFDQFLSSGEAKWLRQTGLVVLLPHGYDGQGPEHSSARLERFLQMSDDNPFVIPEMEPTLRKQIQECNWQVVNVTTPANYFHVLRRQIHREFRKPLIVTAPKNLLRHKDCKSNLSEFDDVEGHPGFDKQGTRFKRLIKDRNDHKQVEEGINRLILCSGKVYYELDEERKKSERSDVAICRVEQLCPFPYDLIQRELKRYPNAEIVWCQEEPMNMGAYSYISPRLYTAMKALGRGSFEDIKYIGRAPSAATATGFLSVHVQEQSELVKKALQPEPNKFP

SEQ ID NO: 5713 - protein, 1001 aa, Hordeum vulgare
AVLARAASATPGARSAWFHTSAIRRRAAAPVPRAVPLSRLTDSFLDGTSSVYLEELQRAWEADPASVDESWDNFFRNFLGQAAGSPGAGLSGQTIQESMQLLLLVRAYQVNGHMKAALDPLRLDDRAVPEDLDLALYGFTEADLDREFFLGVWMMAGFLSENRPVLTLREILSKLERAYCGPIGFEYMHIPDRDKCNWLREKIETVAPKEYDRDRRLVMLDRLIWSTQFENFLATKWATAKRFGLEGGETLIPGMKEMFDRSADLGVENIVIGMPHRGRLNVLGNVVRKPLSQIFSEFAGGTRPVEGEDGLYTGTGDVKYHLGTSYDRPTRGGKRIHLSLVANPSHLEAVDPVVIGKTRAKQFYSNDDDRTKNMGILIHGDGSFAGQGVVYETLHLSALPNYTTGGTIHIVVNNQVAFTTDPRAGRSSQYCTDVAKAVNVPIFHVNGDDLEAVVRVCELAAEWRQTFHSDVVVDLICYRRFGHNEIDEPSFTQPKMYQVIKNHPSSLKLYEQKLLETGEVAKEDVDRIHDKVNRILNEEFAKSKDYVPNKRDWLSAYWTGFKSPEQISRVRNTGVKPEVLKRVGQAITSLPESFKPHRAVKKIFEQRAAMIESGEGIDWAVAEALAFAALIVEGNHVRLSGQDVERGTFSHRHSVVHDQETGAKYCPLDHVVMNQNEELFTVSNSSLSEFAVLGFELGYSMENPNSLVLWEAQFGDFSNGAQVMFDQFLSSGEAKWLRQTGLVVLLPHGYDGQGPEHSSSRLERFLQMSDDNPFVIPEMDPTLRKQIQECNWQVVNVTTPANYFHVLRRQIHRDFRKPLIVTAPKNLLRHKECKSNLSEFDDVEGHPGFDKQGTRFKRLIKDRNDHKEVEEGINRLVLCSGKVYYELDDERKKSERSDVAICRVEQLCPFPYDLIQRELKRYPNAEIVWCQEEPMNMGAYSYISPRLYSAMKTLGRGTFEDIKYVGRAPSAATATGFLTVHVQEQSELVKKALQPEPIKFP

SEQ ID NO: 5714 - protein, 983 aa, Panicum virgatum
ASTPPPCGLAPPPPRPAPSRSPASPTASSTAPAASTSRSSSAPGRPTPHSVDESWDNFFRNFVAQASPSAGVSGQTIQESMQLLLLVRAYQVNGHMMAKLDPLGLDDRAVPEDLRLGLYGFTDADLDREFFLGVWRMSGFLSENRPVLTLREILSKLQQAYCGPIGYEYMNIPDRDKCNWLREKIETAKPRDYDKDRRLVMLDRLIWSTQFENFLATKWATAKRFGLEGGETLIPGMKEMFDRAADLGVENIVIGMPHRGRLNVLGNVVRKPLSQIFSEFTGGTRPVKGEDGLYTGTGDVKYHLGTSYDRPTRGGKRIHLSLVANPSHLEAVDPVVIGKTRAKQFYSNDADRTKNMGILIHGDGSFAGQGVVYETLHLSALPNYTTGGTIHIVVNNQVAFTTDPRAGRSSQYCTDVAKALNAPIFHVNGDDLEAVVRVCELAAEWRQTFHSDVVVDLICYRRFGHNEIDEPSFTQPKMYQVIKNHPSSLKLYEQKLLGSGDVSKEDVQRIHDKVNHILNEEFTKSKHYVPNKRDWLSAYWTGFKSPEQISRVRNTGVKPEILKRVGQAITTLPENFNPHRAVKKIFELRAAMIESGEGIDWAVAEALAFATLIVEGNHVRLSGQDVERGTFSHRHAVLHDQETGAKYCPLDHVAMNQSAELFTVSNSSLSEFAVLGFELGYSMENPNSLVLWEAQFGDFSNGAQVMFDQFLSSGEAKWLRQTGLVVLLPHGYDGQGPEHSSARLERFLQMSDDNPFVIPEMEPTLRKQIQECNWQVVNVTTPANYFHVLRRQIHREFRKPLIVTAPKNLLRHKDCKSNLSEFDDVEGHPGFDKQGTRFKRLIKDRNDHKQVEEGINRLILCSGKVYYELDEERKKSERSDVAICRVEQLCPFPYDLIQRELKRYPNAEIVWCQEEPMNMGAYSYISPRLYTAMKALGRGSFEDIKYIGRAPSAATATGFLSVHVQEQSELVKKALQPEPNKFP

SEQ ID NO: 5715 - protein, 917 aa, Panicum virgatum
SPSAGVSGQTIQESMQLLLLVRAYQVNGHMMAKLDPLGLDDSAVPEDLRLGLYGFTDADLDREFFLGVWRMSGFLSENRPVLTLREILSKLQQAYCGPIGYEYMHIPDRDKCNWLREKIETAKPRDYDKDRRLVMLDRLIWSTQFENFLATKWATAKRFGLEGGETLIPGMKEMFDRAADLGVENIVIGMPHRGRLNVLGNVVRKPLSQIFSEFTGGTRPVEGEDGLYTGTGDVKYHLGTSYDRPTRGGKRIHLSLVANPSHLEAVDPVVIGKTRAKQFYSNDADRTKNMGILIHGDGSFAGQGVVYETLHLSALPNYTTGGTIHIVVNNQVAFTTDPRAGRSSQYCTDVAKALNAPIFHVNGDDLEAVVRVCELAAEWRQTFHSDVVVDLICYRRFGHNEIDEPSFTQPKMYQVIKNHPSSLKLYEQKLLGSGDVSKEDVQRIHDKVNHILNEEFTKSKHYVPNKRDWLSAYWTGFKSPEQISRVRNTGVKPEILKRVGQAITTLPENFNPHRAVKKIFELRAAMIESGEGIDWAVAEALAFATLIVEGNHVRLSGQDVERGTFSHRHAVLHDQETGAKYCPLDHVAMNQSAELFTVSNSSLSEFAVLGFELGYSMENPNSLVLWEAQFGDFSNGAQVMFDQFLSSGEAKWLRQTGLVVLLPHGYDGQGPEHSSARLERFLQMSDDNPFVIPEMEPTLRKQIQECNWQVVNVTTPANYFHVLRRQIHREFRKPLIVTAPKNLLRHKDCKSNLSEFDDVEGHPGFDKQGTRFKRLIKDRNDHKQVEEGINRLILCSGKVYYELDEERKKSERSDVAICRVEQLCPFPYDLIQRELKRYPNAEIVWCQEEPMNMGAYSYISPRLYTATKALGRGSFEDIKYIGRAPSAATATGFLSVHVQEQSELVKKALQPEPIKFP

SEQ ID NO: 5716 - protein, 1024 aa, Musa acuminata
MAWFRAVSGVARLAIRRNLSQAPHHIGRPRALPSPPSRGFHSAALRRKAESAAPIPRAVPLSRLTDSFLDGTSSVYLEELQRAWEADPNSVDESWDNFFRNFVGQAATSPGISGQTIQESMRLLLLVRAYQVNGHMKAKLDPLGLEEREIPEDLDLGLYGFTEADLDREFFLGVWRMAGFLSDNRPVQTLREILNRLEQAYCGNVGYEYMHIPDRDKCNWIRDKIETVKPREYSRERREVILDRLIWSTEFENFLATKWTAAKRFGLEGGETLIPGMKEMFDRAADQGVESIVIGMSHRGRLNVLGNVVRKPLRQIFSEFSSGTKPVDGEVGLYTGTGDVKYHLGTSYDRPTRGGKRIHLSLVANPSHLEAVDPLVVGKTRAKQYYSNDIDRIKNMGVLIHGDGSFAGQGVVYETLHLSALPNYTTGGTIHIVINNQVAFTTDPGSGRSSQYCTDVAKALNAPIFHVNGDDMEAVVHVCELAAEWRQTFHSDVVVDIVCYRRFGHNEIDEPSFTQPKMYQVIRNHPSALEIYQSKLLESGEITKEDIERIHNKVTSILNEEFINSKDYVPKRRDWLSAYWLGFKSPEQISRIRNTGVKPEILKRVGQAITTLPETFKPHRAVKKIFEQRAQMIESGEGIDWAMGEALAFATLIIEGNHVRLSGQDVERGTFSHRHSVIHDQQTGEKYCPLDHIVMNQDEELFTVSNSSLSEFAVLGFELGYSMENPNSLILWEAQFGDFSNGAQVMFDQFLSSGESKWLRQTGLVVLLPHGYDGQGPEHSSARLERFLQMSDDNPYVIPEMDPTLRKQIQECNWQVVNVTTPANYFHVLRRQIHREFRKPLIVMSPKNLLRHKDCKSNLSEFDDLEGHPGFDKQGTRFKRLIKDQNNHKEIEEGINRLILCSGKVYYELDEGRKKLDRQDVAICRVEQLCPFPYDLIQRELKRYPNAEIVWCQEEPMNMGAYSYINPRLYTAMRALGRGEFEDIKYVGRAPSAATATGFYSVHVQEQTELVQKALQPEAISFPY

SEQ ID NO: 5717 - protein, 1020 aa, Elaeis guineensis
MAWFRAASGVARLALRRNLSQAPHHIARTRALPSSTRCFHSTNFRPKAAPVPRPVPLSKLTDSFLDGTSSVYLEELQRAWENDPSSVDESWDNFFRNFVGQAATSPGISGQTIHESMRLLLLVRAYQVNGHMKAQLDPLGLEKREIPEDLDPALYGFTEADLDREFFLGVWRMSGFLSENRPVQTLREILNRLEQAYCGTIGYEYMHIPDREKCNWLREKIETVKPREYSPDRREVLLDRLIWSTQFENFLATKWTAAKRFGLEGGETLIPGMKEMFDRAADMGVESIVIGMSHRGRLNVLGNVVRKPLRQIFSEFSGGTKPVEEGEGLYTGTGDVKYHLGTSYDRPTRGGKRIHLSLVANPSHLEAVDPLVVGKTRAKQYYSNDAERTKNVGVLIHGDGSFAGQGVVYETLHLSALPNYTTGGTIHIVVNNQVAFTTDPKSGRSSQYCTDVAKALNAPIFHVNGDDFEAVVHACELAAGWRQTFHSDVVVDIVCYRRFGHNEIDEPSFTQPKMYQVIRNHPSALEIYQNKLLQSGQISKEDIERIHNKVNSILNEEFIKSKDYVPRRRDWLSAYWAGFKSPEQISRIRNTGVKPEILKRVGQAITTLPENFKPHRALKKIFEQRAKMIETGEGIDWALAEALAFATLIIEGNHVRLSGQDVERGTFSHRHAFVHDQETGEKYCPLGHILMNQNEEMFTVSNSSLSEFAVLGFELGYSMENPNSLVLWEAQFGDFANGAQVIFDQFLSSGESKWLRQTGLAVLLPHGYDGQGPEHSSARLERFLQMSDDNPYVIPEMDPTLRKQIQECNWQVVNVTTPANYFHVLRRQIHRDFRKPLIVMSPKNLLRHKDCKSHLSEFDDLVGHPGFDKQGTRFKRLIKDQNDHKDLEEGINRLILCSGKIYYELDEARKKKDRKDVAICRVEQLCPFPYDLIQRELKRYPNAEIVWCQEEPMNMGAYHYVTPRLHTAMRALGRGTIEDINYVGREPSAATATGFYSVHVQEQTQIIQKAMQQEPVRYPY

SEQ ID NO: 5718 - protein, 911 aa, Secale cereale
SGQTIQESMQLLLLVRAYQVNGHMKAALDPLGLDDRAVPEDLDLALYGFTEADLDREFFLGVWMMAGFLSENRPVLTLREILGKLERAYCGPIGFEYMHIPDRDKCNWLREKIETVAPREYPKDRRLVMLDRLIWSTQFENFLATKWATAKRFGLEGGETLIPGMKEMFDRSADLGVENIVIGMPHRGRLNVLGNVVRKPLSQIFSEFAGGTRPVEGEDGLYTGTGDVKYHLGTSYDRPTRGGKRIHLSLVANPSHLEAVDPVVIGKTRAKQFYSNDDDRTKNMGILIHGDGSFAGQGVVYETLHLSALPNYTTGGTIHIVVNNQVAFTTDPRAGRSSQYCTDAAKAVNVPILHVNGDDLEAVVRVCELAAEWRQTFHSDVVVDLICYRRFGHNEIDEPSFTQPKMYQVIKNHPSSLKLYEQKLLETGEVTKDDVQRIHDKVNRILNEEFAKSKDYVPNKRDWLSAYWTGFKSPEQISRVRNTGVKPEVLKRVGQAITTLPESFKPHRAVKKIFEQRAAMIESGEGIDWAVAEALAFAALIVEGNHVRLSGQDVERGTFSHRHSVVHDQETGAKYCPLDHVVMNQNEELFTVSNSSLSEFAVLGFELGYSMENPNSLVLWEAQFGDFSNGAQVMFDQFLSSGEAKWLRQTGLVVLLPHGYDGQGPEHSSSRLERFLQMSDDNPFVIPEMDPTLRKQIQECNWQVVNVTTPANYFHVLRRQIHRDFRKPLIVTAPKNLLRHKECKSNLSEFDDVEGHPGFDKQGTRFKRLIKDRNDHKEVEEGINRLVLCSGKVYYELDDERKKSERSDVAICRVEQLCPFPYDLIQRELKRYPNAEIVWCQEEPMNMGAYSYISPRLYSAMKTLGRGTFEDIKYVGRAPSAATATGFLTVHVQEQSELVKKALQPEPIKFP

SEQ ID NO: 5719 - protein, 1016 aa, Triticum aestivum
MGLFRAASGLARVALRRSLSRAPASPFAGPAPRYFHSTLPRRYAAPEPRAVPLSRLTDSFLDGTSSVYLEELQRAWEADPTSVDESWDNFFRNFVGQAATSPGISGQTIQESMRLLLLVRAYQVSGHMKAKLDPLGLEQRPVPDVLDPAFYGFSESDLDREFFLGVWRMAGFLSENRPVQTLRSVLGRLEQAYCGTIGYEYMHIPDREKCNWLRERIETVNPREYTYDRRQVMLDRLIWSTQFENFLAQKWTTAKRFGLEGAETLIPGMKEMFDRAADLGVESIVIGMPHRGRLNVLGNVVRKPLRQIFSEFSGGTKPVNEGEGLYTGTGDVKYHLGTSYDRPTRGGKHIHLSLVANPSHLEAVDPVVAGKTRAKQYYSNDLDRTKNLGVLLHGDGSFSGQGVVYETLHLSALPNYTTGGTIHLVVNNQVAFTTDPMSGRSSQYCTDVAKALDAPIFHVNGDDLEAVVHTCELAAEWRQTFHSDVVVDIVCYRRFGHNEIDEPSFTQPKMYKVIRNHPSALEIYQNQLLESGKISKEDIDKIHKKVSTILNEEFKKSKDDIPNKRDWLSAYWTGFKSPEQISRIRNTGVKPEILKRVGEAMTTLPETFKPHRAVKKIFDLRRQMIETGEGIDWAVGEALAFATLIIEGNHVRLSGQDVERGTFSHRHSVIHDQETGEQYCPLDNLVMNQNEELFTVSNSSLSEFAVLGFELGYSMENPNSLVLWEAQFGDFSNGAQVIFDQFISSGEAKWLRQTGLVVCLPHGYDGQGPEHSSARMERFLQMSDDNPYVIPEMDPTLRKQIQECNWQVVNVTTPANYFHVLRRQIHRDFRKPLIVMSPKNLLRHKDCKSSLSEFDDLAGHPGFDKQGTRFKRLIKDRNDHKDLEEGIRRLVLCSGKVYYELDEERKKSDSNDVAICRVEQLCPFPYDLIQRELKRYPNAEIVWCQEEPMNMGAYTYINPRLLTAMRALGRGSIDDIKYVGRAPSAATATGFYTVHVQEQTELVKKALQRDPIKSPL

SEQ ID NO: 5720 - protein, 1021 aa, Eucalyptus grandis
MVWFRASSSAAKLVVRRALSQSRSYVTRSRILPSQERCFHATAFRPKAQAAPVPRPVPLSRLTDSFLDGTSSVYLEELQRAWEADPNSVDESWDNFFRNFVGQAATSPGISGQTIQESMRLLLFVRAYQVNGHMKAKLDPLGLEEREIPSDLDPALYGFTEADLDREFFIGVWRMAGFLSENRPVQTLRSILTRLEQAYCGSIGYEYMHIADREKCNWLRDKIETPTPMQYNRQRREVILDRLIWSTQFENFLATKWTTAKRFGLEGGETLIPGMKEMFDRSADLGVESIVIGMPHRGRLNVLGNVVRKPLRQIFSEFSGGTKPVDEVGLYTGTGDVKYHLGTSYDRPTRGGKRIHLSLVANPSHLEAVDPVVVGKTRAKQYYSNDVERTKNMGILIHGDGSFAGQGVVYETLHLSALPNYTTGGTIHIVVNNQVAFTTDPRAGRSSQYCTDVAKALNAPIFHVNGDDVEAVVHVCELAAEWRQTFHSDVVVDLVCYRRFGHNEIDEPSFTQPKMYKVIRNHPSALEIYRKRLLESGQVTKEDIEKIQSKVNTILNEEFLASKDYVPQRRDWLSSHWSGFKSPEQLSRIRNTGVKPEILKNVGKAITTLPETFKPHRAVKKVYDQRAQMIETGEGIDWAVAEALAFATLLVEGNHVRLSGQDVERGTFSHRHSVLHDQETGEQYCPLDHVMMNQNEEMFTVSNSSLSEFAVLGFELGYSMENPNSLVLWEAQFGDFANGAQVIFDQFLSSGESKWLRQTGLVVLLPHGYDGQGPEHSSARLERFLQMSDDNPYAIPEMEPTLRKQIQECNWQVVNTTTPANYFHVLRRQINREFRKPLIVMAPKNLLRHKDCKSNLSEFDDVQGHPGFDKQGTRFKRLIKDQNDHSDLEEGIRRLVLCSGKVYYELDEERKKVGGKDVAICRVEQLCPFPYDLVQRELKRYPNAEIVWCQEEPMNMGAYSYVAPRLSTAMKALGRGTFEDIKYVGRAPSAATATGFYQVHVKEHTELVQKALQPEPINYPF

SEQ ID NO: 5721 - protein, 1016 aa, Secale cereale
MGLFRAASGLARVALRRSLSRAPASPFAGPAPRYFHSSLPRRYAAPEPRAVPLSRLTDSFLDGTSSVYLEELQRAWEADPTSVDESWDNFFRNFVGQAATSPGISGQTIQESMRLLLLVRAYQVSGHMKAKLDPLGLEQRPVPDVLDPAFYGFSESDLDREFFLGVWRMAGFLSENRPVQTLRSVLGRLEQAYCGTIGYEYMHIPDREKCNWLRERIETVNPREYTYDRRQVMLDRLIWSTQFENFLAQKWTTAKRFGLEGAETLIPGMKEMFDRAADLGVESIVIGMPHRGRLNVLGNVVRKPLRQIFSEFSGGTKPVNEGEGLYTGTGDVKYHLGTSYDRPTRGGKHIHLSLVANPSHLEAVDPVVAGKTRAKQYYSNDLDRTKNLGVLLHGDGSFSGQGVVYETLHLSALPNYTTGGTIHLVVNNQVAFTTDPMSGRSSQYCTDVAKALDAPIFHVNGDDLEAVVHTCELAAEWRQTFHSDVVVDIVCYRRFGHNEIDEPSFTQPKMYKVIRNHPSALEIYQNQLLESGKISKEDIDKIHKKVSTILNEEFKKSKDDIPNKRDWLSAYWTGFKSPEQISRIRNTGVKPEILKRVGEAMTTLPETFKPHRAVKKIFDLRRQMIETGEGIDWAVGEALAFATLIIEGNHVRLSGQDVERGTFSHRHSVIHDQETGEQYCPLDNLVMNQNEELFTVSNSSLSEFAVLGFELGYSMENPNSLVLWEAQFGDFSNGAQVIFDQFISSGEAKWLRQTGLVVCLPHGYDGQGPEHSSARMERFLQMSDDNPYVIPEMDPTLRKQIQECNWQVVNVTTPANYFHVLRRQIHRDFRKPLIVMSPKNLLRHKDCKSSLSEFDDLAGHPGFDKQGTRFKRLIKDRNDHKDLEEGIRRLVLCSGKVYYELDEERKKSDSNDVAICRVEQLCPFPYDLIQRELKRYPNAEIVWCQEEPMNMGAYSYINPRLLTAMRALGRGSIDDIKYAGRAPSAATATGFYTVHVQEQTELVKKALQRDPIKSPF

SEQ ID NO: 5722 - protein, 1016 aa, Brachypodium distachyon
MGWFRAASGLARVALRRNLSRVPASPFAGPAPRYFHSTRPRRFAAPEPRAVPLSRLTDSFLDGTSSVYLEELQRAWEADPSSVDESWDNFFRNFVGQAATSPGISGQTIQESMRLLLLVRAYQVSGHMKAKLDPLGLEERPVPDVLDPAFYGFSEDDLDREFFLGVWKMAGFLSENRPVQTLRSVVERLEQAYCGTIGYEYMHIPDREKCNWLRERIETVNPREYTYDRRQVMLDRLIWSTQFENFLAQKWTTAKRFGLEGAETLIPGMKEMFDRAADLGVESIVIGMPHRGRLNVLGNVVRKPLRQIFSEFSGGTKPVNEGEGLYTGTGDVKYHLGTSYDRPTRGGKHIHLSLVANPSHLEAVDPVVAGKTRAKQYYSNDLDRTKNLGVLLHGDGSFSGQGVVFETLHLSALPNYTTGGTIHIVVNNQVAFTTDPMSGRSSQYCTDVAKALDAPIFHVNGDDLEAVVHTCELAAEWRQTFHSDVVVDIVCYRRFGHNEIDEPSFTQPKMYKIIRNHPSALEIYQKQLLESGKLSKEDIDKLHKKVSTILNEEFQKSKDDIPNKRDWLSAYWTGFKSPEQISRIRNTGVKPEILKRVGEAMTTLPETFKPHRAVKKIFDLRRQMIETGEGIDWAVGEALAFATLIVEGNHVRLSGQDVERGTFSHRHSVIHDQETGEQYCPLDNLVMNQNEELFTVSNSSLSEFAVLGFELGYSMENPNSLVLWEAQFGDFSNGAQVIFDQFISSGEAKWLRQTGLVVCLPHGYDGQGPEHSSARMERFLQMSDDNPYVIPEMDPTLRKQIQQCNWQVVNVTTPANYFHVLRRQIHRDFRKPLIVMSPKNLLRHKECKSSLSEFDDLAGHPGFDKQGTRFKRLIKDRNDHKDLEEGINRLVLCSGKVYYELDEERKKLDRNDVAICRVEQLCPFPYDLIQRELKRYPNAEIVWCQEEPMNMGAYTYINPRLLTAMKALSRGSIEDIKYVGRAPSAATATGFYSVHVQEQTELVQKALQKDPIKGPF

SEQ ID NO: 5723 - protein, 1025 aa, Sorghum bicolor
MGLFRAASGLARVALRRNLSRAAASPFAGGGGAVPRAAPARYFHSTRPRWFAAPEPRAVPLSRLTDSFLDGTSSVYLEELQRAWEADPNSVDESWDNFFRNFVGQAAATSPGLSGQTIQESMRLLLLVRAYQVSGHLKAKLDPLGLEERPVPDVLDPAFYGFSEADLDREFFLGVWRMAGFLEENRPVQTLRSVLERLEQAYCGTIGYEYMHIPDREKCNWLRDRIETVNPREYSYDRRQVMLDRLIWSTQFENFLATKWTTAKRFGLEGAETLIPGMKEMFDRAADLGVESIVIGMPHRGRLNVLGNVVRKPLRQIFSEFSGGTKPVNEGEGLYTGTGDVKYHLGTSYDRPTRGGKQIHLSLVANPSHLEAVDPVVAGKTRAKQYYSNDRDRTKNLGVLLHGDGSFSGQGVVYETLHLSALENYTTGGTIHIVVNNQVAFTTDPKSGRSSQYCTDVAKALDAPIFHVNGDDLEAVVHVCELAAEWRQTFHSDVVVDIVCYRRFGHNEIDEPSFTQPKMYKVIRNHPSALEIYQRKLLESGKISKEDIDKLNKKVSTILNEEFQNSKDYVPNKRDWLSAYWTGFKSPEQISRIRNTGVKPEILKRVGEAMTTLPENFKPHRAVKKIFDLRRQMIETGEGIDWAVGEALAFATLIIEGNHVRLSGQDVERGTFSHRHSVIHDQETGEQYYPLDHLVMNQDEELFTVSNSSLSEFAVLGFELGYSMENPNSLVIWEAQFGDFANGAQVIFDQFLSSGESKWLRQTGLVVCLPHGYDGQGPEHSSARLERFLQMSDDNPYVIPEMDPTLRKQIQECNWQVVNVTTPANYFHVLRRQIHRDFRKPLIVMSPKNLLRHKDCKSNLSEFDDLAGHPGFDKQGTRFKRLIKDQNNHKDLEEGINRLVLCSGKVYYELDEERRKAERTDVAICRVEQLCPFPYDLIQRELKRYPNAEIVWCQEEPMNMGAYSYINPRLLTAMKALGRGGIEDIKYVGRAPSAATATGFYSVHVQEQTELVKKALQRDPINYPF

SEQ ID NO: 5724 - protein, 340 aa, Avena sativa
MGWFRAASGIARVALRRNLTRAPAAPFAAPARRYLHSTIPRRYAAPEPRAVPLSRLTDSFLDGTSSVYLEELQRAWEADPTSVDESWDNFFRNFVGQAATSPGISGQTIQESMRLLLLVRAYQVSGHMKAKLDPLGLEERPVPDVLDPAFYGFSEADLDREFFLGVWRMAGFLSENRPVQTLRSVVGRLEQAYCGTIGYEYMHIPDREKCNWLRERIETVNPKEYTYDRRQVMLDRLIWSTQFENFLAQKWTTAKRFGLEGAETLIPGMKEMFDRAADMGVESIVIGMPHRGRLNVLGNVVRKPLRQIFSEFSGGTKPVNGGGGFVYRDRRCQVPSRNFI

SEQ ID NO: 5725 - protein, 1021 aa, Ricinus communis
MAWFRAGASVARLAIRRTLSQSGSYTVRTRVVPSQNRYFHTTVFKSKAQAAPVPRPVPLSRLTDSFLDGTSSVYLEELQRAWEADPSSVDESWDNFFRNFVGQAATSPGISGQTIQESMRLLLLVRAYQVNGHMKAKLDPLGLEEREIPEDLDPALYGFAEADLDREFFLGVWRMSGFLSENRPVQTLRSILTRLEQAYCGSIGYEYMHIADRDKCNWLRDKIETPTPMQYNRQRREVILDRLIWSTQFENFLATKWTTAKRFGLEGGETLIPGMKEMFDRSADLGVESIVIGMPHRGRLNVLGNVVRKPLRQIFSEFSGGTKPVDEVGLYTGTGDVKYHLGTSYDRPTRGGKRIHLSLVANPSHLEAVDPVVVGKTRAKQYYSNDEDRIKNMGILIHGDGSFAGQGVVYETLHLSALPNYSTGGTIHIVVNNQVAFTTDPTAGRSSQYCTDVAKALNAPIFHVNGDDVEAVVHACELAAEWRQTFHSDVVVDLVCYRRFGHNEIDEPSFTQPKMYQVIRNHPSSLQIYKNKLLESGQVGEEDISRIQEKVITILNEEFLASKDYVPKRRDWLSSHWAGFKSPEQLSRIRNTGVQPEILKNVGKAITTIPDNFKPHRAVKKVYEQRAQMIETGEGIDWAVAEALAFATLLVEGNHVRLSGQDVERGTFSHRHSVIHDQETGEKYCPLDHVIMNQNEEMFTVSNSSLSEFGVLGFELGYSMESPNSLVIWEAQFGDFSNGAQVIFDQFLSSGESKWLRQTGLVVLLPHGYDGQGPEHSSARLERFLQMSDDNPCVIPEMEPTLRKQIQECNWQVVNVTTPANYFHVLRRQLHRDFRKPLIVMAPKNLLRHKDCKSNLSEFDDVQGHPGFDKQGTRFKRLIKDQNDHSDLEEGIRRLVLCSGKVYYELDEERKKIGAKDVAICRVEQLCPFPYDLIQRELKRYPNAEIVWCQEEPMNMGAYNYIAPRLCTAMKALERGSVEDIKYVGRAPSAATATGFYQVHVKEQSELVQKAMQPEPIHYPF

SEQ ID NO: 5726 - protein, 1023 aa, Setaria italica
MGLFRAASGLARVALRRNLARAAGNPFAGGAVPGAAPARYFHSTRPRRFAAPAPRAVPLSRLTDSFLDGTSSVYLEELQRAWEADPNSVDESWDNFFRNFVGQAAATSPGLSGQTIQESMRLLLLVRAYQVSGHLKAKLDPLGLEERPVPDVLDPAFYGFSEADLDREFFLGVWMMAGFLSENRPVQTLRSVLKRLEQAYCGTIGYEYMHIPDHDKCNWLRDKIETVNPREYTYDRRQVMLDRLIWSTQFENFLATKWTTAKRFGLEGAETLIPGMKEMFDRAADLGVESIVIGMPHRGRLNVLGNVVRKPLRQIFSEFSGGTKPVNEGEGLYTGTGDVKYHLGTSYDRPTRGGKHIHLSLVANPSHLEAVDPVVAGKTRAKQYYSNDRDRTKNLGVLLHGDGSFSGQGVVYETLHLSALENYTTGGTIHIVVNNQVAFTTDPRSGRSSQYCTDVAKALDAPIFHVNGDDLEAVVHVCELAAEWRQKFHSDVVVDIVCYRRFGHNEIDEPSFTQPKMYKVIRSHPSALEIYQNKLLESGKISKEDIDRLNKKVSTILNEEFKNSKDYVPNKRDWLSAYWTGFKSPEQISRIRNTGVKPEILKRVGEAMTTLPENFKPHRAVKKIFDQRRKMIETGEGIDWAVGEALAFATLIVEGNHVRLSGQDVERGTFSHRHSVIHDQETGEQYCPLDNLVMNQDEELFTVSNSSLSEFAVLGFELGYSMENPNSLVLWEAQFGDFSNGAQVIFDQFLSSGESKWLRQTGLVVCLPHGYDGQGPEHSSARLERFLQMSDDNPYVIPEMDPTLRKQIQQCNWQVVNVTTPANYFHVLRRQIHRDFRKPLIVMSPKNLLRHKDCKSNLSEFDDLAGHPGFDKQGTRFKRLIKDQNNHKDLEEGINRLVLCSGKVYYELDEERRKTERTDVAICRVEQLCPFPYDLIQRELKRYPNAEIVWCQEEPMNMGAYSYINPRLLTAMKALGRGGIEDIKYVGRAPSAATATGFYSVHVQEQTELVQKALQRDPISYPF

SEQ ID NO: 5727 - protein, 1025 aa, Sorghum bicolor
MGLFRAASGLARVALRRNLSRAAASPFAGGGGAVPRAAPARYFHSTRPRRFAAPEPRAVPLSRLTDSFLDGTSSIYLEELQRAWEADPNSVDESWDNFFRNFVGQAAATSPGLSGQTIQESMRLLLLVRAYQVSGHLKAKLDPLGLEERPVPDVLDPAFYGFSEADLDREFFLGVWRMAGFLEENRPVQTLRSVLERLEQAYCGTIGYEYMHIPDREKCNWLRDRIETVNPREYSYDRRQVMLDRLIWSTQFENFLATKWTTAKRFGLEGAETLIPGMKEMFDRAADLGVESIVIGMPHRGRLNVLGNVVRKPLRQIFSEFSGGTKPVNEGEGLYTGTGDVKYHLGTSYDRPTRGGKQIHLSLVANPSHLEAVDPVVAGKTRAKQYYSNDRDRTKNLGVLLHGDGSFSGQGVVYETLHLSALENYTTGGTIHIVVNNQVAFTTDPESGRSSQYCTDVAKALDAPIFHVNGDDLEAVVHVCELAAEWRQTFHSDVVVDIVCYRRFGHNEIDEPSFTQPKMYKVIRNHPSALEIYQRKLLESGKISKEDIDKLNKKVSTILNEEFQNSKDYVPNKRDWLSAYWTGFKSPEQISRIRNTGVKPEILKRVGEAMTTLPENFKPHRAVKKIFDLRRQMIETGEGIDWAVGEALAFATLIIEGNHVRLSGQDVERGTFSHRHSVIHDQETGEQYCPLDHLVMNQDEELFTVSNSSLSEFAVLGFELGYSMENPNSLVIWEAQFGDFANGAQVIFDQFLSSGESKWLRQTGLVVCLPHGYDGQGPEHSSARLERFLQMSDDNPYVIPEMDPTLRKQIQECNWQVVNVTTPANYFHVLRRQIHRDFRKPLIVMSPKNLLRHKDCKSNLSEFDDLAGHPGFDKQGTRFKRLIKDQNNHKDLEEGINRLVLCSGKVYYELDEERRKAERTDVAICRVEQLCPFPYDLIQRELKRYPNAEIVWCQEEPMNMGAYSYINPRLLTAMKALGRGGIEDIKYVGRAPSAATATGFYSVHVQEQTELVQKALQRDPINYPF

SEQ ID NO: 5728 - protein, 1020 aa, Amborella trichopoda
MAWFRLASGVAKATLRRNLIQASYTTRPSWTVPYARPFHSTVRRSQAQAAPVPRPVPLSKLTDSFLDGTSSVYLEELQRAWEADPESVDESWDNFFRNFVGQAATSPGISGQTIQESMRLLLLVRAYQVNGHMKAKLDPLGLEEREIPADLDPGLYGFTEADLDREFFLGVWRMAGFLSENRPVQTLRSILNRLEQAYCGYIGFEYMHIADRDKCNWLRDKIETVEPMKYSQERREVILDRLIWSTQFENFLATKWTAAKRFGLEGAETLIPGMKEMFDRSADLGVESIVIGMSHRGRLNVLGNVVRKPLRQIFSEFSGGTKPVDGEVGLYTGTGDVKYHLGTSYDRPTRGGKRIHLSLVANPSHLEAVDPVVVGKTRAKQYYSNDTERKKNMGVLIHGDGSFAGQGVVYETLHLSALPNYTTGGTIHIVVNNQVAFTTDPRSGRSSQYCTDVAKALNAPIFHVNGDDVEAVVHVCELAAEWRQLFQSDVVVDIICYRRFGHNEIDEPSFTQPKMYQVIRNHPRALDIYQDQLIKSGQISKENIDRINNKVSTILNEEFVNSKDDVPRKRDWLAAYWSGFKSPEQISRIRNTGVKPEILKTVGKAITTLPENFKPHRAVKKIFELRGQMIETGEGIDWAVGEALAFATLIVEGNHVRLSGQDVERGTFSHRHSVIHDQETGEKYCPLDHLILNQNEEMFTVSNSSLSEFGVLGFELGYSMENPNSLVLWEAQFGDFSNGAQVIFDQFLSSGESKWLRQTGLVVLLPHGYDGQGPEHSSARLERFLQMSDDNPFVIPEMDSTLRKQIQECNWQVVNVTTPANYFHVLRRQINREFRKPLIVMSPKNLLRHKDCKSNLSEFDDVQGHPGFDKQGTRFKRLIKDQNDHSDLEEGIRRLILCSGKVYYELDEERKKVDGKDLAICRVEQLCPFPYDLIQRELKRYPNAEIVWCQEEPMNMGAYPYITPRLLTAMKALGRGSYEDIKYVGRAPSAATATGFYQVHVQEHTELIQKALQPDPIKFP

SEQ ID NO: 5729 - protein, 1016 aa, Brachypodium distachyon
MGWFRAASGLARVALRRNLSRVPASPFAGPAPRYFHSTRPRRFAAPEPRAVPLSRLTDSFLDGTSSVYLEELQRAWEADPNSVDESWDNFFRNFVGQASTSPGISGQTIQESMRLLLLVRAYQVSGHLKAKLDPLGLEERPVPDVLDPAFYGFSEADLDREFFLGVWKMAGFLSDNRPVQTLRSVVERLEQAYCGTIGYEYMHIPDREKCNWLRERIETVNPREYTYDRRQVMLDRLIWSTQFENFLAQKWTTAKRFGLEGAETLIPGMKEMFDRAADLGVESIVIGMPHRGRLNVLGNVVRKPLRQIFSEFSGGTKPVNEGEGLYTGTGDVKYHLGTSYDRPTRGGKHIHLSLVANPSHLEAVDPVVAGKTRAKQYYSNDLDRTKNLGVLLHGDGSFSGQGVVYETLHLSALPNYSTGGTIHIVVNNQVAFTTDPLSGRSSQYCTDVAKALDAPIFHVNGDDLEAVVHTCELAAEWRQTFHSDVVVDIVCYRRFGHNEIDEPSFTQPKMYKVIRNHPSALEIYQKQMLESGKLSKEDIDKLHTKVNTILNEEFKKSKDDIPNKRDWLSAYWTGFKSPEQISRVRNTGVKPEILKRVGEAMTTLPENFKPHRAVKKIFDLRRQMIETGEGIDWAVGEALAFATLIIEGNHVRLSGQDVERGTFSHRHSVVHDQETGQHYCPLDNLVMNQNEELFTVSNSSLSEFAVLGFELGYSMENPNSLVLWEAQFGDFSNGAQVIFDQFISSGEAKWLRQSGLVVCLPHGYDGQGPEHSSARMERFLQMSDDNPYVIPEMDSTTRKQIQQCNLQVVNVTTPANYFHVLRRQIHRDFRKPLIVMSPKNLLRHKECKSSLSEFDDVAGHPGFDKQGTRFKRLIKDRNDHKDLEEGINRLVLCSGKVYYELDEERKKSDRNDVAICRVEQLCPFPYDLIQRELKRYPNAEIVWCQEEPMNMGAYTYINPRLLTAMRALGRGTIEDIKYAGRAPSAATATGFYSVHGQEQTELVQKALQRDPIKCPF

SEQ ID NO: 5730 - protein, 1025 aa, Zea mays
MGLFRAASGLARLALRRNLSRAAASPFAGSGGAVPGAMPARYFHSTRPRRFAAPAPRAVPLSRLTDSFLDGTSSVYLEELQRAWEADPNSVDESWDNFFRNFVGQAAATSPGLSGQTIQESMRLLLLVRAYQVSGHLKAKLDPLGLEERPVPDVLDPGFYGFSEADLDREFFLGVWMMAGFLSENRPVQTLRSVLERLEQAYCGTIGYEYMHIPDREKCNWLRDRIETVNPREYTYDRRQVMLDRLIWSTQFENFLATKWTTAKRFGLEGAETLIPGMKEMFDRAADLGVESIVIGMPHRGRLNVLGNVVRKPLRQIFSEFSGGTKPVNEGEGLYTGTGDVKYHLGTSYDRPTRGGKHIHLSLVANPSHLEAVDPVVAGKTRAKQYYSNDRDRTKNLGVLLHGDGSFSGQGVVYETLHLSALENYTTGGTIHIVVNNQVAFTTDPRSGRSSQYCTDVAKALDAPIFHVNGDDLEAVVHVCELAAEWRQTFHSDVVVDIVCYRRFGHNEIDEPSFTQPKMYKVIRNHPSALEIYQRKLLESGKISKEDIDKLNKKVSTILNEEFQNSKDYVPNKRDWLSAYWTGFKSPEQISRIQNTGVKPEILKRVGEAMTTLPENFNPHRAVKKIFYQRRQMIETGEGIDWAVGEALAFATLIIEGNHVRLSGQDVERGTFSHRHSVLHDQETGEQYCPLDHLVMNQDEELFTVSNSSLSEFAVLGFELGYSMENPNSLVIWEAQFGDFSNGAQVIFDQFLSSGESKWLRQTGLVVCLPHGYDGQGPEHSSARLERFLQMSDDNPYVIPEMDPTLRKQIQQCNWQVVNVTTPANYFHVLRRQIHRDFRKPLIVMSPKNLLRHKDCKSNLSEFDDLAGHPGFDKQGTRFKRLIKDQNNHKDLEEGINRLVLCSGKVYYELDEERRKTERTDVAICRVEQLCPFPYDLIQRELKRYPNAEIVWCQEEPMNMGAYSYINPRLLTAMKALGRGGIEDIKYVGRAPSAATATGFYSVHVQEQTELVQKALQRDPINYPF

SEQ ID NO: 5731 - protein, 1021 aa, Manihot esculenta
MGWFRAGTSVARLAIRRTLSQSGSYTTRTRLIPSQSRYFHTTVFKSKAQSAPVPRPVPLSRLTDSFLDGTSSVYLEELQRAWEADPNSVDESWDNFFRNFVGQAATSPGISGQTIQESMRLLLLVRAYQVNGHMKAKLDPLGLEEREIPDDLDPALYGFTEADLDREFFLGVWRMSGFLSENRPVQTLRSILTRLEQAYCGSIGFEYMHIADRDKCNWLRDKIETPTPMQYNRQRREVILDRLIWSTQFENFLATKWATAKRFGLEGGETLIPGMKEMFDRSADLGVESIVIGMPHRGRLNVLGNVVRKPLRQIFSEFSGGTKPVDEVGLYTGTGDVKYHLGTSYDRPTRGGKRIHLSLVANPSHLEAVDPVVVGKTRAKQFYSNDEQRTKNMGVLIHGDGSFAGQGVVYETLHLSALPNYTTGGTIHIVVNNQVAFTTDPRAGRSSQYCTDVAKALDAPIFHVNGDDVEAVVHACELAAEWRQTFHSDVVVDLVCYRRFGHNEIDEPSFTQPKMYQVIRNHPSSLEIYRKRLLESGQVGEEDIQKIQEKVNSILNEEFLASKDYVPKRRDWLSSHWAGFKSPEQLSRIRNTGVKPEILKNVGKAITTFPDNFKPHRGVKKVYEQRAQMIETGEGIDWAVAEALAFATLVVEGNHVRLSGQDVERGTFSHRHSVVHDQETGEKYCPLDHLVINQDEELFTVSNSSLSEFAVLGFELGYSMENPNSLVIWEAQFGDFANGAQVIFDQFLSSGESKWLRQTGLVVLLPHGYDGQGPEHSSARLERFLQMSDDNPYVIPDMDPTLRKQIQECNWQVVNVTTPANYFHVLRRQLHREFRKPLIVMAPKNLLRHKDCKSNLSEFDDVQGHPGFDKQGTRFKRLIKDQNDHSDLEEGIRRLVLCSGKVYYELDEERKKNGAKDIAICRVEQLCPFPYDLIQRELKRYPNAEIVWCQEEPMNMGAYNYILLRLCTAMKALGRGSLEDIKYVGRAPSAATATGFYQVHVKEQTELIQKAMQPEPIKYPS

SEQ ID NO: 5732 - protein, 1025 aa, Zea mays
MGLFRAASGLARLALRRNLLRAAASPFAAGGGAVPGAAPARYFHSTCPRRFAAPTPRAVPLSRLTDSFLDGTSSVYLEELQRAWEADPSSVDESWDNFFRNFVGQAATTSPGLSGQTIQESMRLLLLVRAYQVSGHLKAKLDPLGLEERPVPDVLDPAFYGFSEADLDREFFLGVWMMAGFLSENRPVQTLRSVLERLEQAYCGTIGYEYMHIPDREKCNWLRDRIETVNPMDYTYDRRQVMLDRLIWSTQFESFLATKWTTAKRFGLEGAETLIPGMKEMFDRAAHLGVESIVIGMPHRGRLNVLGNVVRKPLRQIFSEFSGGTKPVNEGEGLYTGTGDVKYHLGTSYDRPTRGGKHIHLSLVANPSHLEAVDPVVAGKTRAKQYYSNDRDRTKNLGVLLHGDGSFSGQGVVYETLHLSALENYTTGGTIHIVVNNQVAFTTDPRSGRSSQYCTDVAKALDAPIFHVNGDDLEAVVHVCELAAEWRQTFHSDVVVDIVCYRRFGHNEIDEPSFTQPKMYKVIRNHPSALEIYQRKLLESGKISKEDIDRLNKKVSTILNEEFQNSKDYVPNKRDWLSAYWTGFKSPEQISRIRNTGVKPEILKRVGEAMTTLPENFKPHRAVKKIFDLRRQMIETGEGIDWAVGEALAFATLIIEGNHVRLSGQDVERGTFSHRHSVIHDQETGEQYCPLDHLVMNQDAELFTVSNSSLSEFAVLGFELGYSMENPNSLVLWEAQFGDFSNGAQVIFDQFLSSGESKWLRQTGLVVCLPHGYDGQGPEHSSARLERFLQMSDDNPYVIPEMDPTLRKQIQQCNWQVVNVTTPANYFHVLRRQIHRDFRKPLIVMSPKNLLRHKDCKSNLSEFDDLAGHPGFDKQGTRFKRLIKDQNNHKDLEEGINRLVLCSGKVYYELDEERRKSERTDVAICRVEQLCPFPYDLIQRELKRYPNAEIVWCQEEPMNMGAYSYINPRLLTAMKVLGRGGIEDIKYVGRAPSAATATGFYSVHVQEQTELVQKALQRDPLNYPF

SEQ ID NO: 5733 - protein, 1016 aa, Oryza sativa
MGWFRAASGLARVALRRNLARAPANPFAGPAPRYFHSTRPRRFAAPVPRAVPLSRLTDSFLDGTSSVYLEELQRAWEADPTSVDESWDNFFRNFVGQAATSPGISGQTIQESMRLLLLVRAYQVSGHLKAKLDPLALEERPIPDVLDPAFYGFSEADLDREFFLGVWRMAGFLSENRPVQTLRSVLERLEQAYCGTIGYEYMHIPDREKCNWLRDRIETVNAREYSYDRRQVMLDRLMWSTQFESFLAQKWTTAKRFGLEGAETLIPGMKEMFDRAADLGVESIVIGMPHRGRLNVLGNVVRKPLRQIFSEFSGGTKPAEEGEGLYTGTGDVKYHLGTSYDRPTRGGKHIHLSLVANPSHLEAVDPVVAGKTRAKQYYSNDLDRTKNLGVLLHGDGSFSGQGVVYETLHLSALPNYTTGGTIHIVVNNQVAFTTDPRAGRSSQYCTDVAKALDAPIFHVNGDDLEAVVHVCELAAEWRQTFHSDVVVDIVCYRRFGHNEIDEPSFTQPKMYKIIRNHQSALEIYQNRLLESGKISKEDIDKMQKKVSTILNDEFQNSKEYIPNKRDWLSAYWTGFKSPEQISRIRNTGVKPEILKRVGEAMTTLPENFKPHRAVKKIFELRRQMIETGEGIDWAVGEALAFATLIIEGNHVRLSGQDVERGTFSHRHAVIHDQETGEQYCPLDNLVMNQDEELFTVSNSSLSEFAVLGFELGYSMENPNSLVLWEAQFGDFSNGAQVIFDQFLSSGEAKWLRQTGLVVCLPHGYDGQGPEHSSARLERFLQMSDDNPYVIPEMDPTLRKQIQQCNWQVVNVTTPANYFHVLRRQIHRDFRKPLIVMSPKNLLRHKDCKSNLSEFDDLAGHPGFDKQGTRFKRLIKDQNNHKDLEEGIKRLVLCSGKVYYELDEERRKKERDDVAICRVEQLCPFPYDLIQRELKRYPNAEIVWCQEEPMNMGAYSYINPRLLTAMRALGRGTIDDIKYVGRAPSAATATGFYSVHVQEQTELVQKALQRDPINSPF

SEQ ID NO: 5734 - protein, 1021 aa, Musa acuminata
MAWFRAASGVARLALRRNLARTPYHVARAGALPRFQPARCFHSTQLRRAAPVPRPVPLSRLTDSFLDGTSSVYLEELQRAWEADPSSVDESWDNFFRNFVGQAATSPGISGQTIQESMRLLLLVRAYQVNGHMKAKLDPLDLEEREMSDDLDLALYGFTEADLDREFFLGVWRMSGFLSENRPVQTLRSILERLEQAYCGTVGYEYMHIPNRDQCNWLRERIETVKPREYSQERRQVILDRLTWSTLFENFLATKWKAAKRFGLEGGETLIPGMKEMFDRAADLGVESIVIGMPHRGRLNVLGNVVRKPLRQIFSEFSGGTKPVEEGEGLYTGTGDVKYHLGTSYDRPTRGGKMIHLSLVANPSHLEAVDPVVVGKARAKQYYSNDIERTRNMGVLIHGDGSFAGQGVVYETLHLSALPNYTTGGTIHIVVNNQVAFTTDPKCGRSSQYCTDVAKALSVPIFHVNGDDVEAVVHVCELAAEWRQTFHSDVVVDVVCYRRFGHNEIDEPSFTQPKMYRVIQDHPSALELYEKELLESGRISKDDVDRMRNKVSTILEEEFINSKDYVPRKRDWLSAYWAGFKSPEQISRIRNTGVKPEILKRVGQAITTLPENFKPHRAIKRIFQQRAEMIETEEGIDWALAEALAFATLIVEGNHVRLSGQDVERGTFSHRHAVVHDQETGEMYCPLDHIIINQDEEMFTVSNSSLSEFGVLGFELGYSMENPNSLVLWEAQFGDFANGAQVMFDQFLSSGEAKWLRQTGLAVLLPHGYDGQGPEHSSGRVERFLQMSDDNPYIIPEMDPTLRKQIQECNWQVVNVTTPANYFHVLRRQLHRDFRKPLIVMSPKNLLRHKDCKSHLSEFDDVLGHPGFDKQGTRFKRLIKDRNDHKEIEEGIDRLILCSGKVYYELDEARKNTKRNDVAICRVEQLCPFPYDLIQRELKRYPNAEIVWCQEEPMNMGAYSYVNPRIYTAMRAISRGNIEDIKYVGRAPSAATATGFLSVHVQEQKEILHKAMQPEPIGFPF

SEQ ID NO: 5735 - protein, 1021 aa, Manihot esculenta
MAWFRAGTSVARLAIRRTLSQSGSYTTRTRIIPSQSRYFHTTVFKSKAQTAPVPRPVPLSRLTDSFLDGTSSVYLEELQRAWEADPNSVDESWDNFFRNFVGQAATSPGISGQTIQESMRLLLLVRAYQVNGHMKAKLDPLGLEEREIPEDLDPALYGFTEADLDREFFLGVWRMSGFLSENRPVRTLRSILTRLEQAYCGSIGFEYMHIADHDKCNWLRDKIETPTPMQYNRQRREVILDRLIWSTQFENFLATKWTTAKRFGLEGGETLIPGMKEMFDRAADLGVESIVIGMPHRGRLNVLGNVVRKPLRQIFSEFSGGTKPVDEVGLYTGTGDVKYHLGTSYDRPTRGGKRIHLSLVANPSHLEAVDPVVIGKTRAKQYYSNDEHRTKNMGVLIHGDGSFAGQGVVYETLHLSALPSYTTGGTIHIVVNNQVAFTTDPRAGRSSQYCTDVAKALNAPIFHVNGDDVEAVVHACELAAEWRQTFHSDVVVDLVCYRRFGHNEIDEPSFTQPKMYQVIRNHPSSLEIYQKKLLESSQVGEEDILKIQEKVNKILNEEFLASKDYVPKRRDWLSSHWAGFKSPEQISRIRNTGVKPEILKNVGKAITTFPDNFKPHRAVKKVYEQRAQMIETGEGIDWALAEALAFATLVVEGNHVRLSGQDVERGTFSHRHSVVHDQETGEKYCPLDHVIMNQNEEMFTVSNSSLSEFGVLGFELGYSMENPNSLVIWEAQFGDFANGAQVIFDQFLSSGESKWLRQTGLVVLLPHGYDGQGPEHSSARLERFLQMSDDNPYVIPEMDPTLRKQIQECNWQVVNVTTPANYFHVLRRQLHRGFRKPLVVMAPKNLLRHKDCKSNLSEFDDVQGHPGFDKQGTRFKRLIKDQNDHSDLEKGIRRLVLCSGKVYYELDEERKKNSAQDVAICRVEQLCPFPYDLIQRELKRYPNAEIVWCQEEPMNMGAYSYIAPRLCTAMKELERGSIEDIKYVGRAPSASTATGFYQVHVKEQTELLQKAMQPEPIKYPF

SEQ ID NO: 5736 - protein, 1019 aa, Chelidonium majus
MAWFRAASSLAKLAAKKNLAQTRSYVTRTRAIRSQSQFFHTTAYRSNAAPVPRPVPLSRLTDSFLDGTSSVYLEELQRAWETDPSSVDESWDNFFRNFVGQASTSPGISGQTIQESMRLLLLVRAYQVNGHMKAKLDPLGLEERVIPDDLDPAIYGFSEADLDREFFLGVWRVSGFMSENRPVQTLRAILTRLEQAYCGSIGYEYMHISDRDKCNWLRDKIETPTPRQYNSQRREVMLDRLMWSTQFENFLATKWTAAKRFGLEGGETLIPGMKEMFDRAADMGVESIVIGMSHRGRLNVLGNVVRKPLRQIFSEFSGGTKPIDEVGLYTGTGDVKYHLGTSYDRPTRGGKRLHLSLVANPSHLEAVDPLVVGKTRAKQYYSNDVDRTKNLGVLIHGDGSFAGQGVVYETLHLSALPNYTTGGTIHIVVNNQVAFTTDPRAGRSSQYCTDVAKALECPIFHVNGDDLEAVVHACELAAEWRQTFHSDVVVDIICYRRFGHNEIDEPSFTQPKMYQIIRNHPSALEIYQKTLLESEQISQEDIDRMQTKVNSILNEEFINSKDYVPKRRDWLAAYWTGFKSPEQISRVRNTGVKPEILKNVGKAITSLPDTFKPHRAVKKIFEQRAQMIESGEGIDWAVGEALAFATLLVEGNHVRLSGQDVERGTFSHRHSVIHDQETGEKYCPLDHVTMNQNEEMFTVSNSSLSEFGVLGFELGYSMENPNSLVIWEAQFGDFSNGAQVMFDQFLSSGESKWLRQTGLVVLLPHGYDGQGPEHSSARLERFLQMSDDNPYVIPEMEPTLRKQIQECNWQVANVTTPANYFHLLRRQIHREFRKPLIVMAPKNLLRHKDCKSNLSEFDDVKGHPGFDKQGTRFKRLIKDQRDRSDLEEGVRRLVLCSGKVYYELDEERKKVNGDDVAICRVEQLSPFPYDLIQRELKRYPNAEVVWCQEEPMNMGAYSYIAPRLCNAMKALGRGTYEDIKYIGRAPSAATATGFYTVHTKEQTELVQKALQPEPINYPY

SEQ ID NO: 5737 - protein, 1019 aa, Malus domestica
MSWFRAGSSVAKLAIRRSLSNSGSYAARRRVLPSQSRDFHTTISKSRAAPVPRPVPLSRLTDSFLDGTSSVYLEGLQRAWEADPNSVDESWDNFFRNFVGQASTSPGISGQTIQESMRLLLLVRAYQVNGHMKAKLDPLGLEERDIPDDLDPALYGFTESDLDREFFLGVWRMAGFLSENRPVQTLRSILTRLEQAYCGTIGYEYMHIADRERCNWLRDKIETPTPMQYNRQRREVILDRLIWSTQFENFLATKWTTAKRFGLEGGETLIPGMKEMFDRAADLGVESIVIGMPHRGRLNVLGNVVRKPLRQIFSEFSGGTKPVDEVGLYTGTGDVKYHLGTSYDRPTRGGKRIHLSLVANPSHLEAVDPVVVGKTRAKQYYSNDADRTKNMGILIHGDGSFAGQGVVYETLHLSALPNYTTGGTIHIVVNNQVAFTTDPMSGRSSQYCTDVAKALNAPIFHVNGDDMEAVVHVCELAAEWRQTFHSDVVVDLVCYRRFGHNEIDEPSFTQPNMYKVIRNHPSALTIYQNKLLESGQVTKEDIERIQNKVNSILNEEFLSSKDYVPQRRDWLSSHWSGFKSPEQISRIRNTGVKPEILKSVGKAVTALPETFKPHRAVKKVYEQRGQMIETGEGIDWAVAEALAFATLLVEGNHVRLSGQDVERGTFSHRHSVLHDQETGEKYCPLDHITAGQDEEMFTVSNSSLSEFGVLGFELGYSMESPNALVIWEAQFGDFANGAHVIFDQFLSSGESKWLRQTGLVVLLPHGYDGQGPEHSSARLERFLQMSDDNPFVIPEMDPTLRKQIQECNWQVVNVTTPANYFHVLRRQIHREFRKPLIVMAPKNLLRHKDCKSNLSEFDDVQGHPGFDKQGTRFKRLIKDQNHHSDLEEGIRRLVLCSGKVYYELDEQRRKVEAKDVAICRVEQLCPFPYDLIQRELKRYPNAEIVWVQEEPMNMGAYSYIAPRLSTAMKSLGRGTIDDIKYIGRAPSAASATGFYSVHLKEQSEIVQKAVQKEPIESHS

SEQ ID NO: 5738 - protein, 1022 aa, Cucumis sativus
MGLFRAGSALAKVAIRRTLAQGGGSYAARSRIISSQNRYFHTTLFKPKAQSAPVPRPVPLSKLTDSFLDGTSSVYLEELQRAWEDDPNSVDESWDNFFRNFVGQAATSPGISGQTIQESMRLLLLVRAYQVNGHMKAKLDPLNLEEREIPDDLDPALYGFTDADLDREFFLGVWRMAGFLSENRPVQTLRSILTRLEQAYCGSVGYEYMHIADRNKCNWLRDKIETPTPMQYNRQRREVILDRLIWSTQFENFLATKWTTAKRFGLEGGETLIPGMKEMFDRAADLGVESIVIGMPHRGRLNVLGNVVRKPLRQIFSEFSGGTKPVDEVGLYTGTGDVKYHLGTSYDRPTRGGKHIHLSLVANPSHLEAVDPVVVGKTRAKQYYSNDIERIKNMGILIHGDGSFAGQGVVYETLHLSALPNYTTGGTIHIVVNNQVAFTTDPRAGRSSQYCTDVAKALDAPIFHVNGDDMEAVVHVCELAAEWRQTFHSDVVVDLVCYRRFGHNEIDEPSFTQPKMYQVIRNHPSSLEIYQKKLLESGQVSQEDINKIRDKVNKILNEEFLASKDYVPKRRDWLSAYWSGFKSPEQISRVRNTGVKPEILKNVGKAITVFPENFKPHRAVKKVYEQRAQMIETGEGIDWALGEALAFATLLVEGNHVRLSGQDVERGTFSHRHSVVHDQETGAIYCPLDHVIMNQNEELFTVSNSSLSEFGVLGFELGYSMENPNSLVIWEAQFGDFSNGAQVIFDQFLSSGEAKWLRQTGLVVLLPHGYDGQGPEHSSARLERFLQMSDDNPFVIPEMDSTLRKQIQECNWQVVNVTTPANYFHVLRRQIHREFRKPLVVMAPKNLLRHKDCKSNLSEFDDVQGHPGFDKQGTRFKRLIKDQNNHSDHEEGIRRLVLCSGKIYYELDDERTKSDGKDVAICRVEQLCPFPYDLIQRELKRYPNAEVVWCQEEPMNMGAFTYISPRLATAMRALGRGTFEDIKYVGRAPSASTATGFYTVHVKEQTELVKKALQPEPINSSF

SEQ ID NO: 5739 - protein, 1022 aa, Tripterygium wilfordii
MAWFRAGSGLVRLAIRRTLSQSGSSYTGRTRILPAQNRYFHSTVFKSKAQAAPVPHPVPLSRLTDSFLDGTSSVYLEELQRAWEADPNSVDESWDNFFRNFVGQAATSPGISGQTIQESMRLLLFVRAYQVNGHMKAKLDPLGLEEREIPEDLDPALYGFSEADLDREFFLGVWRMSGFLSENRPVQTLRSILTRLEQAYCGSIGYEYMHIPDRDQCNWLREKIETPTPTQYNRQRREVILDRLIWSTQFENFLATKWTTAKRFGLEGGESLIPGMKEMFDRSADLGVENIVIGMPHRGRLNVLGNVVRKPLRQIFSEFSGGTKPVDEVGLYTGTGDVKYHLGTSYDRPTRGGKRIHLSLVANPSHLEAVDPVVVGKTRAKQYYSNDLDRTKNMGILIHGDGSFAGQGVVYETLHLSALPNYTTGGTIHIVVNNQVAFTTDPKAGRSSQYCTDVAKALNAPIFHVNGDDIEAVVHVCELAAEWRQTFHSDAVVDLVCYRRFGHNEIDEPSFTQPKMYQVIRNHPSSLEIYQKKLLESGQVTKEDIDRIQEKVNSILNEEFLASKDYVPKRRDWLASHWSGFKSPEQLSRIRNTGVKPEILKNVGKAITALPDTFKPHRGVKKVYEQRAQMIETGEGIDWALAEALAFATLLVEGNHVRLSGQDVERGTFSHRHSVLHDQETGDMYCPLDHVIMNQNEEMFTVSNSSLSEFGVLGFELGYSMENPNSLVLWEAQFGDFANGAQVIFDQFLSSGESKWLRQTGLVLLLPHGYDGQGPEHSSARLERFLQMSDDNPFVIPEMDPTMRKQIQECNWQVVNVTTPANYFHVLRRQLHRDFRKPLVVMSPKNLLRHKECRSNLSEFDDVKGHPGFDKQGTRFKRLIKDQNLHSDLEEGIRRLVLCSGKIYYELDEERRKVNANDVAICRVEQLCPFPYDLIQRELKRYPNAEIVWCQEEPMNMGAYSYISPRLFTAMKALGRGGMDDIKYAGRAPSAATATGFYQAHVKEQSELVHKALQPEPVNYPC

SEQ ID NO: 5740 - protein, 784 aa, Papaver somniferum
MLDRLMWSTQFENFLATKWTAAKRFGLEGGETLIPGMKEMFDRAADLGVESIVIGMSHRGRLNVLGNVVRKPLAQIFSEFSGGIKPIDEVGLYTGTGDVKYHLGTSYDRPTRGGKRIHLSLVANPSHLEAVDPVVVGKTRAKQYYSNDVERTKNLGILIHGDGSFAGQGVVYETLHLSALPNYTTGGTIHIVVNNQVAFTTDPSAGRSSQYCTDVAKALNAPILHVNGDDLEAVVHVCELAAEWRQMFHSDVVVDIVCYRRFGHNEIDEPSFTQPKMYQVIRNHPSALEIYQKKLVEQGQIGQDDIDRIHSKVSGILNEEFLKSKDYVPKKRDWLSAYWTGFKSPEQISRVHNTGVKPEILKTVGKAITTLPETFKPHRAVKKIFEQRAQMIETEEGIDWAVGEALAFATLLVEGNHVRLSGQDVERGTFSHRHAVLHDQLSGDKYCPLDHIVMNQNEELFTVSNSSLSEFGVLGFELGYSMENPNSLVIWEAQFGDFSNGAQVIFDQFLSSGESKWLRQTGLVVLLPHGYDGQGPEHSSARLERFLQMSDDNPYVIPEMDPTLRKQIQECNWQVVNITTPANYFHVLRRQIHREFRKPLVVMAPKNLLRHKDCKSNLSEFDDVQGHPGFDKQGTRFKRLIKDQNDHSDLEEGIRRLVLCSGKVYYELDEERKKAQGKDVAICRVEQLCPFPYDLIQRELKRYPNAEIVWCQEEPMNMGAYNYIAPRLWTAMRALGRGGLDDIKYVGRAPSAATATGFYTVHTKEQTELVKKAIQPEPIQQYAC

SEQ ID NO: 5741 - protein, 411 aa, Papaver somniferum
MTWFRAASSVAKLAAKRNLTQVRSYTTRTRLIPSQARGFHSTIFNSKAASSAPVPRAVPLSRLTDSFLDGTSSVYLEELQRAWEADPSSVDESWDNFFRNFVGQAATSPGISGQTIQESMRLLLLVRAYQVNGHMKANLDPLALEEREIPDELDPALYGFTEADLDREFFLGVWKMAGFLSENRPVQTLRGILTRLEQAYCGSVGYEYMHIADREKCNWLRDKIETPTPRQYNQQRREVMLDRLMWSTQFENFLATKWTAAKRFGLEGGETLIPGMKEMFDRAADLGVESIVIGMSHRGRLNVLGNVVRKPLAQIFSEFSGGIKPIDEVGLYTGTGDVKYHLGTSYDRPTRGGKRIHLSLVANPSHLEAVDPVVVGKTRAKQYYSNDVERTKKFGYIDSWRWKFCRSGCGL

SEQ ID NO: 5742 - protein, 993 aa, Panicum virgatum
AAPGAAPARYFHSTRPRRFAAPAPRAVPLSRLTDSFLDGTSSVYLEELQRAWEADPNSVDESWDNFFRNFVGQAATTSPGLSGQTIQESMRLLLLVRAYQVSGHLKAKLDPLGLEERPVPDVLDPAFYGFSEADLDREFFLGVWRMAGFLSDNRPVQTLRSVLERLEQAYCGTIGYEYMHIADREKCNWLREKIETVNPREYTYDRRQVMLDRLIWSTQFENFLATKWTTAKRFGLEGAETLIPGMKEMFDRAADLGVESIVIGMPHRGRLNVLGNVVRKPLRQIFSEFSGGTKPVNEGEGLYTGTGDVKYHLGTSYDRPTRGGKHIHLSLVANPSHLEAVDPVVAGKTRAKQYYSNDRDRTKNLGVLLHGDGSFSGQGVVYETLHLSALENYTTGGTIHIVVNNQVAFTTDPKSGRSSQYCTDVAKALDAPIFHVNGDDLEAVVHVCELAAEWRQTFHSDVVVDIVCYRRFGHNEIDEPSFTQPKMYKVIRNHPSALEIYQNKLLESGKISKEDIDRLNKKVSTILNEEFKNSKDYVPNKRDWLSAYWTGFKSPEQISRIRNTGVKPEILKRVGEAMTTLPENFKPHRAVKKIFDQRRQMIETGEGIDWAVGEALAFATLIVEGNHVRLSGQDVERGTFSHRHSVIHDQETGERYCPLDNLVMNQDEELFTVSNSSLSEFAVLGFELGYSMENPNSLVLWEAQFGDFANGAQVIFDQFLSSGESKWLRQTGLVVCLPHGYDGQGPEHSSARLERFLQMSDDNPYVIPEMDPTLRKQIQQCNWQVVNVTTPANYFHVLRRQIHRDFRKPLIVMSPKNLLRHKDCKSNLSEFDDLAGHPGFDKQGTRFKRLIKDQNNHKDLEEGINRLVLCSGKVYYELDEERRKTERTDVAICRVEQLCPFPYDLIQRELKRYPNAEIVWCQEEPMNMGAYSYINPRLLTAMKALGRGSIEDIKYVGRAPSAATATGFYSVHVQEQTELVQKALQRDPINYSF

SEQ ID NO: 5743 - protein, 1022 aa, Amsonia hubrichtii
MAWFRAGSNVAKLAVRRTLAQGGGSYAARTRVIPPQSRYFHTTVFRRKAQSAPIPRPVPLSKLTDSFLDGTSSVYLEELQRAWEQDPDSVDESWDNFFRNFVGQAATSPGISGQTIQESMRLLLLVRAYQVYGHMKAKLDPLGLEQREIPDDLDPALYGFTEGDLDREFFIGVWRMSGFLSENRPVQTLRAILTRLEQAYCGTIGYEYMHIADREKCNWLRDRIETPTPTEYNRERREVILDRLIWSSQFENFLATKWTAAKRFGLEGAETLIPGMKEMFDRSADLGVENIVIGMSHRGRLNVLGNVVRKPLRQIFSEFSGGTKPSDEVGLYTGTGDVKYHLGTSYDRPTRGGKRIHLSLVANPSHLEAVDPVVVGKTRAKQYYSNDVDRTRNMGILIHGDGSFAGQGVVYETLHLSALPNYTTGGTIHIVVNNQVAFTTDPRAGRSSQYCTDVAKALNAPIFHVNGDDVEAVVHACELAAEWRQTFHSDVVVDIVCYRRFGHNEIDEPSFTQPKMYKVIRSHPSALEIYQQKLLESGQVSKEDIDRISKKVNSILNEEFVASKDYVPQRRDWLSAYWAGFKSPEQLSRIRNTGVKPEILKNVGKAITSLPENFKPHRAVKRVYDERAKMIETGEGIDWALGEALAFATLLVEGNHVRLSGQDVERGTFSHRHSVLHDQVTGEQYCPLDHVMMNQNEEMFTVSNSSLSEFGVLGFELGYSMENPNSLVLWEAQFGDFSNGAQVIFDQFVSSGEAKWLRQTGLVVLLPHGYDGQGPEHSSARLERFLQMSDDNPYVIPEMDPTLRKQIQECNWQVVNVTTPANYFHVLRRQLHREFRKPLIVMSPKNLLRHKECKSNLSEFDDVQGHPGFDKQGTRFKRLIKDQNDHSDLEEGISRLILCSGKVYYELDEQRRKVERKDVAICRVEQLCPFPYDLIQRELKRYPNAEIVWCQEEPMNMGAYSYISPRLCTAMKALGRGDMDDIKYVGRAPSAATATGFLQVHFKEQTELVQKALQPEPINYPC

SEQ ID NO: 5744 - protein, 1023 aa, Papaver somniferum
MTWFRAASSVAKLAAKRNLTQVRSYTTRTRLIPSQARGFHSTIFNSKAASSAPVPRAVPLSRLTDSFLDGTSSVYLEELQRAWEADPSSVDESWDNFFRNFVGQAATSPGISGQTIQESMRLLLLVRAYQVNGHMKANLDPLALEEREIPDELDPALYGFTEADLDREFFLGVWKMAGFLSENRPVQTLRGILTRLEQAYCGSVGYEYMHIADREKCNWLRDKIETPTPRQYNQQRREVMLDRLMWSTQFENFLATKWTAAKRFGLEGGETLIPGMKEMFDRAADLGVESIVIGMSHRGRLNVLGNVVRKPLAQIFSEFSGGIKPIDEVGLYTGTGDVKYHLGTSYDRPTRGGKRIHLSLVANPSHLEAVDPVVVGKTRAKQYYSNDVERTKNLGILIHGDGSFAGQGVVYETLHLSALPNYTTGGTIHIVVNNQVAFTTDPSAGRSSQYCTDVAKALNAPILHVNGDDLEAVVHVCELAAEWRQMFHSDVVVDIVCYRRFGHNEIDEPSFTQPKMYQVIRNHPSALEIYQKKLVEQGQIGQDDIDRIHSKVSDILNEEFLKSKDYVPKKRDWLSAYWTGFKSPEQISRVHNTGVKPEILKTVGKAITTLPETFKPHRAVKKIFEQRAQMIETEEGIDWAVGEALAFATLLVEGNHVRLSGQDVERGTFSHRHAVLHDQLSGDKYCPLDHIVMNQNEELFTVSNSSLSEFGVLGFELGYSMENPNSLVIWEAQFGDFSNGAQVIFDQFLSSGESKWLRQTGLVVLLPHGYDGQGPEHSSARLERFLQMSDDNPYVIPEMDPTLRKQIQECNWQVVNITTPANYFHVLRRQIHREFRKPLVVMAPKNLLRHKDCKSNLSEFDDVQGHPGFDKQGTRFKRLIKDQNDHSDLEEGIRRLVLCSGKVYYELDEERKKAQGKDVAICRVEQLCPFPYDLIQRELKRYPNAEIVWCQEEPMNMGAYNYIAPRLWTAMRALGRGGLDDIKYVGRAPSAATATGFYTVHTKEQTELVKKAIQPEPIQQYAC

SEQ ID NO: 5745 - protein, 1021 aa, Nicotiana benthamiana
MAWFRAGSSVARLAIRRALSQGGSYVPRTRVLPSQGRCFHTTIARPKAQAAPVPRPVPLSKLTDSFLDGTSSVYLEELQRAWEQDPNSVDESWDNFFRNFVGQAATSPGISGQTIQESMRLLLLVRAYQVNGHMKAKLDPLGLEEREIPDDLDPALYGFTEADLDREFFLGVWRMSGFLSENRPVQTLRAILTRLEQAYCGSIGYEYMHISDRDKCNWLRERIETPTSMEYNRERREVILDRLMWSTQFENFLATKWMAAKRFGLEGCETLIPGMKEMFDRAADLGVESIVIGMPHRGRLNVLGNVVRKPLKQIFSEFSGGTKPGDEAGYVGTGDVKYHLGTSYDRPTRGGKRIHLSLVANPSHLEAVDPVVIGKTRAKQYYSNDVDRTKNMGILLHGDGSFAGQGVVYETLHLSALPNYSTGGTIHIVVNNQVAFTTDPRAGRSSQYCTDVAKALNAPIFHVNGDDVEAAVAHVCELAAEWRQKFHSDVVVDIVCYRRFGHNEIDEPSFTQPKMYKIIRNHPSSLEIYQNKLLKSGQVTKDDVEKIHNKINRILNEEFVASKDYVPQKRDWLSAFWAGFKSPSQLSRVRNTGVKPEILKNVGKAITMLPDDFKPHRAVKRIFDDRQKMIETGEGVDWAVGEALAFATLLVEGNHVRLSGQDVERGTFSHRHSVLHDQETGAQYCPLDHVMMNQNEEMFTVSNSSLSEFGVLGFELGYSMENPNSLVLWEAQFGDFANGAQVIFDQFVSSGEAKWLRQSGLVVLLPHGYDGQGPEHSSGRLERFLQMSDDNPFVIPEMEPTLRKQIQECNWQVVNVTTPANYFHVLRRQIHRDFRKPLIVMAPKNLLRHKDCKSNLSEFDDVQGHPGFDKQGTRFKRLIKDKNDHSDLEEGIRRLVLCSGKIYYELDEERKKADGKDVAICRVEQLCPFPYDLIQRELKRYPNAEIVWCQEEPMNMGAFHYIAPRLCTAMKSLGRGNMDDIKYVGRAPSAATATGFFQVHVKEQSELVQKAVQRDPVNYPF

SEQ ID NO: 5746 - protein, 675 aa, Citrullus lanatus
MGLFRAGSALAKVAIRRTLAQGGGSYAARSRIISSQNRYFHTTVFKSKAQSAPVPRPVPLSKLTDSFLDGTSSVYLEELQRAWEADPNSVDESWDNFFRNFVGQAATSPGISGQTIQESMRLLLLVRAYQVNGHMKAKLDPLSLEEREIPDDLDPALYGFTDADLDREFFLGVWRMAGFLSENRPVQTLRSILTRLEQAYCGSVGYEYMHIADRNKCNWLRDKIETPTPMQYNPQRRVVILDRLIWSTQFENFLATKWTTAKRFGLEGGETLIPGMKEMFDRAADLGVESIVIGMPHRGRLNVLGNVVRKPLRQIFSEFSGGTKPVDEVGLYTGTGDVKYHLGTSYDRPTRGGKHIHLSLVANPSHLEAVDPVVVGKTRAKQYYSNDTERIKNMGVLIHGDGSFAGQGVVYETLHLSALPNYTTGGTIHIVVNNQVAFTTDPRAGRSSQYCTDVAKALDAPIFHVNGDDMEAVVHVCELAAEWRQTFHSDVVVDLVCYRRFGHNEIDEPSFTQPKMYQVIRNHPSSLEIYQKKLLESGQVSQEDINNIRDKVNKILNEEFLASKDYVPKRRDWLSAYWSGFKSPEQLSRVRNTGVKPEILKNVGKAITVFPDNFKPHRAVKKVYEQRAQMIETGEGIDWALGEALAFATLLVEGNHVRLSGQDVERGTFSHRHCA

SEQ ID NO: 5747 - protein, 1021 aa, Populus trichocarpa
MAWFRAGSGVARLAIRRTLSQGGSYATRSRVIPPQNRYFHSTVFKSKAQAAPVPRPVPLSKLTDNFLDGTSSVYLEELQRAWETDPNSVDESWDNFFKNFVGQAATSPGISGQTIQESMRLLLLVRAYQVNGHMKAKLDPLGLEEREIPDDLDPALYGFTDADLDREFFLGVWRMAGFLSENRPVQTLRAILTRLEQAYCGSIGYEYMHIADREKCNWLRDKIETPTSMQYNRQRREVILDRLIWSTQFENFLATKWTTAKRFGLEGGETLIPGMKEMFDRSADLGVESIVIGMPHRGRLNVLGNVVRKPLRQIFSEFSGGTKPVDEVGLYTGTGDVKYHLGTSYDRPTRGGKRIHLSLVANPSHLEAVDPVVVGKTRAKQYYSNDSDRTKNMGILIHGDGSFAGQGVVYETLHLSALPNYTTGGTIHIVVNNQVAFTTDPRAGRSSQYCTDVAKALNAPIFHVNGDDMEAVVHVCELAAEWRQTFHSDVVVDLVCYRRFGHNEIDEPSFTQPKMYQVIRNHPSALEIYKKKLLESGQVTEEDISRIQEKVLSILNEEFLASKDYVPKRRDWLSSHWTGFKSPEQLSRVRNTGVKPEILKNVGKAITTFPENFKPHRAVKKVYEQRLQMIETGEGIDWAVGEALAFATLLVEGNHVRLSGQDVERGTFSHRHSVVHDQETGEKYCPLDHVVMNQDEEMFTVSNSSLSEFGVLGFELGYSMESPNSLVIWEAQFGDFANGAQVIFDQFLSSGESKWLRQTGLVLLLPHGYDGQGPEHSSARLERFLQMSDDNPYVIPEMEPTLRKQIQECNWQVVNVTTPANYFHVLRRQIHRDFRKPLVVIAPKNLLRHKECKSNLSEFDDVQGHPGFDKQGTRFKRLIKDRNDHSDLEEGIRRLVLCSGKIYYELDEVRGKVEAKDIAICRVEQLCPFPYDLIQRELKRYPNAEIVWCQEEPMNMGAYNYIAPRLSTAMKALERGTVDDIKYVGRGPSAASATGFYQVHVKEQTELVQMAMQPEPIKFPN

SEQ ID NO: 5748 - protein, 476 aa, Citrus sinensis
MGWFRAGSSVAKLAIKRTLSQGCSYTTRTRIVPSQTRHFHSTVFKSKAQSAPVPRPVPLSKLTDSFLDGTSSVYLEELQRAWEADPNSVDESWDNFFRNFVGQAATSPGISGQTIQESMRLLLLVRAYQVNGHMKAKLDPLGLEEREIPEDLDPALYGFTEADLDREFFIGVWRMAGFLSENRPVQTLRSILTRLEQAYCGSIGYEYMHIADRDQCNWLRDKIETPTPMQYNRQRREVILDRLIWSTQFENFLATKWTTAKRFGLEGGETLIPGMKEMFDRAADLGVESIVIGMPHRGRLNVLGNVVRKPLRQIFSEFSGGTKPVDEDGLYTGTGDVKYHLGTSYDRPTRGGKRIHLSLVANPSHLEAVDPVVVGKTRAKQYYSHDVDRTKNMGVLIHGDGSFAGQGVVYETLHLSALPNYTTGGTIHIVVNNQVAFTTDPRAGRSSQYCTDVAKALNAPIFHVNGDDIGGGCSCM

SEQ ID NO: 5749 - protein, 1024 aa, Citrus clementina
MGWFRAGSSVAKLAIKRTLSQGCSYTTRTHIVPSQTRHFHSTVFKSKAQSAPVPRPVPLSKLTDSFLDGTSSVYLEELQRAWEADPNSVDESWDNFFRNFVGQAATSPGISGQTIQESMRLLLLVRAYQVNGHMKARLDPLGLEEREIPEDLDPALYGFTEADLDREFFIGVWRMAGFLSENRPVQTLRSILTRLEQAYCGSIGYEYMHIADRDQCNWLRDKIETPTPMQYNRQRREVILDRLIWSTQFENFLATKWTTAKRFGLEGGETLIPGMKEMFDRAADLGVESIVIGMPHRGRLNVLGNVVRKPLRQIFSEFSGGTKPVDEDGLYTGTGDVKYHLGTSYDRPTRGGKRIHLSLVANPSHLEAVDPVVVGKTRAKQYYSHDVDRTKNMGVLIHGDGSFAGQGVVYETLHLSALPNYTTGGTIHIVVNNQVAFTTDPRAGRSSQYCTDVAKALNAPIFHVNGDDIEAVVHVCELAAEWRQKFHSDVVVDLVCYRRFGHNEIDEPSFTQPKMYQVIRSHPSAFEIYQKKLLESAQVTQEDINRIQEKVNTILNEEFMASKDYVPKRRDWLSAYWAGFKSPEQVSRIRNTGVKPEILKNVGKAITNLPENFKPHRGVKKVYEQRAQMIETGEGIDWAVGEALAFATLLVEGNHVRLSGQDVERGTFSHRHSVLHDQETGEKYCPLDHVMMNQDEEMFTVSNSSLSEFGVLGFELGYSMENPNSLVLWEAQFGDFANGAQVIFDQFLSSGESKWLRQTGLVVLLPHGYDGQGPEHSSARLERFLQMSDDNPFVIPEMDPTLRKQIQECNWQIVNVTTPANYFHVLRRQIHRGFRKPLIVMSPKNLLRHKDCKSNLSEFDDVQGHPGFDKQGTRFKRLIKDQNGHSDLEEGIRRLVLCSGKVYYELDEERKKRSASDVAICRVEQLCPFPYDLVQRELKRYPNAEIVWCQEEPMNMGAYTYISPRLATAMKAVGRGTIEDIKYVGRAPSAATATGFYQAHVKEQTELVQKSIHPEPIKAPAEIC

SEQ ID NO: 5750 - protein, 816 aa, Flaveria ramosissima
MHIADRERCNWLRDKIETPTPTQYNRERREVILDRLIWSTQFENFLATKWTAAKRFGLEGGETLIPGMKEMFDRSADLGVESIVIGMSHRGRLNVLGNVVRKPLRQIFSEFSGGTKPVDEVGLYTGTGDVKYHLGTSYDRPTRGGKRIHLSLVANPSHLEAVDPVVIGKTRAKQYYSNDVDRTKNMGILIHGDGSFAGQGVVYETLHLSGLPNYTTGGTIHIVVNNQVAFTTDPQSGRSSQYCTDVAKALNAPIFHVNGDDVEAVVHACELAAEWRQTFHSDVVVDIVCYRRFGHNEIDEPSFTQPKMYKIIRNHPSSLEIYQKKLLENGQATKEDIDRIQSKVTTILNEEFLASKDYVPQRRDWLSAYWTGFKSPEQLSRIRNTGVKPEILKNVGKAITTLPETFKPHRAVKKIFADRYKMIETGEGVDWAVAEALAFATLLVEGNHVRLSGQDVERGTFSHRHSVVHDQETGERYCPLDHVMMNQNEEMFTVSNSSLSEFGVLGFELGYSMENPNSLVLWEAQFGDFSNGAQVIFDQFLSSGEAKWLRQTGLVVLLPHGYDGQGPEHSSARLERFLQMSDDNPFVIPEMEPTLRNQIQTCNMQIVNVTTPANYFHVLRRQLHREFRKPLIVMSPKNLLRHKDCKSNLSEFDDVQGHPGFDKQGTRFKRLIKDQNDHSDLEEGIRRLVLCSGKVYYELDEQRKSVDGKDVAICRVEQLCPFPYDLIQRELKRYPNAEIVWCQEEPMNMGAYSYIAPRLATAMKALNRGTIDDIKYVGRAPSAATATGFYTVHGREQSELVQKALQPEPVTSPALS

SEQ ID NO: 5751 - protein, 1024 aa, Lactuca sativa
MTWFRAGSGVAKLAIKRSLSQTGTYAARKHFLPSQTRHFHTTLFKSKAQSAPVPRPVPLSRLTDSFLDGTSSVYLEELQRTWENDPQSVDESWDNFFRNFVGQASTSPGISGQTIQESMRLLLLVRAYQVYGHMKAKIDPLGLEKREIPDDLDPAFYGFTEADLDREFFLGVWRMSGFLSENRPVQTLRSILTRLEQAYSGSIGYEYMHIADRERCNWLRDRIETPTPTQYNSERREVILDRLIWSTQFENFLATKWTAAKRFGLEGGETLIPGMKEMFDRSADLGVESIVIGMSHRGRLNVLGNVVRKPLRQIFSEFSGGTKPVDEVGLYTGTGDVKYHLGTSYDRPTRGGKRIHLSLVANPSHLEAVDPVVVGKTRAKQYYSNDADRTKNMGILIHGDGSFAGQGVVYETLHLSGLPNYTTGGTIHIVVNNQVAFTTDPQAGRSSQYCTDVAKALNAPIFHVNGDDVEAVVHACELAAEWRQTFHSDVVVDIVCYRRFGHNEIDEPSFTQPKMYKIIRNHPSSLEIYQKKLLETGQATKEDIDRIQSKVTSILNEEFLASKDYVPQRRDWLSAYWLGFKSPEQLSRIRNTGVKPEILKNVGKAITTLPETFKPHRAVKKIFADRFKMIESGEGVDWAVAEALAFATLLVEGNHVRLSGQDVERGTFSHRHSVIHDQETGDRYCPLDHVMMNQNEEMFTVSNSSLSEFAVLGFELGYSMENPNSLVLWEAQFGDFSNGAQVIFDQFLSSGEAKWLRQTGLVVLLPHGYDGQGPEHSSARLERFLQMSDDNPFVVPEMEPTLRNQIQTCNWQVVNVTTPANYFHVLRRQLHREFRKPLIVMSPKNLLRHKECKSNLSEFDDVQGHPGFDKQGTRFKRLIKDQNDHSDLEEGIRRLVLCSGKVYYELDEKRKSIDGKDVAICRVEQLCPFPYDLIQRELKRYPNAEIVWCQEEPMNMGAYSYIAPRLATAMKTLNRGTIDDVKYVGRAPSAATATGFYTVHGREQSELVQNALQSEPITTNPTLC

SEQ ID NO: 5752 - protein, 1017 aa, Silene vulgaris
MVWFRAGSRLANLAVRRTLSQGRTYVTRTQVIDTQRRAFHSTPFRRAAPVPRAVPLSKLTDSFLDGTSSVYLEALQRDWEADPSSVDESWDNFFRNFVGQAATSPGISGQTIQESMRLLLLVRAYQVNGHFKAKLDPLGLEERPVPDDLNLELYGFTEADLDREFFLGVWKMSGFLSENRPVQTLRSILNRLEQAYCGRIGFEYMHIANRERCNWLRDRIETPSAMEYNKERRQVMLDRLIWSTQFESFLATKWTTAKRFGLEGCETLIPGMKEMFDRSADLGVENIVIGMSHRGRLNVLGNVVRKPLRQIFSEFSGGTKPTDEVGLYTGTGDVKYHLGTSYDRPTRGGKRIHLSLVANPSHLEAVDPVVVGKTRAKQYYSNDVDRTKNMAILIHGDGSFAGQGVVYETLHLSALPNYTTGGTIHIVVNNQVAFTTDPSSGRSSQYCTDVAKALDAPIFHVNGDDLEAVVHVCELAAEWRQTFHSDVVIDIVCYRRFGHNEIDEPSFTQPKMYKVIRNHPSSLEIYKKKVLENGELSKEEIDEIQKKVMTILNEEFEASKNHVTNKRDWLSAYWLGFKSPEQLSRIRNTGVKPEILKNVGKAITTIPETFKPHKAVKRIYDQRAQMIETGEGIDWAVGEALAFATLLVEGNHVRLSGQDVERGTFSHRHSVIHDQESGEKYCPLDHVMINQNEELFTVSNSSLSEFGVLGFELGYSMENPNSLVIWEAQFGDFSNGAQVIFDQFLSSGEAKWLRQTGLVVLLPHGYDGQGPEHSSARLERFLQMSDDNPYVIPDMEPTLRKQIQECNWQVVNVTTPANYFHVLRRQIHREFRKPLIVMAPKNLLRHKECKSNLSEFDDVQGHPGFDKQGTRFKRLIKDQNMHSDLEEGIRRLVLCSGKVYYELDEQRKKANGSDVAICRVEQLCPFPYDLVQRELRRYPNAEVVWCQEEPMNMGGYSYIAPRLFTAMKSVGRGNIDDIKYVGRPPSAATATGFLMVHAKEQTELVHKALQPEPIQFP

SEQ ID NO: 5753 - protein, 816 aa, Flaveria ramosissima
MHIADRERCNWLRDKIETPTPTQYNRERREVILDRLIWSTQFENFLATKWTAAKRFGLEGGETLIPGMKEMFDRSADLGVESIVIGMSHRGRLNVLGNVVRKPLRQIFSEFSGGTKPVDEVGLYTGTGDVKYHLGTSYDRPTRGGKRIHLSLVANPSHLEAVDPVVIGKTRAKQYYSNDVDRTKNMGILIHGDGSFAGQGVVYETLHLSGLPNYTTGGTIHIVVNNQVAFTTDPQAGRSSQYCTDVAKALNAPIFHVNGDDVEAVVHACELAAEWRQTFHSDVVVDIVCYRRFGHNEIDEPSFTQPKMYKIIRNHPSSLEIYQKKLLESGQATKEDIDRIQSKVTTILNEEFLASKDYVPQRRDWLSAYWTGFKSPEQLSRIRNTGVKPEILKNVGKAITTLPETFKPHRAVKKIFADRYKMIETGEGVDWAVAEALAFATLLVEGNHVRLSGQDVERGTFSHRHSVLHDQETGERYCPLDHVMMNQNEEMFTVSNSSLSEFGVLGFELGYSMENPNSLVLWEAQFGDFSNGAQVIFDQFLSSGEAKWLRQTGLVVLLPHGYDGQGPEHSSARLERFLQMSDDNPFVIPEMEPTLRNQIQTCNMQIVNVTTPANYFHVLRRQLHREFRKPLIVMSPKNLLRHKDCKSNLSEFDDVQGHPGFDKQGTRFKRLIKDQNDHSDLEEGIRRLVLCSGKVYYELDEQRKSVDGKDVAICRVEQLCPFPYDLIQRELKRYPNAEIVWCQEEPMNMGAYSYIAPRLATAMKVLNRGTIDDIKYVGRAPSAATATGFYTVHGREQSELVQKALQPEPVTSPALS

SEQ ID NO: 5754 - protein, 1023 aa, Centaurea maculosa
MTWFRAGSSVAKLAIRRTLSQSGSYAARKRLLPSESRHFHTTVFKSKAQSAPVPRAVPLSRLTDSFLDGTSSVYLEELQRAWEDDPNSVDESWDNFFRNFVGQAATSPGISGQTIQESMRLLLLVRAYQVYGHMKAKIDPLGLEKREIPDDLDPAFYGFSEADLDREFFLGVWRMSGFLSENRPVQTLRSILTRLEQAYSGSIGYEYMHIADRERCNWLRDRIETPTPTQYNSERREVILDRLIWSTQFENFLATKWTAAKRFGLEGGETLIPGMKEMFDRSADLGVESIVIGMSHRGRLNVLGNVVRKPLRQIFSEFSGGTKPVDEVGLYTGTGDVKYHLGTSYDRPTRGGKRIHLSLVANPSHLEAVDPVVIGKTRAKQYYSNDVDRTKNMGILIHGDGSFAGQGVVYETLHLSGLPNYTTGGTIHIVVNNQVAFTTDPQAGRSSQYCTDVAKALNAPIFHVNGDDVEAVVHACELAAEWRQTFHSDVVVDIVCYRRFGHNEIDEPSFTQPKMYKIIRNHPSSLEIYQKKLLETGQATKEDIDRIQSKVTSILNEEFLASKDYVPLKRDWLSAYWTGFKSPEQLSRIRNTGVKPEILKNVGKAITTLPETFKPHRAVKKIFADRYKMIETGEGVDWAVAEALAFATLLVEGNHVRLSGQDVERGTFSHRHSVIHDQETGERYCPLDHVMMNQNEEMFTVSNSSLSEFGVLGFELGYSMENPNSLVLWEAQFGDFSNGAQVIFDQFLSSGEAKWLRQTGLVVLLPHGYDGQGPEHSSARLERFLQMSDDNPFVIPEMEPTLRNQIQTCNWQVVNVTTPANYFHVLRRQLHREFRKPLIAMAPKNLLRHKECKSNLSEFDDVQGHPGFDKQGTRFKRLIKDQNDHSNLEEGIRRLVLCSGKVYYELDEKRTSLEGKDIAICRVEQLCPFPYDLIQRELKRYPNAEVVWCQEEPMNMGAYSYIAPRLATAMKALDRGTIDDIKYVGRAPSAATATGFYSVHGREQSELVQNALQPEPVTNPAFC

SEQ ID NO: 5755 - protein, 1023 aa, Aquilegia formosa
MAWFRAASSAAKLAVRRSLARPGSYATKARILPSHNRDFHSTVFTSRAQAATAPIPRPVPLSRLTDSFLDGSSSVYLEELQRAWEEDPDSVDESWDNFFRNFVGQATTSPGISGQTIQESMRLLLLVRAYQVNGHMKANLDPLALEERHIPEDLDPALYGFSEADLDREFFLGVWKMAGFLSENRPVQTLRSILTRLQQAYCGSVGYEYMHISDREKCNWLRDKIETPTPTQYNSERRVVMLDRLTWSTQFENFLATKWTAAKRFGLEGGETLIPGMKEMFDRSADLGVESIVIGMSHRGRLNVLGNVVRKPLRQIFSEFSGGTRPVDEVGLYTGTGDVKYHLGTSYDRPTRGGKRIHLSLVANPSHLEAVDPLVIGKTRAKQYYSNDVDRTRNLGILIHGDGSFAGQGVVYETLHLSGLPNYTTGGTIHIVVNNQVAFTTDPQAGRSSQYCTDVAKALDAPIFHVNGDDLEAVVHVCELAAEWRQTFHSDVVVDIVCYRRFGHNEIDEPSFTQPKMYKVIRSHPSALEIYQQKLLKNGQIAQEDIDKIQKKVNSILNEEFMNSKDYVPKKRDWLAAYWSGFKSPEQISRVRNTGVKPEILKNVGKAITTLPDTFKAHRAVKKIFEQRSQMIESGEGIDWAVGEALAFATLLVEGNHVRLSGQDVERGTFSHRHSVVHDQETGEQYCPLDHVIMNQDEEMFTVSNSSLSEFGVLGFELGYSMENPNSLVIWEAQFGDFSNGAQVIFDQFLSSGESKWLRQTGLVVLLPHGYDGQGPEHSSARLERFLQMSDDNPYVIPEMDATLRKQIQECNWQVVNVTTPANYFHVLRRQIHRDFRKPLVVMAPKNLLRHKDCKSNLSEFDDVQGHPGFDKQGTRFKRLIKDQNDHSDLEEGIRRLVLCSGKVYYELDEQRKKVSGKDVAICRVEQLCPFPYDLIQRELKRYPNAEVVWCQEEPMNMGAYSYIAPRLCTAMRALGRGTMEDIRYVGRAPSAATATGFYQAHVKEQAELVQKALQSEPIKYPY

SEQ ID NO: 5756 - protein, 1019 aa, Podocarpus macrophillus
MTWQRLSSGLVRAALRIRLAQASAHTKRSLWTLSQARSFHSSPHKFQQAAPVPRPVPLSRLTDNFLDGTSSVYLEELQRAWEADPHSVDESWDNFFRNFVGQAVTSPGISGQTIQESMRLLLLLRAYQVNGHMKAKLDPLGLEEREIPADLDPALYGFTEADLDREFFLGVWRMSGFLSENRPVQTLRSILNRLEQAYCGTIGYEYMHIADRDKCNWLREKIETVVPSKYGPERRHVILDRLIWSTQFENFLATKWTAAKRFGLEGAETLIPGMKEMFDRSADLGVENIVIGMSHRGRLNVLGNVVRKPLRQIFSEFSGGTKPVDEVGSYTGTGDVKYHLGTSYDRPTRGGKRIHLSLVANPSHLEAVDPVVVGKTRAKQYYSNDKDRTKNMAILIHGDGSFAGQGVVYETLHLSALPNYTTGGTIHIVVNNQVAFTTDPKAGRSSQYCTDVAKALNAPIFHVNGDDVEAVVHVCELAAEWRQTFHSDVVVDIVCYRRFGHNEIDEPSFTQPKMYQVIRNHPRALDVYQKQLIELGQLSKEEIDALHEKVNSILNEEFVNSKEYVPKRRDWLAAYWSGFKSPEQLSRIRNTGVKPEILKNVGKAITTLPETFKPHRAVKRIFEQRAQMIEKGEGVDWAVGEALAFATLLVEGNHVRLSGQDVERGTFSHRHAVLHDQETGERYCPLDHLVMNQNEEMFTVSNSSLSEFGVLGFELGYSMENPNSLVCWEAQFGDFANGAQVIFDQFISSGESKWLRQSGLVVLLPHGYDGQGPEHSSARLERLLQMSDDNPFVIPEMDSTLRTQIQQCNWQVVNVTTPANYFHVLRRQIHRDFRKPLIVMSPKNLLRHKDCKSNLSEFDDVQGHPGFDKQGTRFKRLIKDQNDHSDLEEGIQRLILCSGKVYYELDEERQRVERKDVAICRVEQLCPFPYDLVQRELKRYPNAEIVWCQEEPMNMGAYHYITPRLLSAMKTLGRGTYEDIKYVGRAPSAATATGFYQVHVKEQRELVEIALQSSPIKFP

SEQ ID NO: 5757 - protein, 905 aa, Gossypium hirsutum
MRLLLLVRAYQVNGHMKAKLDPLGLEEREIPDDLDPAFYGFTEADLDREFFLGVWRMAGFLSENRPVQTLRSILTRLEQAYCGSIGFEYMHIAERDKCNWLRDKIETPTPMQYNRQRREVILDRLIWSTQFENFLATKWTTAKRFGLEGGETLIPGMKEMFDRAADLGVESIVIGMPHRGRLNVLGNVVRKPLRQIFSEFSGGTRPVDEVGLYTGTGDVKYHLGTSYDRPTRGGKRIHLSLVANPSHLEAVDPVVVGKTRAKQYYSNDEDRTKNMAVLIHGDGSFAGQGVVYETLHLSALPNYTTGGTIHIVVNNQVAFTTDPRAGRSSQYCTDVAKALNAPIFHVNGDNVEAVVHACELAAEWRQAFHSDVVVDLVCYRRFGHNEIDEPSFTQPKMYKIIRNHPSALQIYRNKLLESGQVTDEDIGNISQKVSTILNEEFLGSKDYVPKRRDWLSAYWTGFKSPEQISRVRNTGVKPEILKNVGKAITTLPDNFKPHRAVKKVYEQRAQMIETGEGLDWAMGEALAFATLLVEGNHVRLSGQDVERGTFSHRHSVIHDQETGEQYCPLDHVIINQNEEMFTVSNSSLSEFGVLGFELGYSMENPNSLVMWEAQFGDFANGAQVIFDQFISSGEAKWLRQTGLVVLLPHGYDGQGPEHSSARLERYLQMSDDNPFVIPEMDPTLRKQIQECNSQVVNVTTPANYFHVLRRQIHREFRKPLIVMSPKNLLRHKDCKSNLSEFDDVQGHPGFDKQGTRFKRLIKDQNMHSDLEEGIRRLVLCSGKVYYELDDERKKNNASDVAICRVEQLCPFPYDLIQRELKRYPNAEIVWCQEEPMNMGAYNYIAPRLATAMTALGRGTFDDIRYIGRAPSASTATGFYSVHVKEQTELVQKAIQPEPIKTNITI

SEQ ID NO: 5758 - protein, 793 aa, Gossypium hirsutum
MGWLRAGSSVAKLAIRRTLSQGGSYAARSRIVPSQSRFFHTTVFKSKAQTAPVPRPVPLSKLTDSFLDGTSSVYLEELQRAWEADPDSVDESWDNFFRNFVGQAATSPGISGQTIQESMRLLLLVRAYQVNGHMKAKLDPLGLEEREIPDDLDPALYGFTEADLDREFFLGVWRMAGFLSENRPVQTLRSILTRLEQAYCGSIGFEYMHIADRDKCNWLRDKIETPTPMQYNRQRREVILDRLIWSTQFENFLATKWTTAKRFGLEGGETLIPGMKEMFDRAADLGVESIVIGMPHRGRLNVLGNVVRKPLRQIFSEFSGGTKPVDEVGLYTGTGDVKYHLGTSYDRPTRGGKRIHLSLVANPSHLEAVDPVVVGKTRAKQYYSNDEDRTKNMAVLIHGDGSFAGQGVVYETLHLSALPNYTTGGTIHVVVNNQVAFTTDPRAGRSSQYCTDVAKALDAPIFHVNGDDVEAVVHACELAAEWRQTFHSDVVVDLVCYRRFGHNEIDEPSFTQPKMYKIIRNHPSALQIYRNKLLESGQVTDDDIGNISQKVSTILNEEFLASKDYVPKRRDWLSAYWTGFKSPEQISRVRNTGVKPEILKNVGKAITTLPDNFKPHRAVKKVYEQRAQMIETGEGLDWAMGEALAFATLLVEGNHVRLSGQDVERGTFSHRHSVIHDQETGEQYCPLDHVIINQNEEMFTVSNSSLSEFGVLGFELGYSMENPNSLVMWEAQFGDFANGAQVIFDQFISSGEAKWLRQTGLVVLLPHGYDGQGPEHSSARLERYLQMSDDNPL

SEQ ID NO: 5759 - protein, 1027 aa, Aquilegia formosa
MAWFKAASSIRKLVTKRNLAQIRSYNSITTTRTRAIQSQNRCFHSTIFTPKAQSATAPIPRAVPLSKLTDSFLDGSSSVYLEELQRAWEADPNSVDESWDNFFRNFVGQASTSPGISGQTIQESMRLLLLVRAYQVNGHMKAKLDPLGLEERQIPDDLDPSFYGFSEADLDREFFLGVWKMAGFLSENRPVQTLRSILTRLEQAYCGSVGYEYMHIADRNKCNWLRDKIETPTPRQYNTQRREVMLDRLTWSTQFENFLATKWTAAKRFGLEGGETLIPGMKEMFDRSADLGVESIVIGMSHRGRLNVLGNVVRKPLRQIFSEFSGGIKPIDEVGLYTGTGDVKYHLGTSYDRPTRGGKRIHLSLVANPSHLEAVDPVVVGKTRAKQYYSNDEDRTKNLGILIHGDGSFAGQGVVYETLHLSALPNYTTGGTIHIVVNNQVAFTTDPRSGRSSQYCTDVAKALDAPILHVNGDDLEAVVHVCELAAEWRQTFHSDVVVDIVCYRRFGHNEIDEPSFTQPKMYKVIRNHPSALEIYQKKLLESGLIGQEDIDRINKKVNNILNEEFMNSKDYVPRKRDWLSAYWAGFKSPEQVSRVRNTGVKPEILKNVGKAITTFPENFKPHRAVKKIFEQRAQMIETGEGIDWAVGEALAFATLLVEGNHVRLSGQDVERGTFSHRHSVVHDQESGEKYCPLDHVIMNQNEEMFTVSNSSLSEFGVLGFELGYSMENPNSLVIWEAQFGDFANGAQVIFDQFLSSGESKWLRQTGLVVLLPHGYDGQGPEHSSARLERFLQMSDDNPYVIPEMDSTLRKQIQECNWQVVNVTTPANYFHVLRRQIHRDFRKPLIVMAPKNLLRHKDCKSNLSEFDDVQGHPGFDKQGTRFKRLIKDQNEHSDLEEGIRRLVLCSGKVYYELDEERKKVNGKDVAICRVEQLCPFPYDLIQRELKRYPNAEIVWCQEEPMNMGAYNYIAPRLSTAMRALGRGTTEDINYVGRAPSAATATGFYSVHGKEQTELVQKALQQDLINYPW

SEQ ID NO: 5760 - protein, 1016 aa, Brassica rapa
MVWFRAGSSATKLAVRRILNQGTRTPRYLPSQNRSFHSTLYRPNPQSSAAPVPRAVPLSKLTDSFLDGTSSVYLEELQRAWEADPTSVDESWDNFFRNFVGQAATSPGISGQTIQESMRLLLLVRAYQVNGHMKAKLDPLGLEQREIPEDLDLALYGFTEADLDREFFLGVWQMSGFMSENRPVQTLRSILTRLQQAYCGSIGFEYMHIADRDKCNWLREKIETPTPWRYNRERREVILDRLAWSTQFENFLATKWTTAKRFGLEGGESLIPGMKEMFDRAADLGVESIVIGMSHRGRLNVLGNVVRKPLRQIFSEFSGGIRPVDEVGYTGTGDVKYHLGTSYDRPTRGGKKIHLSLVANPSHLEAADSVVVGKTRAKQYYSKDLDRTKNLGILIHGDGSFAGQGVVYETLHLSALPNYTTGGTIHIVVNNQVAFTTDPRAGRSSQYCTDVAKALSAPIFHVNGDDVEAVVHACELAAEWRQTFHSDVVVDLVCYRRFGHNEIDEPSFTQPKMYKVIKNHPSTLQIYHKKLLECGEISQQDIDRIQEKVNTILNEEFVASKDYLSKKRDWLSTNWAGFKSPEQISRVRNTGVKPEILKTVGKAISSLPENFKPHRAVKKVYEQRAQMIETGEGIDWALAEALAFATLVVEGNHVRLSGQDVERGTFSHRHSVLHDQETGEEYCPLDHLVMNQDPEMFTVSNSSLSEFGVLGFELGYSMESPNSLVLWEAQFGDFANGAQVIFDQFISSGEAKWLRQTGLVVLLPHGYDGQGPEHSSARLERYLQMSDDNPYVIPDMEPTLRKQIQECNWQIVNATTPANYFHVLRRQLHRDFRKPLIVMAPKNLLRHKDCKSNLSEFDDVQGHPGFDKQGTRFKRLIKDQNDHSDLEEGIRRLVLCSGKVYYELDDERKKVGASDVAICRVEQLCPFPYDLIQRELKRYPNAEIVWCQEEAMNMGAYSYITPRLWTAMRSLGSGDMEDIKYVGRGPSAATATGFYTFHVKEQAELVQKAIGKESIS

SEQ ID NO: 5761 - protein, 1023 aa, Theobroma cacao
MGWFRAGSSVAKLASRRTLSQGGLYTARSRIVPSQNHYFHTTVFKSKAQSAPVPRPVPLSKLTDSFLDGTSSVYLEELQRAWEADPDSVDESWDNFFRNFVGQAATSPGISGQTIQESMRLLLLVRAYQVNGHMKAKLDPLGLEEREIPDDLDPALYGFTEADLDREFFLGVWRMSGFLSENRPVQTLRSILTRLEQAYCGSIGFEYMNIADREKCNWLRDKIETPTPMQYNRQRREVILDRLIWSTQFENFLATKWTTAKRFGLEGGETLIPGMKEMFDRAADLGVESIVIGMPHRGRLNVLGNVVRKPLRQIFSEFSGGTKPVDEVGLYTGTGDVKYHLGTSYDRPTRGGKRIHLSLVANPSHLEAVDPVVVGKTRAKQYYSNDVDRTKNMAVLIHGDGSFAGQGVVYETLHLSALANYTTGGTIHIVVNNQVAFTTDPRAGRSSQYCTDVAKALNAPIFHVNGDDVEAVVHACELAAEWRQTFHSDVVVDLVCYRRFGHNEIDEPSFTQPKMYKIIRNHPSALQIYQNKLLESGQVMKEDIGWISEKVSKILNEEFLASKDYVPKRRDWLSAYWTGFKSPEQLSRVRNTGVKPEILKNVGKAITTLPDNFKPHRAVKKVYDQRAQMIETGEGLDWAIGEALAFATLLVEGNHVRLSGQDVERGTFSHRHSVLHDQETGEQYCPLDHVIINQNEEMFTVSNSSLSEFGVLGFELGYSMENPNSLVMWEAQFGDFANGAQVIFDQFLSSGESKWLRQTGLVVLLPHGYDGQGPEHSSARLERYLLMSGDNPFVIPEMDPTLRTQIQECNWQVVNVTTPANYFHVLRRQIHREFRKPLIVMSPKNLLRHKDCKSNLSEFDDVQGHPGFDKQGTRFKRLIKDQNMHSDLEEGIRRLVLCSGKVYYELDDERKKNKATDVAICRVEQLCPFPYDLIQRELKRYPNAEIVWCQEEPMNMGAFSYIAPRLATSMQALGRGTFEDIKYVGRAPSASTATGFYVVHVKEQTELVQKAIQPEPIKFHAPV

SEQ ID NO: 5762 - protein, 1023 aa, Gossypium hirsutum
MGWLRAGSSVAKLAIRRTLSLGGSYAARSRIVPSQSRYFHTTVFKSKAQTAPVPRPVPLSKLTDSFLDGTSSVYLEELQRAWEADPDSVDESWDNFFRNFVGQAATSPGISGQTIQESMRLLLLVRAYQVNGHMKAKLDPLGLEEREIPDDLDPALYGFTEADLDREFFLGVWRMAGFLSENRPVQTLRSILTRLEQAYCGSIGFEYMHIADRDKCNWLRDKIETPTPMQYNRQRREVILDRLIWSTQFENFLATKWTTAKRFGLEGGETLIPGMKEMFDRAADLGVESIVIGMPHRGRLNVLGNVVRKPLRQIFSEFSGGTRPVDEVGLYTGTGDVKYHLGTSYDRPTRGGKRIHLSLVANPSHLEAVDPVVVGKTRAKQYYSNDEDRTKNMAILIHGDGSFAGQGVVYETLHLSALPNYTTGGTIHIVVNNQVAFTTDPRAGRSSQYCTDVAKALDAPIFHVNGDDVEAVVHACELAAEWRQTFHSDVVVDLVCYRRFGHNEIDEPSFTQPKMYKIIRNHPSALQIYRNKLLESGQVTDDDIGNISQKVSTILNEEFLASKDYVPKRRDWLSAYWTGFKSPEQISRVRNTGVKPEILKNVGKAITTLPDNFKPHRAVKKVYEQRAQMIETGEGLDWAMGEALAFATLLVEGNHVRLSGQDVERGTFSHRHSVIHDQETGEQYCPLDHVIINQNEEMFTVSNSSLSEFGVLGFELGYSMENPNSLVMWEAQFGDFANGAQVIFDQFISSGEAKWLRQTGLVVLLPHGYDGQGPEHSSARLERYLQMSDDNPFVIPEMDTTLRKQIQECNWQVVNVTTPANYFHVLRRQIHREFRKPLIVMSPKNLLRHKDCKSNLSEFDDVQGHPGFDKQGTRFKRLIKDQNMHSDLEEGIRRLVLCSGKVYYELDDERKKNNATDIAICRVEQLCPFPYDLIQRELKRYPNAEIVWCQEEPMNMGAYNYIAPRLATAMTALGRGTFDDVRYVGRAPSASTATGFYSMHVKEQAELVQKAIQPEPIKTNTTI

SEQ ID NO: 5763 - protein, 1023 aa, Gossypium raimondii
MGWLRAGSSVAKLAIRRTLSQGGSYAARSRIVPSQSRYFHTTVFKSKAQTAPVPRPVPLSKLTDSFLDGTSSVYLEELQRAWEADPDSVDESWDNFFRNFVGQAATSPGISGQTIQESMRLLLLVRAYQVNGHMKAKLDPLGLEEREIPDDLDPALYGFTEADLDREFFLGVWRMAGFLSENRPVQTLRSILTRLEQAYCGSIGFEYMHIADRDKCNWLRDKIETPTPMQYNRQRREVILDRLIWSTQFENFLATKWTTAKRFGLEGGETLIPGMKEMFDRAADLGVESIVIGMPHRGRLNVLGNVVRKPLRQIFSEFSGGTRPVDEVGLYTGTGDVKYHLGTSYDRPTRGGKRIHLSLVANPSHLEAVDPVVVGKTRAKQYYSNDEDRTKNMAILIHGDGSFAGQGVVYETLHLSALPNYTTGGTIHIVVNNQVAFTTDPRAGRSSQYCTDVAKALDAPIFHVNGDDVEAVVHACELAAEWRQTFHSDVVVDLVCYRRFGHNEIDEPSFTQPKMYKIIRNHPSALQIYRNKLLESGQVTDDDIGNISQKVSTILNEEFLASKDYVPKRRDWLSAYWTGFKSPEQISRVRNTGVKPEILKNVGKAITTLPDNFKPHRAVKKVYEQRAQMIETGEGLDWAMGEALAFATLLVEGNHVRLSGQDVERGTFSHRHSVIHDQETGEQYCPLDHVIINQNEEMFTVSNSSLSEFGVLGFELGYSMENPNSLVMWEAQFGDFANGAQVIFDQFISSGEAKWLRQTGLVVLLPHGYDGQGPEHSSARLERYLQMSDDNPFVIPEMDTTLRKQIQECNWQVVNVTTPANYFHVLRRQIHREFRKPLIVMSPKNLLRHKDCKSNLSEFDDVQGHPGFDKQGTRFKRLIKDQNMHSDLEEGIRRLVLCSGKVYYELDDERKKNNATDIAICRVEQLCPFPYDLIQRELKRYPNAEIVWCQEEPMNMGAYNYIAPRLATAMTALGRGTFDDVRYVGRAPSASTATGFYSMHVKEQAELVQKAIQPEPIKTNTTI

SEQ ID NO: 5764 - protein, 1021 aa, Prunus persica
MTWFRAGSSVAKLAIRRTLSHSGSYAGRRRVLPSQNRDFHTTLCKSKAQSAPVPRPVPLSRLTDSFLDGTSSVYLEGLQRAWEADPNSVDESWDNFFRNFVGQASTSPGISGQTIQESMRLLLLVRAYQVNGHMKAKLDPLGLEEREIPDDLDPALYGFTEADLDREFFLGVWRMAGFLSENRPVQTLRSILTRLEQAYCGTIGYEYMHIADRNRCNWLRDKIETPTPMQYNRQRREVILDRLIWSTQFENFLATKWTAAKRFGLEGGETLIPGMKEMFDRAADLGVESIVIGMSHRGRLNVLGNVVRKPLRQIFSEFSGGTKPVDEVGLYTGTGDVKYHLGTSYDRPTRGGNRIHLSLLANPSHLEAVDPVVVGKTRAKQYYSSDPDRTKNVGILIHGDGSFAGQGVVYETLHLSALPNYTTGGTIHIVVNNQVAFTTDPMSGRSSQYCTDVAKALNAPIFHVNADDMEAVVHVCELAAEWRQTFHSDVVVDLVCYRRFGHNEIDEPSFTQPKMYKVIRNHPSALTIYQNKLLESGQVTKEDIERIQNKVNSILNEEFLASKDYVPQRRDWLSSHWSGFKSPEQISRIRNTGVKPEILKSVGKAVTSLPETFKPHRAVKKNYEQRAQMIETGEGIDWAVAEALAFATLLVEGNHVRLSGQDVERGTFSHRHSVVHDQETGERYCPLDHIMANQDEEMFTVSNSSLSEFGVLGFELGYSMESPNALVIWEAQFGDFANGAQVIFDQFLSSGESKWLRQTGLVVLLPHGYDGQGPEHSSARLERFLQMSDDNPFVIPEMDPTLRKQIQECNWQVVNVTTPANYFHVLRRQLHREFRKPLIVMAPKNLLRHKECKSNLSEFDDVQGHPGFDKQGTRFKRLIKDQNDHSNLEEGIRRLVLCSGKLYYELDEERRKVEAKDVAICRVEQLCPFPYDLIQRELKRYPNAEIVWCQEEPMNMGAYSYIAPRLCSAMKSLGRGTIEDIKYVGRAPSAATATGFYQVHVKEQNEIVHKAVQPEPIEYHI

SEQ ID NO: 5765 - protein, 1021 aa, Prunus mume
MTWFRAGSSVAKLAIRRTLSNSGSYAGRRRVLPSQNRDFHTTLCKSKAQSAPVPRPVPLSRLTDSFLDGTSSVYLEGLQRAWEADPNSVDESWDNFFRNFVGQASTSPGISGQTIQESMRLLLLVRAYQVNGHMKAKLDPLGLEEREIPDDLDPALYGFTEADLDREFFLGVWRMAGFLSENRPVQTLRSILTRLEQAYCGTIGYEYMHIADRNRCNWLRDKIETPTPMQYNRQRREVILDRLIWSTQFENFLATKWTAAKRFGLEGGETLIPGMKEMFDRAADLGVESIVIGMSHRGRLNVLGNVVRKPLRQIFSEFSGGTKPVDEVGLYTGTGDVKYHLGTSYDRPTRGGNRIHLSLLANPSHLEAVDPVVVGKTRAKQYYSSDLDRTKNVGILIHGDGSFAGQGVVYETLHLSALPNYTTGGTIHIVVNNQVAFTTDPMSGRSSQYCTDVAKALNAPIFHVNADDMEAVVHVCELAAEWRQTFHSDVVVDLVCYRRFGHNEIDEPSFTQPKMYKVIRNHPSALTIYQNKLLESGQVTKEDIERIQNKVNSILNEEFLASKDYVPQRRDWLSSHWSGFKSPEQISRIRNTGVKPEILKSVGKAVTSLPETFKPHRAVKKNYEQRAQMIETGEGIDWAVAEALAFATLLVEGNHVRLSGQDVERGTFSHRHSVVHDQETGERYCPLDHIMANQDEEMFTVSNSSLSEFGVLGFELGYSMESPNALVIWEAQFGDFSNGAQVIFDQFLSSGESKWLRQTGLVVLLPHGYDGQGPEHSSARLERFLQMSDDNPFVIPEMDPTLRKQIQECNWQVVNVTTPANYFHVLRRQLHREFRKPLIVMAPKNLLRHKECKSNLSEFDDVQGHPGFDKQGTRFKRLIKDQNDHSDLEEGIRRLVLCSGKLYYELDEERRKVEAKDVAICRVEQLCPFPYDLIQRELKRYPNAEIVWCQEEPMNMGAYSYIAPRLCSAMKSLGRGTIEDIKYVGRAPSAATATGFYQVHVKEQNEIVHKAVQPEPIEYHI

SEQ ID NO: 5766 - protein, 1023 aa, Gossypium raimondii
MGWLRAGSSVAKLAIRRTLSQGGSYATRSRIVPSQGRYFHTTVFKSKAQTAPVPRPVPLSKLTDSFLDGTSSVYLEELQRAWEADPDSVDESWDNFFRNFVGQAATSPGISGQTIQESMRLLLLVRAYQVNGHMKAKLDPLGLEEREIPDDLDPAFYGFTEADLDREFFLGVWRMAGFLSENRPVQTLRSILTRLEQAYCGSIGFEYMHIAERDKCNWLRDKIETPTPMQYNRQRREVILDRLIWSTQFENFLATKWTTAKRFGLEGGETLIPGMKEMFDRAADLGVESIVIGMPHRGRLNVLGNVVRKPLRQIFSEFSGGTRPVDEVGLYTGTGDVKYHLGTSYDRPTRGGKRIHLSLVANPSHLEAVDPVVVGKTRAKQYYSNDEDRTKNMAVLIHGDGSFAGQGVVYETLHLSALPNYTTGGTIHIVVNNQVAFTTDPRAGRSSQYCTDVAKALNAPIFHVNGDDVEAVVHACELAAEWRQTFHSDVVVDLVCYRRFGHNEIDEPSFTQPKMYKIIRNHPSALQIYRNKLLESGQVTDDDIGNISQKVSTILNDEFLASKDYVPKRRDWLSAYWTGFKSPEQISRVRNTGVKPEILKNVGKAITTLPDNFKPHRAVKKVYEQRAQMIETGEGLDWAMGEALAFATLLVEGNHVRLSGQDVERGTFSHRHSVIHDQETGEQYCPLDHVIINQNEEMFTVSNSSLSEFGVLGFELGYSMENPNSLVMWEAQFGDFANGAQVIFDQFISSGEAKWLRQTGLVVLLPHGYDGQGPEHSSARLERYLQMSDDNPFVIPEMDTTLRKQIQECNWQVVNVTTPANYFHVLRRQIHREFRKPLIVMSPKNLLRHKDCKSNLSEFDDVQGHPGFDKQGTRFKRLIKDQNMHSDLEEGIRRLVLCSGKVYYELDDERKKNNATDVAICRVEQLCPFPYDLIQRELKRYPNAEIVWCQEEPMNMGAYNYIAPRLATAMTALGRGTFDDIRYIGRAPSASTATGFYSVHVKEQTELVQKAIQPEPIKTNITI

SEQ ID NO: 5767 - protein, 1021 aa, Sequoia sempervirens
MTIPRLYSGLYRAALRIRLAQQSSYTKKSSVWSLPYARFFHSTPHNFQQSTAPVPRAVPLSRLTDSFLDGTSSVYLEELQRAWEADPQSVDESWDNFFRNFVGQAATSPGISGQTIQESMRLLLLLRAYQVNGHMKAKLDPLGLEQREIPVELDPALYGFTEADLDREFFLGVWRMSGFLSENRPVQTLRSILTRLEQAYCGTVGYEYMHIADRDKCNWLREKIETVVPSKYGPERRYVMLDRLIWSTQFENFLATKWTAAKRFGLEGAETLIPGMKEMFDRSADMGVESIVIGMSHRGRLNVLANVVRKPLRHIFSEFSSGTKPVEEVGSYTGTGDVKYHLGTSYDRPTRGGKRIHLSLVANPSHLEAVDPVVVGKTRAKQYYSNDKDRTKNMAVLIHGDGSFAGQGVVYETLHLSALPNYTTGGTIHIVVNNQVAFTTDPKAGRSSQYCTDVAKALNAPIFHVNGDDMEAVVHVCELAAEWRQTFHSDVVVDIVCYRRFGHNEIDEPSFTQPKMYQVIRNHPRALDLYEKQLIESGQLSKEEIDDLHNKVNSILNEEFVNSKEYVSNRRDWLAAYWAGFKSPEQLSRIRNTGVKPEILKNVGKAITSLPETFKPHRAVKRIFDQRAQMIEKGEGVDWAVGEALAFATLLVEGNHVRLSGQDVERGTFSHRHAVLHDQETGERYCPLDHVTMNQNEEMFTVSNSSLSEFGVLGFELGYSMENPNSLVLWEAQFGDFANGAQVIFDQFISSGESKWLRQTGLVVLLPHGYDGQGPEHSSARLERFLQGSDDNPFVIPEMDPTLRTQIQQCNWQVVNVTTPANYFHVLRRQIHRDFRKPLIVMSPKNLLRHKDCKSNLSEFDDVQGHPGFDKQGTRFKRLIKDQNDHSDQEEGINRLILCSGKVYYELDEERKRVQRKDVAICRIEQLCPFPYDLVQRELKRYPNAEIVWCQEEPMNMGGYHYISLRLLTAMKALGRGTFEDIKYVGRAPSAATATGFNQVHVREQKELVETALQPAPIKFP

SEQ ID NO: 5768 - protein, 714 aa, Ambrosia trifida
MTWFRAGSSVAKLAIRRTLTQSGSYAARKRVFPAESRYFHTTVFKSKAQSAPVPRAVPLSRLTDSFLDGTSSVYLEELQRAWEDDPNSVDESWDNFFRNFVGQAATSPGISGQTIQESMRLLLLVRAYQVYGHMKAKIDPLGLEKRETPDDLDPAFYGFSEADLDREFFLGVWRMSGFLSENRPVQTLRNILTRLEQAYCGNIGYEYMHIADRERCNWLRDKIETPTPTQYNRERREVILDRLIWSTQFENFLATKWTAAKRFGLEGGETLIPGMKEMFDRSADLGVESIVIGMSHRGRLNVLGNVVRKPLRQIFSEFSGGTKPVDEVGLYTGTGDVKYHLGTSYDRPTRGGKRIHLSLVANPSHLEAVDPVVIGKTRAKQYYSNDVDRTKNMGILIHGDGSFAGQGVVYETLHLSGLPNYTTGGTIHIVVNNQVAFTTDPQAGRSSQYCTDVAKALNAPIFHVNGDDVEAVVHACELAAEWRQTFHSDVVVDIVCYRRFGHNEIDEPSFTQPKMYKIIRNHPSSLEIYQKKLLESGQATKEDIDRIQSKVTTILNEEFLASKDYVPQRRDWLSAYWAGFKSPEQLSRIRNTGVKPEILKNVGKAITTLPETFKPHRAVKKIFADRYKMIETGEGVDWAVAEALAFATLLVEGNHVRLSGQDVERGTFSHRHSVLHDQETGERYCPLDHVMMNQHEEMFTVKQQFSFGVWCAGI

SEQ ID NO: 5769 - protein, 1023 aa, Gossypium hirsutum
MGWLRAGSSVAKLAIRRTLSQGGSYAARSRIVPSQSRYFHTTVFKSKAQTAPVPRPVPLSKLTDSFLDGTSSVYLEELQRAWEADPDSVDESWDNFFRNFVGQAATSPGISGQTIQESMRLLLLVRAYQVNGHMKAKLDPLGLEEREIPDDLDPAFYGFTEADLDREFFLGVWRMAGFLSENRPVQTLRSILTRLEQAYCGSIGFEYMHIAERDKCNWLRDKIETPTPMQYNRQRREVILDRLIWSTQFENFLATKWTTAKRFGLEGGETLIPGMKEMFDRAADLGVESIVIGMPHRGRLNVLGNVVRKPLRQIFSEFSGGTRPVDEVGLYTGTGDVKYHLGTSYDRPTRGGKRIHLSLVANPSHLEAVDPVVVGKTRAKQYYSNDEDRTKNMAILIHGDGSFAGQGVVYETLHLSALPNYTTGGTIHIVVNNQVAFTTDPRAGRSSQYCTDVAKALNAPIFHVNGDDVEAVVHACELAAEWRQTFHSDVVVDLVCYRRFGHNEIDEPSFTQPKMYKIIRNHPSALQIYRNKLLESGQVTDDDIGNISQKVSTILNDEFLASKDYVPKRRDWLSAYWTGFKSPEQISRVRNTGVKPEILKNVGKAITTLPDNFKPHRAVKKVYEQRAQMIETGEGLDWAMGEALAFATLLVEGNHVRLSGQDVERGTFSHRHSVIHDQETGEQYCPLDHVIINQNEEMFTVSNSSLSEFGVLGFELGYSMENPNSLVMWEAQFGDFANGAQVIFDQFISSGEAKWLRQTGLVVLLPHGYDGQGPEHSSARLERYLQMSDDNPFVIPEMDTTLRKQIQECNWQVVNVTTPANYFHVLRRQIHREFRKPLIVMSPKNLLRHKDCKSNLSEFDDVQGHPGFDKQGTRFKRLIKDQNMHSDLEEGIRRLVLCSGKVYYELDDERKKNNATDIAICRVEQLCPFPYDLIQRELKRYPNAEIVWCQEEPMNMGAYNYIAPRLATAMTALGRGTFDDVRYVGRAPSASTATGFYSMHVKEQAELVQKAIQPEPIKTNTTI

SEQ ID NO: 5770 - protein, 816 aa, Ambrosia trifida
MHIADRERCNWLRDKIETPTPTQYNRERREVILDRLIWSTQFENFLATKWTAAKRFGLEGGETLIPGMKEMFDRSADLGVESIVIGMSHRGRLNVLGNVVRKPLRQIFSEFSGGTKPVDEVGLYTGTGDVKYHLGTSYDRPTRGGKRIHLSLVANPSHLEAVDPVVIGKTRAKQYYSNDVDRTKNMGILIHGDGSFAGQGVVYETLHLSGLPNYTTGGTIHIVVNNQVAFTTDPQAGRSSQYCTDVAKALNAPIFHVNGDDVEAVVHACELAAEWRQTFHSDVVVDIVCYRRFGHNEIDEPSFTQPKMYKIIRNHPSSLEIYQKKLLESGQATKEDIDRIQSKVTTILNEEFLASKDYVPQRRDWLSAYWAGFKSPEQLSRIRNTGVKPEILKNVGKAITTLPETFKPHRAVKKIFADRYKMIETGEGVDWAVAEALAFATLLVEGNHVRLSGQDVERGTFSHRHSVVHDQETGERYCPLDHVMMNQHEEMFTVSNSSLSEFGVLGFELGYSMENPNSLVLWEAQFGDFSNGAQVIFDQFLSSGEAKWLRQTGLVVLLPHGYDGQGPEHSSSRLERFLQMSDDNPFVIPEMEPTLRNQIQTCNMQIVNVTTPANYFHVLRRQLHREFRKPLVVMSPKNLLRHKDCKSNLSEFDDVQGHPGFDKQGTRFKRLIKDQNDHADLEEGIRRLVLCSGKVYYELDEQRKSVSGKDVAICRVEQLCPFPYDLIQRELKRYPNAEVVWCQEEPMNMGPYSYIAPRLATAMKDLNRGTIDDIKYVGRAPSAATATGFYTVHGREQSELVQKALQPESITNPALC

SEQ ID NO: 5771 - protein, 905 aa, Flaveria ramosissima
MRLLLLVRAYQVYGHMKAKIDPLGLEKRETPDDLDPAFYGFSEADLDREFFLGVWRMSGFLSENRPVQTLRSILTRLEQAYCGNIGYEYMHIADRERCNWLRDKIETPTPTQYNRERREVILDRLIWSTQFENFLATKWTAAKRFGLEGGETLIPGMKEMFDRSADLGVESIVIGMSHRGRLNVLGNVVRKPLRQIFSEFSGGTKPVDEVGLYTGTGDVKYHLGTSYDRPTRGGKRIHLSLVANPSHLEAVDPVVIGKTRAKQYYSNDVDRTKNMGILIHGDGSFAGQGVVYETLHLSGLPNYTTGGTIHIVVNNQVAFTTDPQAGRSSQYCTDVAKALNAPIFHVNGDDVEAVVHACELAAEWRQTFHSDVVVDIVCYRRFGHNEIDEPSFTQPKMYKIIRNHPSSLEIYQKKLLESGQATKEDIDRIQSKVTTILNEEFLASKDYVPQRRDWLSAYWTGFKSPEQLSRIRNTGVKPEILKNVGKAITTLPETFKPHRAVKKIFADRYKMIETGEGVDWAVAEALAFATLLVEGNHVRLSGQDVERGTFSHRHSVLHDQETGERYCPLDHVMMNQNEEMFTVSNSSLSEFGVLGFELGYSMENPNSLVLWEAQFGDFSNGAQVIFDQFLSSGEAKWLRQTGLVVLLPHGYDGQGPEHSSARLERFLQMSDDNPFVIPEMEPTLRNQIQTCNMQIVNVTTPANYFHVLRRQLHREFRKPLIVMSPKNLLRHKDCKSNLSEFDDVQGHPGFDKQGTRFKRLIKDQNDHSDLEEGIRRLVLCSGKVYYELDEQRKSVDGKDVAICRVEQLCPFPYDLIQRELKRYPNAEIVWCQEEPMNMGAYSYIAPRLATAMKALNRGTIDDIKYVGRAPSAATATGFYTVHGREQSELVQKALQPEPVTSPALS

SEQ ID NO: 5772 - protein, 1042 aa, Vinca minor
MAWFRAGSNVAKLAVRRSLARGGGGSYVARAHVIPLQNRYFHTTVFKPKAQSAPVPRPVPLSKLTDSFLDGTSSVYLEELQRAWEQDPNSVDESWDNFFRNFVGQAATSPGISGQTIQESMRLLLVVRAYQVYGHMKANLDPLGLEQREIPDDLDPALYGFSEADLDREFFIGVWRMSGFLSENRPVQTLRAILTRLEQAYCGNIGYEYMHIADREKCNWLRDRIETPTPIEYNRERREVILDRLVWSSQFENFLATKWTAAKRFGLEGAETLIPGMKEMFDRSADLGVESIVIGMSHRGRLNVLGNVVRKPLRQIFSEFSGGTKPSDEVGLYTGTGDVKYHLGTSYDRPTRGGKRIHLSLVANPSHLEAVDPVVVGKTRAKQYYSNDVDRTKNMGILIHGDGSFAGQGVVYETLHLSALPNYTTGGTIHIVVNNQVAFTTDPQSGRSSQYCTDVAKALNAPIFHVNGDDVEAVVRVCELAAEWRQTFHSDVVVDIVCYRRFGHNEIDEPSFTQPKMYKVIRNHPSALEIYQKKLLGSGQVSKEDVDRISKKVNAILNEEFLASKEYIPQRRDWLSAYWAGFKSPEQLSRIRNTGVKPEILKNVGKAITSLPENFKAHRAVKRVYDERAKMIETGEGIDWAVGEALAFATLLVEGNHVRLSGQDVERGTFSHRHSVLHDQETGEKYCPLDHVMMNQNEEMFTVSNSSLSEFGVLGFELGYSMENPNSLVLWEAQFGDFANGAQVIFDQFVSSGEAKWLRQSGLVVLLPHGYDGQGPEHSSARLERFLQMSDDHPYLIPEMDSTLRKQIQECNWQVVNVTTPANYFHVLRRQIHREFRKPLIVMSPKNLLRHKECKSNLSEFDDVQGHPGFDKQGTRFKRLIKDQNDHSDLEEGISRLVLCSGKVYYELDEERRKVGRKDVAICRVEQLCPFPYNLIQRELKRYPNAEIVWCQEEPMNMGAYSYISPRLCSAMKALGRGNLDDIKYVGRGPSAATATGSFRFTSRSRPNLFKKLCRKSPSINFPSRNYQMRPNNILGYLPFFE

SEQ ID NO: 5773 - protein, 1021 aa, Euphorbia peplus
MTWFRAGTTVARHAIRRTLSQSGTYTTRARIIPSQSRYFHSTVFKSQAQSAPVPRPVPLSKLTDSFLDGTSSVYLEELQRAWEADPNSVDESWDNFFRNFVGQAATSPGISGQTIQESMRLLLLVRAYQVNGHMKAKLDPLGLEEREIPDDLNPALYGFTDADLDREFFLGVWRMAGFLSENRPVQTLRSILTRLEQAYCGSIGYEYMHIADREKCNWLRDKIETPTPTQYNRQRREVILDRLIWSTQFENFLATKWTTAKRFGLEGGETLIPGMKEMFDRSADLGVESIVIGMPHRGRLNVLGNVVRKPLRQIFSEFSGGTKPVDEVGLYTGTGDVKYHLGTSYDRPTRGGKRIHLSLVANPSHLEAVDPVVVGKTRAKQYYSNDENRTKHMGILIHGDGSFAGQGVVYETLHLSALPNYTTGGTIHIVVNNQVAFTTDPRAGRSSQYCTDVAKALDAPIFHVNGDDVEAVVHACELAAEWRQTFHSDVVVDLVCYRRFGHNEIDEPSFTQPKMYKIIRSHPSALEIYRQKLLESEQVGEEDISKIQAKVTAILNEEFLASKDYVPKRRDWLSSHWAGFKSPEQLSRVRNTGVKPEILKNVGKAITSLPDTFKPHRAVKKVYEQRAQMIETGEGIDWAVAEALAFATLLVEGNHVRLSGQDVERGTFSHRHSVIHDQETGEQYCPLDHVIMNQNAEMFTVSNSSLSEFGVLGFELGYSMESPNSLVIWEAQFGDFANGAQVIFDQFISSGESKWLRQTGLVVLLPHGYDGQGPEHSSARLERFLQMSDDNPFVIPEMDATLRKQIQECNWQVVNVTTPANYFHVLRRQLHRDFRKPLVVMAPKNLLRHKDCKSNLSEFDDVQGHPGFDKQGTRFKRLIKDQNDHSDLEEGVRRLVLCSGKVYYELDEERKKNNAKDVAICRVEQLCPFPYDLVQRELKRYPNAEIVWCQEEAMNMGAYSYVLPRLCTTVKQMGRGSIEDIKYVGRAPSAATATGFYQVHVKEQTELVQKAIQQEPIKYPF

SEQ ID NO: 5774 - protein, 814 aa, Papaver somniferum
MHIADRDKCNWLRDKIETPTPRQYNLQRREVMLDRLMWSTQFENFLATKWTAAKRFGLEGGETLIPGMKEMFDRSADLGVESIVIGMSHRGRLNVLGNVVRKPLAQIFSEFSGGIKPIDEVGLYTGTGDVKYHLGTSYDRPTRGGKRLHLSLVANPSHLEAVDPLVIGKTRAKQYYSNDLDRTKNLGVLIHGDGSFAGQGVVYETLHLSALPNYTTGGTIHIVVNNQVAFTTDPMSGRSSEYCTDVAKALDAPIFHVNGDDLEAVVYVCELAAEWRQTFHSDVVVDVVCYRRFGHNEIDEPSFTQPKMYQVIRNHPSALELYQKKLLETEQITEEDIKRMQNKVNKILNEEFVNSKDYVPKKRDWLAAYWTGFKSPEQVSRVRNTGVKPEILKSVGKAITSLPETFKPHRAVKKIFEQRAQMIETGEGIDWAVGEALAFATLLVEGNHVRLSGQDVERGTFSHRHSVIHDQETGEKYCPLDHVTMNQDEEMFTVSNSSLSEFGVLGFELGYSMENPNSLVIWEAQFGDFSNGAQVMFDQFLSSGESKWLRQTGLVVLLPHGYDGQGPEHSSARMERFLQMSDDNPYVIPEMDQTLRKQIQECNWQVANVTTPANYFHLLRRQIHREFRKPLVVMAPKNLLRHKDCKSNLSEFDDVKGHPGFDKQGTRFKRLIKDQKDRSDLEEGVRRLVLCSGKVYYELDEERKKVSGDDVAICRVEQLCPFPYDLIQRELKRYPNAEVVWCQEEPMNMGGYSYIAPRLCTAMKALGRGTMEDIKYVGRGPSAATATGFYSVHTKEQTDLVHKALQPEPINYPF

SEQ ID NO: 5775 - protein, 1020 aa, Solanum lycopersicum
MAWFRAGSSVAKLAIRRAVSQGGSYVPRTRIIPSQSRYFHTTVVRPKAQAAPVPRPVPLSKLTDSFLDGTSSVYLEELQRAWEQDPSSVDESWDNFFRNFTGLAATSPGISGQTIQESMNLLLLVRAYQVNGHLKAKLDPLDLEERDIPDVLDPVSYGFTEADLDREFFLGVWRMAGFLSENRPVQTLRAILTRLEQAYCGSIGFEYMHISDRDKCNWLRERIETPTPREYNRERREVILDRLMWSTQFENFLATKWVAAKRFGLEGCETLIPGMKEMFDRSADLGVESIVIGMPHRGRLNVLGNVVRKPLRQIFSEFTGGTKPADGAGYVGTGDVKYHLGTSYDRPTRGGKRIHLSLVANPSHLEAVDPVVIGKTRAKQYYSNDVDRTKNMGILLHGDGSFAGQGVVYETLHLSALPNYTTGGTIHIVVNNQVAFTTDPKAGRSSQYCTDVAKALSAPIFHVNGDDVEGVVYACELAAEWRQTFHSDVVVDIVCYRRFGHNEIDEPSFTQPKMYQVIRNHPSSLEIYQNKLLQHGQVTKDDVEKIHNKINTILNEEFVASKDYVPQKRDWLSAFWSGFKSPAQLSRVRNTGVKPEILKDVGKAITSLPDDFKPHRAVKRIFDDRKKMIETGEGVDWAVGEALAFATLLVEGNHVRLSGQDVERGTFSHRHSVVHDQETGAKYCPLDHVMMNQNEEMFTVSNSSLSEFGVLGFELGYSMENPNSLVLWEAQFGDFANGAQVIFDQFLSSGEAKWLRQSGLVVLLPHGYDGQGPEHSSARLERFLQMSDDNPYVIPDMEPTLRKQIQECNLQVVNVTTPANYFHVLRRQIHRDFRKPLIVMSPKNLLRHKDCKSNLSEFDDVQGHPGFDKQGTRFKRLIKDQNDHSDLEEDIRRLVLCSGKVYYELDEERKKVEGKDVAICRVEQLCPFPYDLVQRELKRYPNAEIVWCQEEPMNMGAYHYIAPRLSTAMKALNRGNVDDIKYVGRAPSAATATGFYQVHVKEQTELVQKALQQDPISSPV

SEQ ID NO: 5776 - protein, 1021 aa, Populus trichocarpa
MAWFRAGASVARLAIRRTLSQGGSYATRSRVIPSQSRYFHSTVTKSKEQTAPVPRPVPLSKLTDNFLDGTSSVYLEELQRAWEADPNSVDESWDNFFRNFVGQAATSPGISGQTIQESMRLLLLLRAYQVNGHMKAKLDPLGLEEREIPDELDPALYGFTEADLDREFFLGVWKMAGFLSENRPVQTLRSILTRLEQAYCGSIGYEYMHIADREKCNWLRDKIETPTPMQYNRQRHEVILDRLIWSTQFENFLATKWTAAKRFGLEGGETLIPGMKEMFDRSADLGVESIVIGMPHRGRLNVLGNVVRKPLRQIFSEFSGGTKPVDEVGLYTGTGDVKYHLGTSYDRPTRGGKRIHLSLVANPSHLEAVDPVVVGKTRAKQYYSNDSDRTKNMGILIHGDGSFAGQGVVYETLHLSALPNYTTGGTIHIVVNNQVAFTTDPRAGRSSQYCTDVAKALNAPIFHVNGDDMEAVVRVCELAAEWRQTFHSDVVVDLVCYRRFGHNEIDEPSFTQPKMYQVIRNHPSALEIYKKKLLESGQVTEEDIHRIQEKVLSILNEEFLASKDYVPKRRDWLASHWSGFKSPEQLSRVRNTGVKPEILKNVGKAITTLPDNFKPHRAVKKVYDQRAQMIETGEGIDWAVGEALAFATLLVEGNHVRLSGQDVERGTFSHRHSVIHDQETGEKYCPLDHVTINQNEEMFTVSNSSLSEFGVLGFELGYSMESPNSLVIWEAQFGDFANGAQVIFDQFLSSGESKWLRQTGLVVLLPHGYDGQGPEHSSGRLERFLQMSDDNPFVIPEMEPTFRKQIQECNWQVVNVTTPANYFHVLRRQIHRDFRKPLVVMAPKNLLRHKDCKSNLSEFDDVQGHPGFDKQGTRFKRLIKDQNDHSDLEEGIRRLVLCSGKVYYELDEERRKVEAKDIAICRVEQLCPFPYDLIQRELKRYPSAEVVWCQEEPMNMGAYSYIAPRLSTAMKALGRGTMDDIKYAGRGPSAATATGFYQMHVKEQAELLQKAMQPEPIQIPN

SEQ ID NO: 5777 - protein, 1020 aa, Nicotiana benthamiana
MAWFRAGSSVAKLAIRRAVSQGGSYVPRSRILPSQSRYFHTTVIRPKAQSAPVPRPVPLSKLTDSFLDGTSSVYLEELQRTWEQDPNSVDESWDNFFRNFVGLAATSPGISGQTIQESMNLLLLVRAYQVNGHMKAKLDPLALEEREIPDVLDPVSYGFTEADLDREFFLGVWRMSGFLSENRPVQTLRAILTRLEQAYCGSIGFEYMHIPDRDKCNWLRERIETPTPREYNPERREVILDRLMWSTQFENFLATKWMAAKRFGLEGCETLIPGMKEMFDRSADLGVESIVIGMPHRGRLNVLGNVVRKPLRQIFSEFSGGTKPADGAGYVGTGDVKYHLGTSYDRPTRGGNRIHLSLVANPSHLEAVDPVVVGKTRAKQYYSNDVDRTKNMGVLLHGDGSFAGQGVVYETLHLSALPNYTTGGTIHIVVNNQVAFTTDPRSGRSSQYCTDVAKALSAPIFHVNGDDVEGVVHACELAAEWRQTFHSDVVVDIVCYRRFGHNEIDEPSFTQPKMYKVIRSHPSALEIYQDKLLQSGQVTKDDVEKIHNKINTILNEEFVASKDYIPQKRDWLSAFWSGFKSPAQLSRVRNTGVKPEILKDVGKAITTLPEDFKPHRAIKKVYDERKKMIETGERVDWALGEALAFATLLVEGNHVRLSGQDVERGTFSHRHSVLHDQETGAKYCPLDHVMMNQNEEMFTVSNSSLSEFGVLGFELGYSMENPNSLVLWEAQFGDFSNGAQVIFDQFLSSGEAKWLRQTGLVVLLPHGYDGQGPEHSSARLERFLQMSDDNPFVIPEMEPTLRKQIQECNWQVVNVTTPANYFHVLRRQIHRDFRKPLIVMSPKNLLRHKECKSNLSEFDDVQGHPGFDKQGTRFKRLIKDQNDHSDLEEGIRRLVLCSGKVYYELDEERKKVDGKDVAICRVEQLCPFPYDLVQRELKRYPNAEIVWCQEEPMNMGAYSYIAPRLCTAMKALGRGDMDDIKYVGRAPSAATATGFQQVHVKEQTELVQKALQRDPINSPF

SEQ ID NO: 5778 - protein, 1017 aa, Arabidopsis lyrata
MVWFRAGSSVTKLAVRRILNQGGSYATRTRSLPSQTRSFHSTIYRPKAQSAPVPRAVPLSKLTDSFLDGTSSVYLEELQRAWEADPNSVDESWDNFFRNFVGQAATSPGISGQTIQESMRLLLLVRAYQVNGHMKAKLDPLGLEQREIPEDLDLALYGFTEADLDREFFLGVWQMSGFMSENRPVQTLRSILTRLEQAYCGNIGFEYMHIADRDKCNWLREKIETPTPWRYNRERREVILDRLAWSTQFENFLATKWTTAKRFGLEGGESLIPGMKEMFDRAADLGVESIVIGMSHRGRLNVLGNVVRKPLRQIFSEFSGGIRPVDEVGYTGTGDVKYHLGTSYDRPTRGGKKIHLSLVANPSHLEAADSVVVGKTRAKQYYSNDLDRTKNLGILIHGDGSFAGQGVVYETLHLSALPNYTTGGTIHIVVNNQVAFTTDPKAGRSSQYCTDVAKALSAPIFHVNGDDVEAVVHACELAAEWRQTFHSDVVVDLVCYRRFGHNEIDEPSFTQPKMYKVIKNHPSTLQIYHKKLLECGEVSQQDIDRIQEKVNTILNEEFVSSKDYLPKKRDWLSTNWAGFKSPEQISRVRNTGVKPEILKSVGKAISSLPENFKPHRAVKKVYEQRAQMIESGEGVDWALAEALAFATLVVEGNHVRLSGQDVERGTFSHRHSVLHDQETGEEYCPLDHLIMNQDPEMFTVSNSSLSEFGVLGFELGYSMESPNSLVLWEAQFGDFANGAQVIFDQFISSGEAKWLRQTGLVMLLPHGYDGQGPEHSSARLERYLQMSDDNPYVIPDMEPTMRKQIQECNWQIVNATTPANYFHVLRRQIHRDFRKPLIVMAPKNLLRHKDCKSNLSEFDDVQGHPGFDKQGTRFKRLIKDQNDHSDLEEGIRRLVLCSGKVYYELDDERKKVGATDVAICRVEQLCPFPYDLIQRELKRYPNAEIVWCQEEAMNMGAFSYISPRLWTAMRSLNRGDMEDIKYVGRGPSAATATGFYTFHVKEQAELVQKAIGKEPIN

SEQ ID NO: 5779 - protein, 1017 aa, Arabidopsis thaliana
MVWFRAGSSVTKLAVRRILNQGASYATRTRSIPSQTRSFHSTICRPKAQSAPVPRAVPLSKLTDSFLDGTSSVYLEELQRAWEADPNSVDESWDNFFRNFVGQAATSPGISGQTIQESMRLLLLVRAYQVNGHMKAKLDPLGLEQREIPEDLDLALYGFTEADLDREFFLGVWQMSGFMSENRPVQTLRSILTRLEQAYCGNIGFEYMHIADRDKCNWLREKIETPTPWRYNRERREVILDRLAWSTQFENFLATKWTTAKRFGLEGGESLIPGMKEMFDRAADLGVESIVIGMSHRGRLNVLGNVVRKPLRQIFSEFSGGIRPVDEVGYTGTGDVKYHLGTSYDRPTRGGKKIHLSLVANPSHLEAADSVVVGKTRAKQYYSNDLDRTKNLGILIHGDGSFAGQGVVYETLHLSALPNYTTGGTIHIVVNNQVAFTTDPRAGRSSQYCTDVAKALSAPIFHVNGDDVEAVVHACELAAEWRQTFHSDVVVDLVCYRRFGHNEIDEPSFTQPKMYKVIKNHPSTLQIYHKKLLECGEVSQQDIDRIQEKVNTILNEEFVASKDYLPKKRDWLSTNWAGFKSPEQISRVRNTGVKPEILKTVGKAISSLPENFKPHRAVKKVYEQRAQMIESGEGVDWALAEALAFATLVVEGNHVRLSGQDVERGTFSHRHSVLHDQETGEEYCPLDHLIMNQDPEMFTVSNSSLSEFGVLGFELGYSMESPNSLVLWEAQFGDFANGAQVIFDQFISSGEAKWLRQTGLVMLLPHGYDGQGPEHSSARLERYLQMSDDNPYVIPDMEPTMRKQIQECNWQIVNATTPANYFHVLRRQIHRDFRKPLIVMAPKNLLRHKDCKSNLSEFDDVQGHPGFDKQGTRFKRLIKDQNDHSDLEEGIRRLVLCSGKVYYELDDERKKVGATDVAICRVEQLCPFPYDLIQRELKRYPNAEIVWCQEEAMNMGAFSYISPRLWTAMRSVNRGDMEDIKYVGRGPSAATATGFYTFHVKEQAGLVQKAIGKEPIN

SEQ ID NO: 5780 - protein, 1021 aa, Populus trichocarpa
MAWFRAGASVARLAIRRTLSQGGSYATRSRVIPSQSRYFHSTVTKSKEQTAPVPRPVPLSKLTDNFLDGTSSVYLEELQRAWEADPNSVDESWDNFFRNFVGQAATSPGISGQTIQESMRLLLLLRAYQVNGHMKAKLDPLGLEEREIPDELDPALYGFTEADLDREFFLGVWKMAGFLSENRPVQTLRSILTRLEQAYCGSIGYEYMHIADREKCNWLRDKIETPTPMQYNRQRHEVILDRLIWSTQFENFLATKWTAAKRFGLEGGETLIPGMKEMFDRSADLGVESIVIGMPHRGRLNVLGNVVRKPLRQIFSEFSGGTKPVDEVGLYTGTGDVKYHLGTSYDRPTRGGKRIHLSLVANPSHLEAVDPVVVGKTRAKQYYSNDSDRTKNMGILIHGDGSFAGQGVVYETLHLSALPNYTTGGTIHIVVNNQVAFTTDPRAGRSSQYCTDVAKALNAPIFHVNGDDMEAVVRVCELAAEWRQTFHSDVVVDLVCYRRFGHNEIDEPSFTQPKMYQVIRNHPSALEIYKKKLLESGQVTEEDIHRIQEKVLSILNEEFLASKDYVPKRRDWLASHWSGFKSPEQLSRVRNTGVKPEILKNVGKAITTLPDNFKPHRAVKKVYDQRAQMIETGEGIDWAVGEALAFATLLVEGNHVRLSGQDVERGTFSHRHSVIHDQETGEKYCPLDHVTINQNEEMFTVSNSSLSEFGVLGFELGYSMESPNSLVIWEAQFGDFANGAQVIFDQFLSSGESKWLRQTGLVVLLPHGYDGQGPEHSSGRLERFLQMSDDNPFVIPEMEPTFRKQIQECNWQVVNVTTPANYFHVLRRQIHRDFRKPLVVMAPKNLLRHKECKSNLSEFDDVQGHPGFDKQGTRFKRLIKDQNDHSDLEEGIRRLVLCSGKVYYELDEERRKVEAKDIAICRVEQLCPFPYDLIQRELKRYPSAEVVWCQEEPMNMGAYSYIAPRLSTAMKALGRGTMDDIKYAGRGPSAATATGFYQMHVKEQAELLQKAMQPEPIQIPN

SEQ ID NO: 5781 - protein, 1020 aa, Vinca minor
MAWFRAGSNVAKLAVRRSLARGGGGSYVSRTHVIPLQNRYFHTTVFKPKAQSAPVPRSVPLSKLTDSFLDGTSSVYIEELQRAWEQDPNSVDESWDNFFRNFVGQAATSPGISGQTIQESMRLLLVVRAYQVYGHMKAKLDPLGLEQREIPDDLDPAFYGFSEADLDREFFIGVWRMSGFLSENRPVQTLRAILTRLEQAYCGNIGYEYMHIADREKCNWLRDRIETPTPTEYNRERREVILDRLVWSSQFENFLATKWTAAKRFGLEGAETLIPGMKEMFDRSADLGVESIVIGMSHRGRLNVLGNVVRKPLRQIFSEFSGGTKPSDEVGLYTGTGDVKYHLGTSYDRPTRGGKRIHLSLVANPSHLEAVDPVVVGKTRAKQYYSNDLDRTKNMGILIHGDGSFAGQGVVYETLHLSALPNYTTGGTIHIVVNNQVAFTTDPQSGRSSQYCTDVAKALNVPIFHVNGDDVEAVVRVCELAAEWRQTFHSDVVVDIVCYRRFGHNEIDEPSFTQPKMYKVIRNHPSALEIYQKKLLGSGQVSKEDVDRISKKVNTILNEEFLASKEYIPQRRDWLSAYWAGFKSPEQLSRIRNTGVKPEILKNVGKAITSLPENFKAHRAVKRVYDERAKMIETGEGIDWAVGEALAFATLLVEGNHVRLSGQDVERGTFSHRHSVLHDQETGEKYCPLDHVMMNQNEEMFTVSNSSLSEFGVLGFELGYSMENPNSLVLWEAQFGDFANGAQVIFDQFISSGEAKWLRQTGLVVLLPHGYDGQGPEHSSARLERFLQMSDDHPYVIPEMDSTFRKQIQECNWQVVNVTTPANYFHVLRRQIHREFRKPLIVMSPKNLLRHKECKSNLSEFDDVEGHPGFDKQGTRFKRLIKDQNNHSDLEEGISRLVLCSGKVYYELDEERRKVGRKDVAICRVEQLCPFPYNLIQRELNRYPNAEIVWCQEEPMNMGAYTYISPRLSTAMKALGRGNIDDIKYVGRGPSAATATGFLSVHVKEQTELVQKALQKEPIN

SEQ ID NO: 5782 - protein, 813 aa, Sciadopitys verticillata
MHIPDRDKCNWLREKIETVVPSKYGPERRHVILDRLIWSSQFENFLATKWTAAKRFGLEGAETLIPGMKEMFDRSADMGVESIVIGMSHRGRLNVLGNVVRKPLRQIFSEFSGGTKPVDEVGSYTGTGDVKYHLGTSYDRPTRGGKRIHLSLVANPSHLEAVDPVVVGKTRAKQYYSNDEDRTKNMAILIHGDGSFAGQGVVYETLHLSALPNYTTGGTIHIVVNNQVAFTTDPKAGRSSQYCTDVAKALNAPIFHVNGDDVEAVVHVCELAAEWRQTFHSDVVVDIVCYRRFGHNEIDEPSFTQPKMYQVIRNHPRAVDVYEKQLIESGQLSKEEIGALHTKVNSILNEEFINSKEYVPKRRDWLAAYWAGFKSPEQLSRVRNTGVKPEILKNVGKAITTLPETFKPHRAVKRIFEQRAQMIEKGEGVDWAVGEALAFATLLVEGNHVRLSGQDVERGTFSHRHAVLHDQETGEIYCPLDHVIMNQNEEMFTVSNSSLSEFGVLGFELGYSMENPNSLVLWEAQFGDFSNGAQVIFDQFLSCGESKWLRQTGLVVLLPHGYDGQGPEHSSARLERFLQMSDDNPFVIPEMDPTLRTQIQQCNWQVVNVTTPANYFHVLRRQIHRDFRKPLIVMSPKNLLRHKDCKSNLSEFDDVQGHPGFDKQGTRFKRLIKDQNDHSDREEGIQRLLLCSGKLYYELDEERQRVERNDVAICRVEQLCPFPYDLVQRELKRYPNAEIVWCQEEPMNMGAYHYISPRLHTAMKALGRGTFEDIKYVGRAPSAATATGFHQVHVKEQREIAETALQSAPIKFP

SEQ ID NO: 5783 - protein, 814 aa, Papaver somniferum
MHIADRDKCNWLRDKIETPTPRQYNLQRREVMLDRLMWSTQFENFLATKWTAAKRFGLEGGETLIPGMKEMFDRSADLGVESIVIGMSHRGRLNVLGNVVRKPLAQIFSEFSGGIKPIDEVGLYTGTGDVKYHLGTSYDRPTRGGKRLHLSLVANPSHLEAVDPLVIGKTRAKQYYSNDLDRTKNLGVLIHGDGSFAGQGVVYETLHLSALPNYTTGGTIHIVVNNQVAFTTDPMSGRSSEYCTDVAKALDAPIFHVNADDLEAVVYVCELAAEWRQTFHSDVVVDIVCYRRFGHNEIDEPSFTQPKMYQVIRNHPSALELYQKKLLETEQITEEDVKRMQNKVNTILNEEFINSKDYVPRKRDWLAAYWTGFKSPEQVSRVRNTGVKPEILKSVGKTITSLPETFKPHRAVKKIFEQRAQMIETGEGIDWAVGEALAFATLLVEGNHVRLSGQDVERGTFSHRHSVIHDQETGEKYCPLDHVTMNQDEEMFTVSNSSLSEFGVLGFELGYSMENPNSLVIWEAQFGDFSNGAQVMFDQFLSSGESKWLRQTGLVVLLPHGYDGQGPEHSSARMERFLQMSDDNPYVIPEMEPTLRKQIQECNWQVANVTTPANYFHLLRRQIHREFRKPLVVMAPKNLLRHKDCKSNLSEFDDVKGHPGFDKQGTRFKRLIKDQKDRSDLEEGVRRLVLCSGKVYYELDEERKKVSGDDVAICRVEQLCPFPYDLIQRELKRYPNAEVVWCQEEPMNMGGYNYIAPRLCTAMKALGRGTMEDIKYVGRGPSAATATGFYSVHTKEQTDLVHKALQPEPINYPF

SEQ ID NO: 5784 - protein, 1035 aa, Nicotiana benthamiana
MAWFRAGSSVARLAIRRALLQGGSYVPRTRILPSQGRCFHATVARPKPQAAPVPRPVPLSKLTDSFLDGTSSVYLEELQRAWEQDPNSVDESWDNFFRNFVGQAATSPGISGQTIQESMRLLLLVRAYQVNGHMKAKLDPLGLEEREIPDDLDPALYGFTEADLDREFFLGVWRMSGFLSENRPVQTLRAILTRLEQAYCGSIGYEYMHISDRDKCNWLRERIETPTSMEYNRERREVILDRLMWSTQFENFLATKWMAAKRFGLEGCETLIPGMKEMFDRAADLGVESIVIGMPHRGRLNVLGNVVRKPLKQIFSEFSGGTKPGDEAGYVGTGDVKYHLGTSYDRPTRGGKRIHLSLVANPSHLEAVDPVVIGKTRAKQYYSNDVDRTKNMGILLHGDGSFAGQGVVYETLHLSALPNYSTGGTIHIVVNNQVAFTTDPRAGRSSQYCTDVAKALNAPIFHVNGDDVEAVAHVCELAAEWRQKFHSDVVVDIVCYRRFGHNEIDEPSFTQPKMYKIIRNHPSSLEIYQNKLLISGQVTKDDVEKIHNKINRILNEEFVASKDYVPQKRDWLSAFWAGFKSPSQLSRVRNTGVKPEILKNVGKAITTLPDDFKPHRAVKRIFDDRRKMIETGEGVDWAVGEALAFATLLVEGNHVRLSGQDVERGTFSHRHSVLHDQETGSQYCPLDHVMMNQNEEMFTVSNSSLSEFGVLGFELGYSMENPNSLVLWEAQFGDFANGAQVIFDQFVSSGEAKWLRQSGLVVLLPHGYDGQGPEHSSGRLERFLQMSDDNPFVIPEMEPTLRKQIQECNWQVVNVTTPANYFHVLRRQIHRDFRKPLIVMAPKNLLRHKDCKSNLSEFDDVQGHPGFDKQGTRFKRLIKDQNDHSDLEEGIRRLVLCSGKIYYELDEERKKADGKDVAICRVEQLCPFPYDLIQRELKRYPNAEIVWCQEEPMNMGAFHYIAPRLCTAMKSLGRGNMDDIKYVGRAPSAATATGFFQVHVKEQSELVQKAVQRDPVNYPFSLHLPPRPLGSTKFM

SEQ ID NO: 5785 - protein, 1028 aa, Papaver somniferum
MAWFRAVSNISKLAIKRNLAQARSSSYISRTQLIRSQQQQSQYFHSSVIRSKAAPSSAPVPRPVPLSRLTDSFLNGTSSVYLEELQRAWEADPNSVDESWDNFFRNFVGQASTSPGLSGQTIQESMRLLLLVRAYQVNGHMKAKLDPLALEEREVPDDLDPALYGFTEADLDREFFLGVWTVSGFLSENRPVQTLRAILNRLEQAYCGSIGFEYMHIADRDKCNWLRDKIETPTPRQYNLQRREVMLDRLMWSTQFENFLATKWTAAKRFGLEGGETLIPGMKEMFDRSADLGVESIVIGMSHRGRLNVLGNVVRKPLAQIFSEFSGGIKPIDEVGLYTGTGDVKYHLGTSYDRPTRGGKRLHLSLVANPSHLEAVDPLVIGKTRAKQYYSNDLDRTKNLGVLIHGDGSFAGQGVVYETLHLSALPNYTTGGTIHIVVNNQVAFTTDPMSGRSSEYCTDVAKALDAPIFHVNGDDLEAVVYVCELAAEWRQTFHSDVVVDIVCYRRFGHNEIDEPSFTQPKMYQVIRNHPSALELYQKKLLETEQITEEDIKRMQNKVNTILNEEFVNSKDYVPKKRDWLAAYWTGFKSPEQVSRVRNTGVKPKILKSVGKAITSLPETFKPHRAVKKIFEQRAQMIETGEGIDWAVGEALAFATLLVEGNHVRLSGQDVERGTFSHRHSVIHDQATGEKYCPLDHVTMNQDEEMFTVSNSSLSEFGVLGFELGYSMENPNSLVIWEAQFGDFSNGAQVMFDQFLSSGESKWLRQTGLVVLLPHGYDGQGPEHSSARMERFLQMSDDNPYVIPEMDPTLRKQIQECNWQVANVTTPANYFHLLRRQIHREFRKPLVVMAPKNLLRHKDCKSNLSEFDDVKGHPGFDKQGTRFKRLIKDQKDRSDLEEGVRRLVLCSGKVYYELDEERKKVSGDDVAICRVEQLCPFPYDLIQRELKRYPNAEVVWCQEEPMNMGGYNYIAPRLCTAMKALGRGTMEDIKYVGRGPSAATATGFYSVHTKEQTDLVHKALQPEPINYPF

SEQ ID NO: 5786 - protein, 1017 aa, Silene vulgaris
MVWFRAGSRLANLAVRRTLSQGRTYVTRTQLIDTQRRAFHSTPFKSAAPVPRAVPLSKLTDSFLDGTSSVYLEALQRDWEADPSSVDESWDNFFRNFVGQAATSPGISGQTIQESMRLLLLVRAYQVNGHFKAKLDPLGLEHRPVPDDLNLDMYGFSEADLDREFFLGVWRMAGFLSENRPVQTLRSILTRLEQAYCGRIGYEYMHISDREKCNWLRERIETATPTEYNKERRQVMLDRLIWSTQFESFLATKWTTAKRFGLEGCETLIPGMKEMFDRSADLGVENIVIGMSHRGRLNVLGNVVRKPLRQIFSEFSGGTKPTDEVGLYTGTGDVKYHLGTSYDRPTRGGKRIHLSLVANPSHLEAVNPVVLGKTRAKQYYSSDDDRTKNLGILIHGDGSFAGQGVVYETFHLSALPNYTTGGTIHIVVNNQVAFTTDPSSGRSSQYCTDVAKALDVPIFHVNGDDLEAVVHVCELAAEWRQTFHSDVVIDIVCYRRFGHNEIDEPSFTQPKMYKVIRNHPSALEIYKKKVLEAGELSKDEVDVIQKKVMTILNEEFEASKDHVTSKRDWLSAYWLGFKSPEQLSRIRNTGVKPEILTNVGKAITTIPETFKPHKAVKRIYDQRAQMIETGEGIDWAVGEALAFATLLVEGNHVRLSGQDVERGTFSHRHSVIHDQETGEQYCPLDHVMINQNEELFTVSNSSLSEFGVLGFELGYSMENPNSLVIWEAQFGDFSNGAQVIFDQFLSSGEAKWLRQTGLTVLLPHGYDGQGPEHSSARLERFLQMSDDNPYVIPDMDSTLRKQIQECNWQVVNVTTPANYFHVLRRQLHREFRKPLIVMAPKNLLRHKECKSNLSEFDDVEGHPGFDKQGTRFKRLIKDQNMHSDREEGIRRLVLCSGKVYYELDDERRKVNGSDVAICRVEQLCPFPYNLIQRELNRYPNAEIVWCQEEPMNMGAYSYIAPRLCTAMKSVGRGNIDDIKYVGRPPSAATATGFLMVHGKEQTELVHKALQPQPIQFP

SEQ ID NO: 5787 - protein, 1020 aa, Solanum phureja
MAWFRAGSSVAKLAIRRAVSQGGSYVPRTRIIPSQSRYFHTTVVRPKAQAAPVPRPVPLSKLTDSFLDGTSSVYLEELQRAWEQDPSSVDESWDNFFRNFTGLAATSPGISGQTIQESMNLLLLVRAYQVNGHLKAKLDPLDLEERDIPDVLDPVSYGFTEADLDREFFLGVWRMAGFLSENRPVQTLRAILTRLEQAYCGSIGFEYMHISDHDKCNWLRERIETPTPREYNRERREVILDRLMWSTQFENFLATKWVAAKRFGLEGCETLIPGMKEMFDRSADLGVESIVIGMPHRGRLNVLGNVVRKPLRQIFSEFTGGTKPADGAGYVGTGDVKYHLGTSYDRPTRGGKRIHLSLVANPSHLEAVDPVVIGKTRAKQYYSNDVDRTKNMGILLHGDGSFAGQGVVYETLHLSALPNYTTGGTIHIVVNNQVAFTTDPKAGRSSQYCTDVAKALSAPIFHVNGDDVEGVVHACELAAEWRQTFHSDVVVDIVCYRRFGHNEIDEPSFTQPKMYQVIRNHPSSLEIYQNKLLQYGQVTKDDVEKIHNKINTILNEEFVASKDYVPQKRDWLSAFWSGFKSPAQLSRVRNTGVKPEILKDVGKAITSLPDDFKAHRAVKRIFDDRKKMIETGEGVDWAVGEALAFATLLVEGNHVRLSGQDVERGTFSHRHSVIHDQETGAKYCPLDHVMMNQNEEMFTVSNSSLSEFGVLGFELGYSMENPNSLVLWEAQFGDFANGAQVIFDQFLSSGEAKWLRQSGLVVLLPHGYDGQGPEHSSARLERFLQMSDDNPYVIPDMEPTLRKQIQECNWQVVNVTTPANYFHVLRRQIHRDFRKPLIVMSPKNLLRHKDCKSNLSEFDDVQGHPGFDKQGTRFKRLIKDQNDHSDLEEGIRRLVLCSGKVYYELDEERKKVEGKDVAICRVEQLCPFPYDLVQRELKRYPNAEIVWCQEEPMNMGAYQYIAPRLSTAMKALDRGNIDDIKYAGRGPSAATATGFYQVHVKEQTGLVQKALQQDPINSPV

SEQ ID NO: 5788 - protein, 291 aa, Valeriana officinalis
MEDGRFLSENRPVQTLRSILTRLEQAYCGSIGFEYMHIADREKCNWLRDRIETPTPMKYNKQRREVMLDRLIWSTQFENFLATKWTAAKRFGLEGGETLIPGMKEMFDRSADLGVEGIVIGMSHRGRLNVLGNVVRKPLRQIFSEFSGGTKPVDEVGLYTGTGDVKYHLGTSYDRPTRGGKQLHLSLVANPSHLEAVDPVVVGKTRGKQYYSNDFDRTKNMGILIHGDGSFAGQGVVYETLHLSGLPNYTTGGTIHIVVNNQVAFTTDPKSGRSSQYCTDVAKALSAPIFM

SEQ ID NO: 5789 - protein, 1021 aa, Valeriana officinalis
MTWFRAGSSIAKLAIRRTLSESKSYVSRARIIPPHSRNIHTSVFKSKAQAAPVPRPVPLSKLTDSFLDGTSSVYLEELQRAWEADPNSVDESWDNFFKNFVGQAATSPGISGQTIQESMRLLLLLRAYQVNGHMKAKLDPLGLEEREIPSDLDPAIYGFTEADLDREFFLGVWNMAGFLSENRPVQTLRAILTRLEQAYCGSIGYEYMHIAEREKCNWLRDRIETPTPMQYNRQRREVILDRLIWSTQFENFLATKWTAAKRFGLEGGETLIPGMKEMFDRSADLGVESIVIGMSHRGRLNVLGNVVRKPLRQIFSEFSGGIKPIDEVGLYTGTGDVKYHLGTSYDRPTRGGKRIHLSLVANPSHLEAVDPVVVGKTRAKQYYSNDLDRTKNMGILIHGDGSFAGQGVVYETLHLSGLPNYTTGGTIHIVVNNQVAFTTDPMAGRSSQYCTDVAKALNAPIFHVNGDDMEAVAHVCELAAEWRQTFHSDVVVDIVCYRRFGHNEIDEPSFTQPKMYKVIRNHPSALEIYEKKLLESGQVTKEDVDKIQNKVNTILNDEFLASKDYVPKRRDWLSAYWTGFKSPEQLSRIRNTGVKPEILKTVGKAITTLPETFKPHRAVKKIFSERAKMIETGEGIDWAVGEALAFATLLIEGNHVRLSGQDVERGTFSHRHSVLHDQESGEKYCPLDHVITNQNEELFTVSNSSLSEFGVLGFELGYSMENPNSLVLWEAQFGDFANGAHVIFDQFISSGEAKWLRQSGLVVLLPHGYDGQGPEHSSARLERFLQMSDDNPYVIPEMDGTLRKQIQDCNWQVVNVTTPANYFHVLRRQINREFRKPLIVMAPKNLLRHKECKSNLSEFDDVQGHPGFDKQGTRFKRLIKDQNDHSNLEEGIRRLILCSGKVYYELDEERKKVGGKDVAICRVEQLCPFPYDLVQRELKRYPNAEIVWCQEEPMNMGAYTYIAPRLCTAMKAVERGSSDDIKYIGRAPSAASATGFYGVHVKEQSDIVHKAMQAEPINYPR

SEQ ID NO: 5790 - protein, 1018 aa, Mimulus guttatus
MAWFMAGSNVAKLAVRRNLLQNCSYVTRTRIAPSQNRYFQTTVFRSKAQSAPVPRAVPLSRLTDNFLDGTSSVYIEELQRAWEQDPNSVDESWDNFFRNFVGQAATSPGISGQTIQESMRLLLLVRAYQVYGHLKAKLDPLNLEERTIPDDLDPGLYGFSEADLDREFFVGVWRIHGFLSENRPVQTLRAILKRLEQAYCGNIGYEYMHIADREKCNWLRDKIETPTPTQYSPQRREVILDRLIWSTQFENFLAAKWTAAKRFGLEGCETLIPGMKEMFDRSADLGVKNIVIGMSHRGRLNVLGNVVRKPLRQIFSEFSGGTKPVDEVGLYTGTGDVKYHLGTSYDRPTRGGKRIHLSLVANPSHLEAVDPVVIGKTRAKQYYSNDVDRTKNMGILIHGDGSFAGQGVVYETLHLSALPNYTTGGTIHIVVNNQVAFTTDPRSGRSSQYCTDVAKALSAPIFHVNGDDVEAVVHVCELAAEWRQTFHTDVVVDIVCYRRFGHNEIDEPSFTQPKMYKVIRNHPSALQIYQNKLLESGQVTKEGIDQINSKVLSILNEEFLASKDYVPQRRDWLSAYWSGFKSPEQLSRIRNTGVKPEILKNVGKAITVLPENFKPHRAVKRIFEDRAKMIETGEGIDWAVGEALAFATLLVEGNHVRLSGQDVERGTFSHRHSVIHDQETGEQYCPLDHVMMNQNEEMFTVSNSSLSEFGVLGFELGYSMENPNSLVLWEAQFGDFANGAQVIFDQFLSSGEAKWLRQTGLVVLLPHGYDGQGPEHSSARMERFLQMNDDNPYVIPEMDPTLRTQIQECNWQVVNVTTPANYFHVLRRQIHREFRKPLIVMSPKNLLRHKECKSNLSEFDDVQGHQGFDKQGTRFKRLIKDQNAHSDLEEGIRRLVLCSGKVYYELDEERKKVNGNDVAICRIEQLSPFPYDLIQRELKRYPNAEIVWCQEEPMNMGAYNYISVRLGTAMKALGRGTFDDIKYAGRAPSAATATGFYQVHGKEQTELVQKALQPDPIS

SEQ ID NO: 5791 - protein, 1017 aa, Eutrema parvulum
MVWFRAGSSVTKLAVRRILNQGGSYATRTRSLPSQSRCFHSTLYRPKAHSAPVPRAVPLSKLTDSFLDGTSSVYLEELQRAWESDPNSVDESWDNFFRNFVGQAATSPGISGQTIQESMRLLLLVRAYQVNGHMKAKLDPLGLEQREIPEDLDLALYGFTEADLDREFFLGVWQMSGFMSENRPVQTLRSILTRLEQAYCGNIGFEYMHIADRDKCNWLREKIETPTPWRYNRERREVILDRLAWSTQFENFLATKWTTAKRFGLEGGESLIPGMKEMFDRAADLGVESIVIGMSHRGRLNVLGNVVRKPLRQIFSEFSGGIRPVDEVGYTGTGDVKYHLGTSYDRPTRGGKKIHLSLVANPSHLEAADSVVVGKTRAKQYYSKDLDRTKNLGILIHGDGSFAGQGVVYETLHLSALPNYTTGGTIHIVVNNQVAFTTDPRAGRSSQYCTDVAKALSAPIFHVNGDDVEAVVHACELAAEWRQTFHSDVVVDLVCYRRFGHNEIDEPSFTQPKMYKVIKSHPSTLQIYHKKLLECGEISQQDIDQIQEKVNTILNEEFVASKDYLPKKRDWLSTNWAGFKSPEQISRVRNTGVKPEILKTVGKAISSLPENFKPHRAVKKVYEQRAQMIESGEGIDWALAEALALATLVVEGNHVRLSGQDVERGTFSHRHSVLHDQETGEEYCPLDHLIMNQDPEMFTVSNSSLSEFGVLGFELGYSMESPNSLVLWEAQFGDFANGAQVIFDQFISSGEAKWLRQTGLVMLLPHGYDGQGPEHSSARLERYLQMSDDNPYVIPDMEPTMRNQIQECNWQIVNATTPANYFHVLRRQIHRDFRKPLIVMAPKNLLRHKDCKSNLSEFDDVQGHPGFDKQGTRFKRLIKDQNDHSDLEEGIRRLVLCSGKVYYELDDERKKVGANDVAICRVEQLCPFPYDLIQRELKRYPNAEIVWCQEEAMNMGAFSYISPRLWTAMRSLNRGDMEDIKYVGRGPSAATATGFYTFHVKEQAELVQKAIGKEPIN

SEQ ID NO: 5792 - protein, 1014 aa, Brassica rapa
MVWFRTGSSLAKLAIRRTLSQSRVLPSSHARCFHSTSLKSNAAPVPRPVPLSKLTDSFLDGTSSVYLEELQRAWEADPNSVDESWDNFFRNFVGQAATSPGISGQTIQESMRLLLLVRAYQVNGHMKAKLDPLGLEEREIPEDLTPGLYGFSEADLDREFFLGVWRMSGFLSENRPVQTLRAILSRLEQAYCGTIGYEYMHIADRDKCNWLRDKIETPTPRQYNSERRVVIYDRLTWSTQFENFLATKWTTAKRFGLEGAESLIPGMKEMFDRAADLGVENIVIGMPHRGRLNVLGNVVRKPLRQIFSEFSGGTRPVDEVGLYTGTGDVKYHLGTSYDRPTRGGKHLHLSLLANPSHLEAVDPVVMGKTRAKQYYTKDESRTKNMGILIHGDGSFAGQGVVYETLHLSALPNYCTGGTVHIVVNNQVAFTTDPRAGRSSQYCTDVAKALDAPIFHVNADDIEAVVHVCELAAEWRQTFHSDVVVDLVCYRRFGHNEIDEPSFTQPKMYKVIRSHPSSLQIYQEKLVESGQVTKEDIDKIQKKVSSILNEEFEASKEYIPQKRDWLASHWTGFKSPEQISRIRNTGVKPEILKNVGKAISTFPENFKPHRGVKRVYEQRAQMIESGEGIDWGLGEALAFATLVVEGNHVRLSGQDVERGTFSHRHSVLHDQETGKEYCPLDHLTMNQDPEMFTVSNSSLSEFGVLGFELGYSMENPNSLVIWEAQFGDFANGAQVMFDQFISSGEAKWLRQTGLVVLLPHGYDGQGPEHSSGRLERFLQMSDDNPFVIPEMDPTLRKQIQECNWQIVNVTTPANYFHVLRRQIHRDFRKPLIVMAPKNLLRHKKCVSNLSEFDDVKGHPGFDKQGTRFKRLIKDQSGHSDLEEGIRRLVLCSGKVYYELDEERQKSGTNDIAICRMEQLCPFPYDLIQRELKRYPNAEIVWCQEEPMNMGAYQYIAPRLCTAMKALNRGSFNDIKYVGRLPSAATATGFYQLHVKEQTDLVHKALQPDPITPILP

SEQ ID NO: 5793 - protein, 1019 aa, Cephalotaxus harringtonia
MTLQRLSSGLFRAALKIRLAQQTSYAKRSLWTLPQARSFHSTPHNFQQSAPVPRAVPLSRLTDNFLDGTSSVYLEELQRAWEADPQSVDESWDNFFRNFVGQAATSPGVSGQTIQESMRLLLLVRAYQVNGHMKAKLDPLGLEQREIPVDLEPGLYGFTEADLDREFFLGVWKMSGFLSENRPVQTLRSILNRLEQAYCGTIGYEYMHIPDRDKCNWLREKIETVVPSKYSPERRHVILDRLIWSTQFENFLATKWTAAKRFGLEGAETLIPGMKEMFDRSSDMGVESIVIGMSHRGRLNVLGNVVRKPLRQIFSEFSGGTKPVDEVGSYTGTGDVKYHLGTSYDRPTRGGKRIHLSLVANPSHLEAVDPVVVGKTRAKQYYSNDKDRTKNMAILIHGDGSFPGQGVVYETLHLSALPNYTTGGTIHIVVNNQVAFTTDPKSGRSSQYCTDVAKALNAPIFHVNGDDVEAVVHACELAAEWRQIFHSDVVVDIVCYRRFGHNEIDEPSFTQPKMYQVIKTHPRAVDVYEKQLIQSGQLSEEEIDALHTKVNSILNEEFVNSKEYEPKRRDWLAAYWTGFKSPEQLSRRRNTGVKPEILKNVGKAITTLPETFNPHRAVKRIFDQRAQMIEKEEGVDWAVGEALAFATLLVEGNHVRLSGQDVERGTFSHRHSVVHDQETGERYCPLDHVVMNQNEEMFTVSNSSLSEFGVLGFELGYSMENPNSLVLWEAQFGDFANGAQVIFDQFISSGESKWLRQSGLVVLLPHGYDGQGPEHSSARLERFLQNSDDNPFVIPEMDPTLRTQIQQCNWQVVNVTTPANYFHVLRRQLHRDFRKPLIVMSPKNLLRHKDCKSNLSEFDDVQGHPGFDKQGTRFKRLIKDQNDHSDREEGIQRLILCSGKVYYELDEERKRVQRKDVAICRVEQLCPFPYDLVQRELKRYPNAEIVWCQEEPMNMGAYHYITPRLLTAMRALDRGTFEDLKYVGRAPSAATATGFSQVHVKEHKELVETALQSDPIKFL

SEQ ID NO: 5794 - protein, 1023 aa, Mimulus guttatus
MVWFRAGSRVAKLAVKRTLTQSGSYVARATGSPAQSRCFQTTVFRSKAQSAPVPRPVPLSRLTDSFLDGTSSVYLEELQRAWEQDPNSVDESWDNFFRNFVGQATTSPGISGQTIQESMRLLLLVRAYQVYGHMKAKIDPLGLEERTIPDDLDPGLYGFSEADLDREFFVGVWRLSGFLSENRPVQTLRAILTRLEQAYCGNIGFEYMHIADHEKCNWLRDKIETPTSTQYSRDRREVILDRLIWSTQFENFLAAKWTAAKRFGLEGCETLIPGMKEMFDRSADLGVESIVIGMSHRGRLNVLGNVVRKPLRQIFSEFSGGTKPVDEVGLYTGTGDVKYHLGTSYDRPTRGGKRIHLSLVANPSHLEAVDPLVVGKTRAKQYYSNDVDRTKNMGILIHGDGSFAGQGVVYETLHLSALPNYTTGGTIHIVVNNQVAFTTDPTAGRSSQYCTDVAKALSAPIFHVNGDDVEAVVHACELAAEWRQTFHTDVVVDIVCYRRFGHNEIDEPSFTQPKMYKVIRNHPSAAEIYQKKLLESGQVTKEEIDKINSKVLSILNEEFLASKDYVPKRRDWLSAYWAGFKSPEQLSRIRNTGVKPEILKNVGKAITTLPETFKPHRAVKRIFEDRAKMIESGEGIDWAVAESLAFATLLVEGNHVRLSGQDVERGTFSHRHSVLHDQETGERYCPLDHVIMNQDEEMFTVSNSSLSEFGVLGFELGYSMENPNSLILWEAQFGDFANGAQVMFDQFLSSGEAKWLRQTGLVVLLPHGYDGQGPEHSSARMERFLQMSDDNPFVIPEMDSTLRTQIQECNWQVVNVTTPANYFHVLRRQIHREFRKPLIVMAPKNLLRHKDCKSNLSEFDDVEGHPGFDKQGTRFKRLIKDQNLHSDLEEGIRRLVLCSGKLYYELDEQRKKADAKDVAICRVEQLCPFPYDLVQRELKRYPNAEIVWCQEEPMNMGAYSYIAPRLGTAMKALKRGNVDDIKYVGRAPSAATATGFYMVHTKEQNEIVHKATQPEPINLSHTA

SEQ ID NO: 5795 - protein, 1023 aa, Helianthus annuus
MTWFRAGSSVAKLAIRRTITQSGSYAARKRVFPAESRYFHTTVFKSKAQSAPVPRAVPLSRLTDSFLDGTSSVYLEELQRAWEDDPNSVDESWDNFFRNFVGQAATSPGISGQTIQESMRLLLLVRAYQVYGHMKAKIDPLGLEKREIPDDLDPAFYGFSEADLDREFFLGVWRMSGFLSENRPVQTLRSILTRLEQAYSGNIGYEYMHIADRERCNWLRDKIETPTPTQYNRERREVILDRLIWSTQFENFLATKWTAAKRFGLEGGETLIPGMKEMFDRSADLGVESIVIGMSHRGRLNVLGNVVRKPLRQIFSEFSGGTKPVDEVGLYTGTGDVKYHLGTSYDRPTRGGKRIHLSLVANPSHLEAVDPVVIGKTRAKQYYSNDVDRTKNMGILIHGDGSFAGQGVVYETLHLSGLPNYTTGGTIHIVVNNQVAFTTDPQAGRSSQYCTDVAKALNAPIFHVNGDDVEAVVHACELAAEWRQTFHSDVVVDIVCYRRFGHNEIDEPSFTQPKMYKIIRNHPSSLEIYQKKLLESGQATKEDIDRIQSKVTTILNEEFLASKDYVPQRRDWLSAYWAGFKSPEQLSRIRNTGVKPEILKNVGKAITTLPETFKPHRAVKKIFADRYKMIETGEGVDWAVAEALAFATLLVEGNHVRLSGQDVERGTFSHRHSVVHDQETGERYCPLDHVMMNQHEEMFTVSNSSLSEFGVLGFELGYSMENPNSLVLWEAQFGDFSNGAQVIFDQFLSSGEAKWLRRTGLVLLLPHGYDGQGPEHSSARLERFLQMSDDNPFVIPEMEPTLRNQIQTCNMQIVNVTTPANYFHVLRRQLHREFRKPLVVMSPKNLLRHKDCKSNLSEFDDVQGHPGFDKQGTRFKRLIKDQNDHSDLEEGIRRLVLCSGKVYYELDEKRKSVDGKDVAICRVEQLCPFPYDLIQRELKRYPNAEVVWCQEEPMNMGAYSYIAPRLATAMKALDRGTIDDVKYVGRAPSAATATGFYTVHGREQSEIVQKALQPEPVTNPTLS

SEQ ID NO: 5796 - protein, 423 aa, Amorphophallus konjac
MAWFRAFSGVARHAVRRHLAQASHHVPRPSRGFHSTALRPKAVPVPRPVPLSRLTDSFLDGTSSVYLEELQRAWEADPNSVDESWDNFFRNFVGQAATSPGISGQTIQESMRLLLLVRAYQVNGHMKAKLDPLGLEEREVPDDLDPAFYGFTEADLDREFFIGVWSMAGFLSENRPVQTLRSILNRLEQAYCGSVGYEYMHIANREQCNWLRDKIETVSPMTYTGERQEVILDRLIWSTQFENFLATKWVTAKRFGLEGGETLIPGMKEMFDRAADLGVESIVVGMPHRGRLNVLGNVFRKPLRQIFSEFSGSGTKAVDEVGLYTGTGDVKYHLGTSYDRPTRGGNRIHLSLVANPSHLEAVNPVVIGKTRAKQYYSNDIDRTRNLAVLIHGDGSFAGQGVVYETFHLSALPITRLVEPFILW

SEQ ID NO: 5797 - protein, 1019 aa, Zostera marina
MVWFRTATNIGRLAIRRSLAQASHHAKRPHLLPASTVRGFHSTFPKCAAPVPRPVPLSKLTDSFLDASSSVYLEELQRTWEVDPNSVDESWDNFFRNFVGQAATSPGISGQTIQESMRLLLLVRAYQVNGHMKAKHDPLGLEKREIPHDLNPEFYGFTQADFDREFFIGVWSMSGFLSENRPVQTLRSIINRLEQAYCGSVGYEYMHIADKEQCNWLRNKIETVKPREYNAERREVILDRLIWSTQFENFLATKWTAAKRFGLEGGESLIPGMKEMFDRASDLGVETIVIGMPHRGRLNVLANVVRKPLRQIFNEFSGGTKPVEEQGLYTGTGDVKYHLGTSYDRPTRSGKMIHLSLVANPSHLEAVDPVVVGKTRAKQYHSNDVDRKKNMGILIHGDGSFAGQGVVYETLHLSALPNYTTGGTIHLVVNNQVAFTTDPRAGRSSDYCTDVAKSLNVPIFHVNGDDMEAVVHVFELAAEWRQKFHCDAVIDIVCYRRFGHNEIDEPSFTQPKMYQVIRNHPSSLEIYQNKLLKLGVITKEGIEAIHNKVNSILNEEFINSKDYVTNRRDWLSAYWTGFKSPEQISRVRNTGVNPEIIKRVGQAITTLPETFKPHRAVKKIFDLRAQMIETGVGIDWALAEALAFATLVIEGNHVRLSGQDVERGTFSHRHSVLHDQVTGDRYCPLDHLILNQNEEMFTVSNSSLSEFAVLGFELGYSMENPNSLVLWEAQFGDFANGAHVMFDQFLSSGESKWLRQTGLVCLLPHGYDGQGPEHSSARVERYLQMSDDNPYTIPEMEPTLRKQIQECNWQVVNVTTPANYFHVLRRQIHREFRKPLIVIAPKNLLRHKDCKSNLSEFDDVQGHPGFDMQGTRFKRLIKDQNNHSEREEGIRRLVLCSGKVYYELDDQRKKVDGKDVAICRVEQLCPFPYDLIQRELKRYPNAEIVWCQEEPMNMGAYSYIAPRLCTAMKALGRGTMEDIKYVGRNTSAATATGFYSVHLKEQAGLVEKALQSDPINYPY

SEQ ID NO: 5798 - protein, 1025 aa, Arabidopsis thaliana
MVWFRIGSSVAKLAIRRTLSQSRCGSYATRTRVLPCQTRCFHSTILKSKAESAAPVPRPVPLSKLTDSFLDGTSSVYLEELQRAWEADPNSVDESWDNFFRNFVGQASTSPGISGQTIQESMRLLLLVRAYQVNGHMKAKLDPLGLEKREIPEDLTPGLYGFTEADLDREFFLGVWRMSGFLSENRPVQTLRSILSRLEQAYCGTIGYEYMHIADRDKCNWLRDKIETPTPRQYNSERRMVIYDRLTWSTQFENFLATKWTTAKRFGLEGAESLIPGMKEMFDRSADLGVENIVIGMPHRGRLNVLGNVVRKPLRQIFSEFSGGTRPVDEVGLYTGTGDVKYHLGTSYDRPTRGGKHLHLSLVANPSHLEAVDPVVIGKTRAKQYYTKDENRTKNMGILIHGDGSFAGQGVVYETLHLSALPNYCTGGTVHIVVNNQVAFTTDPREGRSSQYCTDVAKALSAPIFHVNADDIEAVVHACELAAEWRQTFHSDVVVDLVCYRRFGHNEIDEPSFTQPKMYKVIRSHPSSLQIYQEKLLQSGQVTQEDIDKIQKKVSSILNEEYEASKDYIPQKRDWLASHWTGFKSPEQISRIRNTGVKPEILKNVGKAISTFPENFKPHRGVKRVYEQRAQMIESGEGIDWGLGEALAFATLVVEGNHVRLSGQDVERGTFSHRHSVLHDQETGEEYCPLDHLIKNQDPEMFTVSNSSLSEFGVLGFELGYSMENPNSLVIWEAQFGDFANGAQVMFDQFISSGEAKWLRQTGLVVLLPHGYDGQGPEHSSGRLERFLQMSDDNPYVIPEMDPTLRKQIQECNWQVVNVTTPANYFHVLRRQIHRDFRKPLIVMAPKNLLRHKQCVSNLSEFDDVKGHPGFDKQGTRFKRLIKDQSGHSDLEEGIRRLVLCSGKVYYELDEERKKSETKDVAICRVEQLCPFPYDLIQRELKRYPNAEIVWCQEEPMNMGGYQYIALRLCTAMKALQRGNFNDIKYVGRLPSAATATGFYQLHVKEQTDLVKKALQPDPITPVIP

SEQ ID NO: 5799 - protein, 336 aa, Phalaenopsis aphrodite
MAWFRAASTAARVALRRNIAQSSHHCNRTLAASPLPGFRAFHSTVLRRKAATPVPRAVPLSRLTDSFLNGTSSVYLEELQRAWEADPDSVDESWDNFFRNFVGQAATSPGISGQTIQESMRLLLLVRAYQVYGHMKANLDPLGLEQREIPEDLDPALYGFTEADLDREFFLGVWRMAGFLSENRPVQTLRAILNRLEQAYCGTIGYEYMHIADREKCNWLRERIETIKPRGYSQERSEVILDRLIWSSQFENFLAKKWPAQKRFGLEGAETLIPGMKEMFDRSSDLGVESIVIGMPHRGRLNVLGNVVRKPLRQIFSEFDKKSPRMRMAYTRELEM

SEQ ID NO: 5800 - protein, 911 aa, Triticum aestivum
YQESDAAAPPRARLPRSTADMKAAASTRLGRRRPRRRPTDLRPPPSYGFTEADLDREFFLGVWMMAGFLSENRPVLTLREILSKLERAYCGPIGFEYMHIPDRDKCNWLREKIETVAPREYPKDRRLVMLDRLIWSTQFENFLATKWATAKRFGLEGGETLIPGMKEMFDRSADLGVENIVIGMPHRGRLNVLGNVVRKPLSQIFSEFAGGTRPVEGEDGLYTGTGDVKYHLGTSYDRPTRGGKRIHLSLVANPSHLEAVDPVVIGKTRAKQFYSNDDDRTKNMGILIHGDGSFAGQGVVYETLHLSALPNYTTGGTIHIVVNNQVAFTTDPRAGRSSQYCTDVAKAVNVPIFHVNGDDLEAVVRVCELAAEWRQTFHSDVVVDLICYRRFGHNEIDEPSFTQPKMYQVIKNHPSSLKLYEQKLLETGEVTKEDVQRIHDKVNRILNEEFAKSKDYVPNKRDWLSAYWTGFKSPEQISRVRNTGVKPEVLKRVGQAITTLPESFKPHRAVKKIFEQRAAMIESGEGIDWAVAEALAFAALIVEGNHVRLSGQDVERGTFSHRHSVVHDQETGAKYCPLDHVVMNQNEELFTVSNSSLSEFAVLGFELGYSMENPNSLVLWEAQFGDFSNGAQVMFDQFLSSGEAKWLRQTGLVVLLPHGYDGQGPEHSSSRLERFLQMSDDNPFVIPEMDPTLRKQIQECNWQVVNVTTPANYFHVLRRQIHRDFRKPLIVTAPKNLLRHKECKSNLSEFDDVEGHPGFDKQGTRFKRLIKDRNDHKEVEEGINRLVLCSGKVYYELDDERKKSERSDVAICRVEQLSPFPYDLIQRELKRYPNAEIVWCQEEPMNMGAYSYISPRLYSAMKTLGRGTFEDIKYVGRAPSAATATGFLTVHVQEQSELVKKALQPEPIKFP

SEQ ID NO: 5801 - protein, 1025 aa, Arabidopsis lyrata
MVWFRTGSSVAKLAIRRTLSQSQCCSFATRTRVLPSQTRCFHSTILKSKAESAAPVPRPVPLSKLTDSFLDGTSSVYLEELQRAWEADPNSVDESWDNFFRNFVGQAATSPGISGQTIQESMRLLLLVRAYQVNGHMKAKLDPLGLEKREIPEDLTPGLYGFTEADLDREFFLGVWRMSGFLSENRPVQTLRAILSRLEQAYCGTIGYEYMHIADRDKCNWLRDKIETPTPRQYNSERRMVIYDRLTWSTQFENFLASKWTTAKRFGLEGAESLIPGMKEMFDRSADLGVENIVIGMPHRGRLNVLGNVVRKPLRQIFSEFSGGTRPVDEVGLYTGTGDVKYHLGTSYDRPTRGGKHLHLSLVANPSHLEAVDPVVMGKTRAKQYYTKDENRTKNMGVLIHGDGSFAGQGVVYETLHLSALPNYCTGGTVHIVVNNQVAFTTDPREGRSSQYCTDVAKALSAPIFHVNADDIEAVVHVCELAAEWRQTFHSDVVVDLVCYRRFGHNEIDEPSFTQPKMYKVIRNHPSSLQIYQEKLLQSGQVTEEDIDKIQKKVSSILNEEFRASKDYIPQKRDWLASHWTGFKSPEQISRIRNTGVKPEILKNVGKAISTFPENFKPHRGVKRVYEQRAQMIESGEGIDWGLGEALAFATLVVEGNHVRLSGQDVERGTFSHRHSVLHDQETGEEYCPLDHLTMNQDPEMFTVSNSSLSEFGVLGFELGYSMENPNSLVLWEAQFGDFANGAQVMFDQFISSGEAKWLRQTGLVVLLPHGYDGQGPEHSSGRLERFLQMSDDNPYVIPEMDPTLRKQIQECNWQVVNVTTPANYFHVLRRQIHRDFRKPLIVMSPKNLLRHKQCVSNLSEFDDVKGHPGFDKQGTRFKRLIKDQSGHSDLEEGIRRLVLCSGKVYYELDEERKKSETNDVAICRVEQLCPFPYDLIQRELKRYPNAEIVWCQEEPMNMGGYQYIALRLCTAMKALQRGNFNDIKYVGRLPSAATATGFYQLHVKEQTDLVKKALQPDPITPVLP

SEQ ID NO: 5802 - protein, 926 aa, Taxus baccata
MFFRNFVGQAVTTPGVSGQTIQESMRLLLLVRAHQVNGHMKAKLDPLGLEQREIPLDLDPALYGFTEADLDREFFLGVWRMSGFLSENRPVQTLRSILNRLEQAYCGTIGYEYMHIPDRDKCNWLREKIETVIPSKYGPERRHVILDRLIWSTQFENFLATKWTAAKRFGLEGAETLIPGMKEMFDRSADMGVESIVIGMSHRGRLNVLCNVVRKPLRQIFSEFSGGTKPIDEVGTYTGTGDVKYHLGTSYDRPTRGGKRIHLSLVANPSHLEAVDPVVVGKTRAKQYYSNDKDRTKNMAVLIHGDGSFAGQGVVYETLHLSALPNYTTGGTIHIVVNNQVAFTTDPKSGRSSQYCTDVAKALNAPIFHVNGDDMEAVVHVCELAAEWRQIFHSDVVVDIVCYRRFGHNEIDEPSFTQPKMYKVIRNHPRALDLYEKQLIESGQLSKEEIDALHEKVSSILNEEFVNSKEYVPKRRDWLSAYWSGFKSPEQLSRIRNTGVKPEILKNVGKAITSLPETFNPHRAVKRIFEQRAQMIEKGEGVDWAVGEALAFATLLVEGNHVRLSGQDVERGTFSHRHAVLHDQETGERYCPLDHVIMNQNEEMFTVSNSSLSEFGVLGFELGYSIENPNSLVLWEAQFGDFANGAQVIFDQFISSGESKWLRQSGLVVLLPHGYDGQGPEHSSARLERFLQGSDDNPFVIPEMDPTLRTQIQQCNWQVVNVTTPANYFHVLRRQIHRDFRKPLIIMSPKNLLRHKDCKSNLSEFDDVQGHPGFDKQGTRFKRLIKDKNDHSDREEGIHRLILCSGKVYYELDEERQRVQRKDVAICRIEQLCPFPYDLVQRELKRYPNAEIVWCQEEPMNMGGYHYISLRLLTAMKALGRGTFEDIKYVGRAPSAATATGFYQVHGQEQRELLETALQSAPIKFP

SEQ ID NO: 5803 - protein, 1019 aa, Solanum phureja
MAWFRASSSVAKLAIRRALSQGGSYIPRTRILPSQGRYFHTTVVRPKAQAAPVPRPVPLSKLTDSFLDGTSSVYLEELQRAWEQDPNSVDESWDNFFRNFVGQAATSPGISGQTIQESMRLLLLVRAYQVNGHMKAKLDPLDLEAREIPDDLDPALYGFTEADLDREFFLGVWKMSGFLSENRPVQTLKAILTRLEQAYCGSIGYEYMHISDRDKCNWLRERIETPTSMEYNRERREVILDRLMWSTQFENFLATKWAAAKRFGLEGCETLIPGMKEMFDRAADLGVESIVIGMPHRGRLNVLGNVVRKPLKQIFSEFSGGIKPGDDAGYVGTGDVKYHLGTSYDRPTRGGKRIHLSLVANPSHLEAVDPVVIGKTRAKQYYTNDENRTKSMGILLHGDGSFAGQGVVYETLHLSALPNYTTGGTIHIVVNNQVAFTTDPTAGRSSQYCTDVAKALDIPIFHVNGDDVEAVAHVCELAAEWRQKFHADVVVDIVCYRRFGHNEIDEPSFTQPKMYKIIRNHPSSLEIYQNKLLNSGQVAKDDVEKIHNKINRILNEEFIASKDYVPQKRDWLSAFWSGFKSPSQLSRVRNTGVKPEILTNVGKAITTFPDGFKPHRALKRVFDDRRKMIETGEGVDWAVGEALAFATLLVEGNHVRLSGQDVERGTFSHRHSVIHDQETGAQYCPLDHVMMNQNEEMFTVSNSSLSEFGVLGFELGYSMENPNSLVIWEAQFGDFANGAQVIFDQFVSSGEAKWLRQTGLVVLLPHGYDGQGPEHSSGRLERFLQMSDDNPFVIPEMEPTLRKQIQECNWQVVNVTTPANYFHVLRRQIHRDFRKPLIVMAPKNLLRHKSCKSNLSEFDDVQGHPGFDKQGTRFKRLIKDQKEHSDLEEGIRRLVLCSGKIYYELDEERAKADGKDIAICRVEQLCPFPYDLIQRELKRYPNAEIVWCQEEPMNMGAFNYIAPRLSTAMKSLGRGNMDDIKYVGRAPSAATATGFFQVHVKEQTELVQKALQQDPINQF

SEQ ID NO: 5804 - protein, 1018 aa, Fragaria vesca
MRWFRAGAGVAKLAVRRSLSTSGSYNVTRSVVPAQNRYLHTTICKSKAEAAPVPRPVPLSRLTDSFLDGTSSVYLEGLQRAWEADPNSVDESWDNFFRNFVGQASTSPGISGQTIQESMRLLLLVRAYQVNGHMKAKLDPLGLEQRDIPDDLDPALYGFTEADLDREFFLGVWRMAGFLSENRPVQTLRSILTRLEQAYCGSIGYEYMHIADRNKCNWLRDKIETPTTMQYNRQRREVILDRLIWSTQFENFLATKWTTAKRFGLEGCETLIPGMKEMFDRAADRGVESIVIGMPHRGRLNVLGNVVRKPLRQIFSEFSGGTKPVDEVGLYTGTGDVKYHLGTSYDRPTRGGKRIHLSLVANPSHLEAVDPVVVGKTRAKQYYSNDVDRTKNMGVLIHGDGSFAGQGVVYETLHLSALPNYTTGGTIHIVVNNQVAFTTDPMSGRSSEYCTDVAKALNAPILHVNADDMEAVVHVCELAAEWRQTFHSDVVVDLVCYRRFGHNEIDEPSFTQPKMYKVIRNHPNPLTIYKNKLLESGQVTQEDIERIQSKVTTILNEEFLASKDYVPQRRDWLSSHWSGFKSPEQLSRIRNTGVKPEILKNVGKAITALPENFKPHRAVKKVYGERAQMIETGEGIDWAVGEALAFATLLVEGNHVRLSGQDVERGTFSHRHSVLHDQETGERYCPLDHVIANQDEEMFTVSNSSLSEFGVLGFELGYSMENPNALVIWEAQFGDFANGAQVIFDQFLSSGESKWLRQTGLVLLLPHGYDGQGPEHSSARLERFLQMSDDNPYVIPEMDPTLRKQIQECNWQVVNVTTPANYFHVLRRQINRDFRKPLVVMAPKNLLRHKDCKSNLSEFDDVQGHPGFDKQGTRFKRLIKDQNDHSDLEEGIRRLVLCSGKIYYEIDEERRKASAKDVAICRVEQLCPFPYDLIQRELKRYPNAEIVWCQEEPMNMGAYNYIAPRLCTAMKSLSRGTIDDIKYIGRAPSAATATGFYQVHLKEQADIVHKAVQPEPID

SEQ ID NO: 5805 - protein, 813 aa, Solanum lycopersicum
MHISDRDKCNWLRERIETPTSMEYNRERREVILDRLMWSTQFENFLATKWAVLAKRFGLEGCETLIPGMKEMFDRAADLGVESIVIGMPHRGRLNVLGNVVRKPLKQIFSEFSGGIKPGDDAGYVGTGDVKYHLGTSYDRPTRGGKRIHLSLVANPSHLEAVNPVVIGKTRAKQYYTNDEDRTKSMGILLHGDGSFAGQGVVYETLHLSALPNYTTGGTIHIVVNNQVAFTTDPTAGRSSQYCTDVAKALDIPIFHVNGDDVEAVAHVCELAAEWRQKFHADVVVDIVCYRRFGHNEIDEPSFTQPKMYKIIRNHPSSLEIYQNKLLNSGQVAKDDVEKIHNKINRILNEEFIASKDYVPQKRDWLSAFWSGFKSPSQLSRVRNTGVKPEILTNVGKAITTFPDGFKPHRALKRVFDDRRKMIETGEGVDWAVGEALAFATLLVEGNHVRLSGQDVERGTFSHRHSVIHDQETGAQYCPLDHVMMNQNEEMFTVSNSSLSEFGVLGFELGYSMENPNSLVIWEAQFGDFANGAQVIFDQFVSSGEAKWLRQTGLVVLLPHGYDGQGPEHSSGRLERFLQMSDDNPFVIPEMEPTLRKQIQECNWQVVNVTTPANYFHVLRRQIHRDFRKPLIVMAPKNLLRHKSCKSNLSEFDDVQGHPGFDKQGTRFKRLIKDQNDHSDLEEGIRRLVLCSGKIYYELDEERAKADGKDIAICRVEQLCPFPYDLIQRELKRYPNAEVVWCQEEPMNMGAFNYIAPRLSTAMKSLGRGNMDDIKYVGRAPSAATATGFFQVHVKEQTELVQKALQQDPINQI

SEQ ID NO: 5806 - protein, 1020 aa, Amorphophallus konjac
MAWFRAASGAVRHAVRRNLARASHHVPRPRPLPPPARGFHSTPLRPKAAPVPRPVPLSRLTDSFLDGTSSVYLEELQRAWEADPNSVDESWDNFFRNFVGQAATSPGISGQTIQESMRLLLLVRAYQVNGHMKAKLDPLGLEEREVPDDLDPAFYGFTDADLDREFFIGVWRMSGFLSENRPVQTLRSILNRLEQAYCGSVGYEYMHIANREQCNWLRDKIETVNPRSYSRERQEVILDRLIWSTLFENFLATKWVTAKRFGLEGAETLIPGMKEMFDRAADLGVENIVVGMPHRGRLNVLGNVFRKPLRQIFSEFSGSGTKAVDEDGLYTGTGDVKYHLGTSYDRPTRGGKRIHLSLVANPSHLEAVDPVVVGKTRAKQYYSHDTERTKNLAVLMHGDGSFAGQGVVYETLHLSALPNYTTGGTVHIVVNNQVAFTTDPKSGRSSQYCTDVAKALNAPIFHVNGDDMEAVVHVFELAAEWRQTFHTDVVVDIVCYRRFGHNEMDEPSFTQPKMYQVIRSHPSALQIYQKELLESERITKEEIDQIQNKVNSILNEEFNNSKDYIPKRRDWLSAYWSGFKSPEQISRIRNTGVKPEILKRVGEAITTLPENFKPHKVVKRVFDERAQMIQTGEGVDWAVAEALAFATLLVEGNHVRLSGQDVERGTFSHRHAVVHDQETGEIYCPLDHVIMNQNEEMFTVSNSSLSEFGVLGFELGYSMENPNSLVLWEAQFGDFANGAQVIFDQFLSSGESKWLRQTGLVCLLPHGYDGQGPEHSSARLERYLQMSDDHPYVIPEMDPTLRKQIQECNWQIVNVTTPANYFHVLRRQIHRKFRKPLIVMSPKNLLRHPKCKSNLSEFDDVQGHPGFDKQGTRFKRLIKDQNDHSDLEEGIRRLILCSGKVYYELDDERKAADAKDIAICRVEQLCPFPYDLIQRELKRYPKAEVVWCQEEPMNMGAYSYISPRLWTAMKALGRGSMEDVKYVGRPPFAATATGFLKVHQQEQKELLQKAIQRDPIEFPG

SEQ ID NO: 5807 - protein, 1023 aa, Arnica chamissonis
MTWFRAGSSVAKLAIRRTLTQSGSYAARKRVFSSESRYFHTTVFKSKAQSAPVPRPVPLSRLTDSFLDGTSSVYLEELQRAWEDDPNSVDESWDNFFRNFVGQAATSPGISGQTIQESMRLLLLVRAYQVYGHMKAKIDPLGLEKREIPDDLDPAFYGFSEADLDREFFLGVWRMSGFLSENRPVQTLRSILTRLEQAYSGSIGYEYMHIADRERCNWLRDRIETPTRTQYNSERREVILDRLIWSTQFENFLATKWTAAKRFGLEGGETLIPGMKEMFDRSADLGVESIVIGMSHRGRLNVLGNVVRKPLRQIFSEFTGGTKPVDDVGLYTGTGDVKYHLGTSYDRPTRGGKRIHLSLVANPSHLEAVDPVVIGKTRAKQYYSNDVDRTKNMGILIHGDGSFAGQGVVYETLHLSGLPNYTTGGTIHIVVNNQVAFTTDPQAGRSSQYCTDVAKALNVPIFHVNGDDVEAVVHACELAAEWRQTFHSDVVVDIVCYRRFGHNEIDEPSFTQPKMYKIIRNHPSSLEIYQKKLLESGQATKEDIDRIQSKVTAILNEEFLASKDYVPQRRDWLSAYWTGFKSPEQLSRIRNTGIKPEILKNVGKAITTLPETFKPHRAVKKIFADRLKMIETGEGVDWAVAEALAFATLLVEGNHVRLSGQDVERGTFSHRHSVVHDQETGERYCPLDHVMMNQDEEMFTVSNSSLSEFGVLGFELGYSMENPNSLVLWEAQFGDFSNGAQVIFDQFLSSGEAKWLRQTGLVVLLPHGYDGQGPEHSSARLERFLQMTDDNPFVIPEMEPTLRNQIQTCNMQIVNVTTPANYFHVLRRQLHREFRKPLVVMSPKNLLRHKDCKSNLSEFDDVQGHPGFDKQGTRFKRLIKDQNDHSDLEEGIRRLVLCSGKVYYELDEKRKSVDGKDIAICRVEQLCPFPYDLIQRELKRYPNAEVVWCQEEPMNMGPYSYIAPRLATAMKALNRGTIDDIKYVGRAPSAATATGFYIVHGREQSEIVQNALQPETVTSPALS

SEQ ID NO: 5808 - protein, 1026 aa, Brassica napus
MVWFRAGSNVTKLAVRRILNQGTSYATRTRSLPSQTRSFHSSLHRPNPQSTTAPIPRAVPLSKLTDSFLDGTSSVYLEELQRAWESDPTSVDESWDNFFRNFVGQAATSPGISGQTIQESMNLLLLVRAYQVNGHMKANLDPLGLEQREIPEDLDLALYGFTEADLDREFFLGVWQMSGFMSENRPVQTLRSILARLQQAYCGSIGFEYMHIADRDKCNWLREKIETATPWRYNRERREVILDRLAWSTQFENFLATKWTTAKRFGLEGGESLIPGMKEMFDRAADLGVESIVIGMSHRGRLNVLGNVVRKPLRQIFSEFSGGIRPVDEVGYTGTGDVKYHLGTSYDRPTRGGKKIHLSLVANPSHLEAADSVVVGKTRAKQYYSKDMDRTKNLGILIHGDGSFAGQGVVYETLHLSALPNYTTGGTIHIVVNNQVAFTTDPRAGRSSQYCTDVAKALSAPIFHVNGDDVEAVVHACELAAEWRQTFHSDVVVDLVCYRRFGHNEIDEPSFTQPKMYKVIKNHPSTLQIYHKKLLECGEISQQDIDRIQEKVNTILSEEFVASKDYLSKKRDWLSTNWAGFKSPEQISRVRNTGVKPEILKTVGKAISSLPENFKPHRAVKKVYEQRAQMIETGEGIDWALAEALALATLVVEGNHVRLSGQDVERGTFSHRHSVLHDQETGEEYCPLDHLVMNQDPEMFTVSNSSLSEFGVLGFELGYSMESPNSLVLWEAQFGDFANGAQVIFDQFISSGEAKWLRQTGLVVLLPHGYDGQGPEHSSARLERYLQMSDDNPYVIPDMEPTMRKQIQECNWQIVNATTPANYFHVLRRQIHRDFRKPLIVMAPKNLLRHKDCKSNLSEFDDVQGHPGFDKQGTRFKRLIKDQNDHSDLEEGIRRLVLCSGKVYYELDDERKKVGASDVAICRVEQLCPFPYDLIQRELKRYPNAEIVWCQEEAMNMGAYSYITPRLWTAMRSLGRGDMEDIKYVGRGPSAATATGFYTFHVKEQAELVQKPLERIHQLKETSFIK

SEQ ID NO: 5809 - protein, 1021 aa, Citrus clementina
MGWFRASSGVAKLAIRRTLSQGCSYTTRAQVFPSRSRCFHSTVLKSKAQSAPVPRPVPLSRLTDNFLDGTSSVYLEELQRSWEADPNSVDESWQNFFRNFVGQAATSPGISGQTIQESMRLLLLVRAYQVNGHMKAKLDPLGLEEREIPDDLDPAFYGFTEADLDREFFLGVWSMAGFLSENRPVQTLRSILTRLEQAYCGSIGFEYMHISDREKCNWLRDKIETPTPMQYNRQRREVILDRLVWSTQFENFLATKWTTAKRFGLEGGETLIPGMKEMFDRAADLGVESIVIGMPHRGRLNVLGNVVRKPLRQIFSEFSGGTRPVDEVGLYTGTGDVKYHLGTSYDRPTRGGKRIHLSLVANPSHLEAVDPVVIGKTRAKQYYSNDMDRTKNMAVLIHGDGSFAGQGVVYETLHLSALPNYSIGGTIHIVVNNQVAFTTDPMSGRSSQYCTDVAKALDAPIFHVNGDDMEAVAHVCELAAEWRQTFHSDVVVDLVCYRRFGHNEIDEPSFTQPKMYKIIRSHPSSLEIYQNKLLECQHVTQEDINKIQEKVNRILSEEFVASKDYVPNRRDWLSAYWSGFKSPEQLSRIRNTGVKPEILKNVGKAITTLPENFKPHRGVKKVYELRAQMIETGEGIDWALGEALAFATLLVEGNHVRLSGQDVERGTFSHRHSVLHDQETGEQYCPLDHVMMNQDAEMFTVSNSSLSEFGVLGFELGYSMENPNSLVMWEAQFGDFANGAQVIFDQFVNSGESKWLRQSGLVVMLPHGYDGQGPEHSSARLERFLQMSDDNPYVIPEMDSTLRTQIQECNWQIVNVTTPANYFHVLRRQIHREFRKPLVVMSPKNLLRHKECKSNLSEFDDVQGHPGFDKQGTRFKRLIKDQNEHSDLEEGIRRLILCSGKVYYELNEERKKHSASDIAICRVEQLCPFPYDLVQRELKRYPNAEVVWSQEEPMNMGAYTYIAPRLCTAMKAVDRGTMEDIKYVGRAPSAASATGFYQVHVKEQSELMQKAIQPEPIGNPF

SEQ ID NO: 5810 - protein, 1021 aa, Citrus sinensis
MGWFRASSGVAKLAIRRTLSQGCSYTTRAQVFPSRSRCFHSTVLKSKAQSAPVPRPVPLSRLTDNFLDGTSSVYLEELQRSWEADPNSVDESWQNFFRNFVGQAATSPGISGQTIQESMRLLLLVRAYQVNGHMKAKLDPLGLEEREIPDDLDPAFYGFTEADLDREFFLGVWSMAGFLSENRPVQTLRSILTRLEQAYCGSIGFEYMHISDREKCNWLRDKIETPTPMQYNRQRREVILDRLVWSTQFENFLATKWTTAKRFGLEGGETLIPGMKEMFDRAADLGVESIVIGMPHRGRLNVLGNVVRKPLRQIFSEFSGGTRPVDEVGLYTGTGDVKYHLGTSYDRPTRGGKRIHLSLVANPSHLEAVDPVVIGKTRAKQYYSNDMDRTKNMAVLIHGDGSFAGQGVVYETLHLSALPNYSIGGTIHIVVNNQVAFTTDPMSGRSSQYCTDVAKALDAPIFHVNGDDMEAVAHVCELAAEWRQTFHSDVVVDLVCYRRFGHNEIDEPSFTQPKMYKIIRSHPSSLEIYQNKLLECQHVTQEDINKIQEKVNRILSEEFVASKDYVPNRRDWLSAYWSGFKSPEQLSRIRNTGVKPEILKNVGKAITTLPENFKPHRGVKKVYELRAQMIETGEGIDWALGEALAFATLLVEGNHVRLSGQDVERGTFSHRHSVLHDQETGEQYCPLDHVMMNQDAEMFTVSNSSLSEFGVLGFELGYSMENPNSLVMWEAQFGDFANGAQVIFDQFVNSGESKWLRQSGLVVMLPHGYDGQGPEHSSARLERFLQMSDDNPYVIPEMDSTLRTQIQECNWQIVNVTTPANYFHVLRRQIHREFRKPLVVMSPKNLLRHKECKSNLSEFDDVQGHPGFDKQGTRFKRLIKDQNEHSDLEEGIRRLILCSGKVYYELYEERKKHSASDIAICRVEQLCPFPYDLVQRELKRYPNAEVVWSQEEPMNMGAYTYIAPRLCTAMKAVDRGTMEDIKYVGRAPSAASATGFYQVHVKEQSELMQKAIQPEPIGNPF

SEQ ID NO: 5811 - protein, 548 aa, Brassica napus
MEMGALLGQGVVYETLHLSALPNYTTGGTIHIVVNNQVAFTTDPRAGRSSQYCTDVAKALSAPIFHVNGDDVEAVVHACELAAEWRQTFHSDVVVDLVCYRRFGHNEIDEPSFTQPKMYKVIKNHPSTLQIYHKKLLECGEISQQDIDRIQEKVNTILNEEFVASKDYLSKKRDWLSTNWAGFKSPEQISRVRNTGVKPEILKTVGKAISSLPENFKPHRAVKKVYEQRAQMIETGEGIDWALAEALAFATLVVEGNHVRLSGQDVERGTFSHRHSVLHDQETGEEYCPLDHLVMNQDPEMFTVSNSSLSEFGVLGFELGYSMESPNSLVLWEAQFGDFANGAQVIFDQFISSGEAKWLRQTGLVVLLPHGYDGQGPEHSSARLERYLQMSDDNPYVIPDMEPTLRKQIQECNWQIVNATTPANYFHVLRRQLHRDFRKPLIVMAPKNLLRHKDCKSNLSEFDDVQGHPGFDKQGTRFKRLIKDQNDHSDLEEGIRRLVLCSGKVYYELDDERKRSAQAMLLFVEWNSFVLFHMISFSVSSRDIQMRR

SEQ ID NO: 5812 - protein, 1019 aa, Brassica rapa
MVWFRAGSNVTKLAVRRILNQGTSYATRTRSLPSQTRSFHSSLHRPNPQSTTAPIPRAVPLSKLTDSFLDGTSSVYLEELQRAWESDPTSVDESWDNFFRNFVGQAATSPGISGQTIQESMNLLLLVRAYQVNGHMKANLDPLGLEQREIPEDLDLALYGFTEADLDREFFLGVWQMSGFMSENRPVQTLRSILARLQQAYCGSIGFEYMHIADRDKCNWLREKIETPTPWRYNRERREVILDRLAWSTQFENFLATKWTTAKRFGLEGGESLIPGMKEMFDRAADLGVESIVIGMSHRGRLNFLGNVVRKPLRQIFSEFSGGIRPVDEVGYTGTGDVKYHLGTSYDRPTRGGKKIHLSLVANPSHLEAADSVVVGKTRAKQYYSKDMDRTKNLGILIHGDGSFAGQGVVYETLHLSALPSYTTGGTIHIVVNNQVAFTTDPRAGRSSQYCTDVAKALSAPIFHVNGDDVEAVVHACELAAEWRQTFHSDVVVDLVCYRRFGHNEIDEPSFTQPKMYKVIKNHPSTLQIYHKKLLECGEISQQDIDRIQEKVNTILSEEFVASKDYLSKKRDWLSTNWAGFKSPEQISRVRNTGVKPEILKTVGKAISSLPENFKPHRAVKKVYEQRAQMIETGEGIDWALAEALALATLVVEGNHVRLSGQDVERGTFSHRHSVLHDQETGEEYCPLDHLVMNQDPEMFTVSNSSLSEFGVLGFELGYSMESPNSLVLWEAQFGDFANGAQVIFDQFISSGEAKWLRQTGLVVLLPHGYDGQGPEHSSARLERYLQMSDDNPYVIPDMEPTMRKQIQECNWQIVNATTPANYFHVLRRQIHRDFRKPLIVMAPKNLLRHKDCKSNLSEFDDVQGHPGFDKQGTRFKRLIKDQNDHSDLEEGIRRLVLCSGKVYYELDDERKKVGASDVAICRVEQLCPFPYDLIQRELKRYPNAEIVWCQEEAMNMGAFSYITPRLWTAMRSLGRGDMEDIKSFGRGPSAAPATGFYTFHVKEQAELVQKAIGKEPIS

SEQ ID NO: 5813 - protein, 1000 aa, Brassica napus
IRRTLSQSRVLPSSHTRCFHSTSLKSNAAPVPRPVPLSKLTDSFLDGTSSVYLEELQRAWEADPNSVDESWDNFFRNFVGQAATSPGISGQTIQESMRLLLLVRAYQVNGHMKAKLDPLGLEEREIPEDLTPGLYGFSEADLDREFFLGVWRMSGFLSENRPVQTLRAILSRLEQAYCGTIGYEYMHIADRDKCNWLRDKIETPTPRQYNSERRVVIYDRLTWSTQFENFLATKWTTAKRFGLEGAESLIPGMKEMFDRAADLGVENIVIGMPHRGRLNVLGNVVRKPLRQIFSEFSGGTRPVDEVGLYTGTGDVKYHLGTSYDRPTRGGKHLHLSLLANPSHLEAVDPVVMGKTRAKQYYTKDESRTKNMGILIHGDGSFAGQGVVYETLHLSALPNYCTGGTVHIVVNNQVAFTTDPRAGRSSQYCTDVAKALDAPIFHVNADDIEAVVHVCELAAEWRQTFHSDVVVDLVCYRRFGHNEIDEPSFTQPKMYKVIRSHPSSLQIYQEKLVESGQVTKEDIDKIQKKVSSILNEEFEASKEYIPQKRDWLASHWTGFKSPEQISRIRNTGVKPEILKNVGKAISTFPENFKPHRGVKRVYEQRAQMIESGEGIDWGLGEALAFATLVVEGNHVRLSGQDVERGTFSHRHSVLHDQETGKEYCPLDHLTMNQDPEMFTVSNSSLSEFGVLGFELGYSMENPNSLVIWEAQFGDFANGAQVMFDQFISSGEAKWLRQTGLVVLLPHGYDGQGPEHSSGRLERFLQMSDDNPFVIPEMDPTLRKQIQECNWQIVNVTTPANYFHVLRRQIHRDFRKPLIVMAPKNLLRHKKCVSNLSEFDDVKGHPGFDKQGTRFKRLIKDQSGHSDLEEGIRRLVLCSGKVYYELDEERQKSGTNDIAICRMEQLCPFPYDLIQRELKRYPNAEIVWCQEEPMNMGAYQYIAPRLCTAMKALNRGSFNDIKYVGRLPSAATATGFYQLHVKEQTDLVHKALQPDPITPILP

SEQ ID NO: 5814 - protein, 1019 aa, Pinus taeda
MVLQKISSGLIRAALKTRLAQSSYTKRALWTLPQARSLHSTGPKFQQTAPVPRSVPLSRLTDNFLDGTSSVYLEELQRAWEVDPQSVDESWDNFFRNFVGQASTSPGISGQTIQESMRLLLLVRAYQVNGHMKAKLDPLGLEEREIPVDLDPALYGFTEADLDREFFLGVWRMSGFLSENRPVQTLRSILNRLEQAYCGTIGYEYMHIPDRDKCNWLREKIETVTPRGYNAERRLVMLDRLIWSTQFENFLATKWTAAKRFGLEGAETLIPGMKEMFDRSADMGVESIVIGMSHRGRLNVLGNVVRKPLRQIFSEFSGGTKPASGEFGSYTGTGDVKYHLGTSYDRPTRGGKRIHLSLVANPSHLEAVDPVVVGKTRAKQYYSNDKERKKNLAILIHGDGSFAGQGVVYETLHLSALPNYTTGGTIHMVVNNQVAFTTDPMSGRSSQYCTDVAKALNAPIFHVNGDDLEAVVHACELAAEWRQTFQSDVVVDIVCYRRFGHNEIDEPSFTQPKMYKVIRNHPQALDLYEKQLIEMGQLSKEEIDALHKKVNSILNEEFINSKEYVPNRRDWLAAYWAGFKSPEQLSRIRNTGVKPEILKNVGKAITSIPETFKPHRAVKRVYDQRAQMIETEEGVDWAVGEALAFATLLVEGNHVRLSGQDVERGTFSHRHSVLHDQETGERYCPLDHVIMNQPEEMFTVSNSSLSEFGVLGFELGYSMENPNSLVLWEAQFGDFANGAQVIFDQFISSGESKWLRQSGLVVLLPHGYDGQGPEHSSARLERYLQMSDDNPFVIPEMDPTLRTQIQQCNWQIVNVTTPANYFHVLRRQINRDFRKPLIVMSPKNLLRHKDCKSNLSEFDDVQGHPGFDKQGTRFKRLIKDQNDHSDLEEGIKRLILCSGKIYYELDEERQRLQRKDVAICRVEQLCPFPYDLVQRELKRYPNAEIVWCQEEPMNMGAYSYITPRLTTAMTALGRGKYEDIKYVGRAPSAATATGFSQLHVKEQREVIETALQSAPVSFP

SEQ ID NO: 5815 - protein, 1033 aa, Prunus mume
MTWFRAGSRVAKLAIRRTLSNSGSYAARRRLLPLQNRHFHTTLCKSKAPVPSPVSLSRITDSVLDGTSSVYLEGLQRAWEADPNSVDESWDNFFRNFVGHQASISPGVSGQTIQESMRLLLLVKAYQVNGHMKAKLDPLGLEERAIPDDLDPCLYGFSEADLDREFFLGVWRMAGFLAENRPVQTLRSILTRLEQAYCGTIGYEYMHIADRNRCNWLRDKIETPTPMQYNNKRREVILDRLIWSTQFENFLATKWTAAKRFGLEGGETLIPGMKEMFDRAADLGVESIVIGMSHRGRLNVLGNVVRKPMRQIFSEFSGGTKPVEAVGGLYTGTGDVKYHLGTSYDRPTRGGNRIHLSLLANPSHLEAVDPVVVGKTRAKQYCSNDADRTKNMAVLIHGDGSFAGQGVVFEILHLSALPNYTTGGTIHIVVNNQVAFTTDPMSGRSSQYCTDVAKALSAPIFHVNADDMEAVVHVSELAAEWRQTFHSDVVVDLVCYRRFGHNELDEPSFTQPKMYKVIRNHPSALTIYQNKLLESGQVTKEDIERIQNKVNSILNEEFLASKDYVPQKRDWLSSHWSGFKSPEQISRILNTGVKPEILKSVGKAVTALPETFKPHRAVKKNYEQRAQMIETGEGIDWAVAEALAFATLLVEGNHVRLSGQDVERGTFTHRHSVLHDQETGEKYCPLDHIMENQDEEMFTVSNSSLSEFGVLGFELGYSMESPNALVIWEAQFGDFANGAQVIFDQFLSSGESKWLRQTGLVLLLPHGYLGQGPEHSSARLERFLQMSDDNPVAIPEMDPTHRKQIQECNWQVVNVTTPANYFHVLRRQLHREFRKPLIVMAPKNLLRHKECKSNLSEFDDVQGHPGFDKQGTRFKRLIKDQNDHSDLEEGIRRLVLCSGKLYYELDEERRNVEAKDVAICRMEQLCPFPYDLIQRELKRYPNAEIVWCQEEPMNMGAYSYIAPRLCAAMKSLSRGTIDDIKYVGRAPSASTATGFPQVHEKEQSEILHNAVQPEPIEYLTSSEARAYLSKTKQ

SEQ ID NO: 5816 - protein, 1019 aa, Abies balsamea
MVLQKISSGLIRAALRTRLGQSSYTKRALWTLPQARSLHSTGEKFQQAAPVPRPVPLSRLTDNFLDGTSSVYLEELQRAWEADPQSVDESWDNFFRNFVGQASTSPGISGQTIQESMRLLLLVRAYQVNGHMKAKLDPLGLEEREIPLDLDPGLYGFTEADLDREFFLGVWRMSGFLSENRPVQTLRSILSRLEQAYCGTIGYEYMHIPDRDKCNWLREKIETVVPRGYNAERRHVMLDRLIWSSQFENFLATKWTAAKRFGLEGAETLIPGMKEMFDRAADMGVESIVIGMSHRGRLNVLGNVVRKPLRQIFSEFSVGTKPASEVVGSYTGSGDVKYHLGTSYDRPTRGGKRIHLSLVANPSHLEAVDPVVVGKTRAKQYYSNDKERKKNLAILIHGDGSFAGQGVVYETLHLSALPNYTTGGTIHIVVNNQVAFTTDPKSGRSSQYCTDVAKALNAPIFHVNGDDVEAVVHACELAAEWRQTFQSDVVVDIVCYRRFGHNEIDEPSFTQPKMYKVIRNHPRALDLYEKQLIEMGQLSKEEIDALHNKVSSILNEEFISSKEYVPNRRDWLAAYWTGFKSPEQLSRIRNTGVKPEILKNVGKTITSLPETFKPHRAVKRIFDQRAQMIATEEGLDWAVGEALAFATLLVEGNHVRLSGQDVERGTFSHRHSVLHDQETGERYCPLDHVIMNQPEEMFTVSNSSLSEFGVLGFELGYSMENPNSLVLWEAQFGDFANGAQVIFDQFISCGESKWLRQSGLVVLLPHGYDGQGPEHSSARLERYLQMSDDNPFVIPEMDPTLRTQIQQCNWQIVNVTTPANYFHVLRRQINRDFRKPLIVMSPKNLLRHKDCKSNLSEFDDVQGHQGFDKQGTRFKRLIKDQNDHSDREEGIKRLILCSGKIYYELDEERQRIQRKDVAICRVEQLCPFPYDLVQRELKRYPNAEIVWCQEEPMNMGAYTYITPRLTTAMTALGRGTYEDIKYVGRAPSAATATGFSSVHVKEQREVLETALQSAPVIFP

SEQ ID NO: 5817 - protein, 1025 aa, Eutrema halophilum
MAWFRTGSSVAKLAIRRTLCQSQCGSYATRTRVLPSQSRYFHSTILKSKAESAAPVPRPVPLSKLTDSFLDGTSSVYLEELQRAWEADPNCVDESWDNFFRNFVGQAATSPGISGQTIQESMRLLLLVRAYQVNGHMKAKLDPLGLEEREIPEDLTPGLYGFSEADLDREFFLGVWRMSGFLSENRPVQTLRAILSRLEQAYCGTIGYEYMHIADREKCNWLRDKIETPTPRQYNSERRVVIYDRLTWSTQFENFLASKWTTAKRFGLEGAESLIPGMKEMFDRAADLGVENIVIGMPHRGRLNVLGNVVRKPLRQIFSEFSGGTKPVDEVGLYTGTGDVKYHLGTSYDRPTRGGKHLHLSLLANPSHLEAVDPVVIGKTRAKQYYTKDENRTKNMGILIHGDGSFAGQGVVYETLHLSALPNYCTGGTVHIVVNNQVAFTTDPRAGRSSQYCTDVAKALDAPIFHVNADDVEAVVHACELAAEWRQTFHSDVVVDLVCYRRFGHNEIDEPSFTQPKMYKVIRSHPSSLQIYQEKLLESGQVNQGDIDKIQKKVSSILNEEFGASKDYIPQKRDWLASHWTGFKSPEQISRIRNTGVKPEILKNVGKAISTFPENFKPHRGVKRVYEQRAQMIESGEGIDWGLGEALAFATLVVEGNHVRLSGQDVERGTFSHRHSVLHDQETGEEYCPLDHLTMNQDPEMFTVSNSSLSEFGVLGFELGYSMENPNSLVIWEAQFGDFANGAQVMFDQFISSGEAKWLRQTGLVVLLPHGYDGQGPEHSSGRLERFLQMSDDNPYVIPEMDPTLRKQIQECNWQVVNVTTPANYFHVLRRQIHRDFRKPLIVMAPKNLLRHKKCVSNLSEFDDVKGHPGFDKQGTRFKRLIKDQSGHSDLEEGIRRLVLCSGKVYYELDEERQKSETNDVAICRVEQLCPFPYDLIQRELKRYPNAEIVWCQEEPMNMGGYQYIAPRLCTAMKAMKRGIFNDIKYVGRLPSAATATGFYQLHVKEQTDLVQKALQPDPITPVIP

SEQ ID NO: 5818 - protein, 296 aa, Triphysaria pusilla
MAWFRSGSNLTKLAIRRTLSQTTSYTARTKTAPSQSRYFHTTVFKSKAQSAPVPRPVPLSRLTDSFLDGTSSVYLEELQRAWEQDPNSVDESWDNFFRNFVGQSSTSPGISGQTIQESMRLLLLVRAYQVYGHTKAKLDPLGLEQRPIPDDLDPALYGFSEADFDREFFVGVWSMAGFLSENRPVQTLRAILKRLEQSYCGSIGYEYMHIADREKCNWLRDKIETPTPTQYNRERREVILDRLIWSTQFENFLAAKWTAAKRFGLEGCETLIPGMKEMFDRSADLGVESIVIGMVG

SEQ ID NO: 5819 - protein, 815 aa, Pseudotsuga menziesii
MNTCTYRTVISVIGSGRRLRGNPRGYNAERRHVMLDRLIWSSQFENFLATKWTAAKRFGLEGAETLIPGMKEMFDRAADMGVESIVIGMSHRGRLNVLGNVVRKPLRQIFSEFSGGTKPVSEVGSYTGTGDVKYHLGTSYDRPTRGGKRIHLSLVANPSHLEAVDPVVVGKTRAKQYYSNDKERTKNVAVLIHGDGSFAGQGVVYETLHLSALPNYTTGGTIHIVVNNQVAFTTDPKSGRSSQYCTDVAKALNAPIFHVNGDDVEAVVHACELAAEWRQTFHSDVVVDIVCYRRFGHNEIDEPSFTQPKMYKVIRNHPRALDLYEKQLIEMGQLSKEEIDALHNKVSSILNEEFINSKEYVPNRRDWLAAYWTGFKSPEQLSRIRNTGVKPEILKNVGKAITSLPETFKPHRSVKRIFDQRAQMIETGEGVDWAVGEALAFATLLVEGNHVRLSGQDVERGTFSHRHSVLHDQETGERYCPFDHVTINQPEEMFTVSNSSLSEFGVLGFELGYSMENPNSLVLWEAQFGDFANGAQVIFDQFISSGESKWLRQSGLVVLLPHGYDGQGPEHSSARLERFLQMSDDNPFVIPEMDPTLRTQIQQCNWQVVNVTTPANYFHVLRRQINRDFRKPLIVMSPKNLLRHKDCKSNLSEFDDVQGHQGFDKQGTRFKRLIKDQNDHSGLEEGIKRLVLCSGKIYYELDEERQRIQRKDVAICRVEQLCPFPYDLVQRELKRYPNAEIVWCQEEPMNMGAYNYIAPRLTTSMTTLGRGKYEDIKYVGRAPSAATATGFSLVHVKEQREVVETALQSDPIIFP

SEQ ID NO: 5820 - protein, 982 aa, Brassica napus
SFHSSLYRPNPQSTTAPIPRAVPLSKLTDSFLDGTSSVYLEELQRAWESDPSSVDESWDNFFRNFVGQAATSPGISGQTIQESMNLLLLVRAYQVNGHMKANLDPLGLEQREIPEDLDLALYGFTEADLDREFFLGVWQMSGFMSENRPVQTLRSILARLQQAYCGSIGFEYMHIADRDKCNWLREKIETPTPWRYNRERREVILDRLAWSTQFENFLATKWTTAKRFGLEGGESLIPGMKEMFDRAADLGVESIVIGMSHRGRLNVLGNVVRKPLRQIFSEFSGGIRPVDEVGYTGTGDVKYHLGTSYDRPTRGGKKIHLSLVANPSHLEAADSVVVGKTRAKQYYSKDMDRTKNLGILIHGDGSFAGQGVVYETLHLSALPNYTTGGTIHIVVNNQVAFTTDPRAGRSSQYCTDVAKALSAPIFHVNGDDVEAVVHACELAAEWRQTFHSDVVVDLVCYRRFGHNEIDEPSFTQPKMYKVIKSHPSTLQIYHKKLLECGEISQQDIDRIQEKVNTILSEEFVASKDYLSKKRDWLSTNWAGFKSPEQISRVRNTGVKPEILKTVGKAISSLPENFKPHRAVKKVYEQRAQMIETGEGIDWALAEALAFATLVVEGNHVRLSGQDVERGTFSHRHSVLHDQETGEEYCPLDHLVMNQDPEMFTVSNSSLSEFGVLGFELGYSMESPNSLVLWEAQFGDFANGAQVIFDQFISSGEAKWLRQTGLVVLLPHGYDGQGPEHSSARLERYLQMSDDNPYVIPDMEPTMRKQIQECNWQIVNATTPANYFHVLRRQIHRDFRKPLIVMAPKNLLRHKDCKSNLSEFDDVQGHPGFDKQGTRFKRLIKDQNDHSDLEEGIRRLVLCSGKVYYELDDERKKVGASDVAICRVEQLCPFPYDLIQRELKRYPNAEIVWCQEEAMNMGAFSYITPRLWTAMRSLGRGDMEDIKYVGRGPSAATATGFYTFHVKEQAELVQKAIGKEPIS

SEQ ID NO: 5821 - protein, 506 aa, Picea glauca
MYKVIRNHPRALDLYENQLIEMGQLSKEEIDALHNKVSSILNEEFINSKEYVPNRRDWLAAYWTGFKSPEQLSRIRNTGVKPEILKNVGKTITSLPETFKPHRAVKRVYDQRAQMIETGEGVDWAVGEALAFATLLVEGNHVRLSGQDVERGTFSHRHSVLHDQETGESYCPLDHVIINQPEEMFTVSNSSLSEFGVLGFELGYSMENPNSLVLWEAQFGDFANGAQVIFDQFISSGESKWLRQSGLVVLLPHGYDGQGPEHSSARLERYLQMSDDNPFVIPEMDPTLRTQIQQCNWQVVNVTTPANYFHVLRRQINRDFRKPLIVMSPKNLLRHKDCKSNLSEFDDVQGHPGFDKQGTRFKRLIKDQNDHSDLEEGIKRLILCSGKIYYELDEERQRVQRKDVAICRVEQLCPFPYDLVQRELKRYPNAEIVWCQEESMNMGAYNYITPRLTTAMKALGRGTYEDIKYVGRAPSAATATGFSQVHVKEQREVVETALQSAPIIFP

SEQ ID NO: 5822 - protein, 706 aa, Eutrema parvulum
MAWFRTGSSVAKLAIRRTLSQSQFGSYAARTRVLPSQSRWFHSTILKSKAESVAPVPRPVPLSKLTDSFLDGTSSVYLEELQRAWEADPNSVDESWDNFFRNFVGQAATSPGISGQTIQESMRLLLLVRAYQVNGHMKAKLDPLGLEEREIPEDLTPGLYGFTEADLDREFFLGVWRMSGFLSENRPVQTLRAILSRLEQAYCGTIGYEYMHIADREKCNWLRDKIETPAARQYNSERRVVIYDRLTWSTQFENFLASKWTTAKRFGLEGAESLIPGMKEMFDRAADLGVENIVIGMPHRGRLNVLGNVVRKPLRQIFSEFSGGTRPVDEVGLYTGTGDVKYHLGTSYDRPTRGGKHLHLSLLANPSHLEAVDPVVMGKTRAKQYYTKDESRTKNMGILIHGDGSFAGQGVVYETLHLSALPNYCTGGTVHIVVNNQVAFTTDPRAGRSSQYCTDVAKALDAPIFHVNADDVEAVVHACELAAEWRQTFHSDVVVDLVCYRRFGHNEIDEPSFTQPKMYKVIRSHPSSLQIYQERLLESGQVTQEDIDKIQKKVSSILNEEFGASKDYIPQRRDWLASHWTGFKSPEQISRIRNTGVKPEVLKNVGKAISTFPENFKPHRGVKRVYEQRAQMIESEEGIDWGFGEALAFATLVVEGNHVRLSGQDVERGTFSHRHSVLHDQETGKEYCPLDHLTMNQDPEMFTVSN

SEQ ID NO: 5823 - protein, 966 aa, Brassica napus
PVPRAVPLSKLTDSFLDGTSSVYLEELQRAWEADPTSVDESWDNFFRNFVGQAATSPGISGQTIQESMRLLLLVRAYQVNGHMKAKLDPLGLEQREIPEDLDLALYGFTEADLDREFFLGVWQMSGFMSENRPVQTLRSILTRLQQAYCGSIGFEYMHIADRDKCNWLREKIETPTPWRYNRERREVILDRLAWSTQFENFLATKWTTAKRFGLEGGESLIPGMKEMFDRAADLGVESIVIGMSHRGRLNVLGNVVRKPLRQIFSEFSGGIRPVDEVGYTGTGDVKYHLGTSYDRPTRGGKKIHLSLVANPSHLEAADSVVVGKTRAKQYYSKDLDRTKNLGILIHGDGSFAGQGVVYETLHLSALPNYTTGGTIHIVVNNQVAFTTDPRAGRSSQYCTDVAKALSAPIFHVNGDDVEAVVHACELAAEWRQTFHSDVVVDLVCYRRFGHNEIDEPSFTQPKMYKVIKNHPSTLQIYHKKLLECGEISQQDIDRIQEKVNTILNEEFVASKDYLSKTRDWLSTNWAGFKSPEQISRVRNTGVKPEILKTVGKAISSLPENFKPHRAVKKVYEQRAQMIETGEGIDWALAEALAFATLVVEGNHVRLSGQDVERGTFSHRHSVLHDQETGEEYCPLDHLVMNQDPEMFTVSNSSLSEFGVLGFELGYSMESPNSLVLWEAQFGDFANGAQVIFDQFISSGEAKWLRQTGLVVLLPHGYDGQGPEHSSARLERYLQMSDDNPYVIPDMEPTLRKQIQECNWQIVNATTPANYFHVLRRQLHRDFRKPLIVMAPKNLLRHKDCKSNLSEFDDVQGHPGFDKQGTRFKRLIKDQNDHSDLEEGIRRLVLCSGKVYYELDDERKKVGASDVAICRVEQLCPFPYDLIQRELKRYPNAEIVWCQEEAMNMGAYSYITPRLWTAMRSLRRGDMEDIKYVGRGPSAATATGFYTFHVKEQAELVQKAIGKEPIS

SEQ ID NO: 5824 - protein, 1020 aa, Lactuca sativa
MAWLRAGTSVAKLAIRKTLTQGRSYASRPRLLPSRIHHFHTTIPKSKPQSPIPRSVPLSKLSDNFLDGTSSVYLEEMQRAWEADPTSVDESWDNFFRNFVGQASISPGVSGQTIQESMKLLLLVRAYQFHGHMKAKLDPLSLEQRDIPGDLDPGFYGFTESDLDREFFLGVWKMSGFLSENRPVQTLRAILTRLEQAYCGSIGYEYMHIANRDHCNWLRDRIETPSPSQYNSKRREVILDRLIWSTQFENFLATKWTAAKRFGLEGGETLIPGMKEMFDRSADLGVESIVIGMSHRGRLNVLGNVVRKPLRQIFSEFSGGTKPIDEVGLYTGTGDVKYHLGTSYDRATRGGKHIHLSLVANPSHLEAVDPVVIGKTRAKQYYSNDVDRTKNMGILIHGDGSFAGQGVVYETLHLSALPNYTTGGTIHIVVNNQVAFTTDPKSGRSSQYCTDVAKALDAPIFHVNGDDVEAVVHACELAAEWRQTFHSDVVVDITCYRRFGHNEIDEPFFTQPKMYKVIRSHPSALEIYQKKLLESGQSTKEDIDRMQKKVTTILNEEFMASKDYAQKKRDWLSAYWSGFKSPEQLSRIRNTGVQPEILKNVGKAITTLPESFKAHRAVKKIFGDRLKMIESGEGVDWAVAEALAFATLLVEGNHVRLSGQDVERGTFSHRHSVIHDQDTGERYCPLDHVMSNQHPEMFTVSNSSLSEFGVLGFELGYSMENPNSLVLWEAQFGDFSNGAQVMFDQFLSSGEAKWLRQTGLVILLPHGYDGQGPEHSSARLERFLQMSDDDPFVIPEMDPTLRTQIQTCNWQVVNVTTPANYFHVLRRQLHRDFRKPLIVMSPKNLLRHKDCKSNLSEFDDAEGHPGYDKQGTRFKRLIKDQNGHSDLEEGIRRLVLCSGKVYYELDEARKSTGSKDVAICRVEQLCPFPYDLIQRELKRYPNAEIVWCQEEPMNMGAYSYISHRLATAMKVLGRGTIYDIKYVGRGTSAATATGFYGVHGTEQSELVKKALQPDPIPSPA

SEQ ID NO: 5825 - protein, 957 aa, Panicum virgatum
STGPAASTSRSCSGPGTADPNSVDESWDNFFRNFVGQAATTSPGLSGQTIQESMRLLLLVRAYQVSGHLKAMLDPLGLEERPVPDVLDPAFYEFSEADLDREFFLGVWRMAGFLSDNRPVQTLRSVVERLEQAYCGTIGYEYMHIADREKCNWLREKIETVNPREYTYDRRQVMLDRLIWSTQFENFLATKWTTAKRFGLEGAETLIPGMKEMFDRAADLGVESIVIGMPHRGRLNVLGNVVRKPLRQIFSEFSGGTKPVNEGEGLYTGTGDVKYHLGTSYDRPTRGGKHIHLSLVANPSHLEAVDPVVAGKTRAKQYYSNDRDRTKNLGVLLHGDGSFSGQGVVYETLHLSALENYTTGGTIHIVVNNQVAFTTDPKSGRSSQYCTDVAKALDAPIFHVNGDDLEAVVHVCELAAEWRQTFHSDVVVDIVCYRRFGHNEIDEPSFTQPKMYKVIRNHPSALEIYQNKLLESGKISKEDIDRLNKKVNTILNEEFKNSKDYVPNKRDWLSAYWTGFKSPEQISRIRNTGVKPEILKRVGEAMTTLPENFKPHRAVKKIFDQRRQMIETGEGIDWAVGEALAFATLIVEGNHVRLSGQDVERGTFSHRHSVIHDQETGERYCPLDNLVMNQDEELFTVSNSSLSEFAVLGFELGYSMENPNSLVLWEAQFGDFANGAQVIFDQFLSSGESKWLRQTGLVVCLPHGYDGQGPEHSSARLERFLQMSDDNPYVIPEMDPTLRKQIQQCNWQVVNVTTPANYFHVLRRQIHRDFRKPLIVMSPKNLLRHKDCKSNLSEFDDLAGHPGFDKQGTRFKRLIKDQNNHKDLEEGINRLVLCSGKVYYELDEERRKTERTDVAICRVEQLCPFPYDLIQRELKRYPNAEIVWCQEEPMNMGAYSYINPRLLTAMKALGRGSIDDIKYVGRAPSAATATGFYSVHVQEQTELVQKALQRDPINYLF

SEQ ID NO: 5826 - protein, 210 aa, Setaria italica
MSAGLVTDEVTMGRLYRIRRTVMQMLRDRGYLVVEHELATSRRDFLRKFGESFHREDLLINKYKKNDPSDQIYVFFPNDDKVGMKHIKKYVEMMTHENVSRAVLVLQQNLTPFAKSFLIELEPKIHLEIFQEAELLINIKEHVLVPEHQVLTNEEKKTLLERYTLKETQLPRIQITDPIARYYGLKRGQVVKIIRPSETAGRYVTYRYVV

SEQ ID NO: 5827 - protein, 210 aa, Saccharum officinarum
MSAGLVTDEATVGRLYRVRRTVMQMLRDRGYLVVEHELATSRRDFLRKFGESFHREDLQINKSKKNDPSDQIYVFFPNDDKVGMKHIKKYVEMMTHENVSRAVLVLQQNLTPFAKSFLIELEPKIHLEVFQEAELLINIKEHVLVPEHQVLTNEEKKTLLERYTLKETQLPRIQISDPIARYYGLRRGQVVKIIRPSETAGRYVTYRYVV

SEQ ID NO: 5828 - protein, 210 aa, Pennisetum glaucum
MSAGLVTDEVTIGRLYRIRRTVMQMLRDRGYLVVDHELATSRRDFLRKFGESFHREDLLINKYKKNDPSDQIYVFFPNDDKVGMKHIKKFVEMMTHDNVSRAVLVLQQNLTPFAKSFLIELEAKIHLEVFQEAELLINIKEHVLVPEHQVLTNAEKKTLLERYTLKETQLPRIQITDPIARYYGLRRGQVVKIIRPSETAGRYVTYRYVV

SEQ ID NO: 5829 - protein, 210 aa, Sorghum bicolor
MSAGLVTDEATVGRLYRIRRTVMQMLRDRGYLVVEHELATSRRDFLRKFGESFHREDLQINKSKKNDPSDQIYVFFPNDDKVGMKHIKKYVEMMTHENVSRAMVVLQQNLTPFAKSFLIELEPKIHLEVFQEAELLINIKEHVLVPEHQVLTNEEKKTLLERYTLKETQLPRIQISDPIARYYGLRRGQVVKIIRPSETAGRYVTYRYVV

SEQ ID NO: 5830 - protein, 210 aa, Panicum virgatum
MSAGLVTDEATMGRLYRIRRTVMQMLRDRGYLVGEHELATSRRDFLRKFGESFHREDLLINKYKKNDPSDQIYVFFPNDDKVGMKHIKKYVEMMTHENVSKAVVVLQQNLTPFAKSFLIELEPKIHLEVFQEAELLINIKEHVLVPEHQVLTNEEKKTLLERYTLKETQLPRIQISDPIARYYGLRRGQVVKIIRPSETAGRYVTYRYVV

SEQ ID NO: 5831 - protein, 210 aa, Panicum virgatum
MSTGLVTDEATMGRLYRIRRTVMQMLRDRGYLVGEHELATSRRDFLRKFGESFHREDLLINKYKKNDPSDQIYVFFPNDDKVGMKHIKKYVEMMTHENVSKAVVVLQQNLTPFAKSFLIELEPKIHLEVFQEAELLINIKEHVLVPEHQVLTNEEKKTLLERYTLKETQLPRIQISDPIARYYGLRRGQVVKIIRPSETAGRYVTYRYVV

SEQ ID NO: 5832 - protein, 210 aa, Oryza sativa
MSAGLVTEEVMVGRLVRIRRTVMQMLRDRGYLVVEHELAMGRRDFLRKYGESFHREDLLINKYKKNDPSDQIYVFFPNDDKVGMKHIKKYVEMMKAENVSRAVLVLQQNLTPFARSFLQELEPKIHLEIFQEAELLINIKEHVLVPEHQVLNNEEKKTLLERYTLKETQLPRIQITDPIARYYGLRRGQVVKIIRPSETAGRYVTYRYVV

SEQ ID NO: 5833 - protein, 210 aa, Brachypodium distachyon
MASGLVTDDAGVGRLVRIRSTVMHMLRDRGYLVVEHELAMTRRDFERKYGESFHREDLLINKCKKNDPNDQIYVFFPNDEKVGMKHIKKYVEMMNAEKVSRAVVVVQQNLTPFAKSFLQELEPKIHLEVFQDAEMLINIKEHVLVPEHQVLTNDEKKTLLERYTLKETQLPRIQITDPIARYYGLKRGQVVKIIRPSETAGRYVTYRYVV

SEQ ID NO: 5834 - protein, 209 aa, Avena sativa
MSGLVTDDAAVGRLVRIRRTVMCMLRDRGYLVVEHELAMNRRDFQRKYGESFHREDMQISKCKKNDPNDQIYVFFPNDEKVGMKHIKKYVEMMTSEKVSRAVLVVQQNLTPFAKSFLQELEPKIHLEVFQDAEMLINIKEHVLIPEHQVLTTEEKKTLLERYTLKETQLPRIQITDPIARYYGLKRGQVVKIIRPSETAGRYVTYRYVV

SEQ ID NO: 5835 - protein, 210 aa, Pseudoroegneria spicata
MASGLVTEELTVGRLVRIRRTVMHMLRDRGYLVVEHELSMTRRDFQRKYGESFHREDMLINKCKKNDPNDQIYVFFPNDEKVGMKHIKKYVEMMNAEKVSRAILVVQQNLTPFAKSFLQELEPKIHLEVFQDAEMLINIKEHVLVPEHQVLANEEKKTLLARYTLKETQLPRIQITDPIARYYGLKRGQVVKIIRPSETAGRYVTYRYVV

SEQ ID NO: 5836 - protein, 210 aa, Triticum aestivum
MASGLVTEDVTVGRLVRIRRTVMHMLRDRGYLVVEHELSMTRRDFQRKYGESFHREDMLINKCKKNDPNDQIYVFFPNDEKVGMKHIKKYVEMMNAEKVSRAILVVQQNLTPFAKSFLQELEPKIHLEVFQDAEMLINIKEHVLVPEHQVLANEEKKTLLARYTLKETQLPRIQITDPIARYYGLKRGQVVKIIRPSETAGRYVTYRYVV

SEQ ID NO: 5837 - protein, 210 aa, Hordeum vulgare
MASGLVTEDVTVGRLVRIRRTVMHMLRDRGYLVVEHELSMTRRDFQRKYGETFHREDMLINKCKKNDPNDQIYVFFPNDEKVGMKHIKKYVEMMNAEKVSRAILVVQQNLTPFAKSFLQELEPKIHLEVFQDAEMLINIKEHVLVPEHQVLANEEKKTLLARYTLKETQLPRIQITDPIARYYGLKRGQVVKIIRPSETAGRYVTYRYVV

SEQ ID NO: 5838 - protein, 210 aa, Leymus cinereus x Leymus triticoides
MASGLVTEDVTVGRLVRIRRTVMHMLRDRGYLVVEHELSMTRRDFQHKYGESFHREDMLINKCKKNDPNDQIYVFFPNDEKVGMKHIKKYVEMMNAEKVSRAILVVQQNLTPFAKSFLQELEPKIHLEVFQDAEMLINIKEHVLVPEHQVLATEEKKALLERYTLKETQLPRIQITDPIARYYGLKRGQVVKIIRPSETAGRYVTYRYVV

SEQ ID NO: 5839 - protein, 251 aa, Avena sativa
KQSGTTSSRSAGQAGSPAPPPPPNTKRRPPPPDGSGSGGEGDGRAWVTDDAAVGRLVRIRRTVMCMLRDRGYLVVEHELSMNRRDFQRKYGESFHREDMQISKSKKNDPNDQIYVFFPNDEKVGMKHIKKYVEMMNSEKVFRAVLVVQQNLTPFAKSFLQELEPKIHLEVFQDAEMLINIKEHVLIPEHQVLTTEEKKTLLERYTLKETQLPRIQITDPIARYYGLKRGQVVKIIRPSETAGRYVTYRYVV

SEQ ID NO: 5840 - protein, 209 aa, Secale cereale
GVGPGDGGRDGGRLVRIRRTVMHMLRDRGYLVVEHELSMTRRDFQRKYGESFHREDMLINKCKKNDPNDQIYVFFPNDEKVGMKHIKKYVEMMNAEKVSRAILVVQQNLTPFAKSFLQELEPKIHLEVFQDAEMLINIKEHVLVPEHQVLANEEKKTLLARYTLKETQLPRIQITDPIARYYGLKRGQVVKIIRPSETAGRYVTYRYVV

SEQ ID NO: 5841 - protein, 211 aa, Lolium multiflorum
MSSGLIAEDVAVKRMVRIRRTVMCMLRDRGYLVVEHELSMNRRDFERKYGESFHREDMLINKCKKNDPNDQIYVFFPNDEKVGMKHIKKYVEMMNAEKVSRALLIVQQNLTPFAKNFIIQELEPKIHLEVFQDAEMLINIKEHVLIPEHQVLTNEEKKTLLARYTLKETQLPRIQMTDPIARYYGLKRGQVVKIIRPSETAGRYVTYRYVV

SEQ ID NO: 5842 - protein, 276 aa, Sorghum bicolor
MAAAADVSTAARTSSSPAAEEGGQRGEHESESEGEEVGVAAVLDFDMLCASVALSAERRKGAAAPEGAAGDCGGGGGGVQRMWEGDVVLDCLEDRRIALEASCCPCYRFGKNMRRANLGSCFLQGMVYCILLAAVLISLIAFSVTRHHIYLYMGLGSVLLIAIYTGYFRRRIRKQFNIRGTESSLDDCVLHLICPCCTLCQEARTLEMNNVQCGVWHGRGDTICLGRNGEGNKAFAALNKASLVPIKSPGLCGMDRTSNAADEHEPLVPPDQLEQV

SEQ ID NO: 5843 - protein, 279 aa, Panicum virgatum
MAPEAAEVSTAARSSSGGPAAEEEGERRRGESESEGEEAGVAAVLDFDMLCASVALSAERRKAAAAAAAPAGDCGGGGGGGVQRMWEGDVVLDCLEDRRIALEAACCPCYQFGKNMRRANLGSCFLQGTVYFILLAAVLVSLIAFSVTRHHIYLYMGLGSVLLIAIYTGYFRRRIRKQFNIRGTESSLDDCVLHLICPCCTLCQEGRTLEMNNVQCGVWHGRGDTICLGSNGEGNKVFAALKKASLVPIKSPGLCGMDRTSNAADEHEPLVPPDQLEQV

SEQ ID NO: 5844 - protein, 275 aa, Panicum virgatum
MAPEAARSSSGSPAAEEEGERRRGESESESEGEEAGVAAVLDFDMLCASVALSAERRKGAAAAAAAGDCGGGGGGGGVQRMWEGDVVLDCLEDRRIALEAACCPCYQFGKNMRRANLGSCFLQGMVYFILLVAVLVSLIAFSVTRHHIYLYMGLGSVLFIAIYTGYFRRRIRKQFNIRGTESSLDDCVLHLICPCCTLCQEGRTLEMNNVQCGVWHGRGDTICLGSNGEGNKAFAALKKASLVPIKSPGLCGMDRTSNAADEHEPLVPPDQLEQV

SEQ ID NO: 5845 - protein, 272 aa, Panicum virgatum
MAPEAARSSSGSPAAEEEGERRRGESESESEGEEAGVAAVLDFDMLCASVALSAERRKGAAAAAPAGDCGGSGGVQRMWEGDVVLDCLEDRRIALKAACCPCYQFGKNMRRANLGSCFLQGMVYFILLAAVLVSLIAFSVTRHHIYLYMGLGSVLFIAIYTGYFRRRIRKQFNIRGTESSLDDCVLHLICPCCTLCQEGRTLEMNNVQCGVWHGRGDTICLGSNGEGNKAFAALKKASLVPIKSPGLCGMDRTSNAADEHEPLVPPDQLEQV

SEQ ID NO: 5846 - protein, 281 aa, Setaria italica
MAAAAEELSTAARSSGGGPLGTEEEEEERRRGESESEGEESGMAAVLDFDMLCASVALSAERRKGAAAAEAAGDCGGGVGGGGVQRMWEGDVVLDCLEDRRIALEAACCPCYRFGKNMRRANLGSCFLQGMFYFVLLAAVLVSLIAFSVTKHHIYLYMGLASVLLVAIYTGYFRRRIRKQFNIRGTESSLDDCVLHLICPCCTLCQEARTLEMNNVQCGVWHGRGDTICLGSNGEGNKAFAALNKASLVPSKSPGLCCMDRTSNAADEHEPLVPSAQPEQV

SEQ ID NO: 5847 - protein, 263 aa, Saccharum officinarum
MAAAAEEVSTAARTGSSPAAEEAERRGESESEGEEPGVAAVLDFDMLCASVALSAERRKAAAAPAGAAGDCGGGGGTGVQRMWEGDVVLDCLEDRRIALEASCCPCYRFGKNMRRANLGSCFLQGMVYCILLAGVLISLIAFSVARHHIYLYMGIGSILLIAIYTGYFRRRIRKLFNIRGTESSLDDCVLHLICPWCTLCQEARTLEMNNVHCGVWHGRSDTICLRSNGEGNTASLPLTPPLLCLLKSPGCVAWIECQMLLTS

SEQ ID NO: 5848 - protein, 414 aa, Sorghum bicolor
MGAKRAVLVGINYPGTKAELKGCHNDVARMRRCLVDRFGFDESGIRVLIDDGSALKPTGANIRRELARLVGDARPGDLLFFHYSGHGTRLPAETGQDDDTGYDECIVPCDMNLITDQDFTELVQKIPSGCLFTIVSDSCHSGGLLDKTKEQIGHSTKLNQTQRRELEERPASDTSFREFLKDTVRDVFESKGIHLPHRSHSHRQGHGDDDDAEESRYINTADAHVKNRSLPLSTLIEMLKEKTGKDDVDVGSIRLTLFNLFGDDASPKIKKFMKVMLNKLQQGQHGGIVGFMGALAQEFLKAKLDGKEEELDPAMKQNVHSDQEVYAGTTARVPSNGVLISGCQTDQTSADATTPKGVSYGALSNAIQAILSERGKVTNKELVLKARKMLSKQGYTQQPGLYCSDENASVAFIC

SEQ ID NO: 5849 - protein, 413 aa, Setaria italica
MGEKRAVLVGINYPGTKAELKGCHNDVARMRRCLVDRFGFDESGIRVLVDDGSGGPQPTGANIRRELARLVGDARPGDLLFFHYSGHGTRLPAETGQDDDTGYDECIVPCDMNLITDQDFTELVQKVPEGCLLTIVSDSCHSGGLLDKTKEQIGHSTKQNQTQRRELEERSDSGTSFRAFLKETVRDVFESQGIHLPHRGHRHSDDGDDGDEEPRYIDAADAHVKNRSLPLSTLIEMLKEKTGKDDIDVGSIRLTLFNLFGDDASPKVKKFMKVMLNKLQQGQHGGVMGFMGALAQEFLKAKLEGQQDQLEPAMNQEVHSEEEVYAGTTARVPSNGVLISGCQTDQTSADATTPKGVSYGALSNAIQTILAEHGTVTNKELVLKARKMLSKQGYTQQPGLYCSDEHASVAFIC

SEQ ID NO: 5850 - protein, 407 aa, Panicum virgatum
MGEKRAVLVGINYPGTKAELKGCHNDVARMRRCLVERFGFDESGIRVLVDDGSGPQPTGANIRRELQRLVGDAAPGDLLFFHYSGHGARLPAETGQDDDTGYDECIVPCDMNLITDQDFTELVRKVPEGCLFTIVSDSCHSGGLLDKTKEQIGHSTKQNQAERSDSGSSGGFRSFLKGAVRDVFESQGIHLPHRSHRQSDDGEDGDEEPRYIDTADAHVKNRSLPLSTLIEMLKEKTGKDDIDVGSLRLTLFDLFGDDASPKIKKFMKVMLNKLQQGQHGGVVGFVGALAQELLKAKLDGKQEQLEAAMEQEVHSEQEVYAGTTARVPSNGVLISGCQTDQTSADATTPKGSYGALSNAIQAILAEHGTVTNTELVMKARKMLSRQGYTQQPGLYCSDEHASVAFIC

SEQ ID NO: 5851 - protein, 411 aa, Panicum virgatum
MGEKRAVLVGINYPGTKAELKGCHNDVARMRRCLVERFGFDESGIRVLVDDGGSGPQPTGANIRRELQRLVGDAGPGDLLFFHYSGHGTRLPAETGQDDDTGYDECIVPCDMNLITDQDFTELVRKVPEGCLFTIVSDSCHSGGLLDKTKEQIGHSTKQNQAERSDSGSGSSGFRSFLKGAVRDAFESQGIHLPRRRGHRQSDDGDDGDEEPRYIDTADAHVKNRSLPLSTLIEMLKEKTGKDDIDVGSLRLTLFDLFGDDASPKIKKFMKVMLSKLQQGQHGGVVGFMGALAQELLKAKLDGKQEQLEAAAMEQEVQSEQEVYAGTTARVPSNGVLISGCQTDQTSADATTSKGSYGALSNAIQAILAEHGTVTNMELVTKARKMLSRQGYTQQPGLYCSDEHASVAFIC

SEQ ID NO: 5852 - protein, 411 aa, Panicum virgatum
MGEKRAVLVGINYPGTKAELKGCHNDVARMRRCLVERFGFDESGIRVLVDDGGSGPQPTGANIRRELQRLVGDAGTGDLLFFHYSGHGTRLPAETGQDDDTGYDECIVPCDMNLITDQDFTELVRKVPEGCLFTIVSDSCHSGGLLDKTKEQIGHSTKQNQAERSDSGSGSSGFRSFLKGAVRDAFESQGIHLPRRRGHRQSDDGDDGDEEPRYIDTADAHVKNRSLPLSTLIEMLKEKTGKDDIDVGSLRLTLFDLFGDDASPKIKKFMKVMLSKLQQGQHGGVVGFMGALAQELLKAKLDGKQEQLEAAAMEQEVQSEQEVYAGTTARVPSNGILISGCQTDQTSADATTSKGSYGALSNAIQAILAEHGTVTNMELVTKASKMLSRQGYTQQPGLYCSDEHASVAFIC

SEQ ID NO: 5853 - protein, 354 aa, Saccharum officinarum
MPHLVRERLYFGDIKDAIAALTESSPTPDFTHVLSVVSSASISFITDCRPGLAIPTEEVRRVVAGEEGAPPAAAVPPGTLMRVVERAGHGLRVTRMAVPLRDTEEEDLLDRLEPCLDFIDEGRKVGNVLVHCFAGVSRSASIIVAYLMRSEQKSLEDALEALKEISESACPNDGFLDQLKLFEEMGFKVDTSSPLYKRFRLKLLGQSYKFGEKIGSYMFEDDPGLAPQSGSCQDSSKVEQRKTAYRCRKCRRVIAVEDNVVSHVPGEGESCFDWNRRKSGHPYNNKEQDCSSLFVEPLKWMTAVEDSALEGKLPCIHCGARLGYFNWAGIQCNCGSWVTPALQIVKSKVDISTI

SEQ ID NO: 5854 - protein, 354 aa, Setaria italica
MPHLVRERLYFGDIKDAIAALTDSSSTPTFTHVLSVVSSASISFITDCRPGLAIPTEEVRRVVAGEEGAPPTAAVPPGTLMRVVERAGEGLRVTRMAVPLRDTEEENLLDHLEPCLDFIDDGRKVGNVLVHCFAGVSRSASIIVAYLMRSEQKPLEEALESLKEISELACPNDGFLDQLKLFEEMGFKVDTSSPLYKRFRLKLLGQSYKFGEKIGSYMFEDDPGLSPLPGSCQDPSKTGQHKTAYRCRKCRRIIAVEDNVISHLPGEGESCFDWNRRKSGHSYSNKEQDCSSLFIEPLKWMTPVEEGALEGKLSCIHCGARLGYFNWSGIQCNCGSWVTPAFQIVKSKVDISTI

SEQ ID NO: 5855 - protein, 325 aa, Sorghum bicolor
MPHLVRERLYFGDIKDAIAALTESSPTPHFTHVLSVVSSASISFITDCRPGPSIPTEEVRRVVAGEKGAPPTAAVAPGTLMRVVERAGQGLRVTRMAVPLRDTEEEDLLDRLEPCLDFIDEGRKVGNVLVHCFAGVSRSASIIVAYLMRSEQKSLEDALEALKEISESACPNDGFLDQLKLFEEMGFKVDTSSPLYKKFRLKVLDSSKVEQRKTAYRCRKCRRVIAVEDNVVSHVPGEGESCFDWNRRKSGHPYNNKEQDCSSLFVEPLKWMTPVEDGALEGKLSCIHCGARLGYFNWAGIQCNCGSWVTPAFQIVKSKVDISTI

SEQ ID NO: 5856 - protein, 356 aa, Oryza sativa
MPHLVRERLFFGDINDAIAALTTTAADTGGFTHLLSVVSSASISFITDCRPGLSIPTEEVRRVVAGEEGAPPVSAVAPGRLLRVVERAGVGLRVTRMAVPLRDTEEENLLDHLEPCLDFIDEGRKEGNVLVHCFAGVSRSATIIVAYLMRTEQKSLEEALESLKEVNESACPNDGFLEQLKLFEEMGFKVDTSSPLYKRFRLKLLGQSYKIGEKIGSYVFEDDPGLSGQPNSSTQDLPNKQTQQTAYRCKKCRRIVAVQGNVVSHTPGEGESCFQWQNKRKGERSYSKEQDCSSLFVEPLKWMTPVEDGALEGKLSCIHCGARLGYFNWSGIQCNCGSWITPAFQISKSKVDISTT

SEQ ID NO: 5857 - protein, 93 aa, Triticum aestivum
LSRTAAAAVVALRSAVRSAPLTGRVLGAPLPSFASPSAARSARILRRSAAAASAGLETLMPLHSAVAAARLRSCIAVDSSCWCSLSQGLNKRI

SEQ ID NO: 5858 - protein, 96 aa, Zea mays
MAYLSRTAAAVAVAVRSAVRSAPLTGRVLGAPLPSLASPSAARSARILRRTAAAASAGLETLMPLHSAVAAARLRSCIAVDSSCWSSLSQGLNKRI

SEQ ID NO: 5859 - protein, 96 aa, Sorghum bicolor
MASLSRTAAAAAAAVRSAVRSAPLTGRVLGAPLPSLASTSAARSARILRRSAAAASAGLETLLPLHSAVAAARLRSCIAVDSTCWSSLSQGLNKRI

SEQ ID NO: 5860 - protein, 97 aa, Setaria italica
MASLVRTAAAAAAVVVRSAARASPLTGRVLGAPLPSLASTSAARSARILRRSAAAASAGLETLMPLHSAVAAARLRSCIAVDSSCWSSLSQGLNKRI

SEQ ID NO: 5861 - protein, 95 aa, Panicum virgatum
MASLARAAAAVRSAALSAPLTGRVLGAPLPSLASPSAAARSARILRRSAAAASAGLETLMPLHSAVAAARLRSCIAVDSSCWSSLSQGKPCSSCY

SEQ ID NO: 5862 - protein, 374 aa, Setaria italica
MELGSHHLAAHSCSYTTTYTHCSIGFSPRVRTAGWIRAAADGGDGGADRRRRGASLAADGPRVVEVTAATVASGAAGEAGTGSAGFGARDAELAMWDKLGAVVRLSYGIGIYGAMALTGRFICQMAGIDCTGGFHPSLTALVEGLGYAAPPIMALLFILDDEVVKYSPHARAIRDVEDEELRSFFFGMSPWQFMLIVTASSIGEELFYRAAIQGALADIFLRSTELMKDARGIASLSGIVPPLVPFAQTFAAVITAALTGSLYYIATAPKDPTYVVTPAMRSRSGRDNLKKLFAAWYERRQMRKIYSPLLEGILAFYLGFEWIQTDNILAPMITHGIYSAVVLGHGLWKIHDHRRRLRQRIQQVRSQGKSSDSL

SEQ ID NO: 5863 - protein, 198 aa, Panicum virgatum
MELGSHHHLAARSCSYTATYTHCSIGFSPLVRAGRIRAAAEGGDGGSDRRRRGASLAADGPRVVEVTATPVAAGAAGSAGFRARDAELAMWDKLGAVVRLSYGIGIYGAMALTGRFICQMAGIDCTGGFHPSLTALVQGLGYAAPPIMALLFILDDEVVKYSPHARAIRDVEDEELRSFFYGMEPWQFMLVVTASSIW

SEQ ID NO: 5864 - protein, 364 aa, Panicum virgatum
MELGSRHLAASSCSYTTTYTHCSVGFHPLVRAGRIRAAAEGGDRRRRGASLAADGPRVVEVTAAPVAGGAAGSAGFGARDAELAMWDKLGAVVRLSYGIGIYGVMALTGRFICQMAGIDCTGGFHPSLTALVQGLGYAAPPIMAQLFILDDEVVKYSPHARAIRDVEDEELRSFFYGMEPWQFMLIVTASSIGEELFYRAAIQGALADIFLRSTELMKDARGIASLSGIVPPLVPFAQTFAAVITAALTGSLYYIATAPKDPTYVVTPAMRSRSGRENLKKLFAAWYERRQMRKIYSPLLEGILAFYLGFEWIQTDNILAPMITHGIYSAVVLGHGLWKIHDHRRRLRQRIQQVRSQGKSSDTL

SEQ ID NO: 5865 - protein, 353 aa, Sorghum bicolor
MELGSAVSAHRCSSYYTATYTHCSIGFSPRVRATSCWIRAAAEGDDGGADRRRRGASFGDDRPKVVEVTAELAMWDKLGAVVRLSYGIGIYGAMALTGRFICQMAGIDCTGGFHPSLTALVEGLGYAAPPIMALLFILDDEVVKYSPHARAIRDVEDEELRSFFYGMSPWQFILIVAASSIGEELFYRAAIQGALADIFLRSTELMKDARGIASLSGIVPPLVPFAQTFAAVITAALTGTLYYIATAPKDPTYVVTPAMRSRTGRENLKKLFAAWYERRQMRKIYSPLLEGILAFYLGFEWIQTDNILAPMITHGIYSTVVLGHGLWKIHDHRRRLRQRIQQVRSQESSSDTL

SEQ ID NO: 5866 - protein, 380 aa, Oryza sativa
MELAPFAAASSSSSSSTVTNTCKLRLRLSYTHCSIGFAPRVRRWIRAAAEGRGGDQRRSGRLAADGPRVVEVAAPPAAPVVTGGGGGGGGFAARDAELAMWERLGAVVRLSYGIGIYAAMALTGRFICQMAGIDCTGGFHPSLSALVEGLGYAAPPIMALLFILDDEVVKYSPHARAIRDVEDEELRSFFYGMSPWQFILIVTASSIGEELFYRVAVQGALADIFLRGTELMKDARGIASLSGMVPPFVPFAQTFAAAITAALTGSLYYVATAPKDPTYVVTPAMRSNTGRENLKKLFAAWYERRQMRKIYSPLLEGILAFYLGFEWIQTDNILAPMITHGIYSTVVLCHGLWKIHDHRRRLRQRIQEIRQEGTTNSDTL

SEQ ID NO: 5867 - protein, 616 aa, Sorghum bicolor
MAAAAAAATSLLLRHNRNPHLLLLRAAISSSRALPQQPELSPDPTAGAPDPAPLPPNPSTGSPFYSQNWRNPAAANPPSSLLPTVLAGGAFGAEHRMAAFYDTPNAAGLKETFAKYMAEQRWEDIKHLFDHWVRSLDATTGKPNHPDVDLFNHYLRANLMSGALPHEMLDLADHMREFELEPNTASYNLVLKSMVAGQESEGAEKLIERMLQTGTFPDDESYNLVVGLLIRQNLVDSSLKYLDLILKSGYTLSLTVYTDYIRACMRSGRLDTLTSIIEKCKTTDKNKVLCPQWALCIDIAEAAFEANNSKLALFALEFLAKWIARGENVKPPVQLSVNEGLVISALSAAGRTFSTDLLNAAWSLLRKSLRQKRAPTPETYLAKIYAHSSIGQLQRAFGTLREFENAYGNSEDIDLELFSPFTSLHPLVVACCKDGFTTLDSVYVQLENLSRADPPYKSVSALNCVILGCANIWDINRAYETFVAIKEKFELTPDIHSYNALLCAFGKLKQTGEACNVFQHVLTLGVKPNSTTYSLLVDAHLANKDPKAALAIIDEMVDAGFTPSKDTLRKVRRRCSRESDFDSDEKVQSLAKQFNYRLGGENRREMLYSIEYNPVY

SEQ ID NO: 5868 - protein, 618 aa, Zea mays
MAAVAAATSHLLRHHRNPHLLLLRAAISSSRALPQQPELSPDPTAGTPDLAGAAPLPPNPSTGSPFYTQNWRNPAAANPPSSLLPTVVAGSPFGAQHFMAAFYDAPDVTGLKETFAKYMAEQRWEDMKHLFDHWVRSLDAATGKPNHPDVDLFNHYLRANLMTRALPHEMLDLADHMLEFELQPNAASYNLVLKSMVASQETEGAEKLIERMLQTGTFPDDESYNLVVGLLIRQNLVDSSLKYLDLMLKSGYTLSLTVFTDYIRACMRSGRLDTLTSIIEKCKTTDKNKVLCPEWTWCIDIADAAFEANNSKLALFALEYLARWIARGENVKPPVQLSVNEGLVISALSAAGRTYNTDLLNAAWSLLRKSLRQKRAPTPETYLAKIYAHSSIGQLQRAFGTLREFENAYGNSEDIDLELFSPFTSLHPLVVACCKDGFSTLDSVYGQLENLIHADPPYKSLAALNCVVLGCANIWDINRAYETFVAIKEKFDLTPDIHSYNALLCAFGKLKQTGEACNVFQHVLTLGVKPNATTYSLLVDAHLANKDPKAALAIIDEMVDAGFTPSKDTLRKVRRRCSRESDFDSDEKVQSLAKQFNYRMGGENRREMLYSIEYNPVY

SEQ ID NO: 5869 - protein, 83 aa, Saccharum officinarum
MVAGQESEGAEKLIERMLQTGTFPDDESYNLVVGLLIRQNLVDSSLKYLDLILKSGYTLSLTVYTDYIRACMRSGRWTRWHQL

SEQ ID NO: 5870 - protein, 244 aa, Sorghum bicolor
MSLSLLQGYSSAEEDDDPAAGTELSESGDSSAEEAGSDGDEGSAPQKPAPKPRRRPNPKGGDAGGGDGDSSLPSALEAFADVSGPPDFLRHRVAEPEEGTEALGVLDRRGKEGSKHPPPGAVVVAKPQLVAIRERVTTTGANPSGSVTSGSVDGKRIIGAANPGPEDAADLLRMCLQCGVPKTYSHGKGMVCPQCGDRPVQTKEPEKKKGSTVKDKEKIKRMRGQSSHASWKSETEMALRQQFD

SEQ ID NO: 5871 - protein, 248 aa, Panicum virgatum
MSLTLLQGYSSAEEDDDPTAGAGAGAELSESGDSSTEEAGSDGDEASAPPKPASKPRRRPNPKGGDAGVGEGNASLPSALEAFADVSGPPEFLRHRVAEPEEGTEALGVLDRRGKEGSKHPPPGAVVVAKPQLVAIRERVTTTSSNPPGSVTSGSVDGKRIIGAANPGPEDAADLLRMCLQCGVPKTYSHGKGMVCPVCGDRPAQTKEPEKKKGSTVKDKEKIKRMRGQSSHASWKSETEMALRQQFD

SEQ ID NO: 5872 - protein, 248 aa, Panicum virgatum
MSLTLLQGYSSAEEDDDPTAGAGAGAELSESGDSSTEEAGSDGDEASAPPKPASKPRRRPNPKGGDAAVGEGNSSLPSTLEAFADVSGPPEFLRHRVAEPEEGTEALGVLDRRGKEGSKHPPPGAVVVAKPQLVAIRERVTTTSSNPPGSVTSGSVDGKRIIGAANPGPEDAADLLRMCLQCGVPKTYSHGKGMVCPVCGDRPAQTKEPEKKKGSTVKDKEKIKRMRGQSSHASWKSETEMALRQQFD

SEQ ID NO: 5873 - protein, 248 aa, Panicum virgatum
MSLTLLQGCYSAEEDDDPTAGAGAGAELSESGDSSTEEAGSDGDEASAPPKPASKPRRRPNPKGGDAAGGEGNSSLPSTLEAFADVSGPPEFLRHRVAEPEEGTEALGVLDRRGKEGSKHPPPGAVVVAKPQLVAIRERDTTISSNPPGSVTSGSVDGKRIIGAANPGPEDAADLLRMCLQCGVPKTYSHGKGMVCPVCGDRPAQTKEPEKKKGSTVKDKEKIKRMRGQSSHASWKSETEMALRQQFD

SEQ ID NO: 5874 - protein, 246 aa, Setaria italica
MSLALLQGYSSAEEDDDHAAGAGAELSESGESSAEEAGSDGDEASAPPKPASRPRRRPNPKGGDAGGGEGDSSLPSALEAFADVSGPPEFLRHRVAEPEEGTEALGVLDRRGKEGSKHPPPGAVVVAQPQLVAIRERVTTTSSNPPGSVTSGSVDGKRVIGAANPGPEDAADLLRMCLQCGVPKTYSHAKGMVCPLCGDRPAQPKEPEKKKGSTVKDKEKIKRMKGQSSHASWKSETEMALRQQFD

SEQ ID NO: 5875 - protein, 246 aa, Pennisetum glaucum
MSLSLLQGYSSAEEEDDHAAGAGAELSDSGESSAEEAGSDGDEASAPPKPVSRPRRRPNPKGGDGGGGEGDSSLPSALEAFADVSGPPDFLRHRVADPEEGTEALGVLDRRGKEGSKHPPPGAVVVAQPQLVAIRERVTTTSSNPPGSVMAGSVDGKRVIGAANPGPEDAADLLRMCLQCGVPKTYSHAKGMVCPLCGDRPAQPKEPEKKKGSTVKDKEKVKRMRGQSSHASWKSETEMALRQQFD

SEQ ID NO: 5876 - protein, 241 aa, Cenchrus ciliaris
  misc_feature (214)..(214): Xaa can be any naturally occurring amino acid
LLQGYSSAEEDDHAAGAGAELSESGESSAEEAGSDGDEASAPPKPASRPRRRPNPKGGDAAGGEGDSSLPSALEAFADVSGPPEFLRHRVAEPEEGTEALGVLDRRGKEGSKHPPPGAVVVAQPQLVAIRERVTTTSSNPPGSVTAGSVDGKRVIGAANPGPEDAADLLRMCLQCGVPKTYSHSKGMVCPLCGDRPAQPKEPEKKKGSTVKDKXKVKRMRGQSSHASWKSETEMALRQQFD

SEQ ID NO: 5877 - protein, 245 aa, Cynodon dactylon
MSLALLEGYSSAEDDEPAAGAGPELSESGDSSAEEAGADGDEASAPPKPASKPRRRRPNPRGADAGGGEDSSLPSALEAFADVSGPPDFLRHRVAEPEEATEALGVLDRRTKEGRKHPPPGSVVVAKPQLVAIREQVTTNGANPSGSVTSSSVDGKRIIGAANPGPEDAADLLRMCPQCGVPKTYSHARGMVCPQCSDRPAETKEPEKKKGSTVKDKEKIKRMRGQSSHASWKSETEMALRQQFD

SEQ ID NO: 5878 - protein, 340 aa, Setaria italica
MLLTKPHLSNPLAPSAPPPNPATSSSHARPLAAPTARRGRLRISATSAAAPAATAAAAALSRVDVLSEALPFIQRFKGKTVVVKYGGAAMKSPELQASVIRDLVLLSCVGLRPVLVHGGGPEINSWLLRVGVEPQFRDGLRVTDALTMEVVEMVLVGKVNKNLVSLINLEGGTAVGLCGKDARLITARPSPNAAALGFVGEVARVDATVLHPIIASGHIPVIATVAADETGQAYNINADTAAGEIAAAVGAEKLLLLTDVPGILADRNDPGSLVKEIDIAGVRQMVADGKVAGGMIPKVECCVRALAQGVHTASIIDGRVPHSLLLEILTDEGTGTMITG

SEQ ID NO: 5879 - protein, 337 aa, Brachypodium distachyon
MLLTKPHLSSSLLASTALSNRTSSRNRVEPNAASPSSRRRLRISATSTAVSPAATALSRVDVLSEALPFIQRFKGKTVVVKYGGAAMKSPELQSSVIRDLVLLSCVGLRPILVHGGGPEINSWLLRVGVEPQFRNGLRVTDALTMEVVEMVLVGKVNKNLVSLINLAGGTAVGLCGKDARLITARPSLNAAALGFVGEVARVDATVLHPIIASGHIPVIATVAADETGQAYNINADTAAGEIAAAVGAEKLLLLTDVSGILEDRNDPGSLVKEIDIAGVRQMVSDGKVAGGMIPKVECCVRALAQGVHTASIIDGRVPHSLLLEILTDEGTGTMITG

SEQ ID NO: 5880 - protein, 337 aa, Hordeum vulgare
MLLTKPQLSSSLLASTPLFTPASTPNHAKPIVASHAPGRRLRISATSTAVSPGATALSRVDVLSEALPFIQRFKGKTVVVKYGGAAMKSPELQSSVIRDLVLLSCVGLRPVLVHGGGPEINSWLLRVGVEPQFRNGLRVTDALTMEVVEMVLVGKVNKNLVSLINLAGGTAVGLCGKDARLITARPSPNAAALGFVGEVARVDASVLHPIIASGHIPVIATVAADETGQAYNINADTAAGEIAAAVGAEKLLLLTDVSGILADRNDPGSLVKEIDIAGVRQMVSGGQVAGGMIPKVECCVRALAQGVHTASIIDGRVPHSLLLEILTDEGTGTMITG

SEQ ID NO: 5881 - protein, 337 aa, Secale cereale
MLPTKPQLSSSLLASTPLFNPTSNPNQARPIAASPSPRRRLRISTASTAVSPGATALSRVDVLSEALPFIQRFKGKTVVVKYGGAAMKSPELQSSVIRDLVLLSCVGLRPILVHGGGPEINSWLLRVGVEPQFRNGLRVTDALTMEVVEMVLVGKVNKNLVSLINLAGGTAVGLCGKDARLITARPSPNAAALGFVGEVARVDATVLHPIIASGHIPVIATVAADETGQAYNINADTAAGEIAAAVGAEKLLLLTDVSGILADRNDPGSLVKEIDISGVRQMVSDGQVAGGMIPKVECCVRALAQGVHTASIIDGRVPHSLLLEILTDEGTGTMITG

SEQ ID NO: 5882 - protein, 327 aa, Panicum virgatum
MLLTKPQVSNPLLPSAPSSNPAPSSSHARPLAARAARRGRLRVSAGLSRVDVLSEALPFIQRFKGKTVVVKYGGAAMKTPELQASVIRDLVLLSCVGLRPVLVHGGGPDINSWLLRVGVEPQFRDGLRVTDALTMEVVEMVLVGKVNKNLVSLINLEGGTAVGLCGKDACLITARPSPNAAALGFVGEVARVDATVLHPIVASGHIPVIATVAADETGQAYNINADTAAGEIAAAVGAEKLLLLTDVSGILADRNDPGSLVKEIDIAGVRQMVADGKVAGGMIPKVECCVRALAQGVHTASIIDGRVPHSLLLEILTDEGTGTMITG

SEQ ID NO: 5883 - protein, 327 aa, Panicum virgatum
MLLTKPQLSNPLLPSAPPSNPAPSSSHARPLSAPAARRGRLRVSAGPSRVDVLSEALPFIQRFKGKTVVVKYGGAAMKSPGLQENVIRDLVLLSSVGIRLVLVHGGGPEINSWLLRVGVEPQFRDGLRVTDALTMEVVEMVLVGKVNKNLVSLINLAKGTAVGLCGKDARLITARPSPNAAALGFVGEVASVDATVLHPIIASGHIPVIATVAADETGQAYNINADTAAGEIAAAVGAEKLLLLTDVSGILADRNDPGSLVKEIDIAGVRRMVADGKVAGGMIPKVECCVRALAQGVRTASIIDGRVEHSLLLEILTDQGTGTMITG

SEQ ID NO: 5884 - protein, 339 aa, Triticum aestivum
MLLTKPHPGLTLPSASLPNPTLNAARVRPLASSAAHGRRGRRVSASSSPAPAQAASAALRRVDVLSEALPFIQRFKGKTVVVKYGGAAMKSPELQASVIRDLVLLSCVGLRPVLVHGGGPEINSWLQRVGVEPQFRNGLRVTDALTMEVVEMVLVGKVNKQLVSLISLAGATAVGLCGKDARLLTARPSPDAAALGFVGEVTRVDPSVLHPIIASGHIPVIATVAADETGQAYNINADTAAGEIAAAIGAEKLLLITDVSGILADRDDPGSLVKEIDIAGVRRMVAEGKVGGGMIPKVECCVRALAQGVHTASIIDGRVPHSLLLEILTDEGTGTMITG

SEQ ID NO: 5885 - protein, 344 aa, Hordeum vulgare
MLLTKPHPARILPSAFLPNPNLNAARASTLASPAPHGRRGLGVSASSLAPAGPASASHPTSAALNRVDVLSEALPFIQRFKGKTVVVKYGGAAMKSPELQASVIRDLVLLSCVGLRPVLVHGGGPEINSWLQRVGVEPQFRNGLRVTDALTMEVVEMVLVGKVNKQLVSLISLAGATAVGLCGKDARLLTARPSPDAAALGFVGEVTRVDPSVLHPIIASGHIPVIATVAADETGQAYNINADTAAGEIAAAIGAEKLLLITDVSGILADRDDPGSLVKEIDIAGVRRMVAEGKVGGGMIPKVECCVRALAQGVHTASIIDGRVPHSLLLEILTDEGTGTMITG

SEQ ID NO: 5886 - protein, 300 aa, Triticum aestivum
RRRLRISAASTAVSPGATALSRVDVLSEALPFIQRFKGKTVVVKYGGAAMKSPELQSSVIRDLVLLSCVGLRPILVHGGGPEINSWLLRVGVEPQFRNGLRVTDALTMEVVEMVLVGKVNKNLVSLINLAGGTAVGLCGKDARLITARPSPNAAALGFVGEVARVDATVLHPIIASGHIPVIATVAADETGQAYNINADTAAGEIAAAVGAEKLLLLTDVSGILADRNDPGSLVKEIDISGVRQMVSDGQVAGGMIPKVECCVRALAQGVHTASIIDGRVPHSLLLEILTDEGTGTMITG

SEQ ID NO: 5887 - protein, 334 aa, Setaria italica
MLLTKPHSSSLAAPSAALPKHGPTANRVVTPLASSSSRRGLRVSAASVAAAAALSRVDVLSEALPFIQRFKGKTVVVKYGGAAMKSPELQASVIRDLVLLSCVGLRPVLVHGGGPEINSWLARVGVEPQFRNGLRVTDAITMEVVEMVLVGKVNKQLVSLISLAGATAVGLCGKDARLLTARPSRDAASLGFVGEVTRVDPSVLHPIIAAGHIPVIATVAADEAGQAYNINADTAAGEIAAAIGAEKLLLLTDVSGVLADRDDPGSLVREVDVAWVRQMVAEGKVGGGMIPKVECCVHAIAQGVRTASIIDGRVPHSLLLEILTDEGTGTMITG

SEQ ID NO: 5888 - protein, 347 aa, Panicum virgatum
MLLTKPHPSSLAAPSPSAALPKPGPTANRVATPLPSSSSRRRGSLRVSAASVAAAQPTPASPAAAALSRVDVLSEALPFIQRFKGKTVVVKYGGAAMKSPELQASVIRDLVLLSCVGLRPVLVHGGGPEINSWLARVGVEPQFRNGLRVTDAVTMEVVEMVLVGKVNKQLVSLISLAGATAVGLCGKDARLLTARPSRDAASLGFVGEVTRVDPSVLHPIIASGHIPVIATVAADEAGQAYNINADTAAGEIAAAIGAEKLLLLTDVSGILADRDDPGSLVREVDAAGVRRMIAEGKVGGGMIPKVECCVRAIAQGVRTASIIDGRVPHSLLLEILTDEGTGTMITG

SEQ ID NO: 5889 - protein, 350 aa, Brachypodium distachyon
MFLAKPQPSVLLPSVSLPNPNLNAAGRITPLPSSARSHRRHGLRVSCSSSLATAARPASTAPAHPAAAALNRVDVLSEALPFIQRFKGKTVVVKYGGAAMKSPELQASVIRDLVLLSCVGLRPVLVHGGGPEINSWLERVGVKPQFRNGLRVTDALTMEVVEMVLVGKVNKQLVSLISLAGATAVGLCGKDARLLTARPSPDAAALGFVGEVTRVDPAVLRPIIASGHIPVIATVAADETGQAYNINADTAAGEIAAAIGAEKLLLITDVSGILADRDDPGSLVKEIDIAGVRRMVDEGKVGGGMIPKVECCVRALAQGVRTASIIDGRVPHSLLLEILTDEGTGTMITG

SEQ ID NO: 5890 - protein, 347 aa, Panicum virgatum
  misc_feature (37)..(37): Xaa can be any naturally occurring amino acid
  misc_feature (87)..(87): Xaa can be any naturally occurring amino acid
  misc_feature (257)..(257): Xaa can be any naturally occurring amino acid
  misc_feature (291)..(291): Xaa can be any naturally occurring amino acid
  misc_feature (309)..(309): Xaa can be any naturally occurring amino acid
MLLTKPHPSSLAAPSPSAALPKPGPTANRVATPLPSXSSRRRGSLRVSAASVAAAQPTPASPAAAALSRVDVLSEALPFIQRFKGKXVVVKYGGAAMKSPELQASVIRDLVLLSCVGLRPVLVHGGGPEINSWLARVGVEPQFRNGLRVTDAVTMEVVEMVLVGKVNKQLVSLISLAGATAVGLCGKDARLLTARPSRDAASLGFVGEVTRVDPSVLHPIIASGHIPVIATVAADEAGQAYNINADTAAGEIAAAIXAEKLLLLTDVSGILADRDDPGSLVREVDAAGVRXMIAEGKVGGGMIPKVECXVRAIAQGVRTASIIDGRVPHSLLLEILTDEGTGTMITG

SEQ ID NO: 5891 - protein, 345 aa, Sorghum bicolor
MLLTNPHPSLAAAAAASTPTPKHGLNANRVAALTPSASHRSGGLRVSAASVAAAQPTPASPVAALSRVDVLSEALPFIQRFKGKTVVVKYGGAAMKSAELQASVIRDLVLLSCVGLRPVLVHGGGPEINSWLARVGVEPQFRNGLRVTDAVTMEVVEMVLVGKVNKQLVSLISLAGATAVGLCGKDARLLTARPSPDAASLGFVGEVTRVDPAVLHPIIASGHIPVIATVAADEAGQAYNINADTAAGEIAAAVGAEKLLLLTDVSGILADRDDPGSLVREVDVAGVRRMVAEGKVGGGMIPKVECCVRAIAQGVRTASIIDGRVPHSLLLEILTDEGTGTMITG

SEQ ID NO: 5892 - protein, 543 aa, Sorghum bicolor
MWTAAGGRGSSAAAAVLRVLLIATACGLVFALLHLPLPDGGARPAGPGEERRGVGGGGGARLSAQQGRIREARRLSVVTEEIEGQTDEVAAEEDERISKSPPDTKEKIWMMQDQLIMAKAYLHFASPQGSVHFVRELRLRIKEIERAISHSSGGTRVPGSVLQKMKAMELTLSKAQRIYPRCCQMTAKLRAMVHNSEELVRAHQSESSFLEQVAVRTLSKGHHCLAMQLTAEYFSLDPSKREFPKRESIQLDGYYHYAIFSDNVLASAVVVNSTIAASKDPGRIILHIVTDALNYPAMMMWFLRNPPTPAAIQVKSLDDLKWLPGDFSSRFKLKGVRDPRYTSALNHLRFYLPEVFPSLGKVVLLDHDVVVQNDLTGLWDLDMKGKVIGAVETCTSSEGYHRLDSLVDFSNPSIFDKVDPKACAFAFGMNIFDLNEWRKQDLTTTYHKWFQLGKIQKLWKPGSLPLGQLTFYNRTLPLDHRWHVFGLGHDFSIGRNELESASVIHYSGKLKPWLEISIPKYRDYWNRYLNYDNPHLQQCNIHG

SEQ ID NO: 5893 - protein, 546 aa, Setaria italica
MRAAAGGRESASSSSAGVALRALLIATACGLVFALLNLPDGRAGSTAAPGGERGAGGGGGAGVRLSVEQGLIREARRLNTVAEEIDGQTDEIAAEEDERISKSPPDTKEKIWMMQDQLIMAKAYLHFASPQGSAHLVRELKLRIKEIERAISRSSGGSHVPGSALQKMKAMEQTLSKAQRTYPRCSQMTSKLRAMTHHSEELVRAHQSESSFLEQVAVRTLPKGHHCLAMQLTTEYFSLDPKEREFPKRESRQLDDYYHYAIFSDNVLASAVVVNSTIAASKDPRRIMLHIVTDALNYPAMMMWFLTNPPTPAAIQVESLKDFKWLPDDFSSRFKLKGVRDPRYTSALNHLRFYLPEVFPSLSKILLLDHDVVVQKDLSGLWDIDMKGKVIAAVETCTSGEAYHRLDSLVDFSNPSVFNKFDAKACIFAFGMNIFDLNEWRKQGLSATYHKWFQVGKKRKLWKAGSLPLGQLVFYNQTLPLDRRWHVLELGHDSTIGTDELESGSVIHYSGKLKPWLEISIPKYRDYWNRHLNYENPYLQQCNIHG

SEQ ID NO: 5894 - protein, 543 aa, Panicum virgatum
MRAASGGREPSSSSAAVVALRALLIATACGLVFALLNLPDGRAGSAPPGGERGAGAGGGARLSVEQGLIREARRLNTIAEEIDGQSDESAAEEDERISKSPPDTKEKIWMMQDQLIMAKAYLHFASPQGSAHLVRELKSRIKEIERAISHSSGGSHIPGSALQKMKAMEQTLSKAQRTYPRCSQMTSKLRAMAHNSEELVRAHRSESSFLEQVAVRTLPKGHHCLAMRLTTEYFSLDPKERQFPKRDSRQLDGYYHYAIFSDNVLASAVVVNSTIAQSKDPGRIMLHIVTDALNCPAMMMWFLTNPPTPAAVEVESLDDFKWLPGDFSSRFKLKGVRDPRYTSALNHLRFYLPEVFPSLSKVLLLDHDVVIQTDLSELWGIDMKGKVIGAVETCSSGEGYHRLDNLVDFSNPTIVNKFDAKACIFAFGMNIFDLNEWRKQGLTATYHTWFQVGKRQRLWKAGSLPLGQLVFYNQTLPLDRRWHVLGLGHDFSIGRDELENAYVIHYSGKFKPWLEISIPKYRDNWNRHLNYDNAYLQQCNIHG

SEQ ID NO: 5895 - protein, 625 aa, Panicum virgatum
EKSKERDFQKPRTGNRPVPSRPRAPPPPRFPAARPPLLPRPHCQGHASAGPTIPVPSSEPNPLPPPTPPALPHWCVPAAVGGAAAELELGAAMRAAVALRALLIATACGLVFALLNLPLPDGRAGSTPPGGERGAGGGGGPRLSVVEQGLIREARRLNTVAEERDGQSDESAAEEDERISKSPPDTKEKIWMMQDQLIMAKAYLHFASPQGSAHLVRELKLRIKEIERAISHSSGGSHIPGSALQKMKAMEQTLSKAQRTYPRCSQMTSKLRAMTHNSEELVRAHQSESSFLEQVAVRTLPKGHHCLAMRLTTEYFSLDPKEREFPKRDSRQLDGYYHYAIFSDNVLASAVVVNSTITASKDPGRIMLHIVTDALNYPAMMMWFLTNPPTPAAIEVESLDDFKWLPGDFSSRFKLKGVRDPRYTSALNHLRFYLPEVFPSLSKVLLLDHDVVVQKDLSELWGIDMKGKVIGAVETCTSGEGYHRLDSLVDFSNPTIVNKFDAKACIFAFGMNIFDLNEWRKQGLTATYHKWFQVGKRLRLWKAGSQPLGQLVFYNQTLPLNRRWHVLGLGHDFSIGRDELESAYVIHYSGKFKPWLEISIPKYRDNWNRHLNYDNAYLQQCNIHG

SEQ ID NO: 5896 - protein, 365 aa, Sorghum bicolor
MVCCFMCGTGMKQNTENEGGSKVKIFSYHEMRKATHDFSRANKIGEGGFGSVFRGKLKDGTIVAVKVLSASSRQGIREFVTELTAISDIVHENLITLVGCCAEGSHRILVYNYIENNSLSYTLLGSGRSNIRFNWRARVKIAVGVARGLAYLHEEIRPPIIHRDIKASNILLDKDLTPKISDFGLARLLPPNATHVSTRVAGTIGYLAPEYAVRGQVTKKSDIYSFGVVLLEIVTGRCNHNSRLPQGDQFLLERIWTYYEQRKLEEIIDAEVGEDLNVEEACRFLKVGLLCTQDAMKLRPNMANIVLMLIGEKEVSMDRVTKPAVIGDPYLNGNNDQRTADSTTLRSFATTEPLTSSEANTEWSL

SEQ ID NO: 5897 - protein, 367 aa, Setaria italica
MSCCFMCGTDMKQKVDGEGGNKVKVFSYSEMRKATHSFSGANKIGEGGFGSVFRGRLKDGTIVAVKVLSADSRQGIKEFVTELTAISDIVHENLITLVGCCAEGSHRILVYNYLENNSLAYTLLGSGRSNIRFNWRARVKIAVGVARGLAYLHEEIRPPIIHRDIKASNILLEKDLTPRISDFGLARLLPPNATHVSTGVAGTIGYLAPEYAVRGQVTKKSDIYSFGVLLLEIVTGRCNHNARLPKGDQFLLERTWTYYEQGKLEEIIDIDIGDDLDVEEACRFLKVGLLCTQDAMKLRPNMTNIVHMLTGEKGVSMDRVKKPAVIGDLDLNGNNEQRPTDADSTTMRSFATTEPLTSSEANTETSL

SEQ ID NO: 5898 - protein, 367 aa, Panicum virgatum
MACCFMCGTDMKQKVEGEGGNKVKVFSYSEMRKATHGFSGANKIGEGGFGSVFRGRLKDGTIVAIKVLSADSRQGFREFINELAAISDIVHENLITLVGCCAEGSHRILVYNYLENNSLACTLLGSGRSNIRFNWKARVKIAVGVACGLAYLHEEIRPPIIHRDIKASNILLDKDLTPKISDFGLARLLPPNATHVSTRVAGTIGYLAPEYAVRGQVTKKSDIYSFGVLLLEIVSGRCNHNARLPQGDQFLLERTWTHYEQGKLEEIIDIDVGDDLDVEEACRFLKIGLLCTQDAMKVRPNMTSIIHMLTGEKSVNMDRVTKPAVIGDSDLNGNNELRPTDPDSTTMRSFATTEPLTSSEVNTETSL

SEQ ID NO: 5899 - protein, 371 aa, Sorghum bicolor
MSLCSKLLALLRKSRALTTTSTAAAAAATASATASANGMEEAVAAAGPLRTRVCIIGSGPAAHTAAVYAARAELKPVLFEGWLANDIAAGGQLTTTTDVENFPGFPDGVLGAELMDRCRAQSLRFGTKILTETVTSVDFSARPFRVASDDTVVHADSVVVATGAVARRLHFAGSDAFWNRGISACAVCDGAAPIFRNKPIAVIGGGDSAMEEANFLTKYGSQVYIIHRRNAFRASKIMQARALSNPKIKVVWDSEVVEAYGGGEGGPLAGVKVKNVVTGEVSDLQVAGLFFAIGHEPATKFLGGQLELDSDGYVVTKPGSTHTSVKGVFAAGDVQDKKYRQAITAAGSGCMAALDAEHYLQEVGAQEGKTD

SEQ ID NO: 5900 - protein, 366 aa, Panicum virgatum
MTLCSKLLALLRKSRALTTTAAAAAAATASATANGMEEAAAGPLRTRVCIIGSGPAAHTAAVYAARAELKPVLFEGWLANDIAAGGQLTTTTDVENFPGFPEGILGAELMDRCRAQSARFGTKILTETVTSVDFSARPFRVASDDTVVHADAVVVATGAVARRLHFAGSDAFWNRGISACAVCDGAAPIFRNKPIAVVGGGDSAMEEANFLTKYGSRVYIIHRRNAFRASKIMQARALSNPKIQVVWDSEVVEAYSGAEGGPLAGVKVKNVVSGQVSDLQVAGLFFAIGHEPATKFLGGQLELDSDGYVVTKPGSTHTSVKGVFAAGDVQDKKYRQAITAAGSGCMAALDAEHYLQEVGAQEGKTD

SEQ ID NO: 5901 - protein, 368 aa, Oryza sativa
MRLCSKLAALLRRSRQFAPAAAAASGSATAAAASANGMEEAAAGPLRARVCIIGSGPAAHTAAVYAARAELKPVLFEGFLANDIAAGGQLTTTTDVENFPGFPDGILGADLMDRCRAQSVRFGTRILTETVTAVDLSSRPFRVASGDTVVHADAVVVATGAVARRLHFAGSDAFWNRGISACAVCDGAAPIFRNKPIAVVGGGDSAMEEANFLTKYGSRVYIIHRRNAFRASKIMQARALSNPKIQVVWDSEVVEAYGGADGGPLAGVKVKNVVSGEVSDLQVAGLFFAIGHEPATKFLGGQLELDSDGYVVTKPGSTHTSVKGVFAAGDVQDKKYRQAITAAGSGCMAALDAEHYLQEIGAQEDKTD

SEQ ID NO: 5902 - protein, 369 aa, Triticum aestivum
MRLCSKLAALLRRSRPFAAATAAASVSATATAAAAANGMEEAAAGPLRTRVCIIGSGPAAHTAAVYAARAELKPVLFEGWLANDIAAGGQLTTTTDVENFPGFPDGILGIDLMDRCRAQSVRFGTKIFSETVTSVDFSSRPFRVSSDDTVVHADSVVVATGAVARRLHFAGSDAFWNRGISACAVCDGAAPIFRNKPIAVVGGGDSAMEEANFLTKYGSRVYIIHRRDAFRASKIMQARALSNPKIQVVWDSEVVEAYGGSDGGPLGGVKVKNLVTGEVSDFQVAGLFFAIGHEPATKFLAGQLELDSEGYVATKPGSTHTSVKGVFAAGDVQDKKYRQAITAAGSGCMAALDAEHYLQEVGAQEGKTD

SEQ ID NO: 5903 - protein, 370 aa, Brachypodium distachyon
MRFCSKLAALLRRSRPLAATAAAATATGTATAATAAAGGMEEAAAGPLRTHVCIIGSGPAAHTAAVYAARAELKPMLFEGWLANDIAAGGQLTTTTDVENFPGFPDGILGIDLMDRCRAQSVRFGTKIFTETVTSVDLSSRPFRVASDDTVVHADTVVVATGAVARRLHFTGSDAFWNRGISACAVCDGAAPIFRNKPIAVVGGGDSAMEEANFLTKYGSRVYIIHRRDTFRASKIMQARALSNPKIQVVWDSEVVEAYGGADNSPLTGVKVKNLVTGEVSELQVAGLFFAIGHEPATKFLGGQLELDAEGYVVTKPGSTHTSVNGVFAAGDVQDKKYRQAITAAGSGCMAALDAEHYLQEVGAQEGKTD

SEQ ID NO: 5904 - protein, 257 aa, Secale cereale
MDRCRAQSVRFGTKIFSETVTSVDFSSRPFRVASDDTVVHADSVVVATGAVARRLHFAGSDTFWNRGISACAVCDGAAPIFRNKPIAVVGGGDSAMEEANFLTKYGSRVYIIHRRDAFRASKIMQARALSNPKIQVVWDSEVVEAYGGSDGGPLAGVKVKNLVSGEVSDVQVAGLFFAIGHEPATKFLAGQLELDSEGYVATKPGSTHTSVKGVFAAGDVQDKKYRQAITAAGSGCMAALDAEHYLQEVGAQEGKTD

SEQ ID NO: 5905 - protein, 352 aa, Saccharum officinarum
MSICSKLLALLRKSRALTTTSTAAAAAATASATASANGMEEAVAAAGPLRTRVCIIGSGPAAHTAAVYAARAELKPVLFEGWLANDIAAGGQLTTTTDVENFPGFPDGILGAELMDRCRAQSLRFGTKILTETVTSVDFSARPFRVASDDTVVHADSVVVATGAVARRLHFAGSDAFWNRGISACAVCDGAAPIFRNKPIAVVGGGDSAMEEANFLTKYGSQVYIIHRRNAFRASKIMQARALSNPKIKVVWDSEVVEAYGGAEGGPLAGVKVKNVVTGEVSDLQVAGLFFAIGHEPATKSLGGQLELDTDGYVVTKPGFTHTTVEGVFAAGDVLAQDALGPNIGFWVALLC

SEQ ID NO: 5906 - protein, 366 aa, Panicum virgatum
MTLCSKLLALLRKSRALTTTAAAAAAATASATANGMEEAAAGPLRTRVCIIGSGPAAHTAAVYAARAELRPVLFEGWLANDIAAGGQLTTTTDVENFPGFPEGILGAELMDRCRAQSARFGTKILTETVTSVDFSARPFRVASHDTVVHADAVVVATGAVARRLHFAGSDAFWNKGISACAVCDGAAPIFRNKPIAVVGGGDSAMEEANFLTKYGSRVYIIHRRNAFRASKIMQARALSNPKIQVVWDSEVVEAYGGAEGSPLAGVKVKNVVSGEVSNLQVAGLFFAIGHEPATKFLGGQLDLDSDGYVVTKPGSTHTSVKGVFAAGDVQDKKYRQAITAAGSGIVSSSLTVVLLLLFFIIASANS

SEQ ID NO: 5907 - protein, 331 aa, Saccharum officinarum
MEGSAAAPLRTRVCIIGSGPAAHTAAIYAARAELKPVLFEGWMANDIAAGGQLTTTTDVENFPGFPNGIMGADLMDNCRAQSLRFGTNILSETVTAVDFSASPFRVTADSTTVLADAVIVATGAVARRLHFPGSDAYWNRGISACAVCDGAAPIFRNKPIAVIGGGDSAMEEANFLTKYGSHVYIIHRRNTFRASKIMQARALENPKIKVVWDSEVVEAYGGADGGPLAGVKVKNLLNGEVSDLQVAGLFFAIGHEPATKFLGGQLELDSDGYVATKPGSTHTSVKGVFAAGDVQDKKYRQAITAAGSGCMAALDAEHYLQEIGAQEEKSD

SEQ ID NO: 5908 - protein, 325 aa, Hordeum vulgare
GPLRTRVCIIGSGPAAHTAAVYAARAELKPVLFEGWLANDIAAGGQLTTTTDVENFPGFPDGILGIDLMDRCRAQSVRFGTKIFSETVTSVDFSSRPFRVASDDTVVHADSVVVATGAVARRLHFAGSDAFWNRGISACAVCDGAAPIFRNKPIAVVGGGDSAMEEANFLTKYGSRVYIIHRRDAFRASKIMQARALSNPKIQVVWDSEVVEAYGGSDGGPLAGVKVKNLVSGEVSDVQVAGLFFAIGHEPATKFLAGQLELDSEGYVATKPGSTHTSVKGVFAAGDVQDKKYRQAITAAGSGCMAALDAEHYLQEVGAQEGKTD

SEQ ID NO: 5909 - protein, 325 aa, Leymus cinereus x Leymus triticoides
  misc_feature (243)..(243): Xaa can be any naturally occurring amino acid
GPLRTRVCIIGSGPAAHTAAVYAARAELKPVLFEGWLANDIAAGGQLTTTTDVENFPGFPDGILGIDLMDRCRAQSVRFGTKIFSETVTSVDFSSRPFRVASDDTVVHADSVVVATGAVARRLHFAGSDAFWNRGISACAVCDGAAPIFRNKPIAVVGGGDSAMEEANFLTKYGSRVYIIHRRDAFRASKIMQARALSNPKIQVVWDSEVVEAYGGSDGAPLAGVKVKNLVSGEVSDFQVAGXFFAIGHEPATKFLAGQLELDSDGYVATKPGSTHTSVKGVFAAGDVQDKKYRQAITAAGSGCMAALDAEHYLQEVGAQEGKTD

SEQ ID NO: 5910 - protein, 331 aa, Secale cereale
MEGSAAAPLRTRVCIIGSGPAAHTAAIYAARAELKPVLFEGWMANDIAAGGQLTTTTDVENFPGFPTGIMGIDLMDNCRAQSVRFGTNILSETVTDVDFSARPFRVVSDATTVLADTVVVATGAVARRLHFAGSDTYWNRGISACAVCDGAAPIFRNKPIAVIGGGDSAMEEGNFLTKYGSQVYIIHRRNTFRASKIMQARALSNPKIQVVWDSEVVEAYGGAGGGPLAGVKVKNLVTGEVSDLQVSGLFFAIGHEPATKFLNGQLELHADGYVATKPGSTHTSVEGVFAAGDVQDKKYRQAITAAGSGCMAALDAEHYLQEVGAQEGKSD

SEQ ID NO: 5911 - protein, 331 aa, Zea mays
MEGSAAAPLRTRICIIGSGPAAHTAAIYAARAELKPVLFEGWMANDIAAGGQLTTTTDVENFPGFPNGIMGADLMDNCRAQSLRFGTNILSETVTAVDFSACPFRVSADSTTVLADAVIVATGAVARRLHFPGSDAYWNRGISACAVCDGAAPIFRNKPIAVIGGGDSAMEESNFLTKYGSHVYIIHRRNTFRASKIMQARALENPKIKVLWDSEVVEAYGGANGGPLAGVKVKNLLNGEVSDLQVSGLFFAIGHEPATKFLGGQLELDSDGYVETKPGSTHTSVKGVFAAGDVQDKKYRQAITAAGSGCMAALDAEHYLQEIGAQEGKSD

SEQ ID NO: 5912 - protein, 331 aa, Brachypodium distachyon
MDGSAAAPLRTRVCIIGSGPAAHTAAIYAARAELKPVLFEGWMANDIAAGGQLTTTTDVENFPGFPQGIMGADLMESCRAQSLRFGTNILTETVTAVDFSARPFRVVSDSTTVLADAVVVATGAVARRLHFPGSDTYWNRGISACAVCDGAAPIFRNKPIAVIGGGDSAMEEGNFLTKYGSKVHIIHRRNTFRASKIMQARALSNPKIQVVWDSEVVEAYGGAGGGPLAGVKVKNLVTGEISDLPVSGLFFAIGHEPATKFLNGQLGLHADGYVATKPGSTHTSVEGVFAAGDVQDKKYRQAITAAGSGCMAALDAEHYLQEVGAQEGKSD

SEQ ID NO: 5913 - protein, 332 aa, Triticum aestivum
MEGSAVPAPLRTRVCIIGSGPAAHTAAIYAARAELKPVLFEGWMANDIAAGGQLTTTTDVENFPGFPTGIMGIDLMDNCRAQSARFGTNILSETVTEVDFSARPFRVTSDSTTVLADTVVVATGAVARRLHFPGSDTYWNRGISACAVCDGAAPIFRNKPIAVIGGGDSAMEEGNFLTKYGSQVYIIHRRNTFRASKIMQARALSNPKIQVVWDSEVVEAYGGAGGGPLAGVKVKNLVTGEVSDLKVSGLFFAIGHEPATKFLNGQLELHADGYVATKPGSTHTSVEGVFAAGDVQDKKYRQAITAAGSGCMAALDAEHYLQEVGAQEGKSD

SEQ ID NO: 5914 - protein, 331 aa, Sorghum bicolor
MEGSAAAPLRTRVCIIGSGPAAHTAAIYAARAELKPVLFEGWMANDIAAGGQLTTTTDVENFPGFPNGIMGADLMDNCRAQSLRFGTNILSETVTAVDFSARPFRVTADSTTVLADAVIVATGAVARRLHFPGSDAYWNRGISACAVCDGAAPIFRNKPIAVVGGGDSAMEEANFLTKYGSHVYIIHRRNTFRASKIMQARALENPKIKVVWDSEVVEAYGGADGGPLAGVKVKNLLNGEVSDLQVAGLFFAIGHEPATKFLGGQLELDSDGYVATKPGSTHTSVKGVFAAGDVQDKKYRQAITAAGSGCMAALDAEHYLQEIGAQEGKSD

SEQ ID NO: 5915 - protein, 331 aa, Panicum virgatum
MDGSAAAPLRTRVCIIGSGPAAHTAAIYAARAELNPVLFEGWMANDIAAGGQLTTTTDVENFPGFPDGIMGADLMERCRAQSLHFGTNILSETVTAVDFSARPFRVASDSTTVLADAVVVATGAVARRLHFPGSDTYWNRGISACAVCDGAAPIFRNKPIAVIGGGDSAMEEANFLTKYGSHVYIIHRRNTFRASKIMQARALENPKIQVIWDSEVVEAYGGEGGGPLASVKVKNLVSGDISDLQVAGLFFAIGHEPATKFLGGQLELDSDGYVATKPGSTHTSVKGVFAAGDVQDKKYRQAITAAGSGCMAALDAEHYLQEIGAQEGKSD

SEQ ID NO: 5916 - protein, 331 aa, Panicum virgatum
MDGSAAAPLRTRVCIIGSGPAAHTAAIYAARAELKPVLFEGWMANDIAAGGQLTTTTDVENFPGFPDGIMGADLMDRCRAQSLRFGTNILSETVTAVDFSARPFRVASDSTTVLADAVVVATGAVARRLHFPGSDTYWNRGISACAVCDGAAPIFRNKPIAVIGGGDSAMEEANFLTKYGSHVYIIHRRNTFRASKIMQARALENPKIQVVWDSEVVEAYGGEGGGPLAGVKVKNLVSGDVSDLQVGGLFFAIGHEPATKFLGGQLELDSDGYVATKPGSTHTSVKGVFAAGDVQDKKYRQAITAAGSGCMAALDAEHYLQEVGAQEGKSD

SEQ ID NO: 5917 - protein, 331 aa, Setaria italica
MEGSAAAPLRTRVCIIGSGPAAHTAAIYAARAELKPVLFEGWMANDIAAGGQLTTTTDVENFPGFPDGIMGADLMDRCRAQSARFGTNILSETVTAVDFAARPFRVASDSTTVLADAVVVATGAVARRLHFPGSDTYWNRGISACAVCDGAAPIFRNKPIAVIGGGDSAMEEANFLTKYGSHVYIIHRRNTFRASKIMQARALENPKIQVIWDSEVVEAYGGAGGGPLAGVKVKNLVSGEVSDLQVSGLFFAIGHEPATKFLGGQLELDSDGYVATKPGSTHTSVKGVFAAGDVQDKKYRQAITAAGSGCMAALDAEHYLQEVGAQEGKSD

SEQ ID NO: 5918 - protein, 331 aa, Oryza sativa
MEGSAGAPLRTRVCIIGSGPSAHTAAIYAARAELKPVLFEGWLANDIAAGGQLTTTTDVENFPGFPEGILGGELMDRCRAQSLRFGTSIISETVTAVDFSARPFRVASDSTTVLADAVVVATGAVARRLHFAGSDAYWNRGISACAVCDGAAPIFRNKPIAVIGGGDSAMEESNFLTKYGSHVYIIHRRNTFRASKIMQARALSNPKIQVFWDSEVVEAYGGEGGGPLAGVKVKNLVTGKISDLQVSGLFFAIGHEPATKFLGGQLELDADGYVATKPGSTHTSVKGVFAAGDVQDKKYRQAITAAGSGCMAALDAEHYLQEVGAQEGKAD

SEQ ID NO: 5919 - protein, 184 aa, Saccharum officinarum
MDPTGGDGDSAAARGSAGGGGTGAGRWAVGAVCGGLVYYHCAVRRASAVSLAADVLLVLLCSLSILGLLFRHLHISVPVDPLEWQISQEMANSIVASLANTIGAAESVLRVAATGHDKKLFFKVVFTLYFLAALGRVVSGAAVAYAALCIFCLYMFAQSTDLFDQLPSWVPVGRDSLGGSQDTA

SEQ ID NO: 5920 - protein, 186 aa, Sorghum bicolor
MDPTGGDVVVDSAAARGSGGGGGTGAGRWAVGAVCGGLVYYHCAVRRASAVSLAADVLLVLLCSLSILGLLFRHLHISVPVDPLEWQISQEMANSIVASLANTIGAAESVLRVAATGHDKKLFFKVVFTLYFLAALGRVVSGAAVAYAALCIFCLYMFAQSTDLFDQLPSWVPVGRDSLGGTQDTA

SEQ ID NO: 5921 - protein, 271 aa, Setaria italica
MTRVREHPPSYPHLFSARSFATNHQLHGGRSGWGCCFLGRIRGPLGSFRGSVRRSAPRPSLRGHPAMTWTHSRTSPLSSGHDTTPGWTPRAAAAATATPRRRGGAEGEPGLGGGLWVRFAGGWCTYHCAVRRASAVSLAADVLLVLLCSLSILGLLFRHLHISVPVDPLEWQISQEMANSIVASLANTIGAAESVLRVAATGHDKKLFFKVVFTLYFLAALGRVVSGAAVAYAALCIFCLYMFAQSTDLFDQLPSWVPMGRDSLGGAQDTA

SEQ ID NO: 5922 - protein, 182 aa, Oryza sativa
MEATGGGDAAAEGRRGEGGGGAARWAVGAVCGGLVYYHCAVRRASAVSLAADVLLVLLCSLSILGLLFRHLHISVPVDPLEWQISQEMANSIVASLANTIGAAESVLRVAATGHDKKLFFKVVFTLYFLAALGRVVSGAAVAYAALCIFCLYMFAQSTDLFDQLPSWVPVGRDSLGGSQDTT

SEQ ID NO: 5923 - protein, 189 aa, Panicum virgatum
MDPTGGGGAGGGGDPAAGRGSGGGGGAEAGRWAVGAVHGGLVYYHSAVRRASAVSLAADVLLVLLCSLSILGLLFRHLQISVPVDPLEWQISQEMANSIVASLANTIGAAESVLRVAATGHDKKLFFKVVFTLYFLAALGRVVSGAAVAYAALCIFCLYMFAQSTDLFDQLPSWGPVGRDSLGNAQDTA

SEQ ID NO: 5924 - protein, 179 aa, Pennisetum glaucum
SSLFYLQTDSGLRRAGTGAGRWAVGAVCGGLVYYHCAVRRASAVSLAADVLLVLLCSLSILGLLFRHLHISVPVDPLEWQISQEMANSIVASLANTIGAAESVLRVAATGHDKKLFFKVVFTLYFLAALGRIVSGAAVAYAALCIFCLYMFAQSTDLFDQLPSWVPVGRDSLGGAQDTA

SEQ ID NO: 5925 - protein, 159 aa, Panicum virgatum
RWAVVAVCGGLVYYHCAVRRASAVSLAADVLLVLLCSLSILGLLFRHLHISVPVDPLEWQISQEMANSIVASLANTIGAAESVLRVAATGHDKKLFFKVVFTLYFLAALGRVVSGAAVAYAALCIFCLYMFAQSTDLFDQLPSWVPVGRDSLGSAQDTT

SEQ ID NO: 5926 - protein, 165 aa, Pseudoroegneria spicata
  misc_feature (161)..(161): Xaa can be any naturally occurring amino acid
MGAGGSWRWAVGAVCGGLIYYHCAVRRASAVSLAADVLLVLLCSLSILGLLFRHLHISVPVDPLEWQISQEMANSIVASLANTIGAAESVLRVAATGHDKKLLFKVVFTLYFLAALGRVVSGAAVAYAALCIFSLYMFAQSTDQFDQLPWVPIGRDSLGGXQDTT

SEQ ID NO: 5927 - protein, 165 aa, Secale cereale
MGAGGSWRWAVGAVCGGLVYYHCAVRRASAVSLAADVLLVLLCSLSILGLLFRHLHISVPVDPLEWQISQEMANSIVASLANTIGAAESVLRVAATGHDKKLLFKVVLTLYFLAALGRVVSGAAIAYAALCIFSLYMFAQSTDQFDQLPWVPSGRDSLGGAQDTT

SEQ ID NO: 5928 - protein, 164 aa, Secale cereale
GAGGSWRWAVGAVCGGLVYYHCAVRRASAVSLAADVLLVLLCSLSILGLLFRHLHISVPVDPLEWQISQEMANSIVASLANTIGAAESVLRVAATGHDKKLLFKVVLTLYFLAALGRVVSGAAIAYAALCIFSLYMFAQSTDQFDQLPWVPSGRDSLGGAQDTT

SEQ ID NO: 5929 - protein, 165 aa, Triticum aestivum
MGAGGSWRWAVGAVCGGLVYYHCAVRRASAVSLAADVLLVLLCSLSILGLLFRHLHISVPVDPLEWQISQEMANSIVASLANTIGAAESVLRVAATGHDKKLLFKVVFTLYFLAALGRVVSGAAIAYAALCIFSLYMFAQSTDQFDQLPWVPLGRDSLGGAQDTT

SEQ ID NO: 5930 - protein, 193 aa, Brachypodium distachyon
MEATAGGSAGLGLIDGDGDGDDAASSSRGAGSSGCWAVGAVCGGLVYYHCAVRRASAVSLAADVLLVLLCSLSILGLLFRHLHITVPVDPLEWQISQEMANSIVASLANTIGAAESVLRVAATGHDKKLLLKVVFTLYFLAALGRVVSGAAVAYAALCIFCLYMFVQSTDLFDQLPSWVPVGRDSLGGAQDTT

SEQ ID NO: 5931 - protein, 503 aa, Sorghum bicolor
MAASSLLRSLTRRGCAGPSAFAYRYHQQQPWSPFSTTAAGAAAAGTRDEAAKRFPGLGPTAKGEKARVVVLGTGWAGSRLMKDLDTHGYDMVCVAPRNHMVFTPLLASTCVGTLEFRSVAEPIARIQPAVSKSPGSYFLLARCTGVDPDSHTIDCETVTDGEKDSLEPWKFKVAYDKLVFACGAEASTFGIHGVTDHAIFLREVHHAQEIRRRLLLNLMLSDVPGISEEEKRRLLHCVVVGGGPTGVEFSGELSDFIIRDVKQRYSHVKDYIHVTLIEANEILSSFDVRLRQYAIKQLIKSGVRLVQGIVKDVQPSKIILDNGEEVPYGLLVWSTGVGASPFVKSLPFPKSPGGRIGVNEWLRVPSVQDVYAIGDCSGFLESTGKEVLPALAQVAERQGKYLASLLNHVMKAGGGHANSVTEADLGPPFVYKHLGSMATVGRYKALVDLRKSKESRGISLAGFVSWFIWRSAYLTRVISWRNRFYVAINWLTTLLFGRDISRI

SEQ ID NO: 5932 - protein, 495 aa, Setaria italica
MAASSLLRSLTRHARGASAYRHLPWSPFSTTTAAAAGARDEARKGFPGLGPTAKGEKARVVVLGTGWAGSRLMKDLDTSGYDVVCVAPRNHMVFTPLLASTCVGTLEFRSVAEPLARIQPAVSKSPGSYFFLARCTGVDPDAHTIDCETVTDGEKDTLEPWKFKVAYDKLVFASGAEASTFGIKGVTEHAIFLREVHHAQEIRRRLLLNLMLSDVPGLSEEEKRRLLHCVVVGGGPTGVEFSGELSDFIMRDVKQRYSHVKDYIHVTLIEANEILSSFDVRLRQYATNQLIKSGVRLVQGIVKDVQPNKLILDNGEEVPYGLLVWSTGVGASPFVKSLPFPKSPGGRIGVDEWLRVPSVRDVYAIGDCSGFHESTGKDVLPALAQVAERQGKYLANLLNHVMKAGGGHANSEVEADPGPPFVYKHLGSMATVGRYKALVDLRQSKESRGISLAGFVSFFIWRSAYLTRVVSWRNRFYVAINWLTTLLFGRDISRI

SEQ ID NO: 5933 - protein, 499 aa, Oryza sativa
MAASSLLRSLSRISRRGCVGGAGPSPFHHSRLPYSPFSTAAADAVERRGFAGLGPTAKGEKARVVVLGTGWAGSRLMKDIDTTGYEVVCVSPRNHMVFTPLLASTCVGTLEFRSVAEPLARIQPAVSKSPGSYFLLARCTAVDPDAHTIDCETVTEGEKDTLKPWKFKVAYDKLVFACGAEASTFGIRGVTDHAIFLREVHHAQEIRRKLLLNLMLSDVPGISEEEKRRLLHCVVVGGGPTGVEFSGELSDFIIRDVKQRYSHVKDYIHVTLIEANEILSSFDVRLRQYATNQLTKSGVRLVRGIVKDVQPNKLILDNGEEVPYGLLVWSTGVGPSSFVKSLPFPKSPGGRIGVDEWLRVPSARDVFAIGDCSGFLESTGKDVLPALAQVAERQGKYLAHLLNHVMKAGGGHANCEIDVDLGPAFVYKHLGSMATVGRYKALVDLRQSKESKGISLAGFVSWFIWRSAYLTRVVSWRNRFYVAINWLTTLLFGRDISRI

SEQ ID NO: 5934 - protein, 496 aa, Brachypodium distachyon
MAALLRSLSRTSGLRGCASSFYHRNPYSPFSAAAEAVARDAAVGRGLAGLGPTAKGEKPRVVVLGTGWAGSRLMKDLDTTGYDVVCVSPRNHMVFTPLLASTCVGTLEFRSVAEPLARIQPAVSNSPGSYFLLARCTGVDPDAHTIECETVTEGEKDTLKPWKFKVAYDKLVFGCGAEASTFGIHGVTEHATFLREVYHAQEIRRKLLLNLMLSDVPGISEEEKRRLLHCVVVGGGPTGVEFSGELSDFIIRDVKQRYSHVKDYVHVTLIEANEILSSFDVRLRQYAINQLVKSGVRLVRGIVKDVLPDKLILDNGEEVPYGLLVWSTGVGASSFVKSLPFPKSPGGRIGVDEWLRVPSAPDVFAIGDCSGFLESTGKEVLPALAQVAERQGKYLASLLNHVMKVGGGHANSVVEMDLGPKFVYKHMGSMATVGRYKALVDLRQSKDSRGVSIAGFASWFIWRSAYLTRVVSWRNRFYVAINWLTTLLFGRDISRI

SEQ ID NO: 5935 - protein, 501 aa, Triticum aestivum
MAASSLLRSLSRVSRRGCAPAFYGRGPLSPLSTAAAAAASDAGDAAVLRRGLAGLGPTAKGEKPRVVVLGTGWAGSRLMKDLDTTGYDVVCVSPRNHMVFTPLLASTCVGTLEFRSVAEPLARIQPAVSTSPGSYFLLARCTAVDPDAHTIDCETVTEGEKDTLKPWKFKVSYDKLVFGCGAEASTFGIRGVTEHATFLREVHDAQEIRRKLLLNLMLSDVPGISEGEKRRLLHCVVVGGGPTGVEFSGELSDFIIRDVKERYSHVKDYVHVTLIEANEILSSFDVRLRQYAINQLVKSGVRLVRGIVKDVQPDKLILDNGEEVPYGLLVWSTGVGASSFVKSLPFPKSHGGRIGVDEWLRVPSVPDVFAVGDCCGFLESTGKEVLPALAQVAERQGLYLARLLNRVMKAGGGHANSQVEADLGPKFVYKHLGSMATVGRYKALVDLRQSKDSKGISIAGFASWFIWRSAYLTRVVSWRNRLYVAINWLTTMIFGRDISRI

SEQ ID NO: 5936 - protein, 501 aa, Triticum aestivum
MAASSLLRSLSRVSRRGCAPAFYGRGPFSPLSTAAAAAAADAGDAAVLRRGLAGLGPTAKGEKPRVVVLGTGWAGSRLMKDLDTTGYDVVCVSPRNHMVFTPLLASTCVGTLEFRSVAEPLARIQPAVSRSPGSYFLLARCTAVDPDAHTIDCETVTEGEKDTLKPWKFKVSYDKLVFGCGAEASTFGIRGVTEHATFLREVHDAQEIRRKLLLNLMLSDVPGISEGEKRRLLHCVVVGGGPTGVEFSGELSDFIIRDVKERYSHVKDYVHVTLIEANEILSSFDVRLRQYAINQLVKSGVRLVRGIVKDVQPDKLILDNGEEVPYGLLVWSTGVGASSFVKSLPFPKSHGGRIGVDEWLRVPSVPDVFAVGDCCGFLESTGKEVLPALAQVAERQGLYLARLLNRVMKSGGGHANSQVEVDLGPKFVYKHLGSMATVGRYKALVDLRQSKDSKGISIAGFASWFIWRSAYLTRVVSWRNRLYVAINWLTTMIFGRDISRI

SEQ ID NO: 5937 - protein, 502 aa, Secale cereale
MAASSSLLRSLSRVSRRGCAPAFYGRSPFSPLSTAAAAAAADAGDAAALGRGLAGLGPTAKGEKARVVVLGTGWAGSRLMKDLDTGGYDVVCVSPRNHMVFTPLLASTCVGTLEFRSVAEPLARIQPAVSSSPGSYFLLARCTAVDTDAHTIDCETVTEGEKDTLKPWKFKVSYDKLVFGCGAEASTFGIRGVTEHATFLREVHHAQEIRRKLLLNLMLSDVPGISEDEKRRLLHCVVVGGGPTGVEFSGELSDFITRDVKERYSHVKDYVHVTLIEANEILSSFDVRLRQYAINQLVKSGVKLVRGIVKDVQPDKLILDNGEEVPYGLLVWSTGVGASSFVKSLPFPKSPGGRIGVDEWLRVPSVPDVFAVGDCCGFLESTGKEVLPALAQVAERQGLYLARLLNNVMKAGGGHANSQVEVDLGPKFVYKHLGSMATVGRYKALVDLRQSKDSKGISIAGFASWFIWRSAYLTRVVSWRNRLYVAINWLTTMIFGRDISRI

SEQ ID NO: 5938 - protein, 465 aa, Triticum aestivum
AAAADARDAAVLPRGLAGLGPTAKGEKARVVVLGTGWAGSRLMKDLDTTGYDVVCVSPRNHMVFTPLLASTCVGTLEFRSVAEPLARIQPAVSSSPGSYFLLARCTAVDPDAHTIECETVTEGEKDTLKPWKFKVSYDKLVFGCGAEASTFGIRGVTEHATFLREVHDAQEIRRKLLLNLMLSDVPGISEGEKRRLLHCVVVGGGPTGVEFSGELSDFITRDVKERYSHVKDYVHVTLIEANEILSSFDVRLRQYAVNQLVKSGVRLVRGIVKDVQPDKLILDNGEEVPYGLLVWSTGVGASSFVKSLPFPKSHGGRIGVDEWLRVPSVPDVFAIGDCCGFLESTGKEVLPALAQVAERQGLYLARLLNRVMKAGGGHANSQVEVDLGPKFVYKHLGSMATVGRYKALVDLRQSKDSKGISIAGFASWFIWRSAYLTRVVSWRNRLYVAINWLTTMIFGRDISRI

SEQ ID NO: 5939 - protein, 572 aa, Sorghum bicolor
MSEAVAEGESAVELLLRAAAMVPAERYALAAIIVAFVFLYRFLELHVIGDILRGFRGGRVELTFHPASEIYHRVASRCRLLHGRYLATPWLASPHLQTLFLGIHGMPPSFTYKRQLYTVCDGGTIALDWLLASDFEVADGFISEDASTPLVVVVPGLTSDSSAAYAKHLVYSMASKGWNVVVSNHRGLGGVSITSDCFYNGGWTEDVREVIKYLHHRYPKTPLFCIGTSIGANIVVKYLGEEGENTPVAGAVSICSPWDLLIGDRFISRKLVQRIYDKALAIGLKGYAKLHQPVLARLANWEGIRKSRSIREFDHHATCVIARYETVDTYYRRCSSASYVGNVSVPLLCISALDDPLCTREAIPWDECRANKNIVLATTPNGGHLAFFQGLTARRLWWVGATSEFLSALHDSSYMHRQKANDHVLHSSLESSIDKSPYVNLMEDGMVAAVTEDGPGNDGSPLNHAVDEEQLSNEVGGRRQNVVSALNHNEKASGVGNECPAAATKQQGDDVHSNKLHEIIAPVKRSINQLTRYQGRSVWLLAYIAFVTSWPLLGSLAFITFRKKFRNPLRAK

SEQ ID NO: 5940 - protein, 574 aa, Panicum virgatum
MSDSQAVAGGESPAELLLRAAAMVPAERYALAAVAVVSVFLYRFLELHVIGDALRGFRGGRVELTFHPASEIYHRVASKCRSLHGRYLATPWLASPHLQTLFLGISGRPPSFTYKRQLYTVHDGGTIALDWLLASDLEAADGFISKDDSTPLVVVVPGLTSDSAAAYVKHSVYSIASKGWNVVVSNHRGLGGVSITSDCFYNGGWTEDVREVIKYLHQRYPQTPLFCIGTSIGANIVVKYLGEEGENTPVAGAASICSPWDLLIGDRFISRKLVQRIYDKALAIGLKSYAKLHQPVLARLANWEGIRKSRSIREFDHHATCVVARYETVDTYYRQCSSASYVGNVSVPLLCINALDDPLCTREAIPWDECRANKNIVLATTPNGGHLAFFQGLTAGRLWWVGAASEFLFALHESSYMHRQKANDHVLHSSLESSIDKSPYVNIMEDGMVAPVTKDGPGNNDGSPSDHEVGVQLSNGVGGRQQLEVSGEKHNEQVSGAGNESPAGSANRQGDDIYSNKLHEIIAPVKRSINQLTRHQGRSIWLLAYIAFVTSWPLLGSLAFITFRKKFRNPLQAK

SEQ ID NO: 5941 - protein, 575 aa, Setaria italica
MSGSEAVAGGESAGELLLRAAAMVPAERYALAAAAVVSVFLYRFLELHVIGDILRGCRGGRVELTFHPASEIYHHVASKCRSLHGRYLATPWLASPHLQTLFLGISGRPPSFTYKRQLYTVRDGGTIALDWLLVSDLEDGDGFISENSSTPLVVVVPGLTSDSAAAYVKHLVYSIASKGWNVVVSNHRGLGGVSITSDCFYNGGWTEDVREVIKYLHHRYPKTPLFCVGTSIGANIVVKYLGEEGENTPVAGAAAICSPWDLLIGDRFISRKLVQRIYDKALAIGLKGYAKLHQPVLARLANWEGIKKSRSIREFDHHATCVVSRYETVDTYYRRCSSASYVGNVSVPLLCINALDDPLCTREAIPWDECRANKNIVLATTPNGGHLAFFQGLTARRLWWVGAASEFLFALHDSSYMHWQKANDHVLHSSLESSIDKSPYVNIMEDGMVAPVTKDGPGNNDGSPSKHEVDGVQLSNGVGGRQQLEVSGEKHDEHANGTGNDSTAGSANRQGEDVYNNKLHEIIAPVKRSINQLTRYQGRSVWLLAYIAFVTSWPLLGSLAFITFRKKFRNLLRAK

SEQ ID NO: 5942 - protein, 540 aa, Pennisetum glaucum
AAAAVVSVFLYRFLELHVIGDILRGCRGGRVELTFHPASEIYHRVASKCRSLHGRYLATPWLASPHLQTLFLGISGRPPSFTYKRQLYTVRDGGTVALDWLLASDTEDADGFISKDASTPLVVVVPGLTSDSAAAYVKHLVYSIASKGWNVVVSNHRGLGGVSITSDCFYNGGWTEDVREIIKYLHHRYPKTPLFCVGTSIGANIVVKYLGEEGESTPVAGAAAICSPWDLLIGDRFISRKLVQRIYDKALAIGLKGYAKLHQPVLARLANWEGIKKSRSIREFDHHATCVVASYETVDTYYRRCSSASYVGNVSVPLLCINALDDPLCTKEAIPWDECRANKNIVLATTPNGGHLAFFQGLTAGRLWWVGATSEFLFALHDSSYMHRQKANDHALHSSLESSIDRSPYVNVMEDGMVAPVTKDGPGNNDGPPSKQEVGVQLSNGVDGRQVSGEKQDEHANATGNKSTAGSANHQGDDIYRNKLHEIIAPVKRSINQLTRYQGRSVWLLAYIAFVTSWPLLGSLAFMTFRKKFRNPLRAK

SEQ ID NO: 5943 - protein, 450 aa, Setaria italica
QFPKGSSLALLSPISDSVHLSRHYASSPVPHPPARGHLHHILPLHLPRGLQNPTPEPHPRPAPPRPPLRRHGRQRRGGVCEGPPLPERRRGHHARPPQGPQRHELQMDVRYKALLDEWETNPSIKCILVESSSPRAFSAGMDIKGVAAEIQKDKSTPLVQKVFTAEYSLICKIHEYAKPYICLMDGVTMGFGIGLSGHGRYRIITEKTLLAMPENGIGLFPDVGFAYIGAKAPGAGAVGAYLGITGKRISSPADALFIGLGTHYVPSGNLGSLKESLLSANFTNDPHRDVESILTGYKKEPESEPQLEKLLPQIISSFGPDKSVAESVEELKKCSQSDDAAVAEWANEALAGIKKGAPFSLCLTQRHFSQVASAYGNSEHYLSKLAGVMKLEYRIALRSSVRNDFVEGVRAVLVDKDQNPKWNPATLEEVNMGEVESVFEPLGAEAELSV

SEQ ID NO: 5944 - protein, 380 aa, Sorghum bicolor
MAATAADEFVKGRVFPNGVAVITLDRPKALNAMNVEMDVRYKALLDEWEANPSVKCILVESSSSRAFSAGMDIKGVAAEIQKDKNTPLVQKVFTAEYSLICKIHEYAKPYICLMDGVTMGFGIGLSGHGRYRIITERTLLAMPENAIGLFPDVGFAYIGAKAPGGGAVGAYLGITGKRISSPADAMFIGLGTHYVPSANLGSLKESLLSANFTHDPHRDVESVLTGYKKEPESESQLEKLLPYIISSFSPDKSVAESVEELKKCSRSGDAAVAEWANEALAGIEKGAPFSLCLTQKHFSQVASAYRTSEHYLSKLAGVMKLEYRIALRSSVRNDFVEGVRAVLVDKDQNPKWNPATLEEVNMGEVESVFEPLGAEAELSV

SEQ ID NO: 5945 - protein, 380 aa, Saccharum officinarum
MAATAADEFVKGRVFPNGVAVITLDRPKALNAMNLEMDVRYKALLDEWETNPSVKCVLVESSSSRAFSAGMDIKGVAAEIQKDKNTPLVQKVFTAEYSLICKIHEYAKPYICLMDGVTMGFGIGLSGHGRYRIITERTLLAMPENAIGLFPDVGFAYIGAKAPGGGAVGAYLGITGKRISSPADAMFIGLGTHYVPSANLGSLKESLLSANFTNDPHRDVESVLTGYKKEPESEPQLEKLLPYIVSSFSPDKSVAGSVQELKKCSQSGDAAVAEWANEALAGIEKGAPFSLCLTQKHFSQVASAYGTSEHYLSKLAGVMKLEYRIALRSSVRNDFVEGVRAVLVDKDQNPKWNPATLEEVNMGEVEAVFEPLGAEAELSV

SEQ ID NO: 5946 - protein, 380 aa, Oryza sativa
MAAAAAEEFVKGRVTPNGVAVITLDRPKALNAMNLEMDLRYKAFLDEWETNPSVKCVLVESSSPRAFSAGMDIKGVAAEIQKDKSTPLVQKVFTAEYSLICKIHEYTKPYICLMDGVTMGFGIGLSGHGRYRIITERTLLAMPENGIGLFPDVGFAYIGAKAPGGGAVGSYLGMTGKRISSPADALFFGLGTHYVPSANLGPLRESLLSANFTDDPHRDVESLLTKFKNEPESGPQLDKFLPYIISSFGPDKSVAESVEELKKCSQSDDAAVAEWANEALAGLKKGAPFSLCLTQKHFSQVASAYRNNEHYLSKLAGVMKVEYRIALRSSVRNDFVEGVRAVLVDKDQNPKWKPATLEDVDKGEVESVFEPLAAEAELNV

SEQ ID NO: 5947 - protein, 380 aa, Brachypodium distachyon
MAGAAVEEFVKGRVFPNGVAVITLDRPKALNAMNLEMDLRYKALLDDWETNANVKCILVESSSPRAFSAGMDIKGVAAEIQKDKSTSLVEKVFTAEYSLICKIHEYVKPYICLMDGVTMGFGIGLSGHGRYRVITERTLLAMPENGIGLFPDVGFAYIGAKAPGGGAVGAYLGMTGKRISSPADALFIGLGTHYVPSGDLGSLKESLLSANLTADPHKDVETLLAGYKKEPETEPQLEKLLQHIISSFGPDKSAAESVEELKKCSQSGDAAVAEWANDALAGLKKGAPFSLCLTQKHFSQVASAYGNNGHGLSKLAGVMKMEYRIALRSSVRNDFVEGVRAVLVDKDQNPKWNPPTLEDVNTDEVESIFEPLAAEAELNV

SEQ ID NO: 5948 - protein, 380 aa, Avena sativa
MAAAAADEFVKGRVFPNGVAVITLDRPKALNAMNLEMDLRYKAFLDDWETNSNVKCILVESSSPRAFSAGMDIKGVAAEIQKDKSTSLVQKVFTAEYSLICKIHEYAKPYICLMDGVTMGFGIGLSGHGRYRIITERTLMAMPENAIGLFPDVGFAYIGAKAPGGGAVGAYLGMTGKRISSPADALFIGLGTHYVPSVDLGSLKESLLSAKFTADPHKDVESLLTGYKKEPESVSQLEKLLPNIVSSFGPDKSAAGSVEELKKCSQSGDTEVAEWANDALAGLKKGAPFSLCLTQKHFSRVASSYGHNENHLSKLAGVMKLEYRIALRSSVRDDFVEGVRAVLVDKDQNPKWNPPTLEDVNMDEVESVFEPLAAEAELNV

SEQ ID NO: 5949 - protein, 380 aa, Secale cereale
MAAVAAEEFVKGRVFPNGVAVITLDRPKALNAMNLEMDLRYKAFLDEWETNPNVKCILVESSSPRAFSAGMDIKGVAAEIQKDKSTSLVQKVFTAEYSLICKIHEYAKPYICLMDGVTMGFGIGLSGHGRYRIITERTLLAMPENGIGLFPDVGFAYIGAKAPGGGAVGAYLGMTGKRISSPADALFIGLGTHYVPSGDLGSLKESLLSANFTADPHKDVESLLTGYKKEPESVPQLEKLLPDIVSSFGPDKSATESVEELKKRSQSGDATVSEWANDALAGLKKGAPFSLCLTQKHFSRVASSYGNNENYLSKLAGVMKLEYRIALRSSVRSDFAEGVRAVLVDKDQNPKWSPATLEDVNMDEVESVFEPLAADAELNV

SEQ ID NO: 5950 - protein, 380 aa, Triticum aestivum
MAAAAAEEFVKGRVFPNGVAVITLDRPKALNAMNLEMDLRYKAFLDDWETNPNVKCILVESSSPRAFSAGMDIKGVAAEIQKDKSTSLVQKVFTAEYSLICKIHEYAKPYICLMDGVTMGFGIGLSGHGRYRIITERTLLAMPENGIGLFPDVGFAYIGAKAPGGGAVGAYLGMTGKRISSPADALFIGLGTHYVPSGDLGSLKESLLSANFTADPHKDVESLLTGYKKEPESVPQLEKLLPDIVSSFGPDKSATESVEELKKRSQSGDATVSEWANDALAGLKKGAPFSLCLTQKHFSRVASSYGNNENYLSKLAGVMKLEYRIALRSSVRSDFAEGVRAVLVDKDQNPKWSPATLEDVNMDEVESVFEPLAANAELNV

SEQ ID NO: 5951 - protein, 380 aa, Pennisetum glaucum
MAASAAEEFVKGRVFPNGVAVITLDRPKALNAMNLEMDVSYKALLDEWETNPGVKCILVESSTPRAFSAGMDIKGVAAEIQKDKSTPLVQKVFTAEYSLICKIHEYAKPYICLMDGVTMGFGIGLSGHGRYRVITEKTLLAMPENGIGLFPDVGFAYIGAKAPGGGAVGAYLGITGKRISSPADALFIGLGTHYVPSGNLGSLKESLLSANFTNDPHRDVESVLTRYKKEPESEPQLQKLLPQIISSFSPDKSVAESVEELKKCSQSDDVAVAEWANEALAGIKKGAPFSLCLTQRHFSQVASAYGSSEHYLSKLAGVMKLEYRIALRSSIRNDFVEGVRAVLVDKDQNPKWNPTTLEEVNMGEVESVFEPLGAEAELSV

SEQ ID NO: 5952 - protein, 380 aa, Panicum virgatum
MAAGAAEEFVKGRVFPNGVAVITLDRPKALNAMNLEMDIRYKALLDEWETNPSVKCILVESSSPRAFSAGMDIKGVAAEIQKDKNTPLVQKVFTAEYSLICKMHEYAKPYICLMDGVTMGFGIGLSGHGRYRIITEKTLLAMPENGIGLFPDVGFAYIGAKAPGGGAVGAYLGITGKRISSPADAIFIGLGTHYVPSGSLGSLKESLLSANFTNDPHRDVESVLTGYKKEPESEPQLEKFLPHIISSFSPDKSVAESVEELKKCSQSGDAAVAEWANEALAGIKKGAPFSLCLTQRHFSQVASAYRNSEHYLSKLAGVMKMEYRIALRSSVRNDFVEGVRAVLVDKDQNPKWNPASLEEVNMGEVESVFEPLGAEAELSV

SEQ ID NO: 5953 - protein, 380 aa, Panicum virgatum
MAAGAAEEFVKGRVFPNGVAVITLDRPKALNAMNLEMDIRYKALLDEWETNPSVKCILVESSSPRAFSAGMDIKGVAAEIQKDKNTPLVQKVFTAEYSLICKIHEYAKPYICLMDGVTMGFGIGLSGHGRYRIITEKTLLAMPENGIGLFPDVGFAYIGAKAPGGGAVGAYLGITGKRISSPADALFIGLGTHYVPSGNLGSLKESLLSANFTNDPHRDVESVLTGYKKAPESEPQLEKLLPHIISSFSPDKSVAESVEELKKRSQSGDAAVAEWANEALAGIKKGAPFSLCLTQRHFSQVASAYGNSEHYLAKLAGVMKMEYRIALRSSVRNDFVEGVRAVLVDKDQNPKWNPASLEEVNMDEVESVFEPLGAETELSV

SEQ ID NO: 5954 - protein, 380 aa, Cenchrus ciliaris
  misc_feature (271)..(271): Xaa can be any naturally occurring amino acid
MAATAAEEFVKGRVFPNGVAVITLDRPKALNAMNFEMDVRYKALLDEWETNPSVKCILVESSSPRAFSAGMDIKGVAAEIQKDKSTPLVQKVFTAEYSLICKIHEYAKPYICLMDGVTMGFGIGLSGHGCYRIITEKTLLAMPENGIGLFPDVGFAYIGAKAPGGGAVGAYLGITGKRISSPADALFIGLGTHYVPSGNLGSLKESLLSANFTNDPHRDVESVLTGYKKEPESEPHLEKLLPHIISSFSPDKSVAESVEELKKYSQSDDAXVAEWANEALAGIKKGAPFSLCLTQRHFSQVASAYGNSEHYLSKLAGVMKLEYRIALRSSVRNDFIEGVRAVLVDKDQNPKWNPATLEEVNMGEVESVFEPLGSEAELNV

SEQ ID NO: 5955 - protein, 380 aa, Hordeum vulgare
MAAAAAGEFVKGRVFPNGVAVITLDRPKALNAMNLEMDLRYKAFLDDWETNPNVKCILVESSSPRAFSAGMDIKGVAAEIQKDKSTTLVQKVFTAEYSLICKIHEYAKPYICLMDGVTMGFGIGLSGHGRYRVITERTLLAMPENGIGLFPDVGFAYIGAKAPGGGAVGAYLGMTGKRISSPADALFIGLGTHYVPSGDLGSLKESLLSANFTADPHKDVESLLTGYKKEPESVPHLEKLLPDIISSFGPGKSATESVEELKKRSQSGDGTVSEWANDALAGLKKGAPFSLCLTQKHFSRVASSYGNNENDLSKLAGVMKLEYRIALRSSVRSDFAEGVRAVLVDKDQNPKWNPATLEDVNMDEVESVFEPLAADAELNV

SEQ ID NO: 5956 - protein, 595 aa, Sorghum bicolor
MVEVGNRVRGFLHNRWLVFVAAMWMQSCAGVGYLFGSLSPGIKASLGYNQRQVAGLGVAKDLGDSVGFLAGTLCAVLPLWAALLVGAAQNLVGYGWVWLAVTRRVPVPPLWAMCILIFIGNNGETYFNTAALVSCVQNFPKSRGPIVGILKGFAGLSGAILTQIYAIVHSPDDAALIFMVAVGPTMVVIALMFIVRPVGGHRQVRPSDGTSFTFVYSVCLLLAAYLMGVMLLEDLVDLSQSVTVVLTIVLIIFLLVPIVIPVLLSFFSDDDETLYALLLPSPRKEEPSASTSSEEQQEVILSEVEDEKPRDVDLLPASERQKRIAELQTRLFQAAAVGAVRVKRRKGPRRGEDFTLMQALIKADFWLLFFSLLLGSGSGLTVIDNLGQMSQSLGYEETHIFVSMISIWNFLGRIGGGYFSEIIVKDYAYPRAIALAIAQVLMAIGHFNFAMAWPGTMYIGTLLVGVGYGAHWAIVPAAASELFGVKNFGALYNFLTVANPAGSLVFSGVIASGIYDAEAAKQAQQRHNSMLLAMSGRVVNIVSEAAPSLKCEGAICFFLSSLIMSGFCIIAFGLSLILVYRTKIVYTSLYGKPRT

SEQ ID NO: 5957 - protein, 595 aa, Setaria italica
MVEVGSRVRGFLRNRWLVFVAAMWMQSCAGVGYLFGSLSPVIKSSLGYNQRQVAGLGVAKDLGDSVGFLAGTLCAVLPLWAALLVGAAQNLVGYGWVWLAVTRRAPTPPLWAMCILIFIGNNGETYFNTAALVSCVQNFPKNRGPIVGILKGFAGLSGAILTQIYAMINSPDDAALIFMVAVGPTMVVIGLVFIVRPVGGHRQVRPSDGTSFTFVYSICLLLAAYLMGVMLLEDLVDLSQSMTVLLTIILIMFLLVPIVIPVLLSFFSDDDETLYALLLPSPRKEEASASTSSEEQEEVILSEVEDEKPKDVDLLPASERQKRIAELQARLVQAAAVGAVRVKRRRGPRRGEDFTLMQALIKADFWLLFFSLLLGSGSGLTVIDNLGQMSQSLGYEETHIFVSMISIWNFLGRIGGGYFSEIIVKDYAYPRAIALAIAQVLMAIGHFNFAMAWPGTMYIGTLLVGIGYGAHWAIVPAAASELFGVKNFGALYNFLTVANPAGSLVFSGIIASGIYDAEAAKQAQQRHNSTLLTMPARVVTMISEAAPALKCEGAICFFLSSLIMSGFCIIAVVLSLILVYRTKIVYTNLYGKPRT

SEQ ID NO: 5958 - protein, 596 aa, Zea mays
MVEIGSRVRGFLRNRWLVFVAAMWMQSCAGVGYLFGSLSPVIKASLGYNQRQVAGLGVAKDLGDSVGFLAGTLCSVLPLWAALLVGAAQNLVGYGWVWLAVTRRVPVPPLWAMCILIFIGNNGETYFNTAALVSCVQNFPKSRGPIVGILKGFAGLSGAILTQIYAIVHSPDDAALIFMVAVGPTMIVIALMFIVRPVGGHRQVRPSDNTSFTFVYSVCLLLAAYLMGVMLLEDLVDLSQSVTVLLTIVLIIFLLVPIVIPVLLSFFSDDDETLHALLLPSPRKEEPSASTSSEEQQEVILSEVEDEKPKDVDLLPASERQKRIAELQTRLFQAAADGAVRVKRRKGPRRGEDFTLMQALIKADFWLLFLSLLLGSGSGLTVIDNLGQMSQSLGYEETHIFVSMISIWNFLGRIGGGYFSEIIVKDYAYPRAIALGIAQILIAIGHFNFAMAWPGTMYVGTLLVGVGYGAHWAIVPAAASELFGVKNFGALYNFLTVANPAGSLVFSGVIASGIYDAEAAKQAQQRHSTSKLLATSGRVVSVVSEAAPALKCEGAICFFLSSLIMAGFCVVAFGLSLILVYRTKVVYAGLYGKPRT

SEQ ID NO: 5959 - protein, 595 aa, Oryza sativa
MVEVGGRVRGFVRNRWLVFVAAMWMQSFAGVGYLFGSISPVIKASLGYNQREVAGLGVAKDLGDSVGFLAGTLSAVLPLWAAVLVGAAQNLFGYGWVWLAVTHRAPVPPLWAMCILIFIGTNGETYFNTAALVSCVQNFPKSRGPIVGILKGFAGLSGAILTQMYAMIHSPDHAALIFMVAVGPTMVVIALMFIVRPVGGHRQVRPSDGTSFTFVYSVCLLLAAYLMGVMILGDLVDLSHTVMVLLTIILIVLLIVPIVIPVILSFFSDNDESAYASLLQSPGKEEASASTPSEEQTEVIFSEVEDEKPKEVDLLPASERQKRIAELQTKLFQAAAVGAVRVKRRKGPRRGEDFTLMQALIKADFWLLFFSLLLGSGSGLTVIDNLGQMSQSLGYEDSHIFVSMISIWNFLGRIGGGYFSELIVKDYAYPRAIALATAQVFMAFGHFSFAMAWPGAMYIGTLLVGLGYGAHWAIVPAAASELFGLKNFGALYNFLTVANPAGSLVFSGIIASGIYDSEAEKQAHQHHNSTLLAMPGRLLAMASDATQPLKCEGAICFFLSSLIMSGFCIVAAVLSLILIYRTKIVYANLYGNPRT

SEQ ID NO: 5960 - protein, 589 aa, Brachypodium distachyon
MVEAGSRVRGFLRNRWLVFVAAMWMQSFAGVGYLFGSLSPVIKSSLGYTQRQLAGLGVAKDLGDSVGFLAGTLCAVLPLWAALLVGAAQNLVGYGWVWLAVTRRVPVPPLWAMCILIFVGNNGETYFNTAALVSCVQNFPKNRGPIVGILKGFAGLSGAILTQIYAMVHSPDHAALIFMVAVGPTMVVIALMFIVRPVGGHRQVRPSDGISFTFVYSICLVLAAYLMGVMLLEDLVGLSHPLTVLCTIILMVLLIVPIVIPVILSFFSDNDESIHAALLPSPRREEASASVPSSEEQHEVILSEVEDEKPKEVDLLPASERQKRIAELQNRLFQAAAVGAVRVKRRKGPRRGEDFTLMQALIKADFWLLFFSLLLGSGSGLTVIDNLGQMSQSLGYEDTHIFVSMISIWNFLGRVAGGYFSEIVVKDYAYPRAIALATAQVFMAIGHFIFAMAWPGTMYIGTLLIGLGYGAHWAIVPAAASELFGTKNFGALYNFLTAANPAGSLVFSGIIASGIYDREAEKQAHQHGNSALLAVVFDAAPAIKCDGAICFFLSSMIMSGFCVIAAALSTILVHRTKVVYTNLYGKPPT

SEQ ID NO: 5961 - protein, 587 aa, Hordeum vulgare
MAEVRSRVRGFLRNRWLVFVAAMWMQSVAGVGYLFGSLSPAIKSSLGYNQRQVASLGVAKDLGDSVGFLAGTLCAVLPLWAALLIGAAQNLVGYGWVWLAVTHRVPVPPLWAMCMLIFVGNNGETYFNTAALVSCVQNFPKNRGPIVGILKGFAGLSGAILTQVYAIMHSPDDAALIFMVAVGPTMVVIALMFIVRPVNGHRQVRPSDGTSFTFVYSVCLVLAAYLMGVMLLEDLVGLSHSLTILCTIILMVLLLIPIVIPVMLSFFSNDDESAYTALLTSPRREEASGSVSSEEQEVILSEVEEQKPKEIDLLPASERQKRIAELQAKLFQAAAVGAVRVKRRKGPRRGEDFTLLQAMIKADFWLLFLSLLLGSGSGLTVIDNLGQMSQSLGFEDSHIFVSMISIWNFLGRISGGFFSEIIVKDYAYPRAIALATAQLFMAIGHFIFAMGWPGTMYIGTLLIGLGYGAHWAIVPAAASELFGVKNFGALYNFLTVANPAGSLVFSGIIASGIYDYEARKQANHNHNSTLLGMVSDVAPVLKCEGSICFFISSLIMSGFCIIAAVLSLILVHRTKIVYTNLYGKPRT

SEQ ID NO: 5962 - protein, 586 aa, Secale cereale
MAEVRSRVRGFLRNRWLVFVAAMWMQSVAGVGYLFGSLSPAIKSSLGYNQRQLASLGVAKDLGDSVGFLAGTLCAVLPLWAALLIGAAQNLVGYGWVWLAVTHRVPVPPLWAMCMLIFVGNNGETYFNTAALVSCVQNFPKNRGPIVGILKGFAGLSGAILTQVYAIIHSPDDAALIFMVAVGPTMVVIALMFIVRPVNGHRQVRPSDGTSFTFVYSVCLVLAAYLMGVMLLEDLVGLSHSLTILCTIILMVLLLVPIVIPVMLSFFSNDDESAYTALLTSPRREEASGSVSSEEQEVILSEVEEQKPKEIDLLPASERQKRIAELQAKLFQAAAVGAVRVQRRKGPRRGEDFTLLQAMIKADFWLLFFFLLLGSGSGLTVIDNLGQMSQSLGFEDSHIFVSMISIWNFLGRISGGFFSEIIVKDYAYPRAIALATAQVFMAIGHFIFAMGWPGTMYIGTLLIGLGYGAHWAIVPAAASELFGVKNFGALYNFLTVANPAGSLVFSGIIASGIYDYEARKQANHNHSTLLGMVSDVAPVLKCEGSICFFISSLIMSGFCIIAAALSLILVRRTKIVYTNLYGKPRT

SEQ ID NO: 5963 - protein, 115 aa, Triticum aestivum
MAEVRSRVRGFLRNRWLVFVAAMWMQSVAGVGTCSAACRRRSSPRLATTSARWPASASPRIWETASASSPARSAPCSRSGPRSSSAPRRTSSDTAGSGSPSPTASPCHRSGRCAC

SEQ ID NO: 5964 - protein, 407 aa, Sorghum bicolor
MLRQSSSRNQRSKGLKLKKALQISLLLLVSVWLLYQVKHSYEKKAYSEDEANDLHKDDKDQREAVRLGRKDLPPKMEADSSTLDERVEDEENDEMEQEMKHDENDEDPIDEQDLEKDEDLPEPGEHSSEKDGDVGVFEDEERKERSQEDQEKSFHGDNVSSAVTHDPPSSEQDELFHHAQEKVLFVDDASTAVPNENHDEAGSKEEEVRRARERSFRGDDVSSSVDHDAKVAKPLPEEQLNSMDRIFEGTTNLSNGISFRAPGINGSYATPTNSSSQKNTDIPSDDIKSKTHPSPANLTSNPEQNNSTLKGHPDQQVNSTAVLGNQVQPLTNQTSLLELDSPPNGTLALVTDVQKSTSGAGDDGSSNTSSSTPVDKKTDGEDGPKEDVDVSTKIMNKAMSEDEVVPE

SEQ ID NO: 5965 - protein, 410 aa, Zea mays
MLRQSSSRNQRSKGLKLKKALQISLLLLVSVWLLYQVKHSYEKKAYSEDEVSGSHKDDKDQGETVRLGRKDLPPKMEADSSTLDERVEDEENDEMEQEMKHDENDDDPIDEQDLEKDEDLPEPGEHSSERDGDVGVFDDEERKERSQEDQEKSFHGDNVSSAVTHDPPSSEQDELFHRGQEKVLFVDDASTAVPNENHEAGNEDEVRRARERSFRGDDVSSSVDHDGKVTKPLPEEQLNIMDRIFEGTTNLSNGISFRAPGINGSYTTAGNVATPTNSSSQKNTDIPSDDIESKTHPSPTNLTSNPEQTNSTLKGHPDQQVNSMAVLGNQVQPLTNQTSLELDSPPNGTLALVTDAKKSTSGAGDDGSNSTSPSTHVDKKTDGGDGPKEDVDVSTKIMNKAISEDEVVPE

SEQ ID NO: 5966 - protein, 104 aa, Saccharum officinarum
MLRQSSSRNQRSKGLKLKKALQISLLLLVSVWLLYQVKHSYEKKAYSEDEANDLHKDDKDQQEAVRLGRKDLPPKMEADSSTLDERVEDEENDEMEQEMKHDET

SEQ ID NO: 5967 - protein, 218 aa, Sorghum bicolor
MARPSKLYLVFYNSLQALGWFLALLRLLPSLVPPFPVHSAYVVTGDLICFLQTCAFLETVHAAIGLVPTAPFLAFLQWGGRTHFILAVVRQIPEVQRSPSVYITFIAWSISEVIRYSHYALTTLKVCPGWLTYLRYTAFIPLYPIGVGPGEMWTMYQALPFVKKRNLYSGFFKKFSMSYHSFLVGVLVIYPFLWLKLYLHVFKQRKSKLGKGSRKKRA

SEQ ID NO: 5968 - protein, 218 aa, Panicum virgatum
MARPSKLYLVCYNSLQALGWFVALLRLLPCLASPVSVHSAYAVSGDLICVLQTCAILETVHATIGLVPTAPLLAFLQWGGRTHFVLAVVRQIPEVQSSPSVFITFMAWSISEVIRYSHYALTTLKVCPSWLTYLRYTAFIPLYPIGVGPGEMWTMYQALPFVKKRNLYLGFFKKFSMSYHSFLVGVLVCYPFLWLKLYMHVFKQRKSKLRKGSRKKRA

SEQ ID NO: 5969 - protein, 218 aa, Cenchrus ciliaris
MARPSKLYLICYHSLQALGWFIALLRLLPCLAHPVSAHSAYAVAGDLICFLQTCAILETVHAAIGLVPTAPLLTFLQWGGRTHFVLAVVRQIPQVQSSPSVFITFMAWSISEVIRYSHYALTTLKVCPSWLTYLRYTAFIPLYPIGVGPGEMWTMYQALPFVKKRNLYSGFFDKFSMSYYSFLVGVLVCYPFLWLKLYKHVFKQRKSKLGKGSRKKRS

SEQ ID NO: 5970 - protein, 218 aa, Setaria italica
MARPSKLYLVCYNSLQALGWFIALLRLLPCLAHPVSAHSAYAVAGDLICFLQTCAILETVHAAIGLVPTAPLLTVLQWGGRTHFVLAVVRQIPQVQSSPSVFITFMAWSIAEVIRYSHYALTTLKVCPSWVTYLRYTAFIPLYPIGVGPGEMWTMYQALPFVKKRNLYSGFFEKFSMSYHSFLVGVLVCYPLLWLKLYLHVFKQRKSKLGKGSRKKRA

SEQ ID NO: 5971 - protein, 218 aa, Triticum aestivum
MARPSRLYLLAYNSVQAIGWSVALLRLLPCLAPPVSVRPAYAAAGDLICFLQTCAVLETVHAAVGLVPTSPFLAFLQWGGRTHFILALLRQIPEVQGSPSVFITFMAWSISEVIRYSHYALTTLKVCPAWMTYLRYTAFIPLYPIGVGPGEMWTMYQALPFVKERDLYSGFFAKFSMSYHSFLVGVLLCYPLLWLKLYLHVFKQRKSKLGKGGRKKRA

SEQ ID NO: 5972 - protein, 219 aa, Oryza sativa
MARPSQLYLLSYNSVQALGWFVALLRLLPCLAPPSSVHSSYAVAGDLVCLLQTWAILETIHAAIGLVHTSPLLAFLQWGGRTHFVLAVVRQIPEVQSSPSVFITFMAWSISEVIRYSHYALTTLKVCPPWLTYLRYTAFIPLYPIGVGPGEMWTMYQALPFVKERKLYSGFFGKFSMSYHSFLVAVLAVYPFLWMKLYLHVFKQRRSKLGKSGGAKKRA

SEQ ID NO: 5973 - protein, 231 aa, Panicum virgatum
  misc_feature (188)..(188): Xaa can be any naturally occurring amino acid
  misc_feature (201)..(201): Xaa can be any naturally occurring amino acid
  misc_feature (220)..(220): Xaa can be any naturally occurring amino acid
MARPSKLYLVCYNSLQALGWFVALLRLLPCLASPVSVHSAYAVAAPSVSVHSAYAVAGDLICVLQTCAILETVHATIGLVPTAPLLAFLQWGGRTHFVLAVVRQIPEVQSSPSVFITFMAWSISEVIRYSHYALTTLKVCPSWLTYFRYTAFIPLYPIGVGPGEMWTMYQALPFVKKRNLYLGFFKKXSMSYHSFLVGVLXCYPFLWLKLYMHVFKQRKXKLRKGSRKKRA

SEQ ID NO: 5974 - protein, 218 aa, Secale cereale
MARPSRLYLLAYNSLQAIGWSVALLRLLPCFAPPVSVRPAYAAAGDLICFLQTCAVLETVHAAVGLVPTSPFLAFLQWGGRTHFILALLRQIPEVQGSPSVFITFMAWSISEVIRYSHYALTTLKVCPAWMTYLRYTAFIPLYPIGVGPGEMWTMYQALPFVKERDIYSGFFAKFSMSYHSFLVGVLLCYPLLWLKLYLHVFKQRKSKLGKGERKKRA

SEQ ID NO: 5975 - protein, 218 aa, Hordeum vulgare
MARPSRLYLLAYNSLQAIGWSVAFLRLLACLAPPVSVDSAYAAAGDLICLLQTCAVLETIHAAVGLVPTSPFLAFLQWGGRTHFVLALLRQIPEVQDSPSVFITFMAWSISEVIRYSHYALSTIKVCPAWLTYLRYTAFIPLYPIGVGPGEMWTMYQALPFVKERDLYSGFFAKFSMSYHSFLVGVLLCYPLLWLKLYLHVFKQRKSKLGKADRKKRA

SEQ ID NO: 5976 - protein, 220 aa, Brachypodium distachyon
MAHPSRLYLLAYNSLHSLGWFLALLRLLACLALPVSASARSAYAVAGDLICFLQTCAVLETVHAAVGLVPTSPFLAFLQWGGRTHFVLALLRQIPEVQGSPSVFITFMAWSISEVIRYSHYALTTLKVCPAWLTYLRYTAFIPLYPVGVGPGEMWTMYQALPFVKERDLYSGFFAKFFMGYHSFLVGVLLCYPFLWLKLYLHVFKQRKSKLGKVDRKKRV

SEQ ID NO: 5977 - protein, 122 aa, Saccharum officinarum
MATSTAAATALLRSSPAVPAKRRCLHAVAGRSTTRRRRGAAGVMRACFNPLGDERILREAIKEPVAFMGGVFAGLLRLDLNEDPLKEWITRTVEASGIAEENSSEESSEADQNDAPQQIEIE

SEQ ID NO: 5978 - protein, 126 aa, Sorghum bicolor
MATSTGTATALLRPSRPAVPAKLAQRRCLHGVDGRTTTSRRRGAAVVMRACFNPLGDERILREAIKEPVAFLGGVFAGLLRLDLNEDPLKEWISRTVEASGIAEENSSEESSEADQNDAPQQIEIE

SEQ ID NO: 5979 - protein, 125 aa, Setaria italica
MATSTAAAALLRPCPGVPAALQLSERWSPRAVAGRTTRRRRGAAGVVRACFNPLGDERILREAIKEPVAFMGGVFAGLLRLDLNEDPLKEWITRTVEASGIAEENSSEESSEADQNDAPQQIEIE

SEQ ID NO: 5980 - protein, 123 aa, Pennisetum glaucum
MASSTAAAALLRPCPGVPAALSERRSPRAAAGLTTRRRRRAAGVVRACFTPLGDERILREAIKEPVAFMGGVFAGLLRLDLNEDPLKEWITRTVEASGIADENSSEESSEADQNDAPQQIEIE

SEQ ID NO: 5981 - protein, 124 aa, Panicum virgatum
MATSTVVAAAQLCPSPRFPAELSKRGSPSAVAGRTRRRRKGAAGVVRACFNPLGDERILREAIKEPVAFLGGVFAGLLRLDLNEDPLKEWITRTVEASGIAEENSSEESSEADQNDAPQQIEIE

SEQ ID NO: 5982 - protein, 124 aa, Panicum virgatum
MATSAVAAAALLCPSQLFPAALSKRGSPSAVAGRTRRRRRGAAGVVRACFNPLGDERILREAIKEPVAFLGGVFAGLLRLDLNEDPLKEWITRTVEASGIAEENSSEESSEANQNDAPQQIEIE

SEQ ID NO: 5983 - protein, 154 aa, Sorghum bicolor
MASSSTLDLAMGPGVLVPRSAVPYASFARGRGRSASGRRSRNLVLSASFSNGAAVPSLTTDSEKKGPVIMEIPLDQIRRPLMRTRANDPVKVQELMDSIRVIGLQVPIDVLEVDGVYYGFSGCHRYEAHQRLGLPTIRCKVRRGTKETLRHHMR

SEQ ID NO: 5984 - protein, 154 aa, Saccharum officinarum
MASNSTMDWAMGPGVLLPRSAVPYASFARGRGRSASGRRSRNLALSASFSNGAAVPSLTTDSEKKGPVIMEIPLDQIRRPLMRTRANDPVKVQELMDSIRIIGLQVPIDVLEVDGVYYGFSGCHRYEAHQRLGLPTIRCKVRRGTKETLRHHMR

SEQ ID NO: 5985 - protein, 154 aa, Setaria italica
MASSSSLDLAMTSGVLLHRRALPHASFIPGRGRSASGKRSRNLALSASSSNGAAVPSLTSDSDKKGPVIMEIPLDKIRRPLMRTRANDPVKVQELMDSIRVIGLQVPIDVLEVDGVYYGFSGCHRYEAHQRLGLPTIRCKVRRGTKETLRHHMR

SEQ ID NO: 5986 - protein, 144 aa, Triticum aestivum
MGPGVLVPRSAVPYASFARGRGRSASGRRSRNLVLSASFSNGAAVPSLTTDSEKKGPVIMEIPLDQIRRPLMRTRANDPVKVQELMDSIRVIGLQVPIDVLEVDGVYYGFSGCHRYEAHQRLGLPTIRCKVRRGTKETLRHHMR

SEQ ID NO: 5987 - protein, 155 aa, Panicum virgatum
MASSSSLDLAMAPGVLLHRRVVTHASFIRGRGRGASGRRSSSNLALSASSSNGAAVPSLTSDSDKKGPVIMEIPLDKIRRPLMRTRANDPAKVQELMDSIRVIGLQVPIDVLEVDGVYYGFSGCHRYEAHQRLGLPTIRCKVRRGTKETLRHHMR

SEQ ID NO: 5988 - protein, 153 aa, Pennisetum glaucum
MASSSSLDLAMASGVLLHRRALPQASIPGRGRGSNGKRSRNLALSASFSNGAAVPSLTSDSDKKGPVIMEIPLDKIRRPLMRTRANDPVKVQELMDSIRVIGLQVPIDVLEVDGVYYGFSGCHRYEAHQRLGLPTIRCKVRRGTKETLRHHMR

SEQ ID NO: 5989 - protein, 155 aa, Panicum virgatum
MASSSSLDLAMAPGVLLHRRVVTHASFIRGRGRGASGRSSSSNLALSASSSNGAAVPSLTSDSDKKGPVIMEIPLDKIRRPLMRTRANDPAKVQELMDSIRVIGLQVPIDVLEVDGVYYGFSGCHRYEAHQRLGLPTIRCKVRRGTKETLRHHMR

SEQ ID NO: 5990 - protein, 154 aa, Panicum virgatum
MAPSSSLDLAMAPSVLLHRRVVTHASFIRGRGRGASGRRSSNLALSASSSNGAAVPSLTSDSDKKGPVIMEIPPDQIRRPLMRTRANDPAKVQELMDSICVIGLQVPIDVLEVDGVYYGFSGCHRYEAHQRLGLPTIRCKVRRGTKETLRHHMR

SEQ ID NO: 5991 - protein, 154 aa, Panicum virgatum
MAPSSSLDLAMAPGVLLHRRVVTHASFIRGRGRGANGRRSSNLPLSASSSNGATVPSLTSDSDKKGPVIMEIPLDQIRRPLMRTRANDPAKVQELMDSIRVIGLQVPIDVLEVDGVYYGFSGCHRYEAHQRLGLPTIRCKVRRGTKETLRHHMR

SEQ ID NO: 5992 - protein, 156 aa, Eragrostis curvula
MASSSNPSSVKTMLPGVLLHRPAVTNASFARGTRRRANAGRGRNLGFSVSSSNGSAVTSLTSESEKKGPVIMEIPLDQIRRPLMRTRANDPAKVQELMDSIRVIGLQVPIDVLEVDGVYYGFSGCHRYEAHQRLGLPTIRCKVRRGTKETLRHHMR

SEQ ID NO: 5993 - protein, 138 aa, Sorghum bicolor
MAAPATTTSLLSTLPQLSSFSGKSSPPSVVHVARRAPTAVVAAKGYNVQILVDENEGEESIFRRFRREVMRAGVLQEIKRRRRYESKTDEKKRKAREAGRRNRRRRMMDEPRFPEEDADATSKARDEDDDNWEIDGIL

SEQ ID NO: 5994 - protein, 139 aa, Zea mays
MAAPATTSLLSTLLNLPLAPLSGKSSPPSVVHVARRGPMVVVAAKGYNVQILVDENEGEESIFRRFRREVMRAGVLQEIKRRRRYESKTDEKKRKAREAGRRNRRRRMMDEPRFPEEDADATAKARDEDDDNWEIDGIL

SEQ ID NO: 5995 - protein, 139 aa, Panicum virgatum
MAAPASTSLLSTLLQLPLAPFSGKSSPPSVVHVARRAPTAVVAAKGYNVQILVDENEGEESIFRRFRREVMRAGVLQEIKRRRRYESKKDEKKRKAREAGRRNRRRRMMDEPRFPEEDAGAAARARDEDDDNWEIDGLL

SEQ ID NO: 5996 - protein, 138 aa, Setaria italica
MAAPATTSLLSTLLQLPLAPFSGKSSPPSVVHVPRRAPTAVVAAKGYNVQILVDENEGEESIFRRFRREVMRAGVLQEIKRRRRYESKKDEKKRKAREAGRRNRRRRMMDEPRFPEEDAGAAKARDDDDDNWEIDGLL

SEQ ID NO: 5997 - protein, 138 aa, Saccharum officinarum
MTAPATTTSLLSTLPPLAPFSGKSSPPSVVHVARRAPTAVVAAKGYNVQILVDENEGEESIFRRFRREVMRAGVLQEIKRRRRYESKTDEKKRKAREAGRRNRRRRMMDEPRFPEEDADATSKARDDDDDNWQIDGIL

SEQ ID NO: 5998 - protein, 168 aa, Zea mays
MPSTSQLSLSSSRALEVASASSSGNLGSSIIRLQSFQRKHMRGSTYLRRLRRPASRALRFFSSVLLSYLRRRLISCSTPARITSRRNLRKMDSSPSFSSTRICTLNPLAATTAVGARRATCTTDGGELFPENGASGSCSSVLSRELVAGAAMAAGLLRVRGSRFCVLG

SEQ ID NO: 5999 - protein, 152 aa, Sorghum bicolor
MPSISQLSSSSSRAFEVASASSSGNLGSSIIRLQAMFISYLRRLRRPASRALRFFSSVLLSYLRRRLISCSTPARITSRRNRRKMDSSPSFSSTRICTLYPLAATTAVGARRATCTTDGGELFPENDESCGSVLSREVVVAGAAMAAACFGW

SEQ ID NO: 6000 - protein, 127 aa, Pennisetum glaucum
TLLQLPLAPFSGKSSPPSVVHVPRRAPTAVVAAKGYNVQILVDENEGEESIFRRFRREVMRAGVLQEIKRRRRYESKKDEKKRKAREAGRRNRRRRMMDEPRFPEEDAGAAKARDEDDDNWEIDGLL

SEQ ID NO: 6001 - protein, 146 aa, Oryza sativa
MAAAPATTSLLSALLQLPLAPFSGRRSPPPPSVVHVAPPRSPTAAVAATKGYNVQIVVDENEGEESIFRRFRREVMRAGVLQEIKRRRRYESKKDERKRKAREAGRRNRRRRMMEEPRFPEDDADSEAARRARDDEKDNWEIDGIL

SEQ ID NO: 6002 - protein, 1486 aa, Panicum virgatum
MEKVWESGRRASRSISRGMGMDAWGVDDAFVPPHHQSRSRSRRAGGSRGADDDEEALRWAAIERLPTYSRVRTAILSSAADQFKEVDVRKLAVGDRQEFIERVFRVADEDNQRFLQKLRNRIDRVGIELPTVEVRFEQVTVQAKCHVGSRALPTLLNTARNVAEGALGLCGLRLGRQATLTILKDVSGVVRPSRMTLLLGPPSSGKTTLLLALAGKLDPALRRAGEVTYNGFALGEFVPQKTAAYISQTDVHVGEMTVKETLDFSARCQGVGTKYDLMTELTRREKEAGIRPEPEVDLFMKATSMEGVQSSLQTDYTLRILGLDICADTIVGDQMQRGISGGQKKRVTTGEMIVGPTKVLFMDEISTGLDSSTTFQIVKCLQQIVHLGEATILMSLLQPAPETYDLFDDIILLSEGQIVYQGPREYVLEFFETCGFRCPERKGTADFLQEVTSRKDQEQYWADKQRPYRYISVPEFAQRFKRFHVGLQLENHLSLPFDKSRCHQAALVFSKHSVSTTELLKASFDKEWLLIKRNSFVYIFKTIQLIIVALIASTVFLRTHMHTRNVDDGFVYIGALLFSLIVNMFNGFAELSLAITRLPVFYKHRDLLFYPAWIFTLPNVVLRIPFSIIESVVWVLVTYYTIGFAPEADRFFKHLLLVFLIQQMAGGLFRAIAGLCRSMTIAQTGGALFLLIFFVLGGFLLPKGFIPKWWIWGYWISPLMYGFNALAVNEFYAPRWMNKFVMDQNGVPKRLGISMLEGANIFVDKNWYWIGAAGLLGFTIFFNVLFTLSLMYLNPLGKPQAVISEETAQEAEGNEHARGTVRNGSTKSKDGGHSKEMKEMRLSARLSNCSSNGVSRVMSIGSNEAAPRRGMVLPFNPLAMSFDNVNYYVDMPAEMKQQGVQDNRLQLLREVTGSFRPGVLTALMGVSGAGKTTLMDVLAGRKTGGYIEGDIRIAGYPKNQATFARISGYCEQNDIHSPQVTVRESLIYSAFLRLPEMIGDQEITDDIKIQFVDEVMELVELDNLKDALVGLPGITGLSTEQRKRLTIAVELVANPSIIFMDEPTSGLDARAAAIVMRTVRNTVDTGRTVVCTIHQPSIDIFEAFDELLLLKRGGQVIYSGQLGRNSQKMVEYFETIPGVPKIKGKYNPATWMLEVSSIAAEVRLKMDFAEYYKTSDLYKQNKVLVNQLSQPESGTSDLYFATQYSQSIIGQFKACLWKQWLTYWRSPDYNLVRFSFTLFVALLLGSIFWRIGTKMGDANTLRMVMGAMYTAVMFVGINNCSTVQPIVSIERTVFYRERAAGMYSAMPYAIAQVVMEIPYVFVQTTYYTLIVYAMMSFQWTAAKFFWFFFISYFSFLYFTFYGMMTVSISPNPEVAAIFAAAFYSLFNLFSGFFIPRPKIPRWWIWYYWICPLAWTVYGLIVTQYGDLEEVIEVPGESKQTISYYVTHHFGYHMNFMPVVAPVLVLFAAFFAFMYAVCIKKLNFQQR

SEQ ID NO: 6003 - protein, 1495 aa, Setaria italica
MEKVWESGRRMSRSIGRGMGMEAWGVDEAFMPHPWAGSRGGSRGGRSGRDDDEEALRWAAIERLPTYNRVRTAILSSSTEAEANDAKPGGKQQFKEVDVRKLDVGDRQEFIERVFRVADEDNQRFLQKLRNRIDRVGIELPTVEVRFEQLTVEAKCHVGSRALPTLINTARNIAEGALGLCGIRLGRQATLTILKDVSGVVRPSRMTLLLGPPSSGKTTLLLALAGKLDPTLRCAGEVTYNGFALDEFVPQKTAAYISQTDVHVGEMTVKETLDFSARCQGVGTKYDLMTELTRREKEAGIRPEPEVDLFMKATSMEGVQSSLQTDYTLRILGLDICADTIVGDQMQRGISGGQKKRVTTGEMIVGPTKVLFMDEISTGLDSSTTFQIVKCLQQIVHLGEATILMSLLQPAPETFDLFDDIILLSEGQIVYQGPREYVLEFFESCGFRCPERKGTADFLQEVTSRKDQEQYWADKQRPYRYISVPEFAQRFKRFHVGLQLENHLSLPFDKSRCHQAALVFSKHSVSTIELLKASFDKEWLLIKRNSFVYIFKTIQLIIVALISSTVFLRTHMHQRNVDDGFVYIGALLFSLIVNMFNGFAELSLAITRLPVFYKHRDLLFYPAWVFTLPNVVLRIPFSIIESIVWVLVTYYTIGFAPEADRFFKHLLLVFLIQQMAGGLFRATAGLCRSMIIAHTGGALSLLIFFVLGGFLLPKDFIPKWWIWGYWVSPLMYGFNALAVNEFYAPRWMNKFVLDQSGVPKRLGVSMLEGANIFVDKNWYWIGAAALLGFTIFFNILFTLSLMYLNPLGKPQAVISEETAEEAEGNGHRTVRNGSTKSRDGGHSKEMKEMRLSARLSNSSSNGISRIMSVGSNEAAPRRGMVLPFNPLAMSFDNVNYYVDMPAEMKQQGVQDNRLQLLREVTGSFRPGVLTALMGVSGAGKTTLMDVLAGRKTGGYIEGDIRIAGYPKNQATFARISGYCEQNDIHSPQVTVRESLIYSAFLRLPEMIGDQEITDDIKIQFVDEVMELVELDNLKDALVGLPGITGLSTEQRKRLTIAVELVANPSIIFMDEPTSGLDARAAAIVMRTVRNTVDTGRTVVCTIHQPSIDIFEAFDELLLLKRGGQVIYSGQLGRNSQKMVEYFEAIPGVPKIKDKYNPATWMLEVSSIAAEVRLKMDFAEYYKTSDLYKQNKVQVNRLSQPEPGTSDLYFATQYSQSIIGQFKACLWKQWLTYWRSPDYNLVRFFFTLFVALLLGSIFWRIGTKMGDANTLRIVMGGMYTAVMFVGINNCSTVQPIVSIERTVFYRERAAGMYSALPYAIAQVVMEIPYVFVQTTYYTLIIYAMMSLQWTAAKFFWFFFISYFSFLYFTFYGMMTVSISPNHEVAAIFAAAFYSLFNLFSGFFIPRPRIPRWWIWYYWICPLAWTVYGLIVTQYGDLEEEISVPGGEKQTISYYVTHHFGYHRNFMPVVAPVLVLFPVFFAFMYAVCIKKLNFQQR

SEQ ID NO: 6004 - protein, 1500 aa, Oryza sativa
MEKVWESGRRMSRSIGRGMGMEAWGVDEAFMPQNSGGGGGSRGRRRSGRGGTADDDEEALRWAAIERLPTYSRMRTAILSSAEEEAAAAAAGAGKQQYKEVDVRRLGVGERQEFIERVFRVAEEDNQRFLQKLRNRIDRVGIELPTVEVRFEELMVQARCHVGSRALPTLLNTARNIAEAALGLVGVRPGRQATLTILRGVSGAVRPSRMTLLLGPPSSGKTTLLLALAGKLDPSLRRGGEVTYNGFELEEFVAQKTAAYISQTDVHVGEMTVKETLDFSARCQGVGTKYDLLTELARREKEAGIRPEPEVDLFMKATSMEGVESSLQTDYTLRILGLDICADTIVGDQMQRGISGGQKKRVTTGEMIVGPTKVLFMDEISTGLDSSTTFQIVKCLQQIVHLGEATILMSLLQPAPETFELFDDIILLSEGQIVYQGPREYVLEFFESCGFRCPERKGTADFLQEVTSKKDQEQYWADKHRPYRYISVSEFAQRFKRFHVGLQLENHLSVPFDKTRSHQAALVFSKQSVSTTELLKASFAKEWLLIKRNSFVYIFKTIQLIIVALVASTVFLRTQMHTRNLDDGFVYIGALLFSLIVNMFNGFAELSLTITRLPVFFKHRDLLFYPAWIFTLPNVILRIPFSIIESIVWVIVTYYTIGFAPEADRFFKQLLLVFLIQQMAGGLFRATAGLCRSMIIAQTGGALALLIFFVLGGFLLPKAFIPKWWIWGYWVSPLMYGYNALAVNEFYSPRWMNKFVLDNNGVPKRLGIALMEGANIFTDKNWFWIGAAGLLGFTMFFNVLFTLSLVYLNPLGKPQAVISEETAKEAEGNGDARHTVRNGSTKSNGGNHKEMREMRLSARLSNSSSNGVSRLMSIGSNEAGPRRGMVLPFTPLSMSFDDVNYYVDMPAEMKQQGVVDDRLQLLRDVTGSFRPAVLTALMGVSGAGKTTLMDVLAGRKTGGYIEGDMRISGYPKNQETFARISGYCEQNDIHSPQVTVRESLIYSAFLRLPEKIGDQEITDDIKIQFVDEVMELVELDNLKDALVGLPGITGLSTEQRKRLTIAVELVANPSIIFMDEPTSGLDARAAAIVMRTVRNTVDTGRTVVCTIHQPSIDIFEAFDELLLLKRGGQVIYSGQLGRNSQKMIEYFEAIPGVPKIKDKYNPATWMLEVSSVAAEVRLNMDFAEYYKTSDLYKQNKVLVNQLSQPEPGTSDLHFPTKYSQSTIGQFRACLWKQWLTYWRSPDYNLVRFSFTLFTALLLGTIFWKIGTKMGNANSLRMVIGAMYTAVMFIGINNCATVQPIVSIERTVFYRERAAGMYSAMPYAIAQVVMEIPYVFVQTAYYTLIVYAMMSFQWTAAKFFWFFFVSYFSFLYFTYYGMMTVAISPNHEVAAIFAAAFYSLFNLFSGFFIPRPRIPKWWIWYYWLCPLAWTVYGLIVTQYGDLEQIISVPGQSNQTISYYVTHHFGYHRKFMPVVAPVLVLFAVFFAFMYAICIKKLNFQHR

SEQ ID NO: 6005 - protein, 1505 aa, Brachypodium distachyon
MEKVWDSGRRMSRSIGRGMGMETWGVDEAFLHGGGSRGRAGADDDEEALRWAAIERLPTYSRMRTAILSAEAAASAAADQGDGNKQQQQYKEVDVRKLGAGERQEFIERVFRVAEEDNQRFLQKLRDRIDRVGIELPTVEVRFERLTVEARCHVGSRALPTLLNTARNMAEGALGLLGARLGRQATLTILKDVSGVIRPSRMTLLLGPPSSGKTTLLLALAGKLDPTLACSGEVAYNGFPLEDFVPQKTAAYISQTDVHVGEMTVKETLDFSARCQGVGTKYDLLTELARREKEAGIRPEPEVDLFMKATSMEGVESSLQTDYTLRILGLDICADTIVGDQMQRGISGGQKKRVTTGEMIVGPTKVLFMDEISTGLDSSTTFQIVKCLQQIVHLGEATILMSLLQPAPEAFELFDDIILLSEGQIVYQGPREYVLEFFESCGFRCPERKGTADFLQEVTSKKDQEQYWADKQRPYRYISVSEFAQRFKRFHVGLQLENHLSVPFDKSRSHQAALVFSKHSVSTRELLKASFDKEWLLIKRNSFVYIFKTIQLIIVALIASTVFLRTQMHTRNLDDGFVYIGALLFTLIVNMFNGFAELSLTITRLPVFYKHRDLLFYPAWIFTLPNVVLRIPFSIIESVVWVVVTYYTMGFAPEADRFFKQLLLVFLIQQMAGGLFRAIAGLCRSMIIAQTGGALFLLIFFVLGGFLLPKDFIPKWWIWGYWISPLVYGYNALAVNEFYAPRWMNKFVMDKNGVPKRLGIAMLEGANIFTDKNWFWIGAAGLLGFSIFFNVLFTLSLAYLNPLGKPQAVISEETAKEAEGNGVPRDTVRNGSTKRNGSTKRTGSTKSGDGGNSNEIREVRLSSRLSNSSSNGIARVMSVGSNEAAPRRGMVLPFSPLSMCFDDVNYYVDMPAEMKQQGVTDDRLQLLREVTGSFRPGVLTALMGVSGAGKTTLMDVLAGRKTGGYIEGDIRISGYPKNQATFARISGYCEQNDIHSPQVTIRESLIYSAFLRLPENIGDEEITDDIKIQFVDEVMELVELDNLKDALVGLPGITGLSTEQRKRLTIAVELVANPSIIFMDEPTSGLDARAAAIVMRTVRNTVDTGRTVVCTIHQPSIDIFEAFDELLLLKRGGQVIYSGKLGRNSQKMIEYFEAIPGVPKIKDKYNPATWMLEVSSVAAEVRLNMDFADYYKTSDLYKQNKVLVNRLSQPEPGTSDLHFPTAYSQSIIGQFKACLWKHWLTYWRSPDYNLVRFSFTLFTALLLGSIFWKIGTKMGDANTLRMVIGAMYTAVMFVGINNCATVQPIVSIERTVFYRERAAGMYAAMPYAIAQVVMEIPYVFVQASYYTLIVYAMMSFQWTAAKFFWFFFVSYFSFLYFTYYGMMTVSISPNHEVAAIFAAAFYSLFNLFSGFFIPRPRIPKWWIWYYWICPLAWTVYGLIVTQYGDMEEIISVPGQSNQTISYYVTHHFGYHRSFMAVVAPVLVLFAVFFAFMYALCIKKLNFQQR

SEQ ID NO: 6006 - protein, 1368 aa, Panicum virgatum
KHLCRRVGIELPTVEVRFEQLTVKAKCHVGSRALPTLLNTARNIAEGALGLCGIRLGRQATLTILRDVSGVVRPSRMTLLLGPPSSGKTTLLLALAGKLDPALRRAGEVTYNGFALDEFVPQKTAAYISQTDVHVGEMTVKETLDFSARCQGVGTKYDLMTELTRREKEAGIRPEPEVDLFMKATSMEGVQSSLQTDYTLRILGLDICADTIVGDQMQRGISGGQKKRVTTGEMIVGPTKVLFMDEISTGLDSSTTFQIVKCLQQIVHLGEATILMSLLQPAPETYDLFDDIILLSEGQIVYQGPREYVLEFFESCGFRCPERKGTADFLQEVTSRKDQEQYWANKQRPYRYISVPEFAQRFKRFHVGLQLENHLSLPFDKSRCHQAALVFSKHSVSTTELLKASFDKEWLLIKRNSFVYIFKTIQLVIVALVASTVFLRTHMHTRNVDDGFVYIGALLFSLIVNMFNGFAELSLAITRLPVFYKHRDLLFYPAWVFTLPNVVLRIPFSIIESVVWVLVTYYTIGFAPEADRFFKHLLLVFLIQQMAGGLFRAIAGLCRSMIISHTGGALSLLIFFVLGGFLLPKGFIPKWWIWGYWISPLMYGFNALAVNEFYAPRWMNKFVMDQNGVPKRLGISMLEGANIFVDKNWYWIGAAGLLGFTIFFNVLFTLSLMYLNPLGKPQAVISEETAQEAEGNEHARGTVRNGSTKSKDGGHSKEMKEMRLSARLSNCSSNGVSQVMSIGSNEAAPRRGMVLPFNPLAMSFDNVNYYVDMPAEMKQQGVQDNRLQLLREVMGSFRPGVLTALMGVSGAGKTTLMDVLAGRKTGGYIEGDIRIAGYPKNQATFARISGYCEQNDIHSPQVTVRESLIYSAFLRLPEMIGDQEITDDIKIQFVDEVMALVELDNLKDALVGLPGITGLSTEQRKRLTIAVELVANPSIIFMDEPTSGLDARAAAIVMRTVRNTVDTGRTVVCTIHQPSIDIFEAFDELLLLKRGGQVIYSGQLGRNSQKMVEYFEAIPGVPKIKDKYNPATWMLEVSSIAAEVRLKMDFAEYYKTSDLYRQNKVLVNQLSQPEPGTSDLYFATQYSQSIIGQFKACLWKQWLTYWRSPDYNLVRFSFTLFVALLLGSIFWRIGTKMGDANTLRMVIGGMYTAVMFVGINNCSTVQPIISIERTVFYRERAAGMYSAMPYAIAQVVMEIPYVFVQTTYYTLIVYAMMSFQWTAAKFFWFFFISYFSFLYFTFYGMMTVSISPNHEVAAIFAAAFYSLFNLFSGFFIPRPRIPRWWIWYYWICPLAWSVYGLIVTQYGDLEEVIEVPGQSKQTISYYVTHHFGYHRNFMPVVAPVLVLFAAFFAFMYAVCIKKLNFQQR

SEQ ID NO: 6007 - protein, 755 aa, Triticum aestivum
MDKFVTDKNGVSKRLGIAMLEGTNIFTDKNWFWIGAAGLLGFTIFFNVLFTMSLAYLNPLGQPQAVISEETAKEAEGNGLPREAVSNDSTRRNGRMKSKDGSSNKEMGEMRPMTRLGNSSSNAISRVKSIGRNVSAPRRGMVLPFSPLSMCFEDVNYYVDMPAEMKQRVTDDRLQLLRGVTGSFRPGMLTALMGVSGAGKTTLMDVLAGRKTGGYIEGDVRISGYPKNQTTFARISGYCEQNDIHSPQVTIRESLIYSAFLRLPEKIGDQDITDDIKIQFVDEVMELVELDNLKYALVGLPGISGLSTEQRKRLTIAVELVANPSIIFMDEPTSGLDARAAAIVMRTVRNTVDTGRTVVCTIHQPSIDIFEAFDELLLLKRGGQVIYSGKLGLNSQEMVEYFEAIPGVPKIKDKYNPATWMLEVSSVAAEVRLNMDFADYYKTSDLFKKNKALVNRLSQPEPGTSDLYFPTEYSQSIIGQFKACLWKHWLTYWRSPDYNLVRFSFTLFTALLLGSIFWKIGSNIGDANTLRMVIGAMYTAVMFVGINNCSSVQPIVSIERTVFYRERAAGMYSAMPYAIAQVVMEIPYVFVQASYYTLIIYAMMGFQWTVAKFFWFFFVSYFSFLYFTYYGMMTVSISPNHEIAAIFAAAFYSLFNLFSGFFIPRLKIPKWWIWYYWICPLAWTVYGLIVTQYGDLEETISVPGQSDQTISYYITHHFGYHRSFMAVVAPVLVLFAVFFAFMYALCLKKLSFQQR

SEQ ID NO: 6008 - protein, 1406 aa, Sorghum bicolor
MHMQRGGPGPSMAMAAATTTVVDRVVFALNGQRYEVAGVDPSTRLLEFIRTRTPFTGPKLGCGEGGCGACVVLIAKYNPKTDEVTEFTASSCLTLLYTINLCSVITTEGLGNSQDGFHAVQKRMSGFHASQCGFCTPGMCMSIFTSLINADKSNRPEPPKGFSKLKVSEAEKAFSGNMCRCTGYRPIVDACKSFASDVDLEDLGLNIFWKKGDRNPDVSDLPCYTLGGGVCTFPDFLKTEIKSSLDHLSNRCIAASVEGWYHPRSIKEYYELINSCFFSDSVKVVVGNTSSGIPGYKDQDLYSKYIDIGGIPELSNIVRRESGFEIGAATPISRTIEILEEECESVSSPNGNVVLRKLANHMSKVATPFVRNTASIGGNIVLAQKFPFPSDIATILLGAGATVCLQVVAERRQITLEEFLEQPPIHATTLLLSIFIPHWISDSGTNTSLLFETYRAAPRPLGNAVSYVNCAFLGHASVDKQSDTLVLSNLRLAFGAYGTEHAIRAKKVEEFLTGKSLTASVVLGAIQLLRETVVPMVGTSHPEYRVSAAVGFLFSYLSPLSKGIPEPGKSLTSSCADSADTDDVCNLPLSTCRETLSSGEYKPVGEPIKKYGVELQSSGEAVYVDDIPAPKNCLYGEFIYSTRPLAYVKSVKFKSSLASEKIISFVSAKDIPSGGQNIGSSLMFGDEPLFGDPIAEYAGQALGIVIAETQRYADMAAKQVIVEYDTEDLSPPIITVEQAVEKSSYFDVPHELYPKEVGDVSKGMAEADHKIPSTEVKLASEYYFYMETQTALAVPDEDNTLVVYSSSQYPEHAQSVIARCLGIPFSNVRVITRRVGGGFGGKAFRSFQVATAAALCAYKLRRPVRMYLNRNTDMVMIGGRHPVKAHYSIGFKSDGKITALHLDLLINAGISPDASPIMPGYIISSVKKYNWGALSFDIKLCKTNNSSKSVMRAPGDTQGSLIADAVIEHVASVLSVDANSVREKNFHTYGTLQLFYPDSAGEASTYTLHSIFDRLVSTSSYLDRAESIKEFNSNNKWQKRGISCVPLIFKVEPWAAPGRVSVLSDGSIVVEVGRIEIGQGLWTKVQQMTAFGLGKLWPDGGESLLERVRVLQADTLNLIQGGLTAGSTSSESSCAATLQACNMLFDRLKPVLDRLQQQSENVSWDTLISQASLSSSILCSLYNTNSCCNSNQKISCNVSQQASEDNVNLSASAYWVPGQVSNKYINYGAGISEVEIDLLTGAITLMRGDLVYDCGKSLNPAIDLGQIEGSFIQGIGFFVYEEYITNSDGLMISNSTWDYKIPSVDIIPKQFNAEVLNTGYHKNRVLSSKAAGEPALVLASSVHCALREAIRAARMEFANSTVSGRSPLEFKMDVPAPMTLVKQLCGLDIVEKYLESLSTYEREAGL

SEQ ID NO: 6009 - protein, 1370 aa, Setaria italica
MASSMSSVVGKATAVERLVFALNGRRYEVAAADVDPSTRLLEFIRTRTPFKGTKLGCGEGGCGACVVLIAKYNPKTNEVTEFTASSCLTLLYSINFCSVITTEGLGNTQDGFHAVQKRMSGFHASQCGFCTPGMCMSIFTSLINADKSKRPEPSKGFSKLKVSEAEKAFSGNLCRCTGYRPIVDACKSFASDVDLEDLGLNIFWKRGDKNPDVSDLPSYTLGGGVCTFPDFLKSEIKSSLDDLNDACIAASREGWYHPRSIKEYYELINSCLFSDSVKVVVGNTSTGIPGYKDQDLYNKYIEIGGIPELSNIVRTESGFEIGAATTISRTIEILKQECESISSPNGSVVFRKLADHMSKVATPFVRNTASIGGNIILAQKYPFPSDIATILLGAGATVCLQVVAGRRQITLEEFLGQPPLDPTTLLLSIFIPHWISDYQTKTTLLFETYRAAPRPLGNAVSYVNCAFLGHASVDQQSNALVLNNLRLAFGAYGTKHAIRAKKVEEFLAGKSLTASVVLGAIQLLRDVIVPMEGTSHPEYRVSAAVGFLFSFLSPLAKGIPQPGKALTSGSADSADTDDVRNLPVSSRRETISNDDYKPVGEPIKKYGVELQASGEAVYVDDIPAPKNCLYGEFIYSTQPLAHVKSIKFKSSLASEKIIDVVSAKDIPSGGENIGSTFTFGDEPLFGDTVAEYAGQALGVVIAETQRYADMAAKQVIIEYDTKDLSPPILTVEQAVENSSYFKVPPELYPTEVGDVSKGMAHADHKIPSTEVKLASEYYFYMETQTALAIPDEDNTLVVYSSSQYPELAQSVIARCLGIPFSKVRVITRRAGGGFGGKAFRSFQVATAAALCAYKLRRPVRMYLNRNTDMVMIGGRHPVKARYSVGFKSDGKITALHLDLLINAGISPDASPLMPGTIISSVKKYNWGALSFDIKVCKTNNTSKSVMRAPGDTQGSLIADAIIEHVASVLSVDANSVREKNFHTYGSLQLFYPDSAGEASTYTLHSIFNRLISTSSYLDRAESIKQFNSSNKWRKRGISCVPLIFRVEPRAAPGRVSVLNDGSIVVEVGGIEIGQGLWTKVQQMTAFALGKLWPDGVEGLLERVRVLQADTLNLIQGGLTAGSTSSESSCAATLQACNMLVDRLKPVLDRLQQQSKDVSWDTLISQASKENVNLSASAYWVPGQESNKYLNYGAAISEVEIDLLTGAITLLRGDLVYDCGKSLNPAVDLGQIEGSFIQGIGFFVYEEYVTNSDGLMICNSTWDYKIPSVDIIPKQFNAEVLNTGYHKNRVLSSKASGEPALIAASSVHCALREAIRAARREFANSTGSGSSPLEFQMDVPAPMTLVKELCGFDIVDKYLESLSTQERAAGA

SEQ ID NO: 6010 - protein, 1362 aa, Setaria italica
MCLLEVAAVERVVFALNGRRYEVAGADPSMTLLEFIRTRTPFKGTKLGCGEGGCGACVVLIAKYNPTTDEVTEFTASSCLTLLYSINFCSVLTTEGLGNTQDGFHAVQKRMSGFHASQCGFCTPGMCMSIFTSLINADKSKRPEPPKGFSKLKVSEAEKAFSGNLCRCTGYRPIVDACKSFASDVDLEDLGLNIFWKRSDKNPDASELPSYTLGGGVCTFPDFLKSEIKSSLDHLNVACIPASREGWYHPRSIKEYYELIDSCLCSDSVKMVVGNTSTGVPGYKDQDLYNKYIDIGGIPELSNIVKRESGFEIGAATTISRTIEILMQECESISSPNGSVVFRKLADHMSKVATPFVRNTASIGGNIILAQKYPFPSDIATILLGAGTTVCLQDVAGQRQITLEEFLEQPPLDSTTLLLSIFIPHWVSDYQAETSLLFETYRAAPRPLGNAVSYVNCAFLGLSSVDERSDTLVFSNLRLAFGAYGTEHAIRAKKVEKFLTGKSLTASVVLRAVQLLRETIVPMEGTSHPEYRVSAAVGFLFSFLSPLAKGIPEPGKALTSGSSDSADTDDVRNLPLSSRREKISNNDSKPVGEPIKKYAVELQASGEAVYVDDIPAPKNCLYGEFIYSTQPLAYVKSIKFKSSLASEKIIDVVSAKDIPSGGENIGSSFIWGDEPLFGDPIAEYAGQALGVVIAETQRYADMAAKQVIIEYDTKGLSPPILTVEQAVENSSYFSVPPEYYPKEVGDVMRGMAEADHKIPSTEVKFASEYYFYMETQTALAIPDEDNTLVVYSSSQCPELAQTVIARCLGIPFSNVRVITRRVGGGFGGKAFRSFQVATAAALCAYKLRRPVRMYLNRNTDMVMIGGRHPVKARYSVGFKSDGKITALHLDLLINAGISEDASPSIPRVIISSVKKYNWGALSFDFKLCKTNNSSKSIMRAPGDTQGSLIADAIIEHVASVLSLDANSVREKNFHTYDTLQLFYPDSAGEASTYTLHSIFDRLVSTSSYLDRAESIKMFNSSNKWRKRGISCVPLIFRAEPRAAPGRVSVLNDGSIVVEIGGIEIGQGLWTKVQQTTAFALGKLWPDGVEGFLERVRVLQADTLNLIQGGLTAGSTSSESSCAATLQVCNMLVDRLKPVLDRLQQQSEDVSWDTLISQASKENVNLSASAYWVPGQDSNKYLNYGAGISEVEIDLLTGAITLLRGDLVYDCGKSLNPAVDLGQIEGSFIQGIGFFIYEEYVTNSDGLMISNSTWDYKIPSVDIIPKQFNAEVLNTGYHKNRVLSSKASGEPALIAASSVHCALREAIRAARREFANSTGSGSSPLEFQMDVPAPMTLVKELCGFDIVDKYLESLSNYERAAGA

SEQ ID NO: 6011 - protein, 1243 aa, Sorghum bicolor
MHARPIASSDAQQGPSMAAATAVDRVVFALNGQRYEVAGVDPSTRLLEFIRTQTPFKGPKLGCGEGGCGACVVLIAKYNPKTDEVTEFTASSCLTLLYTLNFCSVITTEGLGNSRDGFHAVQERMSGFHASQCGFCTPGMCMSIFTSLINADKSNSPEPPKGFSKLKVSEAEKAFSGNMCRCTGYRPIVDACKSFASDVDLEDLGLNIFWKKVKVVVGNTSSGVPGYKDQDLYSKYIDIGGIPELSNIIRRESGFEIGAATPISRTIEILEEECESTSSAKGSVVFRKLANHMSKVSTPFVRNTASIGGNIVLAQKFPFPSDIATILLGAGATVCLQVVAERRQITLEEFLEQPPIDATTLLLSIFIPQWIPDSGTKTSLLFETYRAAPRPLGNAVSYVNCAFLGHASVDEQSDTLVLSNLRLAFGAYGTEHAIRAKKVEEFLTGKALTASVVLGAIQLLRETVVPMEGTSHPEYRVSAAVGFLFSFLSPLSKCIPDPGKSLTSSSAGSADTDDVHNLPLSSRRETFSSDEYKPVGEPIKKYGVELQASGEAVYVDDIPVPKNCLYGEFIYSTQPLAYVKSIKFKSSLASEKIVSFVSAKDIPSGGQNIGSSFTFGDEPLFGYPIAEYAGQALGIVIAETQRYADMAAKQVIIEYDTEDLSPAIITVEQAVEKSSYFDVPPELYPKEVGDVSKGMAEADHKIPSTEVKLASEYYFYMETQTALAVPDEHNTLVVYSSTQYPELAQSVIARCLGIPFSNVRVITRRVGGGFGGKAFRSFQVATAAALCAYKLQRPVRMYLNRNTDMVMIGGRHPVKAHYSVGFKSDGKITALHLDLLINAGISPDASPIIPGTIISSVKKYNWGALSFDIKLCKTNNSSKSVMRAPGDTQGSLIADAVIEHVASVLSVDANSVREKNFHTYGTLQLFYPDSAGEASTYTLHSIFDRLVSTSSYLDRAESIKEFNSKNKWRKRGISCVPLIFKVEPRPAPGRVSVLNDGSIVVEVGGIEIGQGLWTKVQQMTAFALGKLWPDGGQSLLERASKDNVNLSASAYWVPGQVSNKYLNYGAGISEVEIDLLTGAITLIRGDLVYDCGKSLNPAVDLGQIEGSFIQGIGFFVYEEYITNSDGLMISNSTWDYKIPSVDIIPKQFNAEVLNTGYHKNRVLSSKASGEPALVLASSVHCALREAIRAARVGFANSTVSGCSPLEFQMDVPAPMTVVKELCGLDIVEKYLERLSTYERVAGA

SEQ ID NO: 6012 - protein, 1252 aa, Panicum virgatum
MSGFHASQCGFCTPGMCMSIFTSLINADKSKRPEPPKGFSKLKVSEAEKAFSGNMCRCTGYRPIVDACRSFASDVDLEDLGLNIFWKRSDKNPDVSELPSYTLGGGVCTFPDFLKSEIKSSLNHLNNAYISASREGWYHPRSIKEYYELINSCLYSDSVKVVVGHTSSGVPGYKDQDLYDKYIDISGIPELSDIVKKESGFEIGAATTIARTIEILEQECESISSPNGCVVFRKLADHMSKVANPFVRNTASIGGNIILAQKYPFPSDIATILLGAGATVCLQVVTERRQITLEEFLEQPPLDPTTLLLSIFIPHWISDYQAETSLLFETYRAAPRPLGNAVSYVNCAFLGLSSVDKQSDTLVLSNLRLAFGAYGTEHAIRAKKVEKFLTGKSLTALVVLGAVQLLRETIVPMEGTSHPEYRVSAAVGFLFSFLSPLAKGIPEPGKALTSGWSDSADTDDVRNLPLSSRRETISNGDYKPVGEPIKKYAVELQASGEAVYVDDIPAPKSCLYGEFIYSTQPLAYVKSIKFKSSLASSKIIDVVTAKDIPCGGENIGSAFMFGGEPLFGDPISEYAGQALGIVIAETQRYADMAAKQVIIEYDTKDLSPPILTVEQAVENSSYFSIPQEYSPKEVGDFSRGMAEADHKIPAAEVKLASEYYFYMETQTALAIPDEDNTLVVYSSSQYPEFAQTVIARCLGIPFSNVRVITRRVGGGFGGKAFRSFQVATAAALCAYKLRRPVRMYLNRNTDMVMIGGRHPVKARYSVGFKSDGKITALHLDLLINAGISPDASPIIPGTIISSVKKYNWGALSFDIKLCKTNNTSKSVMRAPGDTQGSLIADAIIEHVASVLSVDANSVREKNFHTYDTLQLFYPDSAGEASAYTLHSIFDRLVSTSSYLDRAESIKQFNSSNKWRKRGISCVPLIFRAEQKPAPGRVSVLNDGSIVVEVGGIEIGQGLWTKVQQMTAFALGQLWPNGGEDLLERVRVIQADTLNLIQGGLTAGSTGSEASCAATLQACNMLIGRLKPVLDRLQQQSENVSWDTLISQASKENVNLSASAYWVPGQDSYRYLNYGAGISEVEIDLLTGAITILRGDLVYDCGKSMNPAVDLGQIEGSFIQGIGFFIYEEYVTNSDGLMISNSTWDYKIPSVDIIPKQFNAEVLNTGYHKDRVLSSKACGEPALIAASSVHCALREAIRAARKEFANSTGSGSSPLEFQMDVPAPMTLVRELCGFDIVEKYLESLSACERAAGV

SEQ ID NO: 6013 - protein, 1350 aa, Brachypodium distachyon
MKVEKVVFALNGRRYEVVDADPSTTLLEFIRTRTPFKGTKLGCGEGGCGACVVLIAKYNPTKDQVTEFSASSCLTLLYNINFCSVITTEGLGSTQDGFHAIQKRMSGFHASQCGFCTPGMCMSIFTSLVNADKSKNLEPQNGFSKLSVSEAERAFSGNLCRCTGYRPIVDVCKSFASDVDLEDLGLNIFWKKGDKSADVSKLPSYTLGGGVCTFPDFLKSEMKSSLDYLNDSNVAVSREGWYHPKSIEQYYYLLNSGIFSDCSVKVVVGNTSAGVYKDQDLYNKYIDIGGIPELSAISRKDGGIEIGAATPISRTIEVLKQDNDSMSCPNGSVVFRKLAEHMSKVATPFVRNTASLGGNIILAQKYPFASDIATILLGAASTVCLQVTSERLEVTLEEFLEQPPLDPSTLLLSIFIPHWFSDSQKETNVIFETYRAAPRPLGNAVSYINSAFLGNVSLHGSSSDLVLSNLHLAFGAYGTEHAIRATKVEEYLTGKLLTPSVVLQAVRLLRGTIVPKEGTSHPEYRVSVAVGFLFSFLYPLVKGMTGPEKTLSIGCSSSVEEASLPLSSRRETVPSDEYKPVGEPIKKYGVELQASGEAVYVDDIPAPKDCLYGEFIYSTQALAYVKGMKFKPSLASEKIITVVSANDIPSGGQNIGSTFMFGDEPLFGAPIAEFAGQALGVVIAETQRYADLAAKQVVIEYATEDLKPPILTVEQAVQNNSYFKVPPERYPKQVGDFSKGMAEADHKILSTEVKLASQYYFYMETQTALAVPDEDNTMVVYSSSQYPELAQSVIAKCLGIPFSNVRVITRRVGGGFGGKAFRSYNVATAAALCANKLRRPVRMYLNRSTDMIMVGGRHPVKAYYSVGFKSDGKITALHLDVLINAGISPDASPIIPDTIISGLKKYNWGALSFDIKLCKTNNTSKSVMRAPGDTQGSFIADAIIEHVASVLSLDANTVRQKNFHTYDSLVLFYPESAGESSTYTLHSIFDRLLMTSSYLHRAESIKQFNSCNNWRKRGISCVPLIFKVAPRPAPGRVSVLNDGSIIVEVGGIEIGQGLWTKVQQMTAFALGQLWPDGCECLLDRVRVLQADTLNLIQGGLTAGSTASESSCAATLQACNMLTDRLKPVMDKLKQQSGAVSWDSLISQASQDNINLSSTAYWVPGQESSSYLNYGAGISEVEIDLLTGAITLLRSDLVYDCGKSLNPAVDLGQIEGSFIQGIGFFIYEEHETNSDGLVVSDSTWDYKIPSVDTIPKQFNAEVLNTGYHKNRVLSSKASGEPALVLASSVHCAVREAICAARKEFAHSTGSGSSPLTFQLDVPAPMTVVKELCGLDIVDKYLENLSTHQFQC

SEQ ID NO: 6014 - protein, 310 aa, Sorghum bicolor
MSASSFPPRTVICVGDVHGYVTKLESLWSNLEAALPADAFATALVIFLGDYNDRGPDTRRVLDFLLELPTRHPGQRHVFLCGNHDLAFAAFVGALPPPPDGSPFSATWDEYIHNEEHEGWFRGPGYEDMHVQGRRWGGVIKERWNPKKGLPYKGSIYDAQPTFESYGVAHGSPDLAKAVPEEHKRFLHDLVWIHEEENVPIDTDEGQIICNLIAVHAGLERTIDLNEQLRVLRTRDTRVPKVQMLSGRQDVWNTPKDLTGKQTIIVSGHHGKLHIDGLRFIIDEGGGYADKPIAAIVFPSKTLIRSSEAH

SEQ ID NO: 6015 - protein, 314 aa, Panicum virgatum
MSAPSAPPRTVICVGDVHGYITKLESLWSNLQSALPADAFATALVIFLGDYNDRGPHTRRVLDFLLALPQRHPAQRHVFLCGNHDLAFAAFVGVLPPPPDGSPFSATWDEYLHNEEHEGWFRGPGYEDMHVQGRRWGGVIKERWNPKKGLPYRGSIYDAQPTFESYGVAHGSPDLAMAMPEEHKRFLRDLVWIHEEENVPIDTDEGQIICNLIAVHAGLEKSIDLNEQLRVLRTRDTRVPKVPMLSGRQDVWNTPKDLTGKRTIVVSGHHGQLHIDGLRFIIDEGGGYEDKPIAAIVFPSKTLIRSTEGTTSQD

SEQ ID NO: 6016 - protein, 314 aa, Setaria italica
MSAPSAPPRTVICVGDVHGYIAKLESLWSNLQSALPADAFATALVIFLGDYNDRGPHTREVLDFLLALPGRHPAQRHVFLCGNHDLAFAAFVGVLPPPPDGSPFSATWDEYIHNEEHEGWFRGPGYEGMHVQGRRWGGVIKERWNPKKGLPYRGSIYDAQPTFESYGVAHGSPDLAKAVPEDHKMFLHDLVWIHEEENVPIDTDEGQIICNLIAVHAGLEKSIDLNEQLRVLRTRDTRVPKVPMLSGRQDVWNTPKDLTGKHTIVVSGHHGQLHIDGLRFIIDEGGGYEDKPIAAIVFPSKTLIRSTEGAASQN

SEQ ID NO: 6017 - protein, 314 aa, Panicum virgatum
MSAPSAPPRTVICVGDVHGHITKLESLWSNLQSALPAGAFATALVIFLGDYNDRGPHTRGVLDFLLALPRRHPAQRLVFLCGNHDLAFAAFVGALPPPPDGSPFSATWEEYLHNEEHEGWFRGPGYEDMHVQGRRWGGVIKERWNPKKGLPYRGSIYDAQPTFESYGVAHGSPDLAMAMPEEHKRFLRDLVWIHEEENVPIDTDEGQIICNLIAVHAGLEKSIDLNEQLRVLRTRDTRVPKVPMLSGRQDVWNTPKDLTGKRTIVVSGHHGQLHIDGLRFIIDEGGGYEDKPIAAIVFPSKTLIRSTEGTTSQD

SEQ ID NO: 6018 - protein, 334 aa, Sorghum bicolor
MSAPSAAPPPPRTVICVGDVHGYVTKLESLWSNLEAALPADAFATALVIFLGDYNDRGPDTRRVLDFLLALPTRHPAQRHVFLCGNHDLAFAAFVGALPPPPDGSPFSATWDEYIHYEEHEGWFRGPGYEGMHVQGRRWGGVIKERWNPKKGLPYKGSIYDAQPTFESYGVAHGSPELAKAVPVEHKRFLHDLVWIHEEENVPIDTDEGQIICNLIAVHAGLERTIDLNEQLRVLRTRDTRVPKVQMLSGRQDVWNTPKDLAGKQTIIVSGHHGKLHIDGLRFIIDEGGGYEDKPIAAIVFPSKTLIRSTEETGCSFFSLVITACTHVSYVKRQ

SEQ ID NO: 6019 - protein, 314 aa, Brachypodium distachyon
MAPASPPPRTVICVGDVHGFISKLESLWANLQSALPADAFATALVIFLGDYCDRGPHTRRVLDFLLALPARHPAQRHVFLCGNHDLAFAAFVGALPPPPDGSPFAATWPEYIDNEAHEGWFHGPGHEDMHVQGRRWGGVIKERWNPKKGLPYKGSIYDAQPTFESYGVAHGSPDLTKAVPEEHKRFLHDLVWIHEGENVPIDTDEGQIVCKLIAVHAGLEKSIDLNEQLRVLRTRDTRVPKVQMLSGRQDVWNIPEDLAGKQTVIVSGHHGKLHIDGLRFIIDEGGGYEDKPIAAVVFPSKQLIRSTEGTAPLD

SEQ ID NO: 6020 - protein, 311 aa, Hordeum vulgare
MASPPRTVICVGDVHGYISKLESLWANLQAALPADAFAAALVIFLGDYNDRGPHTRRVLDFLLALPARHPAQRHVFLCGNHDLAFAAFVGALPPPPDGSPFAATWAQYIDNEAHEGWFRGPGHEDMHVQGRRWGGVIKERWNPKKGLPYKGSIYDAQPTFESYGVAHGSPDLVKAVPEEHKKFLHDLVWVHEEEDVPIDTDGGQILCKLIAVHAGLEKSLDLNEQLRVLRTRDTRVPKVQMLSGRQDVWNIPQGLAGKQTIVVSGHHAKLHLDGLRFIIDEGGGYADKPIAAVVFPSKEVIRSSEGTASRN

SEQ ID NO: 6021 - protein, 310 aa, Secale cereale
MAPPRTVICVGDVHGYISKLESLWANLQSALPADAFAAALVIFLGDYNDRGPHTRRVLDFLLALPARYPAQRHVFLCGNHDLAFAAFVGALPPPPDGSPFAATWAQYIDNEAHEGWFRGPGHEDMHVQGRRWGGVIKERWNPKKGLPYKGSIYDAQPTFESYGVAHGSPDLMKAVPEEHKKFLHDLVWVHEEEGVPIDTDGGQILCKLIAVHAGLEKSLDLNEQLRVLRTRDTRVPKVQMLSGRQDVWNIPQDLAGKQTIVVSGHHAKLHVDGLRFIIDEGGGYADKPIAAVVFPSKEVIRSTEGMASQN

SEQ ID NO: 6022 - protein, 109 aa, Triticum aestivum
MAPPRAVICVGDVHGYISKLESLWANLQSALPADAFAAALVIFLGDYNDRGPHTRRVLDFLLALPARHPAQRHVFLCGNHDLAFAAFVGALPPPPDGSPFRRHLGPIHR

SEQ ID NO: 6023 - protein, 310 aa, Pseudoroegneria spicata
MAPPRTVICVGDVHGYISKLESLWANLQSALPADAFATALVIFLGDYNDRGPHTRRVLDFLLALPARHPAQRHVFLCGNHDLAFAAFVGALPPPPDGSPFAATWAQYIDNEAHEGWFRGPGHEDMHVQGRRWGGVIKERWNPKKGLPYKGSIYDAQPTFESYGVAHGSPDLMKAVPEEHKKFLHDLVWVHEEEDVRIDTDGGQILCKLIAVHAGLEKSLDLNEQLRVLRSRDTSVPKVQMLSGRQDVWNIPQDLAGKQTIVVSGHHGKLHVDGLRFIIDEGGGYADKPIAAVVFPSKEVIRSSEGTTSQN

SEQ ID NO: 6024 - protein, 310 aa, Triticum aestivum
MAPPRAVICVGDVHGYISKLESLWANLRSALPADAFATALVIFLGDYNDRGPHTRRVLDFLLALPARHPAQRHVFLCGNHDLAFAAFVGALPPPPDGSPFAATWAQYIDNEAHEGWFRGPGHEDMHVQGRRWGGVIKERWNPKKGLPYKGSIYDAQPTFESYGVAHGSPDLMKAVPEEHKKFLHDLVWVHEEEDVRIDTDGGQILCKLIAVHAGLEKSLDLNEQLRVLRTRDTSVPKVQMLSGRQDVWNIPQDLAGKQTIVVSGHHGKLHVDGLRFIIDEGGGYADKPIAAVVFPSKEVIRSTEGTASQN

SEQ ID NO: 6025 - protein, 297 aa, Triticum aestivum
MAPPRTVICVGDVHGYISKLESLWANLQSALPADAFAAALVIFLGDYNDRGPHTRRVLDFLLALPARHPAQRHVFLCGNHDLAFAAFVGALPPPPDGSPFAATWDQYIDNEAHEGWFRGPGHEDMHVQGRRWGGVIKERWNPKKGLPYKGSIYDAQPTFESYGVAHGSPDLMKAVPEEHKKFLHDLVWVHEEEDVRIDTDGGQILCKLIAVHAGLEKSLDLNEQLRVLRTRDTRVPKVQMLSGRQDVWNIPQDLAGKQTIVVSGHHGKLHVDGLRFIIDEGGGYADKPIAAVVFPSK

SEQ ID NO: 6026 - protein, 86 aa, Triticum aestivum
MASAGEAPSTLLRFLYFVGAGVICTKAINTYRDYEHKKESTAALAAAESALAAAAAAEPAPATAAANPDCGRGLSSAVRVSECCSP

SEQ ID NO: 6027 - protein, 340 aa, Sorghum bicolor
MSHADVEAGAPAARAAPPATTGIKPPPGRYNTTSNAPYVQPSPFYYDHAAAHERHHWSWLVPLVVIANVAMFVVVMFYNNCPRGGGDCVGRGFLRRFSFQPLKENPLLGPTAATLQKYGALDWYKVVHGNQAWRLESCTWLHAGLIHLLANMISLIFIGVRLEQQFGFWRVGLVYLVSGFGGSVLSVLFIRKGVSVGASGALFGLLGAMLSELITNWSIYTNRFAAMLNLIIIAAINLALGILPHVDNFAHIGGFATGFLLGFVLLIQPQFGWLEQPYGSKTKSKYKAYQIILLIAALVLLAAGLAVGLVMVFRGENGNDHCGWCHYLTCVPTSSWKCDN

SEQ ID NO: 6028 - protein, 343 aa, Setaria italica
MSNADVEAGGPARAAPATTGIKPPPGRYNMTAGNGNGSAPYMPPSPFYYDNAAAHERHHWAWLVPLVVIANVAMFVVVMFYNNCPRGGGDCVGRGFLRRFSFQPLKENPLLGPSAATLQKYGALDWYKVVRGNQAWRLESCTWLHAGLIHLLANMISLIFIGVRLEQQFGFWKVGLVYLVSGFGGSVLSVLFIRKGVSVGASGALFGLLGAMLSELITNWTIYTNRFAAMLNLVIIAAINLALGILPHVDNFAHIGGFATGFLLGFVLLIQPQFGWLEQPFGSKSKSKYKAYQIILLLLALVLLAAGFAVGLVMVFRGENGNDHCRWCHFLTCVPTSSWKCDN

SEQ ID NO: 6029 - protein, 342 aa, Panicum virgatum
MSNPDVEAGGPARAAPATTGIKPPPGRYSMAGNGNGSAPYVAPSPFYYDNAAAHERHHWSWLVPLVVIANVAMFVVVMFANNCPRGGGDCVGRGFLRRFSFQPLKENPLLGPSAATLQKYGALDWYKVVHGNQAWRLESCTWLHAGLIHLLANMISLIFIGVRLEQQFGFWKVGLVYLVSGFGGSVLSVLFIRKGVSVGASGALFGLLGAMLSELITNWTIYTNRFAALVNLIIIAAINLAVGMLPHVDNFAHIGGFATGFLLGLVLLIQPQFGWLEQPFGAKSKSKYKAYQIILLLLALVLLAAGFAVGLVMVFRGENGNDHCSWCHYLTCVPTSSWKCDN

SEQ ID NO: 6030 - protein, 343 aa, Panicum virgatum
MSNPDVEAGGPARAAPATTGIMPPPGRYSVVGNGNGSAPPYVAPSPFYYDNAAAHERHHWSWLVPLVVIANVAMFVVVMFANNCPRGGGDCVGRGFLRRFSFQPLKENPLLGPSAATLQKYGALDWYKVVHGSQAWRLESCTWLHAGLIHLLANMISLILIGVRLEQQFGFWKVGLVYLVSGFGGSVLSVLFIRKGVSVGASGALFGLLGAMLSELITNWTIYTNRFAALVNLLIIAAINLAVGILPLVDNFAHIGGFATGFLLGFVLLIQPQFGWLEQPFGAKSKSKYKAYQIILLLLALVLLAAGFAVGLVMVFRGENGNDHCSWCHYLTCVPTSSWKCDN

SEQ ID NO: 6031 - protein, 318 aa, Pennisetum glaucum
MTAGNGHVNGNGSAPYMPPSPFYYDNAAAHERHHWAWLVPLVVIANVAMFVVVMFYNNCPRGSGDCVGRGFLRRFSFQPLKENPLLGPSATTLQRYGALDWNKVVHGNQAWRLESCTWLHAGLIHLLANMISLIFIGVRLEQQFGFWKVGLVYLVSGFGGSVLSVLFIRKGVSVGASGALFGLLGAMLSELITNWTIYTNRCAAMFNLIIIAAINLALGILPHVDNFAHIGGFATGFLLGFVLLIQPQFGWLEQPFGSKSKSKYKVYQIILLLLALVLLAAGFAVGLVMVFRGENGNDHCSWCHYLTCVPTSSWKCDN

SEQ ID NO: 6032 - protein, 343 aa, Brachypodium distachyon
MSNGDMEAGAPARAATTTGIKPPPGRYNADGHGPQYAAAGAPVSPFYYAAAAAQEKQHRTWLVPLVVLANVAMFIVVMYYNDCPRSGNGDCVGRGVLRRFSFQPLKENPLFGPSATTLGKYGGLDRYKVVRGNEAWRLETSTWLHAGLIHLGANMISLIFVGVRLEQQFGFWKVGLVYLVSGLGGSILSVLFIRNGVSVGASGALFGLLGAMLSELITNWSIYTNRIAAMANLIIIAAINLALGILPHVDNFAHIGGFATGFLLGFVLLIQPRFGWLEQPFGAKSKSKYTACQIILLVVALILSIAGFAVGLLMVFRGVNGNDHCSWCHYLTCVPTSSWKCDN

SEQ ID NO: 6033 - protein, 67 aa, Panicum virgatum
MGWLRAVLSPLRRLWCRANAVQRKKRGIYILYDDVKSCQCEDVHVLWSILVESHGLPPATPMLSLKR

SEQ ID NO: 6034 - protein, 70 aa, Sorghum bicolor
MGWLRAVLSPLRKLWCRVNAVQQQRKKRGIYILYDDVKSCQCEDVHVLWSILVESHGLPPPTPMPSPPVL

SEQ ID NO: 6035 - protein, 68 aa, Panicum virgatum
MGWLRAVLSPLRRLWCRAKAVQRKKRGIYILYDDVRSCQCEDVHVLWSILVESHGLPPPPPPMLSLKR

SEQ ID NO: 6036 - protein, 81 aa, Eragrostis curvula
MRRRGRRRMRLRRGWLRSLLSPLRKLWCRVNAVQRKKRRGIYILYDDVKSCQCEDVHVLWSILVESYGLPPPTPPVLRLKR

SEQ ID NO: 6037 - protein, 72 aa, Setaria italica
MGWLRSVLSPLRRLWCRVNAVQRKKRGIYILYDDVKSCQCEDVHVLWSILVESHGLPPPTPMPTPPALSLKR

SEQ ID NO: 6038 - protein, 368 aa, Setaria italica
MAGTTGGAAATAPGKKGETPAATRSGALKRLPLALLVFFAALLYSQIQPPPSKVPGAPGGPPVTAPRTRLRDGRHLAYLESGVPKEEARYKIIFVHGFDCCRYDVLNVSQGLLQELGIYLLSFDRPGYAESDAHPARTEKSIALDIAELADNLQLGPKFHLIGFSMGGEIMWSCLKYIPHRLAGVAILAPVGNYWWSGFPADVVEEAWYVQFPQDQRAVWVAHHLPWLTHWWNTQNLFHSSSVKGKNPIILSKEDTALSQKFLDRTYKEQVRQLGEHDSLHRDMMVGFGKWGWSPLEMENPFAGAGDEVKVHLWHGVEDLFVPVQLSRYISKKLPWVIYHELPTAGHLFPAADGMPDVIVRSLLLGDE

SEQ ID NO: 6039 - protein, 372 aa, Panicum virgatum
MATSGRREGSTAPGKSGALPAAAARSGALRRLALALLVMLFSALLYGQIQPPPSKIPGAPGGPPVTAPRTRLMDGRHLAYLESGVPKEEAKYKIIFVHGFHCCIYDVLNVSQGLLQELGIYLLSFDRPGYAESDAHPARTEKSIALDIAELADNLQLGPKFHLIGFSMGGEIMWSCLKHIPHRLAGVAILAPVGNFWWSGFPPGGGRGGWNVQFPQDRRAVWVAHHLPWLTHWWNTQTLFPGSSVKSKNPVILSKEDLPLSQKFIDRPYKDQVRQLGEHDSLHRDMMVGFGRWSWSPLEMENPFAGSGEDGEVKVHLWHGVEDLYVPVQLSRYISKRLPWVIYHELPTAGHLFPVADGMPDAIVRSLLLGDE

SEQ ID NO: 6040 - protein, 372 aa, Pennisetum glaucum
MAGTTSDAASAATAPGKKSGAPPAAAHSGALKRLLLALLVFSAALLYNQIQPPPSKVPGAPGGPPVTAPRTRLRDGRHLAYLESGVPKEDARYKIIFVHGFDCCRYDVLNVSQGLLQELGIYLLSFDRPGYAESDAHPARTEKSIVLDIEELADNLQLGPKFHLIGYSMGGEIMWSCLKYIPHRLAGVAILGPVGNYWWSGFPADVVEEAWYVQFPQDQRAVWVAHHLPWLTHWWNTQNLFRSSSVKGKNPIILSKEDMPLSKKFLDRTYKAQVRQLGEHDSLHRDMMVGFGKWGWSPLEMENPFTGAGEEEVKVHLWHGVEDLFVPVQLSRYISKKLPWVIYHELPTAGHLFPAANGMPDVIVRSLLLGDE

SEQ ID NO: 6041 - protein, 397 aa, Panicum virgatum
MAAEQAAAATGGEPPPATPQPAEGVTAAAGQRSVPTPFLTKTYQLVDDPAVDDVISWNNDGSAFVVWRPAEFALDLLPKYFKHNNFSSFVRQLNTYGFRKIVPDRWEFANDCFRRGEKRLLCDIHRRKVTPAMATGAAVTVAAAAAAIPMALPVGSPVYSGEEQVLSSSSSPEPPPLQPQAASGSGSGGAASGGDAGEENDRLRRENARLARELGQMKKLCNNILLLMSKYAATQQLDAAKAAAAGNCSGESSEAAATLPSVLELLPSCRGGPAPAAALEPPEAAAGTEREQDDDDKAGARLFGVSIGRKRARDDTSNGHAGGAAAEVKAEPVDAHPDHHLHQLPQLRDDDHHHGGTEPQAWPIYRPRPVYHPLRACNGSAGSAGTGSDHDVSNSSR

SEQ ID NO: 6042 - protein, 396 aa, Sorghum bicolor
MAAEHAAAAVGEPPPPAATTTQPPAEGVTAAPAAAAGQRSVPTPFLTKTYQLVDDPAVDDVISWNDDGSAFIVWRPGEFARDLLPSTSSTTTSPASCASSTPTKIVPDRWEFANDCFRRGEKRLLCDIHRRKVTAATGAVTVAAAIPMALPVGSPVYSGEEQVLSSSSSPEPSLQQQPPAPSGSGSGGVPSGDVGEENERLRRENARLARELGQMKKLCNNILLLMSKYAATQQQPDAAAAKQAAAAAGNCSGESAEATAAAPPPPLPSILELLPSCRGDPAPDAAVETAAAVGTEHEVVEKAGARLFGVSIGRKRMRDESNGGVFEDYPASRAAEVKAEPVEAAHPDQRQQENNATEPVPQSWPIYRPRPVYHPLRACNGSGSAGSDHDGSTNSR

SEQ ID NO: 6043 - protein, 564 aa, Sorghum bicolor
MAGTASPAAGYGSDGVYRSPRAAAQIASDPGLSLADLVLRRAAACPSAPALVDAATGRALTFGSLRSAVLVAAAALSSRAGVRRGDAVLLLAPNCVLYPVCFLAVTSLGAVATTANPRYTPREIAKQAADARAKLVVTVSDLLPKIAGLRLPTVLLDGDGGGAPVPSSDCPSRSSNVTLYSDLVAGVQEAEYRRPPAVGQGDTAALFYSSGTTGESKGVVLTHRNFIAAATMVTSDQDELGEGGRNVFLCFLPMFHIFGMAVVTLGQLQRGNAVVVMARFDVDAVLAAVERHRVTYIFGAPPAMIALAKHGGGRRYDLSSLRCIGSGAAPLGKDVMVAMADRFPAPTLSRWEVLLLQGYGMTETCGIISLEYVQKGRARQFGSTGALVIGVEAKIVDTKTMKHLPPNQLGEICVRGPNIMEGYFNNVQATEFTIKQGWLHTGDLGYFDERGQLHVVDRLKELIKYKGFQIAPAELEGLLLSHPEILDAAVIPYPDPEAGEVPIAYVVRSPKSSLAEVDVQKFIEKQVAHYKRLRKVKFVDSVPKSAAGKILRRELIAQVRSSKL

SEQ ID NO: 6044 - protein, 550 aa, Setaria italica
MAEGTESPAAGYGSDGVYRSPRPAAPIPSDPALSLSDLVLRRAAACPSAPALVDAATGAALTFGALRSAVLGAAAALSSRARIRRGDVVLLLAPNCVLYPVCFLAVTAIGAVATTANPLYTPREIAKQAADARAKLVVTVSDLLPKIADLRLPTILLDGDGASVPPGHANDVTLYPDLVAGVHETEYRRPPTRQSDTAALFYSSGTTGESKGVVLTHGNFIAAAAMVTSDQDERGEGRNVLLCFLPMFHIFGMSVVTLGQLQRGNTVVVMARFDVDAVLAAVERHRVTYLFCAPPVMIALAKHRGGGRYDLSSLRCIGSGAAPLGKDVMEAVADKFPNAEIIQGYGMTETCGIISLEYPQKGRARQFGSTGALVTGVEAKIVDTKTMKHLPPNQLGEICLRGPNIMQGYFNNVKATEFTIKQGWLHTGDLGYFDERGQLYVVDRLKELIKYKGFQIAPAELEGLLLSHAQILDAVVIPYPDPEAGEVPIAYVVRSPKSSLSEVDVQKFIEKQVTHYKRLRKVTFVDSVPKSVSGKILRRELIAQVRSSKL

SEQ ID NO: 6045 - protein, 131 aa, Sorghum bicolor
MRPAATAAADAHQSRLLYELCALLLTVLRASPDDGAVARPLLPRQVTPAGVASMLLGASMALMLCGSVTFMLGFFLMPWVVGLGFLFLFVGFVTNLSGIWRAILLWPSAADSPKEASSPWHIFSKPSFMSM

SEQ ID NO: 6046 - protein, 132 aa, Zea mays
MRPAAPAAAADAHQSRLLYELCALLLTVLGASPDDGAGARPLLPRQVTPAGVASMLLGASMALMLCGSVTFMLGFFLMPWVVGLGFLFLFVGFVTNLSGIWRAILLWPSAACSPKEASSPWHILPKPSFMSM

SEQ ID NO: 6047 - protein, 131 aa, Pennisetum glaucum
MRPAAEDAHQSRLLYELCTLLLTVLRASPEDGAGLRPLLPRQVTPAGLASMLLGASMALMLCGSVTFMLGFFLMPWVVGLGCVFLFVGFVTNLSGIWRAILLWPAAACSASPKEASSSPWHIFSKPPFMPM

SEQ ID NO: 6048 - protein, 136 aa, Setaria italica
MRPVATAAEDAHQSRLLYELCALLLTVLRASPEDGAGAGPRPLLPRQVTPAGVASMLLGASMALMLCGSVTFMLGFFLMPWVVGLGCVFLFVGFVTNLSGIWRAILLWPAAACSASPKEASSSPWHIFSKPPFMPM

SEQ ID NO: 6049 - protein, 442 aa, Sorghum bicolor
MAGSSSMDTEAAGQQLKHGSGYSIPATAHAVDTDSWQQVGLLMVIGFNCAYVLSFSNLMMVPLGWAWGVACLLLVGAAAWYANWLLAGLHFVDGQRFIRYRDLMGFVFGRNMYYITWFLQFTTLLLCNMGFILLGARALKAINSEFTHTPARLQWFVTATGFIYFAFAYFVPTISAMRNWLATSAALTLAYDVALLAILIRDGKSNKQKDYNVHGTQAEKVFNALGAVAAIVVCNTSGLLPEIQSTVREPAVRGMRRALLLQYTAGAAGYYGISVAGYWAYGSAVSEYLPNELGGPRWAAVLINATAFLQSIVSQHLFTVPIHEAMDTRLQRLDEGMFSRYNLTRRLCARGLVFGFNVFVTALFPFMGDFVNLVGSFALVPLTFTFPSMAILKIKGKSGGRCNRLWHWGIIVFSSVLCVATTAAAVRLIFNNARIYHFFADM

SEQ ID NO: 6050 - protein, 478 aa, Setaria italica
MASSSMDTEAAGQELKGSDYTVSATAHAVDSDSWQQVGLLLVIGFNCAYVLSFSNLMMAPLGWGWGVACLLLVGAAAWYANWLLAGLHFVDGQRFIRYRDLMGFVFGRKMYYITYFLQFATLLLCNMGFILLGARALKAINVEFTHSPARLQWFITATGIIYFAFAYFVPTISAMRNWLATSAALTLAYDVALLAILIRDGKSNNNQKIQRPWQPIREGVQRAGRVAAILVCNTPGLLPGDTVDGAGAVGARDAAGAAAAVHRRRRRVLRHQRGGVLGVRVGGVRVPPQPARRAAVGRRAHQRRRLPAERRLPTPVRGADPRGDGHAAAAAGRGHVLPVQPDAPLLRAGAHLRLQRLRHRAVPVHGGLRQPRRLLLPRPAHLHVPQHGHPQDQGEEWWEMEQALALGRHRFLHASLRRYHRLRSSFDLQQCQDLPLLRRHMILHVPLILLNINGIDEQCDGEFVKLELCIDFLILRRI

SEQ ID NO: 6051 - protein, 236 aa, Setaria italica
MPPTTPAPARPCPPPAPAAAPIRPQLLSSVAPLALAAALVCGAGPAADAPAARAVPFVRPPPLQGKPFASSTPYAQSQKLQLGLDKLGKIRPCPSTNPGCVSTNALGSSGSFASPLVIPESSAGDKAVASLRQAIEKTQSNVDFKVDQDTPYGHYIEAEMDGGVGRDVMEFLVKKDAGVVAYRCMATKVTFVYPFTTAVGDSKGQKQRIAAISQELGWYAPDIQSSMDFDDAGYPP

SEQ ID NO: 6052 - protein, 244 aa, Sorghum bicolor
MPPGTTAPAPAAAPAAAPIRTHLLTSVAKVALTAALVCGGGGGGGPAAVVVVVPAAAHAVPFVRPPPPLQLQGKSFAASTPYAQSQKLQLGLDKLGKIRACPSTNPGCVSTNALGSSGSFASPLIIPESSAAGEKAVISLRQAIEKTQSNVDLKVDEDTPYGHYIEAEMDGGVGRDVMEFLVKKDAGVVAYRCMATKVTFVYPFTTAVGDSKGQKQRIAAISQELGWYAPDIQSSIDSDDDAPP

SEQ ID NO: 6053 - protein, 230 aa, Panicum virgatum
MPAPPCPPPAPEAAPILPRLLSSVAPAALAAALACGAGPGPAAVVAQAVPFVRPPPQQGRPFAAPTPYAQSQKLQLGLDKLGKIRPCPSTNPGCVSTNPLGSSGSFASPLLIPESSAGDKAVQALRQAIEKTQSNVDFKVDEDTPYGHYIEAEMDGGVGRDVMEFLVKGDAGVVAYRCMATKVTFVYPFTTAVGDSTGQKQRVAAISQELGWYAPDIQSSMDSDDAGYPP

SEQ ID NO: 6054 - protein, 391 aa, Sorghum bicolor
MDRMLPGTVTVKEEWPPEEEEEEEVVVEDVDAPRPMEGLHEVGPPPFLTKTFDLVADPATDEVISWGRAGNSFVVWDPHVFAAVLLPRFFKHNNFSSFVRQLNTYGFRKIDPDRWEFANEGFLRGQRHLLRLIKRRRPAPPPPYLQASQSQSQGSCLEVGQFGGLDGEMDRLRRDKSILLAEVVKLRQEQQSTRAGMRAMEERLQHAEHKQVQMMGFLARAMQSPDFFQQLAQQQDRRRELEGALMLSAAASRKRRRPIGTAPALLDGGVQEEEEEEQAADDDPTATQALFAELDERGTTSELENLALNIQGLGSSKRRQGGGGARSQQRAAAVGGGETAELTDDFWEELLNEGMRGGAAAELLPPERRRPGWYVDALAQKLSSMSNTTAK

SEQ ID NO: 6055 - protein, 245 aa, Sorghum bicolor
MATRIQFENNCEVGVFSKLTNAYCLVAIGGSENFYSAFEAELADAIPVVKTSIGGTRIIGRLCVGNKNGLLLPHTTTDQELQHLRNCLPDQVVVQRIDERLSALGNCIACNDHVALTHPDLDKETEEFIADVLGVEVFRQTIAGNILVGSYCAFSNRGGLVHPHTSVEDLDELSTLLQVPLVAGTVNRGSEVIAAGMTVNDWTAFCGSDTTATELSVIESVFKLREGQPTAIVEDMRKSLIDSYV

SEQ ID NO: 6056 - protein, 245 aa, Panicum virgatum
MATRIQFENNCEVGVFSKLTNAYCLVAIGGSENFYSAFEAELADSIPVVKTSIGGTRIIGRLCVGNKNGLLLPHTTTDQELQHLRNCLPDQVVVQRIDERLSALGNCIACNDHVALTHPDLDKETEEFIADVLGVEVFRQTIAGNILVGSYCAFSNRGGLVHPHTSIEDLDELSTLLQVPLVAGTVNRGSEVIAAGMTVNDWTAFCGSDTTATELSVIESVFKLREGQPTAIVDDMRKSLIDSYV

SEQ ID NO: 6057 - protein, 245 aa, Cenchrus ciliaris
MATRIQFENNCEVGVFSKLTNAYCLVAIGGSENFYSAFEAELADSIPVVKTSIGGTRIIGRLCVGNKNGLLLPHTTTDQELQHLRNCLPDQVVVQRIDERLSALGNCIACNDHVALTHPDLDKETEELIADVLGVEVFRQTIAGNILVGSYCAFSNRGGLVHPHTSIEDLDELSTLLQVPLVAGTVNRGSEVIAAGMTVNDWTAFCGSDTTATELSVIESVFKLREGQPTAIVDDMRKSLIDSYV

SEQ ID NO: 6058 - protein, 245 aa, Setaria italica
MATRIQFENNCEVGVFSKLTNAYCLVAIGGSENFYSAFEAELADSIPVVKTSIGGTRIIGRLCVGNKNGLLLPHTTTDQELQHLRNCLPDQVVVQRIDERLSALGNCIACNDHVALTHPDLDKETEEFIADVLGVEVFRQTIAGNILVGSYCAFSNRGGLVHPHTSIEDLDELSTLLQVPLVAGTVNRGSEVIAAGMTVNDWTAFCGSDTTATELSVIESVFKLREGQSTAIVDDMRKSLIDSYV

SEQ ID NO: 6059 - protein, 245 aa, Unknown
  Sequence found in Organisms: Hordeum vulgare, Pseudoroegneria spicata, Triticum aestivum
MATRIQFENNCEVGVFSKLTNAYCLVAIGGSENFYSTFESELADVIPVVKTSIGGTRIIGRLCVGNKNGLLLPHTTTDQELQHLRNCIPDQVVVQRIDERLSALGNCISCNDHVALTHPDLDKATEELIADVLGVEVFRQTIAGNILVGSYCAFSNRGGLVHPHTSIEDLDELSTLLQVPLVAGTVNRGSEVIAAGMTVNDWTAFCGSDTTATELSVIESVFKLREGQPTAIVDDMRKSLIDSYV

SEQ ID NO: 6060 - protein, 245 aa, Brachypodium distachyon
MATRIQFENNCEVGVFSKLTNAYCLVAIGGSENFYSTFESELADVIPVVKTSIGGTRIIGRLCVGNKNGLLLPHTTTDQELQHLRNCLPDQVVVQRIDERLSALGNCISCNDHVALTHPDLDKATEELIADVLGVEVFRQTIAGNILVGSYCTFSNRGGLVHPHTSIEDLDELSTLLQVPLVAGTVNRGSEVIAAGMTVNDWTAFCGSDTTATELSVIESVFKLREGQPTAIVDDMRKSLIDSYV

SEQ ID NO: 6061 - protein, 245 aa, Avena sativa
MATRIQFENNCEVGVFSKLTNAYCLVAIGGSENFYSTFESELADVIPVVKTSIGGTRIIGRLCVGNKNGLLLPHTTTDQELQHLRNCLPDQVVVQRIDERLSALGNCISCNDHVALTHPDLDKATEELIADVLGVEVFRQTVAGNILVGSYCAFSNRGGLVHPHTSIEDLDELSTLLQVPLVAGTVNRGSEVIAAGMTVNDWTAFCGSDTTATELSVIESVFKLREGQPTAIVDDMRKSLIDSYV

SEQ ID NO: 6062 - protein, 185 aa, Lolium multiflorum
MATRIQFENNCEVGVFSKLTNAYCLVAIGGSENFYSTFESELADVIPVVKTSIGGTRIIGRLCVGNKNGLLLPHTTTDQELQHLRNCLPDQVVVQRIDERLSALGNCISCNDHVALTHPDLDKATEELIADVLGVEVFRQTIAGNILVGSYCAFSNRGGLVHPHTSIEDLDELSTLLQVPWLLEP

SEQ ID NO: 6063 - protein, 245 aa, Leymus cinereus x Leymus triticoides
MATRIQFENNCEVGVFSKLTNAYCLVAIGGSENFYSTFESELADVIPVVKTSIGGTRIIGRLCVGNKNGLLLPHTTTDQELQHLRNCIPDQVVVQRIDERLSALGNCISCNDHVALTHPDLDKATEELIADVLGVEVFRQTIAGNILVGSYCAFSNRGGLVHPHTSIEDLDELSTLLQVPLVAGTVNRGSEVIAAGMTVNDWTAFCGSDTTATELSVIESVFKLREAQPTAIVDDMRKSLIDSYV

SEQ ID NO: 6064 - protein, 245 aa, Oryza sativa
MATRIQFENNCEVGVFSKLTNAYCLVAIGGSENFYSAFESELADVIPVVKTSIGGTRIIGRLCVGNKNGLLLPHTTTDQELQHLRNCLPDQVVVQRIDERLSALGNCVACNDHVALTHPDLDKATEELIADVLGVEVFRQTIAGNILVGSYCAITNRGGLVHPHTSIEDLDELSTLLQVPLVAGTVNRGSEVIAAGMTVNDWTAFCGSDTTATELSVIESVFKLREGQPAAIVDDMRKSLIDSYV

SEQ ID NO: 6065 - protein, 245 aa, Secale cereale
MATRIQFENNCEVGVFSKLTNAYCLVAIGGSENFYSTFESELADVIPVIKTSIGGTRIIGRLCVGNKNGLLLPHTTTDQELQHLRNCIPDQVVVQRIDERLSALGNCISCNDHVALTHPDLDKATEELIADVLGVEVFRQTIAGNILVGSYCAFSNRGGLVHPHTSIEDLDELSTLLQVPLVAGTVNRGSEVIAAGMTVNDWTAFCGSDTTATELSVIESVFKLREGQPTAIVDDMRKSLIDSYV

SEQ ID NO: 6066 - protein, 245 aa, Avena sativa
MATRIQFENNCEVGVFSKLTNAYCLVAIGGSENFYSTFESELADVIPVVKTSIGGTRIIGRLCVGNKNGLLLPHTTTDQELQHLRNCLPDQVVVQRIDERLSALGNCISCNDHVALTHPDLDKATEELIGDVLGVEVFRQTVAGNILVGSYCAFSNRGGLVHPNTSIEDLDELSTLLQVPLVAGTVNRGSEVIAAGMTVNDWTAFCGSDTTATELSVIESVFKLREGQPTAIVDDMRKSLIDSYV

SEQ ID NO: 6067 - protein, 245 aa, Arachis hypogaea
MATRLQFENNCEVGVFSKLTNAYCLVAIGGSENFYSVFESELADVIPVVKTSIGGTRIIGRLCAGNKNGLLLPHTTTDQELQHLRNCLPDQVVVQRIEERLSALGNCIACNDHVALTHTDLDRETEEMIADVLGVEVFRQTIAGNILVGSYCAFSNRGGLVHPHTSIEDLDELSTLLQVPLVAGTVNRGSEVIAAGMTVNDWTAFCGSDTTATELSVIESVFKLREAQPSAIVDEMRKSLIDSYV

SEQ ID NO: 6068 - protein, 245 aa, Arachis hypogaea
MATRLQFENNCEVGVFSKLTNAYCLVAIGGSENFYSAFEAELADVIPVVKTSIGGTRIIGRLCVGNKNGLLLPHTTTDQELQHLRNSLPDQVVVQRVDERLSALGNCIACNDHVALAHTDLDKETEELIADVLGVEVFRQTIAGNILVGSYCALSNRGGLVHPHTSIEDLDELSTLLQVPLVAGTVNRGSEVIAAGMTVNDWTAFCGSDTTATELSVIESVFKLREAQPNAIANEMRKSLIDSYV

SEQ ID NO: 6069 - protein, 245 aa, Cajanus cajan
MATRLQFENNCEVGVFSKLTNAYCLVAIGGSENFYSAFEAELADVIPVVKTSIGGTRIVGRLCVGNKNGLLLPHTTTDQELQHLRNSLPDQVVVQRIEERLSALGNCIACNDHVALTHTDLDRETEEMIADVLGVEVFRQTIAGNILVGSYCAFSNRGGLVHPHTSIEDLDELSTLLQVPLVAGTVNRGSEVIAAGMTVNDWTAFCGSDTTATELSVIESVFKLREAQPSAIVDEMRKSLIDTYV

SEQ ID NO: 6070 - protein, 245 aa, Vigna unguiculata
MATRLQFENNCEVGVFSKLTNAYCLVAIGGSENFYSAFETELADVIPVIKTSIGGTRIVGRLCVGNKNGLLLPHTTTDQELQHLRNSLPDQVVVQRIEERLSALGNCIACNDHVALTHTDLDKETEEMIADVLGVEVFRQTIAGNILVGSYCAFSNRGGLVHPHTSIEDLDELSTLLQVPLVAGTVNRGSEVIAAGMTVNDWTAFCGSDTTATELSVIESVFKLREAQPSAIVDEMRKSLVDSYV

SEQ ID NO: 6071 - protein, 245 aa, Elaeis guineensis
MATRIQFENSCEVGVFSKLTNAYCLVAIGGSENFYSAFEAELADVIPVVKTSIAGTRIIGRLCAGNKNGLLLPHTTTDQELQHLRNSLPDQVVVQRIEERLSALGNCIACNDHVALTHPDLDRETEELIADVLGVEVFRQTIAGNILVGSYCAFSNRGGLVHPHTSIEDLDELSTLLQVPLVAGTVNRGSEVIAAGMTVNDWTAFCGSDTTATELSVVESVFKLREAQPSSIVDEMRKSLIDSYV

SEQ ID NO: 6072 - protein, 245 aa, Cajanus cajan
MATRLQFENNCEVGVFSKLTNAYCLVAIGGSENFYSVFESELADVIPVVKTSIGGTRIIGRLCAGNKNGLLLPHTTTDQELQHLRNSLPDQVVVQRIDERLSALGNCIACNDHVALTHTDLDRETEEMIADVLGVEVFRQTIAGNILVGSYCAFSNRGGLVHPHTSIEDLDELSTLLQVPLVAGTVNRGSEVIAAGMTVNDWTAFCGSDTTATELSVIESVFKLREAQPSAIVDEMRKSLIDTYV

SEQ ID NO: 6073 - protein, 245 aa, Musa acuminata
MATRIQFENSCEVGVFSKLTNAYCLVAIGGSENFYSIFEAELADVIPVVKTSIGGTRIIGRLCAGNKKGLLLPHTTTDQELQHLRNSLPDQVVVQRIDERLSALGNCISCNDHVALTHPDLDKDTEELIADVLGVEVFRQTVAGNILVGSYCAFSNRGGLVHPHTSIEDLDELSTLLQVPLVAGTVNRGSEVIAAGMTVNDWTAFCGSDTTATELSVIESVFKLREAQPSSIVDEMRKSLIDSYV

SEQ ID NO: 6074 - protein, 245 aa, Phaseolus vulgaris
MATRLQFENNCEVGVFSKLTNAYCLVAIGGSESFYSVFETELADVIPVVKTSIGGTRIIGRLCAGNKNGLLLPHTTTDQELQHLRNSLPDQVVVQRIDERLSALGNCIACNDHVALTHTDLDKETEEMIADVLGVEVFRQTIAGNILVGSYCAFSNRGGLVHPHTSIEDLDELSTLLQVPLVAGTVNRGSEVIAAGMTVNDWTAFCGSDTTATELSVIESVFKLREAQPSAIVDEMRKSLVDTYV

SEQ ID NO: 6075 - protein, 245 aa, Vigna unguiculata
MATRLQFENNCEVGVFSKLTNAYCLVAIGGSESFYSVFEAELADVIPVVKTSIGGTRIIGRLCAGNKNGLLLPHTTTDQELQHLRNSLPDQVVVQRIDERLSALGNCIACNDHVALTHTDLDRETEEMIADVLGVEVFRQTIAGNILVGSYCAFSNRGGLVHPHTSIEDLDELSTLLQVPLVAGTVNRGSEVIAAGMTVNDWTAFCGSDTTATELSVIESVFKLREAQPSAIVDEMRKSLVDTYV

SEQ ID NO: 6076 - protein, 245 aa, Flaveria ramosissima
MATRLQFENSCEIGVFSKLTNAYCLVAIGGSENFYSTFEAELADVIPVVKTSIGGTRIIGRLCIGNKNGLLLPHTTTDQELQHLRNSLPDAVVVQRIDERLSALGNCIACNDHVALTHTDLDRETEEMIADVLGVEVFRQTIAGNILVGSYCAFSNRGGLVHPHTSIEDLDELSTLLQVPLVAGTVNRGSEVIAAGLTVNDWTAFCGSDTTATELSVIESVFKLREAQPSAIVDEMRKSLIDTYV

SEQ ID NO: 6077 - protein, 245 aa, Flaveria ramosissima
MATRLQFENSCEIGVFSKLTNAYCLVAIGGSENFYSTFEAELADVIPVVKTSIGGTRIIGRLCIGNKNGLLLPHTTTDQELQHLRNSLPDAVVVQRIDERLSALGNCIACNDHVALTHTDLDRETEEMIADVLGVEVFRQTIAGNILVGSYCAFSNRGGLVHPHTSIEDLDELSTLLQVPLVAGTVNRGSEVIAAGLTVNDWTAFCGSDTTATELSVIESVFKLREAQPIAIVDEMRKSLIDTYV

SEQ ID NO: 6078 - protein, 245 aa, Glycine max
MATRLQFENNCEVGVFSKLTNAYCLVAIGGSESFYSVFEAELADVIPVVKTSIGGTRIIGRLCAGNKNGLLLPHTTTDQELQQLRNSLPDQVVVQRIDERLSALGNCIACNDHVALTHTDLDRETEEMIADVLGVEVFRQTIAGNILVGSYCAFSNRGGLVHPHTSIEDLDELSTLLQVPLVAGTVNRGSEVIAAGMTVNDWTAFCGSDTTATELSVIESVFKLREAQPSAIVDEMRKSLIDTYV

SEQ ID NO: 6079 - protein, 245 aa, Glycine max
MATRLQFENNCEVGVFSKLTNAYCLVAIGGSESFYSVFEAELAGVIPVVKTSIGGTRIIGRLCAGNKNGLLLPHTTTDQELQHLRNSLPDQVVVQRIDERLSALGNCIACNDHVALTHTDLDRETEEMIADVLGVEVFRQTIAGNILVGSYCAFSNRGGLVHPHTSIEDLDELSTLLQVPLVAGTVNRGSEVIAAGMTVNDWTAFCGSDTTATELSVIESVFKLREAQPSAIVDEMRKSLIDTYV

SEQ ID NO: 6080 - protein, 245 aa, Glycine max
MATRLQFENNCEVGVFSKLTNAYCLVAIGGSENFYSAFEAELADVIPVVKTSIGGTRIVGRLCVGNKNGLLLPHTITDQELQHLRNSLPDQVVVQRIEERLSALGNCIACNDHVALTHTDLDKETEEMIADVLGVEVFRQTVAGNILVGSYCVFSNRGGLVHPHTSIEDLDELSTLLQVPLVAGTVNRGSEVIAAGMTVNDWTAFCGSDTTATELSVIESVFKLREAQPSAIVDEMRKSLIDTYV

SEQ ID NO: 6081 - protein, 245 aa, Phaseolus vulgaris
MATRLQFENNCEVGVFSKLTNAYCLVAIGGSENFYSAFETELADIIPVIKTSIGGTRIVGRLCVGNKNGLLLPHTTTDQELQHLRNSLPDQVVVQRIEERLSALGNCIACNDHVALTHTDLDKETEEMVADVLGVEVFRQTIAGNILVGSYCAFSNRGGLVHPHTSIEDLDELSTLLQVPLVAGTVNRGSEVIAAGMTVNDWTAFCGSDTTATELSVIESVFKLREAQPSAIVDEMRKSLVDTYV

SEQ ID NO: 6082 - protein, 245 aa, Unknown
  Sequence found in Organisms: Centaurea maculosa, Cirsium arvense
MATRLQFENSCEIGVFSKLTNAYCLVAIGGSENFYSTFESELADVIPVVKTSIGGTRIIGRLCIGNKNGLLLPHTTTDQELQHLRNSLPDAVVVQRIDERLSALGNCIACNDHVALTHTDLDRETEEMIADVLGVEVFRQTIAGNILVGSYCAFSNRGGLVHPHTSIEDLDELSTLLQVPLVAGTVNRGSEVIAAGITVNDWTAFCGSDTTATELSVIESVFKLREAQPSAIVDEMRKSLIDTYV

SEQ ID NO: 6083 - protein, 245 aa, Coffea canephora
MATRLQFENSCEVGVFSKLTNAYCLVAIGGSENFYSTFEAELADAIPVVKTAIGGTRIIGRLCAGNKNGLLLPHTTTDQELQHLRNSLPDSVVVQRTDERLSALGNCIACNDHVALTHTDLDRETEEMIADVLGVEVFRQTIAGNILVGSYCAFSNRGGLVHPHTSIEDLDELSTLLQVPLVAGTVNRGSEVIAAGLTVNDWTAFCGSDTTATELSVIESVFKLREAQPSAIVDEMRKSLIDSYV

SEQ ID NO: 6084 - protein, 245 aa, Taraxacum officinale
MATRLQFENNCEIGVFSKLTNAYCLVAIGGSENFYSTFESELADVIPVVKTSIGGTRIIGRLCIGNKNGLLLPHTTTDQELQHLRNSLPDAVVVQRIDERLSALGNCIACNDHVALTHTDLDRETEELIADVLGVEVFRQTIAGNVLVGSYCAFSNRGGLVHPHTSIEDLDELSTLLQVPLVAGTVNRGSEVIAAGLTVNDWTAFCGSDTTATELSVIESVFKLREAQPSAIVDEMRKSLIDTYV

SEQ ID NO: 6085 - protein, 245 aa, Lactuca sativa
MATRLQFENSCEIGVFSKLTNAYCLVAIGGSENFYSTFESELADVIPVVKTSIGGTRIIGRLCVGNKNGLLLPHTTTDQELQHLRNSLPDAVVVQRIDERLSALGNCIACNDHVALVHTDLDRETEEMIADVLGVEVFRQTIAGNILVGSYCAFSNRGGLVHPHTSIEDLDELSTLLQVPLVAGTVNRGSEVIAAGLTVNDWTAFCGSDTTATELSVIESVFKLREAQPSAIVDEMRKSLIDTYV

SEQ ID NO: 6086 - protein, 245 aa, Platanus occidentalis
MATRLQFENSCDIGVFSKLTNAYCLVAIGGSENFYSTFEAELADVIPVVKTSIGGTRIIGRLCAGNKKGLLLPHTTTDQELQHIRNSLPDHVVVQRIDERLSALGNCIACNDHVALTHTDLDKETEEMVADVLGVEVFRQTIAGNILVGSYCAFSNRGGLVHPHTSIEDLDELSTLLQVPLVAGTVNRGSEVIAAGMTVNDWTAFCGSDTTATELSVIESVFKLREAQPSAIVDEMRKSLIDSYV

SEQ ID NO: 6087 - protein, 181 aa, Centaurea maculosa
MATRLQFENSCEIGVFSKLTNAYCLVAIGGSENFYSTFESELADVIPVVKTSIGGTRIIGRLCIGNKNGLLLPHTTTDQELQHLRNSLPDAVVVQRIDERLSALGNCIACNDHVALTHTDLDRETEEMIADVLGVEVFRQKQLLAIFSSAATVRFQIEVVWFTHIPLLKIWMNCQPSFKCL

SEQ ID NO: 6088 - protein, 216 aa, Ambrosia trifida
MATRLQFENSCEIGVFSKLTNAYCLVAIGGSENFYSTFEAELADVIPVVKTSIGGTRIIGRLCIGNKNGLLLPHTTTDQELQHLRNSLPDAVVVQRIDERLSALGNCIACNDHVALTHTDLDRETEEMIADVLGVEVFRQTIAGNILVGSYCAFSNRGGMVHPHTSIEDLDELSTLLQVPLVAGTVNRGSEVIAAGLTVNDWTAFAGQIPLRQNCL

SEQ ID NO: 6089 - protein, 245 aa, Unknown
  Sequence found in Organisms: Prunus persica, Prunus mume
MATRLQFENSCEVGVFSKLTNAYCLVSIGGSENFYSTFEAELADVIPVVKTSIGGTRIIGRLCAGNKNGLLLPHTTTDQELQHLRNSLPDHVVVQRIEERLSALGNCIACNDHVALTHTDLDRETEEMIADVLGVEVFRQTIAGNILVGSYCAFTNRGGMVHPHTSVEDLDELSTLLQVPLVAGTVNRGSEVIAAGMTVNDWTAFCGSDTTATELSVIESVFKLREAQPSAIVDEMRKSLIDSYV

SEQ ID NO: 6090 - protein, 245 aa, Unknown
  Sequence found in Organisms: Ambrosia trifida, Arnica chamissonis, Flaveria ramosissima, Helianthus annuus
MATRLQFENSCEIGVFSKLTNAYCLVAIGGSENFYSTFESELADVIPVVKTSIGGTRIIGRLCIGNKNGLLLPHTTTDQELQHLRNSLPDAVVVQRIDERLSALGNCIACNDHVALTHTDLDRETEEMIADVLGVEVFRQTIAGNILVGSYCAFSNRGGMVHPHTSIEDLDELSTLLQVPLVAGTVNRGSEVIAAGLTVNDWTAFCGSDTTATELSVIESVFKLREAQPSAIVDEMRKSLIDTYV

SEQ ID NO: 6091 - protein, 245 aa, Chelidonium majus
MATRLQFENNCEVGVFSKLTNAYCLVAIGGSENFYSTFESELADTIPVVKTSIGGTRIIGRLCAGNKNGLLVPHTTTDQELQHLRNSLPDQVVVQRIDERLSALGNCIACNDYVALTHTDLDRDTEEIIADVLGVEVFRQTIAGNILVGSYCAFSNKGGLVHPHTSIEDLDELSTLLQVPLVAGTVNRGSEVIAAGMTVNDWTAFCGSDTTATELSVIESVFKLREAQPTAIVDEMRKSLIDTYV

SEQ ID NO: 6092 - protein, 245 aa, Carpinus betulus
MATRLQFENSCEVGVFSKLTNAYCLVAIGGSENFYSTFESELADAIPIVKTSIGGTRIIGRLCAGNKNGLLVPHTTTDQELQHLRNSLPDQVVVQRIDERLSALGNCIACNDHVALAHTDLDRETEEMIADVLGVEVFRQTIAGNILVGSYCAFSNRGGLVHPHTSIEDLDELSTLLQVPLVAGSVNRGSEVIAAGMTVNDWTAFCGSDTTATELSVIESVFKLREAQPSAIVDEMRKSLIDSYV

SEQ ID NO: 6093 - protein, 245 aa, Ipomoea nil
MATRLQFENSCEIGVFSKLTNAYCLVAIGGSENFYSTFEAELADAIPVIKTSIGGTRIVGRLCAGNKNGLILPHTTTDQELQHLRNSLPDSVVVQRADERLSALGNCIACNDHVALTHTDLDRETEELIADVLGVEVFRQTIAGNILVGSYCAFSNRGGLVHPHTSVEDLDELSTLLQVPLVAGTVNRGSDVIAAGLTVNDWTAFCGSDTTATELSVIESVFKLREAQPSAIVDEMRKSLIDSYV

SEQ ID NO: 6094 - protein, 245 aa, Olea europaea
MATRLQFENNCEVGVFSKLTNAYCLVAIGGSESFYSTFEAELADVIPVVKTSIGGTRIIGRLCAGNKNGLLLPHTTTDQELQHLRNSLPDSVVVQRIEERLSALGNCIACNDHVALTHPDLDKETEEMIADVLGVEVFRQTVAGNILVGSYCAFSNRGGLVHPHTSIEDLDELSTLLQVPLVAGTVNRGSEVIAAGLTVNDWTAFCGSDTTATELSVIESVFKLREAQPSALVDEMRKSLIDTYV

SEQ ID NO: 6095 - protein, 118 aa, Centaurea maculosa
MIADVLGVEVFRQTIAGNILVGSYCAFSNRGGLVHPHTSIEDLDELSTLLQVPLVAGTVNRGSEVIAAGITVNDWTAFCGSDTTATELSVIESVFKLREAQPSAIVDEMRKSLIDTYV

SEQ ID NO: 6096 - protein, 138 aa, Gerbera hybrid cultivar
MATRLQFENSCEIGVFSKLTNAYCLVAIGGSENFYSTFESELADVIPVVKTSIGGTRIIGRLCIGNKNGLLLPHTTTDQELQHLRNSLPDAVVVQRIDERLSALGNCIACNDHVALTHTDLDRETEEMIADVLWCGSF

SEQ ID NO: 6097 - protein, 83 aa, Platanus occidentalis
MATRLQFENSCEVGVFSKLTNAYCLVAIGGSENFYSTFEAELADVIPVVKTSIAGTRIIGRLCAGNKNGLLCLTIPLTKSFNT

SEQ ID NO: 6098 - protein, 118 aa, Helianthus annuus
MIADVLGVEVFRQTIAGNILVGSYCAFSNRGGMVHPHTSIEDLDELSTLLQVPLVAGTVNRGSEVIAAGLTVNDWTAFCGSDTTATELSVIESVFKLREAQPSAIVDEMRKSLIDTYV

SEQ ID NO: 6099 - protein, 242 aa, Ambrosia trifida
MATRLQFENSCEIGVFSKLTNAYCLVAIGGSENFYSTFEAELADVIPVVKTSIGGTRIIGRLCIGNKNGLLLPHTTTDQELQHLRNSLPDAVVVQRIDERLSALGNCIACNDHVALTHTDLDRETEEMIADVLGVEVFRQTIAGNILVGSYCAFSNRGGMVHPHTSIEDLDELSTLLQVPLVAGTVNRGSEVIAAGLTVNDWTAFCGSDTTATELSVIESVFKLREAQPSAIVDEMRKSLID

SEQ ID NO: 6100 - protein, 245 aa, Malus domestica
MATRLQFENSCEVGVFSKLTNAYCLVSIGGSENFYSTFEAELADVIPVVKTSIGGTRIIGRLCAGNKNGLLLPHTTTDQELQHLRNSLPDNVVVQRIEERLSALGNCIACNDHVALTHTDLDRETEEMIADVLGVEVFRQTIAGNILVGSYCSFTNRGGLVHPHTSVEDLDELSTLLQVPLVAGTVNRGSEVIAAGMTVNDWTAFCGLDTTATELSVIESVFKLREAQPSAIVDEMRKSLIDSYV

SEQ ID NO: 6101 - protein, 245 aa, Manihot esculenta
MATRLMFENSCEVGVFSKLTNAYCLVAIGGSESFYSTFEAELADVIPVVKTSIGGTRIIGRLCAGNKNGLLLPHTTTDQELQHLRNSLPDNVVVQRIEERLSALGNCIACNDHVALTHTDLDRETEEMIADVLGVEVFRQTIAGNILVGSYCTLSNRGGLVHPHTSIEDLDELSTLLQVPLVAGTVNRGSEVIAAGMTVNDWTAFCGSDTTATELSVIESVFKLREAQPSAIVEEMRKSLIDSYV

SEQ ID NO: 6102 - protein, 245 aa, Ricinus communis
MATRLMFENSCEVGVFSKLTNAYCLVAIGGSESFYSAFESELADVIPVVKTSIAGTRIIGRLCAGNKNGLLLPHTTTDQELQHLRNSLPDNVVVQRIEERLSALGNCIACNDHVALTHTDLDKETEEMIADVLGVEVFRQTIAGNILVGSYCALSNRGGLVHPHTSIEDLDELSTLLQVPLVAGTVNRGSEVIAAGMTVNDWTAFCGSDTTATELSVIESVFKLREAQPSAIVDEMRKSLIDSYV

SEQ ID NO: 6103 - protein, 245 aa, Centaurea maculosa
  misc_feature (44)..(44): Xaa can be any naturally occurring amino acid
  misc_feature (218)..(218): Xaa can be any naturally occurring amino acid
MATRLQFENSCEIGVFSKLTNAYCLVAIGGSENFYSTFESELAXVIPVVKTSIGGTRIIGRLCIGNKNGLLLPHTTTDQELQHLRNSLPDAVVVQRIDERLSALGNCIACNDHVALTHTDLDRETEEMIADVLGVEVFRQTIAGNILVGSYCAFSNRGGLVHPHTSIEDLDELSTLLQVPLVAGTVNRGSEVIAAGITVNDWTAFCGSDTTATELSVXESVFKLREAQPSAIVDEMRKSLIDTYV

SEQ ID NO: 6104 - protein, 245 aa, Eucalyptus grandis
MATRLQFENSCEVGVFSKLTNAYCLVAIGGSENFYSTFETDLADVIPVVKTSIAGTRIIGRLCAGNKNGLLLPHNTTDQELQHLRNSLPDQVVVQRIEERLSALGNGIACNDHVALTHTDLDKETEEIIADVLGVEVFRQTIAGNILVGSYCAFSNRGGLVHPHTSIEDLDELSTLLQVPLVAGTVNRGSEVIAAGMTVNDWTAFCGSDTTATELSVIESVFKLREAQPSAIVDEMRKSLIDSYV

SEQ ID NO: 6105 - protein, 245 aa, Elaeis guineensis
MATRLQFENSCEVGVFSKLTNAYCLVAIGGSENFYSAYEAELADVIPVVKTSIGGTRIIGRLCAGNKNGLLLPHTTTDQELQHLRNSLPDRVVVQRIEEKLSALGNCIACNDHVALTHPDLDRETEQLIADVLGVEVFRQTIAGNILVGSYCAFSNRGGLVHPHTSIEDLDELSTLLQVPLVAGTVNRGSEVIAAGMTVNDWTAFCGSDTTATELSVVESVFKLREAQPSTIVDEMRKSLIDSYV

SEQ ID NO: 6106 - protein, 245 aa, Lippia dulcis
MATRLQYENNCEIGVFSKLTNAYCLVAIGGSENFYSTFEADLADVIPVVKTSISGTRIIGRLCAGNKNGLLLPHNTTDQELQHLRNSLPDSVVVQRIDERLSALGNCIACNDHVALTHPDLDKETEELIADVLGVEVFRQTIAGNILVGSYCTFSNRGGLVHPHTSIEDLDELSTLLQVPLVAGTVNRGSEVIAAGLTVNDWTAFCGSDTTATELSVIEGVFKLREAQPSAIVDEMRKSLIDTYV

SEQ ID NO: 6107 - protein, 245 aa, Vinca minor
MATRLQFENSCEIGVFSKLTNAYCLVAIGGSENFYSTFEAELADVIPVVKTSISGTRIIGRLCAGNKNGLLLPHNTTDQELQHLRNSLPDSVVVQRIDERLSALGNCIACNDHVALTHTDLDRETEEMIADVLGVEVFRQTIAGNILVGSYCTFSNRGGLVHPHTSIEDLDELSTLLQVPLVAGTVNRGSEVIAAGLTVNDWTAFCGSDTTATELSVIESVFKLREAQPSAIVDEMRKSLIDTYV

SEQ ID NO: 6108 - protein, 138 aa, Vaccinium corymbosum
MATRLQFENSCEVGVFSKLTNAYCLVAIGGSESFYSTFESELADVIPVVKTSIGGTRIIGRLCAGNKNGLLLPHTTTDQELQHLRNSLPDQVVVQRIDERLSALGNCIACNDYVALTHTDLDRETEEMIADVLGVEVF

SEQ ID NO: 6109 - protein, 118 aa, Fraxinus spp
MIADVLGVEVFRQTIAGNILVGSYCAFSNRGGLVHPHTSIEDLDELSTLLQVPLVAGTVNRGSEVIAAGLIVNDWTAFCGSDTTATELSVIESVFKLREAQPSALVDEMRKSLIDTYV

SEQ ID NO: 6110 - protein, 245 aa, Olea europaea
MATRLQFENNCEVGVFSKLTNAYCLVAIGGSESFYSTFEAELADVIPVVKTSIGGTRIIGRLCAGNKNGLLLPHTTTDQELQHLRNSLPDSVVVQRIEERLSALGNCISCNDHVALTHPDLDRETEEMIADVLGVEVFRQTVAGNILVGSYCAFSNRGGLVHPHTSIEDLDELSTLLQVPLVAGTVNRGSEVIAAGLTVNDWTAFCGSDTTATELSVIESVFKLREAQPSALVDEMRKSLIDTYV

SEQ ID NO: 6111 - protein, 245 aa, Amorphophallus konjac
MATRIQFENSCEVGVFSKLTNAYCLVAIGGSENFYSAFESELADVIPVVKTSIAGTRIIGRLCAGNKNGLLLPHTTTDQELQHLRNSLPDQVVVQRIEERLSALGNCIACNDHVALAHTDLDRETEELIADVLGVEVFRQTIAGNILVGSYCAFSNRGGLVHPHTSIEDLDELSTLLQVPLVAGTVNRGSEVVAAGLTVNDWTAFCGSDTTATELSVMESVFKLREAQPSAIVDEMRKSLIDSYI

SEQ ID NO: 6112 - protein, 245 aa, Amsonia hubrichtii
MATRLQFENSCEVGVFSKLTNAYCLVAIGGSENFYSTFEAELADVIPVVKTSISGTRIIGRLCAGNKNGLLLPHNTTDQELQQLRNSLPDSVVVQRIEERLSALGNCIACNDHVALTHTDLDRETEEMIADVLGVEVFRQTIAGNILVGSYCAFSNRGGLVHPHTSIEDLDELSTLLQVPLVAGTVNRGSEVIAAGLTVNDWTAFCGSDTTATELSVIESVFKLREAQPSAIVDEMRKSLIDSYV

SEQ ID NO: 6113 - protein, 245 aa, Aristolochia fimbriata
MATRLQFENNCEIGVFSKLTNAYCLVAIGGSENFYSTFEAELADVIPVVKTSIAGTRIIGRLCAGNKNGLLLPHNTTDQELQHLRNSLPDQVVVQRIEERLSALGNCIACNDHVALTHTDLDRETEQLITDVLGVEVFRQTIAGNILVGSYCAFSNRGGLVHPHTSIEDLDELSTLLQVPLVAGTVNRGSEVVAAGLIVNDWTAFCGSDTTATELSVIESVFKLREAQPSAIVDEMRKSLIDSYV

SEQ ID NO: 6114 - protein, 245 aa, Cicer arietinum
MATRLKFENSCEIGAFSKLTNAYCLVAIGGSENFYSAFEAELSDVIPVVKTSIGGTRIVGRLCIGNKNGLLLPHTTTDQELQHLRNSLPDQVRVQRIEERLSALGNCIACNDHVALTHTDLDKETEEVIADVLGVEVFRQTVAGNILVGSYCAFSNKGGLVHPHTSVEDLDELSTLLQVPLVAGTVNRGSEVIAAGMVVNDWTAFCGSDTTATELSVIESVFKLREAQPSAIVDEMRKSLIESYV

SEQ ID NO: 6115 - protein, 245 aa, Unknown
  Sequence found in Organisms: Gossypium hirsutum, Gossypium raimondii
MATRLQFENSCEVGVFSKLTNAYCLVAIGGSENFYSAFESELADVIPVIKTSLGGTRIIGRLCAGNKNGLLVPHTTTDQELQHLRNSLPDQVVVQRIEEKLSALGNCIACNDHVALTHTDLDRETEEIIADVLGVEVFRQTIAGNILVGSYCAFSNRGGLVHPHTSIEDLDELSTLLQVPLVAGTINRGSEVIAAGMTVNDWTAFCGSDTTATELSVIESVFKLREAQPTAIVDEMRKSLIDTYV

SEQ ID NO: 6116 - protein, 245 aa, Zingiber officinale
MATRVQFENNCEVGVFSKLTNAYCLVAIGGSESFYSVFESELADVIPVVKTSIAGTRIIGRLCAGNKNGLLLPHTTTDQELQHLRNSLPDGVVVQRIDERLSALGNCIACNDHVALTHPDLDRETEELIADVLGVEVFRQTIAGNILVGSYCAFSNKGGLVHPHTSIEDLDELSTLLQVPLVAGTVNRGSEVIASGMTVNDWTAFCGSDTTATELSVIESVFKLRDAQPNIIVDEMRKSLIDSYV

SEQ ID NO: 6117 - protein, 245 aa, Rosa hybrid cultivar
MATRLQFENSCEVGVFSKLTNAYCLVSIGGSESFYSTFEAELADVIPVVKTSIGGSRIIGRLCAGNKNGLLLPHTTTDQELQHLRNSLPDQVVVQRVDERLSALGNCIACNDHVALTHTDLDRETEEMIADVLGVEVFRQTIAGNILVGSYCAISNKGGLVHPHTSVEDLDELSTLLQVPLVAGTVNRGSEVIAAGMTVNDWTAFCGSDTTATEVSVIESVFKLREAQPSAIVDEMRKSLIDSYV

SEQ ID NO: 6118 - protein, 245 aa, Tabernaemontana elegans
MATRLQFENSCEVGVFSKLTNAYCLVAIGGSENFYSTFEAELADVIPVVKTSISGTRIIGRLCAGNKNGLLLPHNTTDQELQHLRNSLPDSVVVQRIEEKLSALGNCIACNDHVALTHTDLDRETEEMIADVLGVEVFRQTIAGNILVGSYCAFSNRGGLVHPHTSIEDLDELSTLLQVPLVAGTVNRGSEVIAAGLTVNDWTAFCGSDTTATELSVIESVFKLREAQPSAIVDEMRKSLIDSYV

SEQ ID NO: 6119 - protein, 245 aa, Nicotiana tabacum
  misc_feature (151)..(151): Xaa can be any naturally occurring amino acid
  misc_feature (154)..(154): Xaa can be any naturally occurring amino acid
MATRLQFENSCEIGVFSKLTNAYCLVAIGGSENFYSTFESELAGIIPVIKTSIGGTRIIGRLCAGNKNGLLLPHTTTDQELQHLRNSLPDGVVVQRIDERLSALGNCIACNDHVALTHTDLDKETEEMIADVLGVEVFRQTIAGNILVGSXCSXSNRGGLVHPHTSIEDLDELSTLLQVPLVAGTVNRGSEVIAAGLTVNDWTAFCGSDTTATELSVIESVFKLREAQPSAIVDEMRKSLIDSYV

SEQ ID NO: 6120 - protein, 209 aa, Musa acuminata
MFEAELADVIPVVKTSIAGTRIIGRLCAGNKNGLLLPHTTTDQELQHLRNSLPDQVVVQRIEERLSALGNCIACNDHVALTHPDLDRETEELIADVLGVEVFRQTIAGNILVGSYCAISNRGGLVHPHTSIEDLDELSTLLQVPLVAGTVNRGSEVIASGMTVNDWTAFCGSDTTATELSVIESVFKLREARPSSIVDEMRKSLIDSYV

SEQ ID NO: 6121 - protein, 170 aa, Eschscholzia californica
MAIRLQFENSCEVGVFSKLTNAYCLVAIGGSENFYSTFESELADVIPVVKTSIGGTRIIGRLCAGNKNGLLVPHTTTDQELQHLRNSLPDQVVVQRIDERLSALGNCIACNDHVALTHTDLDRDTEEIIADVLGVEVFRQTIAGNILVGSYCNFSNRGGLVHPHTSIEFG

SEQ ID NO: 6122 - protein, 238 aa, Phaseolus vulgaris
MATRLQFENNCEVGVFSKLTNAYCLVAIGGSESFYSVFETELADVIPVVKTSIGGTRIIGRLCAGNKNGLLLPHTTTDQELQHLRNSLPDQVVVQRIDERLSALGNCIACNDHVALTHTDLDKETEEMIADVLGVEVFRQTIAGNILVGSYCAFSNRGGLVHPHTSIEDLDELSTLLQVPLVAGTVNRGSEVIAAGMTVNDWTAFCGSDTTATELSVIESVFKLREAQPSAIVDEMRK

SEQ ID NO: 6123 - protein, 245 aa, Artemisia annua
MATRLMFENSCEIGVFSKLTNAYCLVAIGGSENFYSTFESELADVIPVVKTSIGGTRIIGRLCIGNKNGLLVPHTTTDQELQHLRNSLPDAVVVQRIDERLSALGNCIACNDHVALTHTDLDRETEEMIADVLGVEVFRQTIAGNILVGSYCAFSNRGGLVHPHTSIEDLDELSTLLQVPLVAGTVNRGSEVIGAGIIVNDWTAFCGSDTTATELSVIESVFKLREAQPSAIVDEMRKSLIDTYV

SEQ ID NO: 6124 - protein, 245 aa, Ocimum basilicum
MATRLQYENNCEIGVFSKLTNAYCLVAMGGSENFYSTFEAELADVIPVVKTSISGTRIIGRLCAGNKNGLLLPHNTTDQELQHLRNSLPDSVVVQRIDERLSALGNCIACNDHVALTHPDLDKETEEMIADVLGVEVFRQTIAGNILVGSYCAISNRGGLVHPHTSIEDLDELSTLLQVPLVAGTVNRGSDVIAAGLTVNDWTGFCGSDTTATELSVIESVFKLREAQPSALVDEMRKSLIDTYV

SEQ ID NO: 6125 - protein, 245 aa, Vaccinium corymbosum
MATRLQFENSCEVGVFSKLTNAYCLVAIGGSESFYSTFESELADVIPVVKTSIGGTRIIGRLCAGNKNGLLLPHTTTDQELQHLRNSLPDQVVVQRIDERLSALGNCIACNDYVALTHTDLDRETEEMIADVLGVEVFRQTIAGNILVGSYCSLSNKGGLVHPHTSIEDLDELSTLLQVPLVAGTVNRGSEVIAAGLTVNDWTAFCGSDTTATELSVIESVFKLREAQPSAIVDEMRKSLIDSYV

SEQ ID NO: 6126 - protein, 245 aa, Theobroma cacao
MATRLMFENSCEVGVFSKLTNAYCLVAIGGSESFYSTFEAELADVIPVVKTSIAGTRIIGRLCAGNKNGLLLPHTTTDQELQHLRNSLPDQVVVQRVDERLSALGNCIACNDHVALTHTDLDRETEELIADVLGVEVFRQTIAGNILVGSYCAISNRGGLVHPHTSIEDLDELSTLLQVPLVAGTINRGSEVIAAGMVVNDWTAFCGADTTATELSVIESVFKLREAQPTAIVDEMRKSLIDSYV

SEQ ID NO: 6127 - protein, 245 aa, Gossypium hirsutum
MATRLQFENSCEVGVFSKLTNAYCLVAIGGSENFYSTFESELADVIPVVKTSIAGTRIIGRLCAGNKNGLLVPHNTTDQELQHLRNSLPDQVVVQRIEEKLSALGNCIACNDHVALTHTDLDKETEEIIADVLGVEVFRQTIAGNILVGSYCAFSNRGGLVHPHTSIEDLDELSTLLQVPLVAGTINRGSEVIAAGMTVNDWTAFCGSDTTATELSVIESVFKLREAQPSAIVDEMRKSLIDTYV

SEQ ID NO: 6128 - protein, 245 aa, Humulus lupulus
MAVRLQFENSCDVGVFSKLTNAYCLVAIGGSENFYSAFESELADVIPVVKTSISGTRIIGRLCAGNKNGLLMPHNTTDQELQHLRNSLPDQVVVQRIEEKLSALGNCIACNDHVALTHTDLDKETEEMIADILGVEVFRQTIAGNILVGSYCAFSNRGGLVHPHTSVEDLDELSTLLQVPLVAGTVNRGSEVIAAGMTVNDWTAFCGSDTTATELSVIESVFKLREAQPSAIVDEMRKSLIDTYV

SEQ ID NO: 6129 - protein, 245 aa, Ipomoea nil
MATRLQFENSCEIGVFSKLTNAYCLVAIGGSENFYSTFESELADVIPVIKTSIGGTRIVGRLCAGNKNGLILPHTTTDQELQHLRNSLPDGVVVQRVDERLSALGNCIACNDHVALTHTDLDRETEELIADVLGVEVFRQTIAGNILVGSYCAFSNRGGLVHPHTSIEDLDELSTLLQVPLVAGTVNRGSDVIAAGLTVNDWTAFCGSDTTATELSVIESVFKLREAQPSAIVDEMRKSLIDSYV

SEQ ID NO: 6130 - protein, 245 aa, Mimulus guttatus
MATRLQYENNSEIGVFSKLTNAYCLVAIGGSENFYSTFEAELADVIPVVKTSIAGTRIIGRLCAGNKNGLLLPHNTTDQELQHLRNSLPDSVVVQRIDERLSALGNCIACNDHVALTHPDLDRETEEMIADVLGVEVFRQTVAGNILVGSYCALSNRGGLVHPHTSIEDLDELSTLLQVPLVAGTVNRGSEVIAAGLTVNDWTAFCGSDTTATELSVLESVFKLREAQPSAIVDEMRKSLIDTYV

SEQ ID NO: 6131 - protein, 245 aa, Tropaeolum majus
MATRLQFENSCEIGVFSKLTNAYCLVAIGGSENFYSTFEAELADVIPVVKTSISGTRIIGRLCAGNKNGLLVPHNTTDQELQHLRNSLPDQVVVQRIDEKLSALGNCIACNDHVALTHTDLDRETEEIISDVLGVEVFRQTIAGSILVGSYCAFSNRGGIVHPHTSVEDLDELSTLLQVPLVAGTVNRGSEVIAAGMTVNDWTAFCGSDTTATELSVIESIFKLREAQPSAIVDEMRKSLIDTYV

SEQ ID NO: 6132 - protein, 245 aa, Citrus sinensis
MATRLMFENSCEVGVFSKLTNAYCLVAIGGSESFYSTFEAELADVFPVVKTSIGGTRIIGRLCAGNKNGLLLPHTTTDQELQHLRNSLPDQVVVQRIEERLSALGNCIACNDHVALTHTDLDRETEEMIADVLGVEVFRQTIAGNILVGSYCSFSNRGGLVHPHTSIEDLDELSTLLQVPLVAGTVNRGSEVIAAGLTVNDWTAFCGSDTTATELSVIESVFKLREAQPSALVDEMRKSLIDSYV

SEQ ID NO: 6133 - protein, 245 aa, Capsicum annuum
MATRLQFENSCEIGVFSKLTNAYCLVAIGGSENFYSTFEAELSGIIPVIKTSIGGTRIIGRLCAGNKNGLLLPHTTTDQELQHLRNSLPDSVVVQRIDERLSALGNCIACNDHVALTHTDLDKETEEMIADVLGVEVFRQTIAGNILVGSYCAISNTGGLVHPHTSIEDLDELSTLLQVPLVAGTVNRGSEVIAAGLTVNDWTAFTGSDTTATELTVIENVFKLREAQPTAIVDEMRKSLIDSYV

SEQ ID NO: 6134 - protein, 245 aa, Fragaria vesca
MATRIQFENSCEIGVFSKLTNAYCLVSIGGSESFYSTFESELADVIPVIKTSIGGTRIIGRLCAGNKNGLLLPHTTTDQELQHLKNSLPDQVVVQRVDERLSALGNCIACNDHVALTHTDLDRETEEMIADVLGVEVFRQTIAGNILVGSYCAISNKGGLVHPHTSVEDLDELSTLLQVPLVAGTVNRGSEVIAAGMTVNDSTAFCGSDTTATEVSVIESVFKLRESQPSAIVDEMRKSLIDSYV

SEQ ID NO: 6135 - protein, 245 aa, Solanum lycopersicum
MATRLQFENSCEIGVFSKLTNAYCLVAIGGSENFYSTFESELSGIIPVIKTSIGGTRIIGRLCAGNKNGLLLPHTTTDQELQHLRNSLPDGVVVQRIDERLSALGNCIACNDHVALTHTDLDKETEEMIADVLGVEVFRQTIAGNILVGSYCAISNTGGLVHPHTSIEDLDELSTLLQVPLVAGTVNRGSEVIGAGLTVNDWTAFTGSDTTATELSVIESVFKLREAQPTAIVDEMRKSLIDSYV

SEQ ID NO: 6136 - protein, 245 aa, Triphysaria pusilla
MATRLQYENNCEVGVFSKLTNAYCLVAIGGSENFYSTFEAELADVIPVVKTSIAGTRIIGRLCAGNKNGLLLPHNTTDQELQHLRNSLPDSVVVQRIEERLSALGNCISCNDHVALTHPDLDKETEELIADVLGVEVFRQTVAGNILVGSYCAFSNRGGLVHPHTSIEDLDELSTLLQVPLVAGTVNRGSEVIAAGLTVNDWTAFCGSDTTATELSVIESVFKLRESQPSALVDEMRKSLIDTYV

SEQ ID NO: 6137 - protein, 245 aa, Vinca minor
MATRLQFENSCEIGVFSKLTNAYCLVAIGGSENFYSTFETELADVIPVVKTSISGNRIIGRLCAGNKNGLLLPHNTTDQELQHLRNSLPDSVVVQRIDERLSALGNCIACNDHVALTHTDLDRETEEMIADVLGVEVFRQTIAGNILVGSYCTFSNRGGLVHPHTSIEDLDELSTLLQVPLVAGTVNRGSEVIAAGLTVNDWTAFCGSDTTATELSVIESVFKLREAQPSAIVDEMRKSLIDTYV

SEQ ID NO: 6138 - protein, 118 aa, Nicotiana benthamiana
MIADVLGVEVFRQTIAGNILVGSYCSFSNRGGLVHPHTSIEDLDELSTLLQVPLVAGTVNRGSEVIAAGLTVNDWTAFCGSDTTATELSVIESVFKLREAQPSAIVDEMRKSLIDSYV

SEQ ID NO: 6139 - protein, 245 aa, Populus trichocarpa
MASRLQFENNCEVGVFSKLTNAYCLVAIGGSESFYSTFEAELADVIPVVKTSIAGTRIIGRLCAGNKNGLLVPHTTTDQELQHLRNSLPDQVVVQRIDEKLSALGNCIACNDHVALAHTDLDRETEEIIADVLGVEVFRQTIAGNILVGSYCAFSNRGGLVHPHTSIEDLDELSTLLQVPLVAGTVNRGSEVIGAGITVNDWTAFCGSDTTATELSVIESVFKLREARPSAIVDEMRKSLIDSYV

SEQ ID NO: 6140 - protein, 245 aa, Catharanthus roseus
MATRLQFENSCEVGVFSKLTNAYCLVAIGGSENFYSTFESELADVIPVVKTSISGTRIIGRLCAGNKNGLLLPHNTTDQELQHLRNSLPDSVVVQRIEERLSALGNCIACNDHVALTHTDLDRETEEMIADVLGVEVFRQTIAGNILVGSYCAFSNRGGLVHPHTSIEDLDELSTLLQVPLVAGTVNRGSEVIAAGLTVNDWTAFCGSDTTATELSVIDNVFKLREAQPSAIVDEMRKSLIDSYV

SEQ ID NO: 6141 - protein, 245 aa, Citrus clementina
MATRLMFENSCEVGVFSKLANAYCLVAIGGSESFYSTFEAELADVIPVVKTSIGGTRIIGRLCAGNKNGLLLPHTTTDQELQHLRNSLPDQVVVQRIEERLSALGNCIACNDHVALTHTDLDRETEEMIADVLGVEAFRQTIAGNILVGSYCSFSNRGGLVHPHTSIEDLDELSTLLQVPLVAGTVNRGSEVIAAGLTVNDWTAFCGSDTTATELSVIESVFKLREAQPSALVDEMRKSLIDSYV

SEQ ID NO: 6142 - protein, 245 aa, Gossypium raimondii
MATRLQFENSCDVGVFSKLTNAYCLVAIGGSENFYSTFESELADVIPVVKTSIAGTRIIGRLCAGNKNGLLVPHNTTDQELQHLRNSLPDQVVVQRIEEKLSALGNCIACNDHVALTHTDLDKETEEIIADVLGVEVFRQTIAGNILVGSYCAFSNRGGLVHPHTSIEDLDELSTLLQVPLVAGTINRGSEVIAAGMTVNDWTAFCGSDTTATELSVIESVFKLREAQPSAIVDEMRKSLIDTYV

SEQ ID NO: 6143 - protein, 245 aa, Vitis vinifera
MATRLQFENSCEVGVFSKLTNAYCLVAIGGSESFYSVFESELADVIPVVKTSIGGTRIIGRLCAGNKKGLLLPHTTTDQELQHLRNSLPDQVVVQRIEEKLSALGNCIACNDHVALAHTDLDRETEEMVADVLGVEVFRQTIAGNILVGSYCTFSNRGGLVHPHTSIEDLDELSTLLQVPLVAGTVNRGSEVIAAGMTVNDWTAFCGSDTTATELSVIESVFKLREAQPSAIVDEMRKSLIDSYV

SEQ ID NO: 6144 - protein, 245 aa, Humulus lupulus
MAVRLQFENSCDVGVFSKLTNAYCLVAIGGSENFYSAFESELADVIPVVKTSISGTRIIGRLCAGNKKGLLMPHNTTDQELQHLRNSLPDQVVVQRIEEKLSALGNCIACNDHVALTHTDLDKETEEMIADVLGVEVFRQTIAGNILVGSYCAFSNRGGLVHPHTSVEDLDELSTLLQVPLVAGTVNRGSEVIAAGMTVNDWTAFCGTDTTATELSVIESVFKLREAQPSAIVDEMRKSLIDTYV

SEQ ID NO: 6145 - protein, 245 aa, Jatropha curcas
MATRLMFENSCEVGVFSKLTNAYCLVAIGGSESFYSTFEAELADVIPVVKTSIAGTRIVGRLCAGNKNGLLLPHTTTDQELQHLRNSLPDNVVVQRIEEKLSALGNCIACNDHVALTHTDLDRETEEMIADVLGVEVFRQTVAGNILVGSYCAFSNRGGLVHPHTSIEDLDELSTLLQVPLVAGTVNRGSEVIAAGMTVNDWTAFCGSDTTATELSVIESVFKLREAQPSAIVDEMRKSLIDSYV

SEQ ID NO: 6146 - protein, 245 aa, Actinidia deliciosa
MATRLQFENSCEVGVFSKLTNAYCLVAIGGSESFYSTFEGELADVIPVVKTSIGDTRIIGRLCAGNKNGLLLPHTTTDQELQHLRNSLPDQVVVQRIDERLSALGNCVACNDYVALTHTDLDKETEEMIADVLGVEVFRQTIAGNILVGSYCAFSNKGGLVHPHTSIEDLDELSTLLQVPLVAGTVNRGSEVIAAGLMVNDWTAFCGSDTTATELSVIESVFKLREAQPSTIVDEMRKSLIDSYV

SEQ ID NO: 6147 - protein, 245 aa, Citrus sinensis
MATRLMFENSCEVGVFSKLTNAFCLVAIGGSESFYSTFEAELADVIPVVKTSIGGNRIIGRLCVGNKNGLLLPHTTTDQELQHLRNSLPDQVVVQRIEERLSALGNCIACNDHVALAHTDLDRETEEIIADVLGVEVFRQTIAGNILVGSYCSFSNRGGLVHPHTSIEDLDELSTLLQVPLVAGTVNRGSEVIGAGLTVNDWTAFCGSDTTATELSVIESVFKLREAQPNAIVDEMRKSLIDSYV

SEQ ID NO: 6148 - protein, 245 aa, Unknown
  Sequence found in Organisms: Solanum tuberosum, Solanum phureja
MATRLQFENSCEIGVFSKLTNAYCLVAIGGSENFYSTFESELSGIIPVIKTSIGGTRIIGRLCAGNKNGLLLPHTTTDQELQHLRNSLPDGVVVQRIDERLSALGNCIVCNDHVALTHTDLDKETEEMIADVLGVEVFRQTIAGNILVGSYCAISNTGGLVHPHTSIEDLDELSTLLQVPLVAGTVNRGSEVIGAGLTVNDWTAFTGSDTTATELSVIESVFKLREAQPTAIVDEMRKSLIDSYV

SEQ ID NO: 6149 - protein, 245 aa, Sesamum indicum
MATRLQYENNCEIGVFSKLTNAYCLVAIGGSENFYSTFEAELADVIPVVKASIAGTRIIGRLCAGNKNGLLLPHNTTDQELQHLRNSLPDSVVVQRIEERLSALGNCIACNDHVALTHPDLDRETEEMIADVLGVEVFRQTIAGNILVGSFCTFSNRGGLVHPHTSIEDLDELSTLLQVPLVAGTVNRGSEVIGAGLTVNDWTAFCGSDTTATELSVIESVFKLREAQPSALVDEMRKSLIDSYV

SEQ ID NO: 6150 - protein, 245 aa, Triphysaria pusilla
MATRLQYENNCEVGVFSKLTNAYCLVAIGGSENFYSTFEAELADVIPVVKTSIAGTRIIGRLCAGNKNGLLLPHNTTDQELQHLRNSLPDSVVVQRIEERLSALGNCISCNDHVALTHPDLDKETEELIADVLGVEVFRQTVAGNILVGSYCTFSNRGGLVHPHTSIEDLDELSTLLQVPLVAGTVNRGSEVIAAGLTVNDWTAFCGSDTTATELSVIESVFKLREAQPSALVDEMRKSLIDTYV

SEQ ID NO: 6151 - protein, 245 aa, Vinca minor
MATRLQFENSCEIGVFSKLTNAYCLVAIGGSENFYSTFESELADVIPVVKTSISGTRIIGRLCAGNKNGLLLPHNTTDQELQHLRNSLPDSVAVQRIDERLSALGNCIACNDHVALTHTDLDKETEEMIADVLGVEVFRQTIAGNILVGSYCTFSNRGGLVHPHTSIEDLDELSTLLQVPLVAGTVNRGGEVIAAGLIVNDWTAFCGSDTTATELSVIESVFKLREAQPSAIVDEMRKSLIDTYV

SEQ ID NO: 6152 - protein, 245 aa, Aquilegia formosa
MATRLQFENNCEIGVFSKLTNAYCLVAIGGSENFYSTFESELADHIPVVKTSIAGSRIVGRLCAGNKKGLLLPHTTTDQELQHLRNSLPDGVVVQRIEERLSALGNCIACNDHVALTHTDLDRETEDLIADVLGVEVFRQTIAGNILVGSYCTFSNRGGLVHPHTSIEDLDELSTLLQVPLVAGTVNRGSEVIAAGIVVNDWTAFCGSDTTATELSVIESVFKLREAQPTAIVDEMRKSLIDTYV

SEQ ID NO: 6153 - protein, 245 aa, Arabidopsis lyrata
MATRLQFENNCEVGVFSKLTNAYCLVAIGGSENFYSAFESELADVIPIVKTSIGGTRIIGRLCAGNKNGLLVPHTTTDQELQHLRNSLPDQVVVQRIDERLSALGNCIACNDHVALAHTDLDKETEEIITDVLGVEVFRQTIAGNILVGSYCALSNRGGMVHPRTSVEDLDELSTLLQVPLVAGTVNRGSEVIAAGMTVNDWTSFCGSDTTATELSVIDSIFKLREAQPSSIVDEMRKSLIDTYV

SEQ ID NO: 6154 - protein, 245 aa, Brassica napus
MATRLQFENNCEVGVFSKLTNAYCLVAIGGSENFYSAFESELADVIPIVKTSLGGTRIIGRLCAGNKNGLLVPHTTTDQELQHLRNSLPDQVVVQRIEERLSALGNCIACNDHVALAHTDLDKETEEIIADVLGVEVFRQTIAGNILVGSYCALSNRGGIVHPHTSVEDLDELSTLLQVPLVAGTVNRGSEVIGAGMTVNDWTAFCGSDTTATELSVIDSIFKLREAQPSSIVDEMRKSLIDTYV

SEQ ID NO: 6155 - protein, 245 aa, Citrus clementina
MATRLMFENSCEVGVFSKLTNAFCLVAIGGSESFYSTFEAELADVIPVVKTSIGGNRIIGRLCVGNKNGLLLPHTTTDQELQHLRNSLPDQVVVQRIEERLSALGNCIACNDHVALAHTDLDRETEEIIADVLGVEVFRQTVAGNILVGSYCSFSNRGGLVHPHTSIEDLDELSTLLQVPLVAGTVNRGSEVIGAGLTVNDWTAFCGSDTTATELSVIESVFKLREAQPNAIVDEMRKSLIDSYV

SEQ ID NO: 6156 - protein, 245 aa, Euphorbia peplus
MATRLMFENSCEVGVFSKLTNAYCLVAIGGSESFYSAFESELSDVIPVVKTSIAGTRIIGRLCAGNKNGLLLPHTTTDQELQHLRNSLPDSVVVQRVEERLSALGNCIACNDHVALTHTDLDRETEEMIADVLGVEVFRQTIAGNILVGSYCAFSNRGGLVHPHTSIEDLDELSTLLQVPLVAGTINRGSDVIAAGMTVNDWTAFCGSDTTATELSVIESVFKLREAQPSAIVDEMRKSLIDSYV

SEQ ID NO: 6157 - protein, 245 aa, Fagopyrum esculentum
MATRLQFENNCEVGVFSKLTNAYCLVAIGGSESFYSTFEAELTDYIPIVKTSIGGTRIIGRLCAGNKNGLLLPHTTTDQELQHVRNSLPDEVVVQRIDEKLSALGNCIACNDYVALTHTDLDKETEEMIADVLGVEVFRHTIAGNILVGSYCAFSNKGGLVHPHTSVEDLDELSTLLQVPLVAGTVNRGSDVIAAGLTVNDWTAFCGSDTTATELSVIESVFKLRDAQPTAVVDEMRKSLIDSYV

SEQ ID NO: 6158 - protein, 245 aa, Raphanus sativus
MATRLQFENNCEVGVFSKLTNAYCLVAIGGSENFYSAFESELADVIPIVKTSIGGTRIIGRLCAGNKNGLLVPHTTTDQELQHLRNSLPDSVVVQRIEERLSALGNCIACNDHVALAHTDLDKETEEIIADVLGVEVFRQTIAGNILVGSYCALSNRGGIVHPHTSVEDLDELSTLLQVPLVAGTVNRGSEVIGAGMTVNDWTAFCGSDTTATELSVIDSIFKLREAQPSSIVDEMRKSLIDTYV

SEQ ID NO: 6159 - protein, 245 aa, Raphanus sativus
MATRLQFENNCEVGVFSKLTNAYCLVAIGGSENFYSAFESELADVIPIVKTSIGGTRIIGRLCAGNKNGLLVPHTTTDQELQHLRNSLPDQVVVQRIEERLSALGNCIACNDHVALAHTDLDKETEEIIADVLGVEVFRQTIAGNILVGSYCALSNRGGIVHPHTSVEDLDELSTLLQVPLVAGTVNRGSEVIGAGMTVNDWTSFCGSDTTATELSVIDSIFKLREAQPSSIVDEMRKSLIDTYV

SEQ ID NO: 6160 - protein, 245 aa, Silene vulgaris
MATRLQFENNCEIGVFSKLTNAYCLVAIGGSENFYSTFESELADHIPVVKTSIAGTRIIGRMCAGNKNGLLVPHTTTDQELQHLRNSLPDEVVVQRIEERLSALGNCIACNDYVALTHTDLDKETEEIIADVLGVEVFRQTIAGNILVGSYCSISNKGGLVHPHTSIEDLDELSTLLQVPLVAGTVNRGSEVIAAGLTVNDWTAFCGSDTTATELSVIESVFKLREAQPSAIVDEMRKSLIDTYV

SEQ ID NO: 6161 - protein, 245 aa, Tripterygium wilfordii
MATRLQFENSCEIGVFSKLTNAYCLVAIGGSENFYSTFETELADVIPVVKTSIGGTRIIGRLCAGNKNGLLVPHTTTDQELQHLRNSLPDQVVVQRIEEKLSALGNCIACNDHVALTHTDLDRETEEIVADVLGVEVFRQTIAGNILVGSFCTFSNRGGLVHPHTSIEDLDELSTLLQVPLVAGTVNRGSEVIAAGMTVNDWTAFCGSDTTATELSVIESVFKLREAQPSSIVDEMRKSLVDTYV

SEQ ID NO: 6162 - protein, 245 aa, Tripterygium wilfordii
MATRLQFENSCEVGVFSKLTNAYCLVAIGGSENFYSTFETELADVIPVVKTSIGGTRIIGRLCAGNKNGLLVPHTTTDQELQHLRNSLPDQVVVQRIEEKLSALGNCIACNDHVALTHTDLDRETEEIVADVLGVEVFRQTIAGNILVGSYCTFSNRGGLVHPHTSIEDLDELSTLLQVPLVAGTVNRGSEVIAAGMTVNDWTAFCGSDTTATELSVIESVFKLREAQPSSIVDEMRKSLVDTYV

SEQ ID NO: 6163 - protein, 245 aa, Valeriana officinalis
MATRLQFENNCEIGVFSKLTNAYCLVAIGGSENFYSIFESDLADHIPVVKTSIGGTRIIGRLCAGNKNGLLLPHTTTDQELQHLRNSLPDQVVVQRVDERLSALGNCIVCNDHVALTHTDLDRETEELIADVLGVEVFRQTIAGNILVGSYCVFSNTGGLVHPHTSIEDLDELSTLLQVPLVAGTVNRGSEVVGAGLIVNDWTAFCGSDTTATELSVIESVFKLREAQPGAIVDEMRKSLIDTYV

SEQ ID NO: 6164 - protein, 245 aa, Arabidopsis thaliana
MATRLQFENNCEVGVFSKLTNAYCLVAIGGSENFYSAFESELADVIPIVKTSIGGTRIIGRLCAGNKNGLLVPHTTTDQELQHLRNSLPDQVVVQRIDERLSALGNCIACNDYVALAHTDLDKETEEIIADVLGVEVFRQTIAGNILVGSYCALSNKGGMVHPHTSVEDLEELSTLLQVPLVAGTVNRGSEVIAAGMTVNDWTSFCGSDTTATELSVIDSIFKLREAQPSSIVDEMRKSLIDTYV

SEQ ID NO: 6165 - protein, 245 aa, Unknown
  Sequence found in Organisms: Brassica napus, Brassica rapa
MATRLQFENNCEVGVFSKLTNAYCLVAIGGSENFYSAFESELADVIPIVKTSLGGTRIIGRLCAGNKNGLLVPHTTTDQELQHLRNSLPDAVVVQRIEERLSALGNCIACNDHVALAHTDLDKETEEIIADVLGVEVFRQTIAGNILVGSYCALSNRGGIVHPHTSVEDLDELSTLLQVPLVAGTVNRGSEVIGAGMTVNDWTAFCGSDTTATELSVIDSIFKLREAQPSSIVDEMRKSLIDTYV

SEQ ID NO: 6166 - protein, 245 aa, Brassica napus
MATRLQFENNCEVGVFSKLTNAYCLVAIGGSENFYSAFESELAGVIPIVKTSIGGTRIIGRLCAGNKNGLLVPHTTTDQELQHLRNSLPDQVVVQRIEERLSALGNCIACNDHVALAHTDLDKETEEIIADVLGVEVFRQTIAGNILVGSYCALSNRGGIVHPHTSVEDLDELSTLLQVPLVAGTVNRGSEVIGAGMTVNDWTSFCGSDTTATELSVIDSIFKLREAQPSSIVDEMRKSLIDTYV

SEQ ID NO: 6167 - protein, 235 aa, Eragrostis curvula
  misc_feature (167)..(167): Xaa can be any naturally occurring amino acid
  misc_feature (209)..(209): Xaa can be any naturally occurring amino acid
  misc_feature (223)..(223): Xaa can be any naturally occurring amino acid
  misc_feature (225)..(225): Xaa can be any naturally occurring amino acid
  misc_feature (230)..(230): Xaa can be any naturally occurring amino acid
  misc_feature (234)..(234): Xaa can be any naturally occurring amino acid
MATRIQFENNCEVGVFSKLTNAYCLVAIGGSENFYSAFEAELADVIPVVKTSIGGTRIIGRLCVGNKNGLLLPHTTTDQELQHLRNCLPDQVVVQRIDERLSALGNCIACNDHVALTHPDLDKETEELIADVLGVEVFRQTIAGNILVGSYCTFSNRGGLVHPHTSXEDLDELSTLLQVPLVAGTVNRGSEVIAAGMTVNDWTAFCGSXTTATELSVIESVFXLXEGHPXQLLXT

SEQ ID NO: 6168 - protein, 245 aa, Fragaria vesca
MATRLQFENSCEVGVFSKLTNAYCLVAIGGSESFYSTFEAELADVIPVVKTSIGGTRIIGRLCAGNKNGLLLPHTTTDQELQHLRNSLPDQVVVQRIEERLSALGNCITCNDHVALTHPDLDRETEEMVTDVLGVEVFRNTIATNVLVGSFCALSNRGGLVHPHTSVEDLDELSTLLQVPLVAGTVNRGSEVIAAGMIVNDWTAFCGSDTTATEVSVIESVFKLREAQPSAIVDEMRKSLIDSYV

SEQ ID NO: 6169 - protein, 245 aa, Brassica napus
MATRLQFENNCEVGVFSKLTNAYCLVAIGGSENFYSAFESELADVIPIVKTSLGGTRIIGRLCAGNKNGLLVPHTTTDQELQHLRNSLPDSVVVQRIEERLSALGNCIACNDHVALAHTDLDKETEEIIADVLGVEVFRQTIAGNILVGSNCALSNRGGIVHPHTSVEDLDELSTLLQVPLVAGTVNRGSEVIGAGMTVNDWTAFCGSDTTATELSVIDSIFKLREAQPSSIVDEMRKSLIDTYV

SEQ ID NO: 6170 - protein, 245 aa, Podocarpus macrophillus
MATRTQFENSCEIGVFSKLTNAYCLVAIGGSENFYSTFESELADVIPVVKTSVAGTRIIGRLCVGNKNGLLLPNTTTDQELQHLRNSLPDQVVVQRVEERLSALGNCVVCNDHVALIHTDLDRETEELIADVLGVEVFRQTIAGNILVGSYCAFSNRGGLVHPHTSIEDLDELSTLLQVPLVAGTVNRGSEVVAAGMVVNDWTAFCGLDTTATELSVIESVFKLRESQPSAIVDEMRKSLIDSFV

SEQ ID NO: 6171 - protein, 245 aa, Brassica rapa
MATRLQFENNCEVGVFSKLTNAYCLVAIGGSENFYSAFESELAGVIPIVKTSIGGTRIIGRLCAGNKNGLLVPHTTTDQELQHLRNSLPDQVVGQRIEGRLSALGNCIACNDHVALAHTDLDKETEEIIADVLGVEVFRQTIAGNILVGSYCALSNRGGIVHPHTSVEDLDELSTLLQVPLVAGTVNRGSEVIGAGMTVNDWTSFCGSDTTATELSVIDSIFKLREAQPSSIVDEMRKSLIDTYV

SEQ ID NO: 6172 - protein, 241 aa, Catharanthus roseus
LQFENSCEVGVFSKLTNAYCLVAIGGSENFYSTFESELADVIPVVKTSISGTRIIGRLCAGNKNGLLLPHNTTDQELQHLRNSLPDSVVVQRIEERLSALGNCIACNDHVALTHTDLDRETEEMIADVLGVEVFRQTIAGNILVGSYCAFSNRGGLVHPHTSIEDLDELSTLLQVPLVAGTVNRGSEVIAAGLTVNDWTAFCGSDTTATELSVIERVFKLTEAQPSAIVDEMRKSLIDSYV

SEQ ID NO: 6173 - protein, 245 aa, Cicer arietinum
MATRLQFENNCDIGVFSKLTNAYCMVAIGGSESFYSVFESELSGVIPVVKTSIAGTRIVGRLCAGNKNGLLLPHTTTDQELQHLRNSLPDQVVVQRIEERLSALGNCIACNDHVALTHTDLDRETEEIIADVLGVEVFRQTIAGNILVGSFCALSNRGGLVHPHTSIEDLDELSTLLQVPLVAGTVNRGSEVIAAGMTVNDWTAFCGSDTTATELSVVESVFKLRDSQPSVIVDEMRKSLIDSYV

SEQ ID NO: 6174 - protein, 245 aa, Euonymus alatus
MATRLQFENSCEIGVFSKLTNAYCLVAIGGSENFYSTFEAELADVIPVVKTSIGGTRIIGRLCAGNKNGLLVPHTTTDQELQHLRNSLPDQVVVQRIEEKLSALGNCIACNDHVALTHNDLDRETEEIVADVLGVEVFGHTIAGNILVGSYCTISNRGGLVHPHTSIEELDELSTLLQVPLVAGTVNRGSEVIAAGMTVNDWTSFCGSDTTATELSVIESVFKLREAQPSSIVDEMRKSLVDTYV

SEQ ID NO: 6175 - protein, 245 aa, Mimulus guttatus
MATRLQFENNSEIGVFSKLTNAYCLVAIGGSENFYSTFESELADVIPVVKASIGGTRIIGRLCAGNKKGLLLPHNTTDQELQHLRNSVPDSVVVQRIDERLSALGNCIACNDHVALTHPDLDKETEEMIADVLGVEVFRQTVAGNMLVGSFCALTNRGGLVHPHTSIEDLDELSTLLQVPLVAGTVNRGSEVIGAGLIVNDWTAFCGSDTTATELSVLESVFKLREAQPTAIVDEMRKSLIDTYV

SEQ ID NO: 6176 - protein, 245 aa, Lippia dulcis
MATRLQYENNCEIGVFSKLTNAYCLVAIGGSENFYSTFEAELADVIPVVKTSIAGTRIIGRMCAGNKKGLLLPHNTTDQELQHLRNSLPDSVVVQRIEERLSALGNCISCNDHVALTHPDLDKETEELIADVLGVEVFRQTVAGNILVGSYCTFSNIGGLVHPHTSIEDLDELSTLLQVPLVAGTVNRGSDVIAAGLTVNDWTAFCGSDTTATELSVIESVFKLREAKPSALVDEMRKSLIDTYV

SEQ ID NO: 6177 - protein, 245 aa, Silene vulgaris
MATRLQFENNCEVGVFSKLTNAYCLVAIGGSENFYSTFESELAEHMPVVKTSIAGTRIIGRMCAGNKNGLLVPHSTTDQELQHLRNSLPDEVVVQRIEERLSALGNCIACNDYVALTHTDLDKETEEIIADVLGVEVFRQTIAGNILVGSYCALSNKGGLVHPHTSIEDLDELSTLLQVPLVAGTVNRGSEVIAAGLTVNDWTAFCGSDTTATELSVIESVFKLREAQPSAIVDEMRKSLIDTYV

SEQ ID NO: 6178 - protein, 245 aa, Silene vulgaris
MATRLQFENNCEVGVFSKLTNAYCLVAIGGSENFYSTFESELAEHIPVVKTSIAGTRIIGRMCAGNKNGLLVPHSTTDQELQHLRNSLPDEVVVQRIEEKLSALGNCIACNDYVALTHTDLDKETEEIIADVLGVEVFRQTIAGNILVGSYCALSNKGGLVHPHTSIEDLDELSTLLQVPLVAGTVNRGSEVIAAGLTVNDWTAFCGSDTTATELSVIESVFKLREAQPSAIVDEMRKSLIDTYV

SEQ ID NO: 6179 - protein, 86 aa, Eutrema parvulum
MVHPHTSVEDLDELSTLLQVPLVAGTVNRGSEVIAAGMTVNDWTSFCGSDTTATELSVIDSIFKLREAQPSSIVDEMRKSLIDTYV

SEQ ID NO: 6180 - protein, 86 aa, Eutrema parvulum
MVHPHTSVEDLDELSTLLQVPLVAGTVNRGSEVIAAGMTVNDWTSFCGSDTTATELSVIDSIFKLREAQPNSIVDEMRKSLIDTYV

SEQ ID NO: 6181 - protein, 245 aa, Theobroma cacao
MATRLKFENSCEVGVFSKLTNAYCLVAIGGSESFCSAFESELADVIPVIKTSIAGTRIIGRLCAGNKNGLLVPHTTTDQELQHLRNSLPDQVVVRRIEEKLSALGNCIACNDHVALTHTDLDRETEEIIADVLGVEVFRQTIAGNILVGSYCAFSNRGGLVHPHTSIEDLNELSTLLQVPLVAGTINRGSEVIAAGMTVNDWTAFCGSDTTATELSVIENVFKLREAQPSAIVDEMRKSLIDSSV

SEQ ID NO: 6182 - protein, 245 aa, Papaver somniferum
MAVRLQFENNCEVGVFSKLTNKYCLVAIGGSENFYSTFESELADVIPVVKTSIGGTRIIGRLCAGNKNGLLVPHTTTDQELQHLRNSIPDEVVVQRIDERLSALGNCIACNDHVALTHTDLDRDTEEIIADVLGVEVFRQTIAGNILVGSYCTFSNKGGLVHPHTSVEDLDELSTLLQVPLVAGTVNRGSEVIGAGMIVNDWAAFCGSDTTATELSVIESVFKLREAQPSSIHDEMRKSLIDSFV

SEQ ID NO: 6183 - protein, 245 aa, Primula obconica
MATRLQFENSCEIGVFSKLTNAYCLVAIGGSENFYSTFENELADVIPVVKTSIGGNRIIGRLCAGNKNGLLVPHTTTDQELQHLKNSLPDRVIVQRIDEKLCALGNCIATNDYVALTHTDLDKETEELIADVLGVEVFRQTVAGNILVGSYCSFTNKGGLVHPHTSVEDLDELSTLLQVPLVAGTVNRGSEVIAAGLTVNDWTAFCGSDTTATELSVIESVFKLREAEPSAIVKEMRKSLIDSYV

SEQ ID NO: 6184 - protein, 245 aa, Citrullus lanatus
MATRLMFENSCEIGVFSKLTNAYCLVAIGGSENFYSTFETELGGVIPVVKASIDGTRIIGRLCAGNKNGLLVPHTTTDQELQHLRNSLPDQVVVQRIQERLSALGNTIACNDHVALTHTDLDRETEELIADVLGVEVFRQTVAGNVLVGSYCNFTNRGGLVHPHTSVEDLDELSTLLQVPLVAGTVNRGSEVIAAGLTANDWTAFCGSDTTATELSVIESVFKLREAQPSSIVEEMRKSLIDSYV

SEQ ID NO: 6185 - protein, 118 aa, Linum usitatissimum
MIADVLGVEVFRQTIAGNILVGSYCALSNRGGLVHPHTSMEDMDELSTLLQVPLVAGTVNRGSDVIAAGMTVNDWTAFCGSDTTATELSVIESVFKLREAQPSAIMDEMRKSLVDTYV

SEQ ID NO: 6186 - protein, 489 aa, Medicago truncatula
MATRLQYENSCEIGAFSKLTNAYCLTAIGGSANFYSAFEAELADIIPVVKTSIASTRLVGLLSVGNKNGLLLPHTTTDQELQHLRNSLPDHVLVQRIEEKLSALGNCIACNDHVALAHADLDKETEELIADVLGVEVFRQTVGGNILSGSYCALSNRGGLVHPHTSVEDLDELSTLLQIPLVAGTVNRGSEVIASGMVVNDWTAFCGSDTTATELSVIDTVFKLRPNIKLVSWIKHFCLSSLSVMATRLQFENSCEVGVFSKLTNAYCLVAIGGSENFYSAFEAELSDVIPVIKTSIGGTRIVGRLCIGNKNGLLLPHTTTDQELQHLKNSLPDRVCVQRIEERLSALGNCIACNDHVALTHTDLDKETEEVVADVLGVEVFRQTVAGNILVGSYCAFSNKGGLVHPHTSIEDLDELSTLLQVPLVAGTVNRGSEVIAAGMTVNDWTAFCGSDTTATELSVIESVFKLREAKPSAPVDEMRKSLFDGYN

SEQ ID NO: 6187 - protein, 75 aa, Sarracenia psittacina
MNFRPSFRSRWWRERVNRGSEVIAAGLTVNDWTALCGSDTTATELSVIESVFKLREAQPSAIVDEMRKSLIDAYV

SEQ ID NO: 6188 - protein, 83 aa, Euphorbia esula
MATRLMFENSCEVGVFSKLTNAYCLVAIGGSESFYSAFESELSDVIPVVKTSIAALGLLVVFVLGTKKGFFCPTPPLIKNCNT

SEQ ID NO: 6189 - protein, 84 aa, Utricularia gibba
MATRLQYENNCDIGVFSKLTNAYCLVAIGGSENFYSTFEAELADVIPVVKTSIAGTRIIGRMCARKIKMDCCYHTRLLIKSFST

SEQ ID NO: 6190 - protein, 245 aa, Zostera marina
MATRLQFENSCEIGVFSKLTNAYCLVAIGGSENFYSAFESELADAIPVVKASIGDTRMIGRLCVGNKNGLLLPHTTTDQELQHLRNSIPDSVVVQRIDERMNALGNCIACNDHVALTHTDLDKETEELIADVLGVEVFRQTIAGNILVGSYCTFSNRGGMVHPHTSVEDLDELSTLLQVPLVAGTINRGSDVIAAGMIVNDWAAFCGLDTTATELSVIENIFKLGDSHPTAIVDTMRKSLIDTYV

SEQ ID NO: 6191 - protein, 239 aa, Actinidia deliciosa
  misc_feature (231)..(231): Xaa can be any naturally occurring amino acid
MATRLQFENSCEVGVFSKLTNAYCLVAIGGSESFYSTFEAELADVVPVVKTSIGGTRIIGRLCAGNKNGLLLPHTTTDQELQHLRNSLPDHVVVQRIDERLSALGNCIACNDYVALTHTDLDKETEEMIADVLGVEVFRQTIAGNILVGSYCAFSNKGGLVHPHTSIEDLDELSTLLQVPLVAGTVNRGSEVIAAGLTVNDWTAFCGSDTTATELSVIESVFKLREAQPSXIVDEMRNH

SEQ ID NO: 6192 - protein, 245 aa, Populus trichocarpa
MATRLMFENSCEVGVFSKLTNAYCLVAIGGSENFYSTFEAELGDVIPVVKTSIGGSRIIGRLCAGNKNGILLPHTTTDQELQHLRNSLPDQVVVQRIEERLSALGNGVACNDHVALTHTDLDKETEEMISDVLGVEVFRQTVAGNVLVGSYCAFSNRGGLVHPHTSIEDLDELSTLLQVPLVAGTINRGSEVIAAGLTVNDWAAFCGADTTATELSVIESVFKLREAQPNAIVNEMRNSLIDSYV

SEQ ID NO: 6193 - protein, 245 aa, Papaver somniferum
MATRLQFENNCEVGVFSKLTNAYCLVAIGGSENFYSTFESELADHIPVVKTSIGGTRIVGRLCAGNKNGLLVPHTTTDQELQHLRNILPDEVVVQRIDERLSALGNCVACNDHVALVHTDLDRDTEEIIADVLGVEVFRQTIAGNILVGSYCTFSNTGGLVHPHTSIEDLDELSTLLQVPLVAGTVNRGSEVIGAGMIVNDWTAFCGSDTTATELSVIESVFKLREAQPSLVKDEMRKSLIDSFV

SEQ ID NO: 6194 - protein, 245 aa, Sciadopitys verticillata
MATRTEFENSSEVGVFSKLTNAYCLVAIGGSENFYSTFEAELADVIPVVKTSVAGTRIIGRLCAGNKNGLLLPNTTTDQELQHLRNSLPDQVVVQRVEERLSALGNCVVCNDHVALIHTDLDRETEELIADVLGVEVFRQTIAGNILVGSYCAFSNRGGLVHPHTSIEDLDELSTLLQVPLVAGTVNRGSEVVAAGMVVNDWTAFCGLDTTATELSVIESVFKLRESQPSAIVDEMRKSLIDSFV

SEQ ID NO: 6195 - protein, 245 aa, Taxus baccata
MATRTQFENSCEIGVFSKLTNAYCLVAIGGSENFYSTFESELADIIPVVKTSIGGTRIIGRLCAGNKKGLLLPNSTTDQELQHLRNSLPDQVVVQRVDERLSALGNCVVCNDHVALIHTDLDRETEELIADVLGVEVFRQTIAGNILVGSYGVFSNRGGLVHPHTSIEDLDELSTLLQVPLVAGSVNRGSEVVAAGMIVNDWTAFCGLDTTATELSVIESVFKLRESQPSAIVDEMRKSLIDSFV

SEQ ID NO: 6196 - protein, 86 aa, Eutrema halophilum
MVHPHTSVEDLDELSTLLQVPLVAGTVNRGCEVIAAGMTVNDWTSFCGSDTTATELSVIDSIFKLREARPSSIVDEMRKSLIDTYV

SEQ ID NO: 6197 - protein, 121 aa, Ambrosia trifida
MIADVLGVEVFRQTIAGNILVGSYCAFSNRGGMVHPHTSIEDLDELSTLLQVPLVAGTVNRGSEVIAAGLTVNDWTAFCGSDTTATELSVIESVFKLREAQPSAIVDENRRKSLIGHLRLN

SEQ ID NO: 6198 - protein, 243 aa, Trifolium pratense
MATRLKFENSCEVGVFSKLTNAYCLVAIGGSENFYSAFEAELSDVIPVIRTSIGGTRIVGRLCIGNKNGLLLPHTTTDQELQHLKNSLPDQVRVQRIEEKLSALGNCIACNDHVALTHTDLDKETEEVVADVLGVEVFRQTVAGNILVGSYCAFSNKGGLVHPHTSVEDLDELSTLLQVPLVAGTVNRGSEVIAAGMTVNDWTAFCGADTTATELSVIENVFKLREAKPSAIVDEMRKSLFDS

SEQ ID NO: 6199 - protein, 245 aa, Cucurbita pepo
MATRLMFENSCEIGVFSKLTNAYCLVAIGGSENFYSAFESELGGVIPVVKTSIDGTRIIGRLCAGNKNGLLVPHTTTDQELQHLRNSLPDQVVVQRIQERLSALGNTISCNDHVALTHTDLDRETEELIADVLGVEVFRQTVAGNVLVGSYCSFTNRGGLVHPHTSIEDLDELSTLLQVPLVAGTVNRGSEVIAAGLIANDWTAFCGSDTTATELSVIESVFKLREAQPSSIVDEMRKSLIDSYV

SEQ ID NO: 6200 - protein, 245 aa, Distylium racemosum
MATRTQFENSCDVGVFSKLTNAYCLVAIGGSENFYSTFESELADVIPVVKTSVAGTRIIGRLCVGNKNGLLLPNTTTDQELQHLRNSLPDQVVVQRVEERLSALGNCVVCNDHVALIHTDLDRETEELIADVLGVEVFRQTIAGNILVGSYCALSNRGGLVHPHTSIEDLDELSTLLQVPLVAGTVNRGSEVVAAGMIVNDWTAFCGLDTTATELAVIESVFKLRESQPTAIVDEMRKSLIDTFV

SEQ ID NO: 6201 - protein, 236 aa, Flaveria ramosissima
MATRLQFENSCEIGVFSKLTNAYCLVAIGGSENFYSTFESELADVIPMVKTSIGGTRIIGRLCIGNKNGLLLPHTTTDQELQHLRNSLPDAVVVQRLDERLSALGNCIACNDHVALTHTDLDRETEEMIADVLGVEVFRQTIAGNILVGSYCAFSNRGGMVHPHTSIEELDELSTLLQVPLVAGTVNRGSEVIAAGLTVNDWTAFCGSDTTATELSVIESVFKLREAQPSAIVDEM

SEQ ID NO: 6202 - protein, 245 aa, Medicago truncatula
MATRLQFENNCDIGVFSKLTNGYCMVAIGGSESFYSVFESELGGVIPVVKTSIAGTRIVGRLCAGNKNGLLLPHTTTDQELQHLRNSLPDQVVVQRIEEKLSALGNCIACNDHVALTHTDLDRETEEIIADVLGVEVFRQTIAGNILVGSFCALSNRGGLVHPHTSIEDLDELSTLLQVPLVAGTVNRGSEVIAAGMIVNDWTSFCGSDTTATELSVIESVFKLRDSQPSVIVDEMRKSLIDSYV

SEQ ID NO: 6203 - protein, 245 aa, Cucumis melo
MATRLMFENSCEIGVFSKLTNSYCLVAIGGSEDFYSTFEAELGAVIPVVKTSIHGTRIIGRLCAGNKNGLLLPHTTTDQELQHLRNSLPDQVVVQRIQERLSALGNTIACNDHVALTHTDLDRETEDLIADVLGVEVFRQTIAGNDLVGSYCSFTNRGGLVHPHTSIEDLDELSTLLQVPLVAGTVNRGSAVIAAGLTANDWTAFCGSDTSATELSVIESVFKLREAQPSSIVEEMRKSLIDSYV

SEQ ID NO: 6204 - protein, 245 aa, Phalaenopsis aphrodite
MATRLQFENCCDIGVFSKLTNAYCLVAIGGSENFYSVFESELADVIPVVKTSIAGTRIIGRMCAGNKNGLLVPHSTTDQELQHLRNSLPDQVIVQRIEEKLSALGNCIACNDHVALTHPDLDRETEDLIADILGVEVFRQTVAGNILVGSYCAFSNKGGLVHPHTSIEDLDELSTLLQVPLVAGTVNRGSEVIAAGMAVNDWTAFCGLDTTATELSVIESVFKLREAHPNMIVDEMRKSLIDSYV

SEQ ID NO: 6205 - protein, 245 aa, Pinus taeda
MATRTQFENSSEIGVFSKLTNGYCLVAIGGSENFYSTFEAELADVIPVVKTSIGGTRIVGRLCAGNKNGLLLPNTTTDQELQHLRNSLPDGVVVQRVEERLSALGNCVVCNDHVALIHTDLDRETEELIADVLGVEVFRQTIAGNILVGSYSAFSNRGGLVHPHTSIEDLDELSTLLQVPLVAGTVNRGSEVIGAGMIVNDWTAFCGLDTTATELSVIESVFKLRESQPSAIVDEMRKSLIDTFV

SEQ ID NO: 6206 - protein, 250 aa, Cannabis sativa
ANKTVELEGLQFENSCEVGVFSKLTNAYCLVAIGGSENFYSTFESEFAGVIPVVKTSISGTRIIGRLCAGNKNGLLVPHNTTDQELQHLRNSLPDQVVVQRIEEKLSALGNCIACNDHVALTHTDLDKETEEMIADVLGVEVFRQTIAGNILVGSYCTFSNRGGLVHPHTSVEDLDELSTLLQVPLVAGTVNRGSEVIAAGMTVNDWTAFCGSDTTATELSVIESVFKLREGQPGAIVDEMRKSLIDTYV

SEQ ID NO: 6207 - protein, 245 aa, Beta vulgaris
MATRLQFENNCEVGVFSKLTNAYCLVAIGGSENFYSTFETELADYIPVVKTSIAGTRIIGPNVCRNKNGLLVPHTTTDQELQHLRNCLPDSVVVQRIEEKLSALGNCIACNDYVALTHTDLDKETEELIADVLGVEVFGQTIAGNILVGSYCAITNKGGLVHPHTSIEDLDELSTLLQVPLVAGTVNRGSEVIAAGLTVNDWTAFCGSDTTATELSVIESVFRLREAQPSAIVDEMRKSLIDSTI

SEQ ID NO: 6208 - protein, 245 aa, Fagus grandifolia
MATRLQFENSCEVGVFSKLTNKYCLVAIGGSESFYSAFESELAGTIPVVKTSIAGTRIIGRLCAGNKNGLLLPHNTTDQELQHLRNSLPDGVVVQRTEERLSALGNCIACNDFVALTHTDLDRETEEMIADVLGVEVFRQTIAGNILVGSYCAFSNRGGLVHPHTSIEDMTELATLLQVPLLAGTVNRGSEVIAAGMTVNDWTAFCGSDTTATELAVIESAFKLREAQPSAIVDEMRKSLIDTYV

SEQ ID NO: 6209 - protein, 245 aa, Pinus pinaster
MATRTQFENSSEIGVFSKLTNGYCLVAIGGSENFYSTFEAELADVIPVVKTSIGGTRIVGRLCAGNKNGLLLPNTTTDQELQHLRNSLPDEVVVQRVEERLSALGNCVVCNDHVALIHTDLDRETEELIADVLGVEVFRQTIAGNILVGSYSVFSNRGGLVHPHTSIEDLDELSTLLQVPLVAGTVNRGSEVIGAGMIVNDWTAFCGLDTTATELSVIESVFKLRESQPSAIVDEMRKSLIDTFV

SEQ ID NO: 6210 - protein, 245 aa, Quercus alba
MANRIQFENSCDVGVFSKLTNAYCLVAIGGSESFYSAFEAELADVIPVVKTSIAGTRIIGRLCAGNKNGLLLPHNTTDQELQHLRNSLPDQVVVQRIDERLSALGNCIACNDHVALTHTDLDKETEEMIADVLGVEVFRQTIAGNILVGSYCAFSNKGALVHPHTSVEDMNELATLLQVPVSAGTVNRGSEVIGAGLTVNDWTAFCGSDTTATELNVIETAFQLKPAQPSAIVDEMRKSLIDSYV

SEQ ID NO: 6211 - protein, 245 aa, Pinus taeda
MATRTQFENSSEVGVFSKLTNGYCLVAIGGSENFYSTFEAELADAIPVVKTSIGGTRIVGRLCAGNKNGLLLPNTTTDQELQHLRNSLPDEVVVQRVEERLSALGNCVVCNDHVALIHTDLDRETEELIADVLGVEVFRQTIAGNILVGSYSVFSNRGGLVHPHTSIEDLDELSTLLQVPLVAGTVNRGSEVIGAGMIVNDWTAFCGLDTTATELSVIESVFKLRESQPSAIVDEMRKSLIDTFV

SEQ ID NO: 6212 - protein, 245 aa, Picea glauca
MATRIQFENSSEVGVFSKLTNAYCLVAIGGSENFYSTFEAELADVIPVVKTSITGTRIIGRLCAGNKNGLLLPNMTTDQELQHLRNSLPDEVVVQRVEERLSALGNCVVCNDHVALIHTDLDRETEELIADVLGVEVFRQTIAGNILVGSYCMFSNRGGLVHPHTSIEDLDELSTLLQVPLVAGTVNRGSEIIGAGMIVNDWTAFCGLDTTATELSVIESVFKLRESQPSAIVDEMRKSLIDTFV

SEQ ID NO: 6213 - protein, 239 aa, Raphanus sativus
  misc_feature (226)..(226): Xaa can be any naturally occurring amino acid
  misc_feature (228)..(228): Xaa can be any naturally occurring amino acid
MATRLQFENNCEVGVFSKLTNAYCLVAIGGSENFYSAFESELADVIPIVKTSIGGTRIIGRLCAGNKNGLLVPHTTTDQELQHLRNSLPDSVVVQRIEERLSALGNCIACNDHVALAHTDLDKETEEIIADVLGVEVFRQTIAGNILVGSYCALSNRGGIVHPHTSVEDLDELSTLLQVPLVAGTVNRGSEVIGAGMTVNDWTAFCGSDTTATELSVIDSIFKLRXPXQLHVDEMRKSL

SEQ ID NO: 6214 - protein, 166 aa, Pinus pinaster
MATRTQFENSSEIGVFSKLTNGYCLVAIGGSENFYSTFEAELADVIPVVKTSIGGTRIVGRLCAGNKNGLLLPNTTTDQELQHLRNSLPDEVVVQRVEERLSALGNCVVCNDHVALIHTDLDRETEELIADVLGVEVFRQTIAGNILVGSYSVFSNRVVWSIHTLQ

SEQ ID NO: 6215 - protein, 245 aa, Abies balsamea
MATRIQFENNSEVGVFSKLTNAYCLVAIGGSENFYSTFEAELAEVIPVVKTSIAGTRIVGRLCAGNKKGLLLPNTTTDQELQHLRNSLPDEVVVQRVEERLSALGNCVVCNDHVALIHTDLDRETEELIADVLGVEVFRQTIAGNILVGSYCVFSNRGGLVHPHTSIEDLDELSTLLQVPLVAGTVNRGSEVVGAGMIVNDWTAFCGLDTTATELSVIESVFKLRESQPSAIVDEMRKSLIDTFV

SEQ ID NO: 6216 - protein, 245 aa, Cedrus atlantica
MATRTQFENSSEIGVFSKLTNAYCLVAIGGSENFYSTFEAELADVIPVVKASIAGTRIVGRLCAGNKNGLLLPNTTTDQELQHLRNSLPDEVVVQRVEERLSALGNCVVCNDHVALIHTDLDRETEELIADVLGVEVFRQTIAGNILVGSYSVFSNRGGLVHPHTSIEDLDELSTLLQVPLVAGTVNRGSEVIGAGMIVNDWTAFCGLDTTATELSVIESVFKLRESQPSAIVDEMRKSLIDTFV

SEQ ID NO: 6217 - protein, 245 aa, Cryptomeria japonica
MATRAQFENSSEVGVFSKLTNAYCLVAIGGSENFYSTFESELAEVIPVVKTSIAGTRIIGRLCVGNKNGLLLPNTTTDQELQHLRNSLPDQVVVQRVDERLSALGNCVVCNDHVGLIHTDLDRETEELIADVLGIEVFRQTIAGNILVGSYGVLSNRGGLVHPHTSIEDLDELSTLLQVPLVAGTVNRGSEVVAAGMIVNDWTAFCGLDTTATELSVIESVFKLRESQPSAIVDEMRKSLIDSFV

SEQ ID NO: 6218 - protein, 245 aa, Cucumis sativus
MATRLMFENSCEIGVFSKLTNSYCLVAIGGSEDFYSTFEAELGAVIPVVKTSIHGTRIIGRLCAGNKNGLLLPHTTTDQELQHLRNSLPDQVVVQRIQERLSALGNTIACNDHVALAHTDLDRETEDLIADVLGVEVFRQTVAGNDLVGSYCSFTNRGGLVHPHTSIEDLDELSTLLQVPLVAGTVNRGSAVIAAGLTANDWTAFCGSDTSATELSVIESVFKLREAQPSSIVEEMRKSLIDSYV

SEQ ID NO: 6219 - protein, 232 aa, Eschscholzia californica
AYYSKLTNAYCLVAIGGSENFYSTFESELADVIPVVKTSIGGTRIIGRLCAGNKNGLLVPHTTTDQELQHLRNSLPDQVVVQRIDERLSALGNCIACNDHVALTHTDLDRDTEEIIADVLGVEVFRQTIAGNILVGSYCTFSNRGGLVHPHTSIEDLDELSTLLQVPLVAGTVNRGSEVIAAGMTVNDWTAFCGSDTTATELSVIESVFKLREAQPSAIVDEMRKSLIDSYV

SEQ ID NO: 6220 - protein, 245 aa, Euonymus alatus
MATRLQFENSCEIGVFSKLTNAYCLVAIGGSENFYSTFEAELADVIPVVKTSIGGTRIIGRICAGNKNGLLVPHTTTDQELQHLRNSLPDQVEVRKIEEKLSALGNCIACNDHVALTHTELDKETEELVQDVLGVEVFRHTIAGNILVGSFCTLSNRGGLVHPHTSIEDLDELSTLLQVPLVAGTVNRGSEVIGAGMTVNDWTAFCGSDTTATELSVIEGVFKLREAQPSTIVDEMRKSLVDTYV

SEQ ID NO: 6221 - protein, 245 aa, Cucumis melo
MATRLMFENSCEIGVFSKLTNAYCLVAIGGSENFYSAFETELRGVIPVVKASIGGTRIIGRLCAGNKNGLLVPHTTTDQELQHLRNSLPDQVVIQRIQERLSALGNTISCNDHVALAHTDLDRETEDLIADVLGVEVFRQTVAGNVLVGSYSSFTNRGGLVHPHTSVEDLDELSTLLQVPLVAGTVNRGSEVIAAGLTANDWTAFCGSDTTATELSVIENVFKLREAQPSSIVEEMRKSLIDSYV

SEQ ID NO: 6222 - protein, 245 aa, Momordica charantia
MATRLMFENSCEVGVFSKLTNAYCLVAIGGSENFYSAFESELGGVIPVVKASIDGTRIIGRLCAGNKNGLLVPHTTTDQELQHLRNSLPDQVVVQRIQERLSALGNTIACNDHVALAHTDLDRETEELIADVLGVEVFRQTVAGNVLVGSYCSFTNRGGLVHPHTSIEDLDELSTLLQVPLVAGTVNRGSEVIAAGLTANDWIAFCGSDTTATELSVIESVFKLREAQPSSIVDEMRKSLIDSYV

SEQ ID NO: 6223 - protein, 245 aa, Petunia hybrida
MATRLQFENSCEVGVFSKLTNAYCLVAIGGSENFYSVFEDALPENFPVIKTSIGGTRIIGRLCAGNKNGLLLPHTTTDQELQHLRNSLPDGVVVQRIEERLSALGNCIACNDHVALTHTDLDKETEEMIADVLGVEVFRQTIAGNILVGSYCTFSNLGGLVHPHTSIEDLDELSTLLQIPLAAGTVNRGSEVVAAGLTVNDWAAFCGSDTTATELSVIENIFKLREAQPGAIVDEMRKSLIDTYV

SEQ ID NO: 6224 - protein, 245 aa, Picea glauca
MATRIQFENSSEVGVFSKLTNAYCLVAIGGSENFYSTFEAELADVIPVVKTSIAGTRIVGRLCAGNKNGLLLPNTTTDQELQHLRNSLPDEVVVQRVEERLSALGNCVVCNDHVALIHTDLDRETEELIADVLGVEVFRQTIAGNILVGSYCVLSNRGGLVHPHTSIEDLDELSTLLQVPLVAGTVNRGSEVIGAGMIVNDWTAFCGLDTTATELSVVESVFKLRESQPSAIVDEMRKSLIDTFV

SEQ ID NO: 6225 - protein, 245 aa, Picea glauca
MATRTQFENSSEVGVFSKLTNAYCLVAIGGSENFYSTFEAELADVIPVVKTSIAGTRIIGRLCAGNKNGLLLPNTTTDQELQHLRNSLPDEVVVQRVEERLSALGNCVVCNDHVALIHTDLDRETEELIANVLGVEVFRQTIAGNILVGSYCMFSNRGGLVHPHTSIEDLDELSTLLQVPLVAGTVNRGSEVIGAGMIVNDWTAFCGLDTTATELSVIESVFKLRESQPSAIVDEMKKSLIDTFV

SEQ ID NO: 6226 - protein, 245 aa, Picea glauca
MATRIQFENSSDVGVFSKLTNAYCLVAIGGSENFYSTFEAELADVIPVVKTSIAGTRIVGRLCAGNKNGLLLPNTTTDQELQHLRNSLPDEVVVQRIEERLSALGNCVVCNDHVALIHTDLDRETEELIADVLGVEVFRQTIAGNILVGSYCVLSNRGGLVHPHTSIEDLDELSTLLQVPLVAGTVNRGSEVIGAGMIVNDWTAFCGLDTTATELSVVESVFKLRESQPSAIVDEMRKSLIDTFV

SEQ ID NO: 6227 - protein, 245 aa, Zamia vazquezii
MATKTQFENSSDVGVFSKLTNAYCLVAIGGSENFYSTFEAELADVIPVVKTSIAGTRVIGRICAGNKNGLLLPHTTTDQELQHLRNSLPDQVVVQRVDERLSALGNCVGCNDHVALIHTDLDKETEELIADVLGVEVFRQTIAGNILVGSYCVFSNRGGLVHPHTSIEDLDELSTLLQVPLVAGSVNRGSEVVGAGLVANDWTAFCGLDTTATELSVIESVFKLRESQPSAIVDEMRKSLIDSYV

SEQ ID NO: 6228 - protein, 235 aa, Prunus persica
MATRLQFENSCEVGVFSKLTNAYCLVSIGGSENFYSTFEAELADVIPVVKTSIGGTRIIGRLCAGNKNGLLLPHTTTDQELQHLRNSLPDHVVVQRIEERLSALGNCIACNDHVALTHTDLDRETEEMIADVLGVEVFRQTIAGNILVGSYCAFTNRGGMVHPHTSVEDLDELSTLLQVPLVAGTVNRGSEVIAAGMTVNDWTAFCGSDTTATELSVIESVFKLREAQPRPLWMK

SEQ ID NO: 6229 - protein, 164 aa, Quercus alba
MANRIQFENSCDVGVFSKLTNAYCLVAIGGSESFYSAFEAELADVIPVVKTSIAGTRIIGRLCAGNKNGLLLPHNTTDQELQHLRNSLPDQVVVQRIDERLSALGNCIACNDHVALTHTDLDKETEEMIADVLGVEVFRQTIAGNILVGSYCAFSNKGSSPYIR

SEQ ID NO: 6230 - protein, 245 aa, Cephalotaxus harringtonia
MATRTQFENSSEVGVFSKLTNAYCLVAIGGSENFYSTFESELAGIIPVVKTSIAGTRIIGRLCAGNKNGLLLPNTTTDQELQHLRNSLPDQVVVQRVDESLSALGNCVVCNDHVSLIHTDLDRETEELIADVLGVEVFRQTIAGNTLVGSYGVFSNRGGLVHPHTSIEDLDELSTLLQVPLVAGTVNRGSEVVAAGMIVNDWTAFCGLDTTATELSVIESVFKLRESQPSAIVDEMRKSLIDSFV

SEQ ID NO: 6231 - protein, 245 aa, Castanea mollissima
MANRIQFENSCDVGVFSKLTNAYCLVAIGGSESFYSAFEAELADVIPVVKTSIAGTRIIGRLCAGNKNGLLLPHNTTDQELQHLRNSLPDQVVVQRIDERLSALGNCIACNDHVALTHTDLDRETEEMIADVLGVEVFRQTIAGNILVGSYCAFSNKGALVHPHTSVEDMNELATLLQVPVSAGSVNRGSEVIGAGLTVNDWTAFCGSDTTATELNVIETAFQLKPAQPSAIVDEMRKSLIDSYV

SEQ ID NO: 6232 - protein, 245 aa, Cycas rumphii
MATRTQFENSSEVGVFSKLTNAYCLVAIGGSENFYSTFEAELADVIPVVKTSIAGTRVIGRICAGNKNGLLLPNTTTDQELQHLRNSLPDQVVVQRVEERLSALGNCVVCNDHVALIHTDLDRETEEMIADVLGVEVFRQTIAGNILVGSYCIFTNRGGLVHPHTSIEDLDELSTLLQVPLVAGTVNRGSEVVGAGMVVNDWTAFCGLDTTATELSVIESVFKLRESQPSAIVDEMRKSLIDTFV

SEQ ID NO: 6233 - protein, 245 aa, Pseudotsuga menziesii
MATRTQFENSSEVGVFSKLTNAYCLVAIGGSENFYSTFEAELADVIPVVKTSIADARIVGRLCAGNKNGLLLPNTTTDQELQHLRNSLPDEVVVQRVEERLSALGNCVVCNDHVALIHTDIDRETEELIADVLGVEVFRQTIAGNILVGSYCAFSNRGGLVHPHTSIEDLDELSTLLQVPLVAGTVNRGSEVIGAGMIVNDWTAFCGLDTTATELSVIESVFKLRESQPSAIVDEMRKSLIDTFV

SEQ ID NO: 6234 - protein, 245 aa, Picea glauca
MATRTQFENSSEVGVFSKLTNAYCLVAIGGSENFYSTFEAELADVIPVVKTSIAGTRIIGRLCAGNKNGLLLPNTTSDQELQHLRNSLPDEVVVQRVEERLSALGNCVVCNDHVALIHTDLDRETEELIANVLGVEVFRQTIAGNILVGSYCMFSNRGGLVHPHTSIEDLDELSTLLQVPLVAGTVNRGSEVIGAGMIVNDWTAFCGLDTTATELSVIESVFKLRESQPSAIVDEMKKSLIDTFV

SEQ ID NO: 6235 - protein, 246 aa, Fagopyrum esculentum
MATTRLQFENNCEIGVFSKLTNTYCLVAIGGSESFYSTFEADLTEHIPVVKASIGGTRIIGRLCAGNRKGLLLPHTTTDQELQHLRNSLPDEVVVQRIEEKLSALGNCIACNDYVALAHTDLDRETEEMIADVLGVEVFRQTIAGNILVGSYCALSNKGGLVHPHTSVEDLDELSTLLQVPLVAGTVNRGSEVIAAGLTVNDWTAFCGSDTTATEISVIESVFKFGGDNPPAIVDEMRKSLIDSYV

SEQ ID NO: 6236 - protein, 83 aa, Flaveria ramosissima
MATRLRFENSCEVGVFTKLTNAYCLVATEGSENFYSVFESELADVIPVVKTSIGGTRIIGRLCIGIKKAFFCLTLLLTKNFNT

SEQ ID NO: 6237 - protein, 219 aa, Pinus taeda
MATRTQFENSSEIGVFSKLTNGYCLVAIGGSENFYSTFEAELADVIPVVKTSIGGTRIVGRLCAGNKNGLLLPNTTTDQELQHLRNSLPDGVVVQRVEERLSALGNCVVCNDHVALIHTDLDRETEELIADVLGVEVFRQTIAGNILVGSYSAFSNRGGLVHPHTSIEDLDELSTLLQVPLVAGTVNRGSEVIGEMIGQLFVVWTQLQLNCLLSKVFSS

SEQ ID NO: 6238 - protein, 245 aa, Cucumis sativus
MAIRLMFENSCDIGVFSKLTNAYCLVAIGGSENFYSTFETEIRGVIPVVKASIGGTRIIGRLCAGNKNGLLVPHTTTDQELQHLRNSLPDQVVVQRIQERLSALGNTIACNDHVALAHSDLDRETEELIADVLGVEVFRQTVAGNVLVGSYSSFTNRGGLVHPHTSVEDLDELSTLLQVPLVAGTVNRGSEVIAAGLTANDWTAFCGSDTTATELSVIENVFKLREAQPSSIVEEMRKSLIDSHV

SEQ ID NO: 6239 - protein, 219 aa, Pinus taeda
MATRTQFENSSEVGVFSKLTNGYCLVAIGGSENFYSTFEAELADAIPVVKTSIGGTRIVGRLCAGNKNGLLLPNTTTDQELQHLRNSLPDEVVVQRVEERLSALGNCVVCNDHVALIHTDLDRETEELIADVLGVEVFRQTIAGNILVGSYSVFSNRGGLVHPHTSIEDLDELSTLLQVPLVAGTVNRGSEVIGEMIGQPFVVWTQLQLNCLLSKVFSS

SEQ ID NO: 6240 - protein, 245 aa, Centaurea maculosa
  misc_feature (22)..(22): Xaa can be any naturally occurring amino acid
  misc_feature (28)..(28): Xaa can be any naturally occurring amino acid
MATRLRFENSCEIGVFTKLTNXYCLVAXEGSESFYSIFESELADVIPVVKTSIGGTRIIGRLCIGNKKGLLLPHTTTDQELQHLRNSLPDEVVVQRINEKLSALGNCMACNDHVALTHTDLDKETEDMIADVLGVEVFRQTIAGNVLVGSYCAFSNRGGLVHPHTSVEDLDELSTLLQVPLVAGTVNRGSEVIAGGLIVNDWTAFCGSDTTATELSVIENVFKLRDNQPNDIANEMRKSLIDAHV

SEQ ID NO: 6241 - protein, 245 aa, Cephalotaxus harringtonia
MATRTQFENSSEVGVFSKLTNAYCLVAIGGSENFYSTFESELAGIIPVVKTSIAGTRIIGRLCAGNKDGLLLPNTTTDQELQHLRNSLPDQVVVQRVDESLSALGNCVVCNDHVALIHTDLDRETEELIADVLGVEAFRQTIAGNTLVGSYGVFSNRGGLVHPHTSIEDLDELSTLLQVPLVAGSVNRGSEVVAAGMIVNDWTAFCGLDTTATELSVIESVFKLRESQPSAIVDEMRKSLIDSFV

SEQ ID NO: 6242 - protein, 245 aa, Cirsium arvense
MATRLRFENSCEIGVFTKLTNGYCLVANEGSESFYSIFESELADVIPVVKTSIGGTRIIGRLCIGNKKGLLLPHTTTDQELQHLRNSLPDEVVVQRINEKLSALGNCMACNDHVALTHTDLDKETEDMIADVLGVEVFRQTIAGNVLVGSYCAFSNRGGLVHPHTSVEDLDELSTLLQVPLVAGTVNRGSEVIAGGLIVNDWTAFCGSDTTATELSVIENVFKLRDNQPNDIANEMRKSLIDTHV

SEQ ID NO: 6243 - protein, 245 aa, Cynara scolymus
MATRLRFENSCEIGVFTKLTNGYCLVADEGSESFYSIFESELADVIPVVKTSIGGTRIIGRLCIGNKKGLLLPHTTTDQELQHLKNSLPDEVVVQRIDEKLSALGNCMACNDHVALTHTDLDKETEDMIADVLGVEVFRQTIAGNVLVGSYCAFSNRGGLVHPHTSIEDLDELSTLLQVPLVAGTVNRGSEVIAGGLIVNDWTAFCGSDTTATELSVIENVFKLRETQPTDIANEMRKSLIDTHA

SEQ ID NO: 6244 - protein, 245 aa, Pinus pinaster
MATRTQFENSSEVGVFSKLTNGYCLVAIGGSENFYSTFEAELADVIPVVKTSIGGTRIVGRLCAGNKKGLLLPNTTTDQELQHLRNSLPDEVVAQRVEERLSALGNCVVCNDHVALIHTDLDRETEELIADVLGVEVFRQTIAGNILVGSYSVFSNRGGLVHPHTSIEDLDELSTLLQVPLAAGTVNRGSEVIGAGMIVNDWTAFCGLDTTATELSVIESVFKLRESQPSAIVDEMRKSLIDTFV

SEQ ID NO: 6245 - protein, 243 aa, Cajanus cajan
VGLQFENNCEVGGFSKLTNAYCLVPIGGSENFYSVFEAALADVIPVVKTSIAGIRTLGYQCAGNKNGLLVPHTTTDQELQHLRNSLPDQVVVQRIEERLCALGNCIACNDHVALAHTDLDAETEEIIADVLGVEVFRQTIAGNILVGSYCAFSNRGGLVHPHTSIEDLDELSTLLQVPLVAGTVNRGSEVIASGMSVNDWIAFCGSDTTATELSVIESVFKLREAQPSAIVDEMRKSLIDIYV

SEQ ID NO: 6246 - protein, 244 aa, Plantago ovata
MATRLHYENNSEIGVFSKLTNAYCLVAIGGSENFYSTFESELADVIPVVKTSIAGTRIVGRLCAGNKNGLLLPHTTTDQELQHLRNSLPDSVVQRIEERLSALGNCIACNDHVALTHIDLDKETEEIVADVLGVEVFRQSIASNVLVGSFCAFSNRGGLVHPHTSIEDLDELSTLLQVPLVAGTVNRGSEVIAAGLTVNDWTAFCGADTTATELSVVENVFKLREARPNVLVDEMRKSLIDTIV

SEQ ID NO: 6247 - protein, 245 aa, Sequoia sempervirens
MATRTQFENSSEVGVFAKLTNAYCLVAIGGSENFYSTFESELAEVIPVVKTSIAGTRIIGRLCAGNKNGLLLPNTTTDQELQHLRNSLPDQVVVQRVDERLSALGNCVVCNDHVGLIHTDLDRETEEMIADVLGIEVFRQTIAGNILVGSYGVLSNRGGLVHPHTSIEDLDELSTLLQVPLVAGTVNRGSEVVGAGMIVNDWTAFCGLDTTATELSVIESVFKLRESQPSAIVDEMRKSLIDSFV

SEQ ID NO: 6248 - protein, 250 aa, Citrullus lanatus
HILCFSSLGLMFENSCEIGVFSKLTNAYCLVAIGGSENFYSTFETELGGVIPVVKTSIDGTRIIGRLCAGNKNGLLVPHTTTDQELQHLRNSLPDQVVVQRIQERLSALGNTIACNDHVALTHTDLDRETEELIADVLGVEVFRQTVAGNVLVGSYCSFTNRGGLVHPHTSVEDLDELSTLLQVPLVAGTVNRGSEVIAAGLTANDWTAFCGSDTTATELSVIESVFKLREAQPSSIVEEMRKSLIDSYV

SEQ ID NO: 6249 - protein, 108 aa, Ambrosia trifida
MIADVLGVEVFRQTIAGNILVGSYCAFSNRGGMVHPHTSIEDLDELSTLLQVPLVAGTVNRGSEVIAAGLTVNDWTAFCGSDTTATELSVIESVFKLREAQPVPLWMR

SEQ ID NO: 6250 - protein, 245 aa, Helianthus annuus
MATRLRFENSCEIGVFTKLTNSYCLVANEGSDSFYSVFESELADTIPVVKTSIGGTRIIGRLCIGNKKGLLLPHTTTDQELQHLKNSLPDAVVVQRINERLSALGNCMACNDHVALTHTDLDKETEEMIADVLGVEVFRQTIAGNVLVGSYCAFSNRGGLVHPHTSVEDLEELSTLLQVPLVAGTVNRGSEVIAGGLTVNDWTAFCGSDTTATELSVIENVFKLREAQSSAIADETRKSLVSTYV

SEQ ID NO: 6251 - protein, 245 aa, Ambrosia trifida
MATRLRFENSCEIGVFTKLTNSYCLVANEGSDSFYSVFESELADTIPVVKTSIGGTRIIGRLCIGNKKGLLLPHTTTDQELQHLKNSLPDAVVVQRINERLSALGNCMACNDHVALTHTDLDKETEEMIADVLGVEVFRQTIAGNVLVGSYCAFSNRGGLVHPHTSVEDLEELSTLLQVPLVAGTVNRGSEVIAGGLTVNDWTAFCGSDTTATELSVIENVFKLREAQSSAVADETRKSLVSTYV

SEQ ID NO: 6252 - protein, 245 aa, Ambrosia trifida
MATRLRFENSCEIGVFTKLTNSYCLVANEGSDSFYSVFETELADTIPVVKTSIGGTRIIGRLCIGNKKGLLLPHTTTDQELQHLKNSLPDAVVVQRINERLSALGNCMACNDHVALTHTDLDKETEEMIADVLGVEVFRQTIAGNVLVGSYCAFSNRGGLVHPHTSVEDLEELSTLLQVPLVAGTVNRGSEVIAGGLTVNDWTAFCGSDTTATELSVIENVFKLREAQSSAVADETRKSLVSTYV

SEQ ID NO: 6253 - protein, 245 aa, Cichorium intybus
MATRLRFENSCEIGVFTKLTNAYCLVANEGSESFYSIFESELADVIPVVRTTIGGTRIVGRLCIGNKKGLLLPHTTTDQELEHMRNSLPDTVVVQRINEKLSALGNCMACNDHVALTHTDLDKETEEMIADVLGVEVFRQTIAGNTLVGSYCAFSNKGGLVHPHTSVEDLDELSTLLQVPLVAGTVNRGSEVIAGGLTVNDWTAFCGSDTTATELSVIENVFKLREARPEAIANEMKKSLIDTYV

SEQ ID NO: 6254 - protein, 245 aa, Gnetum gnemon
MATRTQFENCNEVGVFSKLTNKYCLVAIGGSENFYSTFEAELSDVIPVVKTSIADTRIIGRICVGNKNGLLLPNTATDQELQHLRNSLPDQVVVQRIEERLSALGNVVACNDHVALIHTDLDRESEELIADVLGVEVFRQTIAGNILVGSYCVFSNRGGLVHPHTSIEDLDELSTLLQVPLVAGTVNRGSDVLAAGMVANDWTAFCGLDTTATELSVIESVFKLRDSQPSAIADEMRKSLIDTFV

SEQ ID NO: 6255 - protein, 245 aa, Lactuca sativa
MATRLRFENSCEIGVFTKLTNAYCLVANEGSESFYSIFESELADVIPVVKTSIGGTRIVGRLCIGNKKGLLLPHTTTDEELQHLRNSLPDAVVVKRINEKLSALGNCMACNDHVALTHTDLDKETEDMIADVLGVEVFRQTIAGNVLVGSYCVFSNRGGIVHPHTSVEDLDELSTLLQVPLVAGTVNRGSEVIAGGLTVNDWTAFCGSDTTATELSVIENVFKLREARPQAIANEMKKSLIDTYV

SEQ ID NO: 6256 - protein, 245 aa, Orobanche aegyptiaca
MATRLQFENSCEIGVFSKLTNAYCLVAIGGSENFYSTFEADLADYIPVIKASIAGTRIIGRLCAGNKNGLLLPHNTTDQELQHLRNSLPDSVVVQRIEEKLSALGNCVACNDHVALTHPDLDKETEELIADVLGVEVFRHAVAGNILVGSYCSFSNIGGLVHPHTSVEDLNELATLLQVPLVPGTVNRGSEVIGAGLVVNDWTAFCGSDTTATELSVVESIFKLRDAKPSAIINEMRKSLIDTYV

SEQ ID NO: 6257 - protein, 245 aa, Pteridium aquilinum
MATRIQFENNSEIGVFSKLTNAYCLTAIGGSENFYSTFESELADTIPVVKASIAGTRVIGRMCAGNRNGLLLPNSTTDQELQHLRNSLPDSVVVQRIDERLSALGNCISCNDYVALIHTDLDRETEELLADVLNVEVFRQTIAGNILVGSYCTFSNRGGLVHPHTSVEDLDELSSLLQVPLVAGTVNRGSEVIGAGLVVNDWTAFCGFDTTATELSVIESVFKLREAQPSAIVKEMRASLIDTLA

SEQ ID NO: 6258 - protein, 245 aa, Ambrosia trifida
MATRLRFENSCEIGVFTKLTNSYCLVANEGSDSFYSVFESELADTIPVVKTSIGGTRIIGRLCIGNKKGLLLPHTTTDQELQHLKNSLPDAVVVQRINERLSALGNCMACNDHVALTHTDLDKETEEMIADVLGVEVFRQTIAGNVLVGSYCAFSNRGGLVHPHTSVEDLEELSTLLQVPLVAGTVNRGSEVIAGGLTVNDWTAFCGSDTTATELSVIENVFKLREAQSSTVADETRKSLVSTYV

SEQ ID NO: 6259 - protein, 228 aa, Gossypium hirsutum
MATRLQFENSCDVGVFSKLTNAYCLVAIGGSENFYSTFESELADVIPVVKTSIAGTRIIGRLCAGNKNGLLVPHNTTDQELQHLRNSLPDQVVVRRIEEKLSALGNCIACNDHVALTHTDLDKETEEIIADVLGVEVFRQTIAGNILVGSYCAFSNRGGLVHPHTSIEDLDELSTLLQVPLVAGTINRGSEVIAAGMTVNDWTAFCGSDTTATELSVIESVFKLREAH

SEQ ID NO: 6260 - protein, 245 aa, Cajanus cajan
MATRLQFENCCEVGVFSKLTNAYCLVAIGGSENFYSSFEAELADVIPVIKTSISGIRTVGRLCVGNKNGLLLPHTTTDQELQHLRNSLPDQVLVQRIDERLTALGNCIACNDHVALTHIDLDKETEDMIADVLKVEVFRQTIASNIIVGSYCTFSNRGGLVHPHTSIEELEELSTLLDVPLVAGTVNRGSELLAAGMTVNDWIAFCGSDTTATELSVIESIFKLREVQPGVTMHEMRKSLFDSFL

SEQ ID NO: 6261 - protein, 149 aa, Arnica chamissonis
MATRIRFENSCEIGVFTKLTNAYCLVATEGSESFYSVFESELADVIPVVRTSIGGTRIIGRLCIGNKKGLLLPHTTTDEELQHLRNSLPDTVVIERINEKLSALGNCMACNDHVALTHTDLDKETEEMIADVLGVEVFRSDNCRECSCG

SEQ ID NO: 6262 - protein, 245 aa, Ambrosia trifida
MATRLRFENSCEIGVFTKLTNSYCLVANEGSDSFYSVFETELADTIPVVKTSIGGTRIIGRLCIGNKKGLLLPHTTTDQELQHLKNSLPDAVVVQRINERLSALGNCMACNDHVALTHTDLDKETEEMIADVLGVEVFRQTIAGNVLVGSYCAFSNRGGLVHPHTSVEDLEELSTLLQVPLVAGTVNRGSEVIAGGLTVNDWTAFCGSDTMATELSVIENVFKLREAQSSTVADETRKSLVSTYV

SEQ ID NO: 6263 - protein, 244 aa, Cirsium arvense
MATRLRFENSCEIGVFTKLTNGYCLVANEGSESFYSIFESELADIIPVVKTSIGGTRIIGRLCIGNKKGLLLPHTTTDQELQHLRNSLPDEVVVQRINEKLSALGNCMACNDHVALTHTDLDKETEDMIADVLGVEVFRQTIAGNVLVGSYCAFSNRGGLVHPHTSVEDLDELSTLLQVPLAAGTVNRGSEVIAGGLIVNDWTAFCGSDTTATELSVIENVFKLRDAQSNDIANEMRSLIDTHG

SEQ ID NO: 6264 - protein, 245 aa, Taraxacum officinale
MATRLRFENSCEIGVFTKLTNAYCLVATEGSESFYSIFESELADVIPVVRTTIAGTRIVGRLCIGNKKGLLLPHTTTDEELEHLVNSLPDSVVVKRINEKLSALGNCMACNDHVALTHTDLDKETEEMIADVLGVEVFRQTIAGNVLVGSYCAFTNRGGLVHPHTSVEDLDELSTLLQVPLVAGTVNRGSEVIAGGLTVNDWTAFCGSDTTATELSVIENVFKLREARPEAIADEMKKSLIDTYV

SEQ ID NO: 6265 - protein, 248 aa, Flaveria ramosissima
MATRLRFENSCEVGVFTKLTNAYCLVATEGSENFYSVFESELTDVIPVVKTSIGGTRIIGRLCIGNKKGLLLPHTTTDQELQHLRNSLPDAVVIKRINERLSALGNCMACNDHVALTHTDLDKETEEMIADVLGVEVFRQTIAGNVLVGSYCAFSNRGGLVHPHTSVEDLDELSTLLQVPLVAGTVNRGSEVIAGGLAVNDWTAFCGSDTTATELSVIENVFKLREAQSNAISDETRKSVVPSLCLNY

SEQ ID NO: 6266 - protein, 245 aa, Ceratodon purpureus
MATRAQFENSNEIGVFSKLTNAYCLVAIGGSENFYSTFESELADVIPVVKVSIAGTRVIGRMCVGNKNGLLLPQATTDQELLHIRNCLPDSVVVQRVDERLSALGNCIACNDYVSLIHTDLDRETEELIADVLGVEVFRQTIAGNILVGSYSQFTNRGGLVHPHTSIEDLDELSSLLQVPLVAGTVNRGSEVIGAGLVVNDWTAFCGLDTTATELSVIESVFKLRDAQPSNIVNEMRASLIDTMS

SEQ ID NO: 6267 - protein, 237 aa, Olea europaea
MATRLQFENNCEVGVFFQVDQCILFGRNWGSQSFYSTFEAELADVIPVVKTSIGGTRIIGRLCAGNKNGLLLPHTTTDQELQHLRNSLPDSVVVQRIEERLSALGNCIACNDHVALTHPDLDKETEEMIADVLGVEVFRQTVAGNILVGSYCAFSNRGGLVHPHTSIEDLDELSTLLQVPLVAGTVNRGSEVIAAGLTVNDWTAFCGSDTTATELSVIESVFKLREAQPSALVDEMK

SEQ ID NO: 6268 - protein, 245 aa, Physcomitrella patens
MATRVQFENSNEIGVFSKLTNAYCLVAIGGSENFYSTFEAELGDVIPVVKASIAGTRVIGRMCVGNKNGLLLPQATTDQELLHIRNCLPDSVVVQRVDERLSALGNCIACNDYVSLIHTDLDRETEELVADVLGVEVFRQTIAGNILVGSYCQFTNRGGLVHPHTSIEDLDELSSLLQVPLVAGTVNRGSEVIGAGLVVNDWTAFCGLDTTATELSVIESVFKLRDAQPSNIVNEMRASLIDTMS

SEQ ID NO: 6269 - protein, 205 aa, Cichorium intybus
MATRLQFENSCEIGVFSKLTNAYCLVAIGGSENFYSTFESELADVIPEVKTSIGGTRIIGRLCIGNKNGLLIPHTTTDQELQHLKNRLPDADVVQRIDERLSALRNSIACNDHVALTHTDLDRETEEMIADVLGIEVFRQTIAGNIHVSSYCAISNRSGLVHPHTSIEDLDELSTLLQVPMVARTVNRGSEVITAGLTENDWNAL

SEQ ID NO: 6270 - protein, 245 aa, Physcomitrella patens
MATRAQFENSNEIGVFSKLTNAYCLVAIGGSENFYSTFEAELQDVIPVVKASIAGTRVIGRMCVGNKNGLLLPQATTDQELLHIRNCLPDKVVVQRVDERLSALGNCIACNDYVSLIHTDLDRETEELVADVLGVEVFRQTIAGNILVGSYSQFTNRGGLVHPHTSIEDLDELSSLLQVPLVAGTVNRGSEVIGAGLVVNDWTAFCGLDTTATELSVIESVFKLRDAQPSNIVNEMRASLIDTMS

SEQ ID NO: 6271 - protein, 223 aa, Raphanus sativus
MATRLQFENNCEVGVFSKLTNAYCLVAIGGSENFYSAFESELADVIPIVKTSIGGTRIIGRLCAGNKNGLLVPHTTTDQELQHLRNSLPDQVVVQRIEERLSALGNCIACNDHVALAHTDLDKETEEIIADVLGVEVFRQTIAGNILVGSYCALSNRGGIVHPHTSVEDLDELSTLLQVPLVARTVNRGSEVIGAGMTVNDWTSFCGSDTTATELSVIDSIFS

SEQ ID NO: 6272 - protein, 259 aa, Antirrhinum majus
DIFPAAKTKLSPINHGYKAAVRDNSEIGVFSKLTNAYCLVAIGGSENFYSIFESELADVIPVVKTSIAGTRIIGRLCAGNKNGLLLPHNTTDQELQHLRNSLPDSVVVQRIEERLSALGNCIACNDHVALTHPDLDKETEELIADVLGVEVFRQTIAGNILVGSFCTFSNRGGLVHPHTSIEDLDELSTLLQVPLVAGTVNRGSEVIAAGLTVNDWTGFCGSDTTATELSVIESVFKLREAQPSALVDEMRKSLIDTYV

SEQ ID NO: 6273 - protein, 206 aa, Pennisetum glaucum
AELADSIPVVKTSIGGTRIIGRLCVGNKNGLLLPHTTTDQELQHLRNCLPDQVVVQRIDERLSALGNCIACNDHVALTHPDLDKETEELIADVLGVEVFRQTIAGNILVGSYCAFSNRGGLVHPHTSIEDLDELSTLLQVPLVAGTVNRGSEVIAAGMTVNDWTAFCGSDTTATELSVIESVFKLREGQPTAIVDDMRKSLIDSYV

SEQ ID NO: 6274 - protein, 245 aa, Selaginella moellendorffii
MATRAQFENSSDIGVFSKLTNAYCLVAIGGSENFYSTFEAELADHIPVVKVSISGTRVIGRMCVGNKNGLLLPNSTTDQELLHIRNSLPDRVVVQRVDERLSALGNCIATNDYVSLVHTDLDKETEELVADVLGVEVFRQTIAGNVLVGSYGVFSNRGGLVHPHTSIEDLDELSSLLQVPLVAGTVNRGSDVIGAGLIVNDWTAFCGLDTTTTELSVVESVFKLRESQPSAIVNEMRASLIDTLA

SEQ ID NO: 6275 - protein, 51 aa, Populus trichocarpa
MTGHPFVGRTLHTELSVIESVFKLRESQPSAIVDEMRKSLIDSYVRLDISH

SEQ ID NO: 6276 - protein, 201 aa, Parthenium argentatum
MATRLRFENSCEIGVFTKLTNSYCLVANEGSDSLYSVFESELADTIPVVKTSIGGTRIIGRLCIGNKKGLLLPHTTTDEELQHLKNSLPDTVVVQRINERLSALGNCMACNDHVALTHTDLDKETEEMIADVLGVEVFRQTIAGNVLVGSYCAFSNKGGLVHPHTSVEDLEELSTLLQVPLVAGTVNRGSEVIAGGLTVND

SEQ ID NO: 6277 - protein, 245 aa, Guizotia abyssinica
MATRLRFENSCEIGVFTKLTNAYCLVADEGSESFYSVFESELADVIPVVKTAIGGTRIIGRLCIENKKGLLLPHTTTDAELEHLRNSLPDAVVVKRINERLSALGNCMACNDHVALTHTDLDKETEEMIADVLGVEVFRQTIAGNVLVGSYCAFSNRGGLGHPHTSVEDLEELSTLLQVPLVAGTVNRGSEVIAGGLTVNDWAAFCGSAPPPTELSVIPHVFKLREAQSNAIADEARKSLVATYV

SEQ ID NO: 6278 - protein, 225 aa, Fraxinus spp
MHIAWSQSGGSESFYSTFEAELADVIPVIKTSIGGTRIIGRLCAGNKNGLLLPHTTTDQELQHLRNSLPDSVVVQRIDERLSALGNCIACNDHVALTHPDLDKDTEEMIADVLGVEVFRQTVAGNILVGSNCAFSNRGGLVHPHTSIEDLDELSTLLQVPLVAGTVNRGSEVIAAGLTVNDWTAFCGSDTTATELSVIESVFKLREAQPSALVDEMRKSLIDTYV

SEQ ID NO: 6279 - protein, 245 aa, Selaginella moellendorffii
MATRAQFENSSDIGVFSKLTNAYCLVAIGGSENFYSTFESELADHIPVVKVSISGTRVIGRMCVGNKNGLLLPNSTTDQELLHIRNSLPDRVVVQRVEERLSALGNCIATNDYVSLVHTDLDKETEELVADVLGVEVFRQTIAGNVLVGSYGVFSNRGGLVHPHTSIEDLDELSSLLQVPLVAGTVNRGSDVIGAGLIVNDWTAFCGLDTTTTELSVVESVFKLRESQPSAIVNEMRASLIDTLA

SEQ ID NO: 6280 - protein, 251 aa, Brachypodium distachyon
RFWSCCAAGLKFENSCEVGVFSRLTNAYCLVAAGGAENFVSVFEAELAGVIPVVRASIGGTRIVGRLCVGNKNGLLLPHTTTDQELQHLKNSLPDQVVVQRIDERLSALGNCIACNDHVALTNPDLTKETEELISDVLGVEVFRQTIAGNILVGSFCTFSNKGGLVHPRTSVEDLDELSTLLQVPLVAGTVNRGSEVIASGMAVNDWAAFCGSDTTATELSVVESVFRLRDGRPGALGADVRKSLVESCFV

SEQ ID NO: 6281 - protein, 217 aa, Cleome gynandra
GGSENFYSAFEAELADVIPIVKTSIGGTRIIGRLCAGNKNGLLVPHTTTDQELQHLRNSLPDQVVVQRIEERLSALGNCIACNDHVALAHTDLDRETEEIIADVLGVEVFRQTIAGNILVGSYCAFSNRGGLVHPHTSVGDLDELSTLLQVPLVAGTVNRGSEVIAAGMTVNDWTAFCGSDTTATELSVIDSIFKLREAQPSSIVDEMRKSLIDTYV

SEQ ID NO: 6282 - protein, 243 aa, Petunia hybrida
MAIRLQFENSCEVGVFSKLTNSYCLVAIGGSENFYSVFEDALPENFPVIRTSIGGTRIIGRLCTGNKNGLLLPHTTTDQELQHLRNSLPDGVVVQRIEERLSALGNCIACNDHVALAHTDLDKETEDMIADVLGVEVFRQAIAGNILVGSYCTLSNLGGLVHPNTSIEDKDELADLLQISLAAGTVNRGSEVIAAGLTVNDWAAFCGSDTTATELSVIEDVFKLRDNLPRPDEWRKSLIDTYV

SEQ ID NO: 6283 - protein, 216 aa, Carthamus tinctorius
MATRLQFENSCEIGVFSKLTNAYCLVAIGGSENFYSTFESELADVIPVVKTSIGGTRIIGRLCIGNKNGLLLPHTTTDQELQHLRNSLPDAVVVQRIDERLSALGNCIACNDHVALTHTDLDRETEEMIADVLGVEVFRQTIAGNILVGSYCAFSNRGGLVHPHTSIEDLDELSTLLQVPLVAGTVNRGSEVIAAGITVNDWTAFCGQTLLQLSYL

SEQ ID NO: 6284 - protein, 222 aa, Centaurea maculosa
MATRLRFENSCEIGVFTKLTNSYCLVADEGSESFYSIFESELADVIPVVKTSIGGTRIIGRLCIGNKKGLLLPHTTTDQELQHLRNSLPDEVVVQRINEKLSALGNCMACNDHVALTHTDLDKETEDMIADVLGVEVFRQTIAGNVLVGSYCAFSNRGGLVHPHTSVEDLDELSTLLQVPLVAGTVNRGSEVIAGGLIVNDWTAFCGSDTTATELSVIENVF

SEQ ID NO: 6285 - protein, 207 aa, Ambrosia trifida
FSKLTNAYCLVAIGGSENFYSTFEAELADVIPVVKTSIGGTRIIGRLCIGNKNGLLLPHTTTDQELQHLRNSLPDAVVVQRIDERLSALGNCIACNDHVALTHTDLDRETEEMIADVLGVEVFRQTIAGNILVGSYCAFSNRGGMVHPHTSIEDLDELSTLLQVPLVAGTVNRGSEVIAAGLTVNDWTAFCGSDTTATELSVIESVF

SEQ ID NO: 6286 - protein, 215 aa, Allium cepa
SENFYSAFEAELADVIPVVKTSISGTRIIGRLCVGNKNGLLLPHNTTDQELQHLRNCLPDSVVVQRIDERLSALGNCVACNDHVALTHTDLDRNTEELIADVLGVEVFRQTIAGNVLVGSYCTFTNRGGLVHPQTSIEDLDELSTLLQVPLVAGTVNRGSEVIAAGMTVNDWTAFCGSDTTATELSVIESVFKLREAQPSSIVDEMRKSLIDSYV

SEQ ID NO: 6287 - protein, 563 aa, Sorghum bicolor
MDPAGPRVGTDPTGSGAAPPREELDGRGRGGACSGAAAVEGSASRLAGAGLGDPRAGILESLVQAEAYLHTYTMDVPQLTAEGATQCGDRVSLLPQTGALQSVTPCLTLGRDSNATSMEKLHGNESLPFGKENIRKDLQPKPDPEHVDNRMSVARLGLDLNTADSSDAAELNPFFPYKKLGQLKVSGPSECGSTTGATEESESHRKWREMKQNGFLSSSHGNAMVPRPRGRPPKRKRDDEFKKSTSTQHGQANKSMKVAAPSGLLSGLNPGIINHVRNSKQVYSIIKAMVHSERLQNENQPAFTSQTGERGRDVSERIQDQKYGSGFMKCHSLMKDNNVVFHQTLPTTLHFLPQDGDSLKLQLSSAVTMSSDRTCSTSADDPASNHDYMTVLSVKAASVASQWLELLHQDIRGRLAALKRSRKRVRNALRTELPYLMSTEFPSNQENESSIANTSEAGCTEKAVSEAHVARWRSLFVQMDRTLQEEGKQLENRLKQVQEMQLNCDKGLKHMTCEAPLLGPMAELWKLNNPDNSESEWAVQAAAASIYSTCNMVMRAENNVPCF

SEQ ID NO: 6288 - protein, 558 aa, Zea mays
MDLAGPRGATDPAGSRAAPPHEELDGRGGGACSGAAAVEGSAWRLAVAGLGDPRAGVLESLGQPEAHLHTCTMDVPQLTAEGATQLGDRVSLLHQTGTLQSETPCLTLGRDSNAVSMEKLHASDCLPCGKENVGTGLQPKSDPERADNRMSVARLGLDLNTVDSPDVAEPNPFFPYKKLGQSKVSDPSECGSTTGAIEESESHRKWREMKQNGFLSSFHGNAVVPRPRGRPPKRKRDDEFKKSSSTQHVQANKSVKVAAPSGLLSGLNPGIINHVRNSKQVYSIIKAMVHSERLENENHSSQTGERGREVNERIQDQKYGGGFMKCHLLINDNNAVFHQTLPNTSQFLAQDGDSLKLQLPSAVTMSSDRTFSTSADDPASNHDYMTVLSVKAASVASQWLELLHQDIRGRLAALKRSRKRVRNALHTELPYLTATEFSSNQENESSIANTSEIGCTDKAVSEAHVARWRSLFVQMDKTLQEEGKQLENKLKQVQEMQLNCDKGLKHMTCEAPLLGPMAELWKLKNPNISESEWAVQAAAASIYSTCNMVMRTENVPCF

SEQ ID NO: 6289 - protein, 553 aa, Setaria italica
MDPAAADPAGSGAPPPKEFDGSGAPGGGAAEGSAPRPVVAGLGDLRAGIPESSGQSEACLHPCNKDIPQFTADGAKQCGDRVSLLPLAGALQTEAPCLTLGRDSNAASVEKLHGSDPLSCGKENIGTDLQSKPDAEHGENRMSSAHLGLDLNTVDSSDAAELNPFFPYKKLGQSKVSDPSECGSTTGATEESESHRKWREMKQNGFLSSSHGKAVVPRPRGRPPKRKRDDEFKKNTSTQHGQANKFVKVAAPSGLLSGLNPGIINHVRNSKQVYSIIKAMVHSERLENENQPACTSRTSERGKEVSERIQDHNYGGGFMKCHFMMKDNNAMFHQTLPTTSQFLPQDGDSLKLQLSSAAAASSDRTCSTSADDLASNHDYMTLLSVKAASVASQWLELLHQDIRGRLAALKRSRKRVRNALHTELPYLISTEFSSNQENESSIANTSESGCTDKAVSEAHAARWKSLFVQMDRALQEEGKHLENRLKQVQEMQLNCDKGLKHMTSDAPLLGPMAELWKLKNPDTSESEWAVQAAAASIYSTCNMVMRTENVPCF

SEQ ID NO: 6290 - protein, 531 aa, Sorghum bicolor
MSKPWGGVGAWALDAERAEEEEREQALSFPAPEPPAAAGGAASFPSLREAAAAGAGGKSKKNKNKGTTLSLSEFTTYGAAAAQRRAAPVEPRGLTHEEMMMLPTGPRERSAEELDRSRGFRSYGGGGGGFGGPGGGERRGGFDDEGRRGPGRSSDLDMPSRADEADDWGATKKFTPAPADSGRRDRFGGPSPLGRADDIDDWSRDKKPLPSRYPSLGSGGGGFRDSPGFRDSSAASDADRWVRGATPMPHNGQGSGERPRIVLNPPPKRDPAAAASTPPAEVARNRPSPFGAARPREDVLAEKGVDWRKVENEIEQKTSRPTSSHSSRPNSAHSSRPGSPGSQVSAVGSEGAPRARPKVNPFGDAKPRELVLQEKGKDWRKIDLELEHRAINRPESDEEKNLKEEINLLKVDLKEIEGKMSNGSDQTSVDAKDLSEKISQLESQLEQLSRELDDKIRFGQRPRSGAGRVTTHAPTSLGEEPQATVVDRPRSRGGMEPPPRQEERWGFQGSRERGSFGGSRNSDRPMARQRW

SEQ ID NO: 6291 - protein, 528 aa, Zea mays
MSKPWGGVGAWALDAERAEEEEREQVLAFPAPEPPAAAGGAASFPSLREAASAGGKGKSKKKNKGTTLSLSEFTTFGAAAAQRRAAPVEPKGLTHEEMMLLPTGPRERSAEELDRSRGFRSYGGGGGGGFGAGAGGERRGGFDDEGRRGPGRSSDLDMTSRADEADDWGATKKFTPAPADSGRRDRFGGPSPLGRADDIDDWSRDKKPLPSRYPSLGSAGGFRDSPGFRDSSASSDADRWVRGATPMPHNGQGAGERPRIVLNPPKRDPSTASTPPAEVARNRPSPFGAARPREDVLAEKGVDWKKFENEIDQKTSRPTSSHSSRPNSAHSSRPGSPGSQVSAVGSEGAPRARPKVNPFGDAKPREVVLQEKGKDWRKIDVELEHRAINRPESDEERNLKEEINLLKVDLKEIEGKMSNGSEQTSVDAKDLSEKISMLESQLEQLSRELDDKIRFGQRPRSGAGRVTTLAPTSLGEEPQATVVDRPRSRGGMEPPPRQEERWGFQGSRERGSFGGSRNSDRPMARQRW

SEQ ID NO: 6292 - protein, 530 aa, Setaria italica
MSKPWGGVGAWALDAERAEEEEREQAAALPAPEPPAPAGGAASFPSLREAAAATGGGKSKKKNKGTTLSLSEFTTYGAAAAHRRAAPVEPRGLTPEEMMMLPTGPRERSAEELDRSRGFRSYGGGGGFGGGERRGGFDDEGRRGPGRSSDLDMPSRADEVDDWGAGKKFTPAAADSGRRDRFGGPSPLGRADDIDDWSRDKKPLPSRYPSLGSGGGGGFRSSPGFRDSPGFRDSAASSDSDRWVRGATPLPHNGEGMGERPRIVLNAPKRDPSATTTPPAEVARNRPSPFGAARPREDVLAEKGVDWRKIESEIEQKTSRPTSSHSSRPNSAHSSRPGSPGSQVSAVGSEGAPRARPKVNPFGDAKPRELVLQEKGKDWRKIDLELEHRAVNRPESDEERNLKEEINLMKVDLKEIEGKISDDSDQASVDAKNLAEKITQLESQLEQLTRELDDKIRFGQRPRSGAGRVTALPPSPAEEPQATVVDRPHSRGGMEPHARPEERWGFQGSRERGSFDGSRSSDRPMTRQRW

SEQ ID NO: 6293 - protein, 402 aa, Setaria italica
MSKPWGGVGAWALDAERAEEEEREQAAALPAPEPPAPAGGAASFPSLREAAAATGGGKSKKKNKGTTLSLSEFTTYGAAAAHRRAAPVEPRGLTPEEMMMLPTGPRERSAEELDRSRGFRSYGGGGGFGGGERRGGFDDEGRRGPGRSSDLDMPSRADEVDDWGAGKKFTPAAADSGRRDRFGGPSPLGRADDIDDWSRDKKPLPSRYPSLGSGGGGGFRSSPGFRDSPGFRDSAASSDSDRWVRGATPLPHNGEGMGERPRIVLNAPKRDPSATTTPPAEVARNRPSPFGAARPREDVLAEKGVDWRKIESEIEQKTSRPTSSHSSRPNSAHSSRPGSPGSQVSAVGSEGAPRARPKVNPFGDAKPRELVLQEKGKDWRKIDLELEHRAYFSGQSQMKKEI

SEQ ID NO: 6294 - protein, 1136 aa, Panicum virgatum
MSSSRSNNRGTCSRSSSARSKHSARVVAQTPVDAQLHAEFEGSQRHFDYSSSVSAANRPSASTSTVSAYLQNLQRGRFIQPFGCLLAVHPDTFALLAYSENAPEMLDLTPHAVPTIDQRDALALGTDVRTLFRTQSSVALHKAAIFGEVNLLNPILVHARTSGKPFYAIMHRIDVGLVIDLEPVNPADVPVTAAGALKSYKLAAKAISRLQSLPSGNLSLLCNVLVREVSELTGYDRVMAYKFHEDEHGEVIAESRRSDLEPYLGVHYPATDIPQASRFLFMKNKVRMICDCSATPVKIIQDDSLAQPLSLCGSTLRAPHGCHAQYMANMGSVASLVLSVTINEDDEEDGDTGSDQQPKGRKLWGLVVCHHTSPRFVPYPLRYACEFLLQLFGIQLNKEVELAAQAKERHILRTQTLLCDMLLREAPVAIFTQSPNVMDLVKCDGTALYYQNQLWVLGSTPSEAEIRSIVTWLQENHDGSTGLSTDSLVEAGYPGAAALREVVCGMAAIKISSKDFIFWFRAHTAKEIKWGGRKHKTTDGDENGRKMHPRSSFKAFLEVVKWRSVPWEDVEMDAIHSLQLILRGSLQDEDANKNNVRSIVKAPSEDTKKIQGLLELRTVTNEMVRLIETATAPIFAVDIYGNINGWNNKVAELTGLPVMEAIGRPLVDLVMSDSVEVVKQILDSALPGIEEQNLEIKLKTFNQQECNGPIILMVNSCCSRDLSDKVVGVCFVAQDLTGQKMIMDKYTRIQGDYVAIVKNPSELIPPIFMINDLGSCLEWNEAMQKITGMKREDAIDKLLIGEIFTLHEYGCRVKDHATLTKLSILMNTVISGQDPGKLLFGFFDTYGKYVESLLTAKKRTNAEGKITGALCFLHVASPELQHALQVQKMSEQAATKSFKELTYIRQELRNPLNGMQFTHNLLEHSELTEEQRQLVASNVLCQDQLKKILHDTDLESIEQCYMDMNMVEFKLEEALNTVLMQGMSLGKEKRISVERDWPVEVSCMYLYGDNLRLQQVLADYLTCTLQFTQPAEGPIVLQVIPKKENIGSGMQIAHLEFRIVHPAPGVPEALIQEMFRHSPEVSREGLGLYICQKLVKMMSGTVQYLREADSSSFIVLVEFPVAQLSSKRSKPSTSKF

SEQ ID NO: 6295 - protein, 1140 aa, Brachypodium distachyon
MSSSRSNNRATCSRGSSARSKHSERVVAQTPVDARLHAEFEGSQRRFDYSSSVSAANRSGASTSTAVSAYLQNMQRGRYIQPFGCLLAAHPETFALLAYSENAAEMLDLTPHAVPTIDQRDALTVGVDVRTLFRSQSAVALHKAAVFGEVNLLNPILVHARTSGKPFYAILHRIDVGLVIDLEPVNPADVPVTAAGALKSYKLAAKAISRLQSLPSGNLSLLCDVLVREVSELTGYDRVMAYKFHEDEHGEVIAECRRSDLEPYLGLHYPATDIPQASRFLFMKNKVRMICDCAAVPVKLIQDDNLSQPISLCGSTMRAPHGCHAQYMANMGSVASLVMSITINEDEEEDGDTGSDQQPKGRKLWGLVVCHHSSPRFVPFPLRYACEFLLQVFGIQLNKEVELASQAKERHILRTQTLLCDMLLRDAPIGIFTQSPNVMDLVKCDGAALCYRNQIMVLGSTPSEGEIKNIVAWLQEYHDGSTGLSTDSLVEAGYPGASALGEIVCGMAAIKISSKGFILWFRSHTAKEIKWGGAKHEPGDADDNGRKMHPRSSFRAFLEVVKWRSVPWEDVEMDAIHSLQLILRGSLQDEDANNNNNVMSIVEAPSDDMKKIQGLLELRIVTNEMVRLIETATAPILAVDIVGNINGWNNKAAEITGLPTTEAIGMPLVQVVHGDSVEVVTQILNSALQGVEEQNLEIKLKTFHHLESNGPVILMVNACCSRDLSEKVVGVCFVAQDLTGQKMILDKYTRIQGDYVAIVKNPNELIPPIFMINDLGSCLEWNEAMQRITGIKREDAIDKLLIGEVFTLHDYGCRVKDHATLTKLSILMNTVISGQDPEKLPFGFFDADGKCMESLLTANKRTDAEGKITGALCFLHVASPELQHALQVQKMSEQAATHSFKELTYIRQELKNPLNGMQFTRNLLEPSELTEEQRQLLASNVLCQEQLKKILHDNDLEGIEQCYMEMNTVEFNLEEALNTVLMQGMSLSKEKQISLDRDWPVEVSSMYLYGDNLRLQQVLADFLACTLQFTQPAEGPIVLQVIPRKESIGSGMQIAHLEFRLNHPVPGVPETLIQEMFRHGPGVSREGLGLHISQKLVKTMSGTVQYLREAEISSFIVLVEFPVAQLNSKRPRPSTSKSNF

SEQ ID NO: 6296 - protein, 1139 aa, Secale cereale
MSSSRSNNRPACSRGSSARSKHSERVVAQTPVDARLHAEFEGSQRHFDYSSSVSALNRSGASTSSAVSAYLQNMQRGRYIQPFGCLLAIHPESFALLAYSENAAEMLDLTPHAVPTIDQRDALAVGADVRTLFRSQSAVALHKAAVFGEVNLLNPILVHARTSGKPFYAILHRIDVGLVIDLEPVNPADVPVTAAGALKSYKLAAKAISRLQSLPSGNLSLLCDVLVREVSELTGYDRVMAYKFHEDEHGEVIAECRRSDLEPYLGLHYPATDIPQASRFLFMKNKVRMICDCAASPVKLIQDDNLSQPISLCGSTMRAPHGCHAQYMANMGSIASLVMSITINEDEDEDGDTGSDQQPKGRKLWGLVVCHHTSPRFVPFPLRYACEFLLQVFGIQLNKEVELASQAKERHILRTQTLLCDMLLRDAPVGIFTQSPNVMDLVKCDGAALCYQNQIMVLGSTPSEGEIKKIVAWLLECHDGSTGLSTDSLLEAGYPGASALGEVVCGMAAIKISSKGFIFWFRSHTAKEIKWGGAKHEPGDADDNGRRMHPRSSFRAFLEVVKWRSVPWEDVEMDAIHSLQLILRGSLQDEDANDNNARTIVEAPSDDIKKIQGLLELRIVTNEMVRLIETATAPILAVDIVGNINGWNNKVAEITGLPTTEAIGMLLVDLVEGDSVEVVKQMLNSALQGTEEQNLEIKLKTFHQQESKGPVVLMVNACCSRDLSDKVVGVCFVAQDLTGHKMIMDKYTRIQGDYVAIVKNPNELIPPIFMINDLGSCLEWNEAMQKITGIKREDAIDKLLIGEVFTLHDYGCRVKDQATITKLSILMNTVISGQEPEKLAFGFFNTDGKYMDSLLTANKRTDAEGKITGALCFLHVASPELQHALQVQKMSEQAATHSFKELTYIRQELKNPLNGMQFTRKLLEPSDLTEEQRQLFASNVLCQEQLKKILHDNDLEGIEQCYMEMNTVEFNLEEALNTVLMQGMSLSKEKQISLDRDWPVEVSSMYLYGDNLRLQQVLADYLACALQFTQPAEGPIVLQVIPKKEHIGSGMQIAHLEFRLVHPAPGVPEALIQEMFRHGPGVSREGLGLHISQKLVKTMSGTVQYLREAESSSFIVLVEFPVAQLNSKRSKPSTSKSNF

SEQ ID NO: 6297 - protein, 1139 aa, Triticum aestivum
MSSSRSNNRPACSRGSSARSKHSERVVAQTPVDARLHAEFEGSHRHFDYSSSVSALNRSGASTSSAVSAYLQNMQRGRYIQPFGCLLAIHPESFALLAYSENAAEMLDLTPHAVPTIDQRDALAVGADVRTLFRSQSAVALHKAAVFGEVNLLNPILVHARTSGKPFYAILHRIDVGLVIDLEPVNPADVPVTAAGALKSYKLAAKAISRLQSLPSGNLSLLCDVLVREVSELTGYDRVMAYKFHEDEHGEVIAECRRSDLEPYLGLHYPATDIPQASRFLFMKNKVRMICDCAASPVKLIQDDNLSQPISLCGSTMRAPHGCHAQYMANMGSIASLVMSITINEDDDEDGDTGSDQQPKGRKLWGLVVCHHTSPRFVPFPLRYACEFLLQVFGIQLNKEVELASQAKERHILRTQTLLCDMLLRDAPVGIFTQSPNVMDLVKCDGAALCYQNQIMVLGSTPSEGEIKKIVAWLLECHDGSTGLSTDSLLEAGYPGASALGEVVCGMAAIKISSKGFIFWFRSHTAKEIKWGGAKHEPGDADDNGRRMHPRSSFRAFLEVVKWRSVPWEDVEMDAIHSLQLILRGSLQDEDANDNNARSIVEAPSDDIKKIQGLLELKIVTNEMVRLIETATAPILAVDIVGNINGWNNKVAEITGLPTTEAIGMLLVDLVEGDSVEVVKQMLNSALQGTEEQNLEIKLKTMHQQESKGPVVLMVNACCSRDLSDKVVGVCFVAQDLTGHKMVMDKYTRIQGDYVAIVKNPNELIPPIFMINDLGSCLEWNEAMQKITGIKREDAIDKLLIGELFTLHDYGCRVKDQVTLTKLSILMNTVISGQEPEKLAFGFFNTDGKYMESLLTANKRTDAEGKITGALCFLHVASPELQHALQVQKMSEQAATHSFKELTYIRQELKNPLNGMQFTRKLLEPSDLTEEQRQLFASNVLCQEQLKKILHDNDLEGIEQCYMEMNTVEFNLEEALNTVLMQGMSLSKEKQISLDRDWPVEVSSMYLYGDNLRLQQVLADYLACTLQFTRPAEGPIVLQVIPKKEHIGSGMQIAHLEFRLVHPAPGVPEALIQEMFRHGPGVSREGLGLHISQKLVKTMSGTVQYLREAESSSFIVLVEFPVAQLNSKRSRPSTSKSNF

SEQ ID NO: 6298 - protein, 1147 aa, Hordeum vulgare
MSSSRSNSRSACSRGSSARSRHSERVVAQTPVDAQLHAEFESSHRHFDYSSSVSALNRSGASTSSAVSAFLQNMQRGRYIQPFGCLLAIHPESFALLAYSENAAEMLDLTPHAVPTIDQRDALAVGADVRTLFRSQSAVALHKAAVFGEVNLLNPILVHARTSGKPFYAILHRIDVGLVIDLEPVNPADVPVTAAGALKSYKLAAKAISRLQSLPSGNLSLLCDVLVREVSELTGYDRVMAYKFHEDEHGEVIAECRRSDLEPYLGLHYPATDIPQASRFLFMKNKVRMICDCAASPVKLIQDGNLSQPISLCGSTMRAPHGCHAQYMANMGSIASLVMSVTVNEDDDEDGDTGSDQQPKGRKLWGLVVCHHTSPRFVPFPLRYACEFLLQVFGIQLNKEVELASQAKERHILRTQTLLCDMLLRDAPVGIFTQSPNVMDLVKCDGAALCYQNQIMVLGSAPSEGEIKKIAAWLLECHDGSTGLSTDSLLEAGYPGASALGEVVCGMAAIKISSKGFIFWFRSHTAKEIKWSGAKHEPGDADDNGRRMHPRSSFRAFLEVVKWRSVPWEDVEMDAIHSLQLILRGSLQDEDANDNNVRSIVEAPSDDVRKIQGLLELRIVTNEMVRLIETATAPILAVDIVGSINGWNGKVAEITGLPTTEAIGMLLVDLVEGDSVEVIKQMLNSAMQGTEEQNFEIKLKTFHQQESNGPVVLMVNACCSRDLSDKVVGVCFVAQDLTGHKMVMDKYTQIQGDYVAIVKNPNELIPPIFMINDLGSCLEWNEAMQKITGIKREDAIDKLLIGEVFTLHDYGCRVKDQATITKLSILMNTVISGQEPEKLAFGFFSTDGKYMESLLTANKRTDAEGKITGALCFLHVPSPELQHALQVQKMSEQAAARSFKELTYIRQELKNPLNGMQFTRKLLEPSDLTEEQRQLFASNVLCQEQLKKILHDNDLEGIEQCYMEMNTVEFNLEEALNTVLMQGMSLSKEKQISLDRDWPVEVSSMYLYGDNLRLQQVLADYLACTLQFTRPAEGPIVLQVIPKKEHIGSGMQIAHLEFRVVHPAPGVPEALIQEMFRHGPGVSREGLGLHISQKLVKTMSGTVQYLREAESSSFIVLVEFPVAQLNSKRSKPSTSKWSKPSTSKSNF

SEQ ID NO: 6299 - protein, 1053 aa, Setaria italica
MSSSRSNNRGTCSRSSSARSKHSARVVAQTPVDAQLHAEFEGSQRHFDYSSSVGAANRPLASTSTVSAYLQTMQRGRYIQPFGCLLAVHPDTFALLAYSENAPEMLDLTPHAVPTIDQRDALAVGADVRTLFRSQSSVALHKAATFGEVNLLNPILVHARTLGKPFYAIMHRIDVGLVIDLEPVNPADVPVTAAGALKSYKLAAKAISRLQSLPSGNLSLLCDVLVREVSELTGYDRVMAYKFHEDEHGEVIAECRRSDLEPYLGLHYPATDIPQASRFLFMKNKVRMICDYSAVPVKIIQDDSLAQPLSLCGSTLRAPHGCHAQYMANMGSVASLVMSVTINEDEEDEDTGSDQQPKGRKLWGLVVCHHTSPRFVPFPLRYACEFLLQVFGIQLNKEVELAAQAKERHILRTQTLLCDMLLRDAPVGIFTQSPNVMDLVKCDGAALYYQNQLWALGSVPSEAEIKSIVAWLQENHDGSTGLSTDSLVEAGYPGAAALREVVCGMAAIKISSKDFIFWFRAHTAKEIKWGGAKHEAVDADENGRKMHPRSSFKAFLEVVKWRSVPWEDVEMDAIHSLQLILRGSLQDEDANRNNVRTIVKAPSEDTKKIQGLLELRTVTDEMVRLIETATAPILAVDIAGNINGWNNKAAELTGLPVMEAIGRPLVDLVMSDSVEVVKQILDSALQGIEEQNLEIRLKTFNQQECNGPVILMVNSCCSRDLSEKVVGVCFVAQDLTGQKMIMDKYTRIQGDYVAIVKNPSELIPPIFMINDLGSCLEWNEAMQKITGMKREDAIDKLLIGEVFTLHDYGCRVKDHATLTKLSILMNTVISGQDPGKLPFGFFNTDGKYVESLLTANKRTNAEGKITGALCFLHVASPELQHALQVQKMSEQAATNSFKELTYIRQELRNPLNGMQFTHSLLEPSELTEEQRRLVASNVLCQDQLKKILHDTDLESIEQCYMEMNTVEFKLEEALNTVLMQGMSLGKEKRISIERDWPVEVSCMHLYGDNLRLQQVLADYLACTLQFTQPAKDLLYSKSFPRRKILGLACRLLI

SEQ ID NO: 6300 - protein, 191 aa, Panicum virgatum
MATLVISEQRGHQLHHSSGRRKKASSASPHFSSPQPVRGFQADNCRAFHSSITIGILPSPPAPGVARTRSSPEPKTPKQQVHHGKKRSRAISISPSTSPPSRPELWAGPGFSNSPPPSSLPIPKFSLHQKRSISLEFPPADRSDDEVLPVHAKSVPSSPTAGSGVSFFSDNDAAIATENLRRILHLKIEDH

SEQ ID NO: 6301 - protein, 179 aa, Panicum virgatum
MATLVISEQRGHQLHHSSGRRKKASSASPHFSSPQPVRGFQADNCRAFHSSITIGILPSPPAPGVARTRSSPEPKTPKQQCTMGKSAAEQYPSALQHPLPRALNSGLARGSPTHHHPAPCRYPSSPSTRSAVSHLSFHLLTGQMMKCCLCMPSLCLHRQLQAQVLASLVIMMLPLQRRI

SEQ ID NO: 6302 - protein, 119 aa, Oryza sativa
MARAATVAAASSALLLALLLALAWGAAAGAGEVPLGWELGVGVGGGSGDDDGFGFSGAAADGAAVVRRVLQGRGYISYGALRRDTTPCSVRGASYYNCRPGGQANPYSRGCSAITRCRG

SEQ ID NO: 6303 - protein, 427 aa, Brachypodium distachyon
MDAASRPAVVIDNGTGYTKMGFAGNVEPCFITPTVVAVNDSFSNQARATTKGNWMAQHNAGVMADLDFFIGDEALARSRSSSTYSLSYPIRGGQVENWDTMEKFWQQCIFNYLRCDPEDHYFLLTESPLTPPETREYTGEIMFETFNVPGLYIAVQPVLALAAGYTTTKCEMTGVVVDVGDGATHIVPVADGYVIGSSIRSIPLTGKDVTQFIQQLMKERGEHIPPEESFDVARRAKEMYCYTCSDIVKEFNKHDREPSKYIKHLTGTKPKTGAPYTCDIGYERFLGPEIFFHPEIYNNDFTTPLQDVIDKCIQSSPIDTRRALYKNIVLSGGSTMFKDFHRRLQRDLKKIVDARVRTSNARLGGDTKAQPVEVNVVSHPIQRYAVWFGGSVLASTAEFYEACHTKAEYEEYGASICRSNPVFKGMY

SEQ ID NO: 6304 - protein, 427 aa, Triticum aestivum
MDPTSRPAVVIDNGTGYTKMGFAGNVEPCFITPTAVAVNESFSDQTRATAKGNWLAQHSAGVMADLDFLIGEEALARSRSSSTYSLSYPIRNGQVDNWDTMEKFWQQCIFNYLRCDPEDHYFLLTESPLTPPETREYTGEIMFETFNVPGLYIAVQPVLALAAGYTTTKCEMTGVVVDVGDGATHIVPVADGYVIGNSISSIPLTGKDVTQFIQQLMKERGEHIPPEESFDVARRAKEMYCYTCSDIVKEFNKHDREPSKYIKRLTGIKPKTGAPYTCDIGYERFLGPEIFFHPEIYNNDFTTPLQDVIDKCIQSSPIDTRRALYKNIVLSGGSTMFKDFHRRLQRDLKKIVDVRVRASNARLGGDAKAQPVEVNVVSHPIQRYAVWFGGSVLASTAEFYEACHTKAEYEEYGASICRSNPVFKGMY

SEQ ID NO: 6305 - protein, 433 aa, Setaria italica
MDALSRPAVVIDNGTGYTKMGFAGNVEPCFITPTVVAVNDSFSASAQPAPRGAPAKGNWLAQHSAGVMADLDFYIGEEALARSRASSTYSLSYPIRNGQVENWDTMERFWQQCIFNYLRCDPEDHYFLLTESPLTAPETREYTGEIMFETFNVPGLYIAVQPVLALAAGYTTTKCEMTGVVVDVGDGATHIVPVADGYVIGSSIRSIPLTGKDVTQFIQQLMKERGENIPPEESFDVARRLKEMYCYTSSDIVKEFNKHDREPSKYIKHWTGIKPKTGAKYTCDIGYERFLGPEIFFNPEIYNNDFTTPLQVVIDKCIQSSPIDTRRALYKNIVLSGGSTMFKDFHRRLQRDLKKIVDARVRASNTRLISGDPKAQPIEVNVVSHPIQRYAVWFGGSVLASTAEFYEACHTKAEYEEYGASICRTNPVFKGMY

SEQ ID NO: 6306 - protein, 433 aa, Sorghum bicolor
MDALSRPAVVIDNGTGYTKMGFAGNVEPCFITPTVVAVNDSFSSSGQPAARGAPARGNWLAQHSAGVMADLDFYIGEEALARSRASTSHSLSYPIRNGQVENWDTMERFWQQCIFNYLRCDPEDHYFLLTESPLTAPETREYTGEIMFETFNVPGLYIAVQPVLALAAGYTTTKCEMTGVVVDVGDGATHIVPVADGYVIGSSIRSIPITGKDVTQFVHQLLKERGENIPPEESFDVARRIKEMYCYTSSDIVKEFNKHDREPSKYVKHWTGIKPKTGAKYTCDIGYERFLGPEIFFNPEIYNNDFTTPLQVVIDKCIQSSPIDTRRALYKNIVLSGGSTMFKDFHRRLQRDLKKIVDARVRASNSRLISGDTKAQPIEVNVVSHPIQRYAVWFGGSVLASTAEFYEACHTKAEYEEYGASICRSNPVFKGMY

SEQ ID NO: 6307 - protein, 433 aa, Zea mays
MDALSRPAVVIDNGTGYTKMGFAGNVEPCFITPTVVAVNDSFSGSAQPAVRGTPARGNWLAQHSAGVMADLDFYIGDEALARSRASSSHSLSYPIRNGQVENWDTMERFWQQCIFNYLRCDPEDHYFLLTESPLTAPETREYTGEIMFETFNVPGLYIAVQPVLALAAGYTTTKCEMTGVVVDVGDGATHIVPVADGYVIGSSIRSIPITGKDVTQFIHQLLKERGENIPAEESFDVARRIKEMYCYTSSDIVKEFNKHDKEPSKYIKHWTGTKPKTGAKYTCDIGYERFLGPEIFFNPEIYNNDFTTPLQVVIDKCIQSSPIDTRRALYKNIVLSGGSTMFKDFHRRLQRDLKKIVDARVRASNSRLISGDAKAQPIEVNVVSHPIQRYAVWFGGSVLASTAEFYEACHTKAEYEEYGASICRTNPVFKGMY

SEQ ID NO: 6308 - protein, 433 aa, Panicum virgatum
MDALSRPAVVIDNGTGYTKMGFAGNVEPCFINPTAVAVNDSFAASAQPAPRGGPAKGNWLAQHSAGVMADLDFYIGEEALARSRASSTYSLSYPIRNGQVENWDTMERFWQQCIFNYLRCDPEDHYFLLTESPLTAPETREYTGEIMFETFNVPGLYIAVQPVLALAAGYTTTKCEMTGVVVDVGDGATHIVPVADGYVIGSSIRSIPLTGKDVTQFVQQLMKERGENIPPEESFDVARRVKEMYCYTSSDIVKEFNKYDREPSKYIKRWTGIKPKTGAKYTCDIGYERFLGPEIFFNPEIYNSDFTTPLQVVIDRCIQSSPIDTRRALYKNIVLSGGSTMFKDFHRRLQRDLKKIVDARVRASNTRLISGDPKAQPIEVNVVSHPIQRYAVWFGGSVLASTAEFYEACHTKAEYEEYGASICRTNPVFKGMY

SEQ ID NO: 6309 - protein, 433 aa, Zea mays
MDALSRPAVVIDNGTGYTKMGFAGNVEPCFITPTVVAVNDSFSGSGQPAARGAPARGNWLAQHSAGVMADLDFYIGQEALARSRASSSHSLSYPIRNGQVENWDSMERFWQQCIFNYLRCDPEDHYFLLTESPLTAPEIREYTGEIMFETFNVPGLYIAVQPVLALAAGYTTTKCEMTGVVVDVGDGATHIVPVADGYVIGSSIRSIPITGKDVTQFIHQLLKERGENIPPEESFDVARRIKEMYCYTSSDVVKEFNKHDREPSKYVKHWTGIKPKTGAKYTCDIGYERFLGPEIFFNPEMYNNDFTTPLQVVIDRCIQSSPIDTRRALYKNIVLSGGSTMFKDFHRRLQRDLKKIVDARVRASNSRLLSGDAKAQPIEVNVVSHPIQRYAVWFGGSVLASTAEFYEACRTKAEYEEYGASICRSNPVFKGMY

SEQ ID NO: 6310 - protein, 427 aa, Elaeis guineensis
MDAASRPAVVIDNGTGYTKMGFAGNVEPCFIIPTVVAVNESFLNQARSSSKGNWLAQHSAGVMADLDFFIGEEALSRSRSSSTYNLSYPIHHGQVENWDTMERFWQQCIFNYLRCDPEDHYFLLTESPLTAPENREYTGEIMFETFNVPGLYIAVQPVLALAAGYTTSKCEMTGVVVDVGDGATHVVPVADGYVIGSSIKSIPIAGKDVTQFIQQLLRERGEHIPPEDSFEVARKVKEMYCYTCSDIVKEFNKHDKEPAKYIKHWTGVKPRTRAPYSCDIGYERFLGPEIFFHPEIYGSDFTTPLPAVIDKCIQSSPIDTRRALYKNIVLSGGSTMFKDFHRRLQRDLKKIVDTRIVTSAARFGGDVKSQPIEVNVVSHPIQRFAVWFGGSVLASTPEFYGACHTKAEYEEYGANICRTNPVFKGMY

SEQ ID NO: 6311 - protein, 427 aa, Elaeis guineensis
MDAVSRPAVVIDNGTGYTKMGFAGNVEPCFIIPTVVAVNESFLNPSRSSSKGNWLAQHSAGVMADLDFFIGEEALSRSRSSSTYNLSYPIHHGQVENWDTMERFWQQCIFNYLRCDPEDHYFLLTESPLTAPENREYTGEIMFETFNVPGLYIAVQPVLALAAGYTTSKCEMTGVVVDVGDGATHVVPVADGYVIGSSIKSIPIAGKDVTQFIQQLLKERGEHIPPEDSFEVARKVKEMYCYTCSDIVKEFNKHDKEPSKYIKRWTGVKPKTGAPYSCDIGYERFLGPELFFHPEIYSSDFTTPLPAVIDKCIQSSPIDTRRALYKNIVLSGGSTMFKDFHRRLQRDVKRIVDTRIVASDARFGGDVKSQPIEVNVVSHPIQRFAVWFGGSVLASTPEFYEACHTKAEYEEYGASICRTNPVFRGMY

SEQ ID NO: 6312 - protein, 427 aa, Amborella trichopoda
MDATSRPAVVIDNGTGYTKMGFAGNVEPCFIIPTVVAVNESFLNQSRVSSKGSWLAQHSAGVMADLDFFIGDEALSRSRTSSTYNLSYPIHHGQVENWDTMERFWQQCIFNYLRCDPEDHYFLLTESPLTAPENREYTGEIMFETFNVPGLYIAVQPVLALAAGYTTSKCEMTGVVVDVGDGATHVVPVADGYVIGSSIKSIPIAGKDVTLFIQQLLRERGEHIPPEDSLEVARKIKEMYCYTCSDIVKEFGKHDREPSKYIKHWTGIKAKTGAPYSCDIGYERFLGPEVFFSPEIYSSDFITPLPSVIDKCIQSSPIDTRRALYKNIVLSGGSTMFKDFHRRLQRDIKKIVDARVAASDARLGGDTKSQPIEVNVVSHPIQRFAVWFGGSVLASTPEFYAACHTKAEYEEYGASVCRTNPVFKGMY

SEQ ID NO: 6313 - protein, 427 aa, Musa acuminata
MDAASRPAVVIDNGTGYTKMGYAGNVEPCFIIPTVVAVNESFSNQSRSSAKGNWLAQHNASVMADLDFLIGEEALMRSRFSTAYNLSYPIRNGQVENWDAMERFWQQCIFNYLRCDPEDHYFLLTESPLTAPENREYTGEIMFETFNVPGLYIAVQPVLALAAGYTTSKCEMTGVVVDVGDGATHVVPVADGYVIGSSIKSIPIAGKDVTQFIQQLMKERGEHVPPEDSLEVARKVKEMYCYTCSDIVKEFNKHDRLPGKYTKQWTGVKPKTGASYTCDIGYERFLGPEIFFHPEIYGSDFITPLPVVIDKCIQSSPIDTRRALYKNIVLSGGSTMFKDFHRRLQRDLKKIVDARIVASAARLDGDVKSQPIQVNVVSHPIQRFAVWFGGSILASTPEFYRACHTKAEYDEYGASICRTNPVFKGMH

SEQ ID NO: 6314 - protein, 447 aa, Amorphophallus konjac
MDATSRPAVVIDNGTGYTKMGFAGNVEPCFIIPTVVAVNESFLNQSRVSNKGNWLVQHNAGVMADLDFFIGDEALSRSRSSSTYNLTYPIHHGQVENWDAMERFWQQCIFNYLRCDPEDHYFLLTESPLTAPEHREYTGEIMFETFNVPGLYIAVQPVLALAAGYTTSKCEMTGVVIDVGDGATHVVPVADGYVIGSSMKSIPISGKDVSLFIQQLLRERGEHIPPEDSFEVARKVKEMYCYTCSDIVKEYNKHDREPSKYVKQWSGIKPKTGAPYSCDIGYERFLGPEIFFNPEIYSSEFTTPLPIVVDKCIQSAPIDTRRALYKNIVLSGGSTMFKDFHRRLQRDLKKIVDARLLASDARHGGEIKSQPVEVNVMSHPIQRFAVWLGALYLHQHPSSMRLVIQKQSTRNTEQVFAARILFSKGCIKMVEVYDACITMDFFCLQPP

SEQ ID NO: 6315 - protein, 429 aa, Solanum phureja
MDPATSRPALVIDNGTGYTKLGFAGNVEPSFILPTVVAVNESFLNQTRATTKNSNWLAQHSAGVMADLDFFIGEEALTRSKSSNTYNLSYPIKHGQVDNWDAMERFWQQCIFNYLRCDPEDHYFLLTESPMTAPESREYTGEIMFETFNIPGLYIAVQPVLALAAGYTTSKCEMTGVVVDIGDGATHVVPVADGYVIGSSIKSIPIAGRDVTLFIQQLMRERGEHVPPEDSFEVARKVKEMYCYTCSDIVKEFNKHDKEPGKYIKHWRGTKPKTGAPYSCDVGYERFLGPEVLFNPEIYNSDFTTPLPDVIDKCIQSAPIDTRRALYKNIVLSGGSTMFKDFHRRLQRDIKKIVDARVLASDARLGGNVKAQPVEVNVVSHPIQRYAVWFGGSVLASTPEFFAACHTKAEYEEYGASICRTNPVFKGMY

SEQ ID NO: 6316 - protein, 429 aa, Eucalyptus grandis
MDPAASRPAVVIDNGTGYTKMGFAGNVEPCFIVPTVVAVNESFQNQARGSSKSSNWLAQHSAGVMADLDFYIGEEAHARSRSSSVYNLTYPIKHGQVENWDAMERFWQHCIFNYLRCDPEDHYFLLTESPLTAPESREYTGEIMFETFNIPGLYIAVQPVLALAAGYTTSKCEMTGVVVDVGDGATHVVPVADGYVIGSSIKSIPISGKDVTLFIQQLMRERGEHVPPEDSFEVARKVKETYCYTCSDIVKEYNKHDKEPAKYIKQWKGVKPKTGAPYTCDIGYERFLGPEVFFSPEIYSSDFSSPLPVVIDKCIQSAPIDTRRALYKNIVLSGGSTMFKDFHRRLQRDLKKIVDARVLASDARLGGEVKAQPVEVNVVSHPIQKFAVWFGGSVLGSTPEFFEACHTKAEYEEYGASICRTNPVFKGMY

SEQ ID NO: 6317 - protein, 429 aa, Solanum lycopersicum
MDPATSRPALVIDNGTGYTKLGFAGNVEPSFILPTVVAVNESFVNQTRATTKNSNWLAQHSAGVMADLDFFVGEEAVTRSKSSNTYNLSYPIKHGQVDNWDAMERFWQQCIFNYLRCDPEDHYFLLTESPMTAPESREYTGEIMFETFNIPGLYIAVQPVLALAAGYTTSKCEMTGVVVDIGDGATHVVPVADGYVIGSSIKSIPIAGRDVTLFIQQLMRERGEHVPPEDSFEVARKVKEMYCYTCSDIVKEFNKHDKEPGKYIKHWRGTKPKTGAPYSCDVGYERFLGPEVFFNPEIYNSDFTTPLPDVIDNCIQSAPIDTRRALYKNIVLSGGSTMFKDFHRRLQRDIKKIVDARVLASDARLGGNVKAQPVEVNVVSHPIQRYAVWFGGSVLASTPEFFAACHTKAEYEEYGASICRTNPVFKGMY

SEQ ID NO: 6318 - protein, 124 aa, Zostera marina
MDATSRPAVVIDNGTGYSKMGFAGNVEPCFMTPTVVAVNESFLNQSKSSSSKANWLAQHSAGVMADLDFLSETRLCHALAQAAHTTSVIPLVMVRWKIGMQWKDFGNNVYTITCVAILKIIIFF

SEQ ID NO: 6319 - protein, 427 aa, Unknown
  Sequence found in Organisms: Gossypium hirsutum, Gossypium raimondii
MDPTSRPAVVIDNGTGYTKMGFAGNVEPCFIQPTVVAVNESFLNQSRTSSKSNWSAQYSAGVMADLDFFIGDEALTKSRSSNAYNLTYPIRNGQVYNWDAMERYWQQCIFNYLRCDPEDHYFLLTESPLTAPENREYTGEIMFETFNVPGLYIAVNSVLALAAGYTTSKCEMTGVVVDVGDGATHIVPVADGYVIGSSIKSIPIAGKDVTLFIQQLMRERGEKIPPEDSFEAARKVKEMYCYTCSDVVKEFNKHDKEPGKYIKHWRGIRPKTGAPYSCDIGYERFLGPEVFFSPEIYSSDFTTPLPVVIDKCIQSAPIDTRRALYKNIVLSGGSTMFKDFHRRLQRDLKKIVDARVLASDTRLGGEVKAHPVEVNVVSHPIQRFAVWFGGSVLASTPEFFAACHTKAEYEEYGASICRTNPVFKGMY

SEQ ID NO: 6320 - protein, 427 aa, Phalaenopsis aphrodite
MDAASRPAVVIDNGTGYTKMGFSGNVEPCFIIPTVVAVNESFLNQSRSSNKSNWLAQYNAGVMADLDFFIGEEALSRSRSSSTYNLSYPIHEGQVENWDTMERFWQQCIFNYLRCDPEDHYFLLTESPLTAPENREYMGEIMFETFNVPGLYIAVQPVLALAAGYTTSKCEMTGVVVDVGDGATHVVPVAEGYVIGNSIKSIPISGKDVTLFIQRLMKERGENLPPEDSFEVARKVKEMYSYTCSDIVKEFNKYDKEPNKYIKQWTGIKPKTGAPYSCDIGYERFLGPEIFFNPEIYSSEFATPLPEVIDKCIQSSPIDTRRALYKNIVLSGGSTMSKDFHRRLQRDLKKIVDARIAASEARLGGEVKSHPIEVNVVSHPIQRFAVWFGGSVLASTPEFYGACHTKAEYEEHGASICRTNPIFKGMY

SEQ ID NO: 6321 - protein, 286 aa, Lippia dulcis
MFETFNVPGLYIAVQPVLALAAGYTTSKCEMTGVVVDVGDGATHVVPVADGYVIGSSIKSIPISGEDVTLFVQQLMRERGENIPPEDSFDVARKVKETYCYTCSDIVKEFNKHDKEPAKYIKQWRGTKPKTGAPYTCDIGYERFLGPEVFFNPEIYNSDFSTPLPDVIDKCIQSAPIDTRRALYKNVVLSGGSTMFKDFSRRLQRDLKKIVDARVLASDARLGGELKAQPVEVNVVSHPVQRYAVWFGGSVLASTPEFFPACHTKAEYEECGASICRTNPVFKGMY

SEQ ID NO: 6322 - protein, 427 aa, Ricinus communis
MDPTNRPAVVIDNGTGYTKMGFAGNVEPCFILPTVVAVNESFLNQSRTTSKANWLSQHNAGVMADLDFFIGEEAITKSRSSNTYNLSYPIKHGQVDNWDAMERYWQQCIFNYLRCDPEDHYFLLTESPLTAPETREYTGEIMFETFNVPGLYIAVNSVLALAAGYTTSKCEMTGVVVDVGDGATHVVPVADGYVIGSSIKSIPIAGKDVTLFIQQLMRERGENIPLEDSFDVARKVKEMHCYTCSDIVKEFNKHDKEPGKYIKHWRGIKPKTGAPYSCDIGYERFLGPEVFFNPEIYSSDFTTPLPALIDKCIQSAPIDTRRALYKNIVLSGGSTMFKDFGRRLQRDLKKIVDARVLASEARLNGEIKSQPVEVNVVSHPIQRFAVWFGGSVLASTPEFFAACHTKAEYEEYGASICRTNPVFKGMY

SEQ ID NO: 6323 - protein, 428 aa, Cucumis sativus
MDPAASRPAVVIDNGTGYTKMGFAGNVEPCFIVPSVVAVNESFLNQSRNSSKANWLAQHNAGVMADLDFFIGDEALAKSRSSSTYNLSYPIRNGQVYNWDAMERFWQQCIFNYLRCDPEDHYFLLTESPLTAPESREYTGEIMFETFNVPGLYIAVNSVLALAAGYTTSKCEMTGVVVDVGDGATHVVPVADGYVIGSSIKSVPIAGKDVTLFVQQLMKERGENVPPEDSFEVARKVKEMYCYTCSDIVKEFNKHDKEPGKYLKHWKGIKPKTGAPYSCDIGYERFLGPEVFFNPEIYSSEFTTPLPAVIDRCIQSAPIDTRRALYKNIVLSGGSTMFKDFHRRLQRDLKKIVDARILASEARLGGEIKSHPVEVNVVSHPIQRFAVWFGGSVLASTPEFFAACHTKAEYEEYGASICRTNPVFKGMY

SEQ ID NO: 6324 - protein, 428 aa, Citrullus lanatus
MDPAASRPAVVIDNGTGYTKMGFAGNVEPCFIVPSVVAVNESFLNQSKNSSKANWLAQHNAGVMADLDFFIGDEALAKSRSSSTYNLSYPIRNGQVYNWDAMERFWQQCIFNYLRCDPEDHYFLLTESPLTAPESREYTGEIMFETFNVPGLYIAVNSVLALAAGYTTSKCEMTGVVVDVGDGATHVVPVADGYVIGSSIKSVPIAGKDVTLFVQQLMKERGENVPPEDSFEVARKVKEMYCYTCSDIVKEFNKHDKEPGKYIKHWKGIKPKTGAPYSCDIGYERFLGPEVFFNPEIYSSEFTTPLPAIIDRCIQSAPIDTRRALYKNIVLSGGSTMFKDFHRRLQRDLKKIVDARILASEARLGGEIKSHPVEVNVVSHPIQRYAVWFGGSVLASTPEFFAACHTKAEYEEYGASICRTNPVFKGMY

SEQ ID NO: 6325 - protein, 430 aa, Nicotiana benthamiana
MDPATSRPAVVIDNGTGYTKLGFAGNVEPSFIVPTVVAVNESFLNQTRATTKSSNWLSQHSASVMADLDFFIGEEALARSKSSSNTYNLTYPIKKGQVNNWDVMERFWQQCIFDYLRCDPEDHYFILTESPMTAPESREYTGEIMFETFNVPGLYIAVQPVLALAAGYTTSKCEMTGVIVDIGDGATHVVPVAEGYVIGSSIKSIPIAGKDVTLFIQQLMRERGEHVPPEDSFEVARKVKEMYCYTCSDIVKEFNKHDKEPGKYIKHWRGTKPKTGAPYSCDVGYERFLGPEVFFNPEMYNSDFTTPLPDVIDKCIQSAPIDTRRALYKNIVLSGGSTMFKDFHRRLQRDLKKIVDARVLASDARLGGNVKAQPVEVNVVSHPIQRYAVWFGGSVLASTPEFFAACHTKAEYQEYGASICRTNPVFKGMY

SEQ ID NO: 6326 - protein, 245 aa, Tabernaemontana elegans
MADLDFCIGEEALSRSKSNSTYNLSYPIKHGQVDNWDAMERFWQQCIFNYLRCDPEDHYFLLTESPLTAPESREYTGEIMFETFNVPGLYIAVQPVLALAAGYTTSKCEMTGVVVDVGDGATHVVPVADGYVIGSSIKSIPVSGRDVTVFIQQLMRERGEHVPPEDSFEVARKVKEMYCYTSSDIVKEFNKHDKEPAKYIKRWRGTKPKTGHLTHVTSDMKDFLVLRSSLIQRFTTVILQPLYRL

SEQ ID NO: 6327 - protein, 426 aa, Manihot esculenta
MDPTSRPSVVIDNGTGYTKMGFAGNVEPCFILPTVVAVNDSFLNPSRTSKANWLAQHSAGVMADLDFFIGEEAFAKSRSSSTYSLSYPIKHGQVDNWDAMERYWQQCVFNYLRCDPEDHYFLLTESPLTAPENRECTGEIMFETFNVPGLYIAVNSVLALAAGYTTSKCEMTGVVVDVGDGATHIVPVADGYVIGSSIRSVPIAGKDVTLFIQQLMRERGENVPPEDSFDVARKVKEMYCYTSSDIVKEYNKHDKEPAKYIKHWRGIKPKTGAPYSCDIGYERFLGPEVFFNPEIYSSDFTTPLPVVIDKCIQSAPIDTRRALYKNIVLSGGSTMFKDFGRRLQRDLKKIVDARVLASEARLKDEVKTQPVEVNVVSHPIQRFAVWFGGSVLASTPEFFAACHTKAEYEEYGASICRTNPVFKGMY

SEQ ID NO: 6328 - protein, 428 aa, Cucumis melo
MDPAASRPAVVIDNGTGYTKMGFAGNVEPCFIVPSVVAVNESFLNQSRNSSKANWLAQHNAGVMADPDFFIGDEALAKSRSSSTYNLSYPIRNGQVYNWDAMERFWQQCIFNYLRCDPEDHYFLLTESPLTAPESREYTGEIMFETFNVPGLYIAVNSVLALAAGYTTSKCEMTGVVVDVGDGATHVVPVADGYVIGSSIKSVPIAGKDVTLFVQQLMKERGENVPPEDSFEVARKVKEMYCYTCSDIVKEFNKHDKEPGKYLKHWKGIKPKTGAPYSCDIGYERFLGPEVFFNPEIYSSEFTTPLPAVIDRCIQSAPIDTRRALYKNIVLSGGSTMFKDFHRRLQRDLKKIVDARILASEARLGGEIKSHPVEVNVVSHPIQRFAVWFGGSVLASTPEFFAACHTKAEYEEYGASICRTNPVFKGMY

SEQ ID NO: 6329 - protein, 431 aa, Ambrosia trifida
MDPSTSRPAVVIDNGTGYTKMGFAGNVEPCFITPTVVAVNESFITQPTRSSSKGSSSWMAQHSAGVMADLDFFIGEEALSKSRSSSTYNLSYPIKHGQVENWDAMERFWQQCIFNYLRCDPEDHYFLLTESPLTPPESREYTGEIMFETFNVPGLYIAVQPVLALAAGYTTSKCEMTGVVVDVGDGSTHVVPVAEGYVIGSSIKSLPISGKDVTLFVQQLMRERGEHVPPEDSLEVARKIKEMYCYTSSDIVKEFNKHDKEPSKYIKQWRGIKPKTGAPYSCDVGYERFLGPEIFFNPEIYNSDFTTPLPVVIDKCIQSAPIDTRRALYKNIVLSGGSTMFKDFQRRLQRDTKKIVDARVLASSMRHNGEVKAQPVEVNVVSHPIQRYAAWFGGSVLASTPEFFTACHTKAEYEEYGASICRTNPVFKGMY

SEQ ID NO: 6330 - protein, 428 aa, Nicotiana benthamiana
MDPSTSRPAVVIDNGTGYTKMGFAGNVEPSFILPTVVAVNESFINQPRALTKSSNLAQYSAGVMADLDFFIGEEAVSRSKSSSTYNLSYPIKHGQVDNWDAMERFWQQCIFNYLRCDPEDHYFLLTESPMTAPENREYTGEIMFETFNVPGLYIAVQPVLALAAGYTASKCEMTGVVVDVGDGATHVVPVAEGYVIGSSIKSIPVAGKDVTLFIQQLMKERGEHVPAEDSFEVARRVKEMYCYTCSDIVKEFNKHDKEPGKYIKQWRGTKPKTGAPYSCDVGYERFLGPEVFFNPEIYNSDFTTPLPDVIDKCIQSAPIDTRRALYKNIVLSGGSTMFKDFHRRLQRDLKKIVDDRVHASDARLGGNVKAQPVEVNVVSNPIQRYAVWFGGSVLASTPEFFAACHTKAEYEEYGASICRTNPVFKGMY

SEQ ID NO: 6331 - protein, 429 aa, Cajanus cajan
MDPSTSRPAVVIDNGSGYTKMGFAGNVEPCFIVPTVVALNESFLNQSRSSSKGNWVAQHNAGVMADLDFFIGDDALSKSRSSSTYNLSYPIRHGQVENWDAMERFWQQCIFNYLRCDPEDHYFLLTESPLTAPESREYTGEIMFETFNVPGLYIAVNSVLALAAGYTTSKCEMTGVVVDVGDGATHVVPVADGYVIGSSIKSIPIAGKDVTLFVQQLMRERGENVPPEDSFEVARKVKEMYCYTCSDIVKEFNKHDKEPAKYIKHWRGIKPKTGAPYSCDIGYERFLGPEIFFNPEIYGSSNFTTPLPVVIDKCIQSAPIDTRRSLYKNIVLSGGSTMFKDFHRRLQRDLKKIVDARVLSSEARINGEIKSQPVEVNVVSHPIQRFAVWFGGSVLASTPEFFTACHTKAEYEEYGASICRTNPVFKGMY

SEQ ID NO: 6332 - protein, 429 aa, Valeriana officinalis
MDAASTRPAVVIDNGTGYTKIGFAGNVEPCFTLPTVVALNESFVSQARNSVKGSNWLQQHSAGVMADLDFFIGDEAVARSRSSSTYSLSHPIEQGQVHNWDSMERFWQQCIYNYLRCDPEDHYFLLTESPLTPPESREYTGEIMFETFNVPGLYIAVQPVLALAAGYTTSKCEMTGVVVDVGDGATHVVPVADGYVIGSSIKSIPISGKDVTLFIQQLMRERGEHVPPEDSLEVARKIKEMYCYTCSDIVKEFNKHDREPAKYVKQWKGTKLKTGAPYSCDIGYERFLGPEVFFNPEIYSTDFATPLPAVIDKCIQSAPIDTRRALYKNVVLSGGSTMFKDFHRRLQRDLKKIVDSRVLVSDARLGGELKAQPVEVNVVSHPIQRYAVWFGGSVLASTPEFFAACHTKAEYEEYGASICRTNPVFKGMY

SEQ ID NO: 6333 - protein, 427 aa, Musa acuminata
MDAASRPVVVIDNGSGYTKMGFAGNVEPSFIIPTVVAVNESFSNQSKSISKGNWVAQHSASVMADLDFSIGEEALLYSRSSTTYGLSYPIHHGQVENWDAMERFWQQCIFNYLRCDPEDHYFLLTESPLTAPESREYTGEIMFETFNIPGLYIAVQPVLALAAGYTTSKCQMTGVVVDVGDGATHVVPVADGYVIGSSIRSIPIAGKDATQFIQQLMKERGEHIPPEDSFEVARKIKETYCYTCSDIVKEFNKHDKEHSKYTKQWIGTKPKTRARYSCDVGYERFLGPEIFFHPEIYNDNFTTPLPAIVDKCIQLSPIDTRRALYKNIVLSGGSTMFKDFHRRLQRDLKRIVDARMVTSNAQLIDDVKSQPIEVNVVSHPFQRYAVWFGGSVLASTPEFYEACHTKAEYEEYGASICRTNPVFKGMY

SEQ ID NO: 6334 - protein, 428 aa, Phaseolus vulgaris
MDPSTSRPAVVIDNGSGYTKMGFAGNVEPSFIVPTVVAVNESFLTQSRGSSKGNWAAQHNAGVLADLDFFIGDEALSKSRSSSTYNLSYPIRHGQVENWDAMERFWQQCIFNYLRCDPEDHYFLLTESPLTAPESREYTGEIMFETFNVPGLYIAVNSVLALAAGYTTSKCEMTGVVVDVGDGATHVVPVADGYVIGSSIKSIPIAGKDVTLFVQQLMRERGEKVPPEDSFEVAWKVKEMYCYTCSDIVKEFNKHDKEPGKYIKHWRGIKPKTGAPYSCDIGYERFLGPEIFFSPEIYGSDFTTPLPVVIDKCIQSAPIDTRRSLYKNIVLSGGSTMFKDFHRRLQRDLKKIVDARVLLSEARLNGEIKSQPVEVNVLSHPIQRFAVWFGGSVLASTPEFFTACHTKAEYEEYGASICRTNPVFKGMY

SEQ ID NO: 6335 - protein, 429 aa, Beta vulgaris
MDASSSRPAVVIDNGTGYTKMGFSGNVEPCFIVPTAVAVNDSFVNQPRTSTKSSNWLTQHNAGVMADLDFFIGDEALARSRSSSTYSLNYPITNGQVENWDAMERFWQQCIFNYLRCDPEDHHFLLTESPLTPPESREYTGEIMFETFNVPGLYIAVQPVLALAAGYNTSKCEMTGVVVDIGDGGTHVVPVAEGYVIGSSIKSIPISGTDVSLFVQQLMRERGENVPPEDSFEVARQVKEMYCYTSSDIVKEFNKHDKEPSKYVKQWKGIKPKTGAPYTCDIGYERFLGPEVFFNPEIYNTDFTTPLPAVIDKCIQSAPIDTRRALYKNIVLSGGSTMFKDFHRRLQRDLKKIVDARALASEVRLGGSMKSQPVEVNVVSHPIQRYAVWFGGSVLASTPEFYGACHTKAEYEEYGASICRTNPVFKGMY

SEQ ID NO: 6336 - protein, 428 aa, Quercus alba
MDPATSRPAVVIDNGTGYTKMGFAGNVEPCFIVPTVVAVNESFLNQSRSSSKASWLAQHSAGVMADLDFFIGDEAVARSRSSTTYNLSYPIQHGQVENWDAMERFWQQCIFNYLRCDPEDHYFLLTESPLTAPESREYTGEIMFETFNVPGLYIGVNSVLALAAGYTTSKCEMTGVVVDVGDGATHVVPVADGYVIGSSIKSVPIAGKDVTLFVQQLMRERGEHVPPEDSFEVARKVKETYCYTCSDIVKEFNKHDKEPAKYVKQWRGIKPKTGAPYSCDIGYERFLGPEVFFNPEIYSSEFSTPLPAVIDKCIQSAPIDTRRALYKNIVLSGGSTMFKDFHRRLQRDLKKIVDARVLASEARLGGEIRSQPVEVNVVSHPIQRFAVWFGGSVLASTPEFFAACHTKAEYEEYGASICRTNPVFKGMY

SEQ ID NO: 6337 - protein, 428 aa, Populus trichocarpa
MDPTSRPAVVIDYGTGYTKMGFAGNVEPCFILPTAVAVNESFLNQSRTSSSKANWQAQHSAGVMADLDFFIGEEALAKSRSSNTYSLSYPIKHGQVDNWDAMERYWQQCIFNYLRCDPEDHYFLLTESPLTAPESREYTGEIMFETFNVPGLYIAVNSVLALAAGYTTSKCEMTGVVVDVGDGAAHVVPVADGYVIGSSIKSIPIAGKDVTLFIQQLMRERGENVPPEDSFEVARKVKETHCYTCSDIVKEFNKHDKEPAKYIKHWRGIKPKTGAPYSCDIGYERFLGPEVFFNPEIYSSDFTTPLPAVIDKCIQSAPIDTRRALYKNIVLSGGSTMFKDFGRRLQRDLKKIVDTRVLTSEARLGGKIKSQPVEVNVVSHPIQRFAVWFGGSVLASTPEFFAACHTKAEYEEYGASICRTNPVFKGMY

SEQ ID NO: 6338 - protein, 428 aa, Populus trichocarpa
MDASSRPAVVIDNGSGYTKMGFAGNVEPCFILPSVVAVNESFLNQSRTSSSKANWLAQHSAGVMADLDFFIGDEALAKSRSSNTYNLSYPIKHGQVANWDAMERYWQQCIFNYLRCDPEDHYFLLTESPLTAPESREYTGEIMFETFNVPGLYIAVNSVLALAAGYTTSKCEMTGVVVDAGDGATYVVPVADGYVIGSSIKSIPIAGKDVTLFIQQLMRERGENVPPEDSFEVARKAKEMHCYTCSDIVKEFNKHDKEPAKYIKQWRGIKPKTGAPYSCDIGYERFLGPEVFFNPEIYSSDFTTPLPAVIDKCIQSAPIDTRRALYKNIVLSGGSTMFKDFGRRLQRDLKKIVDTRVLASEARLGGGVKSQPVEVNVVSHPIQRFAVWFGGSVLASTPEFFAACHTKAEYEEYGASICRTNPVFKGMY

SEQ ID NO: 6339 - protein, 431 aa, Ambrosia trifida
MDPSTSRPAVVIDNGTGYTKMGFAGNVEPCFITPTVVAVNESFITQPTRSSSKGSSSWMAQHSAGVMADLDFFIGEEALSKSRGSSTYNLSYPIKHGQVENWDAMERFWQQCIFNYLRCDPEDHYFLLTESPLTPPESREYTGEIMFETFNVPGLYIAVQPVLALAAGYTTSKCEMTGVVVDVGDGSTHVVPVAEGYVIGSSIKSLPISGKDVTLFVQQLMRERGEHIPPEDSLEVARKIKETYCYTSSDIVKEFNKHDKEPSKYIKQWRGIKPKTGAPYSCDVGYERFLGPEIFFNPEIYNSDFTTPLPVVIDKCIQSAPIDTRRALYKNIVLSGGSTMFKDFQRRLQRDTKKIVDARVLASSMRNNGEVKAHPVEVNVVSHPIQRYAAWFGGSVLASTPEFFTACHTKAEYEEYGASICRTNPVFKGMY

SEQ ID NO: 6340 - protein, 428 aa, Musa acuminata
MDATSRPAVVIDNGTGYTKMGFAGNVEPSFIIPTIVAVNESFSNQPKSSSKGNWLTQHTAGVVADLDFLIGEEALTCSRSSNMYSLSYPIHHGQVENWDTMERFWQQCIFDYLRCDPEDHYFLLTESPLTAPETREYTGEIMFETFNIPGLYIAVQPVLALAAGYTTSKCEMTGVVVDVGDGATHVVPVADGYVIGSSISSIPIAGKNVTQFIQQLMKERGEHIPPEDSFEVARKIKEAYCYTCSDIVKEFNRHDKEPGKYTKQWVGTKPKTGVRYSCDIGYERFLGPEIFFHPEIYNSDFTTPLPAVVDKCIQLSPIDTRRALYKASNIVLSGGSTMFKDFHRRLQRDLKRIVDARIVTSEAQFKDVKAQPIEVNVVSHPIQRYAVWFGGSVLASTSEFYGACHTKAEYEEYGASICRTNPVFKGMY

SEQ ID NO: 6341 - protein, 430 aa, Mimulus guttatus
MDPTTSRPAVVIDNGTGYTKMGFAGNVEPCFIVPTVVAVNESFVNQPRSSSSKGSNWLSQHSAGVMADLDFYIGEEALARSKSSSTYNLSYPIKHGQVDNWDAMERFWQQCIFNYLRCDPEDHYFLLTESPLTPPESREYTGEIMFETFNVPGLYIGVQPVLALAAGYTTSKCEMTGVVVDVGDGATHVVPVAEGYVIGSSIKSIPIAGEDVTLFIQQLMRERGELVPPEDSFEVARKVKEMYCYTCSDIVKEFNKHDKEPSKYVKQWRGTKPKTGAPYSCDIGYERFLGPEVFFNPEIYSTDFSTPLPDVIDKCIQSAPIDTRRALYKNVVLSGGSTMFKDFHRRLQRDVKKIVDARVLASETRLGGEVKSQPVEVNVVSHPIQRYAVWFGGSVLASTPEFFTACHTKAEYEECGASICRTNPVFKGMY

SEQ ID NO: 6342 - protein, 150 aa, Ambrosia trifida
MDPSTSRPAVVIDNGTGYTKMGFAGNVEPCFITPTVVAVNESFITQPTRSSSKGSSSWMAQHSAGVMADLDFFIGEEALSKSRSSSTYNLSYPIKHGQVENWDAMERFWQQCIFNYLRCDPEDHYFLLTESPLTPPESREYTGEIMFVDV

SEQ ID NO: 6343 - protein, 428 aa, Phaseolus vulgaris
MDPSTSRPAVVIDNGSGYTKMGFAGNVEPSFIVPTVVAVNESFLTQSRGSSKGNWAAQHNAGVLADLDFFIGDEALSKSRSSSTYNLSYPIRHGQVENWDAMERFWQQCIFNYLRCDPEDHYFLLTESPLTAPESREYTGEIMFETFNVPGLYIAVNSVLALAAGYTTSKCEMTGVVVDVGDGATHVVPVADGYVIGSSIKSIPIAGKDVTLFVQQLMRERGEKVPPEDSFEVAWKVKEMYCYTCSDIVKEFNKHDKEPGKYIKHWRGIKPKTGAPYSCDIGYERFLGPEIFFSPEIYGSDFTTPLPVVIDKCIQSAPIDTRRSLYKNIVLSGGSTMFKDFHRRLQRDLKKIVDARVLLSEARLNGEIKSQPVEVNVLSHPIQRFAVWFGGSVLASTPEFFTACHTKAEYEEYGASICRTNPVFKGMF

SEQ ID NO: 6344 - protein, 428 aa, Glycine max
MDPSSSRPAVVIDNGSGYTKMGFAGNVEPCFIAPTVVAVNESFLNQSRGSSKGSWVAQHNAGVMADLDFFIGDEALSKSRSSSTYNLSYPIRHGQVENWDAMERFWQQCIFNYLRCDPEDHYFLLTESPLTAPESREYTGEIMFETFNVPGLYIAVNSVLALAAGYTTSKCEMTGVVVDVGDGATHVVPVADGYVIGSSIKSIPIAGKDITLFVQQLMRERGENVPPEDSFEVARKVKEMYCYTCSDIVKEFNKHDKEPGKYIKHWRGIKPKTGAPYSCDIGYERFLGPEIFFNPEIYSSDFTTPLPVVIDKCIQSAPIDTRRSLYKNIVLSGGSTMFKDFHRRLQRDLKKIVDARALSSEARINGEIKSQPVEVNVLSHPIQRFAVWFGGSVLASTPEFFTACHTKAEYEEYGASICRTNPVFKGMY

SEQ ID NO: 6345 - protein, 427 aa, Euphorbia peplus
MDPTSRPAVVIDNGTGYTKMGFAGNVEPCFILPTVVAVNESFINQSRTSSKSNLLAQHSAGVMADLDFFIGEEAASKSRSSNTYNLNYPIQQGQVDNWDAMERYWQQCIFNYLRCDPEDHYFLLTESPLTAPESREYTGEIMFETFNVPGLYIAVNSVLALAAGYTTSKCEMTGVVVDVGDGATHIVPVADGYVIGSSIKSIPIAGKDVTLFIQELMRERGENVPPEDSFDVARKVKEMYCYTCSDIVKEYNKHDKEPAKYIKHWRGIKPKTGAPYSCDIGYERFLGPEVFFSPEIYSNDSISPLPEVIDKCIQSAPIDTRRALYKNIVLSGGSTMFKDFGRRLQRDLKKIVDARVLASEARMEGEIKARPVEVNVVSHPIQRFAVWFGGSVLASTPEFFAACHTKEEYEEYGASICRTNPVFKGMY

SEQ ID NO: 6346 - protein, 430 aa, Amsonia hubrichtii
MDPATSRPAVVIDNGTGYTKMGFAGNVEPCFIVPTVVAVNESFVNQPRSATTKSNNWLTQYSAGVMADLDFCIGEEALSRSKSNSTYNLTYPIKHGQVDNWDAMERFWQQCIFNYLRCDPEDHYFLLTESPLTAPESREYTGEIMFETFNVPGLYIAVQPVLALAAGYTTSKCEMTGVVVDVGDGATHVVPVAEGYVIGSSIKSIPISGRDVTLFIQQLMRERGEHVPPEDSLEVARKVKEMYCYTSSDIVKEFNKHDKEPAKYIKHWRGTKPKTGAPYSCDVGYERFLGPEVFFNPEIYNSDFTTPLPVVIDKCIQSAPIDTRRALYKNIVLSGGSTMFKDFHRRLQRDIKKIVDARIVASDVRVQGDVKAHPVEVNVVSHPIQRYAVWFGGSVLASTPEFFTACHTKAEYEECGASICRTNPVFKGMY

SEQ ID NO: 6347 - protein, 124 aa, Fagus grandifolia
MDPATSRPAVVIDNGTGYTKMGFAGNVEPCYIVPTVVAVNESFLNQSRSSSKANWLAQHSAGVMADLDFFIGDEALARSRSSSTYNLSYPIQHGQVDNWDAMERFWQQCIFNYLRCDPEDHYFC

SEQ ID NO: 6348 - protein, 433 aa, Arachis hypogaea
MDPVASRPAVVIDNGSGYTKMGFAGNVEPCFIVPTVVALNESFLNQSRTSSKANWIAQHNAGVMADLDFFIGDEALAKSRSSSTYSLSYPIQHGQVENWDSMERFWQQCIFNYLRCDPEDHYFLLTESPLTAPESREYTGEIMFETFNVPGLYIAVNSVLALAAGYTTSKCEMTGVVVDVGDGATHVVPVADGYVIGSSIKSVPIAGKDVTLFVQQLMRERGENIPPEDSFEVARKVKEMYCYTCSDIVKEFNKHDKEPSKYIRQWRGIKPKTGAPYSCDIGYERFLGPEVFFNPEIYSSDFSTPLPVVIDKCIQSAPIDTRRALYKNIVLSGGSTMFKDFHRRLQRDLKKIVDARVHASDARLNGEIKSQPVEVNVVSHSVQRFAVWFGGSVLASTPEFLRLVIQKQNMRNMEQAFVGQILFSKGCTEVKTN

SEQ ID NO: 6349 - protein, 427 aa, Citrus sinensis
MDPTSRPAVVIDNGTGYTKMGFAGNVEPCFILPTVVAVNESFLNQSRSSSKANWLAQYNAGVMADLDFFIGDEAVTKSRSSSTYNLSYPIRHGQVDNWDAMERYWQQCIFNYLRCDPEDHYFLLTESPLTAPESREYTGEIMFETFNVPGLYIAVNSVLALAAGYTTSKCEMTGVVVDVGDGATYVVPVAEGYVIGSSIKSIPIAGKDVTLFIQQLMRERGENVPPEDSFEVARKVKEMYCYTCSDIVKEYNKHDKEPSKYLKQWRGIKPKTGAPYSCDIGYERFLGPEVFFNPEIYSSDFTTPLPAVIDKCIQSAPIDTRRALYKNIVLSGGSTMFKDFHRRLQRDLKKIVDARVLASDARLGGEVKAQPVEVNVVSHAIQRYAVWFGGSVLASTPEFFAACHTKAEYEEYGASICRSNPVFKGMY

SEQ ID NO: 6350 - protein, 427 aa, Euphorbia esula
  misc_feature (227)..(227): Xaa can be any naturally occurring amino acid
MDPTSRPAVVIDNGTGYTKMGFAGNVEPCFILPTVVAVNESFINQSRTSSKANLLAQHSAGVMADLDFFIGEEAASKSRSSNTYNLNYPIKQGQVDNWDAMERYWQQCIFNYLRCDPEDHYFLLTESPLTAPESREYTGEIMFETFNVPGLYIAVNSVLALAAGYTTSKCEMTGVVVDVGDGATHIVPVADGYVIGSSIKSIPIAGKDVTLFIQELMRERGENVPPXDSFDVARNVKEMYCYTCSDIVKEYNKHDKEPAKYIKHWRGIKPKTGAPYSCDIGYERFLGPEVFFSPEIYSNDSISPLPEVIDKCIQSAPIDTRRALYKNIVLSGGSTMFKDFGRRLQRDLKKIVDARVLASEARMDGEIKARPVEVNVVSHPIQRFAVWFGGSVLASTPEFFAACHTKEEYEEYGASICRTNPVFKGMY

SEQ ID NO: 6351 - protein, 427 aa, Malus domestica
MDPASRPAVVIDNGSGYTKMGFAGNVEPCYIVPTVVALNESFLNPSRTSSKAGWVAQHNAGVMADLDFFIGDEALERSRSSTTYNLSYPIRQGQVENWDSMERFWQQCIFNYLRCDPEDHYFLLTESPLTAPESREYTGEIMFETFNVPGLYIAVNSVLALAAGYTTSKCEMTGVVVDVGDGATHIVPVAEGYVIGSSIKSVPIAGKDVTLFVQQLMRERGENVPQEDSFDVARRVKEMYCYTSSDIVKEFNKHDKEPSKYIKQWRGIKPKTGAPYSCDIGYERFLGPEVFFNPEIYSTDFTTPLPVVIDKCIQSAPIDTRRSLYKNIVLSGGSTMFKDFHRRLQRDIKKIVDARLLASEARVGGEVKSQPVEVNVVSHPIQRFAVWFGGSVLASTPEFFAACHTKEEYEEYGASICRTNPVFKGMY

SEQ ID NO: 6352 - protein, 429 aa, Papaver somniferum
MDAAASRPAVVIDNGTGYSKMGFAGNVEPCFIIPTVVAVNESFLNQPRGSVKGSNWLAQHSAGVMADLDFYIGEEAVSRSRSSSSYNLSHPIQHGQVENWDAMERFWQQCIFNYLRCDPEDHYFLLTESPLTPPENREYTGEIMFETFNVPGLYIAVQPVLALAAGYTTSKCEMTGVVVDVGDGATHIVPVAEGYVIGSSIKSIPIAGRDVTQFIQQLMRERGELIPPEDAFEVARKVKENYCYTCSDIVKEYNKHDKEPSKYIKQWRGIKPRTGAPFSFDVGYERFLGPEIFFNPEIYSSDFTTPLPSVIDKCIQSAPIDTRRALYKNIVLSGGSTMFKDFHRRIQRDVKKIVDARLHVSDTRLGGEIKSQPVEVNVVSHPIQRFAVWFGGSVLASTPEFYAACHTKAEYEEYGASICRTNPVFKGMY

SEQ ID NO: 6353 - protein, 428 aa, Glycine max
MDPSTSRPAVVIDNGSGYTKMGFAGNVEPCFNVPTVVAINESFLNQSRNSSKGNWVAQHNAGVMADLDFFIGDEALSKSRSSSTYNLSYPIQHGQVENWDAMERFWQQCIFNYLRCDPEDHYFLLTESPLTSPESREYTGEIMFETFNVPGLYIGVNSVLALAAGYTTSKCEMTGVVVDVGDGAAHVVPVADGYVIGSSIKSIPISGKDITLFVQQLMRERGENVPPEDSFEVARKVKEMYCYTCSDIVKEFNKHDKEPAKYIKHWRGIKPKTGAPYSCDIGYERFLGPEIFFNPEIYGSDFTTPLPVVIDKCIQSAPIDTRRSLYKNVVLSGGSTMFKDFHRRLQRDLKKIVDARVLLSEARLNGEIKSQPVEVNVLSNPIQRYAVWFGGSVLASTPDFFTACHTKAEYEEYGASICRTNPVFKGMY

SEQ ID NO: 6354 - protein, 428 aa, Nicotiana tabacum
MDPSTSRPAVVIDNGTGYTKMGFAGNVEPSFILPTVVAVNESFINQPRALTKSSNLAQYSAGVMADLDFFIGEEALSRSKSSSTYNLSYPIKHGQVDNWDAMERFWQQCVFNYLRCDPEDHYFLLTESPMTAPENREYTGEIMFETFNVPGLYIAVQPVLALAAGYTASKCEMTGVVVDVGDGATHVVPVAEGYVIGSSIKSIPVAGKDVTLFIQQLMKERGEHVPAEDSLEVARKVKEMYCYTCSDIVKESNKHDKEPGKYIKQWRGTKPKTGAPYSCDVGYERFLGPEVFFNPEIYNSDFTTPLPDVIDKCIQSAPIDTRRALYKNIVLSGGSTMFKDFHRRLQRDLKKIVDDRVPASDARLGGNVKAQPVEVNVVSNPIQRYAVWFGGSVLASTPEFFAACHTKTEYEEYGASICRTNPVFKGMY

SEQ ID NO: 6355 - protein, 428 aa, Trigonella foenum-graecum
MDPAASRPAVVIDNGSGYTKMGFAGNVEPCFIVPTVVAINESFLNQSRSSSKGNWIAQHNAGVMADLDFFIGDDALSKSRSSSTYNLTYPIKHGQVENWDAMERFWQQCIFNYLRCDPEDHYFLLTESPLTAPESREYTGEIMFETFNVPGLYIAVNSVLALAAGYTTSKCEMTGVVVDIGDGATHVVPVADGYVIGSSIKSVPIAGKDVTLFIQQLMRERGENIPPEDSFEVARKVKEMHCYTCSDIVKEYNKHDKEPAKYIKQWRGVKPKTGAPYSCDIGYERFLGPEVFFNPEIYSSDFTTPLPVVIDKCIQSAPIDTRRSLYKNIVLSGGSTMFKDFHRRLQRDIKKIVDARVLAAEARLNGEIKSHPVEVNVLSHPIQRFAVWFGGSVLASTPEFFTACHTKAEYEEYGASICRTNPVFKGMY

SEQ ID NO: 6356 - protein, 428 aa, Phaseolus vulgaris
MDLSPSRPAVVIDNGSGYTKMGFAGNVEPCFILPTVVAVNESFLNQSRNLSKGNWLAQHNAGVMADLDFFIGDEALSKSRSSSTYNLSYPIQHGQVENWDAMERYWQQCIFNYLRCDPEDHYFLLTESPLTSPESREYTGEIMFETFNVPGLYIGVNSVLALAAGYTTSKCEMTGVVVDVGDGAAHVVPVADGYVIGSSIKSIPISGKDVTLFVQKLMRERGENVPPEDSFEVARKVKEMYCYTCSDIVKEFNKHDKEPAKYIKHWRGIKPKTGAPYSCDIGYERFLGPEIFFNPEIYGSDFTTPLPVVIDKCIQSAPIDTRRSLYKNIVLSGGSTMFKDFHKRLQRDLKKIVDTRVILSEARLNGEIRSQPVEVNVVSHPIQRFAVWFGGSVLASTPEFFTACHTKAEYEEHGASICRTNPVFKGMY

SEQ ID NO: 6357 - protein, 428 aa, Fragaria vesca
MDPASRPAVVIDNGTGYTKMGFAGNVEPCYIVPTVVAVNDSFVNQSRSTSSKASWIAQHNAGVMADLDFFIGDEAIEKSRSSSTYNLKYPISHGQVENWDSMERFWQQCIFNYLRCDPEDHYFLLTESPLTAPESREYTGEIMFETFNVPGLYIAVNSVLALAAGYTTSKCEMTGVVVDVGDGASHVVPVAEGYVIGSSIKSVPIAGRDVTLFVQQLMRERGENVPPEDSFDVARKVKEMYCYTSSDIVKEFNKHDKEPSKYIKQWKGIKPKTGAPYTCDIGYERFLGPEVFFNPEIYSSDFTTPLPVVIDKCIQSAPIDTRRSLYKNIVLSGGSTMFKDFHRRLQRDIKKIVDARLHASEARVGGELKSHPVEVNVVSHPIQRYAVWFGGSVLASTPEFFGACHTKAEYEEYGASICRTNPVFKGMY

SEQ ID NO: 6358 - protein, 431 aa, Flaveria ramosissima
MDPSTSRPAVVIDNGTGYTKMGFAGNVEPCFIAPTVVAINESFITQPTRSSSKGSSSWLAQHSAGVMADLDFFIGEEALSKSRTSSTYNLSYPIKHGQVENWDAMERFWQQCIFNYLRCDPEDHYFLLTESPLTPPESREYTGEIMFETFNVPGLYIAVQPVLALAAGYTTSKCEMTGVVVDVGDGSTHVVPVAEGYVIGSSIKSIPISGKDVTLFVQQLMRERGEPIPPEDSFEVARKIKETYCYTSSDIVKEYNKHDKEPSKYIKQWRGIKPKTGAPYSCDVGYERFLGPEIFFNPEIYNSDFTTPLPAVIDKCIQSAPIDTRRALYKNIVLSGGSTMFKDFQRRLQRDTKKIVDARVHASSMRHNGEVKAQPVEVNVVSHPIQRYAAWFGGSVLASTPEFFTACHTKAEYEEYGASICRTNPVFKGMY

SEQ ID NO: 6359 - protein, 430 aa, Mimulus guttatus
MESSTSRPAVVIDNGTGYTKLGFAGNVEPCFTVPTVVAVNESFVNQARPGSTKGSNWLVQHSAGVMADLDYHIGEEAVARSKSSTTYSLSYPMKHGQVDNWDSMERFWQQCIFNYLRCDPEDHYFLLTESSLTAPESREYTGEIMFETFNVPGLYIAVQPVLALAAGYTTSKCEMTGVVVDIGDGATHVVPVADGYVIGSSIKSIPIAGKDVTRFIQHLMKERGEHVPPDDSFEVARKVKEMYCYTCSDIVKEFNKHDKEPAKYVKQWRGTKPKTGAPYSCDIGYERFLGPEIFFNPEIYSDDFTTPLPDVIDKCIQSAPIDTRRSLYKNIVLSGGSTMFKDFHRRLQRDVKKIVDARVLASNTKLGGELKAQPVEVNVVSHPIQKCAVWFGGSVLASTPEFFTACHTKAEYEEYGASICRTNPVFKGMY

SEQ ID NO: 6360 - protein, 427 aa, Unknown
  Sequence found in Organisms: Prunus persica, Prunus mume
MDPAARPAVVIDNGSGYTKMGFAGNVEPCYIVPTVVALNESFLNPARTSSKAGWLAQHNAGVMADLDFFIGDEALERSRSSTTYNLSYPVRQGQVENWDSMERFWQQCIFNYLRCDPEDHYFLLTESPLTAPESREYTGEIMFETFNVPGLYIAVNSVLALAAGYTTSKCEMTGVVVDVGDGATHVVPVAEGYVIGSSIKSVPIAGKDVTLFVQQLMRERGENVPPEDSFDVARKVKEMYCYTSSDIVKEFNKHDKEPSKYIKQWRGIKPKTGAPYSCDIGYERFLGPEVFFNPEIYSNDFTTPLPAVIDKCIQSAPIDTRRSLYKNIVLSGGSTMFKDFHRRLQRDIKKIVDARLLASEARVGGELKSQPVEVNVVSHPIQRFAVWFGGSVLASTPEFYAACHTKEEYEEYGASICRTNPVFKGMY

SEQ ID NO: 6361 - protein, 428 aa, Cicer arietinum
MDPAASRPAVVIDNGSGYTKMGFAGNVEPCFIVPTVVAINESFLNQSRSSSKGNWVAQHNAGVMADLDFFIGDDALSKSRSSSTYNLTYPIRHGQVDNWDAMERFWQQCIFNYLRCDPEDHYFLLTESPLTAPESREYTGEIMFETFNVPGLYIAVNSVLALAAGYTTSKCEMTGVVVDIGDGATHVVPVADGYVIGSSIKSVPIAGKDVTLFVQQLMRERGENVPPEDSFEVARKVKEMHCYTCSDIVKEYNKHDKEPAKYIKQWRGVKPKTGAPYSCDIGYERFLGPEVFFNPEIYSSDFSTPLPVVIDKCIQSAPIDTRRSLYKNIVLSGGSTMFKDFHRRLQRDLKKIVDARVLAAEARLNGEIKSHPVEVNVVSHPIQKFAVWFGGSVLASTPEFFTACHTKAEYEEYGASICRTNPVFKGMY

SEQ ID NO: 6362 - protein, 429 aa, Solanum phureja
MDPSTSRPAVVFDNGTGYTKIGFAGNVEPCFILPTVVAANESFVNQPRALTKNSNWLAQHSAGVMADLDFFIGDEALTRSKSSSNYNLTYPIEHGQVDNWDSMERFWQQCIFNYLRCDPEDHYFLLTESPMTAPENREYTGEIMFETFNVPGLYIAVQPVLALAAGYTASKCEMTGVVVDIGDGATHVVPVAEGYVIGSSIKSIPVSGKDVTLFVQQLMKERGEHVPAEDSFEIARKVKEMHCYTCSDIVKEFNKHDKEPGKYIKHWRGTKPKTGAPYSCDVGYERFLGPEVFFSPEIYNSDFTNPLPEVIDKCIQSAPIDTRRALYKNIVLSGGSTMFKDFHRRLQRDLKKIVDDRILASDARLGGNVKAQPVEVNVVSNPIQRYAVWFGGSVLASTPEFFAACHTKAEYEEYGASICRTNPVFKGMY

SEQ ID NO: 6363 - protein, 428 aa, Glycine max
MDPSTSRPAVVIDNGSGYTKMGFAGNVEPCFIVPTVVAINESFLNQSRNSSKGNWVAQHNAGVMADLDFFIGDEALSKSRSSSTYNLNYPIQHGQVENWDAMERFWQQCIFNYLRCDPEDHYFLLTESPLTSPESREYTGEIMFETFNVPGLYIGVNSVLALAAGYTTSKCEMTGVVVDVGDGAAHVVPVADGYVIGSSIKSIPISGKDITLFVQQLMRERGENVPLEDSFEVARKVKEMYCYTCSDIVKEFNKHDKEPAKYIKHWRGIKPRTGAPYSCDIGYERFLGPEIFFNPEIYGSDFTTPLPVVIDKCIQSAPIDTRRSLYKNVVLSGGSTMFKDFHRRLQRDLKKIVDARVLLSESRLNGEIKSQPVEVNVLSNPIQRFAVWFGGSVLASTPEFFTACHTKAEYEEYGASICRTNPVFKGMY

SEQ ID NO: 6364 - protein, 429 aa, Solanum lycopersicum
MDPSTSRPAVVIDNGTGYTKIGFAGNVEPCFILPTVVAANESFVNQPRALTKNSNWLAQHSAGVMADLDFFIGDEALTRSKSSSNYNLTYPIQHGQVDNWDSMERFWQQCIFNYLRCDPEDHYFLLTESPMTAPENREYTGEIMFETFNVPGLYIAVQPVLALAAGYTASKCEMTGVVVDIGDGATHVVPVAEGYVIGSSIKSIPVSGKDVTLFVQQLMKERGEHVPAEDSFEIARKVKEMHCYTCSDIVKEFNKHDKEPGKYIKHWRGTKPKTGAPYSCDVGYERFLGPEVFFSPEIYNSDFTSPLPEVIDKCIQSAPIDTRRALYKNIVLSGGSTMFKDFHRRLQRDLKKIVDDRILASDARLGGNVKAQPVEVNVVSNPIQRCAVWFGGSVLASTPEFFAACHTKAEYEEYGASICRTNPVFKGMY

SEQ ID NO: 6365 - protein, 434 aa, Cirsium arvense
MDPSTSRPAVVIDNGTGYTKMGFAGNVEPCFIAPTVVAVNESFITQPNRSSNKGSSSWMAQHSAGVMADLDFFIGEEALSKSRTSSTYNLTYPIKHGQVENWDAMERFWQQCIFNYLRCDPEDHYFLLTESPLTPPESREYTGEIMFETFNVPGLYIAVQPVLALAAGYTTSKCEMTGVVVDVGDGATHVVPVAEGYVIGSSIKSIPISGRDVTLFVQQLMRERGEHVPPEDSFEIARKVKETYCYTCADIVKEYNKHDKEPSKYIKQWRGIKPKTGAPYACDVGYERFLGPEIFFNPEIYNKDFTTPLPAVIDKCIQSAPIDTRRALYKNIVLSGGSTMFKDFQRRLQRDTKKIVDARVLASNLKYTSTSNEVKSQPVEVNVVSHPIQRYAVWFGGSVLASTPEFFTACHTKAEYEEYGASICRTNPVFKGMY

SEQ ID NO: 6366 - protein, 427 aa, Gossypium hirsutum
MDPTSRPAVVIDNGTGYTKMGFAGNVEPCFIQQTVVAVNESLLNQSRASSKSNWLAQYSAGVMADLDFFIGDEALTRSRSSNNYNITHPIKHGQVDNWDAMERYWQQCIFNYLRCDPEDHYFLLTESPLTAPENREYMGEIMFETFNVPGLYIAVNSVLALAAGYTTSKCEMTGVVVDVGDGATHIVPVADGYVIGSSIKSIPIAGKDVTLFIQQLMRERGEKVPPEDSFEVARKVKERYCYTCSDIVKEFNKHDKEPSKYIKQWRGIRPKTGTPYSCDIGYERFLGPEVLFNPEIHNSNFTTPLPAVIDKCIQSAPIDTRRALYKNIVLSGGSTMFKDFHRRLQRDLKKIVDARVLASDARYGGEVKAQPVEVNVVSHPIQGFAVWFGGSVLASTPEFYAASHTKAEYEEHGASICRTNPVFKGMY

SEQ ID NO: 6367 - protein, 427 aa, Gossypium raimondii
MDPTSRPAVVIDNGTGFTKMGFAGNVEPCFIQPTVVAVNESLLNQSRASSKSNWLAQYSAGVMADLDFFIGDEALTRSRSSNNYNITHPIKHGQVDNWDAMERYWQQCIFNYLRCDPEDHYFLLTESPLTAPENREYMGEIMFETFNVPGLYIAVNSVLALAAGYTTSKCEMTGVVVDVGDGATHIVPVADGYVIGSSIKSIPIAGKDVTLFIQQLMRERGEKVPPEDSFEVARKVKERYCYTCSDIVKEFNKHDKEPSKYIKQWRGIRPKTGTPYSCDIGYERFLGPEVLFNPEIHNSNFTTPLPAVIDKCIQSAPIDTRRALYKNIVLSGGSTMFKDFHRRLQRDLKKIVDARVLASDARYGGEVKAQPVEVNVVSHPIQGFAVWFGGSVLASTPEFYAASHTKAEYEEHGASICRTNPVFKGMY

SEQ ID NO: 6368 - protein, 434 aa, Centaurea maculosa
MDPSTSRPAVVIDNGTGYTKMGFAGNVEPCFIAPTVVAVNESFITQPNRSSNKGSSSWMAQHSAGVMADLDFFIGEEALSKSRTSSTYNLTYPIKHGQVENWDAMERFWQQCIFNYLRCDPEDHYFLLTESPLTPPESREYTGEIMFETFNVPGLYIAVQPVLALAAGYTTSKCEMTGVVVDVGDGATHVVPVAEGYVIGSSIKSIPISGRDVTLFVQQLMRERGEHVPPEDSFEIARKVKETYCYTCADIVKEYNKHDKEPSKYIKQWRGIKPKTGAPYACDVGYERFLGPEIFFNPEIYNKDFTTPLPAVIDKCIQSAPIDTRRALYKNIVLSGGSTMFKDFQRRLQRDTKKIVDARVLASNMKYTSTSNEVKSQPVEVNVVSHPIQRYAVWFGGSVLASTPEFFTACHTKAEYEEYGASICRTNPVFKGMY

SEQ ID NO: 6369 - protein, 427 aa, Malus domestica
MDPASRPAVVIDNGSGYTKMGFAGNVEPCYTVPTVVALNESFLNPSRTSSKSGWIAQHNAGVMADLDFFIGDEALERSRSSTTYNLSYPVRQGQVENWDSMERFWQQSIFNYLRCDPEDHYFLLTESPLTAPESREYTGEIMFETFNVPGLYIAVNSVLALAAGYTTSKCEMTGVVVDVGDGATHIVPVAEGYVIGSSIKSVPIAGKDVTLFVQQLMRERGENVPPDDSFDVARRVKEMYCYTSSDIVKEFNKHDKEPSKYIKQWRGIKPKTGAPYSCDIGYERFLGPEVFFNPEIYSTDFTTPLPVVIDKCIQSAPIDTRRSLYKNIVLSGGSTMFKDFHRRLQRDIKKIVDARLLASEARVGGEVKSHPVEVNVVSHPIQRFAVWFGGSVLASTPEFFAACHTKEEYEEYGASICRTNPVFKGMY

SEQ ID NO: 6370 - protein, 426 aa, Manihot esculenta
MDPTTRPAVVMDNGTGYTKMGFAGNVEPCFILPTVVALNDSFLNQSRTSKANWLAQHSAGVMADLDFFIGEEAFAKYRSSSIYNLRYPIEHGQVDNWDAMERYWQQCIFNYLRCDPEDHYFLLTESPLTAPESREYTGEIMFETFNVPGLYIAVNSVLALAAGYTTSKCEMTGVVVDVGDGASHVVPVADGYVIGSSIKSIPIAGKDVTLFIQQLMRERGENVPPEDSFDVARRVKEMHCYTCSDIVKEYNKHDKEPAKYIKQWRGIKPKTGAPYSCDIGYERFLGPEVFFNPEIYSSDFTTPLSAVIDKCIQSAPIDTRRALYKNIVLSGGSTMFKDFGKRLQRDLKKIVDARALAFEAKLDAGVKSQPVEVNVVSHPIQRFAVWFGGSVLASTPEFFSACHTKAEYEEYGASICRSNPVFKGMY
